United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 202

SEQ ID NO: 8392613 - DNA, 22 bp, Homo sapiens
tgtgcatagactttcaccacct

SEQ ID NO: 8392614 - DNA, 22 bp, Homo sapiens
tgtgcagagcccacaggcagct

SEQ ID NO: 8392615 - DNA, 22 bp, Homo sapiens
tgtgcagagcggggaagagcac

SEQ ID NO: 8392616 - DNA, 22 bp, Homo sapiens
tgtgcacataaaacagtactag

SEQ ID NO: 8392617 - DNA, 22 bp, Homo sapiens
tgtgcacattctaggactagta

SEQ ID NO: 8392618 - DNA, 18 bp, Homo sapiens
tgtgcaatattaaccacc

SEQ ID NO: 8392619 - DNA, 22 bp, Homo sapiens
tgtgcaatcatattttaaaatg

SEQ ID NO: 8392620 - DNA, 22 bp, Homo sapiens
tgtgaccataatttgtaaataa

SEQ ID NO: 8392621 - DNA, 22 bp, Homo sapiens
tgtgaccttatttagaaatacc

SEQ ID NO: 8392622 - DNA, 22 bp, Homo sapiens
tgtgactgagctgcagagtgtc

SEQ ID NO: 8392623 - DNA, 22 bp, Homo sapiens
tgtgactggagtccagcccact

SEQ ID NO: 8392624 - DNA, 22 bp, Homo sapiens
tgtgactaggcctgagctcttg

SEQ ID NO: 8392625 - DNA, 22 bp, Homo sapiens
tgtgactaggcctgagctcttg

SEQ ID NO: 8392626 - DNA, 22 bp, Homo sapiens
tgtgagaagggcatgcagggag

SEQ ID NO: 8392627 - DNA, 22 bp, Homo sapiens
tgtgagagagtgcatttgcata

SEQ ID NO: 8392628 - DNA, 22 bp, Homo sapiens
tgtgagagcagaagacacatag

SEQ ID NO: 8392629 - DNA, 22 bp, Homo sapiens
tgtgagagctccatcctcatga

SEQ ID NO: 8392630 - DNA, 22 bp, Homo sapiens
tgtgagcaagattcagagattc

SEQ ID NO: 8392631 - DNA, 22 bp, Homo sapiens
tgtgagagctgcttcagccagg

SEQ ID NO: 8392632 - DNA, 22 bp, Homo sapiens
tgtgagaggagaaatgcattaa

SEQ ID NO: 8392633 - DNA, 22 bp, Homo sapiens
tgtgagcactgtgatgctgttc

SEQ ID NO: 8392634 - DNA, 22 bp, Homo sapiens
tgtgagttcttattgctcatct

SEQ ID NO: 8392635 - DNA, 22 bp, Homo sapiens
tgtgagttcttattgctcatct

SEQ ID NO: 8392636 - DNA, 22 bp, Homo sapiens
tgtgagtgacagttcccttggt

SEQ ID NO: 8392637 - DNA, 22 bp, Homo sapiens
tgtgagttcttagaaagtcagt

SEQ ID NO: 8392638 - DNA, 22 bp, Homo sapiens
tgtgagttattttcaggagttt

SEQ ID NO: 8392639 - DNA, 22 bp, Homo sapiens
tgtgatggttcactgggcatga

SEQ ID NO: 8392640 - DNA, 22 bp, Homo sapiens
tgtgaaatgtggatgttaatag

SEQ ID NO: 8392641 - DNA, 22 bp, Homo sapiens
tgtgaaatgctattgtgacaaa

SEQ ID NO: 8392642 - DNA, 22 bp, Homo sapiens
tgtgaaacggagtcagggaagg

SEQ ID NO: 8392643 - DNA, 22 bp, Homo sapiens
tgtgacagtgccagcttcatag

SEQ ID NO: 8392644 - DNA, 23 bp, Homo sapiens
tgtgacagggtcattgaaaaggg

SEQ ID NO: 8392645 - DNA, 22 bp, Homo sapiens
tgtgacagcacggttcaactgc

SEQ ID NO: 8392646 - DNA, 22 bp, Homo sapiens
tgtgacagaattggtctgttct

SEQ ID NO: 8392647 - DNA, 22 bp, Homo sapiens
tgtgaatgttaatattggatta

SEQ ID NO: 8392648 - DNA, 22 bp, Homo sapiens
tgtgaatgcttgttatggagtg

SEQ ID NO: 8392649 - DNA, 22 bp, Homo sapiens
tgtgaatggacaattaaatcta

SEQ ID NO: 8392650 - DNA, 22 bp, Homo sapiens
tgtgaaggtttttatgggatat

SEQ ID NO: 8392651 - DNA, 22 bp, Homo sapiens
tgtgtggattcatctcaaagag

SEQ ID NO: 8392652 - DNA, 19 bp, Homo sapiens
tgtgtgctgactgccagag

SEQ ID NO: 8392653 - DNA, 19 bp, Homo sapiens
tgtgtgctgactgccagag

SEQ ID NO: 8392654 - DNA, 22 bp, Homo sapiens
tgtgtgtctggaagctcaggga

SEQ ID NO: 8392655 - DNA, 22 bp, Homo sapiens
tgtgtgtgaaccattgagggct

SEQ ID NO: 8392656 - DNA, 19 bp, Homo sapiens
tgtgtgccctcaccacata

SEQ ID NO: 8392657 - DNA, 19 bp, Homo sapiens
tgtgtgcatgcgcacgtgt

SEQ ID NO: 8392658 - DNA, 22 bp, Homo sapiens
tgtgtgccagatacaagcactg

SEQ ID NO: 8392659 - DNA, 22 bp, Homo sapiens
tgtgtgcattcacatgcatgcc

SEQ ID NO: 8392660 - DNA, 22 bp, Homo sapiens
tgtgtcaagacatttagtcatt

SEQ ID NO: 8392661 - DNA, 22 bp, Homo sapiens
tgtgtcaacctgtggccgggtg

SEQ ID NO: 8392662 - DNA, 22 bp, Homo sapiens
tgtgtcaaattgttttacacag

SEQ ID NO: 8392663 - DNA, 22 bp, Homo sapiens
tgtgtcaaagtgtggagtattt

SEQ ID NO: 8392664 - DNA, 22 bp, Homo sapiens
tgtgtcaacaacagccttggat

SEQ ID NO: 8392665 - DNA, 22 bp, Homo sapiens
tgtgtcaattttcattcctact

SEQ ID NO: 8392666 - DNA, 22 bp, Homo sapiens
tgtgtcaatttatgtcattcat

SEQ ID NO: 8392667 - DNA, 22 bp, Homo sapiens
tgtgtcaaggcatcagcccagc

SEQ ID NO: 8392668 - DNA, 22 bp, Homo sapiens
tgtgtcaagtggaatttcaggg

SEQ ID NO: 8392669 - DNA, 22 bp, Homo sapiens
tgtgtcaaagtcaggtgtcact

SEQ ID NO: 8392670 - DNA, 22 bp, Homo sapiens
tgtgtattctgaggtaggtata

SEQ ID NO: 8392671 - DNA, 22 bp, Homo sapiens
tgtgtattaccattttacagct

SEQ ID NO: 8392672 - DNA, 22 bp, Homo sapiens
tgtgtagaaagatctccaagat

SEQ ID NO: 8392673 - DNA, 22 bp, Homo sapiens
tgtgtgtgtgcgcgcacgcata

SEQ ID NO: 8392674 - DNA, 22 bp, Homo sapiens
tgtgtgtgtgcgcgcacgcata

SEQ ID NO: 8392675 - DNA, 22 bp, Homo sapiens
tgtgtgtgtcctcatttgcaga

SEQ ID NO: 8392676 - DNA, 22 bp, Homo sapiens
tgtgtgtgtgcgcgcacgcata

SEQ ID NO: 8392677 - DNA, 23 bp, Homo sapiens
tgtgtgtgtattctacgcaaggt

SEQ ID NO: 8392678 - DNA, 22 bp, Homo sapiens
tgtgtgtggggaggcagcagat

SEQ ID NO: 8392679 - DNA, 22 bp, Homo sapiens
tgtgtgtgcaggagagcaggtg

SEQ ID NO: 8392680 - DNA, 21 bp, Homo sapiens
tgtgtgtgcaggcacacacac

SEQ ID NO: 8392681 - DNA, 22 bp, Homo sapiens
tgtgtgtgcaggagagcaggtg

SEQ ID NO: 8392682 - DNA, 20 bp, Homo sapiens
tgttaaaggacacttgcttt

SEQ ID NO: 8392683 - DNA, 22 bp, Homo sapiens
tgttaaactgtattgcataagg

SEQ ID NO: 8392684 - DNA, 22 bp, Homo sapiens
tgttaaaaattcagctctagat

SEQ ID NO: 8392685 - DNA, 22 bp, Homo sapiens
tgttaaacagctgtcttcttca

SEQ ID NO: 8392686 - DNA, 22 bp, Homo sapiens
tgttaaaaccacaggtgaggac

SEQ ID NO: 8392687 - DNA, 22 bp, Homo sapiens
tgtgtgttagtctcaaagccgt

SEQ ID NO: 8392688 - DNA, 22 bp, Homo sapiens
tgtgtgtgttcctcctcagcta

SEQ ID NO: 8392689 - DNA, 22 bp, Homo sapiens
tgtggctcaggcggcttctcct

SEQ ID NO: 8392690 - DNA, 22 bp, Homo sapiens
tgtggctctcctcctgctgccc

SEQ ID NO: 8392691 - DNA, 22 bp, Homo sapiens
tgtggctctgccccctggtaag

SEQ ID NO: 8392692 - DNA, 22 bp, Homo sapiens
tgtggctctgcctggcagtatt

SEQ ID NO: 8392693 - DNA, 22 bp, Homo sapiens
tgtggctctcatgcactcccag

SEQ ID NO: 8392694 - DNA, 22 bp, Homo sapiens
tgtggctctcagatcctccaat

SEQ ID NO: 8392695 - DNA, 22 bp, Homo sapiens
tgtggctcggccagctgctgaa

SEQ ID NO: 8392696 - DNA, 22 bp, Homo sapiens
tgtggctccactccacattaat

SEQ ID NO: 8392697 - DNA, 22 bp, Homo sapiens
tgtggctccactccacattaat

SEQ ID NO: 8392698 - DNA, 22 bp, Homo sapiens
tgtgggaagtttggagggaaag

SEQ ID NO: 8392699 - DNA, 22 bp, Homo sapiens
tgtgggaatcagccaggggggc

SEQ ID NO: 8392700 - DNA, 22 bp, Homo sapiens
tgtgggaagatgttgcaggaga

SEQ ID NO: 8392701 - DNA, 22 bp, Homo sapiens
tgtgggaagagcagtggcagca

SEQ ID NO: 8392702 - DNA, 22 bp, Homo sapiens
tgtgggaatgacgaggaagagg

SEQ ID NO: 8392703 - DNA, 23 bp, Homo sapiens
tgtgggaatgttggagaggaaac

SEQ ID NO: 8392704 - DNA, 22 bp, Homo sapiens
tgtgggagaaggaagcaagctg

SEQ ID NO: 8392705 - DNA, 22 bp, Homo sapiens
tgtgggagaaggaagcaagctg

SEQ ID NO: 8392706 - DNA, 22 bp, Homo sapiens
tgtgggaggaacacagccagaa

SEQ ID NO: 8392707 - DNA, 22 bp, Homo sapiens
tgtgggaggaacacagccagaa

SEQ ID NO: 8392708 - DNA, 22 bp, Homo sapiens
tgtgggaggaattagaatggga

SEQ ID NO: 8392709 - DNA, 22 bp, Homo sapiens
tgtgggaggattcagaattggg

SEQ ID NO: 8392710 - DNA, 22 bp, Homo sapiens
tgtgggaggaattagaatggga

SEQ ID NO: 8392711 - DNA, 22 bp, Homo sapiens
tgtgggaggaattagaatggga

SEQ ID NO: 8392712 - DNA, 22 bp, Homo sapiens
tgtgggaggaattagaatggga

SEQ ID NO: 8392713 - DNA, 22 bp, Homo sapiens
tgtgggaggtctggaaggctcc

SEQ ID NO: 8392714 - DNA, 22 bp, Homo sapiens
tgtgggaggtctggaaggctcc

SEQ ID NO: 8392715 - DNA, 22 bp, Homo sapiens
tgtgggaggtctggaaggctcc

SEQ ID NO: 8392716 - DNA, 22 bp, Homo sapiens
tgtgggaggtctggaaggctcc

SEQ ID NO: 8392717 - DNA, 19 bp, Homo sapiens
tgtgggcaagggatggcag

SEQ ID NO: 8392718 - DNA, 22 bp, Homo sapiens
tgtgggcaaagggtagctgggt

SEQ ID NO: 8392719 - DNA, 22 bp, Homo sapiens
tgtgggcaggcccgggtctgag

SEQ ID NO: 8392720 - DNA, 22 bp, Homo sapiens
tgtgggctccccctcactctgt

SEQ ID NO: 8392721 - DNA, 22 bp, Homo sapiens
tgtgtacacatgacaggcaccc

SEQ ID NO: 8392722 - DNA, 22 bp, Homo sapiens
tgtgtacacacagatatataca

SEQ ID NO: 8392723 - DNA, 22 bp, Homo sapiens
tgtgtacagcatggtccagcag

SEQ ID NO: 8392724 - DNA, 22 bp, Homo sapiens
tgtgtacatatacacaaataca

SEQ ID NO: 8392725 - DNA, 22 bp, Homo sapiens
tgtgtacatctcttctcacatt

SEQ ID NO: 8392726 - DNA, 22 bp, Homo sapiens
tgtgtacacaagtatatataca

SEQ ID NO: 8392727 - DNA, 23 bp, Homo sapiens
tgtgtacacaatagatgaggttt

SEQ ID NO: 8392728 - DNA, 22 bp, Homo sapiens
tgtggggacccatgccatgggc

SEQ ID NO: 8392729 - DNA, 22 bp, Homo sapiens
tgttctttcagttagacacagt

SEQ ID NO: 8392730 - DNA, 22 bp, Homo sapiens
tgttctttggcttcctttccgt

SEQ ID NO: 8392731 - DNA, 22 bp, Homo sapiens
tgttctttgccagtgatttaat

SEQ ID NO: 8392732 - DNA, 22 bp, Homo sapiens
tgttctttgctgttgatgtaga

SEQ ID NO: 8392733 - DNA, 22 bp, Homo sapiens
tgttagtcagacacacctaaat

SEQ ID NO: 8392734 - DNA, 22 bp, Homo sapiens
tgttcttagcaggagcatctat

SEQ ID NO: 8392735 - DNA, 22 bp, Homo sapiens
tgttagaatattgtaatattcg

SEQ ID NO: 8392736 - DNA, 22 bp, Homo sapiens
tgttagaatattgtaatattcg

SEQ ID NO: 8392737 - DNA, 22 bp, Homo sapiens
tgttagaatattgtaatattcg

SEQ ID NO: 8392738 - DNA, 22 bp, Homo sapiens
tgttagcaaggataattatgat

SEQ ID NO: 8392739 - DNA, 22 bp, Homo sapiens
tgttaagagagtttctaatatt

SEQ ID NO: 8392740 - DNA, 22 bp, Homo sapiens
tgttaactaatggtctaacatt

SEQ ID NO: 8392741 - DNA, 22 bp, Homo sapiens
tgttactgatttgatatacagt

SEQ ID NO: 8392742 - DNA, 22 bp, Homo sapiens
tgttagaaattattagtaatat

SEQ ID NO: 8392743 - DNA, 22 bp, Homo sapiens
tgttagaaattattagtaatat

SEQ ID NO: 8392744 - DNA, 22 bp, Homo sapiens
tgttacttcttatttcttacat

SEQ ID NO: 8392745 - DNA, 22 bp, Homo sapiens
tgttacttcttatttcttacat

SEQ ID NO: 8392746 - DNA, 22 bp, Homo sapiens
tgttacttcttggtaaaggaga

SEQ ID NO: 8392747 - DNA, 22 bp, Homo sapiens
tgttaacatactgctttctaat

SEQ ID NO: 8392748 - DNA, 22 bp, Homo sapiens
tgttaaatgtattatgtgttct

SEQ ID NO: 8392749 - DNA, 22 bp, Homo sapiens
tgttaaatgttcctttactgga

SEQ ID NO: 8392750 - DNA, 18 bp, Homo sapiens
tgttaaatgaagatttgc

SEQ ID NO: 8392751 - DNA, 18 bp, Homo sapiens
tgttaaatgaagatttgc

SEQ ID NO: 8392752 - DNA, 22 bp, Homo sapiens
tgttgagtatatacctacaagt

SEQ ID NO: 8392753 - DNA, 22 bp, Homo sapiens
tgttggggtcaggagctagcct

SEQ ID NO: 8392754 - DNA, 21 bp, Homo sapiens
tgtttactccctgcaagcacg

SEQ ID NO: 8392755 - DNA, 22 bp, Homo sapiens
tgtttaaatagaacatactgca

SEQ ID NO: 8392756 - DNA, 18 bp, Homo sapiens
tgtttattctcctgacag

SEQ ID NO: 8392757 - DNA, 22 bp, Homo sapiens
tgttttaatctcccattgctct

SEQ ID NO: 8392758 - DNA, 22 bp, Homo sapiens
tgttttaagggtcaactgtcac

SEQ ID NO: 8392759 - DNA, 22 bp, Homo sapiens
tgttttatgagccatataacct

SEQ ID NO: 8392760 - DNA, 22 bp, Homo sapiens
tgttttatcaagatggcatgtc

SEQ ID NO: 8392761 - DNA, 22 bp, Homo sapiens
tgttttatcaagatggcatgtc

SEQ ID NO: 8392762 - DNA, 22 bp, Homo sapiens
tgttttatataagcagagcggt

SEQ ID NO: 8392763 - DNA, 22 bp, Homo sapiens
tgttttatttctccaagaggga

SEQ ID NO: 8392764 - DNA, 22 bp, Homo sapiens
tgttttatgagccatataacct

SEQ ID NO: 8392765 - DNA, 22 bp, Homo sapiens
tgttttatgagccatataacct

SEQ ID NO: 8392766 - DNA, 22 bp, Homo sapiens
tgttttatttctccaagaggga

SEQ ID NO: 8392767 - DNA, 20 bp, Homo sapiens
tgtttgtgccagctttgtca

SEQ ID NO: 8392768 - DNA, 22 bp, Homo sapiens
tgtttgtcatcattgtgagaga

SEQ ID NO: 8392769 - DNA, 22 bp, Homo sapiens
tgtttcaaagaaagaaaatata

SEQ ID NO: 8392770 - DNA, 22 bp, Homo sapiens
ttaaaagaatcctgttatcctc

SEQ ID NO: 8392771 - DNA, 22 bp, Homo sapiens
ttaaaagaatcctgttatcctc

SEQ ID NO: 8392772 - DNA, 22 bp, Homo sapiens
ttaaaagagacttcctttgttt

SEQ ID NO: 8392773 - DNA, 22 bp, Homo sapiens
ttaaaatgcagattctgattca

SEQ ID NO: 8392774 - DNA, 22 bp, Homo sapiens
ttaaaatgcagattatgactca

SEQ ID NO: 8392775 - DNA, 22 bp, Homo sapiens
ttaaaaaccatcttcctttcct

SEQ ID NO: 8392776 - DNA, 22 bp, Homo sapiens
tgtttttttatatacctgaagt

SEQ ID NO: 8392777 - DNA, 22 bp, Homo sapiens
tgttttttccttatgcaatctg

SEQ ID NO: 8392778 - DNA, 22 bp, Homo sapiens
ttaaaacagcgtgaatctggca

SEQ ID NO: 8392779 - DNA, 20 bp, Homo sapiens
ttaaaaagagtcacaggaga

SEQ ID NO: 8392780 - DNA, 22 bp, Homo sapiens
ttaaaaatatgtagggcccgat

SEQ ID NO: 8392781 - DNA, 20 bp, Homo sapiens
ttaaaaagagtcacaggaga

SEQ ID NO: 8392782 - DNA, 22 bp, Homo sapiens
ttaaaattatggcccatttgga

SEQ ID NO: 8392783 - DNA, 22 bp, Homo sapiens
ttaaaattatggcccatttgga

SEQ ID NO: 8392784 - DNA, 22 bp, Homo sapiens
ttaaaattatggcccatttgga

SEQ ID NO: 8392785 - DNA, 22 bp, Homo sapiens
ttaaaattatggcccatttgga

SEQ ID NO: 8392786 - DNA, 22 bp, Homo sapiens
ttaaaatttccccaccatgtat

SEQ ID NO: 8392787 - DNA, 22 bp, Homo sapiens
ttaaaatttccccaccatgtat

SEQ ID NO: 8392788 - DNA, 22 bp, Homo sapiens
ttaaaatttccccaccatgtat

SEQ ID NO: 8392789 - DNA, 22 bp, Homo sapiens
ttaaaatttccccaccatgtat

SEQ ID NO: 8392790 - DNA, 22 bp, Homo sapiens
ttaaaatttccccaccatgtat

SEQ ID NO: 8392791 - DNA, 22 bp, Homo sapiens
ttaaacatttttgatgatcgat

SEQ ID NO: 8392792 - DNA, 22 bp, Homo sapiens
tggggctaacgagagagcagag

SEQ ID NO: 8392793 - DNA, 22 bp, Homo sapiens
tggggctcacctaggctggaag

SEQ ID NO: 8392794 - DNA, 22 bp, Homo sapiens
tggggcctgaggtggagctgca

SEQ ID NO: 8392795 - DNA, 22 bp, Homo sapiens
tggggcctggtcagagctgcac

SEQ ID NO: 8392796 - DNA, 22 bp, Homo sapiens
tggggctgaggagcctcactct

SEQ ID NO: 8392797 - DNA, 22 bp, Homo sapiens
tggggctgaggagcctcactct

SEQ ID NO: 8392798 - DNA, 22 bp, Homo sapiens
tggggctctccacagtgtctca

SEQ ID NO: 8392799 - DNA, 22 bp, Homo sapiens
tggggctctccacagtgtctca

SEQ ID NO: 8392800 - DNA, 22 bp, Homo sapiens
tggggctcatgcctgctggaac

SEQ ID NO: 8392801 - DNA, 22 bp, Homo sapiens
tggggccaggtggctgcaggtc

SEQ ID NO: 8392802 - DNA, 22 bp, Homo sapiens
tggggccaggtggctgcaggtc

SEQ ID NO: 8392803 - DNA, 22 bp, Homo sapiens
tggggccagggaggaccagaca

SEQ ID NO: 8392804 - DNA, 22 bp, Homo sapiens
tggggccagcggggaggactca

SEQ ID NO: 8392805 - DNA, 22 bp, Homo sapiens
tggggccagcggggaggactca

SEQ ID NO: 8392806 - DNA, 22 bp, Homo sapiens
tggggccagcggggaggactca

SEQ ID NO: 8392807 - DNA, 22 bp, Homo sapiens
tggggcacagctgagaaagcac

SEQ ID NO: 8392808 - DNA, 22 bp, Homo sapiens
tggggccacagcctcctagctt

SEQ ID NO: 8392809 - DNA, 22 bp, Homo sapiens
tggggccagagctgcagggagc

SEQ ID NO: 8392810 - DNA, 22 bp, Homo sapiens
tggggccagagctgcagggagc

SEQ ID NO: 8392811 - DNA, 22 bp, Homo sapiens
tggggccagagatggggcgcag

SEQ ID NO: 8392812 - DNA, 22 bp, Homo sapiens
tggggctggctattgtctccct

SEQ ID NO: 8392813 - DNA, 22 bp, Homo sapiens
tgggggagagtgcaagcatgaa

SEQ ID NO: 8392814 - DNA, 22 bp, Homo sapiens
tgggggagagtttagatgattt

SEQ ID NO: 8392815 - DNA, 22 bp, Homo sapiens
tgggggagccttcacagtagct

SEQ ID NO: 8392816 - DNA, 22 bp, Homo sapiens
tgggggagtatagtctggcctc

SEQ ID NO: 8392817 - DNA, 22 bp, Homo sapiens
tgggggcacttcgaggtcgcct

SEQ ID NO: 8392818 - DNA, 22 bp, Homo sapiens
tgggggcacttcgaggtcgcct

SEQ ID NO: 8392819 - DNA, 22 bp, Homo sapiens
tgggggcagaggattcaggaat

SEQ ID NO: 8392820 - DNA, 22 bp, Homo sapiens
tgggggcagccaggctgtcaag

SEQ ID NO: 8392821 - DNA, 22 bp, Homo sapiens
tgggggcagccaggctgtcaag

SEQ ID NO: 8392822 - DNA, 22 bp, Homo sapiens
tgggggcatggaccagcctggc

SEQ ID NO: 8392823 - DNA, 22 bp, Homo sapiens
tgggctggtgagggatcattta

SEQ ID NO: 8392824 - DNA, 22 bp, Homo sapiens
tgggctggcgtggagagtttag

SEQ ID NO: 8392825 - DNA, 18 bp, Homo sapiens
tgggctgcctggcctctg

SEQ ID NO: 8392826 - DNA, 22 bp, Homo sapiens
tggggaaaatgcttgtagtcag

SEQ ID NO: 8392827 - DNA, 22 bp, Homo sapiens
tgggctttgagctcggtcacct

SEQ ID NO: 8392828 - DNA, 22 bp, Homo sapiens
tgggctttatcatgggtctggt

SEQ ID NO: 8392829 - DNA, 22 bp, Homo sapiens
tgggcttcataattggtcctag

SEQ ID NO: 8392830 - DNA, 22 bp, Homo sapiens
tgggctgtggagaggagctgga

SEQ ID NO: 8392831 - DNA, 23 bp, Homo sapiens
tgggcttctgagaaagcacctaa

SEQ ID NO: 8392832 - DNA, 22 bp, Homo sapiens
tggggacaggagacttacagct

SEQ ID NO: 8392833 - DNA, 22 bp, Homo sapiens
tggggaggaagtcagatttcag

SEQ ID NO: 8392834 - DNA, 22 bp, Homo sapiens
tggggacccggactcctgggtc

SEQ ID NO: 8392835 - DNA, 22 bp, Homo sapiens
tggggaccagattagaccatgg

SEQ ID NO: 8392836 - DNA, 22 bp, Homo sapiens
tggggactgacagccaggcctc

SEQ ID NO: 8392837 - DNA, 22 bp, Homo sapiens
tggggacatagccagtctggct

SEQ ID NO: 8392838 - DNA, 22 bp, Homo sapiens
tggggacatagccagtctggct

SEQ ID NO: 8392839 - DNA, 22 bp, Homo sapiens
tggggagtgatgcctcggataa

SEQ ID NO: 8392840 - DNA, 22 bp, Homo sapiens
tggggaggttcgggaatcttgt

SEQ ID NO: 8392841 - DNA, 22 bp, Homo sapiens
tggggaggtaacaatttcaggc

SEQ ID NO: 8392842 - DNA, 17 bp, Homo sapiens
tggggatggttcatgag

SEQ ID NO: 8392843 - DNA, 22 bp, Homo sapiens
tggggtgggcatgcgctgtcct

SEQ ID NO: 8392844 - DNA, 22 bp, Homo sapiens
tggggtgaatctttgttgtccg

SEQ ID NO: 8392845 - DNA, 22 bp, Homo sapiens
tggggtctgagtatctgcattt

SEQ ID NO: 8392846 - DNA, 22 bp, Homo sapiens
tggggtctgagtatctgcattt

SEQ ID NO: 8392847 - DNA, 22 bp, Homo sapiens
tggggtctggagttgcccatga

SEQ ID NO: 8392848 - DNA, 18 bp, Homo sapiens
tggggtctctcaggtaag

SEQ ID NO: 8392849 - DNA, 22 bp, Homo sapiens
tgggggtgccctatgaggaagc

SEQ ID NO: 8392850 - DNA, 22 bp, Homo sapiens
tgggggctgtgcacaggctcac

SEQ ID NO: 8392851 - DNA, 22 bp, Homo sapiens
tgggtagcagggctgagctgtg

SEQ ID NO: 8392852 - DNA, 22 bp, Homo sapiens
tgggtaaactgggtctggagag

SEQ ID NO: 8392853 - DNA, 22 bp, Homo sapiens
tgggtaaacaatgtttgcctaa

SEQ ID NO: 8392854 - DNA, 22 bp, Homo sapiens
tgggtctgtagggctgtccaat

SEQ ID NO: 8392855 - DNA, 20 bp, Homo sapiens
tgggtctgcttggcttcagt

SEQ ID NO: 8392856 - DNA, 22 bp, Homo sapiens
tgggtctgtagggctgtccaat

SEQ ID NO: 8392857 - DNA, 22 bp, Homo sapiens
tgggtccatggaacagaggtgc

SEQ ID NO: 8392858 - DNA, 20 bp, Homo sapiens
tgggtgcctgccacggggcc

SEQ ID NO: 8392859 - DNA, 22 bp, Homo sapiens
tgggtgccaacctctggtggcc

SEQ ID NO: 8392860 - DNA, 22 bp, Homo sapiens
tgggtgccaacctctggtggcc

SEQ ID NO: 8392861 - DNA, 22 bp, Homo sapiens
tgggtgcatgtgagcacgtgca

SEQ ID NO: 8392862 - DNA, 22 bp, Homo sapiens
tggtaagaataggggctttgga

SEQ ID NO: 8392863 - DNA, 22 bp, Homo sapiens
tggtaagataagagccaggcct

SEQ ID NO: 8392864 - DNA, 22 bp, Homo sapiens
tgggttctagagggaccagaac

SEQ ID NO: 8392865 - DNA, 22 bp, Homo sapiens
tggtatctgtgaatgtgacatt

SEQ ID NO: 8392866 - DNA, 22 bp, Homo sapiens
tggtataagctgtgtcagagcc

SEQ ID NO: 8392867 - DNA, 22 bp, Homo sapiens
tggtcacacatgtatctcaatg

SEQ ID NO: 8392868 - DNA, 22 bp, Homo sapiens
tggtattctttctgtagatcat

SEQ ID NO: 8392869 - DNA, 19 bp, Homo sapiens
tgggcaggttcagtaatgg

SEQ ID NO: 8392870 - DNA, 22 bp, Homo sapiens
tgggcaggggccctgcttccgt

SEQ ID NO: 8392871 - DNA, 22 bp, Homo sapiens
tgggcagggtctctgttatcag

SEQ ID NO: 8392872 - DNA, 22 bp, Homo sapiens
tgggcaggttgttatttgacat

SEQ ID NO: 8392873 - DNA, 22 bp, Homo sapiens
tgggcatctctgctgccggcct

SEQ ID NO: 8392874 - DNA, 22 bp, Homo sapiens
tgggccacagttcaccaatccc

SEQ ID NO: 8392875 - DNA, 22 bp, Homo sapiens
tgggccagcactgggtgctcat

SEQ ID NO: 8392876 - DNA, 22 bp, Homo sapiens
tgggccagctgaagtgccgccc

SEQ ID NO: 8392877 - DNA, 22 bp, Homo sapiens
tgggccagctgaagtgccgccc

SEQ ID NO: 8392878 - DNA, 22 bp, Homo sapiens
tgggccagctccctgcccctgg

SEQ ID NO: 8392879 - DNA, 22 bp, Homo sapiens
tgggcagatgtggctctccttg

SEQ ID NO: 8392880 - DNA, 22 bp, Homo sapiens
tgggcagatgtggctctccttg

SEQ ID NO: 8392881 - DNA, 22 bp, Homo sapiens
tgggcagattaatgcagtggct

SEQ ID NO: 8392882 - DNA, 22 bp, Homo sapiens
tgggcagattaatgcagtggct

SEQ ID NO: 8392883 - DNA, 22 bp, Homo sapiens
tgggcagatgtcctctgaagtg

SEQ ID NO: 8392884 - DNA, 21 bp, Homo sapiens
tgggcagatggcagtgtggct

SEQ ID NO: 8392885 - DNA, 16 bp, Homo sapiens
tgggcagatgagaaga

SEQ ID NO: 8392886 - DNA, 21 bp, Homo sapiens
tgggcagatggcagtgtggct

SEQ ID NO: 8392887 - DNA, 15 bp, Homo sapiens
tgggcagatcacttg

SEQ ID NO: 8392888 - DNA, 22 bp, Homo sapiens
tgggcagatctttggtggctag

SEQ ID NO: 8392889 - DNA, 22 bp, Homo sapiens
tgggcagagttgtgatgaactg

SEQ ID NO: 8392890 - DNA, 22 bp, Homo sapiens
tgggcagagttgtgatgaactg

SEQ ID NO: 8392891 - DNA, 22 bp, Homo sapiens
tgggcagcaaagactgtgtgct

SEQ ID NO: 8392892 - DNA, 22 bp, Homo sapiens
tgggcagcaaagactgtgtgct

SEQ ID NO: 8392893 - DNA, 22 bp, Homo sapiens
tgggcagggatctcttttgcaa

SEQ ID NO: 8392894 - DNA, 22 bp, Homo sapiens
tgggcagggatctcttttgcaa

SEQ ID NO: 8392895 - DNA, 22 bp, Homo sapiens
tgggcaggggccctgcttccgt

SEQ ID NO: 8392896 - DNA, 22 bp, Homo sapiens
tgggcaggggccctgcttccgt

SEQ ID NO: 8392897 - DNA, 22 bp, Homo sapiens
tgggcagggatctcttttgcaa

SEQ ID NO: 8392898 - DNA, 22 bp, Homo sapiens
tgggcagggagctggaaccaca

SEQ ID NO: 8392899 - DNA, 22 bp, Homo sapiens
tgggcagggagctggaaccaca

SEQ ID NO: 8392900 - DNA, 22 bp, Homo sapiens
tgggcaggagagaagctaaaga

SEQ ID NO: 8392901 - DNA, 22 bp, Homo sapiens
tgggcagcttccacttagttag

SEQ ID NO: 8392902 - DNA, 23 bp, Homo sapiens
tgggcagcttctgcatgcccacc

SEQ ID NO: 8392903 - DNA, 22 bp, Homo sapiens
tgggcagagagtagaggcaacg

SEQ ID NO: 8392904 - DNA, 22 bp, Homo sapiens
tgggcagactgagccctgtccc

SEQ ID NO: 8392905 - DNA, 22 bp, Homo sapiens
tgggcactcctggggacagctg

SEQ ID NO: 8392906 - DNA, 22 bp, Homo sapiens
tgggcacatagttttatggtca

SEQ ID NO: 8392907 - DNA, 22 bp, Homo sapiens
tgggcagagtcatacaggagac

SEQ ID NO: 8392908 - DNA, 22 bp, Homo sapiens
tgggcagagtagctcagaagaa

SEQ ID NO: 8392909 - DNA, 22 bp, Homo sapiens
tgggcagagtagctcagaagaa

SEQ ID NO: 8392910 - DNA, 22 bp, Homo sapiens
tgggcagagtcgtggggaatag

SEQ ID NO: 8392911 - DNA, 22 bp, Homo sapiens
tgggcagaggacagggaagatc

SEQ ID NO: 8392912 - DNA, 22 bp, Homo sapiens
tgggcagagatctggatcaaac

SEQ ID NO: 8392913 - DNA, 22 bp, Homo sapiens
tgggcagaggcagcagaaacct

SEQ ID NO: 8392914 - DNA, 22 bp, Homo sapiens
tgggcagaggctctgaagtcca

SEQ ID NO: 8392915 - DNA, 22 bp, Homo sapiens
tgggcacagagtcccatctgcc

SEQ ID NO: 8392916 - DNA, 22 bp, Homo sapiens
tgggatggcctttgaaagccag

SEQ ID NO: 8392917 - DNA, 22 bp, Homo sapiens
tgggatgagttgttaggactga

SEQ ID NO: 8392918 - DNA, 18 bp, Homo sapiens
tgggatggagagtaactg

SEQ ID NO: 8392919 - DNA, 22 bp, Homo sapiens
tgggatggagcctgagtatagt

SEQ ID NO: 8392920 - DNA, 17 bp, Homo sapiens
tgggatccgtctctgtg

SEQ ID NO: 8392921 - DNA, 22 bp, Homo sapiens
tgggaggcttccagaccttgct

SEQ ID NO: 8392922 - DNA, 22 bp, Homo sapiens
tgggaggcttccagaccttgct

SEQ ID NO: 8392923 - DNA, 22 bp, Homo sapiens
tgggagtcatcgtgtttggatc

SEQ ID NO: 8392924 - DNA, 22 bp, Homo sapiens
tgggagtgaggcagagtctatc

SEQ ID NO: 8392925 - DNA, 22 bp, Homo sapiens
tgggagtgatacagtatggaat

SEQ ID NO: 8392926 - DNA, 22 bp, Homo sapiens
tgggagtactatgtgataggat

SEQ ID NO: 8392927 - DNA, 22 bp, Homo sapiens
tgggagtcactgttgttgaggg

SEQ ID NO: 8392928 - DNA, 22 bp, Homo sapiens
tgggaggccaaggcaggcggat

SEQ ID NO: 8392929 - DNA, 22 bp, Homo sapiens
tgggaggccaaggcaggcggat

SEQ ID NO: 8392930 - DNA, 22 bp, Homo sapiens
tgggaggcccaggcctggcagg

SEQ ID NO: 8392931 - DNA, 22 bp, Homo sapiens
tgggaggcccaggcctggcagg

SEQ ID NO: 8392932 - DNA, 22 bp, Homo sapiens
tgggaggccgaggcaggtggat

SEQ ID NO: 8392933 - DNA, 22 bp, Homo sapiens
tgggaggccgaggcaggtggat

SEQ ID NO: 8392934 - DNA, 22 bp, Homo sapiens
tgggaggccgaggcaggtggat

SEQ ID NO: 8392935 - DNA, 22 bp, Homo sapiens
tgggaggccgaggcaggtggat

SEQ ID NO: 8392936 - DNA, 21 bp, Homo sapiens
tgggctctttaacccaggcac

SEQ ID NO: 8392937 - DNA, 22 bp, Homo sapiens
tgggctgcaccctcagcctctg

SEQ ID NO: 8392938 - DNA, 22 bp, Homo sapiens
tgggctctgctgcgtaccagtt

SEQ ID NO: 8392939 - DNA, 22 bp, Homo sapiens
tgggctctgcatcagtgcccat

SEQ ID NO: 8392940 - DNA, 22 bp, Homo sapiens
tgggctctggacaaacccttgc

SEQ ID NO: 8392941 - DNA, 22 bp, Homo sapiens
tgggctctgaagggtcccggat

SEQ ID NO: 8392942 - DNA, 22 bp, Homo sapiens
tgggctcagtctgcttggtcct

SEQ ID NO: 8392943 - DNA, 22 bp, Homo sapiens
tgggcctgttgcctgagtccat

SEQ ID NO: 8392944 - DNA, 22 bp, Homo sapiens
tgggctcagggaagcttggcct

SEQ ID NO: 8392945 - DNA, 22 bp, Homo sapiens
tgggctcagtctgcacctgcgg

SEQ ID NO: 8392946 - DNA, 22 bp, Homo sapiens
tgggctcagggtcgaggacttt

SEQ ID NO: 8392947 - DNA, 22 bp, Homo sapiens
tgggctcagctcccaagggaag

SEQ ID NO: 8392948 - DNA, 23 bp, Homo sapiens
tgggctcagcttccagtggggag

SEQ ID NO: 8392949 - DNA, 22 bp, Homo sapiens
tgggctcaggaccccagaggcc

SEQ ID NO: 8392950 - DNA, 22 bp, Homo sapiens
tgggctcagcctcagtctgtgg

SEQ ID NO: 8392951 - DNA, 21 bp, Homo sapiens
tgggctcagccccagccctgc

SEQ ID NO: 8392952 - DNA, 22 bp, Homo sapiens
tgggctcagccttcatgtggcc

SEQ ID NO: 8392953 - DNA, 22 bp, Homo sapiens
tgggctcagccttcatgtggcc

SEQ ID NO: 8392954 - DNA, 22 bp, Homo sapiens
tgggctcagccatgacctccac

SEQ ID NO: 8392955 - DNA, 22 bp, Homo sapiens
tgggctcactggggcagggacc

SEQ ID NO: 8392956 - DNA, 22 bp, Homo sapiens
tgggctcagaagatagtttcca

SEQ ID NO: 8392957 - DNA, 22 bp, Homo sapiens
tgggctagcagggaagagagac

SEQ ID NO: 8392958 - DNA, 22 bp, Homo sapiens
tgggctattaggaccaggccat

SEQ ID NO: 8392959 - DNA, 22 bp, Homo sapiens
tgggctcaatctgcttctgttt

SEQ ID NO: 8392960 - DNA, 22 bp, Homo sapiens
tgggctcaagtgatgctcctgt

SEQ ID NO: 8392961 - DNA, 18 bp, Homo sapiens
tgggctcaaaggatcctc

SEQ ID NO: 8392962 - DNA, 22 bp, Homo sapiens
tgggctcaaactggaggttgtt

SEQ ID NO: 8392963 - DNA, 22 bp, Homo sapiens
tgggcgaggcccagggctgcgt

SEQ ID NO: 8392964 - DNA, 22 bp, Homo sapiens
tgggcctcggagcacaggagac

SEQ ID NO: 8392965 - DNA, 18 bp, Homo sapiens
tgggcctgcatcctagtc

SEQ ID NO: 8392966 - DNA, 22 bp, Homo sapiens
tgggcctgattcttgaatcctg

SEQ ID NO: 8392967 - DNA, 21 bp, Homo sapiens
tgggcctgattcccagggtca

SEQ ID NO: 8392968 - DNA, 18 bp, Homo sapiens
tgggcctgcatcctagtc

SEQ ID NO: 8392969 - DNA, 22 bp, Homo sapiens
tgggccagttggaatggatact

SEQ ID NO: 8392970 - DNA, 22 bp, Homo sapiens
tgggccagttggaatggatact

SEQ ID NO: 8392971 - DNA, 22 bp, Homo sapiens
tgggccagttggtgactacaaa

SEQ ID NO: 8392972 - DNA, 22 bp, Homo sapiens
tgggccagtttctcattgaaat

SEQ ID NO: 8392973 - DNA, 22 bp, Homo sapiens
tgggccagtcctgcctaaggtg

SEQ ID NO: 8392974 - DNA, 22 bp, Homo sapiens
tgggccaggtgcagtgctttag

SEQ ID NO: 8392975 - DNA, 22 bp, Homo sapiens
tgggccaggtgcagtgctttag

SEQ ID NO: 8392976 - DNA, 21 bp, Homo sapiens
tgggccagtagaaaggaaggc

SEQ ID NO: 8392977 - DNA, 17 bp, Homo sapiens
tgggccagtagaaggga

SEQ ID NO: 8392978 - DNA, 22 bp, Homo sapiens
tgggccagtagctactcgcaag

SEQ ID NO: 8392979 - DNA, 22 bp, Homo sapiens
tgggccagtagctactcgcaag

SEQ ID NO: 8392980 - DNA, 22 bp, Homo sapiens
tgggccagtccagccccaggga

SEQ ID NO: 8392981 - DNA, 22 bp, Homo sapiens
tgggccagtccagccccaggga

SEQ ID NO: 8392982 - DNA, 22 bp, Homo sapiens
tgggccagtcctgcctaaggtg

SEQ ID NO: 8392983 - DNA, 22 bp, Homo sapiens
tgggccaggtctgcggtcattt

SEQ ID NO: 8392984 - DNA, 22 bp, Homo sapiens
tgggccaggggcctcttctgat

SEQ ID NO: 8392985 - DNA, 22 bp, Homo sapiens
tgggccaggtctgtgtcagctg

SEQ ID NO: 8392986 - DNA, 22 bp, Homo sapiens
tgggccaggtctgtgtcagctg

SEQ ID NO: 8392987 - DNA, 22 bp, Homo sapiens
tgggccaggcatgtgatcagca

SEQ ID NO: 8392988 - DNA, 22 bp, Homo sapiens
tgggccaggcatgtgatcagca

SEQ ID NO: 8392989 - DNA, 22 bp, Homo sapiens
tgggccaggcatgtgatcagca

SEQ ID NO: 8392990 - DNA, 23 bp, Homo sapiens
tgggccagggagtccggtttctt

SEQ ID NO: 8392991 - DNA, 22 bp, Homo sapiens
tgggccagggcacccagtccag

SEQ ID NO: 8392992 - DNA, 22 bp, Homo sapiens
tgtcatctgatattacttatag

SEQ ID NO: 8392993 - DNA, 22 bp, Homo sapiens
tgtcatcaactcacagagccaa

SEQ ID NO: 8392994 - DNA, 22 bp, Homo sapiens
tgtcatcatttgagagaagaaa

SEQ ID NO: 8392995 - DNA, 22 bp, Homo sapiens
tgtcatatgtaatatgttcatt

SEQ ID NO: 8392996 - DNA, 22 bp, Homo sapiens
tgtcatatgttgatgaaagaga

SEQ ID NO: 8392997 - DNA, 22 bp, Homo sapiens
tgtcatatctattaaatgtcta

SEQ ID NO: 8392998 - DNA, 22 bp, Homo sapiens
tgtcatatgctgtcatagccat

SEQ ID NO: 8392999 - DNA, 22 bp, Homo sapiens
tgtcatatagatattagacagg

SEQ ID NO: 8393000 - DNA, 22 bp, Homo sapiens
tgtcatttatcttatagtaatc

SEQ ID NO: 8393001 - DNA, 22 bp, Homo sapiens
tgtccaggaccctattctcact

SEQ ID NO: 8393002 - DNA, 22 bp, Homo sapiens
tgtccactttgtcagtgtcata

SEQ ID NO: 8393003 - DNA, 21 bp, Homo sapiens
tgtccaaggtatgcactgggg

SEQ ID NO: 8393004 - DNA, 22 bp, Homo sapiens
tgtcattttctaatctgttgtc

SEQ ID NO: 8393005 - DNA, 22 bp, Homo sapiens
tgtcatttggactttggtatta

SEQ ID NO: 8393006 - DNA, 22 bp, Homo sapiens
tgtcattttaatcacctttcca

SEQ ID NO: 8393007 - DNA, 21 bp, Homo sapiens
tgtcagaaataagcatgtgat

SEQ ID NO: 8393008 - DNA, 22 bp, Homo sapiens
tgtcactgtgctctgttcattt

SEQ ID NO: 8393009 - DNA, 22 bp, Homo sapiens
tgtcacctttacccttttatag

SEQ ID NO: 8393010 - DNA, 22 bp, Homo sapiens
tgtcaccttgcagggctggggc

SEQ ID NO: 8393011 - DNA, 22 bp, Homo sapiens
tgtcaccttgctcatcctcgga

SEQ ID NO: 8393012 - DNA, 22 bp, Homo sapiens
tgtcacctggaaatcactctaa

SEQ ID NO: 8393013 - DNA, 19 bp, Homo sapiens
tgtcaccttctgtcagttt

SEQ ID NO: 8393014 - DNA, 22 bp, Homo sapiens
tgtcaccttgatgatggcctag

SEQ ID NO: 8393015 - DNA, 22 bp, Homo sapiens
tgtcataagattaactttttgt

SEQ ID NO: 8393016 - DNA, 22 bp, Homo sapiens
tgtcagttacctagcacaagaa

SEQ ID NO: 8393017 - DNA, 22 bp, Homo sapiens
tgtcagtttggctctaaagttt

SEQ ID NO: 8393018 - DNA, 22 bp, Homo sapiens
tgtccccaaggttcagcccaca

SEQ ID NO: 8393019 - DNA, 22 bp, Homo sapiens
tgtccccagagcctgttcctgc

SEQ ID NO: 8393020 - DNA, 22 bp, Homo sapiens
tgtcccagggaaggcccagcac

SEQ ID NO: 8393021 - DNA, 22 bp, Homo sapiens
tgtcccagctgtctctgttttt

SEQ ID NO: 8393022 - DNA, 22 bp, Homo sapiens
tgtcccagtcaaggctgtcatc

SEQ ID NO: 8393023 - DNA, 22 bp, Homo sapiens
tgtcccagcagctgggttctct

SEQ ID NO: 8393024 - DNA, 22 bp, Homo sapiens
tgtccaggtggcctctgctgct

SEQ ID NO: 8393025 - DNA, 22 bp, Homo sapiens
tgtccaggtggcctctgctgct

SEQ ID NO: 8393026 - DNA, 22 bp, Homo sapiens
tgtccagggggcttacctggag

SEQ ID NO: 8393027 - DNA, 22 bp, Homo sapiens
tgtccaggtcagcagcagggac

SEQ ID NO: 8393028 - DNA, 22 bp, Homo sapiens
tgtccagggatggggtcaggga

SEQ ID NO: 8393029 - DNA, 22 bp, Homo sapiens
tgtccagggatggggtcaggga

SEQ ID NO: 8393030 - DNA, 20 bp, Homo sapiens
tgtccaggggatcgttggcc

SEQ ID NO: 8393031 - DNA, 22 bp, Homo sapiens
tgtccaggctcccttggtgctg

SEQ ID NO: 8393032 - DNA, 22 bp, Homo sapiens
tgtccaggcggccttgcctgtt

SEQ ID NO: 8393033 - DNA, 22 bp, Homo sapiens
tgtccaggctcccttggtgctg

SEQ ID NO: 8393034 - DNA, 22 bp, Homo sapiens
tgtcctagagacatcagatgtt

SEQ ID NO: 8393035 - DNA, 22 bp, Homo sapiens
tgtcctggccaaggccttgctt

SEQ ID NO: 8393036 - DNA, 22 bp, Homo sapiens
tgtcctggggcgacttggggcc

SEQ ID NO: 8393037 - DNA, 22 bp, Homo sapiens
tgtcctggtgctccaggtggct

SEQ ID NO: 8393038 - DNA, 22 bp, Homo sapiens
tgtcctggtgcttcttgggatt

SEQ ID NO: 8393039 - DNA, 22 bp, Homo sapiens
tgtcctggtgcttcttgggatt

SEQ ID NO: 8393040 - DNA, 22 bp, Homo sapiens
tgtccttttccccaaattcact

SEQ ID NO: 8393041 - DNA, 22 bp, Homo sapiens
tgtatgcataaaattatttaca

SEQ ID NO: 8393042 - DNA, 17 bp, Homo sapiens
tgtatgcatatgctttt

SEQ ID NO: 8393043 - DNA, 22 bp, Homo sapiens
tgtatgcaccattgtattacct

SEQ ID NO: 8393044 - DNA, 22 bp, Homo sapiens
tgtatgcaccattgtattacct

SEQ ID NO: 8393045 - DNA, 22 bp, Homo sapiens
tgtatttaattgtatcatcaca

SEQ ID NO: 8393046 - DNA, 22 bp, Homo sapiens
tgtatttgggtcacaagatggg

SEQ ID NO: 8393047 - DNA, 22 bp, Homo sapiens
tgtattttctgaggagcattag

SEQ ID NO: 8393048 - DNA, 22 bp, Homo sapiens
tgtattttctgaagataatcaa

SEQ ID NO: 8393049 - DNA, 22 bp, Homo sapiens
tgtattttgtgaggatcactct

SEQ ID NO: 8393050 - DNA, 22 bp, Homo sapiens
tgtattttgagtccaatctcct

SEQ ID NO: 8393051 - DNA, 22 bp, Homo sapiens
tgtattttgagtccaatctcct

SEQ ID NO: 8393052 - DNA, 22 bp, Homo sapiens
tgtattttgtgaggatcactct

SEQ ID NO: 8393053 - DNA, 22 bp, Homo sapiens
tgtattttgtgaggatcactct

SEQ ID NO: 8393054 - DNA, 22 bp, Homo sapiens
tgtcaaagacagaaggaaatgg

SEQ ID NO: 8393055 - DNA, 22 bp, Homo sapiens
tgtcaaactgtgacttctaatg

SEQ ID NO: 8393056 - DNA, 22 bp, Homo sapiens
tgtcaaaatgactttactacag

SEQ ID NO: 8393057 - DNA, 22 bp, Homo sapiens
tgtatttttaggaatgcgctat

SEQ ID NO: 8393058 - DNA, 22 bp, Homo sapiens
tgtcacaaacatacattataga

SEQ ID NO: 8393059 - DNA, 22 bp, Homo sapiens
tgtcacagagcgtgcaacagaa

SEQ ID NO: 8393060 - DNA, 22 bp, Homo sapiens
tgtcacagagcgtgcaacagaa

SEQ ID NO: 8393061 - DNA, 22 bp, Homo sapiens
tgtcacaatttatttctcttga

SEQ ID NO: 8393062 - DNA, 22 bp, Homo sapiens
tgtcacaagtaactggcaatgc

SEQ ID NO: 8393063 - DNA, 22 bp, Homo sapiens
tgtcacaaacatacattataga

SEQ ID NO: 8393064 - DNA, 22 bp, Homo sapiens
tgtcacatgaagccaacatagc

SEQ ID NO: 8393065 - DNA, 22 bp, Homo sapiens
tgtcacagggataccatggggc

SEQ ID NO: 8393066 - DNA, 22 bp, Homo sapiens
tgtcacatgacacaaatatcta

SEQ ID NO: 8393067 - DNA, 22 bp, Homo sapiens
tgtcaccaccggaagaaactgc

SEQ ID NO: 8393068 - DNA, 22 bp, Homo sapiens
tgtcaccatgccagcttctgcc

SEQ ID NO: 8393069 - DNA, 22 bp, Homo sapiens
tgtagaaggctatagactagga

SEQ ID NO: 8393070 - DNA, 22 bp, Homo sapiens
tgtagaaagaatatgtttcata

SEQ ID NO: 8393071 - DNA, 22 bp, Homo sapiens
tgtagaaattagtaagatcaac

SEQ ID NO: 8393072 - DNA, 22 bp, Homo sapiens
tgtactaatgcatttaactaac

SEQ ID NO: 8393073 - DNA, 18 bp, Homo sapiens
tgtagaaaagataggaat

SEQ ID NO: 8393074 - DNA, 22 bp, Homo sapiens
tgtagaaactacacatgcaaca

SEQ ID NO: 8393075 - DNA, 22 bp, Homo sapiens
tgtagaaactacacatgcaaca

SEQ ID NO: 8393076 - DNA, 22 bp, Homo sapiens
tgtagaaaattggagcattcat

SEQ ID NO: 8393077 - DNA, 22 bp, Homo sapiens
tgtagaaaattggagcattcat

SEQ ID NO: 8393078 - DNA, 22 bp, Homo sapiens
tgtagatatagaaaaagactga

SEQ ID NO: 8393079 - DNA, 22 bp, Homo sapiens
tgtaggaaaaacaatgatctgc

SEQ ID NO: 8393080 - DNA, 22 bp, Homo sapiens
tgtaggaagatataaaatatct

SEQ ID NO: 8393081 - DNA, 22 bp, Homo sapiens
tgtatattctgcctaaaagctt

SEQ ID NO: 8393082 - DNA, 20 bp, Homo sapiens
tgtatattttctggtgtaaa

SEQ ID NO: 8393083 - DNA, 22 bp, Homo sapiens
tgtatcaaaccaaattaattct

SEQ ID NO: 8393084 - DNA, 22 bp, Homo sapiens
tgtatctgtgatgtaggggttt

SEQ ID NO: 8393085 - DNA, 22 bp, Homo sapiens
tgtatcccctgcaggttgctat

SEQ ID NO: 8393086 - DNA, 22 bp, Homo sapiens
tgtatcaatcatgtaatttggt

SEQ ID NO: 8393087 - DNA, 21 bp, Homo sapiens
tgtatacacgtgttgaaaaca

SEQ ID NO: 8393088 - DNA, 22 bp, Homo sapiens
tgtatacaagtcgtgtaaactt

SEQ ID NO: 8393089 - DNA, 22 bp, Homo sapiens
tgtatacaggcataagagatac

SEQ ID NO: 8393090 - DNA, 22 bp, Homo sapiens
tgtatataagcatttacttgtt

SEQ ID NO: 8393091 - DNA, 23 bp, Homo sapiens
tggtttatgatatgtatgggaat

SEQ ID NO: 8393092 - DNA, 22 bp, Homo sapiens
tggtttatgctgttgcagctct

SEQ ID NO: 8393093 - DNA, 21 bp, Homo sapiens
tggtttatgtgcttagggtct

SEQ ID NO: 8393094 - DNA, 22 bp, Homo sapiens
tggtttatatcttgattctagt

SEQ ID NO: 8393095 - DNA, 22 bp, Homo sapiens
tggtttatttctctgaaaggtt

SEQ ID NO: 8393096 - DNA, 21 bp, Homo sapiens
tggtttatttcactcagcata

SEQ ID NO: 8393097 - DNA, 22 bp, Homo sapiens
tggtttataacatgtctcatga

SEQ ID NO: 8393098 - DNA, 22 bp, Homo sapiens
tggttacacagcatgtggactt

SEQ ID NO: 8393099 - DNA, 22 bp, Homo sapiens
tggttacacaagtgtgtgcagt

SEQ ID NO: 8393100 - DNA, 23 bp, Homo sapiens
tggttcttatgattttactacca

SEQ ID NO: 8393101 - DNA, 17 bp, Homo sapiens
tggttcttttcattccc

SEQ ID NO: 8393102 - DNA, 22 bp, Homo sapiens
tggtgtaatcagtttctagctc

SEQ ID NO: 8393103 - DNA, 22 bp, Homo sapiens
tggtgtctccatcctgccctgc

SEQ ID NO: 8393104 - DNA, 22 bp, Homo sapiens
tggtggggtcatcgtcagatgc

SEQ ID NO: 8393105 - DNA, 23 bp, Homo sapiens
tggtggggtcttggagacagcac

SEQ ID NO: 8393106 - DNA, 22 bp, Homo sapiens
tggtgtgtgagtcaagacaagt

SEQ ID NO: 8393107 - DNA, 18 bp, Homo sapiens
tgtaaacactttcattct

SEQ ID NO: 8393108 - DNA, 22 bp, Homo sapiens
tgtaaataatgcatgtaaatca

SEQ ID NO: 8393109 - DNA, 22 bp, Homo sapiens
tgtaaaataccattccttgtca

SEQ ID NO: 8393110 - DNA, 22 bp, Homo sapiens
tgtaaaataattctccatgttt

SEQ ID NO: 8393111 - DNA, 22 bp, Homo sapiens
tgtacagataaagactgtaaat

SEQ ID NO: 8393112 - DNA, 22 bp, Homo sapiens
tgtacagaggtgtacatatgat

SEQ ID NO: 8393113 - DNA, 22 bp, Homo sapiens
tgtacagctgccttttttactt

SEQ ID NO: 8393114 - DNA, 22 bp, Homo sapiens
tgtacacctgtctttacacata

SEQ ID NO: 8393115 - DNA, 22 bp, Homo sapiens
tgtacacctgtctttacacata

SEQ ID NO: 8393116 - DNA, 22 bp, Homo sapiens
tgtacagagactaccattaata

SEQ ID NO: 8393117 - DNA, 22 bp, Homo sapiens
tgtacagactttgcagtgtgca

SEQ ID NO: 8393118 - DNA, 22 bp, Homo sapiens
tgtacagaggtgtacatatgat

SEQ ID NO: 8393119 - DNA, 22 bp, Homo sapiens
tgtacagactgtatttacaagt

SEQ ID NO: 8393120 - DNA, 22 bp, Homo sapiens
tgtacaagcaaatagaccttca

SEQ ID NO: 8393121 - DNA, 22 bp, Homo sapiens
tgtacaaattcattgaactgta

SEQ ID NO: 8393122 - DNA, 22 bp, Homo sapiens
tgtacaaattcagttctagggt

SEQ ID NO: 8393123 - DNA, 22 bp, Homo sapiens
tgtacaaattcagttctagggt

SEQ ID NO: 8393124 - DNA, 22 bp, Homo sapiens
tgtacaaattcagttctagggt

SEQ ID NO: 8393125 - DNA, 22 bp, Homo sapiens
tgtacaaagttaaacctatata

SEQ ID NO: 8393126 - DNA, 22 bp, Homo sapiens
tgtacaatagctattatctcca

SEQ ID NO: 8393127 - DNA, 22 bp, Homo sapiens
tgtacaaggccatctacatgct

SEQ ID NO: 8393128 - DNA, 22 bp, Homo sapiens
tgtacacaattcttaacataca

SEQ ID NO: 8393129 - DNA, 22 bp, Homo sapiens
tgtacacagtatgaggcatctt

SEQ ID NO: 8393130 - DNA, 22 bp, Homo sapiens
tgtacacaacctacagtctgct

SEQ ID NO: 8393131 - DNA, 22 bp, Homo sapiens
tgtaattttctcaagtttctac

SEQ ID NO: 8393132 - DNA, 22 bp, Homo sapiens
tgtacaaaacaagatgggggta

SEQ ID NO: 8393133 - DNA, 22 bp, Homo sapiens
tgtacaaagagtatagctttga

SEQ ID NO: 8393134 - DNA, 22 bp, Homo sapiens
tgtacaaagagtatagctttga

SEQ ID NO: 8393135 - DNA, 22 bp, Homo sapiens
tgtacaaagagtatagctttga

SEQ ID NO: 8393136 - DNA, 22 bp, Homo sapiens
tgtacaaagccagaactcccaa

SEQ ID NO: 8393137 - DNA, 22 bp, Homo sapiens
tgtacaaagttaaacctatata

SEQ ID NO: 8393138 - DNA, 22 bp, Homo sapiens
tgtacaaaggtactttgatgtt

SEQ ID NO: 8393139 - DNA, 22 bp, Homo sapiens
tgtaagaataatgatttctaag

SEQ ID NO: 8393140 - DNA, 22 bp, Homo sapiens
tgtaaattgaaggaaatttgtg

SEQ ID NO: 8393141 - DNA, 22 bp, Homo sapiens
tgtaaattgtcacctaaatgct

SEQ ID NO: 8393142 - DNA, 23 bp, Homo sapiens
tgtaaattttgtagtcacatttt

SEQ ID NO: 8393143 - DNA, 22 bp, Homo sapiens
tgtaacatggttcttactctca

SEQ ID NO: 8393144 - DNA, 22 bp, Homo sapiens
tggtggcagctgggacagaggt

SEQ ID NO: 8393145 - DNA, 22 bp, Homo sapiens
tggtgggcacagtgcccaggct

SEQ ID NO: 8393146 - DNA, 22 bp, Homo sapiens
tggtgggggaggctgtctagca

SEQ ID NO: 8393147 - DNA, 22 bp, Homo sapiens
tggtggcaacattgctggagtg

SEQ ID NO: 8393148 - DNA, 22 bp, Homo sapiens
tggtgccattagccctgctgtt

SEQ ID NO: 8393149 - DNA, 22 bp, Homo sapiens
tggtgccattagccctgctgtt

SEQ ID NO: 8393150 - DNA, 22 bp, Homo sapiens
tggtgccatcatagctcactgc

SEQ ID NO: 8393151 - DNA, 22 bp, Homo sapiens
tggtgccacttcttaggctggt

SEQ ID NO: 8393152 - DNA, 22 bp, Homo sapiens
tggtgccaccctccttcagctg

SEQ ID NO: 8393153 - DNA, 22 bp, Homo sapiens
tggtgccacaagaatacaaagc

SEQ ID NO: 8393154 - DNA, 23 bp, Homo sapiens
tggtgccacagctgaagtcaggt

SEQ ID NO: 8393155 - DNA, 22 bp, Homo sapiens
tggtgccaagcatgaggactct

SEQ ID NO: 8393156 - DNA, 22 bp, Homo sapiens
tggtcctgggcacagtatatgc

SEQ ID NO: 8393157 - DNA, 22 bp, Homo sapiens
tggtcctggagagtgttccata

SEQ ID NO: 8393158 - DNA, 21 bp, Homo sapiens
tggtcagtatttcagttacat

SEQ ID NO: 8393159 - DNA, 22 bp, Homo sapiens
tggtcagaaggaagggctccta

SEQ ID NO: 8393160 - DNA, 22 bp, Homo sapiens
tggtcagaactcagcgtgcttg

SEQ ID NO: 8393161 - DNA, 22 bp, Homo sapiens
tggtcagcgtttgtcagagcag

SEQ ID NO: 8393162 - DNA, 22 bp, Homo sapiens
tggtcaggattctcagcccttc

SEQ ID NO: 8393163 - DNA, 22 bp, Homo sapiens
tggtctctctcctgcaacaact

SEQ ID NO: 8393164 - DNA, 22 bp, Homo sapiens
tggtctcaggagagtctcttca

SEQ ID NO: 8393165 - DNA, 23 bp, Homo sapiens
tggtctcacttggtaagatgaag

SEQ ID NO: 8393166 - DNA, 19 bp, Homo sapiens
tggtctctgtctctttgca

SEQ ID NO: 8393167 - DNA, 22 bp, Homo sapiens
tggtgagataactttcggcaag

SEQ ID NO: 8393168 - DNA, 22 bp, Homo sapiens
tggtgagagctgaccgtgcgag

SEQ ID NO: 8393169 - DNA, 22 bp, Homo sapiens
tggtgagaccttgttccttatg

SEQ ID NO: 8393170 - DNA, 20 bp, Homo sapiens
tggtgagagcacctgatggg

SEQ ID NO: 8393171 - DNA, 22 bp, Homo sapiens
tggtgagatgtatggagggttg

SEQ ID NO: 8393172 - DNA, 22 bp, Homo sapiens
tggtgagctctttagactggga

SEQ ID NO: 8393173 - DNA, 18 bp, Homo sapiens
tggagggcttgctgcagc

SEQ ID NO: 8393174 - DNA, 22 bp, Homo sapiens
tggagggctctttcacctggta

SEQ ID NO: 8393175 - DNA, 22 bp, Homo sapiens
tggagggctaagctgagggata

SEQ ID NO: 8393176 - DNA, 22 bp, Homo sapiens
tggaggtgggagggactgtcct

SEQ ID NO: 8393177 - DNA, 22 bp, Homo sapiens
tggaggtggcacaagggaggtc

SEQ ID NO: 8393178 - DNA, 20 bp, Homo sapiens
tggaggtggtctgctgtcct

SEQ ID NO: 8393179 - DNA, 20 bp, Homo sapiens
tggaggtggtctgctgtcct

SEQ ID NO: 8393180 - DNA, 22 bp, Homo sapiens
tggagggcgcttagatggaggg

SEQ ID NO: 8393181 - DNA, 22 bp, Homo sapiens
tggagggcgcttagatggaggg

SEQ ID NO: 8393182 - DNA, 22 bp, Homo sapiens
tggagggcatctgtggtcaggc

SEQ ID NO: 8393183 - DNA, 22 bp, Homo sapiens
tggagggcatctgtggtcaggc

SEQ ID NO: 8393184 - DNA, 22 bp, Homo sapiens
tggagggaacccaggctgctct

SEQ ID NO: 8393185 - DNA, 22 bp, Homo sapiens
tggagggaacccaggctgctct

SEQ ID NO: 8393186 - DNA, 22 bp, Homo sapiens
tggaggctgtgtgcatgagacc

SEQ ID NO: 8393187 - DNA, 22 bp, Homo sapiens
tggatggagactgatatgggta

SEQ ID NO: 8393188 - DNA, 19 bp, Homo sapiens
tggatggagcctgtggttg

SEQ ID NO: 8393189 - DNA, 22 bp, Homo sapiens
tggatggatctcaagggaatta

SEQ ID NO: 8393190 - DNA, 22 bp, Homo sapiens
tggatggattgacgaaggcagc

SEQ ID NO: 8393191 - DNA, 22 bp, Homo sapiens
tggatggccccactggatccat

SEQ ID NO: 8393192 - DNA, 22 bp, Homo sapiens
tggatggccccactggatccat

SEQ ID NO: 8393193 - DNA, 22 bp, Homo sapiens
tggagtccccgagaggcctgca

SEQ ID NO: 8393194 - DNA, 21 bp, Homo sapiens
tggagtgcactcagagttggt

SEQ ID NO: 8393195 - DNA, 16 bp, Homo sapiens
tggaggtgtttctagt

SEQ ID NO: 8393196 - DNA, 22 bp, Homo sapiens
tggaggagggctggtgtctgta

SEQ ID NO: 8393197 - DNA, 20 bp, Homo sapiens
tggaggcacctgtggagatc

SEQ ID NO: 8393198 - DNA, 20 bp, Homo sapiens
tggaggcagagccagaggga

SEQ ID NO: 8393199 - DNA, 22 bp, Homo sapiens
tggaggcaccactggctgcccg

SEQ ID NO: 8393200 - DNA, 18 bp, Homo sapiens
tggaggcagagttctggc

SEQ ID NO: 8393201 - DNA, 22 bp, Homo sapiens
tggaggcaggagacagggcaaa

SEQ ID NO: 8393202 - DNA, 22 bp, Homo sapiens
tggaggcaggggatacaggtca

SEQ ID NO: 8393203 - DNA, 22 bp, Homo sapiens
tggaggccggactgagaggcat

SEQ ID NO: 8393204 - DNA, 19 bp, Homo sapiens
tggaggcctcaggaaaaga

SEQ ID NO: 8393205 - DNA, 22 bp, Homo sapiens
tggaggccctcattgtagaagt

SEQ ID NO: 8393206 - DNA, 22 bp, Homo sapiens
tggaggcagtaactgagcaaca

SEQ ID NO: 8393207 - DNA, 22 bp, Homo sapiens
tggaggcagtaactgagcaaca

SEQ ID NO: 8393208 - DNA, 22 bp, Homo sapiens
tggaggcagtcaaatgactgac

SEQ ID NO: 8393209 - DNA, 22 bp, Homo sapiens
tggaggcagtcaaatgactgac

SEQ ID NO: 8393210 - DNA, 22 bp, Homo sapiens
tggaggcagtcacctgaagtca

SEQ ID NO: 8393211 - DNA, 22 bp, Homo sapiens
tggaggccagtgaaagtagatt

SEQ ID NO: 8393212 - DNA, 22 bp, Homo sapiens
tggagccagtgttgcccaacac

SEQ ID NO: 8393213 - DNA, 18 bp, Homo sapiens
tggagccattgccaccat

SEQ ID NO: 8393214 - DNA, 22 bp, Homo sapiens
tggagcccaggtgcaagagagt

SEQ ID NO: 8393215 - DNA, 22 bp, Homo sapiens
tggagcccagggtgagaaggag

SEQ ID NO: 8393216 - DNA, 22 bp, Homo sapiens
tggagcccaggagaggataaac

SEQ ID NO: 8393217 - DNA, 22 bp, Homo sapiens
tggagcccagacactggcattg

SEQ ID NO: 8393218 - DNA, 18 bp, Homo sapiens
tggagccagctctaggat

SEQ ID NO: 8393219 - DNA, 22 bp, Homo sapiens
tggagccagcggcctgctgagg

SEQ ID NO: 8393220 - DNA, 22 bp, Homo sapiens
tggagccagcgagccgaggcgg

SEQ ID NO: 8393221 - DNA, 22 bp, Homo sapiens
tggagccaggagcctgggagtc

SEQ ID NO: 8393222 - DNA, 22 bp, Homo sapiens
tggagccaggctggccctgcca

SEQ ID NO: 8393223 - DNA, 22 bp, Homo sapiens
tggagccaggagcctgggagtc

SEQ ID NO: 8393224 - DNA, 22 bp, Homo sapiens
tggagccagagcgcagcctggg

SEQ ID NO: 8393225 - DNA, 22 bp, Homo sapiens
tggagccagcccaggcccctct

SEQ ID NO: 8393226 - DNA, 22 bp, Homo sapiens
tggagcaggtgctcagggtaat

SEQ ID NO: 8393227 - DNA, 22 bp, Homo sapiens
tggagcagtggtcctggagatg

SEQ ID NO: 8393228 - DNA, 22 bp, Homo sapiens
tggagccaaaaagggaaggaga

SEQ ID NO: 8393229 - DNA, 22 bp, Homo sapiens
tggagcaggtgccaggtgtgtg

SEQ ID NO: 8393230 - DNA, 22 bp, Homo sapiens
tggagcaggacggggagtggta

SEQ ID NO: 8393231 - DNA, 18 bp, Homo sapiens
tggagcaggaagcctggc

SEQ ID NO: 8393232 - DNA, 22 bp, Homo sapiens
tggagcagctaagcctctgaga

SEQ ID NO: 8393233 - DNA, 22 bp, Homo sapiens
tggagcagctgaacagagttga

SEQ ID NO: 8393234 - DNA, 22 bp, Homo sapiens
tggagaagctgtaggtggactc

SEQ ID NO: 8393235 - DNA, 22 bp, Homo sapiens
tggagagaaagttgaatggagg

SEQ ID NO: 8393236 - DNA, 22 bp, Homo sapiens
tggagagagtcgggatagtaca

SEQ ID NO: 8393237 - DNA, 22 bp, Homo sapiens
tggagagaagaggcagtgtgct

SEQ ID NO: 8393238 - DNA, 22 bp, Homo sapiens
tggagagaagaggcagtgtgct

SEQ ID NO: 8393239 - DNA, 22 bp, Homo sapiens
tggagagcagggctggagttca

SEQ ID NO: 8393240 - DNA, 22 bp, Homo sapiens
tggagagcaggggatgcgggcg

SEQ ID NO: 8393241 - DNA, 21 bp, Homo sapiens
tggagagcccttgcctgagtc

SEQ ID NO: 8393242 - DNA, 22 bp, Homo sapiens
tggagagcaatgaggggcaggc

SEQ ID NO: 8393243 - DNA, 22 bp, Homo sapiens
tggagagcctggagtccctgat

SEQ ID NO: 8393244 - DNA, 22 bp, Homo sapiens
tggagcagaaatggcctcttgt

SEQ ID NO: 8393245 - DNA, 22 bp, Homo sapiens
tggagcagaggctgaggttggg

SEQ ID NO: 8393246 - DNA, 22 bp, Homo sapiens
tggagcagaggaagaaggcttt

SEQ ID NO: 8393247 - DNA, 22 bp, Homo sapiens
tggaaaaaaattggctagcttc

SEQ ID NO: 8393248 - DNA, 22 bp, Homo sapiens
tggaaaaactgagacttagaca

SEQ ID NO: 8393249 - DNA, 22 bp, Homo sapiens
tgctttttagtactgtcttatt

SEQ ID NO: 8393250 - DNA, 22 bp, Homo sapiens
tgctttggccactagaattcag

SEQ ID NO: 8393251 - DNA, 22 bp, Homo sapiens
tgctttgctttggagagccagc

SEQ ID NO: 8393252 - DNA, 22 bp, Homo sapiens
tgcttttaagaacaatgctgct

SEQ ID NO: 8393253 - DNA, 22 bp, Homo sapiens
tgcttttagctagtaactagta

SEQ ID NO: 8393254 - DNA, 22 bp, Homo sapiens
tggaaagagatgttgtttctga

SEQ ID NO: 8393255 - DNA, 22 bp, Homo sapiens
tggaaacatctctgcctttatt

SEQ ID NO: 8393256 - DNA, 22 bp, Homo sapiens
tggaaagaggtagaggatctgg

SEQ ID NO: 8393257 - DNA, 22 bp, Homo sapiens
tggaaagaggaagtgcccagca

SEQ ID NO: 8393258 - DNA, 22 bp, Homo sapiens
tggaaagatgaagatgtttaag

SEQ ID NO: 8393259 - DNA, 21 bp, Homo sapiens
tggaaagattcaaagaccagg

SEQ ID NO: 8393260 - DNA, 22 bp, Homo sapiens
tggaaacaggagaatatcttct

SEQ ID NO: 8393261 - DNA, 22 bp, Homo sapiens
tggaaacacccacgcatgcata

SEQ ID NO: 8393262 - DNA, 22 bp, Homo sapiens
tggaaacactgcatgttcaccc

SEQ ID NO: 8393263 - DNA, 22 bp, Homo sapiens
tggaaacactcaagcttatatt

SEQ ID NO: 8393264 - DNA, 22 bp, Homo sapiens
tggaaacactcaagcttatatt

SEQ ID NO: 8393265 - DNA, 19 bp, Homo sapiens
tggaaaatggattgaatca

SEQ ID NO: 8393266 - DNA, 22 bp, Homo sapiens
tggaaacaaagtcataagctca

SEQ ID NO: 8393267 - DNA, 22 bp, Homo sapiens
tggaaacaaagctggatgtagt

SEQ ID NO: 8393268 - DNA, 22 bp, Homo sapiens
tggaaaattagtagtgaaaggc

SEQ ID NO: 8393269 - DNA, 22 bp, Homo sapiens
tggaacactgtggatgagaaga

SEQ ID NO: 8393270 - DNA, 23 bp, Homo sapiens
tggaagaaaatggtttggctgtg

SEQ ID NO: 8393271 - DNA, 22 bp, Homo sapiens
tggaaatttatcaagatataca

SEQ ID NO: 8393272 - DNA, 22 bp, Homo sapiens
tggaaatattgggtaatagttg

SEQ ID NO: 8393273 - DNA, 19 bp, Homo sapiens
tggaaatggaagctcagcc

SEQ ID NO: 8393274 - DNA, 19 bp, Homo sapiens
tggaaatggaagctcagcc

SEQ ID NO: 8393275 - DNA, 22 bp, Homo sapiens
tggaaatagatagtatcattca

SEQ ID NO: 8393276 - DNA, 22 bp, Homo sapiens
tggaaatatgctccattctttt

SEQ ID NO: 8393277 - DNA, 22 bp, Homo sapiens
tggaaagcagttcttagaatcg

SEQ ID NO: 8393278 - DNA, 22 bp, Homo sapiens
tggaaatacttgccataaaact

SEQ ID NO: 8393279 - DNA, 22 bp, Homo sapiens
tggaaaggtgtaaagcagaacc

SEQ ID NO: 8393280 - DNA, 22 bp, Homo sapiens
tgctttatcaaagctatagtga

SEQ ID NO: 8393281 - DNA, 22 bp, Homo sapiens
tgctttatcaaagctatagtga

SEQ ID NO: 8393282 - DNA, 21 bp, Homo sapiens
tgctttatgggaaaaatgtca

SEQ ID NO: 8393283 - DNA, 18 bp, Homo sapiens
tgctttatgcttatataa

SEQ ID NO: 8393284 - DNA, 22 bp, Homo sapiens
tgctttctgtttttcatataat

SEQ ID NO: 8393285 - DNA, 22 bp, Homo sapiens
tgctttattcgacatctggtag

SEQ ID NO: 8393286 - DNA, 22 bp, Homo sapiens
tgctttattcccttctgatgtg

SEQ ID NO: 8393287 - DNA, 19 bp, Homo sapiens
tgctttctaaacacatgca

SEQ ID NO: 8393288 - DNA, 22 bp, Homo sapiens
tgcttctgtttcattgatctta

SEQ ID NO: 8393289 - DNA, 22 bp, Homo sapiens
tgcttctttatgatgtatgatt

SEQ ID NO: 8393290 - DNA, 22 bp, Homo sapiens
tgcttctttactataggcaatt

SEQ ID NO: 8393291 - DNA, 22 bp, Homo sapiens
tgcttctttactataggcaatt

SEQ ID NO: 8393292 - DNA, 22 bp, Homo sapiens
tgcttctttaaatgatagtcaa

SEQ ID NO: 8393293 - DNA, 22 bp, Homo sapiens
tgcttctttactataggcaatt

SEQ ID NO: 8393294 - DNA, 22 bp, Homo sapiens
tgcttctgtattttgggcttga

SEQ ID NO: 8393295 - DNA, 22 bp, Homo sapiens
tgcttctgtattttgggcttga

SEQ ID NO: 8393296 - DNA, 22 bp, Homo sapiens
tgcttctgtctcttatgccttg

SEQ ID NO: 8393297 - DNA, 22 bp, Homo sapiens
tgcttctgttacataccagaac

SEQ ID NO: 8393298 - DNA, 22 bp, Homo sapiens
tgcttctgttctttcacctacg

SEQ ID NO: 8393299 - DNA, 19 bp, Homo sapiens
tgcttctggggcttctcca

SEQ ID NO: 8393300 - DNA, 22 bp, Homo sapiens
tgcttctggggacaggctgcct

SEQ ID NO: 8393301 - DNA, 22 bp, Homo sapiens
tgcttctggggacaggctgcct

SEQ ID NO: 8393302 - DNA, 22 bp, Homo sapiens
tgcttctggcttatctcgtgcc

SEQ ID NO: 8393303 - DNA, 22 bp, Homo sapiens
tgcttctgggcctggtgttccc

SEQ ID NO: 8393304 - DNA, 22 bp, Homo sapiens
tgcttctggcacttgagggggt

SEQ ID NO: 8393305 - DNA, 22 bp, Homo sapiens
tgcttctggaaacagtggctgt

SEQ ID NO: 8393306 - DNA, 22 bp, Homo sapiens
tgcttctgctttacttggttca

SEQ ID NO: 8393307 - DNA, 19 bp, Homo sapiens
tgcttctggaaccatgatc

SEQ ID NO: 8393308 - DNA, 22 bp, Homo sapiens
tgcttctggaaacagtggctgt

SEQ ID NO: 8393309 - DNA, 22 bp, Homo sapiens
tgcttgtgagagttttttcaga

SEQ ID NO: 8393310 - DNA, 19 bp, Homo sapiens
tgcttgaggtgtgctagag

SEQ ID NO: 8393311 - DNA, 22 bp, Homo sapiens
tggactcccagagctgctctcc

SEQ ID NO: 8393312 - DNA, 22 bp, Homo sapiens
tggactgggctaatggcagaca

SEQ ID NO: 8393313 - DNA, 22 bp, Homo sapiens
tggactggaatgctgatcctct

SEQ ID NO: 8393314 - DNA, 22 bp, Homo sapiens
tggactgaagttacagatgaca

SEQ ID NO: 8393315 - DNA, 22 bp, Homo sapiens
tggactcttggaccttctctaa

SEQ ID NO: 8393316 - DNA, 22 bp, Homo sapiens
tggactgagcttgagagggttg

SEQ ID NO: 8393317 - DNA, 22 bp, Homo sapiens
tggactgaattgaagcaggaag

SEQ ID NO: 8393318 - DNA, 22 bp, Homo sapiens
tggactctgaactggcactgac

SEQ ID NO: 8393319 - DNA, 22 bp, Homo sapiens
tggactctatgatgcgccagca

SEQ ID NO: 8393320 - DNA, 22 bp, Homo sapiens
tggacccaggcaggtctgtcct

SEQ ID NO: 8393321 - DNA, 22 bp, Homo sapiens
tggaccagctcctcgggagacg

SEQ ID NO: 8393322 - DNA, 21 bp, Homo sapiens
tggaccaggaaggtggtggtg

SEQ ID NO: 8393323 - DNA, 22 bp, Homo sapiens
tggaccagcagccccagtgcct

SEQ ID NO: 8393324 - DNA, 22 bp, Homo sapiens
tggaccagcagccccagtgcct

SEQ ID NO: 8393325 - DNA, 22 bp, Homo sapiens
tggacccaccccagggcctgct

SEQ ID NO: 8393326 - DNA, 22 bp, Homo sapiens
tggaccagggtcccagagtatg

SEQ ID NO: 8393327 - DNA, 18 bp, Homo sapiens
tggacagggtggagaaaa

SEQ ID NO: 8393328 - DNA, 22 bp, Homo sapiens
tggacagaaacccgagtgatct

SEQ ID NO: 8393329 - DNA, 22 bp, Homo sapiens
tggacagagctgacagtatata

SEQ ID NO: 8393330 - DNA, 22 bp, Homo sapiens
tggacagcaaacatggagagaa

SEQ ID NO: 8393331 - DNA, 22 bp, Homo sapiens
tggacagagaggaaggccattt

SEQ ID NO: 8393332 - DNA, 22 bp, Homo sapiens
tggacagagaggaaggccattt

SEQ ID NO: 8393333 - DNA, 22 bp, Homo sapiens
tggacagcgaaagtgcctggga

SEQ ID NO: 8393334 - DNA, 22 bp, Homo sapiens
tggacagccatgcaaatgagct

SEQ ID NO: 8393335 - DNA, 22 bp, Homo sapiens
tggacaggatagtgcagtacgc

SEQ ID NO: 8393336 - DNA, 22 bp, Homo sapiens
tggaagagcaggcagacaatgc

SEQ ID NO: 8393337 - DNA, 22 bp, Homo sapiens
tggaagagcaggcagacaatgc

SEQ ID NO: 8393338 - DNA, 19 bp, Homo sapiens
tggaagaggaagggaaata

SEQ ID NO: 8393339 - DNA, 22 bp, Homo sapiens
tggaagaggtggaagtggcttc

SEQ ID NO: 8393340 - DNA, 22 bp, Homo sapiens
tggaagatcaaccaggattgac

SEQ ID NO: 8393341 - DNA, 22 bp, Homo sapiens
tggaagaggcccatgactgcct

SEQ ID NO: 8393342 - DNA, 18 bp, Homo sapiens
tggaagctggtgagcaga

SEQ ID NO: 8393343 - DNA, 22 bp, Homo sapiens
tggaaggaaaggtagcagagaa

SEQ ID NO: 8393344 - DNA, 22 bp, Homo sapiens
tggaagcactgaagagacaacc

SEQ ID NO: 8393345 - DNA, 23 bp, Homo sapiens
tggaagcaatcactgtagtgaat

SEQ ID NO: 8393346 - DNA, 22 bp, Homo sapiens
tggaagcagagagctatcacca

SEQ ID NO: 8393347 - DNA, 22 bp, Homo sapiens
tggaagcagcattaatgagtta

SEQ ID NO: 8393348 - DNA, 22 bp, Homo sapiens
tggaagcagtgattcttgtctg

SEQ ID NO: 8393349 - DNA, 22 bp, Homo sapiens
tggaagccaaggtcagaaggag

SEQ ID NO: 8393350 - DNA, 22 bp, Homo sapiens
tggaagtccctgtgtgtggcct

SEQ ID NO: 8393351 - DNA, 19 bp, Homo sapiens
tggaatcagcaagaatatt

SEQ ID NO: 8393352 - DNA, 23 bp, Homo sapiens
tggaatcagccttttttccaagg

SEQ ID NO: 8393353 - DNA, 22 bp, Homo sapiens
tggaaggggagctggaaagggg

SEQ ID NO: 8393354 - DNA, 22 bp, Homo sapiens
tggaaggcaacggagtgagctg

SEQ ID NO: 8393355 - DNA, 22 bp, Homo sapiens
tggaaggagactgggaagtgtg

SEQ ID NO: 8393356 - DNA, 22 bp, Homo sapiens
tggaaggaagccaaggaaggtt

SEQ ID NO: 8393357 - DNA, 22 bp, Homo sapiens
tgccttggtttccccatctgta

SEQ ID NO: 8393358 - DNA, 22 bp, Homo sapiens
tgcctgtgtatgtgcatgcaca

SEQ ID NO: 8393359 - DNA, 22 bp, Homo sapiens
tgcctgtggaaaggctggtgct

SEQ ID NO: 8393360 - DNA, 22 bp, Homo sapiens
tgccttcttgaatatggttctt

SEQ ID NO: 8393361 - DNA, 22 bp, Homo sapiens
tgcctgggctcggtagccatcg

SEQ ID NO: 8393362 - DNA, 22 bp, Homo sapiens
tgcctgggtccaggccaagcct

SEQ ID NO: 8393363 - DNA, 22 bp, Homo sapiens
tgcctggctgggctgctcatgg

SEQ ID NO: 8393364 - DNA, 22 bp, Homo sapiens
tgcctggctgaggtgacaggtt

SEQ ID NO: 8393365 - DNA, 22 bp, Homo sapiens
tgcctggctctatcagtggtgg

SEQ ID NO: 8393366 - DNA, 21 bp, Homo sapiens
tgcctggcctttgcttttcct

SEQ ID NO: 8393367 - DNA, 21 bp, Homo sapiens
tgcctggcctttgcttttcct

SEQ ID NO: 8393368 - DNA, 20 bp, Homo sapiens
tgcctggcctttctctgccc

SEQ ID NO: 8393369 - DNA, 22 bp, Homo sapiens
tgcctggccctgacagccctgg

SEQ ID NO: 8393370 - DNA, 22 bp, Homo sapiens
tgcctgggttgactcttagctg

SEQ ID NO: 8393371 - DNA, 22 bp, Homo sapiens
tgcctgtgacccaaggatgcga

SEQ ID NO: 8393372 - DNA, 22 bp, Homo sapiens
tgcctgtcttcaggagtgtcac

SEQ ID NO: 8393373 - DNA, 19 bp, Homo sapiens
tgctcagctcctgtgagtc

SEQ ID NO: 8393374 - DNA, 22 bp, Homo sapiens
tgctcagagctccagctctcct

SEQ ID NO: 8393375 - DNA, 22 bp, Homo sapiens
tgctcacaggtgaccctgggca

SEQ ID NO: 8393376 - DNA, 22 bp, Homo sapiens
tgctcactctattcacagtgcc

SEQ ID NO: 8393377 - DNA, 22 bp, Homo sapiens
tgctcaagtgtttgttgaatgg

SEQ ID NO: 8393378 - DNA, 22 bp, Homo sapiens
tgctcacaattatcagaagtat

SEQ ID NO: 8393379 - DNA, 22 bp, Homo sapiens
tgctccagcaacaggcttagct

SEQ ID NO: 8393380 - DNA, 22 bp, Homo sapiens
tgctccagaacctgaccatgct

SEQ ID NO: 8393381 - DNA, 22 bp, Homo sapiens
tgctcatcaacatgatgatcat

SEQ ID NO: 8393382 - DNA, 22 bp, Homo sapiens
tgctcagtgagtctgtgacagg

SEQ ID NO: 8393383 - DNA, 19 bp, Homo sapiens
tgctcagtggctaaaagca

SEQ ID NO: 8393384 - DNA, 22 bp, Homo sapiens
tgctcagttcaaggaaggtgga

SEQ ID NO: 8393385 - DNA, 22 bp, Homo sapiens
tgctcagtagcagtgtgctgct

SEQ ID NO: 8393386 - DNA, 22 bp, Homo sapiens
tgctcagtcctcctgcagtgcc

SEQ ID NO: 8393387 - DNA, 22 bp, Homo sapiens
tgctaaagcaaactgtgctact

SEQ ID NO: 8393388 - DNA, 22 bp, Homo sapiens
tgcgcggctcagtcatctccag

SEQ ID NO: 8393389 - DNA, 22 bp, Homo sapiens
tgcgcctctaatctcgggcgtc

SEQ ID NO: 8393390 - DNA, 22 bp, Homo sapiens
tgcgcccagccaagtctggcac

SEQ ID NO: 8393391 - DNA, 22 bp, Homo sapiens
tgctatttggcacttttgacct

SEQ ID NO: 8393392 - DNA, 19 bp, Homo sapiens
tgctatttagaacgcctgg

SEQ ID NO: 8393393 - DNA, 22 bp, Homo sapiens
tgctatttctatctcatttaaa

SEQ ID NO: 8393394 - DNA, 22 bp, Homo sapiens
tgctatttctatctcatttaaa

SEQ ID NO: 8393395 - DNA, 22 bp, Homo sapiens
tgctatttctctgctgtaaaat

SEQ ID NO: 8393396 - DNA, 22 bp, Homo sapiens
tgctatttgggggctacatgat

SEQ ID NO: 8393397 - DNA, 22 bp, Homo sapiens
tgctatttttatcttgatcaaa

SEQ ID NO: 8393398 - DNA, 22 bp, Homo sapiens
tgctatttaacttttatgtgta

SEQ ID NO: 8393399 - DNA, 22 bp, Homo sapiens
tgctataagaattatattactc

SEQ ID NO: 8393400 - DNA, 22 bp, Homo sapiens
tgctagtgtgtgagatgttcaa

SEQ ID NO: 8393401 - DNA, 22 bp, Homo sapiens
tgctaactattcctaaagatca

SEQ ID NO: 8393402 - DNA, 22 bp, Homo sapiens
tgctataagagtcacttttcct

SEQ ID NO: 8393403 - DNA, 22 bp, Homo sapiens
tgctcctgctgcatgcatctcc

SEQ ID NO: 8393404 - DNA, 22 bp, Homo sapiens
tgctcctgagcggtttccatga

SEQ ID NO: 8393405 - DNA, 22 bp, Homo sapiens
tgctcctgagcggtttccatga

SEQ ID NO: 8393406 - DNA, 22 bp, Homo sapiens
tgctcctatcctcctgctgaca

SEQ ID NO: 8393407 - DNA, 22 bp, Homo sapiens
tgctccctgctcagagaggcca

SEQ ID NO: 8393408 - DNA, 22 bp, Homo sapiens
tgctcccaggcattctctgttg

SEQ ID NO: 8393409 - DNA, 22 bp, Homo sapiens
tgctcccaggactcttgagcca

SEQ ID NO: 8393410 - DNA, 20 bp, Homo sapiens
tgctccaggaacactggccg

SEQ ID NO: 8393411 - DNA, 22 bp, Homo sapiens
tgctccagggcctccagtgggg

SEQ ID NO: 8393412 - DNA, 21 bp, Homo sapiens
tgctccagggcagcttccagc

SEQ ID NO: 8393413 - DNA, 22 bp, Homo sapiens
tgctccaggccgcctggggctg

SEQ ID NO: 8393414 - DNA, 18 bp, Homo sapiens
tgctccaggcccatgggc

SEQ ID NO: 8393415 - DNA, 22 bp, Homo sapiens
tgctcctgggctgaagcacact

SEQ ID NO: 8393416 - DNA, 17 bp, Homo sapiens
tgctcctgtggcagcct

SEQ ID NO: 8393417 - DNA, 22 bp, Homo sapiens
tgctcctgtttcatcagctata

SEQ ID NO: 8393418 - DNA, 22 bp, Homo sapiens
tgctcctgtttcatcagctata

SEQ ID NO: 8393419 - DNA, 22 bp, Homo sapiens
tgctccttcccttcccagtgag

SEQ ID NO: 8393420 - DNA, 21 bp, Homo sapiens
tgctcctttaccccacaagac

SEQ ID NO: 8393421 - DNA, 22 bp, Homo sapiens
tgctcgaggtccccaccggctc

SEQ ID NO: 8393422 - DNA, 22 bp, Homo sapiens
tgctctagccattgacctagct

SEQ ID NO: 8393423 - DNA, 22 bp, Homo sapiens
tgctctagctcataggactcat

SEQ ID NO: 8393424 - DNA, 22 bp, Homo sapiens
tgctctggggagctcctctgcg

SEQ ID NO: 8393425 - DNA, 22 bp, Homo sapiens
tgctctggggagctcctctgcg

SEQ ID NO: 8393426 - DNA, 22 bp, Homo sapiens
tgctctggctgggatgagtgca

SEQ ID NO: 8393427 - DNA, 22 bp, Homo sapiens
tgctctcagagtcaggaggtaa

SEQ ID NO: 8393428 - DNA, 22 bp, Homo sapiens
tgctgaggtcatttccaagtga

SEQ ID NO: 8393429 - DNA, 22 bp, Homo sapiens
tgctctgtcaagaaaagatgcc

SEQ ID NO: 8393430 - DNA, 22 bp, Homo sapiens
tgctctgtaggggaaagagagc

SEQ ID NO: 8393431 - DNA, 22 bp, Homo sapiens
tgctcttcaccattacatcatg

SEQ ID NO: 8393432 - DNA, 17 bp, Homo sapiens
tgctctgtggtctttta

SEQ ID NO: 8393433 - DNA, 18 bp, Homo sapiens
tgctctgtttaatgattt

SEQ ID NO: 8393434 - DNA, 22 bp, Homo sapiens
tgctgaaaactcaaccattgtg

SEQ ID NO: 8393435 - DNA, 22 bp, Homo sapiens
tgctgaaagaccgtatttatct

SEQ ID NO: 8393436 - DNA, 21 bp, Homo sapiens
tgctgagatttgcctgattac

SEQ ID NO: 8393437 - DNA, 22 bp, Homo sapiens
tgctgctctgtaaagtgatgag

SEQ ID NO: 8393438 - DNA, 22 bp, Homo sapiens
tgctgctctggccaggaactgc

SEQ ID NO: 8393439 - DNA, 22 bp, Homo sapiens
tgctgctgacatttggggcttg

SEQ ID NO: 8393440 - DNA, 21 bp, Homo sapiens
tgctgctgatcggggttggct

SEQ ID NO: 8393441 - DNA, 22 bp, Homo sapiens
tgctgcctccttcctgccagga

SEQ ID NO: 8393442 - DNA, 22 bp, Homo sapiens
tgctgcctaataagtcgagggt

SEQ ID NO: 8393443 - DNA, 23 bp, Homo sapiens
tgctgcccactcttccagccctc

SEQ ID NO: 8393444 - DNA, 23 bp, Homo sapiens
tgctgccaagcacgagttgagtt

SEQ ID NO: 8393445 - DNA, 22 bp, Homo sapiens
tgctgccaaatgcgagctctgt

SEQ ID NO: 8393446 - DNA, 22 bp, Homo sapiens
tgctgccacctgtggtagtctg

SEQ ID NO: 8393447 - DNA, 22 bp, Homo sapiens
tgctgccagccaggccatggag

SEQ ID NO: 8393448 - DNA, 19 bp, Homo sapiens
tgctgctgtccttgcaggg

SEQ ID NO: 8393449 - DNA, 19 bp, Homo sapiens
tgctgcttccagctcactc

SEQ ID NO: 8393450 - DNA, 22 bp, Homo sapiens
tgctgcttggaaatggggctga

SEQ ID NO: 8393451 - DNA, 20 bp, Homo sapiens
tgctgctttgccactagttg

SEQ ID NO: 8393452 - DNA, 22 bp, Homo sapiens
tgctggagaagctcctgggact

SEQ ID NO: 8393453 - DNA, 22 bp, Homo sapiens
tgctggaggccagaagtctgag

SEQ ID NO: 8393454 - DNA, 22 bp, Homo sapiens
tgctggcatcttaatgttctgt

SEQ ID NO: 8393455 - DNA, 20 bp, Homo sapiens
tgctggcatgcaagagggaa

SEQ ID NO: 8393456 - DNA, 22 bp, Homo sapiens
tgctggcatggtcttggtgaca

SEQ ID NO: 8393457 - DNA, 22 bp, Homo sapiens
tgctggcagccatgccttggaa

SEQ ID NO: 8393458 - DNA, 22 bp, Homo sapiens
tgctggcacgtgactgggaagt

SEQ ID NO: 8393459 - DNA, 22 bp, Homo sapiens
tgctggcagaaggctcgtggaa

SEQ ID NO: 8393460 - DNA, 20 bp, Homo sapiens
tgctggcacgggtggactcc

SEQ ID NO: 8393461 - DNA, 22 bp, Homo sapiens
tgctggcacgaaagggtgtcca

SEQ ID NO: 8393462 - DNA, 23 bp, Homo sapiens
tgctggagtttactcaggccagc

SEQ ID NO: 8393463 - DNA, 22 bp, Homo sapiens
tgctggctctaggctgagacag

SEQ ID NO: 8393464 - DNA, 22 bp, Homo sapiens
tgctggctctgggccaagcagg

SEQ ID NO: 8393465 - DNA, 22 bp, Homo sapiens
tgctggctcccaggagccgctg

SEQ ID NO: 8393466 - DNA, 22 bp, Homo sapiens
tgctggctgaggcctgagcggg

SEQ ID NO: 8393467 - DNA, 22 bp, Homo sapiens
tgctggctgaggcctgagcggg

SEQ ID NO: 8393468 - DNA, 23 bp, Homo sapiens
tgctggctgaaacagccaaagga

SEQ ID NO: 8393469 - DNA, 21 bp, Homo sapiens
tgctggctgaaaggcacagag

SEQ ID NO: 8393470 - DNA, 22 bp, Homo sapiens
tgctggctccaacctggcatct

SEQ ID NO: 8393471 - DNA, 22 bp, Homo sapiens
tgctggctatttaaagaagaaa

SEQ ID NO: 8393472 - DNA, 22 bp, Homo sapiens
tgctggctcagtttgcagactc

SEQ ID NO: 8393473 - DNA, 22 bp, Homo sapiens
tgctggctactgatggcaggcc

SEQ ID NO: 8393474 - DNA, 23 bp, Homo sapiens
tgctggcttccagctgctccctc

SEQ ID NO: 8393475 - DNA, 22 bp, Homo sapiens
tgctggcttatttagtaaatgt

SEQ ID NO: 8393476 - DNA, 22 bp, Homo sapiens
tgctggctgttctagggaggcc

SEQ ID NO: 8393477 - DNA, 23 bp, Homo sapiens
tgctggctgtgttattgccaaca

SEQ ID NO: 8393478 - DNA, 22 bp, Homo sapiens
tgctggctgtccctacctggct

SEQ ID NO: 8393479 - DNA, 22 bp, Homo sapiens
tgctggctgcagtgctgtcaaa

SEQ ID NO: 8393480 - DNA, 22 bp, Homo sapiens
tgctggctgccaggttccctgt

SEQ ID NO: 8393481 - DNA, 22 bp, Homo sapiens
tgctggctgtatatgtgagagt

SEQ ID NO: 8393482 - DNA, 22 bp, Homo sapiens
tgctggctgtatatgtgagagt

SEQ ID NO: 8393483 - DNA, 22 bp, Homo sapiens
tgctggctggcctggcctggac

SEQ ID NO: 8393484 - DNA, 22 bp, Homo sapiens
tgctggctgggctgctggagac

SEQ ID NO: 8393485 - DNA, 23 bp, Homo sapiens
tgctggtgtttttgggaccaggg

SEQ ID NO: 8393486 - DNA, 23 bp, Homo sapiens
tgctgtccaacagactggccatg

SEQ ID NO: 8393487 - DNA, 23 bp, Homo sapiens
tgctgtccaacagactggccatg

SEQ ID NO: 8393488 - DNA, 23 bp, Homo sapiens
tgctgtccaacagactggccatg

SEQ ID NO: 8393489 - DNA, 22 bp, Homo sapiens
tgctgtcaagaaaacaagcaat

SEQ ID NO: 8393490 - DNA, 22 bp, Homo sapiens
tgctggtggagaaagtggaggt

SEQ ID NO: 8393491 - DNA, 21 bp, Homo sapiens
tgctggtgagctcatgtggct

SEQ ID NO: 8393492 - DNA, 22 bp, Homo sapiens
tgctgggtggttgctcctcccg

SEQ ID NO: 8393493 - DNA, 22 bp, Homo sapiens
tgctggtcccctgcagcctgtg

SEQ ID NO: 8393494 - DNA, 20 bp, Homo sapiens
tgctgggcatgcagtggaaa

SEQ ID NO: 8393495 - DNA, 22 bp, Homo sapiens
tgctggcttcctgtgcacagca

SEQ ID NO: 8393496 - DNA, 22 bp, Homo sapiens
tgctggcttcctgtgcacagca

SEQ ID NO: 8393497 - DNA, 22 bp, Homo sapiens
tgctgggcccccagtgaccttc

SEQ ID NO: 8393498 - DNA, 22 bp, Homo sapiens
tgctgggcccccagtgaccttc

SEQ ID NO: 8393499 - DNA, 20 bp, Homo sapiens
tgctgggccatcttgcatgc

SEQ ID NO: 8393500 - DNA, 22 bp, Homo sapiens
tgctgggcccagggagcctctg

SEQ ID NO: 8393501 - DNA, 22 bp, Homo sapiens
tgctgggcccagggagcctctg

SEQ ID NO: 8393502 - DNA, 22 bp, Homo sapiens
tgctgggcatttttatggctcc

SEQ ID NO: 8393503 - DNA, 22 bp, Homo sapiens
tgctgggctgcacccccagagt

SEQ ID NO: 8393504 - DNA, 22 bp, Homo sapiens
tgctgggctggagctgccaggg

SEQ ID NO: 8393505 - DNA, 22 bp, Homo sapiens
tgctgggcttcaactgcctgag

SEQ ID NO: 8393506 - DNA, 22 bp, Homo sapiens
tgctgggctgttcctgtccatg

SEQ ID NO: 8393507 - DNA, 22 bp, Homo sapiens
tgctgggctgttcctgtccatg

SEQ ID NO: 8393508 - DNA, 22 bp, Homo sapiens
tgctgggctcaacctccagagc

SEQ ID NO: 8393509 - DNA, 22 bp, Homo sapiens
tgctgggctagaagctgaggcc

SEQ ID NO: 8393510 - DNA, 22 bp, Homo sapiens
tgctgggcctgcccctgtcagc

SEQ ID NO: 8393511 - DNA, 22 bp, Homo sapiens
tgctgggcctttacctccaggg

SEQ ID NO: 8393512 - DNA, 22 bp, Homo sapiens
tgcttctcccaaccagggcctg

SEQ ID NO: 8393513 - DNA, 22 bp, Homo sapiens
tgcttccctgaaggcacaggag

SEQ ID NO: 8393514 - DNA, 22 bp, Homo sapiens
tgcttccctcacttcacctggc

SEQ ID NO: 8393515 - DNA, 22 bp, Homo sapiens
tgcttcccaaggtttcatgtgc

SEQ ID NO: 8393516 - DNA, 22 bp, Homo sapiens
tgcttctcaaagaagcataatg

SEQ ID NO: 8393517 - DNA, 22 bp, Homo sapiens
tgcttctgactaagctgcatga

SEQ ID NO: 8393518 - DNA, 22 bp, Homo sapiens
tgcttctgacatgttcttggtt

SEQ ID NO: 8393519 - DNA, 22 bp, Homo sapiens
tgcttctgaaatgcaggtcttc

SEQ ID NO: 8393520 - DNA, 22 bp, Homo sapiens
tgcttctgaactcagcatgtgg

SEQ ID NO: 8393521 - DNA, 22 bp, Homo sapiens
tgcttctgcaggagctcctgat

SEQ ID NO: 8393522 - DNA, 22 bp, Homo sapiens
tgcttctgctcagcttcctact

SEQ ID NO: 8393523 - DNA, 22 bp, Homo sapiens
tgcttctgcaggagctcctgat

SEQ ID NO: 8393524 - DNA, 22 bp, Homo sapiens
tgcttccagcatccctggcctg

SEQ ID NO: 8393525 - DNA, 22 bp, Homo sapiens
tgcttcagcactttgagagcct

SEQ ID NO: 8393526 - DNA, 22 bp, Homo sapiens
tgcttcagtcctatgggcaggt

SEQ ID NO: 8393527 - DNA, 22 bp, Homo sapiens
tgcttcagtcctatgggcaggt

SEQ ID NO: 8393528 - DNA, 22 bp, Homo sapiens
tgcttatttaggtagatattaa

SEQ ID NO: 8393529 - DNA, 22 bp, Homo sapiens
tgcttattgctttcaagactgt

SEQ ID NO: 8393530 - DNA, 22 bp, Homo sapiens
tgcttattctttccacaattca

SEQ ID NO: 8393531 - DNA, 22 bp, Homo sapiens
tgcttattctttccacaattca

SEQ ID NO: 8393532 - DNA, 22 bp, Homo sapiens
tgcttattaaacatgcatattc

SEQ ID NO: 8393533 - DNA, 22 bp, Homo sapiens
tgcttattaaacatgcatattc

SEQ ID NO: 8393534 - DNA, 22 bp, Homo sapiens
tgcttcagcactttgagagcct

SEQ ID NO: 8393535 - DNA, 22 bp, Homo sapiens
tgcttaaaaagctccatcaata

SEQ ID NO: 8393536 - DNA, 22 bp, Homo sapiens
tgcttaaaaacagtatggtagt

SEQ ID NO: 8393537 - DNA, 22 bp, Homo sapiens
tgcttaaaaagtaactgctgat

SEQ ID NO: 8393538 - DNA, 22 bp, Homo sapiens
tgcttaaaatagttcatttttg

SEQ ID NO: 8393539 - DNA, 22 bp, Homo sapiens
tgcttaaaatgatgattatttt

SEQ ID NO: 8393540 - DNA, 22 bp, Homo sapiens
tgcttaaaatagttcatttttg

SEQ ID NO: 8393541 - DNA, 22 bp, Homo sapiens
tgcttaaaatgatgattatttt

SEQ ID NO: 8393542 - DNA, 22 bp, Homo sapiens
tgctgtcctgctgagggatgtg

SEQ ID NO: 8393543 - DNA, 22 bp, Homo sapiens
tgctgtcctgttttggagtaat

SEQ ID NO: 8393544 - DNA, 22 bp, Homo sapiens
tgctgtctgcaacagtactaca

SEQ ID NO: 8393545 - DNA, 22 bp, Homo sapiens
tgctgtcttttcccaatcctgg

SEQ ID NO: 8393546 - DNA, 22 bp, Homo sapiens
tgctgtcttttcccaatcctgg

SEQ ID NO: 8393547 - DNA, 22 bp, Homo sapiens
tgctgtcttttcccaatcctgg

SEQ ID NO: 8393548 - DNA, 22 bp, Homo sapiens
tgcttaaacatccagacagtat

SEQ ID NO: 8393549 - DNA, 22 bp, Homo sapiens
tgcttaaaccctgatcatgtgt

SEQ ID NO: 8393550 - DNA, 22 bp, Homo sapiens
tgcttaaaccctgatcatgtgt

SEQ ID NO: 8393551 - DNA, 22 bp, Homo sapiens
tgcttaaagtagtggattgtta

SEQ ID NO: 8393552 - DNA, 22 bp, Homo sapiens
tgcttaaaggatagtttaaact

SEQ ID NO: 8393553 - DNA, 22 bp, Homo sapiens
tgcttaaagctgctcagttgta

SEQ ID NO: 8393554 - DNA, 22 bp, Homo sapiens
tgcttaaacatactatttatat

SEQ ID NO: 8393555 - DNA, 22 bp, Homo sapiens
tgcttaaacatactatttatat

SEQ ID NO: 8393556 - DNA, 22 bp, Homo sapiens
tgcttaaacatccagacagtat

SEQ ID NO: 8393557 - DNA, 22 bp, Homo sapiens
tgcttaaacacatacatacata

SEQ ID NO: 8393558 - DNA, 22 bp, Homo sapiens
tgcttaaacacatacatacata

SEQ ID NO: 8393559 - DNA, 22 bp, Homo sapiens
tgcttaaacacatacatacata

SEQ ID NO: 8393560 - DNA, 22 bp, Homo sapiens
tgcttaatcaagaagcctattt

SEQ ID NO: 8393561 - DNA, 22 bp, Homo sapiens
tgcttaataggagttgaacatt

SEQ ID NO: 8393562 - DNA, 22 bp, Homo sapiens
tgcttacattgcatctgtgcct

SEQ ID NO: 8393563 - DNA, 18 bp, Homo sapiens
tgcttacaggagttcctg

SEQ ID NO: 8393564 - DNA, 22 bp, Homo sapiens
tgcttataatgttactgacaac

SEQ ID NO: 8393565 - DNA, 22 bp, Homo sapiens
tggctgagtgttccaaggagca

SEQ ID NO: 8393566 - DNA, 21 bp, Homo sapiens
tggctgcaagcagctgcctcc

SEQ ID NO: 8393567 - DNA, 22 bp, Homo sapiens
tggctgcagtgcttgagatgtc

SEQ ID NO: 8393568 - DNA, 22 bp, Homo sapiens
tggctgctgcagacagacagga

SEQ ID NO: 8393569 - DNA, 22 bp, Homo sapiens
tggctggaatatgtggagacca

SEQ ID NO: 8393570 - DNA, 22 bp, Homo sapiens
tggctggaagtcagaaatggga

SEQ ID NO: 8393571 - DNA, 22 bp, Homo sapiens
tggctggaagtcagaaatggga

SEQ ID NO: 8393572 - DNA, 19 bp, Homo sapiens
tggctctttttatgacatt

SEQ ID NO: 8393573 - DNA, 22 bp, Homo sapiens
tggctcttttcacgtcccctct

SEQ ID NO: 8393574 - DNA, 22 bp, Homo sapiens
tggctgaatctgcagcaggaag

SEQ ID NO: 8393575 - DNA, 22 bp, Homo sapiens
tggctgacaaataggtgcagtt

SEQ ID NO: 8393576 - DNA, 22 bp, Homo sapiens
tggctgacaatgtagcagtaac

SEQ ID NO: 8393577 - DNA, 22 bp, Homo sapiens
tggctgaggagggtcttctggt

SEQ ID NO: 8393578 - DNA, 22 bp, Homo sapiens
tggctctggggacagtaagtcc

SEQ ID NO: 8393579 - DNA, 23 bp, Homo sapiens
tggctctgtggatccctcaggag

SEQ ID NO: 8393580 - DNA, 23 bp, Homo sapiens
tggctctgtggatccctcaggag

SEQ ID NO: 8393581 - DNA, 22 bp, Homo sapiens
tggctctggcgtgaagcccaga

SEQ ID NO: 8393582 - DNA, 22 bp, Homo sapiens
tggctctggattaatctaggaa

SEQ ID NO: 8393583 - DNA, 22 bp, Homo sapiens
tggctctggagctggcggctga

SEQ ID NO: 8393584 - DNA, 22 bp, Homo sapiens
tggctctggattaatctaggaa

SEQ ID NO: 8393585 - DNA, 22 bp, Homo sapiens
tggctctgttgctcgcagtttt

SEQ ID NO: 8393586 - DNA, 22 bp, Homo sapiens
tggctctgttcgccatcaggag

SEQ ID NO: 8393587 - DNA, 22 bp, Homo sapiens
tggctctgttcgccatcaggag

SEQ ID NO: 8393588 - DNA, 22 bp, Homo sapiens
tggctctgttcgccatcaggag

SEQ ID NO: 8393589 - DNA, 23 bp, Homo sapiens
tggctctgtgtcacatacaggat

SEQ ID NO: 8393590 - DNA, 23 bp, Homo sapiens
tggctctgtgtcacatacaggat

SEQ ID NO: 8393591 - DNA, 22 bp, Homo sapiens
tggctctgtgtctcccagcagc

SEQ ID NO: 8393592 - DNA, 22 bp, Homo sapiens
tggctcttaaggtccctgtgct

SEQ ID NO: 8393593 - DNA, 22 bp, Homo sapiens
tggctcttgcttacgaaggtta

SEQ ID NO: 8393594 - DNA, 22 bp, Homo sapiens
tggctcttctcaagcattggct

SEQ ID NO: 8393595 - DNA, 22 bp, Homo sapiens
tggctcttggtgctagtttctg

SEQ ID NO: 8393596 - DNA, 19 bp, Homo sapiens
tggctcttgtgggactgca

SEQ ID NO: 8393597 - DNA, 22 bp, Homo sapiens
tggctctttctagacttaatta

SEQ ID NO: 8393598 - DNA, 22 bp, Homo sapiens
tggctctttctgtctgggatcc

SEQ ID NO: 8393599 - DNA, 22 bp, Homo sapiens
tggctctttcaaatttactaaa

SEQ ID NO: 8393600 - DNA, 21 bp, Homo sapiens
tggctctgctcagagcagtcc

SEQ ID NO: 8393601 - DNA, 22 bp, Homo sapiens
tggctctgatcagatgtccagt

SEQ ID NO: 8393602 - DNA, 22 bp, Homo sapiens
tggctctgcacctcagtgtacc

SEQ ID NO: 8393603 - DNA, 18 bp, Homo sapiens
tggctctgccactcaccg

SEQ ID NO: 8393604 - DNA, 23 bp, Homo sapiens
tggctctgagaggttcagatgct

SEQ ID NO: 8393605 - DNA, 23 bp, Homo sapiens
tggctctgagaggttcagatgct

SEQ ID NO: 8393606 - DNA, 23 bp, Homo sapiens
tggctctgagcttcctggtggcc

SEQ ID NO: 8393607 - DNA, 20 bp, Homo sapiens
tggctctcaccctgtgcgat

SEQ ID NO: 8393608 - DNA, 22 bp, Homo sapiens
tggctctcaatggctgtactat

SEQ ID NO: 8393609 - DNA, 22 bp, Homo sapiens
tggctctgagacacaggctctc

SEQ ID NO: 8393610 - DNA, 20 bp, Homo sapiens
tggctctcaccctgtgcgat

SEQ ID NO: 8393611 - DNA, 21 bp, Homo sapiens
tggctcgatttatagcatttc

SEQ ID NO: 8393612 - DNA, 22 bp, Homo sapiens
tggctcggccacctgccagcca

SEQ ID NO: 8393613 - DNA, 22 bp, Homo sapiens
tggctcgtattgatcttgaggc

SEQ ID NO: 8393614 - DNA, 23 bp, Homo sapiens
tggctcagggtctcttatgaagt

SEQ ID NO: 8393615 - DNA, 22 bp, Homo sapiens
tggctcagtagcagtgtggtca

SEQ ID NO: 8393616 - DNA, 22 bp, Homo sapiens
tggctcagtcatggatgagtaa

SEQ ID NO: 8393617 - DNA, 22 bp, Homo sapiens
tggctcagtgaagagataactt

SEQ ID NO: 8393618 - DNA, 22 bp, Homo sapiens
tggctcagtctgggttgactga

SEQ ID NO: 8393619 - DNA, 22 bp, Homo sapiens
tggctcagtggcagccgcagct

SEQ ID NO: 8393620 - DNA, 22 bp, Homo sapiens
tggctcagtggcagccgcagct

SEQ ID NO: 8393621 - DNA, 22 bp, Homo sapiens
tggctcagatttttgtaggctt

SEQ ID NO: 8393622 - DNA, 22 bp, Homo sapiens
tggctcagcaagacattgacct

SEQ ID NO: 8393623 - DNA, 22 bp, Homo sapiens
tggctcagcttacttttgaggg

SEQ ID NO: 8393624 - DNA, 22 bp, Homo sapiens
tggctcagccagccctaggaac

SEQ ID NO: 8393625 - DNA, 22 bp, Homo sapiens
tggctcagctgtcacagcctgg

SEQ ID NO: 8393626 - DNA, 22 bp, Homo sapiens
tggctcaggcctacgacgcctt

SEQ ID NO: 8393627 - DNA, 22 bp, Homo sapiens
tggctcaggcttgaaaatagat

SEQ ID NO: 8393628 - DNA, 22 bp, Homo sapiens
tggctcaggcttgaaaatagat

SEQ ID NO: 8393629 - DNA, 22 bp, Homo sapiens
tggctcattctactctccctgg

SEQ ID NO: 8393630 - DNA, 22 bp, Homo sapiens
tggctcattctttagaatatac

SEQ ID NO: 8393631 - DNA, 22 bp, Homo sapiens
tggctcattctactctccctgg

SEQ ID NO: 8393632 - DNA, 22 bp, Homo sapiens
tggctcatggaattagctatta

SEQ ID NO: 8393633 - DNA, 22 bp, Homo sapiens
tggctcagttaggtcagaaaca

SEQ ID NO: 8393634 - DNA, 22 bp, Homo sapiens
tggctccagatttcctgctgca

SEQ ID NO: 8393635 - DNA, 22 bp, Homo sapiens
tggctccagatttcctgctgca

SEQ ID NO: 8393636 - DNA, 22 bp, Homo sapiens
tggctccagatttcctgctgca

SEQ ID NO: 8393637 - DNA, 20 bp, Homo sapiens
tggctccagcctcccctacc

SEQ ID NO: 8393638 - DNA, 23 bp, Homo sapiens
tggctccaggagaagccagaagc

SEQ ID NO: 8393639 - DNA, 22 bp, Homo sapiens
tggctccatcatccatgcaaga

SEQ ID NO: 8393640 - DNA, 22 bp, Homo sapiens
tggctccatcatccatgcaaga

SEQ ID NO: 8393641 - DNA, 22 bp, Homo sapiens
tggctccaggggacacgcagta

SEQ ID NO: 8393642 - DNA, 22 bp, Homo sapiens
tggctccgttgtacaggctgga

SEQ ID NO: 8393643 - DNA, 22 bp, Homo sapiens
tggctcctcacgtcctcagagc

SEQ ID NO: 8393644 - DNA, 22 bp, Homo sapiens
tggcctggttgttgctgccgtt

SEQ ID NO: 8393645 - DNA, 22 bp, Homo sapiens
tggcctggttgttgctgccgtt

SEQ ID NO: 8393646 - DNA, 22 bp, Homo sapiens
tggcctggctcacagtgagatt

SEQ ID NO: 8393647 - DNA, 22 bp, Homo sapiens
tggcgcagtttctctgctgcct

SEQ ID NO: 8393648 - DNA, 22 bp, Homo sapiens
tggccttcctggtgactcatga

SEQ ID NO: 8393649 - DNA, 22 bp, Homo sapiens
tggccttcctggtgactcatga

SEQ ID NO: 8393650 - DNA, 22 bp, Homo sapiens
tggcctgtcactgcccagggct

SEQ ID NO: 8393651 - DNA, 22 bp, Homo sapiens
tggcctgtggcacgtgctccat

SEQ ID NO: 8393652 - DNA, 22 bp, Homo sapiens
tggctcagataattcaaggggc

SEQ ID NO: 8393653 - DNA, 22 bp, Homo sapiens
tggctcagaggggaagtggttt

SEQ ID NO: 8393654 - DNA, 22 bp, Homo sapiens
tggctcagatttttgtaggctt

SEQ ID NO: 8393655 - DNA, 22 bp, Homo sapiens
tggctcagatgctcttccagtg

SEQ ID NO: 8393656 - DNA, 22 bp, Homo sapiens
tggctcagagccttgagagctg

SEQ ID NO: 8393657 - DNA, 22 bp, Homo sapiens
tggctcagaaggctgccttcac

SEQ ID NO: 8393658 - DNA, 22 bp, Homo sapiens
tggcgcgacgtgccccctgctt

SEQ ID NO: 8393659 - DNA, 21 bp, Homo sapiens
tggcggggacttgtggctgcc

SEQ ID NO: 8393660 - DNA, 22 bp, Homo sapiens
tggcggtgacggcggcgcctgg

SEQ ID NO: 8393661 - DNA, 22 bp, Homo sapiens
tggctcagaactacttctagtt

SEQ ID NO: 8393662 - DNA, 22 bp, Homo sapiens
tggctcagaactacttctagtt

SEQ ID NO: 8393663 - DNA, 22 bp, Homo sapiens
tggctcagaagaaaaggtaaac

SEQ ID NO: 8393664 - DNA, 22 bp, Homo sapiens
tggctattgagtgatctctaga

SEQ ID NO: 8393665 - DNA, 22 bp, Homo sapiens
tgggaagggtcagtttcttcat

SEQ ID NO: 8393666 - DNA, 22 bp, Homo sapiens
tgggaagggtctgaatctgaga

SEQ ID NO: 8393667 - DNA, 22 bp, Homo sapiens
tgggaaggtacacgggaaagag

SEQ ID NO: 8393668 - DNA, 22 bp, Homo sapiens
tgggaaggtacacgggaaagag

SEQ ID NO: 8393669 - DNA, 22 bp, Homo sapiens
tgggaaggtacacgggaaagag

SEQ ID NO: 8393670 - DNA, 22 bp, Homo sapiens
tgggaaggtgtagaaagaacaa

SEQ ID NO: 8393671 - DNA, 22 bp, Homo sapiens
tgggaaggtgattttccaaaag

SEQ ID NO: 8393672 - DNA, 22 bp, Homo sapiens
tgggaaggtgtagaaagaacaa

SEQ ID NO: 8393673 - DNA, 22 bp, Homo sapiens
tgggaagggcctgcccttcctc

SEQ ID NO: 8393674 - DNA, 22 bp, Homo sapiens
tgggaaggggagctggaaagga

SEQ ID NO: 8393675 - DNA, 22 bp, Homo sapiens
tgggaaggggagctggaaagga

SEQ ID NO: 8393676 - DNA, 22 bp, Homo sapiens
tgggaagggtcaacagctggaa

SEQ ID NO: 8393677 - DNA, 22 bp, Homo sapiens
tgggaagcattaatgatagggg

SEQ ID NO: 8393678 - DNA, 22 bp, Homo sapiens
tgggaagggagagtgtcctgga

SEQ ID NO: 8393679 - DNA, 22 bp, Homo sapiens
tgggaagctactcatgcaggca

SEQ ID NO: 8393680 - DNA, 22 bp, Homo sapiens
tgggaagggccgatggagcctc

SEQ ID NO: 8393681 - DNA, 22 bp, Homo sapiens
tgggaagggagtttcttggagt

SEQ ID NO: 8393682 - DNA, 22 bp, Homo sapiens
tgggaagggagtttcttggagt

SEQ ID NO: 8393683 - DNA, 22 bp, Homo sapiens
tgggactcactcttttggccag

SEQ ID NO: 8393684 - DNA, 20 bp, Homo sapiens
tgggactgacccatctgagc

SEQ ID NO: 8393685 - DNA, 20 bp, Homo sapiens
tgggactgacccatctgagc

SEQ ID NO: 8393686 - DNA, 22 bp, Homo sapiens
tgggaccagataaagggaggtc

SEQ ID NO: 8393687 - DNA, 21 bp, Homo sapiens
tgggacagtgatggctcctcc

SEQ ID NO: 8393688 - DNA, 22 bp, Homo sapiens
tgggacagtgtgccttgctcct

SEQ ID NO: 8393689 - DNA, 21 bp, Homo sapiens
tgggacagtgatggctcctcc

SEQ ID NO: 8393690 - DNA, 22 bp, Homo sapiens
tgggaccacactttgaacaaca

SEQ ID NO: 8393691 - DNA, 22 bp, Homo sapiens
tgggaccagataaagggaggtc

SEQ ID NO: 8393692 - DNA, 22 bp, Homo sapiens
tgggaccaagtcatttctttag

SEQ ID NO: 8393693 - DNA, 22 bp, Homo sapiens
tgggacagttgtcctccactct

SEQ ID NO: 8393694 - DNA, 22 bp, Homo sapiens
tgggacagttgtcctccactct

SEQ ID NO: 8393695 - DNA, 22 bp, Homo sapiens
tgggacagtgtgccttgctcct

SEQ ID NO: 8393696 - DNA, 22 bp, Homo sapiens
tgggacacaaaccagaccagga

SEQ ID NO: 8393697 - DNA, 22 bp, Homo sapiens
tgggacacagaaaaggcaggtt

SEQ ID NO: 8393698 - DNA, 22 bp, Homo sapiens
tgggacagtgaccccagaggtc

SEQ ID NO: 8393699 - DNA, 22 bp, Homo sapiens
tgggacagtgaccccagaggtc

SEQ ID NO: 8393700 - DNA, 22 bp, Homo sapiens
tgggacaggttggagagaagca

SEQ ID NO: 8393701 - DNA, 22 bp, Homo sapiens
tgggacaggttggagagaagca

SEQ ID NO: 8393702 - DNA, 22 bp, Homo sapiens
tgggaatgggcctagaaggctg

SEQ ID NO: 8393703 - DNA, 22 bp, Homo sapiens
tgggaaggttagcagtttgtca

SEQ ID NO: 8393704 - DNA, 23 bp, Homo sapiens
tgggaatgacatctagagcagag

SEQ ID NO: 8393705 - DNA, 22 bp, Homo sapiens
tgggagagtgctcaatgtgcaa

SEQ ID NO: 8393706 - DNA, 22 bp, Homo sapiens
tgggagatattgctgtggctgt

SEQ ID NO: 8393707 - DNA, 22 bp, Homo sapiens
tgggagcaagctacttagggaa

SEQ ID NO: 8393708 - DNA, 22 bp, Homo sapiens
tgggagcaaatgactgggagat

SEQ ID NO: 8393709 - DNA, 22 bp, Homo sapiens
tgggagcaaatgactgggagat

SEQ ID NO: 8393710 - DNA, 22 bp, Homo sapiens
tgggagaaactgtctctcccac

SEQ ID NO: 8393711 - DNA, 22 bp, Homo sapiens
tgggagaacccagggtcaggct

SEQ ID NO: 8393712 - DNA, 22 bp, Homo sapiens
tgggagaacactgctctggatg

SEQ ID NO: 8393713 - DNA, 22 bp, Homo sapiens
tgggagaaagaaccctgagtga

SEQ ID NO: 8393714 - DNA, 22 bp, Homo sapiens
tgggagaagcagcagccaagtg

SEQ ID NO: 8393715 - DNA, 20 bp, Homo sapiens
tgggagaagaacactggaac

SEQ ID NO: 8393716 - DNA, 22 bp, Homo sapiens
tgggagaagacgtactttagac

SEQ ID NO: 8393717 - DNA, 22 bp, Homo sapiens
tgggagaacccagggtcaggct

SEQ ID NO: 8393718 - DNA, 22 bp, Homo sapiens
tgggagaagcatggggtgcaga

SEQ ID NO: 8393719 - DNA, 22 bp, Homo sapiens
tgggagaatatatttaaaactt

SEQ ID NO: 8393720 - DNA, 22 bp, Homo sapiens
tgggagaatcttgctctgctac

SEQ ID NO: 8393721 - DNA, 22 bp, Homo sapiens
tgggagaagcagtgggacagta

SEQ ID NO: 8393722 - DNA, 21 bp, Homo sapiens
tgggagaccgccttcctggga

SEQ ID NO: 8393723 - DNA, 21 bp, Homo sapiens
tgggagacacagccttgagct

SEQ ID NO: 8393724 - DNA, 22 bp, Homo sapiens
tgggagacactggtgggagctt

SEQ ID NO: 8393725 - DNA, 22 bp, Homo sapiens
tgggaggcagaagttgactgga

SEQ ID NO: 8393726 - DNA, 22 bp, Homo sapiens
tgggaggatctcttgaggccag

SEQ ID NO: 8393727 - DNA, 22 bp, Homo sapiens
tgggaggatcgcttgagcccag

SEQ ID NO: 8393728 - DNA, 22 bp, Homo sapiens
tgggaggatcgcttgagcccag

SEQ ID NO: 8393729 - DNA, 22 bp, Homo sapiens
tgggagcaagctggtgctggag

SEQ ID NO: 8393730 - DNA, 22 bp, Homo sapiens
tgggagcaccctgaggagcttc

SEQ ID NO: 8393731 - DNA, 22 bp, Homo sapiens
tgggagcaccctgaggagcttc

SEQ ID NO: 8393732 - DNA, 22 bp, Homo sapiens
tgggagcactctttgggaagca

SEQ ID NO: 8393733 - DNA, 22 bp, Homo sapiens
tgggagcaccttgagggcagaa

SEQ ID NO: 8393734 - DNA, 22 bp, Homo sapiens
tgggagcagccaacatggcctt

SEQ ID NO: 8393735 - DNA, 22 bp, Homo sapiens
tgggagcagcattgccatgtgc

SEQ ID NO: 8393736 - DNA, 22 bp, Homo sapiens
tgggagcagctttgcgagggag

SEQ ID NO: 8393737 - DNA, 22 bp, Homo sapiens
tggcttctggctggtgagaaat

SEQ ID NO: 8393738 - DNA, 22 bp, Homo sapiens
tggcttctgggacttgtgagca

SEQ ID NO: 8393739 - DNA, 22 bp, Homo sapiens
tggcttctggggtggcctgcat

SEQ ID NO: 8393740 - DNA, 22 bp, Homo sapiens
tggcttctggggtggcctgcat

SEQ ID NO: 8393741 - DNA, 22 bp, Homo sapiens
tggcttctgtccctgctacatt

SEQ ID NO: 8393742 - DNA, 22 bp, Homo sapiens
tggcttctgctttcagtggagg

SEQ ID NO: 8393743 - DNA, 22 bp, Homo sapiens
tggcttctggccaggcacagga

SEQ ID NO: 8393744 - DNA, 19 bp, Homo sapiens
tggcttctggcaacagatg

SEQ ID NO: 8393745 - DNA, 22 bp, Homo sapiens
tggcttctgctcccagaatgat

SEQ ID NO: 8393746 - DNA, 18 bp, Homo sapiens
tggcttctgctagctgga

SEQ ID NO: 8393747 - DNA, 22 bp, Homo sapiens
tggcttctccctacaacatgcc

SEQ ID NO: 8393748 - DNA, 22 bp, Homo sapiens
tggcttctcccgacaccctggc

SEQ ID NO: 8393749 - DNA, 22 bp, Homo sapiens
tggcttctcccgacaccctggc

SEQ ID NO: 8393750 - DNA, 22 bp, Homo sapiens
tggcttctcccgacaccctggc

SEQ ID NO: 8393751 - DNA, 22 bp, Homo sapiens
tggcttctccagaaatcttggt

SEQ ID NO: 8393752 - DNA, 22 bp, Homo sapiens
tggcttctctggcatccccatc

SEQ ID NO: 8393753 - DNA, 22 bp, Homo sapiens
tggcttctcgcctgtcatcccg

SEQ ID NO: 8393754 - DNA, 22 bp, Homo sapiens
tggcttctccctctgcctgatt

SEQ ID NO: 8393755 - DNA, 22 bp, Homo sapiens
tggcttctccctccccatctag

SEQ ID NO: 8393756 - DNA, 22 bp, Homo sapiens
tggcttctgagtctcctgacat

SEQ ID NO: 8393757 - DNA, 22 bp, Homo sapiens
tggcttctgagcattgaaacgt

SEQ ID NO: 8393758 - DNA, 22 bp, Homo sapiens
tggcttctgagtctcctgacat

SEQ ID NO: 8393759 - DNA, 18 bp, Homo sapiens
tggcttctgaacaactgc

SEQ ID NO: 8393760 - DNA, 22 bp, Homo sapiens
tggcttctgagcattgaaacgt

SEQ ID NO: 8393761 - DNA, 22 bp, Homo sapiens
tggcttctgagtctcctgacat

SEQ ID NO: 8393762 - DNA, 22 bp, Homo sapiens
tggcttctctgttttagtattt

SEQ ID NO: 8393763 - DNA, 20 bp, Homo sapiens
tggcttctcttcactcctgt

SEQ ID NO: 8393764 - DNA, 20 bp, Homo sapiens
tggcttctcttcactcctgt

SEQ ID NO: 8393765 - DNA, 20 bp, Homo sapiens
tggcttctcttcactcctgt

SEQ ID NO: 8393766 - DNA, 22 bp, Homo sapiens
tggcttctccagaaatcttggt

SEQ ID NO: 8393767 - DNA, 22 bp, Homo sapiens
tggcttctcagaatactctgga

SEQ ID NO: 8393768 - DNA, 22 bp, Homo sapiens
tggcttctcagaatactctgga

SEQ ID NO: 8393769 - DNA, 22 bp, Homo sapiens
tggcttctattgctgtggcatt

SEQ ID NO: 8393770 - DNA, 22 bp, Homo sapiens
tggcttctaaagtttcttttag

SEQ ID NO: 8393771 - DNA, 22 bp, Homo sapiens
tggcttctagagcccatccttc

SEQ ID NO: 8393772 - DNA, 22 bp, Homo sapiens
tggcttctagagcccatccttc

SEQ ID NO: 8393773 - DNA, 22 bp, Homo sapiens
tggcttctagagcccatccttc

SEQ ID NO: 8393774 - DNA, 22 bp, Homo sapiens
tggcttctagtttgaggaaaaa

SEQ ID NO: 8393775 - DNA, 22 bp, Homo sapiens
tggcttctagtttgaggaaaaa

SEQ ID NO: 8393776 - DNA, 22 bp, Homo sapiens
tggcttcagagtctgagttctt

SEQ ID NO: 8393777 - DNA, 22 bp, Homo sapiens
tggcttcaggagcacctggctt

SEQ ID NO: 8393778 - DNA, 22 bp, Homo sapiens
tggcttcagacttctgctacgt

SEQ ID NO: 8393779 - DNA, 22 bp, Homo sapiens
tgggaacagtagctgctgagct

SEQ ID NO: 8393780 - DNA, 22 bp, Homo sapiens
tgggaactctctgggaggcatc

SEQ ID NO: 8393781 - DNA, 22 bp, Homo sapiens
tgggaactgcaggtgttacata

SEQ ID NO: 8393782 - DNA, 22 bp, Homo sapiens
tgggaagaggatgaggcatatg

SEQ ID NO: 8393783 - DNA, 22 bp, Homo sapiens
tgggaagaggagcactggaatg

SEQ ID NO: 8393784 - DNA, 22 bp, Homo sapiens
tgggaagactcctcaggaggcg

SEQ ID NO: 8393785 - DNA, 22 bp, Homo sapiens
tgggaacagaggacttgactgt

SEQ ID NO: 8393786 - DNA, 22 bp, Homo sapiens
tgggaaagtgttgaggtgtctt

SEQ ID NO: 8393787 - DNA, 22 bp, Homo sapiens
tgggaaagtgttgaggtgtctt

SEQ ID NO: 8393788 - DNA, 22 bp, Homo sapiens
tgggaaagtgtagcctgcaggc

SEQ ID NO: 8393789 - DNA, 22 bp, Homo sapiens
tgggaaagtgtagcctgcaggc

SEQ ID NO: 8393790 - DNA, 22 bp, Homo sapiens
tgggaaagtgtagcctgcaggc

SEQ ID NO: 8393791 - DNA, 16 bp, Homo sapiens
tggcttcttatttcta

SEQ ID NO: 8393792 - DNA, 19 bp, Homo sapiens
tggcttcttcggtgttccc

SEQ ID NO: 8393793 - DNA, 22 bp, Homo sapiens
tggcttcttgacttcttggctg

SEQ ID NO: 8393794 - DNA, 22 bp, Homo sapiens
tggcttcttgacttcttggctg

SEQ ID NO: 8393795 - DNA, 22 bp, Homo sapiens
tggcttcttgatcttggacttg

SEQ ID NO: 8393796 - DNA, 22 bp, Homo sapiens
tgggaaagtaattgtcatcctt

SEQ ID NO: 8393797 - DNA, 22 bp, Homo sapiens
tgggaaagccagcagtgtcacc

SEQ ID NO: 8393798 - DNA, 22 bp, Homo sapiens
tgggaaagactcaggacaggag

SEQ ID NO: 8393799 - DNA, 23 bp, Homo sapiens
tggctggcagaaactgaagcatg

SEQ ID NO: 8393800 - DNA, 22 bp, Homo sapiens
tggctggcaaggctggagtcag

SEQ ID NO: 8393801 - DNA, 22 bp, Homo sapiens
tggctggatatcaggcaagggg

SEQ ID NO: 8393802 - DNA, 22 bp, Homo sapiens
tggctggatatcaggcaagggg

SEQ ID NO: 8393803 - DNA, 22 bp, Homo sapiens
tggctggatgtgagatcaagag

SEQ ID NO: 8393804 - DNA, 22 bp, Homo sapiens
tggctggagtataggagtagga

SEQ ID NO: 8393805 - DNA, 22 bp, Homo sapiens
tggctggagtataggagtagga

SEQ ID NO: 8393806 - DNA, 22 bp, Homo sapiens
tggctggatatcagaggaagtg

SEQ ID NO: 8393807 - DNA, 22 bp, Homo sapiens
tggctggagggttagtgagata

SEQ ID NO: 8393808 - DNA, 22 bp, Homo sapiens
tggctggagggttagtgagata

SEQ ID NO: 8393809 - DNA, 22 bp, Homo sapiens
tggctggagcattccttgtctt

SEQ ID NO: 8393810 - DNA, 22 bp, Homo sapiens
tggctggagcgccctcctctgc

SEQ ID NO: 8393811 - DNA, 22 bp, Homo sapiens
tggctggaggaaggaactgagg

SEQ ID NO: 8393812 - DNA, 22 bp, Homo sapiens
tggctggacctgggctggaatt

SEQ ID NO: 8393813 - DNA, 22 bp, Homo sapiens
tggctggagagggtcccatgag

SEQ ID NO: 8393814 - DNA, 22 bp, Homo sapiens
tggctggacagtgggcagtgga

SEQ ID NO: 8393815 - DNA, 22 bp, Homo sapiens
tggctggctagaatggaaatgt

SEQ ID NO: 8393816 - DNA, 22 bp, Homo sapiens
tggctgggagctggaactgggc

SEQ ID NO: 8393817 - DNA, 22 bp, Homo sapiens
tggctggcgttggggccagtga

SEQ ID NO: 8393818 - DNA, 23 bp, Homo sapiens
tggctggcgcctgcctcaccctg

SEQ ID NO: 8393819 - DNA, 22 bp, Homo sapiens
tggctggcgccgggctagccac

SEQ ID NO: 8393820 - DNA, 22 bp, Homo sapiens
tggctggccctgggagtgcaga

SEQ ID NO: 8393821 - DNA, 22 bp, Homo sapiens
tggctggcatagccattgctcc

SEQ ID NO: 8393822 - DNA, 22 bp, Homo sapiens
tggctggcagttatctttggat

SEQ ID NO: 8393823 - DNA, 22 bp, Homo sapiens
tggctggccctgggagtgcaga

SEQ ID NO: 8393824 - DNA, 22 bp, Homo sapiens
tggctggcatagccattgctcc

SEQ ID NO: 8393825 - DNA, 23 bp, Homo sapiens
tggctggcagaaactgaagcatg

SEQ ID NO: 8393826 - DNA, 22 bp, Homo sapiens
tggctggcagtaggctagtggc

SEQ ID NO: 8393827 - DNA, 18 bp, Homo sapiens
tggctggcagtgggcagc

SEQ ID NO: 8393828 - DNA, 22 bp, Homo sapiens
tggctgtgggatatgtgactga

SEQ ID NO: 8393829 - DNA, 22 bp, Homo sapiens
tggctgtgtcatcatagctgtg

SEQ ID NO: 8393830 - DNA, 22 bp, Homo sapiens
tggctgtcagtcgcctgcattc

SEQ ID NO: 8393831 - DNA, 22 bp, Homo sapiens
tggcttacatgcctttctatct

SEQ ID NO: 8393832 - DNA, 22 bp, Homo sapiens
tggcttcaagtctaggttctac

SEQ ID NO: 8393833 - DNA, 22 bp, Homo sapiens
tggcttcacaatttcataacta

SEQ ID NO: 8393834 - DNA, 22 bp, Homo sapiens
tggctgtgtccctgtccagagt

SEQ ID NO: 8393835 - DNA, 22 bp, Homo sapiens
tggctgtgtgccaggctgtctg

SEQ ID NO: 8393836 - DNA, 22 bp, Homo sapiens
tggcagcctcccagctgcattc

SEQ ID NO: 8393837 - DNA, 22 bp, Homo sapiens
tggcagcctgcgtgaaggagct

SEQ ID NO: 8393838 - DNA, 22 bp, Homo sapiens
tggcagcattttttccagaaca

SEQ ID NO: 8393839 - DNA, 22 bp, Homo sapiens
tggcagctcatttggaaatgga

SEQ ID NO: 8393840 - DNA, 22 bp, Homo sapiens
tggcagctccgggtaggggctg

SEQ ID NO: 8393841 - DNA, 22 bp, Homo sapiens
tggcagctcctggggccagcac

SEQ ID NO: 8393842 - DNA, 22 bp, Homo sapiens
tggcagctcccagagcttccaa

SEQ ID NO: 8393843 - DNA, 22 bp, Homo sapiens
tggcagccttctctgagaaggt

SEQ ID NO: 8393844 - DNA, 22 bp, Homo sapiens
tggcagccttctctgagaaggt

SEQ ID NO: 8393845 - DNA, 22 bp, Homo sapiens
tggcagctagatagtgtgttta

SEQ ID NO: 8393846 - DNA, 22 bp, Homo sapiens
tggcagcagccatggaaggccc

SEQ ID NO: 8393847 - DNA, 22 bp, Homo sapiens
tggcagcagggcccctggagga

SEQ ID NO: 8393848 - DNA, 22 bp, Homo sapiens
tggcagcatgttatgtaaggaa

SEQ ID NO: 8393849 - DNA, 22 bp, Homo sapiens
tggcagcattaattattcaggt

SEQ ID NO: 8393850 - DNA, 22 bp, Homo sapiens
tggcagcatgtcccggcctcag

SEQ ID NO: 8393851 - DNA, 22 bp, Homo sapiens
tggcagcagtggaggtagaaag

SEQ ID NO: 8393852 - DNA, 22 bp, Homo sapiens
tggcagagtgcagaagaggcat

SEQ ID NO: 8393853 - DNA, 22 bp, Homo sapiens
tggcagagtggaccatactcaa

SEQ ID NO: 8393854 - DNA, 22 bp, Homo sapiens
tggcagagtaggatggccctgt

SEQ ID NO: 8393855 - DNA, 22 bp, Homo sapiens
tggcagagtcatcacatctgga

SEQ ID NO: 8393856 - DNA, 22 bp, Homo sapiens
tggcagagtcatcacatctgga

SEQ ID NO: 8393857 - DNA, 21 bp, Homo sapiens
tggcagagttgagtagttatg

SEQ ID NO: 8393858 - DNA, 22 bp, Homo sapiens
tggcagagttcgctgtgccttt

SEQ ID NO: 8393859 - DNA, 22 bp, Homo sapiens
tggcagagttggaggtggaaga

SEQ ID NO: 8393860 - DNA, 22 bp, Homo sapiens
tggcagatacccaggcaaatgg

SEQ ID NO: 8393861 - DNA, 22 bp, Homo sapiens
tggcagataaaataatagggaa

SEQ ID NO: 8393862 - DNA, 22 bp, Homo sapiens
tggcagataacctgctgtgccc

SEQ ID NO: 8393863 - DNA, 22 bp, Homo sapiens
tggcaggaaagtaacagagcac

SEQ ID NO: 8393864 - DNA, 22 bp, Homo sapiens
tggcaggaaataccctgcctag

SEQ ID NO: 8393865 - DNA, 22 bp, Homo sapiens
tggcaggaaataccctgcctag

SEQ ID NO: 8393866 - DNA, 23 bp, Homo sapiens
tggcaggaaatgagaatgttcct

SEQ ID NO: 8393867 - DNA, 22 bp, Homo sapiens
tggcaggaaccttaaccacaaa

SEQ ID NO: 8393868 - DNA, 22 bp, Homo sapiens
tggcaggaagacgtggggcacc

SEQ ID NO: 8393869 - DNA, 18 bp, Homo sapiens
tggcaggaaatgcacttt

SEQ ID NO: 8393870 - DNA, 22 bp, Homo sapiens
tggcaggaaccaggaggctctc

SEQ ID NO: 8393871 - DNA, 22 bp, Homo sapiens
tggcagctgcgttgtgtttctg

SEQ ID NO: 8393872 - DNA, 22 bp, Homo sapiens
tggcaggaaaaagggccagagg

SEQ ID NO: 8393873 - DNA, 22 bp, Homo sapiens
tggcagctgccatgtccacgtg

SEQ ID NO: 8393874 - DNA, 22 bp, Homo sapiens
tggcagctgccatgtccacgtg

SEQ ID NO: 8393875 - DNA, 22 bp, Homo sapiens
tggcagctgcaggcctcctgag

SEQ ID NO: 8393876 - DNA, 22 bp, Homo sapiens
tggcagctgcaggcctcctgag

SEQ ID NO: 8393877 - DNA, 22 bp, Homo sapiens
tggcagctgcaggcctcctgag

SEQ ID NO: 8393878 - DNA, 22 bp, Homo sapiens
tggcagctgaatggctggatgg

SEQ ID NO: 8393879 - DNA, 20 bp, Homo sapiens
tggcaggagccactggaagc

SEQ ID NO: 8393880 - DNA, 22 bp, Homo sapiens
tggcaggagcctgcggggaggt

SEQ ID NO: 8393881 - DNA, 22 bp, Homo sapiens
tggcaggaggatgaggcggcta

SEQ ID NO: 8393882 - DNA, 20 bp, Homo sapiens
tggcaggaggcagcagtgga

SEQ ID NO: 8393883 - DNA, 20 bp, Homo sapiens
tggcaggaggcagcagtgga

SEQ ID NO: 8393884 - DNA, 22 bp, Homo sapiens
tggcaggaggttttctccagga

SEQ ID NO: 8393885 - DNA, 20 bp, Homo sapiens
tggcaggactggctccaccc

SEQ ID NO: 8393886 - DNA, 22 bp, Homo sapiens
tggcaggagagcgtcagatcag

SEQ ID NO: 8393887 - DNA, 22 bp, Homo sapiens
tggcaggagacacatggcatag

SEQ ID NO: 8393888 - DNA, 20 bp, Homo sapiens
tggcaggaatagggccagag

SEQ ID NO: 8393889 - DNA, 22 bp, Homo sapiens
tggcaggaaggagactcagccc

SEQ ID NO: 8393890 - DNA, 22 bp, Homo sapiens
tggcaggaaggagactcagccc

SEQ ID NO: 8393891 - DNA, 22 bp, Homo sapiens
tggcaggaagacgtggggcacc

SEQ ID NO: 8393892 - DNA, 22 bp, Homo sapiens
tggcaggaagcatctataggtc

SEQ ID NO: 8393893 - DNA, 22 bp, Homo sapiens
tggcaggatttgcccggaagga

SEQ ID NO: 8393894 - DNA, 22 bp, Homo sapiens
tggcaggatctttgagagtgaa

SEQ ID NO: 8393895 - DNA, 18 bp, Homo sapiens
tggcagggaggaaatata

SEQ ID NO: 8393896 - DNA, 19 bp, Homo sapiens
tggcagggagtgatattag

SEQ ID NO: 8393897 - DNA, 22 bp, Homo sapiens
tggcagggagttcgttcacaac

SEQ ID NO: 8393898 - DNA, 22 bp, Homo sapiens
tggcagggcctaccccaatatc

SEQ ID NO: 8393899 - DNA, 22 bp, Homo sapiens
tggcagggagttgcaggatttc

SEQ ID NO: 8393900 - DNA, 22 bp, Homo sapiens
tggcagggcctgctcatcatcc

SEQ ID NO: 8393901 - DNA, 22 bp, Homo sapiens
tggcagggcctgaatcttatac

SEQ ID NO: 8393902 - DNA, 21 bp, Homo sapiens
tggcaggggtagtagtacagc

SEQ ID NO: 8393903 - DNA, 22 bp, Homo sapiens
tggcagggtacaccttaacacc

SEQ ID NO: 8393904 - DNA, 22 bp, Homo sapiens
tggcaggggaggtgcttgctta

SEQ ID NO: 8393905 - DNA, 22 bp, Homo sapiens
tggcaggggaggtgcttgctta

SEQ ID NO: 8393906 - DNA, 22 bp, Homo sapiens
tggcaggggaggtgcttgctta

SEQ ID NO: 8393907 - DNA, 18 bp, Homo sapiens
tggcaggggcagtacgcc

SEQ ID NO: 8393908 - DNA, 22 bp, Homo sapiens
tggcagagcccagaactgagca

SEQ ID NO: 8393909 - DNA, 22 bp, Homo sapiens
tggcagagcccagactccagtc

SEQ ID NO: 8393910 - DNA, 22 bp, Homo sapiens
tggcagaggaaaaagtcactgg

SEQ ID NO: 8393911 - DNA, 22 bp, Homo sapiens
tggcagagctggctgcggatga

SEQ ID NO: 8393912 - DNA, 22 bp, Homo sapiens
tggcagagacaaggccgggcct

SEQ ID NO: 8393913 - DNA, 22 bp, Homo sapiens
tggcagagaacctgggctttgt

SEQ ID NO: 8393914 - DNA, 22 bp, Homo sapiens
tggcagagaacacggctgatct

SEQ ID NO: 8393915 - DNA, 22 bp, Homo sapiens
tggcagagagagtgcagtcgac

SEQ ID NO: 8393916 - DNA, 22 bp, Homo sapiens
tggcagagactcctcctgggag

SEQ ID NO: 8393917 - DNA, 22 bp, Homo sapiens
tggcagagagactctccttgat

SEQ ID NO: 8393918 - DNA, 22 bp, Homo sapiens
tggcacatggttaatcataatt

SEQ ID NO: 8393919 - DNA, 22 bp, Homo sapiens
tggcaccaccagacaccaggag

SEQ ID NO: 8393920 - DNA, 22 bp, Homo sapiens
tggcacctggtgcagggtggcc

SEQ ID NO: 8393921 - DNA, 22 bp, Homo sapiens
tggcacctgaacttagaggtgt

SEQ ID NO: 8393922 - DNA, 22 bp, Homo sapiens
tggcaccatgttggcaaatgtt

SEQ ID NO: 8393923 - DNA, 22 bp, Homo sapiens
tggcactgaaaaaggagaggtt

SEQ ID NO: 8393924 - DNA, 22 bp, Homo sapiens
tggcactgtggatttcacaagt

SEQ ID NO: 8393925 - DNA, 17 bp, Homo sapiens
tggcacagaggtgctat

SEQ ID NO: 8393926 - DNA, 22 bp, Homo sapiens
tggcacagagggacccagcagc

SEQ ID NO: 8393927 - DNA, 22 bp, Homo sapiens
tggcacagactgggccaaggaa

SEQ ID NO: 8393928 - DNA, 22 bp, Homo sapiens
tggcacagactgggccaaggaa

SEQ ID NO: 8393929 - DNA, 22 bp, Homo sapiens
tggcacagcccattcagagaag

SEQ ID NO: 8393930 - DNA, 22 bp, Homo sapiens
tggcacagcccattcagagaag

SEQ ID NO: 8393931 - DNA, 22 bp, Homo sapiens
tggcacagcccagagctcttga

SEQ ID NO: 8393932 - DNA, 20 bp, Homo sapiens
tggcacagaacccttgccta

SEQ ID NO: 8393933 - DNA, 22 bp, Homo sapiens
tggcacagaaaaatgctccatt

SEQ ID NO: 8393934 - DNA, 22 bp, Homo sapiens
tggcacagacagcacagcaatg

SEQ ID NO: 8393935 - DNA, 22 bp, Homo sapiens
tggcacagaaaaatgctccatt

SEQ ID NO: 8393936 - DNA, 22 bp, Homo sapiens
tggcacagaaaaatgctccatt

SEQ ID NO: 8393937 - DNA, 22 bp, Homo sapiens
tggcacaaaagtaattgcagtt

SEQ ID NO: 8393938 - DNA, 22 bp, Homo sapiens
tggcaactcctgactctactca

SEQ ID NO: 8393939 - DNA, 22 bp, Homo sapiens
tggcaatattaacagtacttat

SEQ ID NO: 8393940 - DNA, 22 bp, Homo sapiens
tggcaacatgtcgaagtgctgt

SEQ ID NO: 8393941 - DNA, 18 bp, Homo sapiens
tggattgaattgagaggt

SEQ ID NO: 8393942 - DNA, 22 bp, Homo sapiens
tggattctgggagagttctata

SEQ ID NO: 8393943 - DNA, 22 bp, Homo sapiens
tggattgataaaatgggatgtt

SEQ ID NO: 8393944 - DNA, 22 bp, Homo sapiens
tggattagtttcaaggcagcaa

SEQ ID NO: 8393945 - DNA, 22 bp, Homo sapiens
tggattagtttaacaatgtggc

SEQ ID NO: 8393946 - DNA, 22 bp, Homo sapiens
tggattagttaagaaatgttag

SEQ ID NO: 8393947 - DNA, 22 bp, Homo sapiens
tggattattgtaagacaaagta

SEQ ID NO: 8393948 - DNA, 17 bp, Homo sapiens
tggatgtgggatctgga

SEQ ID NO: 8393949 - DNA, 22 bp, Homo sapiens
tggatgggttgaaatgtgagcc

SEQ ID NO: 8393950 - DNA, 22 bp, Homo sapiens
tggatgggttgaaatgtgagcc

SEQ ID NO: 8393951 - DNA, 22 bp, Homo sapiens
tggatggttctgggcggcagca

SEQ ID NO: 8393952 - DNA, 22 bp, Homo sapiens
tggatgtaggacacatagaatt

SEQ ID NO: 8393953 - DNA, 17 bp, Homo sapiens
tggccctagactccagc

SEQ ID NO: 8393954 - DNA, 22 bp, Homo sapiens
tggccctatttggaaatagagc

SEQ ID NO: 8393955 - DNA, 23 bp, Homo sapiens
tggcccgggctcagaggcagtgc

SEQ ID NO: 8393956 - DNA, 22 bp, Homo sapiens
tggcccggctctgagctgtgct

SEQ ID NO: 8393957 - DNA, 22 bp, Homo sapiens
tggcccgccggaagaagatgtc

SEQ ID NO: 8393958 - DNA, 22 bp, Homo sapiens
tggcccagtcagcaggagaggg

SEQ ID NO: 8393959 - DNA, 22 bp, Homo sapiens
tggcccagtatgtataatctta

SEQ ID NO: 8393960 - DNA, 22 bp, Homo sapiens
tggcccaggtgcaagagacaga

SEQ ID NO: 8393961 - DNA, 22 bp, Homo sapiens
tggcccagtagaaaagggatcg

SEQ ID NO: 8393962 - DNA, 22 bp, Homo sapiens
tggcccaggtgcacccagaggc

SEQ ID NO: 8393963 - DNA, 22 bp, Homo sapiens
tggcccaggtgcacccagaggc

SEQ ID NO: 8393964 - DNA, 22 bp, Homo sapiens
tggccctgaggggctgtgcccc

SEQ ID NO: 8393965 - DNA, 22 bp, Homo sapiens
tggccctgcagaactagcctgg

SEQ ID NO: 8393966 - DNA, 22 bp, Homo sapiens
tggccctgaggacccagtgtgg

SEQ ID NO: 8393967 - DNA, 22 bp, Homo sapiens
tggcccagctgcagatggtgga

SEQ ID NO: 8393968 - DNA, 22 bp, Homo sapiens
tggcccaggaggccagagggca

SEQ ID NO: 8393969 - DNA, 22 bp, Homo sapiens
tggcccagggagttcatggtgt

SEQ ID NO: 8393970 - DNA, 22 bp, Homo sapiens
tggcccaggccaaagccctgga

SEQ ID NO: 8393971 - DNA, 22 bp, Homo sapiens
tggcccaggcgaggtgggcaga

SEQ ID NO: 8393972 - DNA, 22 bp, Homo sapiens
tggcccagggcacagcagggag

SEQ ID NO: 8393973 - DNA, 22 bp, Homo sapiens
tggcccaggggctcttggtgtt

SEQ ID NO: 8393974 - DNA, 22 bp, Homo sapiens
tggcccaggtctctctgagccc

SEQ ID NO: 8393975 - DNA, 22 bp, Homo sapiens
tggcccaggtctctctgagccc

SEQ ID NO: 8393976 - DNA, 22 bp, Homo sapiens
tggcccaggtctctctgagccc

SEQ ID NO: 8393977 - DNA, 22 bp, Homo sapiens
tggcccagggtctacagcctca

SEQ ID NO: 8393978 - DNA, 22 bp, Homo sapiens
tggcccagggtctacagcctca

SEQ ID NO: 8393979 - DNA, 22 bp, Homo sapiens
tggcccagctcagggtgggcgg

SEQ ID NO: 8393980 - DNA, 22 bp, Homo sapiens
tggcccagctgcagatggtgga

SEQ ID NO: 8393981 - DNA, 22 bp, Homo sapiens
tggcccaagtctgctagaagag

SEQ ID NO: 8393982 - DNA, 22 bp, Homo sapiens
tggcccagccctgctctagggc

SEQ ID NO: 8393983 - DNA, 22 bp, Homo sapiens
tggcccagactctgctcttatc

SEQ ID NO: 8393984 - DNA, 22 bp, Homo sapiens
tggccagtggactaagttctga

SEQ ID NO: 8393985 - DNA, 22 bp, Homo sapiens
tggccagtgcctgccagtgcag

SEQ ID NO: 8393986 - DNA, 22 bp, Homo sapiens
tggcccaaagcagcccagcagg

SEQ ID NO: 8393987 - DNA, 22 bp, Homo sapiens
tggccatgggatagtgcagggg

SEQ ID NO: 8393988 - DNA, 22 bp, Homo sapiens
tggccatgggatagtgcagggg

SEQ ID NO: 8393989 - DNA, 20 bp, Homo sapiens
tggccctgttttctccaggc

SEQ ID NO: 8393990 - DNA, 22 bp, Homo sapiens
tggccctgttctgtacctcata

SEQ ID NO: 8393991 - DNA, 20 bp, Homo sapiens
tggccctgttttctccaggc

SEQ ID NO: 8393992 - DNA, 22 bp, Homo sapiens
tggcctagagaagccaaaagat

SEQ ID NO: 8393993 - DNA, 22 bp, Homo sapiens
tggcctcaaccgtcctaagcac

SEQ ID NO: 8393994 - DNA, 23 bp, Homo sapiens
tggccctgtgcatgctgcttccc

SEQ ID NO: 8393995 - DNA, 22 bp, Homo sapiens
tggccctgtggcttcagaacag

SEQ ID NO: 8393996 - DNA, 22 bp, Homo sapiens
tggccctgtgtcctgctgccag

SEQ ID NO: 8393997 - DNA, 22 bp, Homo sapiens
tggccctgtctgcacacaggat

SEQ ID NO: 8393998 - DNA, 22 bp, Homo sapiens
tggccctgggcagaggcaacat

SEQ ID NO: 8393999 - DNA, 21 bp, Homo sapiens
tggccctggccacggctgcca

SEQ ID NO: 8394000 - DNA, 22 bp, Homo sapiens
tggccctgccactcactgctga

SEQ ID NO: 8394001 - DNA, 20 bp, Homo sapiens
tggcctctgagatgccacgg

SEQ ID NO: 8394002 - DNA, 22 bp, Homo sapiens
tggcctctggctgaggactaac

SEQ ID NO: 8394003 - DNA, 22 bp, Homo sapiens
tggcctctgggaaagcagattc

SEQ ID NO: 8394004 - DNA, 20 bp, Homo sapiens
tggcctctgtagaggccaag

SEQ ID NO: 8394005 - DNA, 22 bp, Homo sapiens
tggcctcttaggacatcctcta

SEQ ID NO: 8394006 - DNA, 22 bp, Homo sapiens
tggcctcttaaggatgacacaa

SEQ ID NO: 8394007 - DNA, 22 bp, Homo sapiens
tggcctcttaggacatcctcta

SEQ ID NO: 8394008 - DNA, 22 bp, Homo sapiens
tggcctgcctcccggcttcttt

SEQ ID NO: 8394009 - DNA, 22 bp, Homo sapiens
tggcctgccccgagatcctggc

SEQ ID NO: 8394010 - DNA, 23 bp, Homo sapiens
tggcctgcagagtttctgctggg

SEQ ID NO: 8394011 - DNA, 22 bp, Homo sapiens
tggcctgcaaagtcttcttgct

SEQ ID NO: 8394012 - DNA, 22 bp, Homo sapiens
tggcctgatacttccagagttc

SEQ ID NO: 8394013 - DNA, 22 bp, Homo sapiens
tggcctgagttgtctgcaggcc

SEQ ID NO: 8394014 - DNA, 22 bp, Homo sapiens
tggcctgactgtccagccaggg

SEQ ID NO: 8394015 - DNA, 22 bp, Homo sapiens
tggcctggcagagcaaggcctg

SEQ ID NO: 8394016 - DNA, 22 bp, Homo sapiens
tggcctgccttcgctgagctga

SEQ ID NO: 8394017 - DNA, 22 bp, Homo sapiens
tggcagggtcttgctgtgttgc

SEQ ID NO: 8394018 - DNA, 22 bp, Homo sapiens
tggcagggtcttgctgtgttgc

SEQ ID NO: 8394019 - DNA, 22 bp, Homo sapiens
tggcagggtgccagttgcgagt

SEQ ID NO: 8394020 - DNA, 22 bp, Homo sapiens
tggcagggtgccagttgcgagt

SEQ ID NO: 8394021 - DNA, 22 bp, Homo sapiens
tggcagggtggcaacttttggt

SEQ ID NO: 8394022 - DNA, 22 bp, Homo sapiens
tggcagtcggacttctatctca

SEQ ID NO: 8394023 - DNA, 22 bp, Homo sapiens
tggcagtcctcttcctcgggcg

SEQ ID NO: 8394024 - DNA, 22 bp, Homo sapiens
tggcagtcgatcatattcagca

SEQ ID NO: 8394025 - DNA, 22 bp, Homo sapiens
tggcagtctgggttggcagtta

SEQ ID NO: 8394026 - DNA, 22 bp, Homo sapiens
tggcagtctgcctcttcaccat

SEQ ID NO: 8394027 - DNA, 22 bp, Homo sapiens
tggcagtccagaccctggactc

SEQ ID NO: 8394028 - DNA, 22 bp, Homo sapiens
tggcagtccctctggtagcacc

SEQ ID NO: 8394029 - DNA, 22 bp, Homo sapiens
tggcagtcccctgtgcctggaa

SEQ ID NO: 8394030 - DNA, 22 bp, Homo sapiens
tggcaggtttcgttaaaaatgg

SEQ ID NO: 8394031 - DNA, 22 bp, Homo sapiens
tggcagtcagcatttgtagtat

SEQ ID NO: 8394032 - DNA, 22 bp, Homo sapiens
tggcagtcattatcgctgagtc

SEQ ID NO: 8394033 - DNA, 18 bp, Homo sapiens
tggcagtgaggtaggcat

SEQ ID NO: 8394034 - DNA, 22 bp, Homo sapiens
tggcagtcttgtaggcatctcc

SEQ ID NO: 8394035 - DNA, 22 bp, Homo sapiens
tggcagtcttgctctctaagag

SEQ ID NO: 8394036 - DNA, 22 bp, Homo sapiens
tggcagtcttcatcagttctgg

SEQ ID NO: 8394037 - DNA, 22 bp, Homo sapiens
tggcatccagataccctgaggg

SEQ ID NO: 8394038 - DNA, 22 bp, Homo sapiens
tggcatgataggaggtgcagaa

SEQ ID NO: 8394039 - DNA, 22 bp, Homo sapiens
tggcatcgggccaccccatccc

SEQ ID NO: 8394040 - DNA, 22 bp, Homo sapiens
tggcatgaagtcagcagctggg

SEQ ID NO: 8394041 - DNA, 22 bp, Homo sapiens
tggcatggactagtgctgaggt

SEQ ID NO: 8394042 - DNA, 22 bp, Homo sapiens
tggcatggcaaccctgcaggga

SEQ ID NO: 8394043 - DNA, 22 bp, Homo sapiens
tggcatggcatttagagaatta

SEQ ID NO: 8394044 - DNA, 22 bp, Homo sapiens
tggcatggccagtgctgggagt

SEQ ID NO: 8394045 - DNA, 23 bp, Homo sapiens
tggccacagtccatgcatgccca

SEQ ID NO: 8394046 - DNA, 22 bp, Homo sapiens
tggccacccctttctctgcact

SEQ ID NO: 8394047 - DNA, 22 bp, Homo sapiens
tggcatgtggcagctggttcag

SEQ ID NO: 8394048 - DNA, 22 bp, Homo sapiens
tggcatttagagaaatgaagga

SEQ ID NO: 8394049 - DNA, 22 bp, Homo sapiens
tggcatttcacctttcatttcc

SEQ ID NO: 8394050 - DNA, 22 bp, Homo sapiens
tggcatttcagtattttcataa

SEQ ID NO: 8394051 - DNA, 22 bp, Homo sapiens
tggccacactgcccccactggg

SEQ ID NO: 8394052 - DNA, 22 bp, Homo sapiens
tggccagccacaatataaagta

SEQ ID NO: 8394053 - DNA, 22 bp, Homo sapiens
tggccagccagaaagaagcctt

SEQ ID NO: 8394054 - DNA, 22 bp, Homo sapiens
tggccagcagagttcactctct

SEQ ID NO: 8394055 - DNA, 22 bp, Homo sapiens
tggccagcacttagcccttacc

SEQ ID NO: 8394056 - DNA, 22 bp, Homo sapiens
tggccagcacttagcccttacc

SEQ ID NO: 8394057 - DNA, 23 bp, Homo sapiens
tggccagcagaagcaaggggagc

SEQ ID NO: 8394058 - DNA, 22 bp, Homo sapiens
tggccagccctcttcccacact

SEQ ID NO: 8394059 - DNA, 22 bp, Homo sapiens
tggccagccctcttcccacact

SEQ ID NO: 8394060 - DNA, 22 bp, Homo sapiens
tggccagccataaaagaaccca

SEQ ID NO: 8394061 - DNA, 22 bp, Homo sapiens
tggccagcccttcagccatgcc

SEQ ID NO: 8394062 - DNA, 21 bp, Homo sapiens
tggccagctggagtctccaca

SEQ ID NO: 8394063 - DNA, 21 bp, Homo sapiens
tggccagctgctcgtctcctc

SEQ ID NO: 8394064 - DNA, 22 bp, Homo sapiens
tggccagctgagatttagcaca

SEQ ID NO: 8394065 - DNA, 22 bp, Homo sapiens
tggccagccttgtcatcgcttt

SEQ ID NO: 8394066 - DNA, 22 bp, Homo sapiens
tggccagcctggtgcttgctcc

SEQ ID NO: 8394067 - DNA, 19 bp, Homo sapiens
tggccaggtactgtctgct

SEQ ID NO: 8394068 - DNA, 22 bp, Homo sapiens
tggccaggctggtctggaacgc

SEQ ID NO: 8394069 - DNA, 22 bp, Homo sapiens
tggccaggcctcttggtgccca

SEQ ID NO: 8394070 - DNA, 22 bp, Homo sapiens
tctttggaagctttcagagaag

SEQ ID NO: 8394071 - DNA, 22 bp, Homo sapiens
tctttggaagctttcagagaag

SEQ ID NO: 8394072 - DNA, 22 bp, Homo sapiens
tctttgctgagtacatctccaa

SEQ ID NO: 8394073 - DNA, 22 bp, Homo sapiens
tctttggaaaaaatggacaatc

SEQ ID NO: 8394074 - DNA, 22 bp, Homo sapiens
tctttgctgagtacatctccaa

SEQ ID NO: 8394075 - DNA, 22 bp, Homo sapiens
tctttgctcttacacagttagt

SEQ ID NO: 8394076 - DNA, 22 bp, Homo sapiens
tctttggaaatgctttgagaat

SEQ ID NO: 8394077 - DNA, 22 bp, Homo sapiens
tctttgcagaacgatgaagatg

SEQ ID NO: 8394078 - DNA, 22 bp, Homo sapiens
tctttggatctcaaggtggcag

SEQ ID NO: 8394079 - DNA, 22 bp, Homo sapiens
tctttggatcccaactggctgg

SEQ ID NO: 8394080 - DNA, 22 bp, Homo sapiens
tctttggatatgtatggataga

SEQ ID NO: 8394081 - DNA, 22 bp, Homo sapiens
tctttggagtgttatcagtaat

SEQ ID NO: 8394082 - DNA, 22 bp, Homo sapiens
tctttggaatgctagcattcta

SEQ ID NO: 8394083 - DNA, 22 bp, Homo sapiens
tctttggaattctctgcagccc

SEQ ID NO: 8394084 - DNA, 18 bp, Homo sapiens
tctttggacaactactgg

SEQ ID NO: 8394085 - DNA, 22 bp, Homo sapiens
tctttggaatttgctggaaata

SEQ ID NO: 8394086 - DNA, 22 bp, Homo sapiens
tctttggactttccaatttgtt

SEQ ID NO: 8394087 - DNA, 22 bp, Homo sapiens
tctttgtggcgggcttaaatac

SEQ ID NO: 8394088 - DNA, 22 bp, Homo sapiens
tctttgtactttctggctgtcc

SEQ ID NO: 8394089 - DNA, 22 bp, Homo sapiens
tctttggcatttaggagcagga

SEQ ID NO: 8394090 - DNA, 22 bp, Homo sapiens
tctttggcatcagggccagcta

SEQ ID NO: 8394091 - DNA, 22 bp, Homo sapiens
tctttggcatcagggccagcta

SEQ ID NO: 8394092 - DNA, 22 bp, Homo sapiens
tctttggcatcagggccagcta

SEQ ID NO: 8394093 - DNA, 22 bp, Homo sapiens
tctttggcatttaggagcagga

SEQ ID NO: 8394094 - DNA, 22 bp, Homo sapiens
tctttgtgttcaggagccacgt

SEQ ID NO: 8394095 - DNA, 20 bp, Homo sapiens
tctttgtgtcagatggacag

SEQ ID NO: 8394096 - DNA, 22 bp, Homo sapiens
tcttttagtaataaatatttgt

SEQ ID NO: 8394097 - DNA, 22 bp, Homo sapiens
tcttttagagcatttctgattc

SEQ ID NO: 8394098 - DNA, 22 bp, Homo sapiens
tcttttagctctgcaaggaaag

SEQ ID NO: 8394099 - DNA, 22 bp, Homo sapiens
tcttttatagtgaattttcttg

SEQ ID NO: 8394100 - DNA, 21 bp, Homo sapiens
tcttttaacaccaggaattcc

SEQ ID NO: 8394101 - DNA, 21 bp, Homo sapiens
tcttttaacaccaggaattcc

SEQ ID NO: 8394102 - DNA, 22 bp, Homo sapiens
tcttttccttgatggttaaata

SEQ ID NO: 8394103 - DNA, 21 bp, Homo sapiens
tcttttctctgcaggattcct

SEQ ID NO: 8394104 - DNA, 21 bp, Homo sapiens
tcttttcctttctgtgtgcaa

SEQ ID NO: 8394105 - DNA, 19 bp, Homo sapiens
tcttttcacgcattttgaa

SEQ ID NO: 8394106 - DNA, 23 bp, Homo sapiens
tcttttcaatggttctttatgtg

SEQ ID NO: 8394107 - DNA, 22 bp, Homo sapiens
tcttttattaggctgaaatggg

SEQ ID NO: 8394108 - DNA, 22 bp, Homo sapiens
tgaaacataaagttatcttcag

SEQ ID NO: 8394109 - DNA, 22 bp, Homo sapiens
tgaaacattatagaatatttat

SEQ ID NO: 8394110 - DNA, 22 bp, Homo sapiens
tgaaacattgcactgtatgaat

SEQ ID NO: 8394111 - DNA, 21 bp, Homo sapiens
tgaaacatttgatcaaagcac

SEQ ID NO: 8394112 - DNA, 22 bp, Homo sapiens
tgaaacatttgatgatctttgg

SEQ ID NO: 8394113 - DNA, 22 bp, Homo sapiens
tgaaacaggaagtaaacagaca

SEQ ID NO: 8394114 - DNA, 22 bp, Homo sapiens
tgaaacagtgcttcactcagcc

SEQ ID NO: 8394115 - DNA, 19 bp, Homo sapiens
tgaaacaaacttaaaagga

SEQ ID NO: 8394116 - DNA, 19 bp, Homo sapiens
tgaaacaaacttaaaagga

SEQ ID NO: 8394117 - DNA, 22 bp, Homo sapiens
tgaaacaaaccagtaattttgt

SEQ ID NO: 8394118 - DNA, 22 bp, Homo sapiens
tgaaactgaaaggtatttatag

SEQ ID NO: 8394119 - DNA, 21 bp, Homo sapiens
tgaaagaaggtgcagtctgaa

SEQ ID NO: 8394120 - DNA, 22 bp, Homo sapiens
tgaaagaagggtggaaaatgta

SEQ ID NO: 8394121 - DNA, 22 bp, Homo sapiens
tgaaagaagccttcgaggctcg

SEQ ID NO: 8394122 - DNA, 22 bp, Homo sapiens
tgaaagaagggtggaaaatgta

SEQ ID NO: 8394123 - DNA, 22 bp, Homo sapiens
tgaaagaactagcatcttcaag

SEQ ID NO: 8394124 - DNA, 22 bp, Homo sapiens
tgaaagaactagcatcttcaag

SEQ ID NO: 8394125 - DNA, 17 bp, Homo sapiens
tgaaagaatcagggaga

SEQ ID NO: 8394126 - DNA, 22 bp, Homo sapiens
tgaaagaagtgtcacattgcca

SEQ ID NO: 8394127 - DNA, 22 bp, Homo sapiens
tgaaagaagtgtcacattgcca

SEQ ID NO: 8394128 - DNA, 22 bp, Homo sapiens
tgaaagaagtgtcacattgcca

SEQ ID NO: 8394129 - DNA, 21 bp, Homo sapiens
tgaaagaaggtgcagtctgaa

SEQ ID NO: 8394130 - DNA, 22 bp, Homo sapiens
tgaaaaaacaagttggcccatt

SEQ ID NO: 8394131 - DNA, 22 bp, Homo sapiens
tcttttgttgcctacttattaa

SEQ ID NO: 8394132 - DNA, 22 bp, Homo sapiens
tcttttgttgcctacttattaa

SEQ ID NO: 8394133 - DNA, 22 bp, Homo sapiens
tctttttatattgacaaaaggt

SEQ ID NO: 8394134 - DNA, 22 bp, Homo sapiens
tctttttatattgacaaaaggt

SEQ ID NO: 8394135 - DNA, 22 bp, Homo sapiens
tctttttttcctgtgcagagct

SEQ ID NO: 8394136 - DNA, 22 bp, Homo sapiens
tctttttatattgacaaaaggt

SEQ ID NO: 8394137 - DNA, 22 bp, Homo sapiens
tgaaaattgttgtacttgataa

SEQ ID NO: 8394138 - DNA, 22 bp, Homo sapiens
tgaaaatttccatcagttatat

SEQ ID NO: 8394139 - DNA, 22 bp, Homo sapiens
tgaaaatttccatcagttatat

SEQ ID NO: 8394140 - DNA, 22 bp, Homo sapiens
tgaaaatttccatcagttatat

SEQ ID NO: 8394141 - DNA, 22 bp, Homo sapiens
tgaaaatggcctgaagaagcaa

SEQ ID NO: 8394142 - DNA, 22 bp, Homo sapiens
tgaaaattcatctcatagcaga

SEQ ID NO: 8394143 - DNA, 22 bp, Homo sapiens
tgaaaatatagttttccagact

SEQ ID NO: 8394144 - DNA, 22 bp, Homo sapiens
tgaaaatatagttttccagact

SEQ ID NO: 8394145 - DNA, 22 bp, Homo sapiens
tgaaaatgcacgctggaaagca

SEQ ID NO: 8394146 - DNA, 22 bp, Homo sapiens
tgaacatgctgttgatggcctg

SEQ ID NO: 8394147 - DNA, 22 bp, Homo sapiens
tgaacattcctgaatgaagcat

SEQ ID NO: 8394148 - DNA, 22 bp, Homo sapiens
tgaaccaggcacatttcctaca

SEQ ID NO: 8394149 - DNA, 22 bp, Homo sapiens
tgaactcctgacctcatgatcc

SEQ ID NO: 8394150 - DNA, 22 bp, Homo sapiens
tgaactcctgacctcatgatcc

SEQ ID NO: 8394151 - DNA, 22 bp, Homo sapiens
tgaactcctgacctcatgatcc

SEQ ID NO: 8394152 - DNA, 22 bp, Homo sapiens
tgaaattagaaatatgtatggg

SEQ ID NO: 8394153 - DNA, 22 bp, Homo sapiens
tgaaattagtgaagttacagtt

SEQ ID NO: 8394154 - DNA, 22 bp, Homo sapiens
tgaacaaactgcattcttcact

SEQ ID NO: 8394155 - DNA, 19 bp, Homo sapiens
tgaagcaataccatttttg

SEQ ID NO: 8394156 - DNA, 22 bp, Homo sapiens
tgaagcaagtctattgccctgg

SEQ ID NO: 8394157 - DNA, 22 bp, Homo sapiens
tgaagcaagatagaaagctgct

SEQ ID NO: 8394158 - DNA, 22 bp, Homo sapiens
tgaagcaactggacaagttggc

SEQ ID NO: 8394159 - DNA, 22 bp, Homo sapiens
tgaagcaacaagtctggcccca

SEQ ID NO: 8394160 - DNA, 22 bp, Homo sapiens
tgaagcaaacgcttctgttcct

SEQ ID NO: 8394161 - DNA, 22 bp, Homo sapiens
tgaagcaaattgtttagcctga

SEQ ID NO: 8394162 - DNA, 22 bp, Homo sapiens
tgaagagaagaaaattatcttt

SEQ ID NO: 8394163 - DNA, 22 bp, Homo sapiens
tgaagcaatgatcttttggtgg

SEQ ID NO: 8394164 - DNA, 22 bp, Homo sapiens
tgaagcaatgatagcagaatga

SEQ ID NO: 8394165 - DNA, 22 bp, Homo sapiens
tgaagcaatagagacaagacca

SEQ ID NO: 8394166 - DNA, 22 bp, Homo sapiens
tgaagacaaagtcaggcccaga

SEQ ID NO: 8394167 - DNA, 22 bp, Homo sapiens
tgaagactttgctcttaaccac

SEQ ID NO: 8394168 - DNA, 22 bp, Homo sapiens
tgaagacagttttactcatgag

SEQ ID NO: 8394169 - DNA, 22 bp, Homo sapiens
tgaagacagttttactcatgag

SEQ ID NO: 8394170 - DNA, 22 bp, Homo sapiens
tgaagaaaggtgtgggatactc

SEQ ID NO: 8394171 - DNA, 22 bp, Homo sapiens
tgaagaaacgcagagaggtagg

SEQ ID NO: 8394172 - DNA, 22 bp, Homo sapiens
tgaagaaaggtgtgggatactc

SEQ ID NO: 8394173 - DNA, 22 bp, Homo sapiens
tgaagaaacgcagagaggtagg

SEQ ID NO: 8394174 - DNA, 22 bp, Homo sapiens
tgaagaaaatatgattacccca

SEQ ID NO: 8394175 - DNA, 22 bp, Homo sapiens
tgaagaaacagaccaagaggat

SEQ ID NO: 8394176 - DNA, 22 bp, Homo sapiens
tgaagaaacagaccaagaggat

SEQ ID NO: 8394177 - DNA, 22 bp, Homo sapiens
tgaagaaacgcagagaggtagg

SEQ ID NO: 8394178 - DNA, 22 bp, Homo sapiens
tgaaatgttggcatcggtacct

SEQ ID NO: 8394179 - DNA, 22 bp, Homo sapiens
tgaaatgttggtaattttatat

SEQ ID NO: 8394180 - DNA, 22 bp, Homo sapiens
tgaaatgttctggagtttctgt

SEQ ID NO: 8394181 - DNA, 22 bp, Homo sapiens
tgaaatgtctttgcaattgaaa

SEQ ID NO: 8394182 - DNA, 22 bp, Homo sapiens
tgaaatgtgtccatgttatttc

SEQ ID NO: 8394183 - DNA, 22 bp, Homo sapiens
tgaaatgtcagtgttttataag

SEQ ID NO: 8394184 - DNA, 23 bp, Homo sapiens
tgaaatgtagaggaattccacct

SEQ ID NO: 8394185 - DNA, 22 bp, Homo sapiens
tgaaatctcctctttatatatc

SEQ ID NO: 8394186 - DNA, 22 bp, Homo sapiens
tgaaatgcctatgaagtcagga

SEQ ID NO: 8394187 - DNA, 22 bp, Homo sapiens
tgaaatcttatactttggtagt

SEQ ID NO: 8394188 - DNA, 22 bp, Homo sapiens
tgaaatgtacaagtgctttttt

SEQ ID NO: 8394189 - DNA, 22 bp, Homo sapiens
tgaaagtatttgatttctatta

SEQ ID NO: 8394190 - DNA, 22 bp, Homo sapiens
tgaaagtaaccaagggaaggtc

SEQ ID NO: 8394191 - DNA, 22 bp, Homo sapiens
tgaaagtagcgcatttcactca

SEQ ID NO: 8394192 - DNA, 22 bp, Homo sapiens
tgaaagttaggatgtagtaatt

SEQ ID NO: 8394193 - DNA, 22 bp, Homo sapiens
tgaaagttattactgatgatgt

SEQ ID NO: 8394194 - DNA, 20 bp, Homo sapiens
tgaaatagatactcagagat

SEQ ID NO: 8394195 - DNA, 23 bp, Homo sapiens
tgaaatattcttttgcatgagct

SEQ ID NO: 8394196 - DNA, 22 bp, Homo sapiens
tgaaatcagtatgtctttctca

SEQ ID NO: 8394197 - DNA, 22 bp, Homo sapiens
tgaattcatacagtggatacca

SEQ ID NO: 8394198 - DNA, 22 bp, Homo sapiens
tgaattcatccatttatgcaag

SEQ ID NO: 8394199 - DNA, 22 bp, Homo sapiens
tgaattcaagttgttgagccat

SEQ ID NO: 8394200 - DNA, 22 bp, Homo sapiens
tgaattcaggggctattatatt

SEQ ID NO: 8394201 - DNA, 22 bp, Homo sapiens
tgaattccattgccaaagtttt

SEQ ID NO: 8394202 - DNA, 21 bp, Homo sapiens
tgaatttccctctatcattct

SEQ ID NO: 8394203 - DNA, 23 bp, Homo sapiens
tgaattttggcatattctgaaat

SEQ ID NO: 8394204 - DNA, 23 bp, Homo sapiens
tgaattttggcatattctgaaat

SEQ ID NO: 8394205 - DNA, 20 bp, Homo sapiens
tgacacaaattgctttctca

SEQ ID NO: 8394206 - DNA, 22 bp, Homo sapiens
tgacaattgttgtgaattcttc

SEQ ID NO: 8394207 - DNA, 22 bp, Homo sapiens
tgacaattgtgggcagtttgtg

SEQ ID NO: 8394208 - DNA, 22 bp, Homo sapiens
tgacaattgtgggcagtttgtg

SEQ ID NO: 8394209 - DNA, 22 bp, Homo sapiens
tgacaaaactgcaattactttt

SEQ ID NO: 8394210 - DNA, 22 bp, Homo sapiens
tgacaaagaggaacagcagggg

SEQ ID NO: 8394211 - DNA, 22 bp, Homo sapiens
tgaatcagtataaattctcaaa

SEQ ID NO: 8394212 - DNA, 22 bp, Homo sapiens
tgaatagtgttctataatatgg

SEQ ID NO: 8394213 - DNA, 22 bp, Homo sapiens
tgaatagtaagagaatatttgc

SEQ ID NO: 8394214 - DNA, 21 bp, Homo sapiens
tgaatagggccagaaccaaag

SEQ ID NO: 8394215 - DNA, 22 bp, Homo sapiens
tgaatactatttcataatgtgg

SEQ ID NO: 8394216 - DNA, 22 bp, Homo sapiens
tgaatactatttcataatgtgg

SEQ ID NO: 8394217 - DNA, 22 bp, Homo sapiens
tgaatgtgatgctaaacatatg

SEQ ID NO: 8394218 - DNA, 22 bp, Homo sapiens
tgaatggtcactgagcatctgt

SEQ ID NO: 8394219 - DNA, 22 bp, Homo sapiens
tgaatggtgattggtgcttctc

SEQ ID NO: 8394220 - DNA, 22 bp, Homo sapiens
tgaattcaaattgtgcctatta

SEQ ID NO: 8394221 - DNA, 22 bp, Homo sapiens
tgaatgctttggagccttctaa

SEQ ID NO: 8394222 - DNA, 21 bp, Homo sapiens
tgaatgcttcgtcatcctggc

SEQ ID NO: 8394223 - DNA, 22 bp, Homo sapiens
tgaagcccaatcctgtgttcct

SEQ ID NO: 8394224 - DNA, 22 bp, Homo sapiens
tgaagcccaaggcactgtctga

SEQ ID NO: 8394225 - DNA, 23 bp, Homo sapiens
tgaagcccagtgattttgtttca

SEQ ID NO: 8394226 - DNA, 22 bp, Homo sapiens
tgaagcccaggtgttagtgggg

SEQ ID NO: 8394227 - DNA, 22 bp, Homo sapiens
tgaagcccaggaatctacattt

SEQ ID NO: 8394228 - DNA, 22 bp, Homo sapiens
tgaagcccctaagtcccaggca

SEQ ID NO: 8394229 - DNA, 22 bp, Homo sapiens
tgaagccctgtcttatggaaga

SEQ ID NO: 8394230 - DNA, 22 bp, Homo sapiens
tgaagccctgtcttatggaaga

SEQ ID NO: 8394231 - DNA, 22 bp, Homo sapiens
tgaagccctgtgataggtccag

SEQ ID NO: 8394232 - DNA, 22 bp, Homo sapiens
tgaagccctgtgtcagcttcca

SEQ ID NO: 8394233 - DNA, 22 bp, Homo sapiens
tgaagcccttcatgcacagtca

SEQ ID NO: 8394234 - DNA, 22 bp, Homo sapiens
tgaaggcaacctctgtggtcct

SEQ ID NO: 8394235 - DNA, 22 bp, Homo sapiens
tgaaggcacgtgggtggatact

SEQ ID NO: 8394236 - DNA, 22 bp, Homo sapiens
tgaaggcacgtgggtggatact

SEQ ID NO: 8394237 - DNA, 22 bp, Homo sapiens
tgaagcttgtatttaaataagt

SEQ ID NO: 8394238 - DNA, 22 bp, Homo sapiens
tgaagctgcctgctcacagcca

SEQ ID NO: 8394239 - DNA, 22 bp, Homo sapiens
tgaagctggaagcatgcagact

SEQ ID NO: 8394240 - DNA, 22 bp, Homo sapiens
tgaaggctgggctcagccagct

SEQ ID NO: 8394241 - DNA, 22 bp, Homo sapiens
tgaaggctttttaaagcatttg

SEQ ID NO: 8394242 - DNA, 22 bp, Homo sapiens
tgaaggcatttgagttggtgag

SEQ ID NO: 8394243 - DNA, 22 bp, Homo sapiens
tgaaggcataaatcttgggaac

SEQ ID NO: 8394244 - DNA, 22 bp, Homo sapiens
tgaaggcacttgcctaggggca

SEQ ID NO: 8394245 - DNA, 22 bp, Homo sapiens
tgaaggccagcagagtgaaggc

SEQ ID NO: 8394246 - DNA, 22 bp, Homo sapiens
tgaaggccacttcctgtgagct

SEQ ID NO: 8394247 - DNA, 22 bp, Homo sapiens
tgaaggccagggatttgcagcc

SEQ ID NO: 8394248 - DNA, 23 bp, Homo sapiens
tgaaggccctggagccacgaggc

SEQ ID NO: 8394249 - DNA, 22 bp, Homo sapiens
tgaaggtgacctgacagtggct

SEQ ID NO: 8394250 - DNA, 22 bp, Homo sapiens
tgaagtttaaggttagataagt

SEQ ID NO: 8394251 - DNA, 22 bp, Homo sapiens
tgaagttttactaggtgaattt

SEQ ID NO: 8394252 - DNA, 22 bp, Homo sapiens
tgaagttttctggttgattaag

SEQ ID NO: 8394253 - DNA, 22 bp, Homo sapiens
tgacacagaaattaagctgtca

SEQ ID NO: 8394254 - DNA, 22 bp, Homo sapiens
tgacacagaatttggctatcac

SEQ ID NO: 8394255 - DNA, 19 bp, Homo sapiens
tgacacagctaggtttgct

SEQ ID NO: 8394256 - DNA, 22 bp, Homo sapiens
tgacacagggaaagcggatcca

SEQ ID NO: 8394257 - DNA, 22 bp, Homo sapiens
tgacacagggcatgcagcagaa

SEQ ID NO: 8394258 - DNA, 22 bp, Homo sapiens
tgacacagggcatgcagcagaa

SEQ ID NO: 8394259 - DNA, 22 bp, Homo sapiens
tgacacaggggaaggagtctgg

SEQ ID NO: 8394260 - DNA, 23 bp, Homo sapiens
tgacacaggtcaaaaataagatg

SEQ ID NO: 8394261 - DNA, 22 bp, Homo sapiens
tgacacagttgtcgactctaca

SEQ ID NO: 8394262 - DNA, 22 bp, Homo sapiens
tgacacagtatcaaacatgatt

SEQ ID NO: 8394263 - DNA, 22 bp, Homo sapiens
tgacacagtagaaagatgatga

SEQ ID NO: 8394264 - DNA, 22 bp, Homo sapiens
tgacactatgtgtgcagccaga

SEQ ID NO: 8394265 - DNA, 22 bp, Homo sapiens
tgacagaaagaatatgtcaatc

SEQ ID NO: 8394266 - DNA, 22 bp, Homo sapiens
tgacagaacaggttgggagcaa

SEQ ID NO: 8394267 - DNA, 18 bp, Homo sapiens
tgacagaacctggagcct

SEQ ID NO: 8394268 - DNA, 18 bp, Homo sapiens
tgacagaacctggagcct

SEQ ID NO: 8394269 - DNA, 22 bp, Homo sapiens
tgacagaccactgcaactctgt

SEQ ID NO: 8394270 - DNA, 22 bp, Homo sapiens
tgacagcagcatagtgagcaat

SEQ ID NO: 8394271 - DNA, 21 bp, Homo sapiens
tgacagcatagagcagggagg

SEQ ID NO: 8394272 - DNA, 22 bp, Homo sapiens
tgacagcatgaccacagggtct

SEQ ID NO: 8394273 - DNA, 22 bp, Homo sapiens
tgacagcatgaccacagggtct

SEQ ID NO: 8394274 - DNA, 22 bp, Homo sapiens
tgacagcagcatagtgagcaat

SEQ ID NO: 8394275 - DNA, 22 bp, Homo sapiens
tgacagcattactaatacatgt

SEQ ID NO: 8394276 - DNA, 22 bp, Homo sapiens
tgacagccatgatccttactgt

SEQ ID NO: 8394277 - DNA, 22 bp, Homo sapiens
tgacagcccacctcacaggatt

SEQ ID NO: 8394278 - DNA, 22 bp, Homo sapiens
tgacagcctcactttgttaatt

SEQ ID NO: 8394279 - DNA, 22 bp, Homo sapiens
tgacaggaggcttgaggccagg

SEQ ID NO: 8394280 - DNA, 22 bp, Homo sapiens
tgacagggacagtggagatgga

SEQ ID NO: 8394281 - DNA, 22 bp, Homo sapiens
tgacaggagggttgtggcaggg

SEQ ID NO: 8394282 - DNA, 22 bp, Homo sapiens
tgacatttgagagagatataca

SEQ ID NO: 8394283 - DNA, 22 bp, Homo sapiens
tgacatttgagagagatataca

SEQ ID NO: 8394284 - DNA, 22 bp, Homo sapiens
tgacatgtatgttgttggcatg

SEQ ID NO: 8394285 - DNA, 21 bp, Homo sapiens
tgacatttccaatataaagcc

SEQ ID NO: 8394286 - DNA, 22 bp, Homo sapiens
tgacctcttgtcggagctccag

SEQ ID NO: 8394287 - DNA, 22 bp, Homo sapiens
tgacctgacatgaattaaaaac

SEQ ID NO: 8394288 - DNA, 22 bp, Homo sapiens
tgacctgacatgaattaaaaac

SEQ ID NO: 8394289 - DNA, 22 bp, Homo sapiens
tgacctctgtcctgcagtctgg

SEQ ID NO: 8394290 - DNA, 22 bp, Homo sapiens
tgactacaacctccacctcccg

SEQ ID NO: 8394291 - DNA, 22 bp, Homo sapiens
tgactcctggtatggatgacag

SEQ ID NO: 8394292 - DNA, 22 bp, Homo sapiens
tgactcttaaatatactgttga

SEQ ID NO: 8394293 - DNA, 22 bp, Homo sapiens
tgactgaggtttgatatatacc

SEQ ID NO: 8394294 - DNA, 22 bp, Homo sapiens
tgactgagggaggaagcaggtg

SEQ ID NO: 8394295 - DNA, 21 bp, Homo sapiens
tgactgaggcttcttcacaca

SEQ ID NO: 8394296 - DNA, 21 bp, Homo sapiens
tgactgaggcttcttcacaca

SEQ ID NO: 8394297 - DNA, 22 bp, Homo sapiens
tgactgagagagaactcagctt

SEQ ID NO: 8394298 - DNA, 22 bp, Homo sapiens
tgactgagagagaactcagctt

SEQ ID NO: 8394299 - DNA, 22 bp, Homo sapiens
tgactgaggaagaccaggtagc

SEQ ID NO: 8394300 - DNA, 22 bp, Homo sapiens
tgactgaggcagcctgagttat

SEQ ID NO: 8394301 - DNA, 22 bp, Homo sapiens
tgactgaggcctgataacagtt

SEQ ID NO: 8394302 - DNA, 22 bp, Homo sapiens
tgactgaggcctgataacagtt

SEQ ID NO: 8394303 - DNA, 22 bp, Homo sapiens
tgactgtgcaagcagagagcat

SEQ ID NO: 8394304 - DNA, 22 bp, Homo sapiens
tgactgtgccgtgcccctagga

SEQ ID NO: 8394305 - DNA, 17 bp, Homo sapiens
tgacttaacagcaaggc

SEQ ID NO: 8394306 - DNA, 22 bp, Homo sapiens
tgacttctagcatttagcaacc

SEQ ID NO: 8394307 - DNA, 22 bp, Homo sapiens
tgacttgtctctttgggagaca

SEQ ID NO: 8394308 - DNA, 22 bp, Homo sapiens
tgacttctgattgcttctattt

SEQ ID NO: 8394309 - DNA, 22 bp, Homo sapiens
tgacttctgggtgagccagcat

SEQ ID NO: 8394310 - DNA, 22 bp, Homo sapiens
tgagctcatagctcttattatg

SEQ ID NO: 8394311 - DNA, 22 bp, Homo sapiens
tgagctaggtcctgtgtcagct

SEQ ID NO: 8394312 - DNA, 22 bp, Homo sapiens
tgagctaagtactctcatcaag

SEQ ID NO: 8394313 - DNA, 22 bp, Homo sapiens
tgagctagggctggtgaggagc

SEQ ID NO: 8394314 - DNA, 22 bp, Homo sapiens
tgagcccatgtagcacttccat

SEQ ID NO: 8394315 - DNA, 22 bp, Homo sapiens
tgagccagtctgtctgggtgaa

SEQ ID NO: 8394316 - DNA, 22 bp, Homo sapiens
tgagccagtggaagatggcagt

SEQ ID NO: 8394317 - DNA, 22 bp, Homo sapiens
tgagccagtggaagatggcagt

SEQ ID NO: 8394318 - DNA, 22 bp, Homo sapiens
tgagccaggttaagacaggagc

SEQ ID NO: 8394319 - DNA, 22 bp, Homo sapiens
tgagccaggttaagacaggagc

SEQ ID NO: 8394320 - DNA, 22 bp, Homo sapiens
tgagccaggttttccatcattc

SEQ ID NO: 8394321 - DNA, 19 bp, Homo sapiens
tgagctgctgctgcccatc

SEQ ID NO: 8394322 - DNA, 22 bp, Homo sapiens
tgaggaaaacgtattgaaagga

SEQ ID NO: 8394323 - DNA, 22 bp, Homo sapiens
tgaggaaaacgtattgaaagga

SEQ ID NO: 8394324 - DNA, 22 bp, Homo sapiens
tgaggaaactgaggcacagatg

SEQ ID NO: 8394325 - DNA, 22 bp, Homo sapiens
tgaggaaaatgtcttatagatt

SEQ ID NO: 8394326 - DNA, 22 bp, Homo sapiens
tgaggaaacttacaaggcagaa

SEQ ID NO: 8394327 - DNA, 22 bp, Homo sapiens
tgagccaggctccatgccacct

SEQ ID NO: 8394328 - DNA, 22 bp, Homo sapiens
tgagccaggctcaagtgatcct

SEQ ID NO: 8394329 - DNA, 22 bp, Homo sapiens
tgagccaggagtttgaggctgt

SEQ ID NO: 8394330 - DNA, 22 bp, Homo sapiens
tgagccaggagtttgaggctgt

SEQ ID NO: 8394331 - DNA, 22 bp, Homo sapiens
tgagccagccttgcagctgtgc

SEQ ID NO: 8394332 - DNA, 22 bp, Homo sapiens
tgagccagcaggcctccagtgg

SEQ ID NO: 8394333 - DNA, 22 bp, Homo sapiens
tgagcagggactttgagtgtag

SEQ ID NO: 8394334 - DNA, 22 bp, Homo sapiens
tgagcagtggcaccaggtcacc

SEQ ID NO: 8394335 - DNA, 22 bp, Homo sapiens
tgagcagtgatgcgttttgttt

SEQ ID NO: 8394336 - DNA, 22 bp, Homo sapiens
tgagcagtggggcctgcattct

SEQ ID NO: 8394337 - DNA, 22 bp, Homo sapiens
tgagcagtggctcctgctggac

SEQ ID NO: 8394338 - DNA, 22 bp, Homo sapiens
tgagcagttcgacttcttcccc

SEQ ID NO: 8394339 - DNA, 22 bp, Homo sapiens
tgagcagtggtgtttttctatc

SEQ ID NO: 8394340 - DNA, 19 bp, Homo sapiens
tgagcatgcgagctgagaa

SEQ ID NO: 8394341 - DNA, 22 bp, Homo sapiens
tgagcatggtgggtgcagagca

SEQ ID NO: 8394342 - DNA, 22 bp, Homo sapiens
tgagcattggatcaaatgactt

SEQ ID NO: 8394343 - DNA, 22 bp, Homo sapiens
tgagccagataagggctcacgc

SEQ ID NO: 8394344 - DNA, 22 bp, Homo sapiens
tgagccagagtggagtgtgcct

SEQ ID NO: 8394345 - DNA, 22 bp, Homo sapiens
tgagcaggcaaacaatggttat

SEQ ID NO: 8394346 - DNA, 22 bp, Homo sapiens
tgagcaggagataaacaggtag

SEQ ID NO: 8394347 - DNA, 21 bp, Homo sapiens
tgagcaggagtcatgggaatg

SEQ ID NO: 8394348 - DNA, 22 bp, Homo sapiens
tgagcaggcgcagcaggaggtc

SEQ ID NO: 8394349 - DNA, 23 bp, Homo sapiens
tgagcagctaaaggtgatgcggg

SEQ ID NO: 8394350 - DNA, 22 bp, Homo sapiens
tgagcagcaggatcttctggta

SEQ ID NO: 8394351 - DNA, 22 bp, Homo sapiens
tgagcagcaactgtccatggca

SEQ ID NO: 8394352 - DNA, 22 bp, Homo sapiens
tgagcagatttgttctaggggt

SEQ ID NO: 8394353 - DNA, 22 bp, Homo sapiens
tgagcagatttgttctaggggt

SEQ ID NO: 8394354 - DNA, 22 bp, Homo sapiens
tgagcaggactcactgcagcct

SEQ ID NO: 8394355 - DNA, 22 bp, Homo sapiens
tgagcacatttcacatgacagg

SEQ ID NO: 8394356 - DNA, 22 bp, Homo sapiens
tgagcagagcaataggactctc

SEQ ID NO: 8394357 - DNA, 22 bp, Homo sapiens
tgagcagagcaataggactctc

SEQ ID NO: 8394358 - DNA, 22 bp, Homo sapiens
tgagcacagctttcactagaaa

SEQ ID NO: 8394359 - DNA, 22 bp, Homo sapiens
tgagcacagctcgcaccagctt

SEQ ID NO: 8394360 - DNA, 22 bp, Homo sapiens
tgagcacaagtttgcatgtgtg

SEQ ID NO: 8394361 - DNA, 19 bp, Homo sapiens
tgagcacacctgtacaccc

SEQ ID NO: 8394362 - DNA, 23 bp, Homo sapiens
tgagcaagtgaccaactgtctgt

SEQ ID NO: 8394363 - DNA, 22 bp, Homo sapiens
tgagcagaggagtgacgtaggt

SEQ ID NO: 8394364 - DNA, 22 bp, Homo sapiens
tgagcagaggccagcacctggg

SEQ ID NO: 8394365 - DNA, 22 bp, Homo sapiens
tgagcagagcagtaacaggagc

SEQ ID NO: 8394366 - DNA, 22 bp, Homo sapiens
tgagcagagtcgctccagagtg

SEQ ID NO: 8394367 - DNA, 22 bp, Homo sapiens
tgagcagagttgtttctcctga

SEQ ID NO: 8394368 - DNA, 22 bp, Homo sapiens
tgagagcagaggtgggcagcct

SEQ ID NO: 8394369 - DNA, 22 bp, Homo sapiens
tgagagccagaagggcctgagg

SEQ ID NO: 8394370 - DNA, 22 bp, Homo sapiens
tgagagcctagtaggtggaaaa

SEQ ID NO: 8394371 - DNA, 21 bp, Homo sapiens
tgagagagtagcaggacatat

SEQ ID NO: 8394372 - DNA, 21 bp, Homo sapiens
tgagagagtagcaggacatat

SEQ ID NO: 8394373 - DNA, 22 bp, Homo sapiens
tgagagagcgcctgggatcatt

SEQ ID NO: 8394374 - DNA, 22 bp, Homo sapiens
tgagagagcctgaatctcttac

SEQ ID NO: 8394375 - DNA, 18 bp, Homo sapiens
tgagagaatgttcatgct

SEQ ID NO: 8394376 - DNA, 22 bp, Homo sapiens
tgagagaaacgttccttacatc

SEQ ID NO: 8394377 - DNA, 22 bp, Homo sapiens
tgagacagttctgcagctgggt

SEQ ID NO: 8394378 - DNA, 22 bp, Homo sapiens
tgagagctgccacgtgaccatg

SEQ ID NO: 8394379 - DNA, 22 bp, Homo sapiens
tgagaggaacaggcagtaggtt

SEQ ID NO: 8394380 - DNA, 20 bp, Homo sapiens
tgagaggacatttttcatgt

SEQ ID NO: 8394381 - DNA, 18 bp, Homo sapiens
tgagaggctattttttgc

SEQ ID NO: 8394382 - DNA, 19 bp, Homo sapiens
tgagaggcttaaggcagct

SEQ ID NO: 8394383 - DNA, 18 bp, Homo sapiens
tgagaggctattttttgc

SEQ ID NO: 8394384 - DNA, 22 bp, Homo sapiens
tgagaggcgctcactctcaggt

SEQ ID NO: 8394385 - DNA, 22 bp, Homo sapiens
tgagaggccccagctcttggcc

SEQ ID NO: 8394386 - DNA, 17 bp, Homo sapiens
tgagatggaagaagact

SEQ ID NO: 8394387 - DNA, 22 bp, Homo sapiens
tgagatggagccactgcactct

SEQ ID NO: 8394388 - DNA, 22 bp, Homo sapiens
tgagatcatttatttacctttc

SEQ ID NO: 8394389 - DNA, 22 bp, Homo sapiens
tgagatcattgacttgttcctg

SEQ ID NO: 8394390 - DNA, 23 bp, Homo sapiens
tgagataggtattattatcatgc

SEQ ID NO: 8394391 - DNA, 22 bp, Homo sapiens
tgagatagtatatggaaagagt

SEQ ID NO: 8394392 - DNA, 22 bp, Homo sapiens
tgagataattaaatcaaaacct

SEQ ID NO: 8394393 - DNA, 22 bp, Homo sapiens
tgagaggtcaaagggcatggag

SEQ ID NO: 8394394 - DNA, 22 bp, Homo sapiens
tgagataataaatagctttctt

SEQ ID NO: 8394395 - DNA, 22 bp, Homo sapiens
tgagatttcgccgacagtattt

SEQ ID NO: 8394396 - DNA, 22 bp, Homo sapiens
tgagatttgagggttaatctga

SEQ ID NO: 8394397 - DNA, 22 bp, Homo sapiens
tgagatttgttttataaaatag

SEQ ID NO: 8394398 - DNA, 22 bp, Homo sapiens
tgagatttgttttataaaatag

SEQ ID NO: 8394399 - DNA, 22 bp, Homo sapiens
tgagattttcagcatcacttca

SEQ ID NO: 8394400 - DNA, 22 bp, Homo sapiens
tgagattttcctaaatataatg

SEQ ID NO: 8394401 - DNA, 22 bp, Homo sapiens
tgagattttcctaaatataatg

SEQ ID NO: 8394402 - DNA, 22 bp, Homo sapiens
tgagatggttcacagagaaggc

SEQ ID NO: 8394403 - DNA, 22 bp, Homo sapiens
tgagatggttcacagagaaggc

SEQ ID NO: 8394404 - DNA, 22 bp, Homo sapiens
tgagatggggagggctgcagaa

SEQ ID NO: 8394405 - DNA, 22 bp, Homo sapiens
tgagaagatttgctcttctgag

SEQ ID NO: 8394406 - DNA, 22 bp, Homo sapiens
tgagaagatttgctcttctgag

SEQ ID NO: 8394407 - DNA, 22 bp, Homo sapiens
tgagaagcacagctcactcacg

SEQ ID NO: 8394408 - DNA, 22 bp, Homo sapiens
tgagaagatttgctcttctgag

SEQ ID NO: 8394409 - DNA, 22 bp, Homo sapiens
tgagaagattgggcagagtgga

SEQ ID NO: 8394410 - DNA, 22 bp, Homo sapiens
tgagaagcccacactctttcct

SEQ ID NO: 8394411 - DNA, 22 bp, Homo sapiens
tgagaagcccacactctttcct

SEQ ID NO: 8394412 - DNA, 20 bp, Homo sapiens
tgagaaagtagagactcagg

SEQ ID NO: 8394413 - DNA, 22 bp, Homo sapiens
tgagaaaggtatttcatgcact

SEQ ID NO: 8394414 - DNA, 22 bp, Homo sapiens
tgagaaaggtatttcatgcact

SEQ ID NO: 8394415 - DNA, 22 bp, Homo sapiens
tgagaaatggcagcattactgg

SEQ ID NO: 8394416 - DNA, 22 bp, Homo sapiens
tgagaaatggcagcattactgg

SEQ ID NO: 8394417 - DNA, 22 bp, Homo sapiens
tgagaaatggcagcattactgg

SEQ ID NO: 8394418 - DNA, 22 bp, Homo sapiens
tgagaaaggtatttcatgcact

SEQ ID NO: 8394419 - DNA, 22 bp, Homo sapiens
tgagaaacatatgagagatttg

SEQ ID NO: 8394420 - DNA, 22 bp, Homo sapiens
tgagaaacacaggcatgaatag

SEQ ID NO: 8394421 - DNA, 22 bp, Homo sapiens
tgagaaacatatgagagatttg

SEQ ID NO: 8394422 - DNA, 22 bp, Homo sapiens
tgagaatttgcatttctaacaa

SEQ ID NO: 8394423 - DNA, 22 bp, Homo sapiens
tgagaattttcagtttcacttt

SEQ ID NO: 8394424 - DNA, 22 bp, Homo sapiens
tgagaattttttgtcatgcatt

SEQ ID NO: 8394425 - DNA, 22 bp, Homo sapiens
tgagaatgtgcaatatccttcc

SEQ ID NO: 8394426 - DNA, 18 bp, Homo sapiens
tgagaatgtaagaaatgg

SEQ ID NO: 8394427 - DNA, 20 bp, Homo sapiens
tgagaagctcctgtctcctc

SEQ ID NO: 8394428 - DNA, 22 bp, Homo sapiens
tgagacaacctaattaaacacc

SEQ ID NO: 8394429 - DNA, 22 bp, Homo sapiens
tgagacaacattgggcaagtcc

SEQ ID NO: 8394430 - DNA, 22 bp, Homo sapiens
tgagacaacctaattaaacacc

SEQ ID NO: 8394431 - DNA, 22 bp, Homo sapiens
tgagacagcagattagcaatga

SEQ ID NO: 8394432 - DNA, 17 bp, Homo sapiens
tgagacagggcaggccc

SEQ ID NO: 8394433 - DNA, 17 bp, Homo sapiens
tgagacagggcaggccc

SEQ ID NO: 8394434 - DNA, 22 bp, Homo sapiens
tgagacagcccttctgcacagg

SEQ ID NO: 8394435 - DNA, 22 bp, Homo sapiens
tgagacagcctctgcactcatg

SEQ ID NO: 8394436 - DNA, 19 bp, Homo sapiens
tgagggacattgggagcag

SEQ ID NO: 8394437 - DNA, 22 bp, Homo sapiens
tgaggcttgtctcagatggggg

SEQ ID NO: 8394438 - DNA, 22 bp, Homo sapiens
tgaggcttggcaaaagagtggt

SEQ ID NO: 8394439 - DNA, 22 bp, Homo sapiens
tgaggctttatgtaagggtgca

SEQ ID NO: 8394440 - DNA, 22 bp, Homo sapiens
tgagggagcacacactgaagtg

SEQ ID NO: 8394441 - DNA, 22 bp, Homo sapiens
tgagggaggccctttgagcaga

SEQ ID NO: 8394442 - DNA, 22 bp, Homo sapiens
tgaggggaggttggggcacatc

SEQ ID NO: 8394443 - DNA, 22 bp, Homo sapiens
tgagggagttgggtgtatagga

SEQ ID NO: 8394444 - DNA, 22 bp, Homo sapiens
tgaggggagacagagtggactc

SEQ ID NO: 8394445 - DNA, 22 bp, Homo sapiens
tgaggctgttctaccagggcca

SEQ ID NO: 8394446 - DNA, 21 bp, Homo sapiens
tgaggctgttgtaccagggag

SEQ ID NO: 8394447 - DNA, 21 bp, Homo sapiens
tgaggctgttgtaccagggag

SEQ ID NO: 8394448 - DNA, 22 bp, Homo sapiens
tgaggcttagagaagatgggat

SEQ ID NO: 8394449 - DNA, 22 bp, Homo sapiens
tgaggcttccaacatgtgagaa

SEQ ID NO: 8394450 - DNA, 22 bp, Homo sapiens
tgaggctggatgggatgcctcc

SEQ ID NO: 8394451 - DNA, 22 bp, Homo sapiens
tgaggcctgccctggggaagtt

SEQ ID NO: 8394452 - DNA, 22 bp, Homo sapiens
tgaggcctgccctggggaagtt

SEQ ID NO: 8394453 - DNA, 22 bp, Homo sapiens
tgaggcctggagggaggagttt

SEQ ID NO: 8394454 - DNA, 22 bp, Homo sapiens
tgaggcctggagggaggagttt

SEQ ID NO: 8394455 - DNA, 22 bp, Homo sapiens
tgaggccttagtaaccctgcac

SEQ ID NO: 8394456 - DNA, 22 bp, Homo sapiens
tgagtaggtggttaagcatgga

SEQ ID NO: 8394457 - DNA, 22 bp, Homo sapiens
tgagtattttaagttctcaatc

SEQ ID NO: 8394458 - DNA, 22 bp, Homo sapiens
tgagggtgcatttagcatgtag

SEQ ID NO: 8394459 - DNA, 22 bp, Homo sapiens
tgaggggccgcccaagcacttc

SEQ ID NO: 8394460 - DNA, 22 bp, Homo sapiens
tgaggggcggcctgcagaggcc

SEQ ID NO: 8394461 - DNA, 22 bp, Homo sapiens
tgaggtaatgtgtacgttaatt

SEQ ID NO: 8394462 - DNA, 22 bp, Homo sapiens
tgaggtaataagtgtttgtttt

SEQ ID NO: 8394463 - DNA, 18 bp, Homo sapiens
tgaggtagctttcctcct

SEQ ID NO: 8394464 - DNA, 22 bp, Homo sapiens
tgaggtgaatggtgtccctgga

SEQ ID NO: 8394465 - DNA, 22 bp, Homo sapiens
tgaggcaggaggattgcaggat

SEQ ID NO: 8394466 - DNA, 22 bp, Homo sapiens
tgaggcaggagaatggcgggaa

SEQ ID NO: 8394467 - DNA, 22 bp, Homo sapiens
tgaggcaggaggttgagaactg

SEQ ID NO: 8394468 - DNA, 22 bp, Homo sapiens
tgaggcaggagttaatgtgctc

SEQ ID NO: 8394469 - DNA, 22 bp, Homo sapiens
tgaggcaggagttaatgtgctc

SEQ ID NO: 8394470 - DNA, 22 bp, Homo sapiens
tgaggcaggaggttgagaactg

SEQ ID NO: 8394471 - DNA, 22 bp, Homo sapiens
tgaggcaggagttcaggctgcg

SEQ ID NO: 8394472 - DNA, 22 bp, Homo sapiens
tgaggcaggatgcttgcacagg

SEQ ID NO: 8394473 - DNA, 23 bp, Homo sapiens
tgaggcaggcggatcacgaggtc

SEQ ID NO: 8394474 - DNA, 22 bp, Homo sapiens
tgaggcagttgagcttcctgag

SEQ ID NO: 8394475 - DNA, 19 bp, Homo sapiens
tgaggccaaggtcacagat

SEQ ID NO: 8394476 - DNA, 22 bp, Homo sapiens
tgaggcagttcttacttgtatt

SEQ ID NO: 8394477 - DNA, 22 bp, Homo sapiens
tgaggcagttgagcttcctgag

SEQ ID NO: 8394478 - DNA, 21 bp, Homo sapiens
tgaggcaggggtgcttttgtc

SEQ ID NO: 8394479 - DNA, 23 bp, Homo sapiens
tgaggcaggcggatcacgaggtc

SEQ ID NO: 8394480 - DNA, 22 bp, Homo sapiens
tgaggcagggagagtggatatg

SEQ ID NO: 8394481 - DNA, 22 bp, Homo sapiens
tgaggcagggagtttaattgtc

SEQ ID NO: 8394482 - DNA, 22 bp, Homo sapiens
tgaggccctagggcatgggaga

SEQ ID NO: 8394483 - DNA, 22 bp, Homo sapiens
tgaggcctcataatgagatttc

SEQ ID NO: 8394484 - DNA, 22 bp, Homo sapiens
tgaggcctcatttagggagagg

SEQ ID NO: 8394485 - DNA, 18 bp, Homo sapiens
tgaggcccgcagaggtgg

SEQ ID NO: 8394486 - DNA, 22 bp, Homo sapiens
tgaggcccgggtggaggaatgc

SEQ ID NO: 8394487 - DNA, 22 bp, Homo sapiens
tgaggcctctgaggcctaggct

SEQ ID NO: 8394488 - DNA, 22 bp, Homo sapiens
tgaggcctgcattgaactagaa

SEQ ID NO: 8394489 - DNA, 22 bp, Homo sapiens
tgaggcctgaagcctggagcct

SEQ ID NO: 8394490 - DNA, 17 bp, Homo sapiens
tgaggcctgcatcagtg

SEQ ID NO: 8394491 - DNA, 22 bp, Homo sapiens
tgaggccacagtatcagaacag

SEQ ID NO: 8394492 - DNA, 22 bp, Homo sapiens
tgaggccacttccccacagccc

SEQ ID NO: 8394493 - DNA, 22 bp, Homo sapiens
tgaggccaggacccccagcagg

SEQ ID NO: 8394494 - DNA, 22 bp, Homo sapiens
tgaggccagcttcagcagtgga

SEQ ID NO: 8394495 - DNA, 18 bp, Homo sapiens
tgaggccagagtgggcat

SEQ ID NO: 8394496 - DNA, 20 bp, Homo sapiens
tgaggcaggagaatggcatg

SEQ ID NO: 8394497 - DNA, 20 bp, Homo sapiens
tgaggcaggagaatggcatg

SEQ ID NO: 8394498 - DNA, 22 bp, Homo sapiens
tgaggcaggagaatcaccggaa

SEQ ID NO: 8394499 - DNA, 22 bp, Homo sapiens
tgaggcaggacttgcataaagt

SEQ ID NO: 8394500 - DNA, 22 bp, Homo sapiens
tgaggcaggagaatcacatgaa

SEQ ID NO: 8394501 - DNA, 22 bp, Homo sapiens
tgaggcaggactgagcgggatg

SEQ ID NO: 8394502 - DNA, 22 bp, Homo sapiens
tgaggcagctttttctgtgtgt

SEQ ID NO: 8394503 - DNA, 22 bp, Homo sapiens
tgaggcaggaagttatataatg

SEQ ID NO: 8394504 - DNA, 22 bp, Homo sapiens
tgaggcagctttttctgtgtgt

SEQ ID NO: 8394505 - DNA, 22 bp, Homo sapiens
tgaggcagaaaatagcagttca

SEQ ID NO: 8394506 - DNA, 22 bp, Homo sapiens
tgaggcaggacatggacaactg

SEQ ID NO: 8394507 - DNA, 22 bp, Homo sapiens
tgaggcaggaatggggaaaagt

SEQ ID NO: 8394508 - DNA, 19 bp, Homo sapiens
tgaggcacagtggtgaaat

SEQ ID NO: 8394509 - DNA, 22 bp, Homo sapiens
tgaggcacatccaggccagctc

SEQ ID NO: 8394510 - DNA, 22 bp, Homo sapiens
tgaggcacagaaaatggtaggg

SEQ ID NO: 8394511 - DNA, 22 bp, Homo sapiens
tgaggcactccaggatgctgtt

SEQ ID NO: 8394512 - DNA, 22 bp, Homo sapiens
tgaggcaagtctcaatctttga

SEQ ID NO: 8394513 - DNA, 22 bp, Homo sapiens
tgaggcaaaaacactgattagg

SEQ ID NO: 8394514 - DNA, 21 bp, Homo sapiens
tgaggatgtgcagcagcagga

SEQ ID NO: 8394515 - DNA, 22 bp, Homo sapiens
tgaggcaacagaaagggccaat

SEQ ID NO: 8394516 - DNA, 22 bp, Homo sapiens
tgaggcaaagttcaagctgaaa

SEQ ID NO: 8394517 - DNA, 22 bp, Homo sapiens
tgaggcaaagacaaagcagcat

SEQ ID NO: 8394518 - DNA, 22 bp, Homo sapiens
tgaggcaaaagttatgtggtag

SEQ ID NO: 8394519 - DNA, 22 bp, Homo sapiens
tgaggatggcagtgtgctcagc

SEQ ID NO: 8394520 - DNA, 22 bp, Homo sapiens
tgaggatggtgttggagagggc

SEQ ID NO: 8394521 - DNA, 22 bp, Homo sapiens
tgaggagtatggtggggtcatt

SEQ ID NO: 8394522 - DNA, 22 bp, Homo sapiens
tgaggagtcgagaaggggtaat

SEQ ID NO: 8394523 - DNA, 22 bp, Homo sapiens
tgaggagtgtggatggagcttg

SEQ ID NO: 8394524 - DNA, 22 bp, Homo sapiens
tgaggagtgtggatggagcttg

SEQ ID NO: 8394525 - DNA, 22 bp, Homo sapiens
tgaggaggtcagagtctggctg

SEQ ID NO: 8394526 - DNA, 22 bp, Homo sapiens
tgaggagccactctagcagtca

SEQ ID NO: 8394527 - DNA, 19 bp, Homo sapiens
tgaggagcagctggttgat

SEQ ID NO: 8394528 - DNA, 22 bp, Homo sapiens
tgaggaagaacaagaatttaga

SEQ ID NO: 8394529 - DNA, 22 bp, Homo sapiens
tgaggaaagaaaggcatgcatg

SEQ ID NO: 8394530 - DNA, 22 bp, Homo sapiens
tgaggaaatatggtgaactctt

SEQ ID NO: 8394531 - DNA, 22 bp, Homo sapiens
tgaggaaattgaggctcacaga

SEQ ID NO: 8394532 - DNA, 22 bp, Homo sapiens
tgaggaagcaaaggcttgtgtg

SEQ ID NO: 8394533 - DNA, 22 bp, Homo sapiens
tgaggaagccaaacagctacac

SEQ ID NO: 8394534 - DNA, 22 bp, Homo sapiens
tgaggaagccaaacagctacac

SEQ ID NO: 8394535 - DNA, 22 bp, Homo sapiens
tgaggaagccaaacagctacac

SEQ ID NO: 8394536 - DNA, 22 bp, Homo sapiens
tgaggaagttgatctcatcagt

SEQ ID NO: 8394537 - DNA, 22 bp, Homo sapiens
tgaggaagttgatctcatcagt

SEQ ID NO: 8394538 - DNA, 22 bp, Homo sapiens
tgaggagaaatgctcagagcca

SEQ ID NO: 8394539 - DNA, 22 bp, Homo sapiens
tgaggaagttgatctcatcagt

SEQ ID NO: 8394540 - DNA, 22 bp, Homo sapiens
tgaggaagtggttgtatggttt

SEQ ID NO: 8394541 - DNA, 23 bp, Homo sapiens
tgaggaagtaattgtaaaggtct

SEQ ID NO: 8394542 - DNA, 18 bp, Homo sapiens
tgaggaaggggaagtatt

SEQ ID NO: 8394543 - DNA, 22 bp, Homo sapiens
tgatttttaaaattctccttgc

SEQ ID NO: 8394544 - DNA, 22 bp, Homo sapiens
tgcaaaaacagccttgaggcct

SEQ ID NO: 8394545 - DNA, 22 bp, Homo sapiens
tgatttttagctattctgaaga

SEQ ID NO: 8394546 - DNA, 22 bp, Homo sapiens
tgcaaaaattgctggaatcttt

SEQ ID NO: 8394547 - DNA, 22 bp, Homo sapiens
tgcaaaaactgcaattgctttt

SEQ ID NO: 8394548 - DNA, 22 bp, Homo sapiens
tgcaaaaagagcgaggagccct

SEQ ID NO: 8394549 - DNA, 22 bp, Homo sapiens
tgcaaaaagagcgaggagccct

SEQ ID NO: 8394550 - DNA, 22 bp, Homo sapiens
tgatttatgcattatactgttg

SEQ ID NO: 8394551 - DNA, 22 bp, Homo sapiens
tgatttatgcattatactgttg

SEQ ID NO: 8394552 - DNA, 22 bp, Homo sapiens
tgatttacacacctatgattta

SEQ ID NO: 8394553 - DNA, 22 bp, Homo sapiens
tgatttatgaccaagttagaat

SEQ ID NO: 8394554 - DNA, 22 bp, Homo sapiens
tgatttatgaccaagttagaat

SEQ ID NO: 8394555 - DNA, 22 bp, Homo sapiens
tgcaaacaatttcctataaagt

SEQ ID NO: 8394556 - DNA, 20 bp, Homo sapiens
tgcaaacacagagtgtatga

SEQ ID NO: 8394557 - DNA, 22 bp, Homo sapiens
tgcaaacagccttgaaagaggg

SEQ ID NO: 8394558 - DNA, 22 bp, Homo sapiens
tgcaaacaggagagtaagtata

SEQ ID NO: 8394559 - DNA, 22 bp, Homo sapiens
tgcaaacaggagagtaagtata

SEQ ID NO: 8394560 - DNA, 22 bp, Homo sapiens
tgcaaacaggcatttcacaaac

SEQ ID NO: 8394561 - DNA, 23 bp, Homo sapiens
tgcaaagaaatctgggtcattgt

SEQ ID NO: 8394562 - DNA, 22 bp, Homo sapiens
tgcaaagatatgagaagctgta

SEQ ID NO: 8394563 - DNA, 22 bp, Homo sapiens
tgcaaagaaggggaggaggatt

SEQ ID NO: 8394564 - DNA, 22 bp, Homo sapiens
tgcaaatgcccatttattttct

SEQ ID NO: 8394565 - DNA, 22 bp, Homo sapiens
tgcaaatgagttgcagatcagg

SEQ ID NO: 8394566 - DNA, 22 bp, Homo sapiens
tgcaaatgggcatctccaagtg

SEQ ID NO: 8394567 - DNA, 22 bp, Homo sapiens
tgcaaggcccagacaagagctc

SEQ ID NO: 8394568 - DNA, 22 bp, Homo sapiens
tgcaaggctattcacatgtatt

SEQ ID NO: 8394569 - DNA, 22 bp, Homo sapiens
tgcaagggcttagggggctgtg

SEQ ID NO: 8394570 - DNA, 22 bp, Homo sapiens
tgcaaggcttgcaatggtgatc

SEQ ID NO: 8394571 - DNA, 22 bp, Homo sapiens
tgcaagggtagaagtgatggca

SEQ ID NO: 8394572 - DNA, 22 bp, Homo sapiens
tgcaagggtgacaggttgctct

SEQ ID NO: 8394573 - DNA, 22 bp, Homo sapiens
tgcaagggtgtttgagctgccc

SEQ ID NO: 8394574 - DNA, 22 bp, Homo sapiens
tgcaaatttctttagtacataa

SEQ ID NO: 8394575 - DNA, 20 bp, Homo sapiens
tgcacacaccctgtcctcca

SEQ ID NO: 8394576 - DNA, 22 bp, Homo sapiens
tgcacacaccgtgcttcactga

SEQ ID NO: 8394577 - DNA, 22 bp, Homo sapiens
tgcacacacgcggcacatctgt

SEQ ID NO: 8394578 - DNA, 22 bp, Homo sapiens
tgcacacacggagataggcttt

SEQ ID NO: 8394579 - DNA, 22 bp, Homo sapiens
tgcacacacatgaagtagcatg

SEQ ID NO: 8394580 - DNA, 22 bp, Homo sapiens
tgcacacacatgcagagggaga

SEQ ID NO: 8394581 - DNA, 22 bp, Homo sapiens
tgcacacacaggagtctcctcc

SEQ ID NO: 8394582 - DNA, 19 bp, Homo sapiens
tgcacacagataagtatct

SEQ ID NO: 8394583 - DNA, 22 bp, Homo sapiens
tgcacacactctgcatatactt

SEQ ID NO: 8394584 - DNA, 22 bp, Homo sapiens
tgcacacactcgtgtatatgag

SEQ ID NO: 8394585 - DNA, 22 bp, Homo sapiens
tgcacacagatggtacatgcat

SEQ ID NO: 8394586 - DNA, 22 bp, Homo sapiens
tgcacacagctgggcctggctg

SEQ ID NO: 8394587 - DNA, 22 bp, Homo sapiens
tgcacacaggtctaggacatgg

SEQ ID NO: 8394588 - DNA, 22 bp, Homo sapiens
tgcaatttggggaagaaagaga

SEQ ID NO: 8394589 - DNA, 22 bp, Homo sapiens
tgcaatttgacgtcagcacagt

SEQ ID NO: 8394590 - DNA, 22 bp, Homo sapiens
tgcaatttcaaatatcagaaag

SEQ ID NO: 8394591 - DNA, 22 bp, Homo sapiens
tgcaatttcaaatatcagaaag

SEQ ID NO: 8394592 - DNA, 22 bp, Homo sapiens
tgcaatctcggcactttgggag

SEQ ID NO: 8394593 - DNA, 22 bp, Homo sapiens
tgcaatccccgcctcaacagga

SEQ ID NO: 8394594 - DNA, 22 bp, Homo sapiens
tgcaatctcggcactttgggag

SEQ ID NO: 8394595 - DNA, 17 bp, Homo sapiens
tgcacaagagacaatag

SEQ ID NO: 8394596 - DNA, 22 bp, Homo sapiens
tgcaattttaatacattagagg

SEQ ID NO: 8394597 - DNA, 22 bp, Homo sapiens
tgcaattttcagaaattccaaa

SEQ ID NO: 8394598 - DNA, 23 bp, Homo sapiens
tgattacaagggccaaagaaagg

SEQ ID NO: 8394599 - DNA, 22 bp, Homo sapiens
tgattcagacctgtcagacttc

SEQ ID NO: 8394600 - DNA, 23 bp, Homo sapiens
tgattcagcaagtccacttctgg

SEQ ID NO: 8394601 - DNA, 22 bp, Homo sapiens
tgattcagtactttctctaact

SEQ ID NO: 8394602 - DNA, 22 bp, Homo sapiens
tgatgtaggacattattatttc

SEQ ID NO: 8394603 - DNA, 22 bp, Homo sapiens
tgatgtctctctatactctaac

SEQ ID NO: 8394604 - DNA, 22 bp, Homo sapiens
tgattaaaatttaacttagtta

SEQ ID NO: 8394605 - DNA, 22 bp, Homo sapiens
tgattctgccacgtactggctg

SEQ ID NO: 8394606 - DNA, 22 bp, Homo sapiens
tgattctgccccttggctctgg

SEQ ID NO: 8394607 - DNA, 20 bp, Homo sapiens
tgattctggtctacgcttta

SEQ ID NO: 8394608 - DNA, 22 bp, Homo sapiens
tgattctatggaaggcataagg

SEQ ID NO: 8394609 - DNA, 22 bp, Homo sapiens
tgattctgagggagcattctgc

SEQ ID NO: 8394610 - DNA, 23 bp, Homo sapiens
tgatgctcagaatgcaggtatag

SEQ ID NO: 8394611 - DNA, 22 bp, Homo sapiens
tgatgctctcctaatatgaaaa

SEQ ID NO: 8394612 - DNA, 19 bp, Homo sapiens
tgatgccctgacctgagcc

SEQ ID NO: 8394613 - DNA, 22 bp, Homo sapiens
tgatgctgttccagttatattg

SEQ ID NO: 8394614 - DNA, 22 bp, Homo sapiens
tgatgctgtgtacctcatggga

SEQ ID NO: 8394615 - DNA, 22 bp, Homo sapiens
tgatgcaatcctttagaagtaa

SEQ ID NO: 8394616 - DNA, 22 bp, Homo sapiens
tgatgcaattagattgtaattt

SEQ ID NO: 8394617 - DNA, 22 bp, Homo sapiens
tgatgccaataaaactctccct

SEQ ID NO: 8394618 - DNA, 16 bp, Homo sapiens
tgagtgggagaagggg

SEQ ID NO: 8394619 - DNA, 22 bp, Homo sapiens
tgagtgggatgagttagaggtg

SEQ ID NO: 8394620 - DNA, 22 bp, Homo sapiens
tgagtgaggctgggcagtccct

SEQ ID NO: 8394621 - DNA, 22 bp, Homo sapiens
tgagtgcctacggcacaggcgc

SEQ ID NO: 8394622 - DNA, 22 bp, Homo sapiens
tgagtgcctaccaagtgctgga

SEQ ID NO: 8394623 - DNA, 22 bp, Homo sapiens
tgagtgggattaaatgaggtga

SEQ ID NO: 8394624 - DNA, 22 bp, Homo sapiens
tgagtgggttatcaggaaaggt

SEQ ID NO: 8394625 - DNA, 22 bp, Homo sapiens
tgagtgtatatgaaggttgtaa

SEQ ID NO: 8394626 - DNA, 22 bp, Homo sapiens
tgagtgttgtaaccatatgatt

SEQ ID NO: 8394627 - DNA, 22 bp, Homo sapiens
tgagttctaggcttaaaactaa

SEQ ID NO: 8394628 - DNA, 22 bp, Homo sapiens
tgagttatctaaaatagtcaaa

SEQ ID NO: 8394629 - DNA, 22 bp, Homo sapiens
tgatatctaccataaccattcg

SEQ ID NO: 8394630 - DNA, 20 bp, Homo sapiens
tgatatggtttggctgtgtt

SEQ ID NO: 8394631 - DNA, 22 bp, Homo sapiens
tgatatgggaaaagggctcgga

SEQ ID NO: 8394632 - DNA, 22 bp, Homo sapiens
tgagttctccaagagaaggtat

SEQ ID NO: 8394633 - DNA, 22 bp, Homo sapiens
tgagttctcacccattcttctt

SEQ ID NO: 8394634 - DNA, 22 bp, Homo sapiens
tgagttctccaagagaaggtaa

SEQ ID NO: 8394635 - DNA, 22 bp, Homo sapiens
tgagttctagtggctgcagatt

SEQ ID NO: 8394636 - DNA, 23 bp, Homo sapiens
tgagttctaggcttaaaactagc

SEQ ID NO: 8394637 - DNA, 17 bp, Homo sapiens
tgatagttcattttaag

SEQ ID NO: 8394638 - DNA, 22 bp, Homo sapiens
tgatcattatcaaactggtcat

SEQ ID NO: 8394639 - DNA, 21 bp, Homo sapiens
tgatcatttgtgtaaaggaga

SEQ ID NO: 8394640 - DNA, 22 bp, Homo sapiens
tgatcagacagttatgtgcatg

SEQ ID NO: 8394641 - DNA, 22 bp, Homo sapiens
tgatcaggtctgaacagggagg

SEQ ID NO: 8394642 - DNA, 22 bp, Homo sapiens
tgatattttatgagctttcata

SEQ ID NO: 8394643 - DNA, 19 bp, Homo sapiens
tgatctggaaggaaccagg

SEQ ID NO: 8394644 - DNA, 22 bp, Homo sapiens
tgcagagggaaaaggtgctcct

SEQ ID NO: 8394645 - DNA, 22 bp, Homo sapiens
tgcagagggagtgacggttcac

SEQ ID NO: 8394646 - DNA, 19 bp, Homo sapiens
tgcagagggtaggaaggcc

SEQ ID NO: 8394647 - DNA, 23 bp, Homo sapiens
tgcagagggactgaagccagctt

SEQ ID NO: 8394648 - DNA, 21 bp, Homo sapiens
tgcagataattgaaagctgac

SEQ ID NO: 8394649 - DNA, 22 bp, Homo sapiens
tgcagatgaatgctgagacact

SEQ ID NO: 8394650 - DNA, 21 bp, Homo sapiens
tgcagcagaagtctctgtgtc

SEQ ID NO: 8394651 - DNA, 20 bp, Homo sapiens
tgcagcacgggccctttcca

SEQ ID NO: 8394652 - DNA, 22 bp, Homo sapiens
tgcagatggggatcagtggctc

SEQ ID NO: 8394653 - DNA, 22 bp, Homo sapiens
tgcagattcaaatgaaatgcaa

SEQ ID NO: 8394654 - DNA, 22 bp, Homo sapiens
tgcagcaaaaggtcagagggag

SEQ ID NO: 8394655 - DNA, 22 bp, Homo sapiens
tgcagcaagtaaccatcttcct

SEQ ID NO: 8394656 - DNA, 22 bp, Homo sapiens
tgcagcaacaagatagaatggc

SEQ ID NO: 8394657 - DNA, 22 bp, Homo sapiens
tgcagcaaatggggcccgtcct

SEQ ID NO: 8394658 - DNA, 22 bp, Homo sapiens
tgcagcaagaaggcactgtctg

SEQ ID NO: 8394659 - DNA, 22 bp, Homo sapiens
tgcagaattatggtgctggctt

SEQ ID NO: 8394660 - DNA, 22 bp, Homo sapiens
tgcagacaagtcgtgggatctt

SEQ ID NO: 8394661 - DNA, 22 bp, Homo sapiens
tgcagacagagaaatgaggccc

SEQ ID NO: 8394662 - DNA, 21 bp, Homo sapiens
tgcagacagggacagaatgga

SEQ ID NO: 8394663 - DNA, 22 bp, Homo sapiens
tgcagaggagctggaaggctgg

SEQ ID NO: 8394664 - DNA, 22 bp, Homo sapiens
tgcagaggagctggaaggctgg

SEQ ID NO: 8394665 - DNA, 20 bp, Homo sapiens
tgcagagctggctggctcct

SEQ ID NO: 8394666 - DNA, 22 bp, Homo sapiens
tgcagagctcttggcacttcag

SEQ ID NO: 8394667 - DNA, 22 bp, Homo sapiens
tgcagagcagcaactgcgtgcg

SEQ ID NO: 8394668 - DNA, 22 bp, Homo sapiens
tgcagaggcgccgtgggtgggg

SEQ ID NO: 8394669 - DNA, 22 bp, Homo sapiens
tgcagaggctggctcgccgggt

SEQ ID NO: 8394670 - DNA, 22 bp, Homo sapiens
tgcagagggaaaaggtgctcct

SEQ ID NO: 8394671 - DNA, 22 bp, Homo sapiens
tgcagaggagtcagcctgggca

SEQ ID NO: 8394672 - DNA, 22 bp, Homo sapiens
tgcagaggagctggaaggctgg

SEQ ID NO: 8394673 - DNA, 22 bp, Homo sapiens
tgcagaggagctggaaggctgg

SEQ ID NO: 8394674 - DNA, 22 bp, Homo sapiens
tgcagaaataactcatattgca

SEQ ID NO: 8394675 - DNA, 21 bp, Homo sapiens
tgcagaaatggtttttctaag

SEQ ID NO: 8394676 - DNA, 22 bp, Homo sapiens
tgcagaaagcattgactcttcc

SEQ ID NO: 8394677 - DNA, 22 bp, Homo sapiens
tgcagaaaccaattcaagtaag

SEQ ID NO: 8394678 - DNA, 22 bp, Homo sapiens
tgcagaaaccaattcaagtaag

SEQ ID NO: 8394679 - DNA, 22 bp, Homo sapiens
tgcagaaacagtcattaatgta

SEQ ID NO: 8394680 - DNA, 22 bp, Homo sapiens
tgcagaaataaagatattatca

SEQ ID NO: 8394681 - DNA, 22 bp, Homo sapiens
tgcagaaagcattgactcttcc

SEQ ID NO: 8394682 - DNA, 22 bp, Homo sapiens
tgcagaaacaagccatcattca

SEQ ID NO: 8394683 - DNA, 22 bp, Homo sapiens
tgcacgaaatctttctagtctt

SEQ ID NO: 8394684 - DNA, 22 bp, Homo sapiens
tgcacctttaaattcagcagta

SEQ ID NO: 8394685 - DNA, 22 bp, Homo sapiens
tgcacgtgtgagcattcacatg

SEQ ID NO: 8394686 - DNA, 22 bp, Homo sapiens
tgcacattagtgtttgagatgc

SEQ ID NO: 8394687 - DNA, 22 bp, Homo sapiens
tgcacattagtgtttgagatgc

SEQ ID NO: 8394688 - DNA, 22 bp, Homo sapiens
tgcacagttggctacatcgtgg

SEQ ID NO: 8394689 - DNA, 22 bp, Homo sapiens
tgcacatgtgcacatatatgtg

SEQ ID NO: 8394690 - DNA, 22 bp, Homo sapiens
tgcacaggtggtccatctgcac

SEQ ID NO: 8394691 - DNA, 22 bp, Homo sapiens
tgcacagtaaacatgactggag

SEQ ID NO: 8394692 - DNA, 22 bp, Homo sapiens
tgcacagtgtaatgaatcagaa

SEQ ID NO: 8394693 - DNA, 22 bp, Homo sapiens
tgcacccatgtctccacgtaca

SEQ ID NO: 8394694 - DNA, 22 bp, Homo sapiens
tgcaccttcattttaggcagct

SEQ ID NO: 8394695 - DNA, 22 bp, Homo sapiens
tgcaccgttgcactccagagtg

SEQ ID NO: 8394696 - DNA, 22 bp, Homo sapiens
tgcacacagtggacaagtcttg

SEQ ID NO: 8394697 - DNA, 18 bp, Homo sapiens
tgcacagctgtgggctgg

SEQ ID NO: 8394698 - DNA, 22 bp, Homo sapiens
tgcacaggaggctgtggagaag

SEQ ID NO: 8394699 - DNA, 20 bp, Homo sapiens
tgcacagggtgggaagcaac

SEQ ID NO: 8394700 - DNA, 22 bp, Homo sapiens
tgcacaggtatgcaaagcatgt

SEQ ID NO: 8394701 - DNA, 22 bp, Homo sapiens
tgcacaggtgagactcaggaag

SEQ ID NO: 8394702 - DNA, 22 bp, Homo sapiens
tgcacaggccttgaagggagag

SEQ ID NO: 8394703 - DNA, 21 bp, Homo sapiens
tgcacagggcccaggagagcc

SEQ ID NO: 8394704 - DNA, 22 bp, Homo sapiens
tgcacagggagggggccagctc

SEQ ID NO: 8394705 - DNA, 21 bp, Homo sapiens
tgcacagggcccaggagagcc

SEQ ID NO: 8394706 - DNA, 21 bp, Homo sapiens
tgcacagggcccaggagagcc

SEQ ID NO: 8394707 - DNA, 22 bp, Homo sapiens
tgcaggaacttggttttactca

SEQ ID NO: 8394708 - DNA, 22 bp, Homo sapiens
tgcaggaaattccagggtggcc

SEQ ID NO: 8394709 - DNA, 22 bp, Homo sapiens
tgcagctgtgcctgaaaagtac

SEQ ID NO: 8394710 - DNA, 19 bp, Homo sapiens
tgcagctgtctctatatta

SEQ ID NO: 8394711 - DNA, 20 bp, Homo sapiens
tgcagctggtttcacaggga

SEQ ID NO: 8394712 - DNA, 20 bp, Homo sapiens
tgcagctggtttcacaggga

SEQ ID NO: 8394713 - DNA, 22 bp, Homo sapiens
tgcagctgtaacagaggcctca

SEQ ID NO: 8394714 - DNA, 19 bp, Homo sapiens
tgcagctgtatgagcttaa

SEQ ID NO: 8394715 - DNA, 22 bp, Homo sapiens
tgcagctttaagctttcatcag

SEQ ID NO: 8394716 - DNA, 22 bp, Homo sapiens
tgcagctttgctctggtcccca

SEQ ID NO: 8394717 - DNA, 22 bp, Homo sapiens
tgcagcttctctgcaacaggag

SEQ ID NO: 8394718 - DNA, 22 bp, Homo sapiens
tgcagcttctctgcaacaggag

SEQ ID NO: 8394719 - DNA, 22 bp, Homo sapiens
tgcagcttcttgtcctgtgatt

SEQ ID NO: 8394720 - DNA, 22 bp, Homo sapiens
tgcagcttgctgtaggctaagt

SEQ ID NO: 8394721 - DNA, 22 bp, Homo sapiens
tgcagcttgctgtaggctaagt

SEQ ID NO: 8394722 - DNA, 22 bp, Homo sapiens
tgcagcttcactcctgaagcca

SEQ ID NO: 8394723 - DNA, 22 bp, Homo sapiens
tgcagcttccacatccacactc

SEQ ID NO: 8394724 - DNA, 22 bp, Homo sapiens
tgcagcttctccatctccttgt

SEQ ID NO: 8394725 - DNA, 22 bp, Homo sapiens
tgcagcttctccaaatattaca

SEQ ID NO: 8394726 - DNA, 20 bp, Homo sapiens
tgcagcttctcatcttcaaa

SEQ ID NO: 8394727 - DNA, 20 bp, Homo sapiens
tgcagcttcacctgtgtcat

SEQ ID NO: 8394728 - DNA, 22 bp, Homo sapiens
tgcagcttcactcaggaagcca

SEQ ID NO: 8394729 - DNA, 22 bp, Homo sapiens
tgcagcttcactcaggaagcca

SEQ ID NO: 8394730 - DNA, 22 bp, Homo sapiens
tgcagcttcaaagaacctttcc

SEQ ID NO: 8394731 - DNA, 22 bp, Homo sapiens
tgcagcttaaatcagggtttct

SEQ ID NO: 8394732 - DNA, 22 bp, Homo sapiens
tgcagcttagtagggtaaagtt

SEQ ID NO: 8394733 - DNA, 22 bp, Homo sapiens
tgcagcttatctctttggcagt

SEQ ID NO: 8394734 - DNA, 22 bp, Homo sapiens
tgcagcttatctctttggcagt

SEQ ID NO: 8394735 - DNA, 22 bp, Homo sapiens
tgcaggcagctgaaaggtgcct

SEQ ID NO: 8394736 - DNA, 22 bp, Homo sapiens
tgcaggcagctaaaccatgtaa

SEQ ID NO: 8394737 - DNA, 22 bp, Homo sapiens
tgcaggcctcagacttagccat

SEQ ID NO: 8394738 - DNA, 22 bp, Homo sapiens
tgcaggctatcctttgctgcaa

SEQ ID NO: 8394739 - DNA, 22 bp, Homo sapiens
tgcaggctatatcttatttgac

SEQ ID NO: 8394740 - DNA, 21 bp, Homo sapiens
tgcaggctacttctgactcta

SEQ ID NO: 8394741 - DNA, 22 bp, Homo sapiens
tgcaggctcaccctggagctga

SEQ ID NO: 8394742 - DNA, 22 bp, Homo sapiens
tgcaggctcaccctggagctga

SEQ ID NO: 8394743 - DNA, 22 bp, Homo sapiens
tgcaggctccaggtgcacatat

SEQ ID NO: 8394744 - DNA, 22 bp, Homo sapiens
tgcaggctcacctgccagggcc

SEQ ID NO: 8394745 - DNA, 22 bp, Homo sapiens
tgcaggctcatctcaagagtag

SEQ ID NO: 8394746 - DNA, 22 bp, Homo sapiens
tgcaggagctgtgcggtgaggg

SEQ ID NO: 8394747 - DNA, 22 bp, Homo sapiens
tgcaggagcccttgggctctgg

SEQ ID NO: 8394748 - DNA, 22 bp, Homo sapiens
tgcaggagtccaatcaggagac

SEQ ID NO: 8394749 - DNA, 21 bp, Homo sapiens
tgcagctgacactggtatgcc

SEQ ID NO: 8394750 - DNA, 22 bp, Homo sapiens
tgcagctgacccactccagtcc

SEQ ID NO: 8394751 - DNA, 22 bp, Homo sapiens
tgcagctgacccactccagtcc

SEQ ID NO: 8394752 - DNA, 22 bp, Homo sapiens
tgcagctgacccactccagtcc

SEQ ID NO: 8394753 - DNA, 21 bp, Homo sapiens
tgcagctgacaccctttggga

SEQ ID NO: 8394754 - DNA, 21 bp, Homo sapiens
tgcagctgacaccctttggga

SEQ ID NO: 8394755 - DNA, 22 bp, Homo sapiens
tgcagcctttagaagttcagat

SEQ ID NO: 8394756 - DNA, 22 bp, Homo sapiens
tgcagccttggcaaccagggac

SEQ ID NO: 8394757 - DNA, 17 bp, Homo sapiens
tgcagctgctcccaggc

SEQ ID NO: 8394758 - DNA, 17 bp, Homo sapiens
tgcagctgatggggaaa

SEQ ID NO: 8394759 - DNA, 22 bp, Homo sapiens
tgcagctgcttgattcatcttg

SEQ ID NO: 8394760 - DNA, 22 bp, Homo sapiens
tgcagctgcttgattcatcttg

SEQ ID NO: 8394761 - DNA, 22 bp, Homo sapiens
tgcagctggaacttagaggaga

SEQ ID NO: 8394762 - DNA, 22 bp, Homo sapiens
tgcagctggatttatcttttcc

SEQ ID NO: 8394763 - DNA, 22 bp, Homo sapiens
tgcagctggtttagaactagat

SEQ ID NO: 8394764 - DNA, 21 bp, Homo sapiens
tgcagctgggttctggtttgc

SEQ ID NO: 8394765 - DNA, 22 bp, Homo sapiens
tgcagctgggtctgccctggct

SEQ ID NO: 8394766 - DNA, 21 bp, Homo sapiens
tgcagctgggttctggtttgc

SEQ ID NO: 8394767 - DNA, 21 bp, Homo sapiens
tgcagcagagtaagcagggga

SEQ ID NO: 8394768 - DNA, 21 bp, Homo sapiens
tgcagcagagtaagcagggga

SEQ ID NO: 8394769 - DNA, 22 bp, Homo sapiens
tgcagcagcagggaggaggctc

SEQ ID NO: 8394770 - DNA, 22 bp, Homo sapiens
tgcagcagagtgggcctgggtg

SEQ ID NO: 8394771 - DNA, 22 bp, Homo sapiens
tgcagcagagtgggcctgggtg

SEQ ID NO: 8394772 - DNA, 22 bp, Homo sapiens
tgcagcaggcacaggacggaag

SEQ ID NO: 8394773 - DNA, 22 bp, Homo sapiens
tgcagcagggcccaggcacaga

SEQ ID NO: 8394774 - DNA, 22 bp, Homo sapiens
tgcagcagcctcatctggtttc

SEQ ID NO: 8394775 - DNA, 22 bp, Homo sapiens
tgcagcagcagggaggaggctc

SEQ ID NO: 8394776 - DNA, 22 bp, Homo sapiens
tgcagcagcagggaggaggctc

SEQ ID NO: 8394777 - DNA, 23 bp, Homo sapiens
tgcagcagggtggtctacttctc

SEQ ID NO: 8394778 - DNA, 22 bp, Homo sapiens
tgcagcctctctgcttcaggaa

SEQ ID NO: 8394779 - DNA, 22 bp, Homo sapiens
tgcagcctctctgcttcaggaa

SEQ ID NO: 8394780 - DNA, 18 bp, Homo sapiens
tgcagcctgtagtcttgt

SEQ ID NO: 8394781 - DNA, 22 bp, Homo sapiens
tgcagcctggtggtcactggag

SEQ ID NO: 8394782 - DNA, 22 bp, Homo sapiens
tgcagcctggtggtcactggag

SEQ ID NO: 8394783 - DNA, 22 bp, Homo sapiens
tgcagcctagacattctggtca

SEQ ID NO: 8394784 - DNA, 22 bp, Homo sapiens
tgcattgggttgacatactaaa

SEQ ID NO: 8394785 - DNA, 22 bp, Homo sapiens
tgcattggaaactcagcagcac

SEQ ID NO: 8394786 - DNA, 22 bp, Homo sapiens
tgcattcttggaagaagctctc

SEQ ID NO: 8394787 - DNA, 22 bp, Homo sapiens
tgcattcctccacctcctgcac

SEQ ID NO: 8394788 - DNA, 21 bp, Homo sapiens
tgcattcctccatccaacagg

SEQ ID NO: 8394789 - DNA, 21 bp, Homo sapiens
tgcattctagcagctctgagg

SEQ ID NO: 8394790 - DNA, 22 bp, Homo sapiens
tgcatttaagaaaacatgagtc

SEQ ID NO: 8394791 - DNA, 22 bp, Homo sapiens
tgcattttcttccaccaatatc

SEQ ID NO: 8394792 - DNA, 22 bp, Homo sapiens
tgccaaatgccaccacagctgc

SEQ ID NO: 8394793 - DNA, 22 bp, Homo sapiens
tgcatttttgataactgtgtac

SEQ ID NO: 8394794 - DNA, 22 bp, Homo sapiens
tgcatttcagaagaaaattcgg

SEQ ID NO: 8394795 - DNA, 22 bp, Homo sapiens
tgcatttagttttaataaagga

SEQ ID NO: 8394796 - DNA, 22 bp, Homo sapiens
tgccacagggtcctcaggccag

SEQ ID NO: 8394797 - DNA, 22 bp, Homo sapiens
tgccacaggcaatccctgcacg

SEQ ID NO: 8394798 - DNA, 22 bp, Homo sapiens
tgccacagttgtttgtgctcta

SEQ ID NO: 8394799 - DNA, 22 bp, Homo sapiens
tgccacagtttcatggattctg

SEQ ID NO: 8394800 - DNA, 22 bp, Homo sapiens
tgccagaatttgcttccaatgt

SEQ ID NO: 8394801 - DNA, 17 bp, Homo sapiens
tgccacttacctataca

SEQ ID NO: 8394802 - DNA, 22 bp, Homo sapiens
tgccactggacccagaactctt

SEQ ID NO: 8394803 - DNA, 22 bp, Homo sapiens
tgccactggctcaatggtgcag

SEQ ID NO: 8394804 - DNA, 23 bp, Homo sapiens
tgccacccttctcttcccagctt

SEQ ID NO: 8394805 - DNA, 22 bp, Homo sapiens
tgccacctgtacatgctatctg

SEQ ID NO: 8394806 - DNA, 22 bp, Homo sapiens
tgccacctagtggtctttagtc

SEQ ID NO: 8394807 - DNA, 23 bp, Homo sapiens
tgccagaggcagtcacagtggtg

SEQ ID NO: 8394808 - DNA, 22 bp, Homo sapiens
tgccagcacaagttaagagatc

SEQ ID NO: 8394809 - DNA, 22 bp, Homo sapiens
tgccagcaagaatagacagtaa

SEQ ID NO: 8394810 - DNA, 19 bp, Homo sapiens
tgccagcattaggctgaag

SEQ ID NO: 8394811 - DNA, 23 bp, Homo sapiens
tgccagcagggaatgggaaggac

SEQ ID NO: 8394812 - DNA, 23 bp, Homo sapiens
tgccagcagggaatgggaaggac

SEQ ID NO: 8394813 - DNA, 22 bp, Homo sapiens
tgccagcagaaataaatacttg

SEQ ID NO: 8394814 - DNA, 22 bp, Homo sapiens
tgccagcagtagcagtaggcca

SEQ ID NO: 8394815 - DNA, 21 bp, Homo sapiens
tgccagcatgtaggctagttg

SEQ ID NO: 8394816 - DNA, 21 bp, Homo sapiens
tgccagcatgtaggctagttg

SEQ ID NO: 8394817 - DNA, 19 bp, Homo sapiens
tgccagcattaggctgaag

SEQ ID NO: 8394818 - DNA, 21 bp, Homo sapiens
tgccagcattaaacagtcatt

SEQ ID NO: 8394819 - DNA, 22 bp, Homo sapiens
tgcatgttaagaaaatattgag

SEQ ID NO: 8394820 - DNA, 22 bp, Homo sapiens
tgcattcatcatttgaaagccc

SEQ ID NO: 8394821 - DNA, 22 bp, Homo sapiens
tgcatgtgtgacaaggacagtt

SEQ ID NO: 8394822 - DNA, 22 bp, Homo sapiens
tgcatgtggacccctggtgcct

SEQ ID NO: 8394823 - DNA, 17 bp, Homo sapiens
tgcatgtcctttgttcc

SEQ ID NO: 8394824 - DNA, 22 bp, Homo sapiens
tgcatggaggataataattgag

SEQ ID NO: 8394825 - DNA, 22 bp, Homo sapiens
tgcatggaggaagatgaatgca

SEQ ID NO: 8394826 - DNA, 22 bp, Homo sapiens
tgcatgcgttagttggcgtgtt

SEQ ID NO: 8394827 - DNA, 17 bp, Homo sapiens
tgcatgcgtctgtgata

SEQ ID NO: 8394828 - DNA, 23 bp, Homo sapiens
tgcatgctaacacagtgcacagg

SEQ ID NO: 8394829 - DNA, 22 bp, Homo sapiens
tgcatgctcaagttagttgtga

SEQ ID NO: 8394830 - DNA, 22 bp, Homo sapiens
tgcatgctctgtagaaagcagg

SEQ ID NO: 8394831 - DNA, 18 bp, Homo sapiens
tgcatgcttttgtttcca

SEQ ID NO: 8394832 - DNA, 21 bp, Homo sapiens
tgcatcttcaaggttggcagg

SEQ ID NO: 8394833 - DNA, 19 bp, Homo sapiens
tgcatcttgcatgggtgag

SEQ ID NO: 8394834 - DNA, 22 bp, Homo sapiens
tgcatcttcagtaggaactctc

SEQ ID NO: 8394835 - DNA, 22 bp, Homo sapiens
tgcatctttagtcttatgtctg

SEQ ID NO: 8394836 - DNA, 22 bp, Homo sapiens
tgcatctttgcttggctccttc

SEQ ID NO: 8394837 - DNA, 22 bp, Homo sapiens
tgcatctttttccaagtttatt

SEQ ID NO: 8394838 - DNA, 22 bp, Homo sapiens
tgcagttctaagtagacaagtc

SEQ ID NO: 8394839 - DNA, 22 bp, Homo sapiens
tgcagttcaaggttgtacagct

SEQ ID NO: 8394840 - DNA, 22 bp, Homo sapiens
tgcatagggaacctcatgcatt

SEQ ID NO: 8394841 - DNA, 22 bp, Homo sapiens
tgcatagtcgctctgtgcttca

SEQ ID NO: 8394842 - DNA, 22 bp, Homo sapiens
tgcatatacccgcatttacata

SEQ ID NO: 8394843 - DNA, 20 bp, Homo sapiens
tgcatacgtatgtatttgga

SEQ ID NO: 8394844 - DNA, 22 bp, Homo sapiens
tgcatacatgtttgtgtatttt

SEQ ID NO: 8394845 - DNA, 22 bp, Homo sapiens
tgcatactgaacagcatgctaa

SEQ ID NO: 8394846 - DNA, 22 bp, Homo sapiens
tgcatactgaatctgccatcac

SEQ ID NO: 8394847 - DNA, 22 bp, Homo sapiens
tgcatacttgtatgtgttacat

SEQ ID NO: 8394848 - DNA, 22 bp, Homo sapiens
tgcatacttttaatgactgttt

SEQ ID NO: 8394849 - DNA, 22 bp, Homo sapiens
tgcatacataatcgagaccagt

SEQ ID NO: 8394850 - DNA, 22 bp, Homo sapiens
tgcatctgattctcaggcagaa

SEQ ID NO: 8394851 - DNA, 22 bp, Homo sapiens
tgcatccttccatgggtttcaa

SEQ ID NO: 8394852 - DNA, 22 bp, Homo sapiens
tgcatcctcctttgtcctcttg

SEQ ID NO: 8394853 - DNA, 22 bp, Homo sapiens
tgcatcatataatgtctatgga

SEQ ID NO: 8394854 - DNA, 22 bp, Homo sapiens
tgcatcagagtttgctgctgct

SEQ ID NO: 8394855 - DNA, 22 bp, Homo sapiens
tgcatcagctgtgcttcttgac

SEQ ID NO: 8394856 - DNA, 22 bp, Homo sapiens
tgcatcatgcggaactggcttt

SEQ ID NO: 8394857 - DNA, 22 bp, Homo sapiens
tgcatcatataatgtctatgga

SEQ ID NO: 8394858 - DNA, 18 bp, Homo sapiens
tgcatcatttatgggtca

SEQ ID NO: 8394859 - DNA, 22 bp, Homo sapiens
tgcatcatttataatgtctttg

SEQ ID NO: 8394860 - DNA, 18 bp, Homo sapiens
tgcatcatttatgggtca

SEQ ID NO: 8394861 - DNA, 22 bp, Homo sapiens
tgcagggcagatatgactgtag

SEQ ID NO: 8394862 - DNA, 22 bp, Homo sapiens
tgcagggcccctctgcatgagt

SEQ ID NO: 8394863 - DNA, 22 bp, Homo sapiens
tgcaggctttagccccatggct

SEQ ID NO: 8394864 - DNA, 22 bp, Homo sapiens
tgcaggctttagccccatggct

SEQ ID NO: 8394865 - DNA, 22 bp, Homo sapiens
tgcaggcttggatcacatctcc

SEQ ID NO: 8394866 - DNA, 21 bp, Homo sapiens
tgcaggctgtgcgctcctgcc

SEQ ID NO: 8394867 - DNA, 21 bp, Homo sapiens
tgcaggctgtgcgctcctgcc

SEQ ID NO: 8394868 - DNA, 21 bp, Homo sapiens
tgcaggctgtttaagaggcaa

SEQ ID NO: 8394869 - DNA, 22 bp, Homo sapiens
tgcaggctctctgctgccagat

SEQ ID NO: 8394870 - DNA, 17 bp, Homo sapiens
tgcaggctcctgtccct

SEQ ID NO: 8394871 - DNA, 22 bp, Homo sapiens
tgcaggctgaggctggctcaac

SEQ ID NO: 8394872 - DNA, 22 bp, Homo sapiens
tgcaggctgaggctggctcaac

SEQ ID NO: 8394873 - DNA, 22 bp, Homo sapiens
tgcaggctctgtgtgtgcctgg

SEQ ID NO: 8394874 - DNA, 22 bp, Homo sapiens
tgcaggctctgtgtgtgcctgg

SEQ ID NO: 8394875 - DNA, 22 bp, Homo sapiens
tgcaggctggcagtgctgaaat

SEQ ID NO: 8394876 - DNA, 22 bp, Homo sapiens
tgcaggctgtaatctgaggcta

SEQ ID NO: 8394877 - DNA, 22 bp, Homo sapiens
tgcaggctgtaatctgaggcta

SEQ ID NO: 8394878 - DNA, 23 bp, Homo sapiens
tgcaggggaggcttaaagcaggt

SEQ ID NO: 8394879 - DNA, 22 bp, Homo sapiens
tgcaggtctctgcaaggcctat

SEQ ID NO: 8394880 - DNA, 22 bp, Homo sapiens
tgcaggtgaaaattatgaggat

SEQ ID NO: 8394881 - DNA, 22 bp, Homo sapiens
tgcaggtgaaaattatgaggat

SEQ ID NO: 8394882 - DNA, 22 bp, Homo sapiens
tgcaggtgacaccactcttcct

SEQ ID NO: 8394883 - DNA, 22 bp, Homo sapiens
tgcaggtacttgacaacttggg

SEQ ID NO: 8394884 - DNA, 22 bp, Homo sapiens
tgcaggtggacacgggagacgg

SEQ ID NO: 8394885 - DNA, 22 bp, Homo sapiens
tgcaggtgcagcgatactgtga

SEQ ID NO: 8394886 - DNA, 22 bp, Homo sapiens
tgcaggtggacacgggagacgg

SEQ ID NO: 8394887 - DNA, 22 bp, Homo sapiens
tgcaggtgattctgatgcagtt

SEQ ID NO: 8394888 - DNA, 23 bp, Homo sapiens
tgcaggtgattaatccagtttca

SEQ ID NO: 8394889 - DNA, 22 bp, Homo sapiens
tgcaggtgattctgatgcagtt

SEQ ID NO: 8394890 - DNA, 22 bp, Homo sapiens
tgcaggtgagtgcaggggctca

SEQ ID NO: 8394891 - DNA, 22 bp, Homo sapiens
tgcaggtggctccagggactgc

SEQ ID NO: 8394892 - DNA, 22 bp, Homo sapiens
tgcaggtggccatcttcgttct

SEQ ID NO: 8394893 - DNA, 22 bp, Homo sapiens
tgcaggtggcagcggggcacca

SEQ ID NO: 8394894 - DNA, 22 bp, Homo sapiens
tgcaggtggcagcggggcacca

SEQ ID NO: 8394895 - DNA, 22 bp, Homo sapiens
tgcaggtggattcaatgtggga

SEQ ID NO: 8394896 - DNA, 22 bp, Homo sapiens
tgcaggtggatatctcatcaga

SEQ ID NO: 8394897 - DNA, 23 bp, Homo sapiens
tgcagtgtttaacaatgacttga

SEQ ID NO: 8394898 - DNA, 21 bp, Homo sapiens
tgcagtgtccctaacagtggt

SEQ ID NO: 8394899 - DNA, 22 bp, Homo sapiens
tgcagtggttgagagcccagac

SEQ ID NO: 8394900 - DNA, 20 bp, Homo sapiens
tgcaggtgttggagaaggta

SEQ ID NO: 8394901 - DNA, 22 bp, Homo sapiens
tgcaggtgtggttcctcagcca

SEQ ID NO: 8394902 - DNA, 22 bp, Homo sapiens
tgcaggtgtgggcaggggagca

SEQ ID NO: 8394903 - DNA, 22 bp, Homo sapiens
tgcaggtgtgtgcaagggaggg

SEQ ID NO: 8394904 - DNA, 20 bp, Homo sapiens
tgcaggtgttggagaaggta

SEQ ID NO: 8394905 - DNA, 20 bp, Homo sapiens
tgcaggtgtgtccaagcact

SEQ ID NO: 8394906 - DNA, 22 bp, Homo sapiens
tgcaggtgtgtgcaagggaggg

SEQ ID NO: 8394907 - DNA, 22 bp, Homo sapiens
tgcaggtgtgggcaggggagca

SEQ ID NO: 8394908 - DNA, 22 bp, Homo sapiens
tgcaggtgtctgggggcaacag

SEQ ID NO: 8394909 - DNA, 23 bp, Homo sapiens
tgcaggtgtgcagagggctcttg

SEQ ID NO: 8394910 - DNA, 22 bp, Homo sapiens
tgcaggtgtctctgtctagcgt

SEQ ID NO: 8394911 - DNA, 22 bp, Homo sapiens
tgcaggtggctccagggactgc

SEQ ID NO: 8394912 - DNA, 20 bp, Homo sapiens
tgcaggtgggcccttctggg

SEQ ID NO: 8394913 - DNA, 22 bp, Homo sapiens
tgcaggtggtacttctttttct

SEQ ID NO: 8394914 - DNA, 22 bp, Homo sapiens
tgcaggtggtccatttgggaac

SEQ ID NO: 8394915 - DNA, 22 bp, Homo sapiens
tgcaggtggtccttcctctgct

SEQ ID NO: 8394916 - DNA, 22 bp, Homo sapiens
tgcaggtggtttggacactgct

SEQ ID NO: 8394917 - DNA, 22 bp, Homo sapiens
tgcaggtgtctccagggcaggt

SEQ ID NO: 8394918 - DNA, 22 bp, Homo sapiens
tgcaggtgtctccagggcaggt

SEQ ID NO: 8394919 - DNA, 22 bp, Homo sapiens
tgcaggtgtagagttgggctcc

SEQ ID NO: 8394920 - DNA, 22 bp, Homo sapiens
tgcaggtggtttggacactgct

SEQ ID NO: 8394921 - DNA, 22 bp, Homo sapiens
tgcaggtgtaaattttcaagag

SEQ ID NO: 8394922 - DNA, 22 bp, Homo sapiens
tgcccagggtggagtgcagcgg

SEQ ID NO: 8394923 - DNA, 22 bp, Homo sapiens
tgcccagggtggagtgcagtgg

SEQ ID NO: 8394924 - DNA, 22 bp, Homo sapiens
tgcccagggtggagtgcagtgg

SEQ ID NO: 8394925 - DNA, 22 bp, Homo sapiens
tgcccagggtttctaagagcag

SEQ ID NO: 8394926 - DNA, 22 bp, Homo sapiens
tgcccagggtggagtgcagtgg

SEQ ID NO: 8394927 - DNA, 22 bp, Homo sapiens
tgcccaggtttgagtgcccaag

SEQ ID NO: 8394928 - DNA, 22 bp, Homo sapiens
tgcccaggtttgagtgcccaag

SEQ ID NO: 8394929 - DNA, 22 bp, Homo sapiens
tgcccagtctccgggccagccc

SEQ ID NO: 8394930 - DNA, 23 bp, Homo sapiens
tgcccagtgcctttgcccatgca

SEQ ID NO: 8394931 - DNA, 22 bp, Homo sapiens
tgccccaggtgctgaggttgga

SEQ ID NO: 8394932 - DNA, 19 bp, Homo sapiens
tgcccccagcacctccctg

SEQ ID NO: 8394933 - DNA, 22 bp, Homo sapiens
tgcccccttttcttgttacact

SEQ ID NO: 8394934 - DNA, 20 bp, Homo sapiens
tgccccaggcctgcacctgc

SEQ ID NO: 8394935 - DNA, 20 bp, Homo sapiens
tgccccaggcctgcacctgc

SEQ ID NO: 8394936 - DNA, 22 bp, Homo sapiens
tgccccagactctgctcacctc

SEQ ID NO: 8394937 - DNA, 22 bp, Homo sapiens
tgcccaggattgtgaggtcagg

SEQ ID NO: 8394938 - DNA, 22 bp, Homo sapiens
tgcccaggattgtgaggtcagg

SEQ ID NO: 8394939 - DNA, 19 bp, Homo sapiens
tgcccaggcctcccaaaag

SEQ ID NO: 8394940 - DNA, 19 bp, Homo sapiens
tgcccaggcctcccaaaag

SEQ ID NO: 8394941 - DNA, 19 bp, Homo sapiens
tgcccaggccaggttgggc

SEQ ID NO: 8394942 - DNA, 22 bp, Homo sapiens
tgcccaggctggaatgcagtgg

SEQ ID NO: 8394943 - DNA, 22 bp, Homo sapiens
tgcccaggctggagtacagtgg

SEQ ID NO: 8394944 - DNA, 22 bp, Homo sapiens
tgcccaggctcctcgcagcctt

SEQ ID NO: 8394945 - DNA, 22 bp, Homo sapiens
tgcccaggctcctcgcagcctt

SEQ ID NO: 8394946 - DNA, 22 bp, Homo sapiens
tgcccagggtggagtgcagcgg

SEQ ID NO: 8394947 - DNA, 21 bp, Homo sapiens
tgcccaggggccaaccgctgc

SEQ ID NO: 8394948 - DNA, 21 bp, Homo sapiens
tgcccaggggccaaccgctgc

SEQ ID NO: 8394949 - DNA, 22 bp, Homo sapiens
tgcccagggtggagtgcagcgg

SEQ ID NO: 8394950 - DNA, 22 bp, Homo sapiens
tgcccagggataagcctagaga

SEQ ID NO: 8394951 - DNA, 22 bp, Homo sapiens
tgcccagggataagcctagaga

SEQ ID NO: 8394952 - DNA, 22 bp, Homo sapiens
tgcccaggcttcaccctcagag

SEQ ID NO: 8394953 - DNA, 22 bp, Homo sapiens
tgcccaggcttcaccctcagag

SEQ ID NO: 8394954 - DNA, 22 bp, Homo sapiens
tgcccaggctggagtgcagtgg

SEQ ID NO: 8394955 - DNA, 22 bp, Homo sapiens
tgcccaggcttcaccctcagag

SEQ ID NO: 8394956 - DNA, 22 bp, Homo sapiens
tgcccaggctggagtgcagtgg

SEQ ID NO: 8394957 - DNA, 22 bp, Homo sapiens
tgcccaggctggagtgcagtgg

SEQ ID NO: 8394958 - DNA, 22 bp, Homo sapiens
tgcccaggctggagtgcagagg

SEQ ID NO: 8394959 - DNA, 22 bp, Homo sapiens
tgcccaggctggagtgcagagg

SEQ ID NO: 8394960 - DNA, 22 bp, Homo sapiens
tgcccaggctggagtgcagagg

SEQ ID NO: 8394961 - DNA, 22 bp, Homo sapiens
tgcccaggctggagtgcagagg

SEQ ID NO: 8394962 - DNA, 22 bp, Homo sapiens
tgcccagcactgtgccagtcac

SEQ ID NO: 8394963 - DNA, 22 bp, Homo sapiens
tgcccagcactgtgccagtcac

SEQ ID NO: 8394964 - DNA, 22 bp, Homo sapiens
tgcccagccaatttgttatgtt

SEQ ID NO: 8394965 - DNA, 22 bp, Homo sapiens
tgcccagcagggagctacctgg

SEQ ID NO: 8394966 - DNA, 22 bp, Homo sapiens
tgcccaggatctggcgatgctc

SEQ ID NO: 8394967 - DNA, 22 bp, Homo sapiens
tgcccagcagggagctacctgg

SEQ ID NO: 8394968 - DNA, 20 bp, Homo sapiens
tgcccagcaagagtgcagtt

SEQ ID NO: 8394969 - DNA, 22 bp, Homo sapiens
tgcccagcaataaaccagaaga

SEQ ID NO: 8394970 - DNA, 22 bp, Homo sapiens
tgcccagcaataaaccagaaga

SEQ ID NO: 8394971 - DNA, 22 bp, Homo sapiens
tgcccagcacccagcatgatgc

SEQ ID NO: 8394972 - DNA, 22 bp, Homo sapiens
tgcccagcacccagcatgatgc

SEQ ID NO: 8394973 - DNA, 20 bp, Homo sapiens
tgcccagcaagagtgcagtt

SEQ ID NO: 8394974 - DNA, 20 bp, Homo sapiens
tgcccacatcactcaggagt

SEQ ID NO: 8394975 - DNA, 22 bp, Homo sapiens
tgccatggaatcacctccagct

SEQ ID NO: 8394976 - DNA, 22 bp, Homo sapiens
tgccaggccctcccacagatta

SEQ ID NO: 8394977 - DNA, 22 bp, Homo sapiens
tgccaggccaatgaaggcaggg

SEQ ID NO: 8394978 - DNA, 22 bp, Homo sapiens
tgccaggcatttgacagacact

SEQ ID NO: 8394979 - DNA, 22 bp, Homo sapiens
tgccaggcccagctccagagct

SEQ ID NO: 8394980 - DNA, 22 bp, Homo sapiens
tgccagcctggcctgagtcttt

SEQ ID NO: 8394981 - DNA, 17 bp, Homo sapiens
tgccagcctgtcccagg

SEQ ID NO: 8394982 - DNA, 22 bp, Homo sapiens
tgccagctagtcacatattaga

SEQ ID NO: 8394983 - DNA, 22 bp, Homo sapiens
tgccagctagagaagctagaaa

SEQ ID NO: 8394984 - DNA, 19 bp, Homo sapiens
tgccagctcacaggagctc

SEQ ID NO: 8394985 - DNA, 22 bp, Homo sapiens
tgccagctcagagttaggactg

SEQ ID NO: 8394986 - DNA, 22 bp, Homo sapiens
tgccaggatggccagggggcca

SEQ ID NO: 8394987 - DNA, 20 bp, Homo sapiens
tgccaggcacggagtgcatg

SEQ ID NO: 8394988 - DNA, 22 bp, Homo sapiens
tgccagggagccctgctgacca

SEQ ID NO: 8394989 - DNA, 22 bp, Homo sapiens
tgccagggaccctgtcggccct

SEQ ID NO: 8394990 - DNA, 22 bp, Homo sapiens
tgccagggaccctgtcggccct

SEQ ID NO: 8394991 - DNA, 21 bp, Homo sapiens
tgccagggatttacagagcct

SEQ ID NO: 8394992 - DNA, 22 bp, Homo sapiens
tgccaggctccggaacgacagt

SEQ ID NO: 8394993 - DNA, 18 bp, Homo sapiens
tgccatccccagtcaagt

SEQ ID NO: 8394994 - DNA, 22 bp, Homo sapiens
tgccatccttgaggaagggcaa

SEQ ID NO: 8394995 - DNA, 22 bp, Homo sapiens
tgccatcctgtgtcatgctcat

SEQ ID NO: 8394996 - DNA, 22 bp, Homo sapiens
tgccatcctgtgtcatgctcat

SEQ ID NO: 8394997 - DNA, 22 bp, Homo sapiens
tgccatctctccatagcataga

SEQ ID NO: 8394998 - DNA, 22 bp, Homo sapiens
tgccatctgaaaattacatcct

SEQ ID NO: 8394999 - DNA, 22 bp, Homo sapiens
tgccatcttcaataacactgag

SEQ ID NO: 8395000 - DNA, 22 bp, Homo sapiens
tgccatccaacagttccatctt

SEQ ID NO: 8395001 - DNA, 22 bp, Homo sapiens
tgccagggctgctactggctga

SEQ ID NO: 8395002 - DNA, 23 bp, Homo sapiens
tgccagggccctgtgtgcaatgc

SEQ ID NO: 8395003 - DNA, 22 bp, Homo sapiens
tgccagggtcctgagggccttg

SEQ ID NO: 8395004 - DNA, 22 bp, Homo sapiens
tgccagggtcctgagggccttg

SEQ ID NO: 8395005 - DNA, 22 bp, Homo sapiens
tgccagggtcagctgcagctct

SEQ ID NO: 8395006 - DNA, 22 bp, Homo sapiens
tgcctgctttctcctcaactca

SEQ ID NO: 8395007 - DNA, 20 bp, Homo sapiens
tgcctgcccaggtcctgcac

SEQ ID NO: 8395008 - DNA, 22 bp, Homo sapiens
tgcctgcatcttggaggcccca

SEQ ID NO: 8395009 - DNA, 17 bp, Homo sapiens
tgcctgccagcattgga

SEQ ID NO: 8395010 - DNA, 17 bp, Homo sapiens
tgcctgccagcattgga

SEQ ID NO: 8395011 - DNA, 22 bp, Homo sapiens
tgcctggagtccccaagtccat

SEQ ID NO: 8395012 - DNA, 22 bp, Homo sapiens
tgcctggcaagaggggctggct

SEQ ID NO: 8395013 - DNA, 22 bp, Homo sapiens
tgcctggcaatgccagaagcca

SEQ ID NO: 8395014 - DNA, 19 bp, Homo sapiens
tgcctggcaccagctccac

SEQ ID NO: 8395015 - DNA, 22 bp, Homo sapiens
tgcctggcatctagccctggga

SEQ ID NO: 8395016 - DNA, 22 bp, Homo sapiens
tgcctcaggcacctggcaggtt

SEQ ID NO: 8395017 - DNA, 22 bp, Homo sapiens
tgcctcagctgaggccgctcca

SEQ ID NO: 8395018 - DNA, 22 bp, Homo sapiens
tgcctcagagtgggcttgctat

SEQ ID NO: 8395019 - DNA, 22 bp, Homo sapiens
tgcctcagtctaaagtctctca

SEQ ID NO: 8395020 - DNA, 19 bp, Homo sapiens
tgcctcagggctttgagga

SEQ ID NO: 8395021 - DNA, 23 bp, Homo sapiens
tgcctctgcctccctagtctgca

SEQ ID NO: 8395022 - DNA, 22 bp, Homo sapiens
tgcctccctctctgccactgga

SEQ ID NO: 8395023 - DNA, 22 bp, Homo sapiens
tgcctctgtgggccttcctggc

SEQ ID NO: 8395024 - DNA, 22 bp, Homo sapiens
tgcctctgggtgaccaaggagc

SEQ ID NO: 8395025 - DNA, 22 bp, Homo sapiens
tgcctcttggagcctttcctct

SEQ ID NO: 8395026 - DNA, 22 bp, Homo sapiens
tgcccttgggatttaggtaagg

SEQ ID NO: 8395027 - DNA, 22 bp, Homo sapiens
tgcccttcctctggattgcctt

SEQ ID NO: 8395028 - DNA, 22 bp, Homo sapiens
tgccctgggaacacagatgcca

SEQ ID NO: 8395029 - DNA, 23 bp, Homo sapiens
tgccgtgttagaaatgttttaca

SEQ ID NO: 8395030 - DNA, 22 bp, Homo sapiens
tgccgcagtgcggggagggccc

SEQ ID NO: 8395031 - DNA, 22 bp, Homo sapiens
tgccgctccaggtctcgcggtg

SEQ ID NO: 8395032 - DNA, 22 bp, Homo sapiens
tgccgctccaggtctcgcggtg

SEQ ID NO: 8395033 - DNA, 22 bp, Homo sapiens
tgccgtggggctgaggctggag

SEQ ID NO: 8395034 - DNA, 22 bp, Homo sapiens
tgcctcagagacctgacagtac

SEQ ID NO: 8395035 - DNA, 23 bp, Homo sapiens
tgcctattcagcagagtgatagc

SEQ ID NO: 8395036 - DNA, 22 bp, Homo sapiens
tgcctattcaatatatgcattt

SEQ ID NO: 8395037 - DNA, 22 bp, Homo sapiens
tgcctagttctgtatttacagt

SEQ ID NO: 8395038 - DNA, 22 bp, Homo sapiens
tgcctaggaaacctcatgcttc

SEQ ID NO: 8395039 - DNA, 22 bp, Homo sapiens
tgcctagtagggttgttgtagg

SEQ ID NO: 8395040 - DNA, 22 bp, Homo sapiens
tgccctggatgctgcaggtgtg

SEQ ID NO: 8395041 - DNA, 22 bp, Homo sapiens
tgccctggcacacacacagctg

SEQ ID NO: 8395042 - DNA, 22 bp, Homo sapiens
tgccctgctgtggctctgccca

SEQ ID NO: 8395043 - DNA, 22 bp, Homo sapiens
tgccctgcttctcttgggacag

SEQ ID NO: 8395044 - DNA, 22 bp, Homo sapiens
tgccctggagtcagtggctatt

SEQ ID NO: 8395045 - DNA, 22 bp, Homo sapiens
tgccctgcagtgagtgcgtctg

SEQ ID NO: 8395046 - DNA, 22 bp, Homo sapiens
tctcagagtttagagctgagcc

SEQ ID NO: 8395047 - DNA, 22 bp, Homo sapiens
tctcagatggcatcagctagag

SEQ ID NO: 8395048 - DNA, 22 bp, Homo sapiens
tctcagaggtcttcagcctctg

SEQ ID NO: 8395049 - DNA, 18 bp, Homo sapiens
tctcagcccagctccggc

SEQ ID NO: 8395050 - DNA, 22 bp, Homo sapiens
tctcaggcttcctggtgctgtg

SEQ ID NO: 8395051 - DNA, 19 bp, Homo sapiens
tctcagagccctagaggcc

SEQ ID NO: 8395052 - DNA, 19 bp, Homo sapiens
tctcagagccctagaggcc

SEQ ID NO: 8395053 - DNA, 19 bp, Homo sapiens
tctcagagccctagaggcc

SEQ ID NO: 8395054 - DNA, 22 bp, Homo sapiens
tctcagagattcagggagaagt

SEQ ID NO: 8395055 - DNA, 22 bp, Homo sapiens
tctcagagatgttagggaagag

SEQ ID NO: 8395056 - DNA, 22 bp, Homo sapiens
tctcagagcttcagaaagcacc

SEQ ID NO: 8395057 - DNA, 22 bp, Homo sapiens
tctcagagatgttagggaagag

SEQ ID NO: 8395058 - DNA, 22 bp, Homo sapiens
tctcagagatgtcaagagtcta

SEQ ID NO: 8395059 - DNA, 22 bp, Homo sapiens
tctcagagagatgaaacttcca

SEQ ID NO: 8395060 - DNA, 22 bp, Homo sapiens
tctcagaacacccttctatggt

SEQ ID NO: 8395061 - DNA, 22 bp, Homo sapiens
tctcagaactttatatgtatca

SEQ ID NO: 8395062 - DNA, 22 bp, Homo sapiens
tctcactttccagacttttcaa

SEQ ID NO: 8395063 - DNA, 22 bp, Homo sapiens
tctcaccatggtgcttgcttat

SEQ ID NO: 8395064 - DNA, 22 bp, Homo sapiens
tctcacattttaaaaggacata

SEQ ID NO: 8395065 - DNA, 19 bp, Homo sapiens
tctcacatcagctcctagc

SEQ ID NO: 8395066 - DNA, 22 bp, Homo sapiens
tctcacatctgccctgtgctgg

SEQ ID NO: 8395067 - DNA, 22 bp, Homo sapiens
tctcacagtatgaattgttcac

SEQ ID NO: 8395068 - DNA, 22 bp, Homo sapiens
tctcatggagtcaggagcagaa

SEQ ID NO: 8395069 - DNA, 22 bp, Homo sapiens
tctcatcttcattgtctcccat

SEQ ID NO: 8395070 - DNA, 22 bp, Homo sapiens
tctcatcttgttcatctaccct

SEQ ID NO: 8395071 - DNA, 22 bp, Homo sapiens
tctcatctttaaatgaaaattt

SEQ ID NO: 8395072 - DNA, 22 bp, Homo sapiens
tctcatcttcattgtctcccat

SEQ ID NO: 8395073 - DNA, 22 bp, Homo sapiens
tctcatcttcatatctgaaaga

SEQ ID NO: 8395074 - DNA, 22 bp, Homo sapiens
tctcatctgcgagctctgccag

SEQ ID NO: 8395075 - DNA, 22 bp, Homo sapiens
tctcatctgcgagctctgccag

SEQ ID NO: 8395076 - DNA, 21 bp, Homo sapiens
tctcatctcctgacctgtgcc

SEQ ID NO: 8395077 - DNA, 22 bp, Homo sapiens
tctcatctcggatcagaagtga

SEQ ID NO: 8395078 - DNA, 22 bp, Homo sapiens
tctcatctgccatttgcaggag

SEQ ID NO: 8395079 - DNA, 22 bp, Homo sapiens
tctcatctgccatttgcaggag

SEQ ID NO: 8395080 - DNA, 22 bp, Homo sapiens
tctcagttttttcaaccataat

SEQ ID NO: 8395081 - DNA, 22 bp, Homo sapiens
tctcataatagcatttctcacc

SEQ ID NO: 8395082 - DNA, 22 bp, Homo sapiens
tctcatctattcacattaactg

SEQ ID NO: 8395083 - DNA, 22 bp, Homo sapiens
tctcatctagactctgcccttg

SEQ ID NO: 8395084 - DNA, 22 bp, Homo sapiens
tctcatctcaaattgtaatccc

SEQ ID NO: 8395085 - DNA, 22 bp, Homo sapiens
tctcatctccattatagcatca

SEQ ID NO: 8395086 - DNA, 23 bp, Homo sapiens
tctcagtgaatctcagaattcgc

SEQ ID NO: 8395087 - DNA, 23 bp, Homo sapiens
tctcagtgcacgcaccatgcctg

SEQ ID NO: 8395088 - DNA, 22 bp, Homo sapiens
tctcagtgcagcaaggaattta

SEQ ID NO: 8395089 - DNA, 22 bp, Homo sapiens
tctcagtgcagcaaggaattta

SEQ ID NO: 8395090 - DNA, 22 bp, Homo sapiens
tctcaggggcctggagtcctgg

SEQ ID NO: 8395091 - DNA, 20 bp, Homo sapiens
tctcagggttcagcaaagta

SEQ ID NO: 8395092 - DNA, 22 bp, Homo sapiens
tctcagggtgaggaaagaattt

SEQ ID NO: 8395093 - DNA, 22 bp, Homo sapiens
tctcaggtggcccccatgagtg

SEQ ID NO: 8395094 - DNA, 22 bp, Homo sapiens
tctcatgttttacctgtcctca

SEQ ID NO: 8395095 - DNA, 18 bp, Homo sapiens
tctcattacaatctttgt

SEQ ID NO: 8395096 - DNA, 22 bp, Homo sapiens
tctcattcatccaaggatttat

SEQ ID NO: 8395097 - DNA, 22 bp, Homo sapiens
tctcattcataccctacatgct

SEQ ID NO: 8395098 - DNA, 22 bp, Homo sapiens
tctcatttgcctcatctataaa

SEQ ID NO: 8395099 - DNA, 22 bp, Homo sapiens
tctcatttgcctcatctataaa

SEQ ID NO: 8395100 - DNA, 22 bp, Homo sapiens
tctcatttgcctcatctataaa

SEQ ID NO: 8395101 - DNA, 22 bp, Homo sapiens
tctcatttgcctcatctataaa

SEQ ID NO: 8395102 - DNA, 22 bp, Homo sapiens
tctcatttgtgtgcaattcaga

SEQ ID NO: 8395103 - DNA, 22 bp, Homo sapiens
tctcatttggctttgttttaaa

SEQ ID NO: 8395104 - DNA, 22 bp, Homo sapiens
tctccacaagctgatgctagga

SEQ ID NO: 8395105 - DNA, 22 bp, Homo sapiens
tctccaaggccctactctattt

SEQ ID NO: 8395106 - DNA, 22 bp, Homo sapiens
tctccaagcagggctgcaaggc

SEQ ID NO: 8395107 - DNA, 22 bp, Homo sapiens
tctccaggactgagctccagcc

SEQ ID NO: 8395108 - DNA, 22 bp, Homo sapiens
tctccaggagaaatatgaagga

SEQ ID NO: 8395109 - DNA, 22 bp, Homo sapiens
tctccaggcacttggctgctac

SEQ ID NO: 8395110 - DNA, 22 bp, Homo sapiens
tctccaggagcaagtcacccag

SEQ ID NO: 8395111 - DNA, 22 bp, Homo sapiens
tctccaggcactacctgggtaa

SEQ ID NO: 8395112 - DNA, 23 bp, Homo sapiens
tctcctcctagatacagtcatgg

SEQ ID NO: 8395113 - DNA, 22 bp, Homo sapiens
tctcctcccaggctcttccagg

SEQ ID NO: 8395114 - DNA, 22 bp, Homo sapiens
tctcctcccaggctcttccagg

SEQ ID NO: 8395115 - DNA, 22 bp, Homo sapiens
tctcctctcctttcatgttgtt

SEQ ID NO: 8395116 - DNA, 22 bp, Homo sapiens
tctcctgacatgtctggaggaa

SEQ ID NO: 8395117 - DNA, 22 bp, Homo sapiens
tctcctgccactgcttcccatt

SEQ ID NO: 8395118 - DNA, 22 bp, Homo sapiens
tctcctgcagcgagcccgacac

SEQ ID NO: 8395119 - DNA, 22 bp, Homo sapiens
tctcctgcagtcagcagtctca

SEQ ID NO: 8395120 - DNA, 22 bp, Homo sapiens
tctcctggaagaataccacact

SEQ ID NO: 8395121 - DNA, 22 bp, Homo sapiens
tctcctggaagtgattcccctg

SEQ ID NO: 8395122 - DNA, 22 bp, Homo sapiens
tctcctgctcccaactgctgca

SEQ ID NO: 8395123 - DNA, 22 bp, Homo sapiens
tctcctgcttcaactgatggac

SEQ ID NO: 8395124 - DNA, 22 bp, Homo sapiens
tctcctggagcaggaaggtggg

SEQ ID NO: 8395125 - DNA, 22 bp, Homo sapiens
tctcctggagcccagatgctgg

SEQ ID NO: 8395126 - DNA, 22 bp, Homo sapiens
tctcctggagcccagatgctgg

SEQ ID NO: 8395127 - DNA, 22 bp, Homo sapiens
tctcctggcatttggttgagta

SEQ ID NO: 8395128 - DNA, 22 bp, Homo sapiens
tctcctggcatgtgggtcatct

SEQ ID NO: 8395129 - DNA, 22 bp, Homo sapiens
tctcctggatagatactatcca

SEQ ID NO: 8395130 - DNA, 22 bp, Homo sapiens
tctcctggatggaccttctctt

SEQ ID NO: 8395131 - DNA, 22 bp, Homo sapiens
tctcctgggtaaaagggttgat

SEQ ID NO: 8395132 - DNA, 18 bp, Homo sapiens
tctcctgggtaggggcct

SEQ ID NO: 8395133 - DNA, 22 bp, Homo sapiens
tctcctgggcttggttgaagtt

SEQ ID NO: 8395134 - DNA, 22 bp, Homo sapiens
tctcctggtacccttcctagca

SEQ ID NO: 8395135 - DNA, 22 bp, Homo sapiens
tctcctggtatgtatgcacctg

SEQ ID NO: 8395136 - DNA, 22 bp, Homo sapiens
tctcctggtatgtatgcacctg

SEQ ID NO: 8395137 - DNA, 21 bp, Homo sapiens
tctcctgggtccaacccatgc

SEQ ID NO: 8395138 - DNA, 22 bp, Homo sapiens
tctcctgggtgctttatcagaa

SEQ ID NO: 8395139 - DNA, 20 bp, Homo sapiens
tctcctggtgacagtaccca

SEQ ID NO: 8395140 - DNA, 22 bp, Homo sapiens
tctcctggtttgttaaataatt

SEQ ID NO: 8395141 - DNA, 20 bp, Homo sapiens
tctcctggtctggtccgtgc

SEQ ID NO: 8395142 - DNA, 22 bp, Homo sapiens
tctcctggtcacctcagaagtc

SEQ ID NO: 8395143 - DNA, 22 bp, Homo sapiens
tctccttccaacaaaaggtcac

SEQ ID NO: 8395144 - DNA, 22 bp, Homo sapiens
tctcctgtcttctcagcacccc

SEQ ID NO: 8395145 - DNA, 22 bp, Homo sapiens
tctcctgtgcaccctccctgtg

SEQ ID NO: 8395146 - DNA, 22 bp, Homo sapiens
tctctaaagatagctgcctcga

SEQ ID NO: 8395147 - DNA, 22 bp, Homo sapiens
tctctaaagatatttatggcaa

SEQ ID NO: 8395148 - DNA, 22 bp, Homo sapiens
tctctaaacttatatgaactat

SEQ ID NO: 8395149 - DNA, 22 bp, Homo sapiens
tctctaaagaagcctccctaaa

SEQ ID NO: 8395150 - DNA, 22 bp, Homo sapiens
tctctagtctcctttaacctga

SEQ ID NO: 8395151 - DNA, 21 bp, Homo sapiens
tctctaaaaagattctatttg

SEQ ID NO: 8395152 - DNA, 22 bp, Homo sapiens
tctctaaaattcccggccaact

SEQ ID NO: 8395153 - DNA, 22 bp, Homo sapiens
tctctaaacttatatgaactat

SEQ ID NO: 8395154 - DNA, 22 bp, Homo sapiens
tctcgctctgtcgcccaggctg

SEQ ID NO: 8395155 - DNA, 22 bp, Homo sapiens
tctcgctctgtcgcccaggctg

SEQ ID NO: 8395156 - DNA, 22 bp, Homo sapiens
tctcgatctcctgaccttgtga

SEQ ID NO: 8395157 - DNA, 22 bp, Homo sapiens
tctcctttaagatttcctcagg

SEQ ID NO: 8395158 - DNA, 22 bp, Homo sapiens
tctccttcgaggcccagctccc

SEQ ID NO: 8395159 - DNA, 22 bp, Homo sapiens
tctccttcgaggcccagctccc

SEQ ID NO: 8395160 - DNA, 22 bp, Homo sapiens
tctccttcgaggcccagctccc

SEQ ID NO: 8395161 - DNA, 22 bp, Homo sapiens
tctcccaggcaggagtgcagtg

SEQ ID NO: 8395162 - DNA, 22 bp, Homo sapiens
tctcccaggcaggagtgcagtg

SEQ ID NO: 8395163 - DNA, 22 bp, Homo sapiens
tctcccaggtgggtgcctggag

SEQ ID NO: 8395164 - DNA, 22 bp, Homo sapiens
tctcccagtcctctgtgcttac

SEQ ID NO: 8395165 - DNA, 22 bp, Homo sapiens
tctcccagtcctctgtgcttac

SEQ ID NO: 8395166 - DNA, 22 bp, Homo sapiens
tctcccaggtcatacacagaga

SEQ ID NO: 8395167 - DNA, 22 bp, Homo sapiens
tctcccaggtcatacacagaga

SEQ ID NO: 8395168 - DNA, 22 bp, Homo sapiens
tctcccaggctggagtgcagtg

SEQ ID NO: 8395169 - DNA, 22 bp, Homo sapiens
tctcccaggctggagtgcagtg

SEQ ID NO: 8395170 - DNA, 19 bp, Homo sapiens
tctcccatgcctgtgtcta

SEQ ID NO: 8395171 - DNA, 22 bp, Homo sapiens
tctcccatgaggctgcggtcaa

SEQ ID NO: 8395172 - DNA, 22 bp, Homo sapiens
tctcccattcagcttgcagtca

SEQ ID NO: 8395173 - DNA, 22 bp, Homo sapiens
tctcccagtgtctggcagtcag

SEQ ID NO: 8395174 - DNA, 22 bp, Homo sapiens
tctcccagtggtgcagaaagca

SEQ ID NO: 8395175 - DNA, 22 bp, Homo sapiens
tctccccaaccatggcactcac

SEQ ID NO: 8395176 - DNA, 22 bp, Homo sapiens
tctccccaaaggactcactctc

SEQ ID NO: 8395177 - DNA, 22 bp, Homo sapiens
tctccccagctgagctgccctt

SEQ ID NO: 8395178 - DNA, 22 bp, Homo sapiens
tctcccctgttggccaggtttt

SEQ ID NO: 8395179 - DNA, 22 bp, Homo sapiens
tctcccctgttggccaggtttt

SEQ ID NO: 8395180 - DNA, 22 bp, Homo sapiens
tctccctcattcctgcttccat

SEQ ID NO: 8395181 - DNA, 23 bp, Homo sapiens
tctccctcatgcctaggcctggg

SEQ ID NO: 8395182 - DNA, 22 bp, Homo sapiens
tctccctactgactccaggacc

SEQ ID NO: 8395183 - DNA, 22 bp, Homo sapiens
tctccagggcagagaatagcaa

SEQ ID NO: 8395184 - DNA, 22 bp, Homo sapiens
tctccagggaggtagcccagtg

SEQ ID NO: 8395185 - DNA, 22 bp, Homo sapiens
tctccagggtgagctaggccag

SEQ ID NO: 8395186 - DNA, 22 bp, Homo sapiens
tctccagggactgaggctggag

SEQ ID NO: 8395187 - DNA, 22 bp, Homo sapiens
tctccaggtggggtcacctttt

SEQ ID NO: 8395188 - DNA, 22 bp, Homo sapiens
tctcccagaagtcctcagtaca

SEQ ID NO: 8395189 - DNA, 22 bp, Homo sapiens
tctcccagaggatcccagtgga

SEQ ID NO: 8395190 - DNA, 22 bp, Homo sapiens
tctccaggtgaaacttgcaggg

SEQ ID NO: 8395191 - DNA, 19 bp, Homo sapiens
tctccaggtgccccaaaca

SEQ ID NO: 8395192 - DNA, 22 bp, Homo sapiens
tctccaggtgctaagtgtgcct

SEQ ID NO: 8395193 - DNA, 22 bp, Homo sapiens
tctccaggtggcttgggcttct

SEQ ID NO: 8395194 - DNA, 22 bp, Homo sapiens
tctcttccagtggctttgattt

SEQ ID NO: 8395195 - DNA, 22 bp, Homo sapiens
tctcttcccctttcctttaaca

SEQ ID NO: 8395196 - DNA, 22 bp, Homo sapiens
tctcttcccggataaagtaagt

SEQ ID NO: 8395197 - DNA, 22 bp, Homo sapiens
tctcttcctagtgatgggcttt

SEQ ID NO: 8395198 - DNA, 22 bp, Homo sapiens
tctcttcctcagcctggggcct

SEQ ID NO: 8395199 - DNA, 22 bp, Homo sapiens
tctcttccttgacctattgtaa

SEQ ID NO: 8395200 - DNA, 22 bp, Homo sapiens
tctcttcagcccattataaggg

SEQ ID NO: 8395201 - DNA, 21 bp, Homo sapiens
tctctgtgtctttaagctgga

SEQ ID NO: 8395202 - DNA, 22 bp, Homo sapiens
tctcttagtcttatatgtaaaa

SEQ ID NO: 8395203 - DNA, 22 bp, Homo sapiens
tctcttaggagaaattcataaa

SEQ ID NO: 8395204 - DNA, 23 bp, Homo sapiens
tctcttacctgagacatttccta

SEQ ID NO: 8395205 - DNA, 18 bp, Homo sapiens
tctcttcttggcagtcaa

SEQ ID NO: 8395206 - DNA, 22 bp, Homo sapiens
tctcttctgaaacctgtcttta

SEQ ID NO: 8395207 - DNA, 23 bp, Homo sapiens
tctctggttaggggagattggtg

SEQ ID NO: 8395208 - DNA, 22 bp, Homo sapiens
tctctgggtttttgtcctgtac

SEQ ID NO: 8395209 - DNA, 22 bp, Homo sapiens
tctctgtgcaggatgctgagtt

SEQ ID NO: 8395210 - DNA, 22 bp, Homo sapiens
tctctgtgagatttgtattaag

SEQ ID NO: 8395211 - DNA, 22 bp, Homo sapiens
tctctgtgacagctgggtatgt

SEQ ID NO: 8395212 - DNA, 22 bp, Homo sapiens
tctctgtgaagctcccgttagg

SEQ ID NO: 8395213 - DNA, 22 bp, Homo sapiens
tctctgtggcaagcatgctgct

SEQ ID NO: 8395214 - DNA, 22 bp, Homo sapiens
tctctgtggcaagcatgctgct

SEQ ID NO: 8395215 - DNA, 22 bp, Homo sapiens
tctctgtggagcagtgtgttca

SEQ ID NO: 8395216 - DNA, 22 bp, Homo sapiens
tctctgtgcccagtagttctct

SEQ ID NO: 8395217 - DNA, 22 bp, Homo sapiens
tctctgtgcaggatgctgagtt

SEQ ID NO: 8395218 - DNA, 21 bp, Homo sapiens
tctctgtgtacagtctcaccc

SEQ ID NO: 8395219 - DNA, 22 bp, Homo sapiens
tctctgtgtctcatgttcctat

SEQ ID NO: 8395220 - DNA, 22 bp, Homo sapiens
tctctgtgggtttcaccagcgc

SEQ ID NO: 8395221 - DNA, 22 bp, Homo sapiens
tctctgtggtgggaggctgagt

SEQ ID NO: 8395222 - DNA, 22 bp, Homo sapiens
tctgaaagctagaaaatgctct

SEQ ID NO: 8395223 - DNA, 22 bp, Homo sapiens
tctgaaatactgcaggttctct

SEQ ID NO: 8395224 - DNA, 22 bp, Homo sapiens
tctctttgtctgctcttagttg

SEQ ID NO: 8395225 - DNA, 22 bp, Homo sapiens
tctctttgtctgctcttagttg

SEQ ID NO: 8395226 - DNA, 20 bp, Homo sapiens
tctcttttagcttacagctg

SEQ ID NO: 8395227 - DNA, 22 bp, Homo sapiens
tctctttaaaaatagtgaaata

SEQ ID NO: 8395228 - DNA, 22 bp, Homo sapiens
tctctttaagtataatcttata

SEQ ID NO: 8395229 - DNA, 22 bp, Homo sapiens
tctctttaaagactcagagatt

SEQ ID NO: 8395230 - DNA, 18 bp, Homo sapiens
tctctttcctcagtggag

SEQ ID NO: 8395231 - DNA, 22 bp, Homo sapiens
tctgaagattctttccactatt

SEQ ID NO: 8395232 - DNA, 22 bp, Homo sapiens
tctgaagagctttggaagtatg

SEQ ID NO: 8395233 - DNA, 22 bp, Homo sapiens
tctgaaatagaagtgtctttct

SEQ ID NO: 8395234 - DNA, 22 bp, Homo sapiens
tctgaagaataggatgttgtgt

SEQ ID NO: 8395235 - DNA, 19 bp, Homo sapiens
tctgaagaattagagagca

SEQ ID NO: 8395236 - DNA, 22 bp, Homo sapiens
tctgaacagcatggaatcattt

SEQ ID NO: 8395237 - DNA, 22 bp, Homo sapiens
tctgaaattttagttatagaaa

SEQ ID NO: 8395238 - DNA, 22 bp, Homo sapiens
tctctggggtagggcccaggac

SEQ ID NO: 8395239 - DNA, 22 bp, Homo sapiens
tctctgggttctcactcagcac

SEQ ID NO: 8395240 - DNA, 22 bp, Homo sapiens
tctctgggtgatggcagggcac

SEQ ID NO: 8395241 - DNA, 22 bp, Homo sapiens
tctctggggaaaaggctgatac

SEQ ID NO: 8395242 - DNA, 22 bp, Homo sapiens
tctctgggctcaggagcccggc

SEQ ID NO: 8395243 - DNA, 22 bp, Homo sapiens
tctctgggcctccctttccaag

SEQ ID NO: 8395244 - DNA, 22 bp, Homo sapiens
tctctgggctaaaatcaaggtg

SEQ ID NO: 8395245 - DNA, 19 bp, Homo sapiens
tctctggcttgtctgcctg

SEQ ID NO: 8395246 - DNA, 22 bp, Homo sapiens
tctctgggaaatggagaatttt

SEQ ID NO: 8395247 - DNA, 20 bp, Homo sapiens
tctctgctgtccacatttgc

SEQ ID NO: 8395248 - DNA, 22 bp, Homo sapiens
tctctggccccatggctgagct

SEQ ID NO: 8395249 - DNA, 20 bp, Homo sapiens
tctctggccagaaacaacag

SEQ ID NO: 8395250 - DNA, 22 bp, Homo sapiens
tctctggccgagagtccctggg

SEQ ID NO: 8395251 - DNA, 22 bp, Homo sapiens
tctctggcagaggccctatccc

SEQ ID NO: 8395252 - DNA, 22 bp, Homo sapiens
tctctggcagactggctgggct

SEQ ID NO: 8395253 - DNA, 22 bp, Homo sapiens
tctctggcagcttgtgctgttg

SEQ ID NO: 8395254 - DNA, 19 bp, Homo sapiens
tctctggcagttcagagca

SEQ ID NO: 8395255 - DNA, 22 bp, Homo sapiens
tctctgagggagatggcctgcc

SEQ ID NO: 8395256 - DNA, 22 bp, Homo sapiens
tctctgagtcaccgtggagacg

SEQ ID NO: 8395257 - DNA, 22 bp, Homo sapiens
tctctgagtcaccgtggagacg

SEQ ID NO: 8395258 - DNA, 20 bp, Homo sapiens
tctctgagcttctcttgggg

SEQ ID NO: 8395259 - DNA, 22 bp, Homo sapiens
tctctgagctcaggagctgcag

SEQ ID NO: 8395260 - DNA, 21 bp, Homo sapiens
tctctgagcccaccaggatct

SEQ ID NO: 8395261 - DNA, 22 bp, Homo sapiens
tctctgagaagctgaggctggg

SEQ ID NO: 8395262 - DNA, 22 bp, Homo sapiens
tctctgaaagcagctgctcatc

SEQ ID NO: 8395263 - DNA, 22 bp, Homo sapiens
tctctctttttaatcatgtaat

SEQ ID NO: 8395264 - DNA, 22 bp, Homo sapiens
tctctctgccaactcacagcca

SEQ ID NO: 8395265 - DNA, 23 bp, Homo sapiens
tctctctggcaaatttcacatat

SEQ ID NO: 8395266 - DNA, 22 bp, Homo sapiens
tctctccctttccttatcagtt

SEQ ID NO: 8395267 - DNA, 22 bp, Homo sapiens
tctctcccaaatctgcagatag

SEQ ID NO: 8395268 - DNA, 22 bp, Homo sapiens
tctctcccaaatctgcagatag

SEQ ID NO: 8395269 - DNA, 22 bp, Homo sapiens
tctctctactggggcactagga

SEQ ID NO: 8395270 - DNA, 22 bp, Homo sapiens
tctctctatatgtcaacagggg

SEQ ID NO: 8395271 - DNA, 22 bp, Homo sapiens
tctctcagtcagatgctaaaga

SEQ ID NO: 8395272 - DNA, 22 bp, Homo sapiens
tctctcagggggaaggctgaag

SEQ ID NO: 8395273 - DNA, 22 bp, Homo sapiens
tctctcagggggaaggctgaag

SEQ ID NO: 8395274 - DNA, 18 bp, Homo sapiens
tctctcagggaaacagaa

SEQ ID NO: 8395275 - DNA, 22 bp, Homo sapiens
tctctcaggctggagtgcagtg

SEQ ID NO: 8395276 - DNA, 22 bp, Homo sapiens
tctctatattatatgtagtttg

SEQ ID NO: 8395277 - DNA, 22 bp, Homo sapiens
tctctagtattaagctccattt

SEQ ID NO: 8395278 - DNA, 20 bp, Homo sapiens
tctctattcccacgaggaaa

SEQ ID NO: 8395279 - DNA, 22 bp, Homo sapiens
tctctattaattgacaatggct

SEQ ID NO: 8395280 - DNA, 22 bp, Homo sapiens
tctctatttgcctaggcttgtg

SEQ ID NO: 8395281 - DNA, 20 bp, Homo sapiens
tctctattcccacgaggaaa

SEQ ID NO: 8395282 - DNA, 22 bp, Homo sapiens
tctctcagaaagcccatgtctg

SEQ ID NO: 8395283 - DNA, 22 bp, Homo sapiens
tctctcagaaagcccatgtctg

SEQ ID NO: 8395284 - DNA, 22 bp, Homo sapiens
tctctcagaggaagaggcagtg

SEQ ID NO: 8395285 - DNA, 22 bp, Homo sapiens
tcctgggcgaggtactggggct

SEQ ID NO: 8395286 - DNA, 22 bp, Homo sapiens
tcctggggaggtcgaggctgag

SEQ ID NO: 8395287 - DNA, 22 bp, Homo sapiens
tcctgggcagcctctctggaag

SEQ ID NO: 8395288 - DNA, 22 bp, Homo sapiens
tcctgggcaaagaggggcagtg

SEQ ID NO: 8395289 - DNA, 22 bp, Homo sapiens
tcctggctgttagagaggcaag

SEQ ID NO: 8395290 - DNA, 22 bp, Homo sapiens
tcctggcttaggtttccagaac

SEQ ID NO: 8395291 - DNA, 22 bp, Homo sapiens
tcctggcttccacacctgtcat

SEQ ID NO: 8395292 - DNA, 22 bp, Homo sapiens
tcctggcttgtcacatctacgt

SEQ ID NO: 8395293 - DNA, 22 bp, Homo sapiens
tcctgggacaagccgtggaagt

SEQ ID NO: 8395294 - DNA, 22 bp, Homo sapiens
tcctgggtccatggcagccgaa

SEQ ID NO: 8395295 - DNA, 22 bp, Homo sapiens
tcctgggtggtggtaggagcag

SEQ ID NO: 8395296 - DNA, 22 bp, Homo sapiens
tcctggggttttggccgcagct

SEQ ID NO: 8395297 - DNA, 22 bp, Homo sapiens
tcctggggttttggccgcagct

SEQ ID NO: 8395298 - DNA, 22 bp, Homo sapiens
tcctgggtagagacctgatgaa

SEQ ID NO: 8395299 - DNA, 22 bp, Homo sapiens
tcctgcttgaaactctgccttc

SEQ ID NO: 8395300 - DNA, 19 bp, Homo sapiens
tcctgctttctactctgct

SEQ ID NO: 8395301 - DNA, 22 bp, Homo sapiens
tcctggacagatccccatcatc

SEQ ID NO: 8395302 - DNA, 22 bp, Homo sapiens
tcctggagaatggacaatgcac

SEQ ID NO: 8395303 - DNA, 23 bp, Homo sapiens
taagaacagacaagcatttacat

SEQ ID NO: 8395304 - DNA, 22 bp, Homo sapiens
taagaacagtgtctgtctcaca

SEQ ID NO: 8395305 - DNA, 22 bp, Homo sapiens
taagaacttcggacatgttatc

SEQ ID NO: 8395306 - DNA, 22 bp, Homo sapiens
taagaacttggcagcaagaaat

SEQ ID NO: 8395307 - DNA, 22 bp, Homo sapiens
taagaactttgtagcctgttct

SEQ ID NO: 8395308 - DNA, 22 bp, Homo sapiens
taagaatagtccctagatgtgt

SEQ ID NO: 8395309 - DNA, 22 bp, Homo sapiens
tcctgctggcaaggaagggact

SEQ ID NO: 8395310 - DNA, 22 bp, Homo sapiens
tcctgctgggtctaactctggt

SEQ ID NO: 8395311 - DNA, 22 bp, Homo sapiens
tcctgctgttttctggcccaca

SEQ ID NO: 8395312 - DNA, 22 bp, Homo sapiens
tcctgctgtttacctacaatgg

SEQ ID NO: 8395313 - DNA, 22 bp, Homo sapiens
tcctgcttgaaactctgccttc

SEQ ID NO: 8395314 - DNA, 21 bp, Homo sapiens
tcctggcccactctatcccca

SEQ ID NO: 8395315 - DNA, 22 bp, Homo sapiens
tcctggcccgatccctgtgaag

SEQ ID NO: 8395316 - DNA, 22 bp, Homo sapiens
tcctggcccggccgggcctgct

SEQ ID NO: 8395317 - DNA, 22 bp, Homo sapiens
tcctggcctagctcaccctgga

SEQ ID NO: 8395318 - DNA, 22 bp, Homo sapiens
tcctggccgctggcccctgaga

SEQ ID NO: 8395319 - DNA, 22 bp, Homo sapiens
tcctggcctagctcaccctgga

SEQ ID NO: 8395320 - DNA, 22 bp, Homo sapiens
tcctggccctgtggcctgcagt

SEQ ID NO: 8395321 - DNA, 22 bp, Homo sapiens
tcctggccgccgcgtggggccg

SEQ ID NO: 8395322 - DNA, 22 bp, Homo sapiens
tcctggccgctggcccctgaga

SEQ ID NO: 8395323 - DNA, 22 bp, Homo sapiens
tcctggccctgtggcctgcagt

SEQ ID NO: 8395324 - DNA, 22 bp, Homo sapiens
tcctggctctctacaaaccaga

SEQ ID NO: 8395325 - DNA, 22 bp, Homo sapiens
tcctggctcggcttggggactt

SEQ ID NO: 8395326 - DNA, 22 bp, Homo sapiens
tcctggctcgattgctaccaat

SEQ ID NO: 8395327 - DNA, 22 bp, Homo sapiens
tcctggcctcgctgtccacctt

SEQ ID NO: 8395328 - DNA, 20 bp, Homo sapiens
tcctggcctccctggggctc

SEQ ID NO: 8395329 - DNA, 22 bp, Homo sapiens
tcctggccaagtagatgtggcg

SEQ ID NO: 8395330 - DNA, 22 bp, Homo sapiens
tcctggcacattgcaggggctc

SEQ ID NO: 8395331 - DNA, 17 bp, Homo sapiens
tcctggcagtcccctgg

SEQ ID NO: 8395332 - DNA, 22 bp, Homo sapiens
tcctggccatgcaagatgagga

SEQ ID NO: 8395333 - DNA, 22 bp, Homo sapiens
tcctggcccaatctgcccatga

SEQ ID NO: 8395334 - DNA, 22 bp, Homo sapiens
tcctggccacccgacagaagtc

SEQ ID NO: 8395335 - DNA, 22 bp, Homo sapiens
tcctggcacattgcaggggctc

SEQ ID NO: 8395336 - DNA, 22 bp, Homo sapiens
tcctggagttgtgcagtgcaca

SEQ ID NO: 8395337 - DNA, 22 bp, Homo sapiens
tctagtgttaaggcaaagtaaa

SEQ ID NO: 8395338 - DNA, 22 bp, Homo sapiens
tctagttctagatccctgagga

SEQ ID NO: 8395339 - DNA, 22 bp, Homo sapiens
tctaggtggatgaggaacatag

SEQ ID NO: 8395340 - DNA, 22 bp, Homo sapiens
tctagggaacatgggtcaagct

SEQ ID NO: 8395341 - DNA, 22 bp, Homo sapiens
tctaggccgtaggatacagagc

SEQ ID NO: 8395342 - DNA, 22 bp, Homo sapiens
tctagggagaagctctgtctgt

SEQ ID NO: 8395343 - DNA, 22 bp, Homo sapiens
tctagggtccacagggtcagcc

SEQ ID NO: 8395344 - DNA, 22 bp, Homo sapiens
tctattatggtacttatcatga

SEQ ID NO: 8395345 - DNA, 22 bp, Homo sapiens
tctattagattattctcaagga

SEQ ID NO: 8395346 - DNA, 23 bp, Homo sapiens
tctattacttattgtactctgga

SEQ ID NO: 8395347 - DNA, 22 bp, Homo sapiens
tctattacttaccactaattca

SEQ ID NO: 8395348 - DNA, 22 bp, Homo sapiens
tctatgtagtgccagctagtat

SEQ ID NO: 8395349 - DNA, 22 bp, Homo sapiens
tctatgtcctttctcccattcc

SEQ ID NO: 8395350 - DNA, 22 bp, Homo sapiens
tctatgtatggaccttttctgt

SEQ ID NO: 8395351 - DNA, 22 bp, Homo sapiens
tctatgtcagcatctttctacc

SEQ ID NO: 8395352 - DNA, 22 bp, Homo sapiens
tctatgtctccaccttcgcaga

SEQ ID NO: 8395353 - DNA, 22 bp, Homo sapiens
tctatattccagatacagatta

SEQ ID NO: 8395354 - DNA, 22 bp, Homo sapiens
tctataaagggccagatagtag

SEQ ID NO: 8395355 - DNA, 22 bp, Homo sapiens
tctataaagggccagatagtag

SEQ ID NO: 8395356 - DNA, 22 bp, Homo sapiens
tctatattttgaaaggtattta

SEQ ID NO: 8395357 - DNA, 23 bp, Homo sapiens
tctcaaatatgatctgggtcatc

SEQ ID NO: 8395358 - DNA, 22 bp, Homo sapiens
tctatttttatagttgaagtgc

SEQ ID NO: 8395359 - DNA, 22 bp, Homo sapiens
tctattttgtttccagctctac

SEQ ID NO: 8395360 - DNA, 22 bp, Homo sapiens
tctattttatactcaaatcttc

SEQ ID NO: 8395361 - DNA, 22 bp, Homo sapiens
tctattcaggcagagtgcagca

SEQ ID NO: 8395362 - DNA, 22 bp, Homo sapiens
tctattcattcaatttagctct

SEQ ID NO: 8395363 - DNA, 22 bp, Homo sapiens
tctattgtgctaccagaattac

SEQ ID NO: 8395364 - DNA, 22 bp, Homo sapiens
tctatttaccaaatgtagttcc

SEQ ID NO: 8395365 - DNA, 22 bp, Homo sapiens
tctcaatattatatgtcataaa

SEQ ID NO: 8395366 - DNA, 19 bp, Homo sapiens
tctcacaagactgctgctc

SEQ ID NO: 8395367 - DNA, 22 bp, Homo sapiens
tctcaagttttctcataatctc

SEQ ID NO: 8395368 - DNA, 22 bp, Homo sapiens
tctcaaatggcaaatgtgggtc

SEQ ID NO: 8395369 - DNA, 23 bp, Homo sapiens
tctcaaatctttgcgttgtatct

SEQ ID NO: 8395370 - DNA, 22 bp, Homo sapiens
tctcaaatggacaatattgtgg

SEQ ID NO: 8395371 - DNA, 22 bp, Homo sapiens
tctcacagcatcattgctcatg

SEQ ID NO: 8395372 - DNA, 22 bp, Homo sapiens
tctcacagcaggggccaggtct

SEQ ID NO: 8395373 - DNA, 19 bp, Homo sapiens
tctcacagctctactatgt

SEQ ID NO: 8395374 - DNA, 22 bp, Homo sapiens
tctacagaaactggctactctc

SEQ ID NO: 8395375 - DNA, 22 bp, Homo sapiens
tctacactgtagaattataagg

SEQ ID NO: 8395376 - DNA, 22 bp, Homo sapiens
tctacacatttgtaaaggcatt

SEQ ID NO: 8395377 - DNA, 22 bp, Homo sapiens
tctacacaagtgagtggcacaa

SEQ ID NO: 8395378 - DNA, 22 bp, Homo sapiens
tctacaacattccacaggcatg

SEQ ID NO: 8395379 - DNA, 22 bp, Homo sapiens
tctacaagttgtgacttgatac

SEQ ID NO: 8395380 - DNA, 22 bp, Homo sapiens
tctacaagtttaattccactta

SEQ ID NO: 8395381 - DNA, 19 bp, Homo sapiens
tctacaaagtggcatcagg

SEQ ID NO: 8395382 - DNA, 22 bp, Homo sapiens
tctacaaaggttgaggtgccct

SEQ ID NO: 8395383 - DNA, 19 bp, Homo sapiens
tctacaaagtggcatcagg

SEQ ID NO: 8395384 - DNA, 22 bp, Homo sapiens
tctacatgatgtaccatctaag

SEQ ID NO: 8395385 - DNA, 21 bp, Homo sapiens
tctacatatcaatatgtaatt

SEQ ID NO: 8395386 - DNA, 22 bp, Homo sapiens
tctacagtgagtcattcaaaca

SEQ ID NO: 8395387 - DNA, 22 bp, Homo sapiens
tctacagtgtttggtttgagga

SEQ ID NO: 8395388 - DNA, 22 bp, Homo sapiens
tctacagtagaaagatcccagt

SEQ ID NO: 8395389 - DNA, 19 bp, Homo sapiens
tctaacagctttcattcta

SEQ ID NO: 8395390 - DNA, 22 bp, Homo sapiens
tctaacattgaatggctgatta

SEQ ID NO: 8395391 - DNA, 22 bp, Homo sapiens
tctaactatacaaagaaaacat

SEQ ID NO: 8395392 - DNA, 22 bp, Homo sapiens
tctaactctgccaggacacaga

SEQ ID NO: 8395393 - DNA, 22 bp, Homo sapiens
tctaaatgtcagtacagaatga

SEQ ID NO: 8395394 - DNA, 22 bp, Homo sapiens
tctaacagaaattctgacaaaa

SEQ ID NO: 8395395 - DNA, 19 bp, Homo sapiens
tctaacagaagtgtcgtcc

SEQ ID NO: 8395396 - DNA, 23 bp, Homo sapiens
tctacaaagctgtgtcaggaccc

SEQ ID NO: 8395397 - DNA, 22 bp, Homo sapiens
tctagcaccacattaaatagca

SEQ ID NO: 8395398 - DNA, 19 bp, Homo sapiens
tctagcaacccactgcatg

SEQ ID NO: 8395399 - DNA, 22 bp, Homo sapiens
tctagatttttgtgcacctttg

SEQ ID NO: 8395400 - DNA, 22 bp, Homo sapiens
tctagatcagtgcctgaaggaa

SEQ ID NO: 8395401 - DNA, 22 bp, Homo sapiens
tctagacctggcactgccctgt

SEQ ID NO: 8395402 - DNA, 22 bp, Homo sapiens
tctaggagctgagagtgtgtac

SEQ ID NO: 8395403 - DNA, 22 bp, Homo sapiens
tctaggagcttaaaggaggcca

SEQ ID NO: 8395404 - DNA, 22 bp, Homo sapiens
tctaggagttgataaaagggct

SEQ ID NO: 8395405 - DNA, 22 bp, Homo sapiens
tctagctttgagatcagtagcc

SEQ ID NO: 8395406 - DNA, 22 bp, Homo sapiens
tctagaaaaacaaagtatctga

SEQ ID NO: 8395407 - DNA, 22 bp, Homo sapiens
tctaccagggtcacagaggccc

SEQ ID NO: 8395408 - DNA, 18 bp, Homo sapiens
tctaccctctcagagtct

SEQ ID NO: 8395409 - DNA, 22 bp, Homo sapiens
tctaccagagcctagcaggccg

SEQ ID NO: 8395410 - DNA, 22 bp, Homo sapiens
tctaccatgtgctgtgcattgg

SEQ ID NO: 8395411 - DNA, 22 bp, Homo sapiens
tctaccactcatgctacttact

SEQ ID NO: 8395412 - DNA, 22 bp, Homo sapiens
tctactgccacttaagacattt

SEQ ID NO: 8395413 - DNA, 17 bp, Homo sapiens
tctactcctgaaggaag

SEQ ID NO: 8395414 - DNA, 22 bp, Homo sapiens
tctactaggtgtactactgcag

SEQ ID NO: 8395415 - DNA, 22 bp, Homo sapiens
tctacctggagtccgttgttaa

SEQ ID NO: 8395416 - DNA, 22 bp, Homo sapiens
tccttaacaagatggcatttgt

SEQ ID NO: 8395417 - DNA, 22 bp, Homo sapiens
tccttaaatgaactctgcatga

SEQ ID NO: 8395418 - DNA, 22 bp, Homo sapiens
tccttacaacttgttatttttc

SEQ ID NO: 8395419 - DNA, 22 bp, Homo sapiens
tccttagacaaagagtgggctt

SEQ ID NO: 8395420 - DNA, 22 bp, Homo sapiens
tccttagacaaagagtgggctt

SEQ ID NO: 8395421 - DNA, 22 bp, Homo sapiens
tccttcaggcctcattctcata

SEQ ID NO: 8395422 - DNA, 22 bp, Homo sapiens
tccttcagggctgaccacaggc

SEQ ID NO: 8395423 - DNA, 22 bp, Homo sapiens
tccttcagaggacggcagccag

SEQ ID NO: 8395424 - DNA, 22 bp, Homo sapiens
tccttgaagcaacgtgcagaca

SEQ ID NO: 8395425 - DNA, 22 bp, Homo sapiens
tccttgaggaggtgacactgga

SEQ ID NO: 8395426 - DNA, 22 bp, Homo sapiens
tccttgaatgaagagaggtgac

SEQ ID NO: 8395427 - DNA, 22 bp, Homo sapiens
tccttgagagccactgtcttgg

SEQ ID NO: 8395428 - DNA, 22 bp, Homo sapiens
tccttggaagagcattcccagg

SEQ ID NO: 8395429 - DNA, 17 bp, Homo sapiens
tccttggcaaccagttc

SEQ ID NO: 8395430 - DNA, 19 bp, Homo sapiens
tccttctccggccaccccg

SEQ ID NO: 8395431 - DNA, 20 bp, Homo sapiens
tctaaagtacagtttgtgtg

SEQ ID NO: 8395432 - DNA, 22 bp, Homo sapiens
tctaaagagaaccttttctcat

SEQ ID NO: 8395433 - DNA, 22 bp, Homo sapiens
tctaaagagagtgggtacatgt

SEQ ID NO: 8395434 - DNA, 22 bp, Homo sapiens
tctaaagatgtttattgacata

SEQ ID NO: 8395435 - DNA, 22 bp, Homo sapiens
tctaaagatgtttattgacata

SEQ ID NO: 8395436 - DNA, 22 bp, Homo sapiens
tctaaagatttggattcatttg

SEQ ID NO: 8395437 - DNA, 22 bp, Homo sapiens
tctaaagatttggattcatttg

SEQ ID NO: 8395438 - DNA, 22 bp, Homo sapiens
tctaaagatgtttattgacata

SEQ ID NO: 8395439 - DNA, 22 bp, Homo sapiens
tctaaactacgtcaaaactagt

SEQ ID NO: 8395440 - DNA, 22 bp, Homo sapiens
tctaaactgcgagcatgccccc

SEQ ID NO: 8395441 - DNA, 22 bp, Homo sapiens
tctaaagacactttttacaggg

SEQ ID NO: 8395442 - DNA, 22 bp, Homo sapiens
tctaaagaagagggttctgcgg

SEQ ID NO: 8395443 - DNA, 22 bp, Homo sapiens
tctaaagaaacattgagacctg

SEQ ID NO: 8395444 - DNA, 22 bp, Homo sapiens
tctaaacttgtaaacaagcata

SEQ ID NO: 8395445 - DNA, 22 bp, Homo sapiens
tctaaaatgcagatctactggt

SEQ ID NO: 8395446 - DNA, 23 bp, Homo sapiens
tctaaaattcatcatttacgttc

SEQ ID NO: 8395447 - DNA, 22 bp, Homo sapiens
tcgtgtgtattccctctccttc

SEQ ID NO: 8395448 - DNA, 20 bp, Homo sapiens
tcgtttatttgaaattgctc

SEQ ID NO: 8395449 - DNA, 22 bp, Homo sapiens
tcgttttaccaaattgaatgtt

SEQ ID NO: 8395450 - DNA, 22 bp, Homo sapiens
tcgttttaggtggacattgtgt

SEQ ID NO: 8395451 - DNA, 22 bp, Homo sapiens
tcgtgatctgtccacctcggcc

SEQ ID NO: 8395452 - DNA, 22 bp, Homo sapiens
tcgcccagctcatctcccacaa

SEQ ID NO: 8395453 - DNA, 22 bp, Homo sapiens
tcgccatggaagtccttgcgga

SEQ ID NO: 8395454 - DNA, 22 bp, Homo sapiens
tcctttccatgcttctagaggc

SEQ ID NO: 8395455 - DNA, 21 bp, Homo sapiens
tccttgggcagtgcccagctt

SEQ ID NO: 8395456 - DNA, 20 bp, Homo sapiens
tcctttcctccttctaaatg

SEQ ID NO: 8395457 - DNA, 22 bp, Homo sapiens
tcctttccatgcttctagaggc

SEQ ID NO: 8395458 - DNA, 22 bp, Homo sapiens
tcctttccctttccatcctggc

SEQ ID NO: 8395459 - DNA, 20 bp, Homo sapiens
tcctttcctccttctaaatg

SEQ ID NO: 8395460 - DNA, 18 bp, Homo sapiens
tcctttctccctcatctt

SEQ ID NO: 8395461 - DNA, 22 bp, Homo sapiens
tcctttcttttctatgggccca

SEQ ID NO: 8395462 - DNA, 22 bp, Homo sapiens
tcctttcttcttctgcccatgg

SEQ ID NO: 8395463 - DNA, 22 bp, Homo sapiens
tcctttcttcttctgcccatgg

SEQ ID NO: 8395464 - DNA, 22 bp, Homo sapiens
tcctttctccgggggactgttg

SEQ ID NO: 8395465 - DNA, 22 bp, Homo sapiens
tcctttctgtgctgtcaggtcc

SEQ ID NO: 8395466 - DNA, 22 bp, Homo sapiens
tcctttctgtctttactctgga

SEQ ID NO: 8395467 - DNA, 22 bp, Homo sapiens
tcctttctgggcctcagtgact

SEQ ID NO: 8395468 - DNA, 22 bp, Homo sapiens
tccttttctctagtaagcttta

SEQ ID NO: 8395469 - DNA, 23 bp, Homo sapiens
tcctttgacaagagacagatgtt

SEQ ID NO: 8395470 - DNA, 22 bp, Homo sapiens
tcctttgcttctgtcattctcc

SEQ ID NO: 8395471 - DNA, 22 bp, Homo sapiens
tcctttgcttctgtcattctcc

SEQ ID NO: 8395472 - DNA, 22 bp, Homo sapiens
tcttccagatgcagatgcttct

SEQ ID NO: 8395473 - DNA, 22 bp, Homo sapiens
tcttccaatacctagattttgg

SEQ ID NO: 8395474 - DNA, 22 bp, Homo sapiens
tcttccaatggtttctagattt

SEQ ID NO: 8395475 - DNA, 22 bp, Homo sapiens
tcttccaattagaatatttggg

SEQ ID NO: 8395476 - DNA, 21 bp, Homo sapiens
tcttccaagggctgctgagac

SEQ ID NO: 8395477 - DNA, 18 bp, Homo sapiens
tcttccaacactgacacc

SEQ ID NO: 8395478 - DNA, 22 bp, Homo sapiens
tcttccaaggttgcacactatc

SEQ ID NO: 8395479 - DNA, 22 bp, Homo sapiens
tcttccaaggtgcagatcttct

SEQ ID NO: 8395480 - DNA, 22 bp, Homo sapiens
tcttccaaggtgcagatcttct

SEQ ID NO: 8395481 - DNA, 22 bp, Homo sapiens
tcttccaaatgcagctaaagct

SEQ ID NO: 8395482 - DNA, 22 bp, Homo sapiens
tcttccaaatgaatatggtttt

SEQ ID NO: 8395483 - DNA, 22 bp, Homo sapiens
tcttccaaaattagtctcagtt

SEQ ID NO: 8395484 - DNA, 22 bp, Homo sapiens
tcttccaaatgaatatggtttt

SEQ ID NO: 8395485 - DNA, 22 bp, Homo sapiens
tcttcagtatttggataacatt

SEQ ID NO: 8395486 - DNA, 22 bp, Homo sapiens
tcttcagttgtaaaagtgttgg

SEQ ID NO: 8395487 - DNA, 22 bp, Homo sapiens
tcttcagtgcacctgatgtctt

SEQ ID NO: 8395488 - DNA, 21 bp, Homo sapiens
tcttcagcagtggtgaggtgg

SEQ ID NO: 8395489 - DNA, 18 bp, Homo sapiens
tcttcatctcctgagctg

SEQ ID NO: 8395490 - DNA, 22 bp, Homo sapiens
tcttcaaatacagtcatattga

SEQ ID NO: 8395491 - DNA, 22 bp, Homo sapiens
tcttcaaatacagtcatattga

SEQ ID NO: 8395492 - DNA, 22 bp, Homo sapiens
tcttcaatatgtgtttaatatt

SEQ ID NO: 8395493 - DNA, 22 bp, Homo sapiens
tcttcaaatgctagtaatatca

SEQ ID NO: 8395494 - DNA, 22 bp, Homo sapiens
tcttcaatttagaatggattta

SEQ ID NO: 8395495 - DNA, 22 bp, Homo sapiens
tcttcaaagaattttagtaatt

SEQ ID NO: 8395496 - DNA, 22 bp, Homo sapiens
tcttcaaaaatacaggttttca

SEQ ID NO: 8395497 - DNA, 22 bp, Homo sapiens
tcttattttttaatgacagaga

SEQ ID NO: 8395498 - DNA, 22 bp, Homo sapiens
tcttcaaaaactgcaccttgct

SEQ ID NO: 8395499 - DNA, 22 bp, Homo sapiens
tcttatttgcaactggctcaga

SEQ ID NO: 8395500 - DNA, 22 bp, Homo sapiens
tcttattttgttagatgctgta

SEQ ID NO: 8395501 - DNA, 22 bp, Homo sapiens
tcttattttgttagatgctgta

SEQ ID NO: 8395502 - DNA, 22 bp, Homo sapiens
tcttattgtgatgatgaagaac

SEQ ID NO: 8395503 - DNA, 22 bp, Homo sapiens
tcttatgcatattcataacaca

SEQ ID NO: 8395504 - DNA, 22 bp, Homo sapiens
tcttattattgttgtaaaagca

SEQ ID NO: 8395505 - DNA, 22 bp, Homo sapiens
tcttattcttttaaacaacgca

SEQ ID NO: 8395506 - DNA, 20 bp, Homo sapiens
tcttctggatttcctttagg

SEQ ID NO: 8395507 - DNA, 22 bp, Homo sapiens
tcttctctcatgtaggagggaa

SEQ ID NO: 8395508 - DNA, 22 bp, Homo sapiens
tcttctgtattgttaactcagg

SEQ ID NO: 8395509 - DNA, 22 bp, Homo sapiens
tcttctgtggctctcaccaccc

SEQ ID NO: 8395510 - DNA, 22 bp, Homo sapiens
tcttctccagtgcttctgcaca

SEQ ID NO: 8395511 - DNA, 22 bp, Homo sapiens
tcttctccagttcatcctacca

SEQ ID NO: 8395512 - DNA, 21 bp, Homo sapiens
tcttgaaaagttagattctct

SEQ ID NO: 8395513 - DNA, 21 bp, Homo sapiens
tcttgaaaagttagattctct

SEQ ID NO: 8395514 - DNA, 21 bp, Homo sapiens
tcttgaaaagttagattctct

SEQ ID NO: 8395515 - DNA, 23 bp, Homo sapiens
tcttgaaaagcctacagcagttc

SEQ ID NO: 8395516 - DNA, 22 bp, Homo sapiens
tcttgaaagcattttcttcatc

SEQ ID NO: 8395517 - DNA, 22 bp, Homo sapiens
tcttgaaagcattttcttcatc

SEQ ID NO: 8395518 - DNA, 22 bp, Homo sapiens
tcttctttggatgaaagaatat

SEQ ID NO: 8395519 - DNA, 22 bp, Homo sapiens
tcttcttatgtgccattatctc

SEQ ID NO: 8395520 - DNA, 22 bp, Homo sapiens
tcttcttcccatccctcaaatg

SEQ ID NO: 8395521 - DNA, 22 bp, Homo sapiens
tcttcttatgtgccattatctc

SEQ ID NO: 8395522 - DNA, 20 bp, Homo sapiens
tcttctgttgccttgttctg

SEQ ID NO: 8395523 - DNA, 22 bp, Homo sapiens
tcttcttaaagtatgttctctt

SEQ ID NO: 8395524 - DNA, 22 bp, Homo sapiens
tcttcttatgtgccattatctc

SEQ ID NO: 8395525 - DNA, 22 bp, Homo sapiens
tcttcctttcattcatgtgtta

SEQ ID NO: 8395526 - DNA, 22 bp, Homo sapiens
tcttcctttcattcatgtgtta

SEQ ID NO: 8395527 - DNA, 22 bp, Homo sapiens
tcttcctcttctgctgagaagt

SEQ ID NO: 8395528 - DNA, 22 bp, Homo sapiens
tcttcctccctacagagctcag

SEQ ID NO: 8395529 - DNA, 22 bp, Homo sapiens
tcttcctcttctgctgagaagt

SEQ ID NO: 8395530 - DNA, 22 bp, Homo sapiens
tcttcctctctaattgatcaga

SEQ ID NO: 8395531 - DNA, 22 bp, Homo sapiens
tcttcctctctaattgatcaga

SEQ ID NO: 8395532 - DNA, 22 bp, Homo sapiens
tcttcctctagatctgaggccc

SEQ ID NO: 8395533 - DNA, 22 bp, Homo sapiens
tcttcctccctacagagctcag

SEQ ID NO: 8395534 - DNA, 21 bp, Homo sapiens
tcttcctccacagcgtgccac

SEQ ID NO: 8395535 - DNA, 23 bp, Homo sapiens
tctttcctcagcacacaccaaga

SEQ ID NO: 8395536 - DNA, 21 bp, Homo sapiens
tctttcctgcccagttgccct

SEQ ID NO: 8395537 - DNA, 17 bp, Homo sapiens
tctttcctgccatgctc

SEQ ID NO: 8395538 - DNA, 17 bp, Homo sapiens
tctttcctgccatgctc

SEQ ID NO: 8395539 - DNA, 22 bp, Homo sapiens
tctttcctagaggctgatgagt

SEQ ID NO: 8395540 - DNA, 22 bp, Homo sapiens
tctttcctactttattgtgaac

SEQ ID NO: 8395541 - DNA, 22 bp, Homo sapiens
tctttcctaggtgatatgcaat

SEQ ID NO: 8395542 - DNA, 22 bp, Homo sapiens
tctttcctaggtgatatgcaat

SEQ ID NO: 8395543 - DNA, 22 bp, Homo sapiens
tctttccctgtgttagcctgta

SEQ ID NO: 8395544 - DNA, 17 bp, Homo sapiens
tctttccctgggagatg

SEQ ID NO: 8395545 - DNA, 17 bp, Homo sapiens
tctttccctgggagatg

SEQ ID NO: 8395546 - DNA, 22 bp, Homo sapiens
tctttccctgtgttagcctgta

SEQ ID NO: 8395547 - DNA, 22 bp, Homo sapiens
tctttcccttagaacattaaca

SEQ ID NO: 8395548 - DNA, 22 bp, Homo sapiens
tctttccctgtgttagcctgta

SEQ ID NO: 8395549 - DNA, 22 bp, Homo sapiens
tctttcctactttattgtgaac

SEQ ID NO: 8395550 - DNA, 23 bp, Homo sapiens
tctttcctaatgaaacagtgaaa

SEQ ID NO: 8395551 - DNA, 22 bp, Homo sapiens
tctttgaacttggctgatctct

SEQ ID NO: 8395552 - DNA, 22 bp, Homo sapiens
tctttcttattagccattgttc

SEQ ID NO: 8395553 - DNA, 22 bp, Homo sapiens
tctttctgtaagctccatggaa

SEQ ID NO: 8395554 - DNA, 21 bp, Homo sapiens
tctttctgaaatctcagtctg

SEQ ID NO: 8395555 - DNA, 19 bp, Homo sapiens
tctttcatttctagctctg

SEQ ID NO: 8395556 - DNA, 22 bp, Homo sapiens
tctttattgctactggtttgtc

SEQ ID NO: 8395557 - DNA, 22 bp, Homo sapiens
tctttcaatgagcattctttcc

SEQ ID NO: 8395558 - DNA, 21 bp, Homo sapiens
tctttccaatattcatgtctc

SEQ ID NO: 8395559 - DNA, 22 bp, Homo sapiens
tctttccatggccacacagtct

SEQ ID NO: 8395560 - DNA, 22 bp, Homo sapiens
tctttcccagtagctctcccag

SEQ ID NO: 8395561 - DNA, 22 bp, Homo sapiens
tctttcccagtagctctcccag

SEQ ID NO: 8395562 - DNA, 22 bp, Homo sapiens
tctttcccctacatttggttaa

SEQ ID NO: 8395563 - DNA, 22 bp, Homo sapiens
tctttcccgccagagcatgagt

SEQ ID NO: 8395564 - DNA, 22 bp, Homo sapiens
tctttagagcacgggaaaaaca

SEQ ID NO: 8395565 - DNA, 22 bp, Homo sapiens
tctttagagcacgggaaaaaca

SEQ ID NO: 8395566 - DNA, 22 bp, Homo sapiens
tctttagagctcagaaatacag

SEQ ID NO: 8395567 - DNA, 22 bp, Homo sapiens
tctttagagctcagaaatacag

SEQ ID NO: 8395568 - DNA, 20 bp, Homo sapiens
tctttagttcctggcccttt

SEQ ID NO: 8395569 - DNA, 22 bp, Homo sapiens
tctttagtgaccatctcattct

SEQ ID NO: 8395570 - DNA, 22 bp, Homo sapiens
tctttagtattgagttatggta

SEQ ID NO: 8395571 - DNA, 19 bp, Homo sapiens
tctttagtcacatttttat

SEQ ID NO: 8395572 - DNA, 22 bp, Homo sapiens
tctttagctagaaatactctaa

SEQ ID NO: 8395573 - DNA, 19 bp, Homo sapiens
tctttagccagagctctgg

SEQ ID NO: 8395574 - DNA, 22 bp, Homo sapiens
tctttataaaagtcattatgtc

SEQ ID NO: 8395575 - DNA, 22 bp, Homo sapiens
tctttatgagaaaaagattgta

SEQ ID NO: 8395576 - DNA, 22 bp, Homo sapiens
tcttggattttaatggatcaaa

SEQ ID NO: 8395577 - DNA, 22 bp, Homo sapiens
tcttggactcaaaattgcctta

SEQ ID NO: 8395578 - DNA, 22 bp, Homo sapiens
tcttggaataccccgaaggtca

SEQ ID NO: 8395579 - DNA, 22 bp, Homo sapiens
tcttggaagtagaacacagtct

SEQ ID NO: 8395580 - DNA, 22 bp, Homo sapiens
tcttggaaccctatgtgatttc

SEQ ID NO: 8395581 - DNA, 22 bp, Homo sapiens
tcttggctactttcctgtctgc

SEQ ID NO: 8395582 - DNA, 22 bp, Homo sapiens
tcttggctatccaagttatcca

SEQ ID NO: 8395583 - DNA, 19 bp, Homo sapiens
tcttgcttcttcatccctc

SEQ ID NO: 8395584 - DNA, 22 bp, Homo sapiens
tcttgcttgatacatggaggaa

SEQ ID NO: 8395585 - DNA, 22 bp, Homo sapiens
tcttgagagatatactactgaa

SEQ ID NO: 8395586 - DNA, 22 bp, Homo sapiens
tcttgaggtcatcatctgaaac

SEQ ID NO: 8395587 - DNA, 22 bp, Homo sapiens
tcttgattgttttctgacctta

SEQ ID NO: 8395588 - DNA, 22 bp, Homo sapiens
tcttgattacttattttgtgcc

SEQ ID NO: 8395589 - DNA, 22 bp, Homo sapiens
tcttgattaataccttagccct

SEQ ID NO: 8395590 - DNA, 22 bp, Homo sapiens
tcttgaaaggagattggaggca

SEQ ID NO: 8395591 - DNA, 22 bp, Homo sapiens
tcttgaataagtttcatgagct

SEQ ID NO: 8395592 - DNA, 22 bp, Homo sapiens
tcttgaagaggaagtggagtag

SEQ ID NO: 8395593 - DNA, 22 bp, Homo sapiens
tcttgaaggggggcagtgttga

SEQ ID NO: 8395594 - DNA, 22 bp, Homo sapiens
tcttgacattgcaatcttcaga

SEQ ID NO: 8395595 - DNA, 22 bp, Homo sapiens
tcttgaattgtactcccataag

SEQ ID NO: 8395596 - DNA, 22 bp, Homo sapiens
tcttgacaactatactacttac

SEQ ID NO: 8395597 - DNA, 22 bp, Homo sapiens
tcttgaattgtactcccataag

SEQ ID NO: 8395598 - DNA, 19 bp, Homo sapiens
tcttggctttgtctactgt

SEQ ID NO: 8395599 - DNA, 22 bp, Homo sapiens
tcttgggagtcccaggacatag

SEQ ID NO: 8395600 - DNA, 22 bp, Homo sapiens
tcttgggagtcccaggacatag

SEQ ID NO: 8395601 - DNA, 20 bp, Homo sapiens
tcttggctgtgtgaggacac

SEQ ID NO: 8395602 - DNA, 22 bp, Homo sapiens
tcttggctcctgttgtcatcag

SEQ ID NO: 8395603 - DNA, 23 bp, Homo sapiens
tctttagaagaacatcagaaatg

SEQ ID NO: 8395604 - DNA, 22 bp, Homo sapiens
tctttagacatccagtttctct

SEQ ID NO: 8395605 - DNA, 21 bp, Homo sapiens
tctttacatttgcctcttgca

SEQ ID NO: 8395606 - DNA, 22 bp, Homo sapiens
tctttacacaagacaagaataa

SEQ ID NO: 8395607 - DNA, 22 bp, Homo sapiens
tctttacaagtcacattttctg

SEQ ID NO: 8395608 - DNA, 22 bp, Homo sapiens
tctgtgcaccagaatgatattt

SEQ ID NO: 8395609 - DNA, 22 bp, Homo sapiens
tctgtgagtactttaacgagag

SEQ ID NO: 8395610 - DNA, 22 bp, Homo sapiens
tctgtgacattgaacatctaca

SEQ ID NO: 8395611 - DNA, 22 bp, Homo sapiens
tctgtgccctcggtgctgggcc

SEQ ID NO: 8395612 - DNA, 22 bp, Homo sapiens
tctgtgctcattcagtcattca

SEQ ID NO: 8395613 - DNA, 22 bp, Homo sapiens
tctgtgctgagctctgagatgt

SEQ ID NO: 8395614 - DNA, 21 bp, Homo sapiens
tctgtgctgccgtcaacatcc

SEQ ID NO: 8395615 - DNA, 22 bp, Homo sapiens
tctgtggctggagaacttgtct

SEQ ID NO: 8395616 - DNA, 22 bp, Homo sapiens
tctgtggctgtctttccagagg

SEQ ID NO: 8395617 - DNA, 18 bp, Homo sapiens
tctgtgggatcagtgagg

SEQ ID NO: 8395618 - DNA, 22 bp, Homo sapiens
tctgtggctttcgtgtaagatg

SEQ ID NO: 8395619 - DNA, 22 bp, Homo sapiens
tctgtgggtgcctccagcagtg

SEQ ID NO: 8395620 - DNA, 22 bp, Homo sapiens
tctgtgggtagagtgagtactt

SEQ ID NO: 8395621 - DNA, 22 bp, Homo sapiens
tctgtgtcccttctaatttcag

SEQ ID NO: 8395622 - DNA, 22 bp, Homo sapiens
tctgtgtctgcagaagttcagc

SEQ ID NO: 8395623 - DNA, 22 bp, Homo sapiens
tctgtgtctgcagaagttcagc

SEQ ID NO: 8395624 - DNA, 23 bp, Homo sapiens
tctgtgtctccacccaaatctca

SEQ ID NO: 8395625 - DNA, 22 bp, Homo sapiens
tctgttagctgtcaaagtgttt

SEQ ID NO: 8395626 - DNA, 22 bp, Homo sapiens
tctgttagctgtcaaagtgttt

SEQ ID NO: 8395627 - DNA, 22 bp, Homo sapiens
tctgttagagaggtagttcttg

SEQ ID NO: 8395628 - DNA, 22 bp, Homo sapiens
tctgttaacctggtcttggctt

SEQ ID NO: 8395629 - DNA, 22 bp, Homo sapiens
tctgttatctcaagtcacaaga

SEQ ID NO: 8395630 - DNA, 22 bp, Homo sapiens
tctgtgttttaaacagtagaaa

SEQ ID NO: 8395631 - DNA, 22 bp, Homo sapiens
tctgtgtttaaaagatatgtcc

SEQ ID NO: 8395632 - DNA, 18 bp, Homo sapiens
tctgtgttctgtcattgc

SEQ ID NO: 8395633 - DNA, 22 bp, Homo sapiens
tctgtgtgaccataagccagct

SEQ ID NO: 8395634 - DNA, 20 bp, Homo sapiens
tctgtgtgccatcacctaac

SEQ ID NO: 8395635 - DNA, 22 bp, Homo sapiens
tctgtgtgggatagtttgagga

SEQ ID NO: 8395636 - DNA, 22 bp, Homo sapiens
tctgtgtgggatagtttgagga

SEQ ID NO: 8395637 - DNA, 22 bp, Homo sapiens
tctgtgtgtgcctgttaatatt

SEQ ID NO: 8395638 - DNA, 22 bp, Homo sapiens
tctgtttaggcaaaatagctac

SEQ ID NO: 8395639 - DNA, 22 bp, Homo sapiens
tctgttatgcataagcatcagt

SEQ ID NO: 8395640 - DNA, 22 bp, Homo sapiens
tctgttctttccaacaagacag

SEQ ID NO: 8395641 - DNA, 22 bp, Homo sapiens
tctgttctttagcctgcttgag

SEQ ID NO: 8395642 - DNA, 23 bp, Homo sapiens
tctgttcttttagctgatcattt

SEQ ID NO: 8395643 - DNA, 22 bp, Homo sapiens
tcttaaaagtatgccaattgga

SEQ ID NO: 8395644 - DNA, 22 bp, Homo sapiens
tcttaaactttgctgtaattct

SEQ ID NO: 8395645 - DNA, 22 bp, Homo sapiens
tcttaaaccacacatgtgctct

SEQ ID NO: 8395646 - DNA, 22 bp, Homo sapiens
tcttaaaagtatgccaattgga

SEQ ID NO: 8395647 - DNA, 22 bp, Homo sapiens
tcttaaaggcacatagtgtcta

SEQ ID NO: 8395648 - DNA, 22 bp, Homo sapiens
tcttagatggcagctagagctc

SEQ ID NO: 8395649 - DNA, 22 bp, Homo sapiens
tcttagaattgaagtcagaggg

SEQ ID NO: 8395650 - DNA, 22 bp, Homo sapiens
tcttaaatgactgataagagga

SEQ ID NO: 8395651 - DNA, 20 bp, Homo sapiens
tcttaaatccccagggccat

SEQ ID NO: 8395652 - DNA, 22 bp, Homo sapiens
tcttaacaagctcctcagtgct

SEQ ID NO: 8395653 - DNA, 22 bp, Homo sapiens
tcttaacatattattttagcac

SEQ ID NO: 8395654 - DNA, 22 bp, Homo sapiens
tcttaacagtgctacagagcag

SEQ ID NO: 8395655 - DNA, 22 bp, Homo sapiens
tcttataaaaggactcccattt

SEQ ID NO: 8395656 - DNA, 22 bp, Homo sapiens
tctgtcatctgttcagtgctca

SEQ ID NO: 8395657 - DNA, 22 bp, Homo sapiens
tctgtcatttcaatatggttaa

SEQ ID NO: 8395658 - DNA, 22 bp, Homo sapiens
tctgtcattgcaataaaatttc

SEQ ID NO: 8395659 - DNA, 22 bp, Homo sapiens
tctgtctcaagttcttgcactc

SEQ ID NO: 8395660 - DNA, 18 bp, Homo sapiens
tctgtccttccattcttc

SEQ ID NO: 8395661 - DNA, 22 bp, Homo sapiens
tctgtctcctgccagtgcctct

SEQ ID NO: 8395662 - DNA, 22 bp, Homo sapiens
tctgtctcctctgaggtgccag

SEQ ID NO: 8395663 - DNA, 22 bp, Homo sapiens
tctgtctctcaagggccgtcct

SEQ ID NO: 8395664 - DNA, 21 bp, Homo sapiens
tctgtctctccactgccctgc

SEQ ID NO: 8395665 - DNA, 18 bp, Homo sapiens
tctgtctctgtccttgct

SEQ ID NO: 8395666 - DNA, 20 bp, Homo sapiens
tctgtctctgagctagactt

SEQ ID NO: 8395667 - DNA, 20 bp, Homo sapiens
tctgtctctgagctagactt

SEQ ID NO: 8395668 - DNA, 22 bp, Homo sapiens
tctgtctctttgttctgtgagt

SEQ ID NO: 8395669 - DNA, 22 bp, Homo sapiens
tctgtaggttaaaagtagacaa

SEQ ID NO: 8395670 - DNA, 22 bp, Homo sapiens
tctgtaggacagagaaatgggg

SEQ ID NO: 8395671 - DNA, 23 bp, Homo sapiens
tctgtacttagactggggcagaa

SEQ ID NO: 8395672 - DNA, 19 bp, Homo sapiens
tctgtaacactctagcctt

SEQ ID NO: 8395673 - DNA, 22 bp, Homo sapiens
tctgtaaacacccgtaagcttt

SEQ ID NO: 8395674 - DNA, 22 bp, Homo sapiens
tctgtaaacaccatgttagagt

SEQ ID NO: 8395675 - DNA, 22 bp, Homo sapiens
tctgtacagtaccagatagtaa

SEQ ID NO: 8395676 - DNA, 20 bp, Homo sapiens
tctgtacactcatcttctgc

SEQ ID NO: 8395677 - DNA, 22 bp, Homo sapiens
tctgggctttacactgtgctta

SEQ ID NO: 8395678 - DNA, 22 bp, Homo sapiens
tctgggctttgtaatgggaggt

SEQ ID NO: 8395679 - DNA, 22 bp, Homo sapiens
tctgggctttgtaatgggaggt

SEQ ID NO: 8395680 - DNA, 21 bp, Homo sapiens
tctgggctttcttataaggca

SEQ ID NO: 8395681 - DNA, 22 bp, Homo sapiens
tctgggctttaagaactctgtt

SEQ ID NO: 8395682 - DNA, 22 bp, Homo sapiens
tctgggcttggattggctctgc

SEQ ID NO: 8395683 - DNA, 22 bp, Homo sapiens
tctgggctgggagcgtgtggac

SEQ ID NO: 8395684 - DNA, 22 bp, Homo sapiens
tctgggctggctttatgctgac

SEQ ID NO: 8395685 - DNA, 22 bp, Homo sapiens
tctgggctgtctacaggttggc

SEQ ID NO: 8395686 - DNA, 15 bp, Homo sapiens
tctgggctgtgagca

SEQ ID NO: 8395687 - DNA, 20 bp, Homo sapiens
tctgggcttcccccagctcc

SEQ ID NO: 8395688 - DNA, 20 bp, Homo sapiens
tctgggcttcccccagctcc

SEQ ID NO: 8395689 - DNA, 17 bp, Homo sapiens
tctgggcttcagtggtc

SEQ ID NO: 8395690 - DNA, 17 bp, Homo sapiens
tctgggcttcagtggtc

SEQ ID NO: 8395691 - DNA, 22 bp, Homo sapiens
tctgggctgtggttccactccg

SEQ ID NO: 8395692 - DNA, 22 bp, Homo sapiens
tctgggctgtgccaaagctctt

SEQ ID NO: 8395693 - DNA, 22 bp, Homo sapiens
tctgggcttggattggctctgc

SEQ ID NO: 8395694 - DNA, 22 bp, Homo sapiens
tctgggcttgcctggttgtgca

SEQ ID NO: 8395695 - DNA, 22 bp, Homo sapiens
tctgggtctatgatctcacttc

SEQ ID NO: 8395696 - DNA, 22 bp, Homo sapiens
tctgggtctatcccatgccttt

SEQ ID NO: 8395697 - DNA, 22 bp, Homo sapiens
tctgggtgtagggcctggcaac

SEQ ID NO: 8395698 - DNA, 22 bp, Homo sapiens
tctgggtgtagggcctggcaac

SEQ ID NO: 8395699 - DNA, 22 bp, Homo sapiens
tctgtaaaacttctttgtaaat

SEQ ID NO: 8395700 - DNA, 22 bp, Homo sapiens
tctgggtgaccctgggcaaggc

SEQ ID NO: 8395701 - DNA, 22 bp, Homo sapiens
tctggctcccagcctgctctca

SEQ ID NO: 8395702 - DNA, 22 bp, Homo sapiens
tctggctccctggagctccaca

SEQ ID NO: 8395703 - DNA, 22 bp, Homo sapiens
tctggctccactttcttcattt

SEQ ID NO: 8395704 - DNA, 22 bp, Homo sapiens
tctggctccacacctcactgca

SEQ ID NO: 8395705 - DNA, 22 bp, Homo sapiens
tctggccccggtcttcacagct

SEQ ID NO: 8395706 - DNA, 22 bp, Homo sapiens
tctggcccctatggcggtggag

SEQ ID NO: 8395707 - DNA, 22 bp, Homo sapiens
tctggctctccagtgctcttag

SEQ ID NO: 8395708 - DNA, 22 bp, Homo sapiens
tctggctctctcatcacccaat

SEQ ID NO: 8395709 - DNA, 22 bp, Homo sapiens
tctggctctgaattcacttctg

SEQ ID NO: 8395710 - DNA, 22 bp, Homo sapiens
tctggctctgacactactgtta

SEQ ID NO: 8395711 - DNA, 20 bp, Homo sapiens
tctggctctttgctcctccc

SEQ ID NO: 8395712 - DNA, 22 bp, Homo sapiens
tctggctctataactcctagct

SEQ ID NO: 8395713 - DNA, 22 bp, Homo sapiens
tctggctctcatactcgccagt

SEQ ID NO: 8395714 - DNA, 22 bp, Homo sapiens
tctggctctcaacaaatattta

SEQ ID NO: 8395715 - DNA, 22 bp, Homo sapiens
tctggctcctgagtccatgctc

SEQ ID NO: 8395716 - DNA, 22 bp, Homo sapiens
tctggctcctggctccactgcc

SEQ ID NO: 8395717 - DNA, 22 bp, Homo sapiens
tctggctttcatttgtttaaag

SEQ ID NO: 8395718 - DNA, 21 bp, Homo sapiens
tctggctttcattccccttct

SEQ ID NO: 8395719 - DNA, 22 bp, Homo sapiens
tctggctttctgactctacaac

SEQ ID NO: 8395720 - DNA, 22 bp, Homo sapiens
tctggctttctcagcatggcat

SEQ ID NO: 8395721 - DNA, 22 bp, Homo sapiens
tctggctttcctggagcaagaa

SEQ ID NO: 8395722 - DNA, 18 bp, Homo sapiens
tctggctttgttccttgt

SEQ ID NO: 8395723 - DNA, 22 bp, Homo sapiens
tctggcttttattcagttggca

SEQ ID NO: 8395724 - DNA, 22 bp, Homo sapiens
tctgggaacagcctggctgtgt

SEQ ID NO: 8395725 - DNA, 22 bp, Homo sapiens
tctgggaagctggtcctgttct

SEQ ID NO: 8395726 - DNA, 22 bp, Homo sapiens
tctgggaactctgtcatttccc

SEQ ID NO: 8395727 - DNA, 22 bp, Homo sapiens
tctgggagagggaaagaagact

SEQ ID NO: 8395728 - DNA, 22 bp, Homo sapiens
tctgggagagagttgataaagg

SEQ ID NO: 8395729 - DNA, 23 bp, Homo sapiens
tctgggaccactcaacaagtcag

SEQ ID NO: 8395730 - DNA, 22 bp, Homo sapiens
tctgggacattctctccatagt

SEQ ID NO: 8395731 - DNA, 21 bp, Homo sapiens
tctgggacagggcctgaggag

SEQ ID NO: 8395732 - DNA, 22 bp, Homo sapiens
tctgggaagtcctctgtcatgc

SEQ ID NO: 8395733 - DNA, 22 bp, Homo sapiens
tctgggaatacacactgattta

SEQ ID NO: 8395734 - DNA, 22 bp, Homo sapiens
tctgggagtaaggcctaggcat

SEQ ID NO: 8395735 - DNA, 22 bp, Homo sapiens
tctgggaggtactgggaggtgt

SEQ ID NO: 8395736 - DNA, 22 bp, Homo sapiens
tctgggagtttctgtgggagct

SEQ ID NO: 8395737 - DNA, 22 bp, Homo sapiens
tctgggcaatggatgcactcac

SEQ ID NO: 8395738 - DNA, 23 bp, Homo sapiens
tctgggcaccttgttgacatgat

SEQ ID NO: 8395739 - DNA, 22 bp, Homo sapiens
tctgggcagccgccccatagga

SEQ ID NO: 8395740 - DNA, 22 bp, Homo sapiens
tctgggcagtacccctctccta

SEQ ID NO: 8395741 - DNA, 22 bp, Homo sapiens
tctgggcagtacccctctccta

SEQ ID NO: 8395742 - DNA, 22 bp, Homo sapiens
tctgggcagttcggatcctctg

SEQ ID NO: 8395743 - DNA, 20 bp, Homo sapiens
tctgggcagggcacatggaa

SEQ ID NO: 8395744 - DNA, 20 bp, Homo sapiens
tctgggcagggcacatggaa

SEQ ID NO: 8395745 - DNA, 23 bp, Homo sapiens
tctgggccacttgtctgcacttc

SEQ ID NO: 8395746 - DNA, 21 bp, Homo sapiens
tctgggcccatgctgcctcac

SEQ ID NO: 8395747 - DNA, 21 bp, Homo sapiens
tctgggctgctgctgcccatc

SEQ ID NO: 8395748 - DNA, 21 bp, Homo sapiens
tctgggctgctgctgcccatc

SEQ ID NO: 8395749 - DNA, 23 bp, Homo sapiens
tctgggctgcttaaggatcaagg

SEQ ID NO: 8395750 - DNA, 22 bp, Homo sapiens
tctgggctgctgtgcagtgacc

SEQ ID NO: 8395751 - DNA, 23 bp, Homo sapiens
tctgggctgagacttggaaggtc

SEQ ID NO: 8395752 - DNA, 23 bp, Homo sapiens
tctgggctgagacttggaaggtc

SEQ ID NO: 8395753 - DNA, 23 bp, Homo sapiens
tctgggctgagctcgagtgtaga

SEQ ID NO: 8395754 - DNA, 22 bp, Homo sapiens
tctgggctgctatgaggcagag

SEQ ID NO: 8395755 - DNA, 22 bp, Homo sapiens
tctgggctgctatgaggcagag

SEQ ID NO: 8395756 - DNA, 22 bp, Homo sapiens
tctgctgtgttgaatgattggt

SEQ ID NO: 8395757 - DNA, 22 bp, Homo sapiens
tctgctggtcaaggctgggtcc

SEQ ID NO: 8395758 - DNA, 23 bp, Homo sapiens
tctgctggtgacacggtcacatt

SEQ ID NO: 8395759 - DNA, 22 bp, Homo sapiens
tctgctggttccgaattaggcc

SEQ ID NO: 8395760 - DNA, 22 bp, Homo sapiens
tctgctggccttagcaggtcta

SEQ ID NO: 8395761 - DNA, 19 bp, Homo sapiens
tctgctggcagaattccct

SEQ ID NO: 8395762 - DNA, 22 bp, Homo sapiens
tctgctggaaaaccagggaatt

SEQ ID NO: 8395763 - DNA, 22 bp, Homo sapiens
tctgctctagttgcttcctgcc

SEQ ID NO: 8395764 - DNA, 22 bp, Homo sapiens
tctgctctccatacttccgcac

SEQ ID NO: 8395765 - DNA, 22 bp, Homo sapiens
tctggacaatcctgagacagac

SEQ ID NO: 8395766 - DNA, 22 bp, Homo sapiens
tctggacaatcctgagacagac

SEQ ID NO: 8395767 - DNA, 23 bp, Homo sapiens
tctggacataacggagaagcaaa

SEQ ID NO: 8395768 - DNA, 23 bp, Homo sapiens
tctggacataacggagaagcaaa

SEQ ID NO: 8395769 - DNA, 22 bp, Homo sapiens
tctggacaggtcaaagcccatg

SEQ ID NO: 8395770 - DNA, 22 bp, Homo sapiens
tctggacatgcttgaataatat

SEQ ID NO: 8395771 - DNA, 22 bp, Homo sapiens
tctggacatttggtaggataga

SEQ ID NO: 8395772 - DNA, 22 bp, Homo sapiens
tctggacatcctggagaatgac

SEQ ID NO: 8395773 - DNA, 22 bp, Homo sapiens
tctggacatcctggagaatgac

SEQ ID NO: 8395774 - DNA, 22 bp, Homo sapiens
tctggactaacagcagcctcag

SEQ ID NO: 8395775 - DNA, 22 bp, Homo sapiens
tctggactaatattctggctgc

SEQ ID NO: 8395776 - DNA, 22 bp, Homo sapiens
tctggactccatgctgcctgga

SEQ ID NO: 8395777 - DNA, 22 bp, Homo sapiens
tctggacttgaatcagagtaga

SEQ ID NO: 8395778 - DNA, 22 bp, Homo sapiens
tctggactctagggggactgtg

SEQ ID NO: 8395779 - DNA, 20 bp, Homo sapiens
tctggactgtcagacaggga

SEQ ID NO: 8395780 - DNA, 22 bp, Homo sapiens
tctggactttcggtgcaagagt

SEQ ID NO: 8395781 - DNA, 22 bp, Homo sapiens
tctggagaacttgcaagaggat

SEQ ID NO: 8395782 - DNA, 22 bp, Homo sapiens
tctggagaagaaacttgctctg

SEQ ID NO: 8395783 - DNA, 22 bp, Homo sapiens
tctggagaagcccagggagctg

SEQ ID NO: 8395784 - DNA, 22 bp, Homo sapiens
tctggagaatctgtcagtgtgg

SEQ ID NO: 8395785 - DNA, 22 bp, Homo sapiens
tctggagaggggcctagaattt

SEQ ID NO: 8395786 - DNA, 22 bp, Homo sapiens
tctggagaggaggatgtggaca

SEQ ID NO: 8395787 - DNA, 22 bp, Homo sapiens
tctggagaggaggatgtggaca

SEQ ID NO: 8395788 - DNA, 22 bp, Homo sapiens
tctggagaggggcctagaattt

SEQ ID NO: 8395789 - DNA, 22 bp, Homo sapiens
tctggagagtcacagtgccaga

SEQ ID NO: 8395790 - DNA, 22 bp, Homo sapiens
tctggagataagacagacagat

SEQ ID NO: 8395791 - DNA, 22 bp, Homo sapiens
tctggagataagacagacagat

SEQ ID NO: 8395792 - DNA, 22 bp, Homo sapiens
tctggcatggatttgagtgtct

SEQ ID NO: 8395793 - DNA, 22 bp, Homo sapiens
tctggcatttcaggcatctata

SEQ ID NO: 8395794 - DNA, 22 bp, Homo sapiens
tctggcatcactcgcaagagca

SEQ ID NO: 8395795 - DNA, 22 bp, Homo sapiens
tctggcaaaggcaaccacagtt

SEQ ID NO: 8395796 - DNA, 22 bp, Homo sapiens
tctggcagtaataggggagaga

SEQ ID NO: 8395797 - DNA, 22 bp, Homo sapiens
tctggcagtaataggggagaga

SEQ ID NO: 8395798 - DNA, 22 bp, Homo sapiens
tctggagtatgtgtgaacggtg

SEQ ID NO: 8395799 - DNA, 22 bp, Homo sapiens
tctggagtaggacctgaaaata

SEQ ID NO: 8395800 - DNA, 22 bp, Homo sapiens
tctggagtctaaagaaccaaaa

SEQ ID NO: 8395801 - DNA, 22 bp, Homo sapiens
tctggagcaacagagcaggaca

SEQ ID NO: 8395802 - DNA, 22 bp, Homo sapiens
tctggagatcatgtggggtgga

SEQ ID NO: 8395803 - DNA, 22 bp, Homo sapiens
tctggatcgccggcgcctgggc

SEQ ID NO: 8395804 - DNA, 22 bp, Homo sapiens
tctggatcctatgcactggact

SEQ ID NO: 8395805 - DNA, 22 bp, Homo sapiens
tctggagtttgaggacaagctt

SEQ ID NO: 8395806 - DNA, 23 bp, Homo sapiens
tctggatgccaccacatactaac

SEQ ID NO: 8395807 - DNA, 22 bp, Homo sapiens
tctggatgatatgtgaacttga

SEQ ID NO: 8395808 - DNA, 22 bp, Homo sapiens
tctggatcgggttcctcaggtc

SEQ ID NO: 8395809 - DNA, 22 bp, Homo sapiens
tctggatgaagacccagaggct

SEQ ID NO: 8395810 - DNA, 22 bp, Homo sapiens
tctggatggtcagctcttcctg

SEQ ID NO: 8395811 - DNA, 22 bp, Homo sapiens
tctgagctacgatgcctgtcac

SEQ ID NO: 8395812 - DNA, 22 bp, Homo sapiens
tctgagctatgtaagacttgga

SEQ ID NO: 8395813 - DNA, 22 bp, Homo sapiens
tctgagctagtgatttataaga

SEQ ID NO: 8395814 - DNA, 22 bp, Homo sapiens
tctgagctaatcctgttgccga

SEQ ID NO: 8395815 - DNA, 19 bp, Homo sapiens
tctgagctgatatgacatt

SEQ ID NO: 8395816 - DNA, 22 bp, Homo sapiens
tctgagctgcccctttactttg

SEQ ID NO: 8395817 - DNA, 22 bp, Homo sapiens
tctgagctcaagtgacagttag

SEQ ID NO: 8395818 - DNA, 21 bp, Homo sapiens
tctgagctgagtcctctaggt

SEQ ID NO: 8395819 - DNA, 22 bp, Homo sapiens
tctgagcttactcagggataca

SEQ ID NO: 8395820 - DNA, 22 bp, Homo sapiens
tctgagcttctgcatttccaac

SEQ ID NO: 8395821 - DNA, 22 bp, Homo sapiens
tctgagcttctgcctgctgcaa

SEQ ID NO: 8395822 - DNA, 22 bp, Homo sapiens
tctgagctgtggccattcttcc

SEQ ID NO: 8395823 - DNA, 22 bp, Homo sapiens
tctgagctgtaagtagacaagg

SEQ ID NO: 8395824 - DNA, 22 bp, Homo sapiens
tctgagctgtaagtagacaagg

SEQ ID NO: 8395825 - DNA, 22 bp, Homo sapiens
tctgagctgggtcttgacagct

SEQ ID NO: 8395826 - DNA, 22 bp, Homo sapiens
tctgagctggagcccatcacct

SEQ ID NO: 8395827 - DNA, 22 bp, Homo sapiens
tctgagctgctaggtatgcatt

SEQ ID NO: 8395828 - DNA, 22 bp, Homo sapiens
tctgagacaggaagtggagggt

SEQ ID NO: 8395829 - DNA, 23 bp, Homo sapiens
tctgagagaacaatgcctcctat

SEQ ID NO: 8395830 - DNA, 22 bp, Homo sapiens
tctgagagagggtcagatgcta

SEQ ID NO: 8395831 - DNA, 22 bp, Homo sapiens
tctgagcactgggcagtcggtg

SEQ ID NO: 8395832 - DNA, 22 bp, Homo sapiens
tctgagcagagcatcatttcag

SEQ ID NO: 8395833 - DNA, 22 bp, Homo sapiens
tctgagcatatgcagcacctgg

SEQ ID NO: 8395834 - DNA, 17 bp, Homo sapiens
tctgagaaaggagaatc

SEQ ID NO: 8395835 - DNA, 17 bp, Homo sapiens
tctgagaaaggagaatc

SEQ ID NO: 8395836 - DNA, 22 bp, Homo sapiens
tctgagaaaataggaaacttga

SEQ ID NO: 8395837 - DNA, 22 bp, Homo sapiens
tctgagaagcaccttctggaca

SEQ ID NO: 8395838 - DNA, 20 bp, Homo sapiens
tctgagaagcaaacaatgtt

SEQ ID NO: 8395839 - DNA, 21 bp, Homo sapiens
tctgagaacttctgctgcagc

SEQ ID NO: 8395840 - DNA, 22 bp, Homo sapiens
tctgagaagctagaggacaaag

SEQ ID NO: 8395841 - DNA, 22 bp, Homo sapiens
tctgagaagctagaggacaaag

SEQ ID NO: 8395842 - DNA, 23 bp, Homo sapiens
tctgagaaggtttcagccagact

SEQ ID NO: 8395843 - DNA, 22 bp, Homo sapiens
tctgagaatagtgccactgtgg

SEQ ID NO: 8395844 - DNA, 22 bp, Homo sapiens
tctgagaatggagctaaaaatc

SEQ ID NO: 8395845 - DNA, 22 bp, Homo sapiens
tctgacatgagggctgtggaga

SEQ ID NO: 8395846 - DNA, 22 bp, Homo sapiens
tctgacaggtcattttctatag

SEQ ID NO: 8395847 - DNA, 22 bp, Homo sapiens
tctgacagggccaaacatgaca

SEQ ID NO: 8395848 - DNA, 22 bp, Homo sapiens
tctgacagtcacagtggaggat

SEQ ID NO: 8395849 - DNA, 19 bp, Homo sapiens
tctgacacttacacacccc

SEQ ID NO: 8395850 - DNA, 22 bp, Homo sapiens
tctgacagctccaggcagcaat

SEQ ID NO: 8395851 - DNA, 22 bp, Homo sapiens
tctgacttggcgctcttgtctt

SEQ ID NO: 8395852 - DNA, 22 bp, Homo sapiens
tctgacttggtgctaccagcca

SEQ ID NO: 8395853 - DNA, 21 bp, Homo sapiens
tctgacttgatctattctccc

SEQ ID NO: 8395854 - DNA, 22 bp, Homo sapiens
tctgacttccttttctgatcca

SEQ ID NO: 8395855 - DNA, 22 bp, Homo sapiens
tctgacttcttcatccttgcca

SEQ ID NO: 8395856 - DNA, 22 bp, Homo sapiens
tctgacttatttgtccttggtg

SEQ ID NO: 8395857 - DNA, 22 bp, Homo sapiens
tctgacttcctccacatctgtt

SEQ ID NO: 8395858 - DNA, 22 bp, Homo sapiens
tctgaggctaagagacagaggc

SEQ ID NO: 8395859 - DNA, 22 bp, Homo sapiens
tctgaggccttgggacagaagt

SEQ ID NO: 8395860 - DNA, 22 bp, Homo sapiens
tctgaggcctagagaggggctt

SEQ ID NO: 8395861 - DNA, 22 bp, Homo sapiens
tctgaggccttcagcatgaatc

SEQ ID NO: 8395862 - DNA, 17 bp, Homo sapiens
tctgaggcctctaggag

SEQ ID NO: 8395863 - DNA, 22 bp, Homo sapiens
tctgaggcctgaagcagcagag

SEQ ID NO: 8395864 - DNA, 22 bp, Homo sapiens
tctgagcttttattatcaacct

SEQ ID NO: 8395865 - DNA, 22 bp, Homo sapiens
tctgagctttcttgtgctcaag

SEQ ID NO: 8395866 - DNA, 22 bp, Homo sapiens
tctgaggccctgcaggcagtgt

SEQ ID NO: 8395867 - DNA, 22 bp, Homo sapiens
tctgaggccctaccctgagcct

SEQ ID NO: 8395868 - DNA, 22 bp, Homo sapiens
tctgaggaatcttgacacattt

SEQ ID NO: 8395869 - DNA, 22 bp, Homo sapiens
tctgaggctgaatggactccgt

SEQ ID NO: 8395870 - DNA, 22 bp, Homo sapiens
tctgaggctgaatggactccgt

SEQ ID NO: 8395871 - DNA, 22 bp, Homo sapiens
tctgaggctatgttcaggctaa

SEQ ID NO: 8395872 - DNA, 22 bp, Homo sapiens
tctgaggctgaatggactccgt

SEQ ID NO: 8395873 - DNA, 22 bp, Homo sapiens
tctgaggggctggaagggctgc

SEQ ID NO: 8395874 - DNA, 19 bp, Homo sapiens
tctgagggtccagatgcat

SEQ ID NO: 8395875 - DNA, 22 bp, Homo sapiens
tctgaggggccagggatctggg

SEQ ID NO: 8395876 - DNA, 22 bp, Homo sapiens
tctgagggcttgaggggaagta

SEQ ID NO: 8395877 - DNA, 22 bp, Homo sapiens
tctgagggcttgaggggaagta

SEQ ID NO: 8395878 - DNA, 23 bp, Homo sapiens
tctgagggagtgggcagtggcac

SEQ ID NO: 8395879 - DNA, 22 bp, Homo sapiens
tctgagggttgtagagagggac

SEQ ID NO: 8395880 - DNA, 22 bp, Homo sapiens
tctgagggtgggagaaggagct

SEQ ID NO: 8395881 - DNA, 22 bp, Homo sapiens
tctgagggttggctggctgtag

SEQ ID NO: 8395882 - DNA, 22 bp, Homo sapiens
tctgatatttgaagaccattag

SEQ ID NO: 8395883 - DNA, 22 bp, Homo sapiens
tctgatattggggtcagagtag

SEQ ID NO: 8395884 - DNA, 22 bp, Homo sapiens
tctgatatttcattcaaaagta

SEQ ID NO: 8395885 - DNA, 21 bp, Homo sapiens
tctgatggtagatgagatgtg

SEQ ID NO: 8395886 - DNA, 21 bp, Homo sapiens
tctgatggtagatgagatgtg

SEQ ID NO: 8395887 - DNA, 22 bp, Homo sapiens
tctgcaaacttaagttgaaata

SEQ ID NO: 8395888 - DNA, 20 bp, Homo sapiens
tctgcaaacaagttttagac

SEQ ID NO: 8395889 - DNA, 22 bp, Homo sapiens
tctgcaagatggtcttagaggt

SEQ ID NO: 8395890 - DNA, 22 bp, Homo sapiens
tctgatgtggagacactgtttt

SEQ ID NO: 8395891 - DNA, 21 bp, Homo sapiens
tctgatgttcacaccctgtat

SEQ ID NO: 8395892 - DNA, 23 bp, Homo sapiens
tctgatgttctcttatgctgtag

SEQ ID NO: 8395893 - DNA, 22 bp, Homo sapiens
tctgatgttgatgcttctgcct

SEQ ID NO: 8395894 - DNA, 22 bp, Homo sapiens
tctgcctgttcaagtcttctag

SEQ ID NO: 8395895 - DNA, 22 bp, Homo sapiens
tctgcctgttcaagtcttctag

SEQ ID NO: 8395896 - DNA, 22 bp, Homo sapiens
tctgcctgttcccgattccatg

SEQ ID NO: 8395897 - DNA, 22 bp, Homo sapiens
tctgcctgttgctagaatgtca

SEQ ID NO: 8395898 - DNA, 22 bp, Homo sapiens
tctgcctgctaactcctgcacc

SEQ ID NO: 8395899 - DNA, 22 bp, Homo sapiens
tctgcctgctaactcctgcacc

SEQ ID NO: 8395900 - DNA, 22 bp, Homo sapiens
tctgcctgcggctgcaggtggc

SEQ ID NO: 8395901 - DNA, 22 bp, Homo sapiens
tctgcctggagagttcttctct

SEQ ID NO: 8395902 - DNA, 22 bp, Homo sapiens
tctgcctggaccctggtgagct

SEQ ID NO: 8395903 - DNA, 22 bp, Homo sapiens
tctgcctgggtgtggagcagag

SEQ ID NO: 8395904 - DNA, 22 bp, Homo sapiens
tctgcctggctcatggcagtga

SEQ ID NO: 8395905 - DNA, 22 bp, Homo sapiens
tctgcctggcctggagggcaca

SEQ ID NO: 8395906 - DNA, 22 bp, Homo sapiens
tctgcctggattttggaaagct

SEQ ID NO: 8395907 - DNA, 18 bp, Homo sapiens
tctgccctgccattcact

SEQ ID NO: 8395908 - DNA, 22 bp, Homo sapiens
tctgccctggggtcagcctcca

SEQ ID NO: 8395909 - DNA, 22 bp, Homo sapiens
tctgcctgagcagagggaggcc

SEQ ID NO: 8395910 - DNA, 22 bp, Homo sapiens
tctgcctgagggagctgaggaa

SEQ ID NO: 8395911 - DNA, 18 bp, Homo sapiens
tctgcctgcagggcatct

SEQ ID NO: 8395912 - DNA, 22 bp, Homo sapiens
tctgcctgagggagctgaggaa

SEQ ID NO: 8395913 - DNA, 22 bp, Homo sapiens
tctgcccagggacccacaggga

SEQ ID NO: 8395914 - DNA, 22 bp, Homo sapiens
tctgcccaggacacctgccact

SEQ ID NO: 8395915 - DNA, 22 bp, Homo sapiens
tctgccctcattgctgcctgga

SEQ ID NO: 8395916 - DNA, 22 bp, Homo sapiens
tctgccctcattgctgcctgga

SEQ ID NO: 8395917 - DNA, 22 bp, Homo sapiens
tctgccctcgaggagcttgtgt

SEQ ID NO: 8395918 - DNA, 22 bp, Homo sapiens
tctgcccagtttgtgctcaggt

SEQ ID NO: 8395919 - DNA, 19 bp, Homo sapiens
tctgcccagttgtctgccc

SEQ ID NO: 8395920 - DNA, 22 bp, Homo sapiens
tctgccctaattcagtgcttag

SEQ ID NO: 8395921 - DNA, 22 bp, Homo sapiens
tctgccatgctaacttcagtat

SEQ ID NO: 8395922 - DNA, 22 bp, Homo sapiens
tctgccatcttaattctctttt

SEQ ID NO: 8395923 - DNA, 22 bp, Homo sapiens
tctgccatcaagatgctctggc

SEQ ID NO: 8395924 - DNA, 23 bp, Homo sapiens
tctgccagtgtgtgccaggagcc

SEQ ID NO: 8395925 - DNA, 23 bp, Homo sapiens
tctgccagtgtgtgccaggagcc

SEQ ID NO: 8395926 - DNA, 22 bp, Homo sapiens
tctgccagtgccagagtacata

SEQ ID NO: 8395927 - DNA, 22 bp, Homo sapiens
tctgccaggtggggagaggcca

SEQ ID NO: 8395928 - DNA, 22 bp, Homo sapiens
tctgccaggtggggagaggcca

SEQ ID NO: 8395929 - DNA, 22 bp, Homo sapiens
tctgccagtattcacggcccgt

SEQ ID NO: 8395930 - DNA, 22 bp, Homo sapiens
tctgccacatgagggcacagca

SEQ ID NO: 8395931 - DNA, 22 bp, Homo sapiens
tctgccaggccacacagggcac

SEQ ID NO: 8395932 - DNA, 22 bp, Homo sapiens
tctgcaggtaagcgttcttgga

SEQ ID NO: 8395933 - DNA, 17 bp, Homo sapiens
tctgcagggggccgtgt

SEQ ID NO: 8395934 - DNA, 22 bp, Homo sapiens
tctgcagggatgtgaggggtga

SEQ ID NO: 8395935 - DNA, 22 bp, Homo sapiens
tctgcaggcttggagtggcagc

SEQ ID NO: 8395936 - DNA, 22 bp, Homo sapiens
tctgcagggatgtgaggggtga

SEQ ID NO: 8395937 - DNA, 22 bp, Homo sapiens
tctgcaggcttataggatgggt

SEQ ID NO: 8395938 - DNA, 22 bp, Homo sapiens
tctgcaggctctagatgaggtt

SEQ ID NO: 8395939 - DNA, 19 bp, Homo sapiens
tctgcatggcaggaagaga

SEQ ID NO: 8395940 - DNA, 22 bp, Homo sapiens
tctgcatatttatcatgagtct

SEQ ID NO: 8395941 - DNA, 22 bp, Homo sapiens
tctgcatctgtgttgagtgccc

SEQ ID NO: 8395942 - DNA, 22 bp, Homo sapiens
tctgcatattgttaatggaatg

SEQ ID NO: 8395943 - DNA, 22 bp, Homo sapiens
tctgcaggtgttggaagggtca

SEQ ID NO: 8395944 - DNA, 22 bp, Homo sapiens
tctgcaggagcagggcgtggag

SEQ ID NO: 8395945 - DNA, 22 bp, Homo sapiens
tctgcaggaggctggctgcagg

SEQ ID NO: 8395946 - DNA, 22 bp, Homo sapiens
tctgcaggagcagggcgtggag

SEQ ID NO: 8395947 - DNA, 22 bp, Homo sapiens
tctgcaggaggctggctgcagg

SEQ ID NO: 8395948 - DNA, 22 bp, Homo sapiens
tctgcaggatggatgctcagaa

SEQ ID NO: 8395949 - DNA, 22 bp, Homo sapiens
tctgcaggcatttttggttgtc

SEQ ID NO: 8395950 - DNA, 22 bp, Homo sapiens
tctgcaggctctagatgaggtt

SEQ ID NO: 8395951 - DNA, 22 bp, Homo sapiens
tctgcaggctctagatgaggtt

SEQ ID NO: 8395952 - DNA, 22 bp, Homo sapiens
tctgcagctttcccctgattta

SEQ ID NO: 8395953 - DNA, 22 bp, Homo sapiens
tctgcagctttttggtggggtg

SEQ ID NO: 8395954 - DNA, 22 bp, Homo sapiens
tctgcagcttcttgccagagag

SEQ ID NO: 8395955 - DNA, 22 bp, Homo sapiens
tctgcagcttgcacaggcaggc

SEQ ID NO: 8395956 - DNA, 22 bp, Homo sapiens
tctgcagcttactttcacatga

SEQ ID NO: 8395957 - DNA, 22 bp, Homo sapiens
tctgcagcttactttcacatga

SEQ ID NO: 8395958 - DNA, 19 bp, Homo sapiens
tctgcaagtgtcagaggcg

SEQ ID NO: 8395959 - DNA, 22 bp, Homo sapiens
tctgcaagtgacccgggcccag

SEQ ID NO: 8395960 - DNA, 22 bp, Homo sapiens
tctgcaaggggttctttaggcc

SEQ ID NO: 8395961 - DNA, 22 bp, Homo sapiens
tctgcacagattctctgagaat

SEQ ID NO: 8395962 - DNA, 22 bp, Homo sapiens
tctgcacacaatttatctttct

SEQ ID NO: 8395963 - DNA, 22 bp, Homo sapiens
tctgcacatgtagtaaatatta

SEQ ID NO: 8395964 - DNA, 22 bp, Homo sapiens
tctgcacaggcgtaggttgact

SEQ ID NO: 8395965 - DNA, 18 bp, Homo sapiens
tctgcactcctgagagag

SEQ ID NO: 8395966 - DNA, 18 bp, Homo sapiens
tctgcactcctgagagag

SEQ ID NO: 8395967 - DNA, 22 bp, Homo sapiens
tctgcagcaacctttcacctcc

SEQ ID NO: 8395968 - DNA, 22 bp, Homo sapiens
tctgcagcacttaatgtttcgt

SEQ ID NO: 8395969 - DNA, 22 bp, Homo sapiens
tctgcagccagaggcatgaaaa

SEQ ID NO: 8395970 - DNA, 20 bp, Homo sapiens
tctgcagcacttgacaatgt

SEQ ID NO: 8395971 - DNA, 22 bp, Homo sapiens
tctgcagcgtgcaggctggtgc

SEQ ID NO: 8395972 - DNA, 22 bp, Homo sapiens
tctgcagcccaaagtctcttag

SEQ ID NO: 8395973 - DNA, 22 bp, Homo sapiens
ttccaggaacaaactcacctta

SEQ ID NO: 8395974 - DNA, 22 bp, Homo sapiens
acattttacaccaagacttctt

SEQ ID NO: 8395975 - DNA, 22 bp, Homo sapiens
acattttaatatgcttagtgtg

SEQ ID NO: 8395976 - DNA, 22 bp, Homo sapiens
acatttgttgccattcatggag

SEQ ID NO: 8395977 - DNA, 22 bp, Homo sapiens
acatttgtgcacatgtgcatgg

SEQ ID NO: 8395978 - DNA, 22 bp, Homo sapiens
acattcttccagctggctgttg

SEQ ID NO: 8395979 - DNA, 22 bp, Homo sapiens
acattcttcttgtgaatttact

SEQ ID NO: 8395980 - DNA, 22 bp, Homo sapiens
acattcttgaagtgaagtttat

SEQ ID NO: 8395981 - DNA, 22 bp, Homo sapiens
acatttcatttgcagtatggat

SEQ ID NO: 8395982 - DNA, 22 bp, Homo sapiens
acatttcatgttttccagagca

SEQ ID NO: 8395983 - DNA, 22 bp, Homo sapiens
acatttctggagtttctcaaca

SEQ ID NO: 8395984 - DNA, 22 bp, Homo sapiens
acatttaaatacctatgtttct

SEQ ID NO: 8395985 - DNA, 22 bp, Homo sapiens
acatttaaatatgccttatatt

SEQ ID NO: 8395986 - DNA, 19 bp, Homo sapiens
acatttaaattcagatctc

SEQ ID NO: 8395987 - DNA, 22 bp, Homo sapiens
aaggcagagattagcagaatga

SEQ ID NO: 8395988 - DNA, 22 bp, Homo sapiens
acatatgtgttgtacatgcatg

SEQ ID NO: 8395989 - DNA, 22 bp, Homo sapiens
aagcattttgttttaagaatga

SEQ ID NO: 8395990 - DNA, 22 bp, Homo sapiens
actctacagaatgaatacctgt

SEQ ID NO: 8395991 - DNA, 22 bp, Homo sapiens
actataacctgttagaatagat

SEQ ID NO: 8395992 - DNA, 22 bp, Homo sapiens
actataacccatggaatataag

SEQ ID NO: 8395993 - DNA, 22 bp, Homo sapiens
actataaaaggataaaccagaa

SEQ ID NO: 8395994 - DNA, 22 bp, Homo sapiens
actttgaaactaaaattcatta

SEQ ID NO: 8395995 - DNA, 22 bp, Homo sapiens
actttgaaatgtgtaagagaga

SEQ ID NO: 8395996 - DNA, 22 bp, Homo sapiens
actttcttcttatgcattaagg

SEQ ID NO: 8395997 - DNA, 22 bp, Homo sapiens
actttatttcctattgcatcca

SEQ ID NO: 8395998 - DNA, 22 bp, Homo sapiens
actttcttaggctgtataaatg

SEQ ID NO: 8395999 - DNA, 22 bp, Homo sapiens
aatactatgtagccaaaataat

SEQ ID NO: 8396000 - DNA, 22 bp, Homo sapiens
aatataattttattcctagagt

SEQ ID NO: 8396001 - DNA, 22 bp, Homo sapiens
aatatagatttactcaagagaa

SEQ ID NO: 8396002 - DNA, 22 bp, Homo sapiens
agaaattctaagcatcaatagc

SEQ ID NO: 8396003 - DNA, 22 bp, Homo sapiens
aatgatgagttctaatagaccc

SEQ ID NO: 8396004 - DNA, 22 bp, Homo sapiens
aatgattggcactagatacaca

SEQ ID NO: 8396005 - DNA, 23 bp, Homo sapiens
acactcttcccagaaggttctga

SEQ ID NO: 8396006 - DNA, 22 bp, Homo sapiens
acactttagaaaaaagaatggt

SEQ ID NO: 8396007 - DNA, 22 bp, Homo sapiens
acactttacagcttcctttgca

SEQ ID NO: 8396008 - DNA, 22 bp, Homo sapiens
acactttacagaatgttttgat

SEQ ID NO: 8396009 - DNA, 22 bp, Homo sapiens
acacatgtgattctaagacagc

SEQ ID NO: 8396010 - DNA, 22 bp, Homo sapiens
acacatgtatggcacttacatt

SEQ ID NO: 8396011 - DNA, 22 bp, Homo sapiens
acactttatgtctagatctggg

SEQ ID NO: 8396012 - DNA, 22 bp, Homo sapiens
acactttatcaatattcaaaaa

SEQ ID NO: 8396013 - DNA, 22 bp, Homo sapiens
acactttatctcatctcagaca

SEQ ID NO: 8396014 - DNA, 22 bp, Homo sapiens
acagaaaagtttacttttgctc

SEQ ID NO: 8396015 - DNA, 22 bp, Homo sapiens
acaaagtaagggctaatgagca

SEQ ID NO: 8396016 - DNA, 22 bp, Homo sapiens
acaaagtagtcaaagtagatga

SEQ ID NO: 8396017 - DNA, 22 bp, Homo sapiens
acaaagtaggtcatcaaagctc

SEQ ID NO: 8396018 - DNA, 22 bp, Homo sapiens
acaaagtaggaagattagctga

SEQ ID NO: 8396019 - DNA, 22 bp, Homo sapiens
acaatgagtttgatgtagtttg

SEQ ID NO: 8396020 - DNA, 22 bp, Homo sapiens
acaagagtctgcatttctaaca

SEQ ID NO: 8396021 - DNA, 22 bp, Homo sapiens
aatgtttgtgcataaatatgtt

SEQ ID NO: 8396022 - DNA, 22 bp, Homo sapiens
aatgtttggctagatagatgga

SEQ ID NO: 8396023 - DNA, 18 bp, Homo sapiens
aatgtttgtcctctctaa

SEQ ID NO: 8396024 - DNA, 22 bp, Homo sapiens
aatgtttgtcatcacacagata

SEQ ID NO: 8396025 - DNA, 22 bp, Homo sapiens
aatggtaccctggtgacttaga

SEQ ID NO: 8396026 - DNA, 21 bp, Homo sapiens
aaatactgggcagtgacttga

SEQ ID NO: 8396027 - DNA, 22 bp, Homo sapiens
aaatactgggctcaaaagggtt

SEQ ID NO: 8396028 - DNA, 22 bp, Homo sapiens
aagataaactcttgatttctga

SEQ ID NO: 8396029 - DNA, 22 bp, Homo sapiens
aaatactgctgctattcctttt

SEQ ID NO: 8396030 - DNA, 22 bp, Homo sapiens
aaatactggcaagtgctaattc

SEQ ID NO: 8396031 - DNA, 22 bp, Homo sapiens
aaatactagaattcagagttga

SEQ ID NO: 8396032 - DNA, 22 bp, Homo sapiens
aagacttaagtgaaaatccaca

SEQ ID NO: 8396033 - DNA, 22 bp, Homo sapiens
aaagtgacaaccatttattaag

SEQ ID NO: 8396034 - DNA, 22 bp, Homo sapiens
aagatcaagtgtactttatgta

SEQ ID NO: 8396035 - DNA, 22 bp, Homo sapiens
aaagcactggagtcatcatcta

SEQ ID NO: 8396036 - DNA, 22 bp, Homo sapiens
aaagcactcggcttcatccagg

SEQ ID NO: 8396037 - DNA, 22 bp, Homo sapiens
aacactttcctgcctttctgat

SEQ ID NO: 8396038 - DNA, 22 bp, Homo sapiens
aaagattatggaacacacatga

SEQ ID NO: 8396039 - DNA, 22 bp, Homo sapiens
aaagatttatgaagttcaatta

SEQ ID NO: 8396040 - DNA, 22 bp, Homo sapiens
aaagatttaagaataatttgtg

SEQ ID NO: 8396041 - DNA, 22 bp, Homo sapiens
aaagatttgaaattaggcatca

SEQ ID NO: 8396042 - DNA, 22 bp, Homo sapiens
aaagatttgagttctgcttata

SEQ ID NO: 8396043 - DNA, 22 bp, Homo sapiens
aacactgtggtcttttcagtaa

SEQ ID NO: 8396044 - DNA, 22 bp, Homo sapiens
aagaacatgaacacaatgttta

SEQ ID NO: 8396045 - DNA, 22 bp, Homo sapiens
aaaggcaggactgcagcatagg

SEQ ID NO: 8396046 - DNA, 22 bp, Homo sapiens
aaaactgaaccttgagatcttt

SEQ ID NO: 8396047 - DNA, 22 bp, Homo sapiens
aaaactgaaatacgatccaatg

SEQ ID NO: 8396048 - DNA, 22 bp, Homo sapiens
aaaacataaactgacagcccat

SEQ ID NO: 8396049 - DNA, 22 bp, Homo sapiens
aaaaggcattttgtcaaccata

SEQ ID NO: 8396050 - DNA, 22 bp, Homo sapiens
aaaaagtattggccatggttga

SEQ ID NO: 8396051 - DNA, 22 bp, Homo sapiens
aaaactgaggtttcctgaagaa

SEQ ID NO: 8396052 - DNA, 22 bp, Homo sapiens
aaaactttcagggatacagaaa

SEQ ID NO: 8396053 - DNA, 22 bp, Homo sapiens
aaaattatggagtatcccaaag

SEQ ID NO: 8396054 - DNA, 22 bp, Homo sapiens
aaaagtaattgcaattttgtag

SEQ ID NO: 8396055 - DNA, 22 bp, Homo sapiens
aaaattgaggctcatgttaaat

SEQ ID NO: 8396056 - DNA, 22 bp, Homo sapiens
aaagagcatggaaagttcagga

SEQ ID NO: 8396057 - DNA, 22 bp, Homo sapiens
aaaattctgtcattaaattgtg

SEQ ID NO: 8396058 - DNA, 17 bp, Homo sapiens
aaaattctgtaaagagg

SEQ ID NO: 8396059 - DNA, 22 bp, Homo sapiens
aaaatgtgatctacaaatgcaa

SEQ ID NO: 8396060 - DNA, 22 bp, Homo sapiens
aaaatatgaagttgtcagtatg

SEQ ID NO: 8396061 - DNA, 22 bp, Homo sapiens
aaaatatggggtgagcccagag

SEQ ID NO: 8396062 - DNA, 20 bp, Homo sapiens
aaaatatgtataactcttct

SEQ ID NO: 8396063 - DNA, 22 bp, Homo sapiens
aaaatatgactgtgctccttaa

SEQ ID NO: 8396064 - DNA, 22 bp, Homo sapiens
aaactgctgggcatatatttct

SEQ ID NO: 8396065 - DNA, 22 bp, Homo sapiens
aaaatatgtataactcttctgc

SEQ ID NO: 8396066 - DNA, 22 bp, Homo sapiens
aaacattagacaccatatgctc

SEQ ID NO: 8396067 - DNA, 23 bp, Homo sapiens
aaacatgcagcacatgaatgcta

SEQ ID NO: 8396068 - DNA, 22 bp, Homo sapiens
aaacatgctggatttagaatat

SEQ ID NO: 8396069 - DNA, 22 bp, Homo sapiens
aaacattctcagccctgcttgc

SEQ ID NO: 8396070 - DNA, 22 bp, Homo sapiens
aaactgtaagagaataaactac

SEQ ID NO: 8396071 - DNA, 22 bp, Homo sapiens
aaactgtcattggatgcatttg

SEQ ID NO: 8396072 - DNA, 22 bp, Homo sapiens
aaacttttcctgctcttgtcct

SEQ ID NO: 8396073 - DNA, 22 bp, Homo sapiens
aaagaacaatgtggaatctcct

SEQ ID NO: 8396074 - DNA, 22 bp, Homo sapiens
aaagactagcatttatatgtac

SEQ ID NO: 8396075 - DNA, 22 bp, Homo sapiens
aaagactaagaagagtattatt

SEQ ID NO: 8396076 - DNA, 22 bp, Homo sapiens
aaagacttggcttatgatttgc

SEQ ID NO: 8396077 - DNA, 22 bp, Homo sapiens
aaagactttcacctagcaaaga

SEQ ID NO: 8396078 - DNA, 22 bp, Homo sapiens
aaagagcaagctgagatttgaa

SEQ ID NO: 8396079 - DNA, 22 bp, Homo sapiens
aaagagactggtggcattttgc

SEQ ID NO: 8396080 - DNA, 22 bp, Homo sapiens
aaagagaaaaagatcccggctc

SEQ ID NO: 8396081 - DNA, 22 bp, Homo sapiens
aaagagaaaatgatctgtacat

SEQ ID NO: 8396082 - DNA, 22 bp, Homo sapiens
aaagagaaacttagaagcctga

SEQ ID NO: 8396083 - DNA, 20 bp, Homo sapiens
aaagagaagcctcaccttgt

SEQ ID NO: 8396084 - DNA, 21 bp, Homo sapiens
aaagagacaaatggcatatac

SEQ ID NO: 8396085 - DNA, 22 bp, Homo sapiens
aaagagaacttttacccaagaa

SEQ ID NO: 8396086 - DNA, 22 bp, Homo sapiens
acacatttctaaatttttaccg

SEQ ID NO: 8396087 - DNA, 22 bp, Homo sapiens
acacatttagcaccaggtttat

SEQ ID NO: 8396088 - DNA, 22 bp, Homo sapiens
acacatttatggatcgcagaaa

SEQ ID NO: 8396089 - DNA, 22 bp, Homo sapiens
acacatttacatgtttacgtat

SEQ ID NO: 8396090 - DNA, 19 bp, Homo sapiens
aagagcagggaaagaattg

SEQ ID NO: 8396091 - DNA, 22 bp, Homo sapiens
aagagcaggacagaatcagaac

SEQ ID NO: 8396092 - DNA, 22 bp, Homo sapiens
aagagcaggctgtcaatggggc

SEQ ID NO: 8396093 - DNA, 22 bp, Homo sapiens
aagagcaggctgctgtggagta

SEQ ID NO: 8396094 - DNA, 22 bp, Homo sapiens
aagatgcagcaaactacttttt

SEQ ID NO: 8396095 - DNA, 20 bp, Homo sapiens
aattttatctccatcctttg

SEQ ID NO: 8396096 - DNA, 22 bp, Homo sapiens
aagactttcaagtatgcatgca

SEQ ID NO: 8396097 - DNA, 22 bp, Homo sapiens
aagactttccctcatcagaacg

SEQ ID NO: 8396098 - DNA, 22 bp, Homo sapiens
aagactttctcccaaatcctca

SEQ ID NO: 8396099 - DNA, 22 bp, Homo sapiens
aagactttctggggtgtaaagg

SEQ ID NO: 8396100 - DNA, 22 bp, Homo sapiens
aattttaatcagtggtgctgag

SEQ ID NO: 8396101 - DNA, 22 bp, Homo sapiens
aattttaagcatatgactggtt

SEQ ID NO: 8396102 - DNA, 22 bp, Homo sapiens
aatttgttacacagcaatataa

SEQ ID NO: 8396103 - DNA, 22 bp, Homo sapiens
aatttcagatgtcataaatata

SEQ ID NO: 8396104 - DNA, 22 bp, Homo sapiens
aatttcagttgctaataagttc

SEQ ID NO: 8396105 - DNA, 22 bp, Homo sapiens
aatttcagtatgaagtttcaca

SEQ ID NO: 8396106 - DNA, 22 bp, Homo sapiens
aatttcagaccatttgcaatta

SEQ ID NO: 8396107 - DNA, 22 bp, Homo sapiens
aatttcagaacccaaattagcg

SEQ ID NO: 8396108 - DNA, 22 bp, Homo sapiens
aatttcagatattaaagaatga

SEQ ID NO: 8396109 - DNA, 21 bp, Homo sapiens
aatttcagacccattttgcct

SEQ ID NO: 8396110 - DNA, 22 bp, Homo sapiens
aagagcagattcctagtggagc

SEQ ID NO: 8396111 - DNA, 22 bp, Homo sapiens
aagagcagaagtccttggatcc

SEQ ID NO: 8396112 - DNA, 22 bp, Homo sapiens
aagagcagcctccaggggtgga

SEQ ID NO: 8396113 - DNA, 22 bp, Homo sapiens
aagagcaagtgggtagtgaagc

SEQ ID NO: 8396114 - DNA, 22 bp, Homo sapiens
aactttctgtctgagctgcaga

SEQ ID NO: 8396115 - DNA, 22 bp, Homo sapiens
aactgcttgagatatgtttgtc

SEQ ID NO: 8396116 - DNA, 22 bp, Homo sapiens
aattcacaatgtgtagtcatgc

SEQ ID NO: 8396117 - DNA, 22 bp, Homo sapiens
aatttcacataaggctcattgg

SEQ ID NO: 8396118 - DNA, 22 bp, Homo sapiens
aatttcacctgcactacatcgc

SEQ ID NO: 8396119 - DNA, 22 bp, Homo sapiens
aatttcacctatcacttaagcc

SEQ ID NO: 8396120 - DNA, 22 bp, Homo sapiens
aatttcactggaaaagataatt

SEQ ID NO: 8396121 - DNA, 22 bp, Homo sapiens
aatttcactgtggagcacattt

SEQ ID NO: 8396122 - DNA, 22 bp, Homo sapiens
aacagacatatttttaatatgc

SEQ ID NO: 8396123 - DNA, 22 bp, Homo sapiens
aacagaatgcaggggatgctgc

SEQ ID NO: 8396124 - DNA, 22 bp, Homo sapiens
aacactttcttccttgctcagg

SEQ ID NO: 8396125 - DNA, 22 bp, Homo sapiens
aacactttttagtaaagattga

SEQ ID NO: 8396126 - DNA, 22 bp, Homo sapiens
aacactttttcctcctgtctgg

SEQ ID NO: 8396127 - DNA, 22 bp, Homo sapiens
aacactttttatatattgtatc

SEQ ID NO: 8396128 - DNA, 22 bp, Homo sapiens
aacactttgggcatggccttcc

SEQ ID NO: 8396129 - DNA, 22 bp, Homo sapiens
aacactttgttgcctatgaacg

SEQ ID NO: 8396130 - DNA, 22 bp, Homo sapiens
aaatttgtcaacttcatatgtt

SEQ ID NO: 8396131 - DNA, 22 bp, Homo sapiens
aaattttaaggctggaacttaa

SEQ ID NO: 8396132 - DNA, 22 bp, Homo sapiens
aaatgtcatatttaagtaggaa

SEQ ID NO: 8396133 - DNA, 22 bp, Homo sapiens
aaatgtcagaggaacatattga

SEQ ID NO: 8396134 - DNA, 22 bp, Homo sapiens
aaatgtcaggtggtggatggct

SEQ ID NO: 8396135 - DNA, 22 bp, Homo sapiens
aaatgtcagaaaacatggagtg

SEQ ID NO: 8396136 - DNA, 22 bp, Homo sapiens
aaatgtcagaagctttacttct

SEQ ID NO: 8396137 - DNA, 22 bp, Homo sapiens
aaatgtcagagctggaaggggc

SEQ ID NO: 8396138 - DNA, 22 bp, Homo sapiens
aaatgtcaaggtgatagatgca

SEQ ID NO: 8396139 - DNA, 22 bp, Homo sapiens
aaatgtcaaagacgtgtttttg

SEQ ID NO: 8396140 - DNA, 22 bp, Homo sapiens
aactataatggggttaggaaat

SEQ ID NO: 8396141 - DNA, 22 bp, Homo sapiens
aactagaacgagaaagctgaac

SEQ ID NO: 8396142 - DNA, 22 bp, Homo sapiens
aactagaaatcactacaggtat

SEQ ID NO: 8396143 - DNA, 22 bp, Homo sapiens
aatgaacaacttgatttttgcc

SEQ ID NO: 8396144 - DNA, 22 bp, Homo sapiens
aacatctttttgtttgctgaaa

SEQ ID NO: 8396145 - DNA, 22 bp, Homo sapiens
aacatctttgataaacttagtg

SEQ ID NO: 8396146 - DNA, 19 bp, Homo sapiens
aacatctttccagtagagg

SEQ ID NO: 8396147 - DNA, 22 bp, Homo sapiens
aacatctttgccaaattgctat

SEQ ID NO: 8396148 - DNA, 22 bp, Homo sapiens
aacatctttgtagtgttctcct

SEQ ID NO: 8396149 - DNA, 22 bp, Homo sapiens
aacatcttcagagaagctaagt

SEQ ID NO: 8396150 - DNA, 22 bp, Homo sapiens
aacatcttatctgcatgatccc

SEQ ID NO: 8396151 - DNA, 22 bp, Homo sapiens
aacatcttgaagattgggaaag

SEQ ID NO: 8396152 - DNA, 22 bp, Homo sapiens
aacatctttacaacagacctag

SEQ ID NO: 8396153 - DNA, 22 bp, Homo sapiens
aacatcttgtccttagattaaa

SEQ ID NO: 8396154 - DNA, 22 bp, Homo sapiens
aacatcttgtactgcacatttt

SEQ ID NO: 8396155 - DNA, 22 bp, Homo sapiens
aagtggtagacaaagataattg

SEQ ID NO: 8396156 - DNA, 22 bp, Homo sapiens
aagtggtagagagagcataagc

SEQ ID NO: 8396157 - DNA, 22 bp, Homo sapiens
aacatctacagtgagatgttag

SEQ ID NO: 8396158 - DNA, 22 bp, Homo sapiens
aacagcttagaaatgttgctaa

SEQ ID NO: 8396159 - DNA, 21 bp, Homo sapiens
acagttttaaggagcacatgg

SEQ ID NO: 8396160 - DNA, 22 bp, Homo sapiens
acagttacatgattcttgtgag

SEQ ID NO: 8396161 - DNA, 22 bp, Homo sapiens
acagttcaagtcttagacaaca

SEQ ID NO: 8396162 - DNA, 22 bp, Homo sapiens
acatttgtcttctttcagatta

SEQ ID NO: 8396163 - DNA, 22 bp, Homo sapiens
accaaaacctgctactaaagga

SEQ ID NO: 8396164 - DNA, 22 bp, Homo sapiens
accatttgaaggaatcattgac

SEQ ID NO: 8396165 - DNA, 22 bp, Homo sapiens
acatttaaccaaactgtttaat

SEQ ID NO: 8396166 - DNA, 22 bp, Homo sapiens
acatttaaccctcaggtttctg

SEQ ID NO: 8396167 - DNA, 22 bp, Homo sapiens
acatttaacctttgaggaactg

SEQ ID NO: 8396168 - DNA, 22 bp, Homo sapiens
acatttaagttaaaacctcagt

SEQ ID NO: 8396169 - DNA, 22 bp, Homo sapiens
acatttaatgatcctactgtga

SEQ ID NO: 8396170 - DNA, 22 bp, Homo sapiens
acatttcactgttcacagcagg

SEQ ID NO: 8396171 - DNA, 22 bp, Homo sapiens
acatttacctagttaagtcaat

SEQ ID NO: 8396172 - DNA, 18 bp, Homo sapiens
acatttaggagagtcaat

SEQ ID NO: 8396173 - DNA, 19 bp, Homo sapiens
acatttagaatgtacttgc

SEQ ID NO: 8396174 - DNA, 22 bp, Homo sapiens
acatttagctgtacaatctatg

SEQ ID NO: 8396175 - DNA, 23 bp, Homo sapiens
acatttcaatactgagggtctga

SEQ ID NO: 8396176 - DNA, 21 bp, Homo sapiens
acatgagacacacatatatgt

SEQ ID NO: 8396177 - DNA, 22 bp, Homo sapiens
actaaactgaagcatgaaaagg

SEQ ID NO: 8396178 - DNA, 22 bp, Homo sapiens
aggtaccaaaagcctttttctg

SEQ ID NO: 8396179 - DNA, 22 bp, Homo sapiens
acctgctttgtagtgtttgctg

SEQ ID NO: 8396180 - DNA, 22 bp, Homo sapiens
actgatgtctggggcagagtct

SEQ ID NO: 8396181 - DNA, 22 bp, Homo sapiens
actgaaatatttagaagtgaag

SEQ ID NO: 8396182 - DNA, 22 bp, Homo sapiens
actcttcagtacaataatatct

SEQ ID NO: 8396183 - DNA, 22 bp, Homo sapiens
actttgtataagacaataaaga

SEQ ID NO: 8396184 - DNA, 18 bp, Homo sapiens
atatattgacaagaggga

SEQ ID NO: 8396185 - DNA, 22 bp, Homo sapiens
actttgtaggaaaaagtcacaa

SEQ ID NO: 8396186 - DNA, 22 bp, Homo sapiens
actttgtaggtttcagtgaaac

SEQ ID NO: 8396187 - DNA, 22 bp, Homo sapiens
atatgaaaagaagtcaccattg

SEQ ID NO: 8396188 - DNA, 22 bp, Homo sapiens
agaaacaacttgtttctcttgc

SEQ ID NO: 8396189 - DNA, 22 bp, Homo sapiens
agaaaatttattcatgttagtt

SEQ ID NO: 8396190 - DNA, 22 bp, Homo sapiens
agaaaatttaaagagacacaca

SEQ ID NO: 8396191 - DNA, 21 bp, Homo sapiens
atatcttcttcaaaccactca

SEQ ID NO: 8396192 - DNA, 22 bp, Homo sapiens
atatatttgagaatattcatga

SEQ ID NO: 8396193 - DNA, 22 bp, Homo sapiens
agaaacatcattggaacacaag

SEQ ID NO: 8396194 - DNA, 22 bp, Homo sapiens
atcacattgttagcatagactg

SEQ ID NO: 8396195 - DNA, 22 bp, Homo sapiens
atcagaggaaattaactctctc

SEQ ID NO: 8396196 - DNA, 22 bp, Homo sapiens
atcatttacaatgaaagcctga

SEQ ID NO: 8396197 - DNA, 22 bp, Homo sapiens
acttcacaactgtacatggcag

SEQ ID NO: 8396198 - DNA, 22 bp, Homo sapiens
acttcaaattttcagaagaaat

SEQ ID NO: 8396199 - DNA, 22 bp, Homo sapiens
acttcacattagctaaaaggga

SEQ ID NO: 8396200 - DNA, 22 bp, Homo sapiens
acttcaaacaattaacagagaa

SEQ ID NO: 8396201 - DNA, 22 bp, Homo sapiens
acttgcatgtcaggaaattaac

SEQ ID NO: 8396202 - DNA, 22 bp, Homo sapiens
acttgcatgtgtaaatcttcct

SEQ ID NO: 8396203 - DNA, 22 bp, Homo sapiens
acttcagtaggtgatatgtgca

SEQ ID NO: 8396204 - DNA, 22 bp, Homo sapiens
acttcagtgtggtataaaacgt

SEQ ID NO: 8396205 - DNA, 22 bp, Homo sapiens
acttcagtttccctcaacaaga

SEQ ID NO: 8396206 - DNA, 22 bp, Homo sapiens
actgtgaatcactactagtaga

SEQ ID NO: 8396207 - DNA, 22 bp, Homo sapiens
caatgacatggataatcatatt

SEQ ID NO: 8396208 - DNA, 22 bp, Homo sapiens
cacatcatgttaattcattaca

SEQ ID NO: 8396209 - DNA, 22 bp, Homo sapiens
cacatctatagggacagcaaca

SEQ ID NO: 8396210 - DNA, 22 bp, Homo sapiens
cacatcttcttaactccaaagt

SEQ ID NO: 8396211 - DNA, 22 bp, Homo sapiens
caatgaaaatttaagttgcagc

SEQ ID NO: 8396212 - DNA, 22 bp, Homo sapiens
caatgaaagcaactgcctataa

SEQ ID NO: 8396213 - DNA, 22 bp, Homo sapiens
caacttcagggaaacatgaagc

SEQ ID NO: 8396214 - DNA, 22 bp, Homo sapiens
caactattaccatgttattgtc

SEQ ID NO: 8396215 - DNA, 17 bp, Homo sapiens
caacttcacaaactgtc

SEQ ID NO: 8396216 - DNA, 22 bp, Homo sapiens
caaatgtttttattctacaaca

SEQ ID NO: 8396217 - DNA, 22 bp, Homo sapiens
attttctatgttgtaattgtta

SEQ ID NO: 8396218 - DNA, 22 bp, Homo sapiens
cagaagaaatcattatctggac

SEQ ID NO: 8396219 - DNA, 22 bp, Homo sapiens
attcaaagcccagtaaacattg

SEQ ID NO: 8396220 - DNA, 22 bp, Homo sapiens
atgttaactgaagccattctcg

SEQ ID NO: 8396221 - DNA, 22 bp, Homo sapiens
atgtttgaaattgtaagtatat

SEQ ID NO: 8396222 - DNA, 22 bp, Homo sapiens
atgttacaatccaacaaaatta

SEQ ID NO: 8396223 - DNA, 22 bp, Homo sapiens
atgttttaaatatgtgtgtaaa

SEQ ID NO: 8396224 - DNA, 22 bp, Homo sapiens
atgtttgtgttacactctgcag

SEQ ID NO: 8396225 - DNA, 22 bp, Homo sapiens
atgtttgtgggataaacaaatg

SEQ ID NO: 8396226 - DNA, 22 bp, Homo sapiens
atgtttgtccctgacatcctct

SEQ ID NO: 8396227 - DNA, 22 bp, Homo sapiens
atgtttgtcaggattgtaatta

SEQ ID NO: 8396228 - DNA, 22 bp, Homo sapiens
atgtttgtaggtaagtgacact

SEQ ID NO: 8396229 - DNA, 22 bp, Homo sapiens
atgtttgttgaacatctactgc

SEQ ID NO: 8396230 - DNA, 22 bp, Homo sapiens
atttagcaaaaaatgatgaagc

SEQ ID NO: 8396231 - DNA, 22 bp, Homo sapiens
atttagcaagagtacaaaataa

SEQ ID NO: 8396232 - DNA, 23 bp, Homo sapiens
atttacaggttaaatgaaatcag

SEQ ID NO: 8396233 - DNA, 22 bp, Homo sapiens
attcttcctcatcaatctgtag

SEQ ID NO: 8396234 - DNA, 23 bp, Homo sapiens
attcttcattatcttctagaaaa

SEQ ID NO: 8396235 - DNA, 22 bp, Homo sapiens
attcttcatgttgaagctgtca

SEQ ID NO: 8396236 - DNA, 22 bp, Homo sapiens
atttgctttaaggtataaaagg

SEQ ID NO: 8396237 - DNA, 22 bp, Homo sapiens
atttgctttcaggtataaaagg

SEQ ID NO: 8396238 - DNA, 22 bp, Homo sapiens
agcaaacagtgtgctaagaaat

SEQ ID NO: 8396239 - DNA, 22 bp, Homo sapiens
atttgcttgtaaatgtatgcct

SEQ ID NO: 8396240 - DNA, 23 bp, Homo sapiens
agatgaaagcttcccatcacagt

SEQ ID NO: 8396241 - DNA, 22 bp, Homo sapiens
agatcttttggttattataaga

SEQ ID NO: 8396242 - DNA, 22 bp, Homo sapiens
agatgaaaatacgtgactttaa

SEQ ID NO: 8396243 - DNA, 22 bp, Homo sapiens
agatgaaagatttttatagaga

SEQ ID NO: 8396244 - DNA, 18 bp, Homo sapiens
agatgaaagcaaatgaca

SEQ ID NO: 8396245 - DNA, 22 bp, Homo sapiens
atttccaagaaagctttaggat

SEQ ID NO: 8396246 - DNA, 22 bp, Homo sapiens
atttccaaaaccacttattgcc

SEQ ID NO: 8396247 - DNA, 21 bp, Homo sapiens
atttccaaataaggtcacatt

SEQ ID NO: 8396248 - DNA, 22 bp, Homo sapiens
atttccaaggtaattttgagta

SEQ ID NO: 8396249 - DNA, 22 bp, Homo sapiens
agaattagtcacaattatagga

SEQ ID NO: 8396250 - DNA, 22 bp, Homo sapiens
agaatgatactctatgccaaat

SEQ ID NO: 8396251 - DNA, 22 bp, Homo sapiens
agacacagtgagtttctttccc

SEQ ID NO: 8396252 - DNA, 22 bp, Homo sapiens
atctttgtgaatctcaacttgg

SEQ ID NO: 8396253 - DNA, 22 bp, Homo sapiens
atggtttgtaacccaatactcc

SEQ ID NO: 8396254 - DNA, 22 bp, Homo sapiens
atgtcaaatgctgcaaactcat

SEQ ID NO: 8396255 - DNA, 22 bp, Homo sapiens
atgtacaggatggtgctcatct

SEQ ID NO: 8396256 - DNA, 22 bp, Homo sapiens
atgtacagtttctagactcaaa

SEQ ID NO: 8396257 - DNA, 22 bp, Homo sapiens
atgtacagtggaaactaacaaa

SEQ ID NO: 8396258 - DNA, 23 bp, Homo sapiens
atggaaatagcatgtgtcattta

SEQ ID NO: 8396259 - DNA, 19 bp, Homo sapiens
atggaaaattgtactcaat

SEQ ID NO: 8396260 - DNA, 19 bp, Homo sapiens
atggaaaattgtactcaat

SEQ ID NO: 8396261 - DNA, 22 bp, Homo sapiens
atggaaatacagccagagcaga

SEQ ID NO: 8396262 - DNA, 22 bp, Homo sapiens
caggaaaaggagactttagcac

SEQ ID NO: 8396263 - DNA, 22 bp, Homo sapiens
caggaaaaatgccaggagtcag

SEQ ID NO: 8396264 - DNA, 21 bp, Homo sapiens
caggaaaagcggaagtctagc

SEQ ID NO: 8396265 - DNA, 22 bp, Homo sapiens
agcttacaccccccaagattct

SEQ ID NO: 8396266 - DNA, 20 bp, Homo sapiens
agcttgcccctgtctttgcc

SEQ ID NO: 8396267 - DNA, 22 bp, Homo sapiens
aggaaattgagaatcagaataa

SEQ ID NO: 8396268 - DNA, 22 bp, Homo sapiens
aggaacaattgataaactcaca

SEQ ID NO: 8396269 - DNA, 22 bp, Homo sapiens
aggcacaggaatgtcatccagt

SEQ ID NO: 8396270 - DNA, 22 bp, Homo sapiens
catgaaaatgtcaagttctgct

SEQ ID NO: 8396271 - DNA, 22 bp, Homo sapiens
cattaacactttggatttagac

SEQ ID NO: 8396272 - DNA, 18 bp, Homo sapiens
cattccaagttctacctc

SEQ ID NO: 8396273 - DNA, 22 bp, Homo sapiens
cattcctacatgataagaatta

SEQ ID NO: 8396274 - DNA, 22 bp, Homo sapiens
aggccaaagcacagagctggaa

SEQ ID NO: 8396275 - DNA, 22 bp, Homo sapiens
aggcatatgattgtaaccttta

SEQ ID NO: 8396276 - DNA, 22 bp, Homo sapiens
ccagtgactggctttctggtgt

SEQ ID NO: 8396277 - DNA, 22 bp, Homo sapiens
ccatgaattcactccatgctag

SEQ ID NO: 8396278 - DNA, 22 bp, Homo sapiens
ctcaaatataagctaaatgtgg

SEQ ID NO: 8396279 - DNA, 22 bp, Homo sapiens
ctcaacatgcctactcagtctg

SEQ ID NO: 8396280 - DNA, 23 bp, Homo sapiens
ctcaacatccattcttgcccttc

SEQ ID NO: 8396281 - DNA, 22 bp, Homo sapiens
ctcaacatatgactttggtggg

SEQ ID NO: 8396282 - DNA, 22 bp, Homo sapiens
ctcaacatttaacagtgaaaaa

SEQ ID NO: 8396283 - DNA, 17 bp, Homo sapiens
agtgaaatttacattgc

SEQ ID NO: 8396284 - DNA, 22 bp, Homo sapiens
ccttgctgaccatcacctttga

SEQ ID NO: 8396285 - DNA, 20 bp, Homo sapiens
ataaaataactgccacaaga

SEQ ID NO: 8396286 - DNA, 22 bp, Homo sapiens
agtttgtaacctaagattcagg

SEQ ID NO: 8396287 - DNA, 22 bp, Homo sapiens
agtttgaaggagttgaatcacc

SEQ ID NO: 8396288 - DNA, 22 bp, Homo sapiens
agttggagtgaacatgagattg

SEQ ID NO: 8396289 - DNA, 22 bp, Homo sapiens
agttgtaacagattctaacata

SEQ ID NO: 8396290 - DNA, 22 bp, Homo sapiens
agttgtaataacaataccaaaa

SEQ ID NO: 8396291 - DNA, 22 bp, Homo sapiens
atacaagtggccacttgaattc

SEQ ID NO: 8396292 - DNA, 22 bp, Homo sapiens
atacagatcccacagcatgtga

SEQ ID NO: 8396293 - DNA, 22 bp, Homo sapiens
atacagatgagatcaggcataa

SEQ ID NO: 8396294 - DNA, 22 bp, Homo sapiens
atacagatgggtcagatttcat

SEQ ID NO: 8396295 - DNA, 22 bp, Homo sapiens
atacttcctgcttccctgatct

SEQ ID NO: 8396296 - DNA, 22 bp, Homo sapiens
atataatacaacctgctaagtg

SEQ ID NO: 8396297 - DNA, 22 bp, Homo sapiens
atatgattgtccttagcaaatt

SEQ ID NO: 8396298 - DNA, 22 bp, Homo sapiens
atatggtaagagtatatttact

SEQ ID NO: 8396299 - DNA, 22 bp, Homo sapiens
atatgtatgtacgcacatattc

SEQ ID NO: 8396300 - DNA, 22 bp, Homo sapiens
atatgtatagccagtctttagg

SEQ ID NO: 8396301 - DNA, 22 bp, Homo sapiens
atatgtgaatgatatcactttg

SEQ ID NO: 8396302 - DNA, 22 bp, Homo sapiens
atatttgtagtgggtaagaagt

SEQ ID NO: 8396303 - DNA, 22 bp, Homo sapiens
atatttgtaaaattctgtgtct

SEQ ID NO: 8396304 - DNA, 22 bp, Homo sapiens
atatttgcaggaaactagtttt

SEQ ID NO: 8396305 - DNA, 22 bp, Homo sapiens
atatttggaaagaaaatcattg

SEQ ID NO: 8396306 - DNA, 22 bp, Homo sapiens
ctgtgcaaaggccttatgtttt

SEQ ID NO: 8396307 - DNA, 22 bp, Homo sapiens
atcatgctgacacagtttatct

SEQ ID NO: 8396308 - DNA, 22 bp, Homo sapiens
atcatgcttggattatgtttgg

SEQ ID NO: 8396309 - DNA, 22 bp, Homo sapiens
atatttgtcaattcactgttca

SEQ ID NO: 8396310 - DNA, 22 bp, Homo sapiens
atatttgtatttcgtgtgtgta

SEQ ID NO: 8396311 - DNA, 22 bp, Homo sapiens
atatttgtggtttttggctcct

SEQ ID NO: 8396312 - DNA, 22 bp, Homo sapiens
atatttgtggtaaaggtaagaa

SEQ ID NO: 8396313 - DNA, 22 bp, Homo sapiens
atatttgtcatctgccttagtt

SEQ ID NO: 8396314 - DNA, 18 bp, Homo sapiens
atccaactatcgctcatt

SEQ ID NO: 8396315 - DNA, 22 bp, Homo sapiens
caccatttaagaaagccaaatt

SEQ ID NO: 8396316 - DNA, 22 bp, Homo sapiens
caaggcagctattgtctccata

SEQ ID NO: 8396317 - DNA, 22 bp, Homo sapiens
cacaatttccttgcttcacttt

SEQ ID NO: 8396318 - DNA, 18 bp, Homo sapiens
cacaatttacagatgaca

SEQ ID NO: 8396319 - DNA, 22 bp, Homo sapiens
cacaatttccaagtcatgttat

SEQ ID NO: 8396320 - DNA, 22 bp, Homo sapiens
cacaaaatatcaagcactttta

SEQ ID NO: 8396321 - DNA, 22 bp, Homo sapiens
caacatttgagtaaagaaatgg

SEQ ID NO: 8396322 - DNA, 22 bp, Homo sapiens
caacatttcaaggtctttagga

SEQ ID NO: 8396323 - DNA, 22 bp, Homo sapiens
caacatttgtgatgagcaaact

SEQ ID NO: 8396324 - DNA, 22 bp, Homo sapiens
caacatatgattttgtatataa

SEQ ID NO: 8396325 - DNA, 22 bp, Homo sapiens
caacatctgtatcattagtaca

SEQ ID NO: 8396326 - DNA, 22 bp, Homo sapiens
caaagtatattggattgaatgg

SEQ ID NO: 8396327 - DNA, 19 bp, Homo sapiens
caaagtacctggcacagtg

SEQ ID NO: 8396328 - DNA, 22 bp, Homo sapiens
caaagtacagtgcttcctggga

SEQ ID NO: 8396329 - DNA, 22 bp, Homo sapiens
caaagtaatttggagatatata

SEQ ID NO: 8396330 - DNA, 22 bp, Homo sapiens
caagatcaaggtgtcagcaggt

SEQ ID NO: 8396331 - DNA, 22 bp, Homo sapiens
caagatcaaggtatcagcagat

SEQ ID NO: 8396332 - DNA, 22 bp, Homo sapiens
caagatattgatttccagctga

SEQ ID NO: 8396333 - DNA, 22 bp, Homo sapiens
caagatatgtcctgttactaag

SEQ ID NO: 8396334 - DNA, 22 bp, Homo sapiens
caagatatcaatgacatagtat

SEQ ID NO: 8396335 - DNA, 22 bp, Homo sapiens
caagatatatgtatgattccat

SEQ ID NO: 8396336 - DNA, 22 bp, Homo sapiens
gtaaaattctagcatctgaaag

SEQ ID NO: 8396337 - DNA, 22 bp, Homo sapiens
gtaaacaagtctaccattagaa

SEQ ID NO: 8396338 - DNA, 22 bp, Homo sapiens
cagcattttccatagaaagaag

SEQ ID NO: 8396339 - DNA, 22 bp, Homo sapiens
cagcatttggaggagaggcttt

SEQ ID NO: 8396340 - DNA, 22 bp, Homo sapiens
gtattttactgctcaaagctct

SEQ ID NO: 8396341 - DNA, 22 bp, Homo sapiens
gtatttgtagtagcatagaatt

SEQ ID NO: 8396342 - DNA, 22 bp, Homo sapiens
gtatttgtcttgttggtctcca

SEQ ID NO: 8396343 - DNA, 22 bp, Homo sapiens
atggaaatgtaacttctgattc

SEQ ID NO: 8396344 - DNA, 21 bp, Homo sapiens
atggaaattggcaaatgctac

SEQ ID NO: 8396345 - DNA, 22 bp, Homo sapiens
atggaaatgatggaacattaaa

SEQ ID NO: 8396346 - DNA, 22 bp, Homo sapiens
atggaaaaggctgatttcatta

SEQ ID NO: 8396347 - DNA, 22 bp, Homo sapiens
atggagatttttagaattacag

SEQ ID NO: 8396348 - DNA, 22 bp, Homo sapiens
atgtgtattttgtactattggg

SEQ ID NO: 8396349 - DNA, 22 bp, Homo sapiens
atgtctttcaaattctgcctag

SEQ ID NO: 8396350 - DNA, 22 bp, Homo sapiens
atgtctttataaatgtataatg

SEQ ID NO: 8396351 - DNA, 22 bp, Homo sapiens
atgtgaaaaatttcttattaca

SEQ ID NO: 8396352 - DNA, 22 bp, Homo sapiens
atgtgaaaatccaatggcagca

SEQ ID NO: 8396353 - DNA, 22 bp, Homo sapiens
atgcaaataaagcaactataca

SEQ ID NO: 8396354 - DNA, 20 bp, Homo sapiens
atgcaaatcccaaaatcagg

SEQ ID NO: 8396355 - DNA, 22 bp, Homo sapiens
atgaagatttataattgccttt

SEQ ID NO: 8396356 - DNA, 22 bp, Homo sapiens
atgaagatttcccagagacatg

SEQ ID NO: 8396357 - DNA, 22 bp, Homo sapiens
atgattttttctaacacagtcg

SEQ ID NO: 8396358 - DNA, 22 bp, Homo sapiens
atgaaatggtggttttccattt

SEQ ID NO: 8396359 - DNA, 22 bp, Homo sapiens
atgaaatatcttgaagaaattc

SEQ ID NO: 8396360 - DNA, 22 bp, Homo sapiens
atgaaatgtgaatgcttttcat

SEQ ID NO: 8396361 - DNA, 22 bp, Homo sapiens
atgaaattaatcaacacataca

SEQ ID NO: 8396362 - DNA, 22 bp, Homo sapiens
cttgttgctaacatatgcttct

SEQ ID NO: 8396363 - DNA, 22 bp, Homo sapiens
atgaaaacggaccagagctatt

SEQ ID NO: 8396364 - DNA, 22 bp, Homo sapiens
atctacaggatagtttaatatt

SEQ ID NO: 8396365 - DNA, 22 bp, Homo sapiens
atcttctatagatattctgaag

SEQ ID NO: 8396366 - DNA, 22 bp, Homo sapiens
atcttctggtcaaatttttgca

SEQ ID NO: 8396367 - DNA, 22 bp, Homo sapiens
caaactgagcatcagaaagttt

SEQ ID NO: 8396368 - DNA, 22 bp, Homo sapiens
caaactgaacacgaaagtcttt

SEQ ID NO: 8396369 - DNA, 22 bp, Homo sapiens
caaacttttcctggaaaagatt

SEQ ID NO: 8396370 - DNA, 22 bp, Homo sapiens
caaactttcagttataacatga

SEQ ID NO: 8396371 - DNA, 21 bp, Homo sapiens
caaaacttaggtgacttagga

SEQ ID NO: 8396372 - DNA, 22 bp, Homo sapiens
caaaacattctctgcagcaggg

SEQ ID NO: 8396373 - DNA, 22 bp, Homo sapiens
caaaaaacacctgtgtgagtat

SEQ ID NO: 8396374 - DNA, 22 bp, Homo sapiens
caaaacattcagagagctcact

SEQ ID NO: 8396375 - DNA, 22 bp, Homo sapiens
atttacagaagcatgtaatagc

SEQ ID NO: 8396376 - DNA, 22 bp, Homo sapiens
attgcttactaatcatcttcag

SEQ ID NO: 8396377 - DNA, 22 bp, Homo sapiens
atttattgagacttaacaaccc

SEQ ID NO: 8396378 - DNA, 22 bp, Homo sapiens
atttcatggtacatcgtgactt

SEQ ID NO: 8396379 - DNA, 22 bp, Homo sapiens
atttcatggcagactttaaccc

SEQ ID NO: 8396380 - DNA, 22 bp, Homo sapiens
atttcatctctggaacataact

SEQ ID NO: 8396381 - DNA, 22 bp, Homo sapiens
atttcctagggtagatgtcaca

SEQ ID NO: 8396382 - DNA, 22 bp, Homo sapiens
atttcatgtgaagaagagataa

SEQ ID NO: 8396383 - DNA, 21 bp, Homo sapiens
atttcatggtgcttttaagaa

SEQ ID NO: 8396384 - DNA, 22 bp, Homo sapiens
attaagatgtgggaaaatttaa

SEQ ID NO: 8396385 - DNA, 22 bp, Homo sapiens
attaatatcctgctggctaaat

SEQ ID NO: 8396386 - DNA, 22 bp, Homo sapiens
attattgccagctattacaaca

SEQ ID NO: 8396387 - DNA, 22 bp, Homo sapiens
gcaagttatttccatttaaagc

SEQ ID NO: 8396388 - DNA, 22 bp, Homo sapiens
attaaaagcttcccaagagtta

SEQ ID NO: 8396389 - DNA, 22 bp, Homo sapiens
attaaaagagataatgtgtgtt

SEQ ID NO: 8396390 - DNA, 22 bp, Homo sapiens
atgttttattaccaacttgtac

SEQ ID NO: 8396391 - DNA, 22 bp, Homo sapiens
attcttaattccaaagactgag

SEQ ID NO: 8396392 - DNA, 22 bp, Homo sapiens
attcttaattgccatgctgtat

SEQ ID NO: 8396393 - DNA, 22 bp, Homo sapiens
attctatagacagaaggtcaat

SEQ ID NO: 8396394 - DNA, 22 bp, Homo sapiens
attgaagagttgattattatct

SEQ ID NO: 8396395 - DNA, 22 bp, Homo sapiens
attgacaagcagtatgtcttag

SEQ ID NO: 8396396 - DNA, 22 bp, Homo sapiens
attcagtgtgaggttttcaagt

SEQ ID NO: 8396397 - DNA, 22 bp, Homo sapiens
attcagtgtagttattatcttt

SEQ ID NO: 8396398 - DNA, 22 bp, Homo sapiens
attctactttgtgtaattatct

SEQ ID NO: 8396399 - DNA, 23 bp, Homo sapiens
tatgtgcatatgtgtaagaatac

SEQ ID NO: 8396400 - DNA, 18 bp, Homo sapiens
tatgtgcatatgtgtgta

SEQ ID NO: 8396401 - DNA, 22 bp, Homo sapiens
cagtgcccaagatgtgccatgc

SEQ ID NO: 8396402 - DNA, 22 bp, Homo sapiens
tcatttcaagttctgacagcta

SEQ ID NO: 8396403 - DNA, 18 bp, Homo sapiens
tcatttgttttgcatgaa

SEQ ID NO: 8396404 - DNA, 22 bp, Homo sapiens
catatacttttctatagctttc

SEQ ID NO: 8396405 - DNA, 22 bp, Homo sapiens
catatgaaatatgagttgaaca

SEQ ID NO: 8396406 - DNA, 22 bp, Homo sapiens
catatgaagttcaacagagatg

SEQ ID NO: 8396407 - DNA, 23 bp, Homo sapiens
catatgaattttagaggcagttt

SEQ ID NO: 8396408 - DNA, 21 bp, Homo sapiens
catatgaaagaagtatctgac

SEQ ID NO: 8396409 - DNA, 23 bp, Homo sapiens
catatgaaagtagacactttcca

SEQ ID NO: 8396410 - DNA, 22 bp, Homo sapiens
catatcttatggttttctaagt

SEQ ID NO: 8396411 - DNA, 22 bp, Homo sapiens
catccaatgtcctattaagact

SEQ ID NO: 8396412 - DNA, 22 bp, Homo sapiens
catccaataccagtttgcaggc

SEQ ID NO: 8396413 - DNA, 22 bp, Homo sapiens
catcacaaatgtaataatgtct

SEQ ID NO: 8396414 - DNA, 22 bp, Homo sapiens
catacttttgccctgacattct

SEQ ID NO: 8396415 - DNA, 22 bp, Homo sapiens
catacattgctcattcagtatc

SEQ ID NO: 8396416 - DNA, 22 bp, Homo sapiens
catacatttatacacatctatg

SEQ ID NO: 8396417 - DNA, 22 bp, Homo sapiens
cagtttctttccattgttacct

SEQ ID NO: 8396418 - DNA, 22 bp, Homo sapiens
tcagaagtaggagacattcttg

SEQ ID NO: 8396419 - DNA, 22 bp, Homo sapiens
tcagaagtcccagaattcacat

SEQ ID NO: 8396420 - DNA, 22 bp, Homo sapiens
catttagagtcttgcaatttta

SEQ ID NO: 8396421 - DNA, 22 bp, Homo sapiens
catttagtccttgacttctctc

SEQ ID NO: 8396422 - DNA, 19 bp, Homo sapiens
catttagaagtacatatta

SEQ ID NO: 8396423 - DNA, 22 bp, Homo sapiens
catttagagaagattacaagga

SEQ ID NO: 8396424 - DNA, 22 bp, Homo sapiens
ccaaagtattaaatcttagcaa

SEQ ID NO: 8396425 - DNA, 22 bp, Homo sapiens
ccaaagtaaggcaattcctaaa

SEQ ID NO: 8396426 - DNA, 22 bp, Homo sapiens
catttgaagaagaaacgtacta

SEQ ID NO: 8396427 - DNA, 22 bp, Homo sapiens
catttgaactaataactgtgct

SEQ ID NO: 8396428 - DNA, 22 bp, Homo sapiens
catttgcagagggtgacactct

SEQ ID NO: 8396429 - DNA, 22 bp, Homo sapiens
ccaattgtcctaattaattaga

SEQ ID NO: 8396430 - DNA, 20 bp, Homo sapiens
ccaatgtttacagattactt

SEQ ID NO: 8396431 - DNA, 22 bp, Homo sapiens
ccaaagtttttatagttagcat

SEQ ID NO: 8396432 - DNA, 22 bp, Homo sapiens
ccaaatattaacaaagtaattt

SEQ ID NO: 8396433 - DNA, 22 bp, Homo sapiens
ccaaatgtgcctgtttcaacaa

SEQ ID NO: 8396434 - DNA, 20 bp, Homo sapiens
ccaaatgtggagaaaaagta

SEQ ID NO: 8396435 - DNA, 22 bp, Homo sapiens
gtttcaaaagtcaggctattct

SEQ ID NO: 8396436 - DNA, 22 bp, Homo sapiens
gtttcaaaatgatgctgtaact

SEQ ID NO: 8396437 - DNA, 22 bp, Homo sapiens
gtttcaaagcacagctcacatt

SEQ ID NO: 8396438 - DNA, 22 bp, Homo sapiens
gtttgcatttcttgaactatat

SEQ ID NO: 8396439 - DNA, 22 bp, Homo sapiens
gtttgctaatttaaagctattt

SEQ ID NO: 8396440 - DNA, 22 bp, Homo sapiens
caggaaatttatgttctactta

SEQ ID NO: 8396441 - DNA, 22 bp, Homo sapiens
gttaaaagaacaactcggaggt

SEQ ID NO: 8396442 - DNA, 20 bp, Homo sapiens
gttaaaagagtaatttgagg

SEQ ID NO: 8396443 - DNA, 22 bp, Homo sapiens
cagcttacctcccacagctctc

SEQ ID NO: 8396444 - DNA, 22 bp, Homo sapiens
gttaccattgtctaggtcattg

SEQ ID NO: 8396445 - DNA, 22 bp, Homo sapiens
gttacatttggtgatttggtgc

SEQ ID NO: 8396446 - DNA, 22 bp, Homo sapiens
gttacatttattagaggtctct

SEQ ID NO: 8396447 - DNA, 22 bp, Homo sapiens
gttacattaggataatttgctg

SEQ ID NO: 8396448 - DNA, 22 bp, Homo sapiens
gttacattacttgtgcagttgt

SEQ ID NO: 8396449 - DNA, 22 bp, Homo sapiens
gttacattaaaaacattcactg

SEQ ID NO: 8396450 - DNA, 22 bp, Homo sapiens
caggaaaatggaatcacctgta

SEQ ID NO: 8396451 - DNA, 22 bp, Homo sapiens
caggaaaatgtcaatggaaagc

SEQ ID NO: 8396452 - DNA, 22 bp, Homo sapiens
caggaaaatctgcccacacaag

SEQ ID NO: 8396453 - DNA, 22 bp, Homo sapiens
taacaaagtattgtttgtgtat

SEQ ID NO: 8396454 - DNA, 22 bp, Homo sapiens
taacaaagtaccatagactgga

SEQ ID NO: 8396455 - DNA, 22 bp, Homo sapiens
taacaaaggttgccaaactaag

SEQ ID NO: 8396456 - DNA, 18 bp, Homo sapiens
taaatatatttccccctt

SEQ ID NO: 8396457 - DNA, 22 bp, Homo sapiens
taaatatcacctggaattgtta

SEQ ID NO: 8396458 - DNA, 22 bp, Homo sapiens
gtttgtaaccagaacagagagt

SEQ ID NO: 8396459 - DNA, 22 bp, Homo sapiens
gtttgtaattactgcagcatgg

SEQ ID NO: 8396460 - DNA, 21 bp, Homo sapiens
gtttgtaaggcactgtgttct

SEQ ID NO: 8396461 - DNA, 22 bp, Homo sapiens
taaacatttgttattcttgttt

SEQ ID NO: 8396462 - DNA, 22 bp, Homo sapiens
taaactgaagctcaactcaaat

SEQ ID NO: 8396463 - DNA, 22 bp, Homo sapiens
taaaatgacttcctccaacatc

SEQ ID NO: 8396464 - DNA, 22 bp, Homo sapiens
taaaatcattctggtgtcagta

SEQ ID NO: 8396465 - DNA, 22 bp, Homo sapiens
taaaatcgcactgctgttgtta

SEQ ID NO: 8396466 - DNA, 22 bp, Homo sapiens
taaaatcatgacagattgacat

SEQ ID NO: 8396467 - DNA, 22 bp, Homo sapiens
taaaaaacattactctgtcctg

SEQ ID NO: 8396468 - DNA, 23 bp, Homo sapiens
tacaaggtagcattagtttcttc

SEQ ID NO: 8396469 - DNA, 22 bp, Homo sapiens
tacaaggttgtactttctctct

SEQ ID NO: 8396470 - DNA, 22 bp, Homo sapiens
tacatattgtccatagttgctt

SEQ ID NO: 8396471 - DNA, 22 bp, Homo sapiens
tacatatttgtctttgtactgt

SEQ ID NO: 8396472 - DNA, 22 bp, Homo sapiens
tacatatgtaaacatgtataaa

SEQ ID NO: 8396473 - DNA, 20 bp, Homo sapiens
tacatattatatcagctgca

SEQ ID NO: 8396474 - DNA, 22 bp, Homo sapiens
tacatgtggccagaaatttgag

SEQ ID NO: 8396475 - DNA, 22 bp, Homo sapiens
taacacttgggggcatccttag

SEQ ID NO: 8396476 - DNA, 20 bp, Homo sapiens
taacacttgctttttgactt

SEQ ID NO: 8396477 - DNA, 22 bp, Homo sapiens
taacacttcagatgattttgtt

SEQ ID NO: 8396478 - DNA, 22 bp, Homo sapiens
taacacttgaagccatttttgc

SEQ ID NO: 8396479 - DNA, 22 bp, Homo sapiens
taacaagtcattttatcagcag

SEQ ID NO: 8396480 - DNA, 22 bp, Homo sapiens
taacaagtttcatttatagaat

SEQ ID NO: 8396481 - DNA, 22 bp, Homo sapiens
taacaagttctgacagcattgt

SEQ ID NO: 8396482 - DNA, 22 bp, Homo sapiens
taacaagatttgtaaaattgta

SEQ ID NO: 8396483 - DNA, 22 bp, Homo sapiens
taacaagtcattttaaattatg

SEQ ID NO: 8396484 - DNA, 22 bp, Homo sapiens
taacattccctttgtgccaagg

SEQ ID NO: 8396485 - DNA, 22 bp, Homo sapiens
taagaaacatttttatgacagt

SEQ ID NO: 8396486 - DNA, 22 bp, Homo sapiens
taacttttacttaccatctgag

SEQ ID NO: 8396487 - DNA, 21 bp, Homo sapiens
taacttttgtgcctatcttgt

SEQ ID NO: 8396488 - DNA, 16 bp, Homo sapiens
taacatttttaaaagg

SEQ ID NO: 8396489 - DNA, 22 bp, Homo sapiens
taacatttaaatttttcacata

SEQ ID NO: 8396490 - DNA, 22 bp, Homo sapiens
taacatttagaaagtgtccatt

SEQ ID NO: 8396491 - DNA, 22 bp, Homo sapiens
taacatttcggtgacagtggga

SEQ ID NO: 8396492 - DNA, 22 bp, Homo sapiens
caggatttcatacatctttact

SEQ ID NO: 8396493 - DNA, 22 bp, Homo sapiens
taagatttttaaaatgtcctca

SEQ ID NO: 8396494 - DNA, 22 bp, Homo sapiens
tgctgaatggtaaagaagtata

SEQ ID NO: 8396495 - DNA, 22 bp, Homo sapiens
tgctgaatcaaaacaaaggttt

SEQ ID NO: 8396496 - DNA, 21 bp, Homo sapiens
tgctgaatctgccatattttc

SEQ ID NO: 8396497 - DNA, 22 bp, Homo sapiens
tgcatcaacctaatatcagctc

SEQ ID NO: 8396498 - DNA, 22 bp, Homo sapiens
tgtgttcaatgacttcatcttt

SEQ ID NO: 8396499 - DNA, 22 bp, Homo sapiens
tgtgttcatgtatgtatacata

SEQ ID NO: 8396500 - DNA, 22 bp, Homo sapiens
tgtgttcagcaggcaccttctt

SEQ ID NO: 8396501 - DNA, 22 bp, Homo sapiens
tgtgttccttcgtcttcccttc

SEQ ID NO: 8396502 - DNA, 22 bp, Homo sapiens
tgtgttcattagcattgccttg

SEQ ID NO: 8396503 - DNA, 22 bp, Homo sapiens
tgtataaaccatggacagcttt

SEQ ID NO: 8396504 - DNA, 19 bp, Homo sapiens
ctgaaaaacattctcagga

SEQ ID NO: 8396505 - DNA, 22 bp, Homo sapiens
tttgtctttcccctcctcattg

SEQ ID NO: 8396506 - DNA, 22 bp, Homo sapiens
tttgtgaacaaacatgaagatg

SEQ ID NO: 8396507 - DNA, 22 bp, Homo sapiens
tttgtgaataagagaatgacag

SEQ ID NO: 8396508 - DNA, 19 bp, Homo sapiens
tttgtgaagaaaatgatgc

SEQ ID NO: 8396509 - DNA, 22 bp, Homo sapiens
tttgtacatcctaattctgagt

SEQ ID NO: 8396510 - DNA, 22 bp, Homo sapiens
tttcagtgttatgactttcatt

SEQ ID NO: 8396511 - DNA, 22 bp, Homo sapiens
tttaacagatgctatgtctacc

SEQ ID NO: 8396512 - DNA, 22 bp, Homo sapiens
tttaaaaggggtattaagtcca

SEQ ID NO: 8396513 - DNA, 22 bp, Homo sapiens
tttaaaaggcagcttcttttgt

SEQ ID NO: 8396514 - DNA, 22 bp, Homo sapiens
ttgtatttgattgtcatatcgt

SEQ ID NO: 8396515 - DNA, 22 bp, Homo sapiens
ttgttaaatggatgcagaataa

SEQ ID NO: 8396516 - DNA, 22 bp, Homo sapiens
ttgttacacataataacatttt

SEQ ID NO: 8396517 - DNA, 22 bp, Homo sapiens
ttgtattttgttatgctactgc

SEQ ID NO: 8396518 - DNA, 22 bp, Homo sapiens
tttaaaaaactagtctgagtct

SEQ ID NO: 8396519 - DNA, 22 bp, Homo sapiens
tttaaaaaactagtctgagtct

SEQ ID NO: 8396520 - DNA, 22 bp, Homo sapiens
ttggaaaaacacgatagtggtt

SEQ ID NO: 8396521 - DNA, 22 bp, Homo sapiens
ttggaaaaattgcctgatgtct

SEQ ID NO: 8396522 - DNA, 22 bp, Homo sapiens
ttcacattaagcctcctcctac

SEQ ID NO: 8396523 - DNA, 22 bp, Homo sapiens
ttccatttttctaactctcaga

SEQ ID NO: 8396524 - DNA, 22 bp, Homo sapiens
ttccaaatgcccatctacacag

SEQ ID NO: 8396525 - DNA, 20 bp, Homo sapiens
ctaatattctactctaagga

SEQ ID NO: 8396526 - DNA, 22 bp, Homo sapiens
ttcttgtactggagatacatga

SEQ ID NO: 8396527 - DNA, 22 bp, Homo sapiens
ctatttttctgtaccctaattt

SEQ ID NO: 8396528 - DNA, 22 bp, Homo sapiens
ctatttgtcacaactggtgttt

SEQ ID NO: 8396529 - DNA, 22 bp, Homo sapiens
ctatttgtcagtttggctttaa

SEQ ID NO: 8396530 - DNA, 22 bp, Homo sapiens
ctatttgtacagcattcgagtt

SEQ ID NO: 8396531 - DNA, 22 bp, Homo sapiens
ttctgtatttcaatgtctttat

SEQ ID NO: 8396532 - DNA, 22 bp, Homo sapiens
ttctgtatctctgtgtttcttg

SEQ ID NO: 8396533 - DNA, 22 bp, Homo sapiens
ttctgtatacgttacaattgag

SEQ ID NO: 8396534 - DNA, 22 bp, Homo sapiens
ctatttctgcctaatgacctgt

SEQ ID NO: 8396535 - DNA, 22 bp, Homo sapiens
ctatttgtaagagccccacacc

SEQ ID NO: 8396536 - DNA, 22 bp, Homo sapiens
ctatttgtaaagtgcctggtgt

SEQ ID NO: 8396537 - DNA, 22 bp, Homo sapiens
ctatttgtacagcattagtaat

SEQ ID NO: 8396538 - DNA, 22 bp, Homo sapiens
ctatttctaaacctataagtga

SEQ ID NO: 8396539 - DNA, 18 bp, Homo sapiens
gccatgttctatgcttac

SEQ ID NO: 8396540 - DNA, 22 bp, Homo sapiens
gccaatctttgactatatgtgt

SEQ ID NO: 8396541 - DNA, 22 bp, Homo sapiens
gatttcttgataattcaaatcc

SEQ ID NO: 8396542 - DNA, 22 bp, Homo sapiens
gatttgtagcttttcagtctgt

SEQ ID NO: 8396543 - DNA, 22 bp, Homo sapiens
gattttattagcccaaactttg

SEQ ID NO: 8396544 - DNA, 22 bp, Homo sapiens
gattttaattataggaggtcct

SEQ ID NO: 8396545 - DNA, 21 bp, Homo sapiens
gattttaaagagactgccaca

SEQ ID NO: 8396546 - DNA, 22 bp, Homo sapiens
gatttgtttcaagttagcatct

SEQ ID NO: 8396547 - DNA, 22 bp, Homo sapiens
gattttatatggcatactgtgg

SEQ ID NO: 8396548 - DNA, 22 bp, Homo sapiens
gattttatagtcaggaaaaaga

SEQ ID NO: 8396549 - DNA, 22 bp, Homo sapiens
gatttttatataaagtgagaaa

SEQ ID NO: 8396550 - DNA, 22 bp, Homo sapiens
gattgtaaaacagatcattatc

SEQ ID NO: 8396551 - DNA, 22 bp, Homo sapiens
gatgtttggctcaaacgagtgt

SEQ ID NO: 8396552 - DNA, 22 bp, Homo sapiens
gatgtttctgggaaggaaaagt

SEQ ID NO: 8396553 - DNA, 22 bp, Homo sapiens
gatgtttcccgttaagagaaaa

SEQ ID NO: 8396554 - DNA, 22 bp, Homo sapiens
gattctttacatctctgctgac

SEQ ID NO: 8396555 - DNA, 22 bp, Homo sapiens
gagaaaatcttgggtcaagaat

SEQ ID NO: 8396556 - DNA, 22 bp, Homo sapiens
gacttcagatattttttaagtt

SEQ ID NO: 8396557 - DNA, 22 bp, Homo sapiens
gaagttagtgtaatgcagggtg

SEQ ID NO: 8396558 - DNA, 22 bp, Homo sapiens
gaagttagtgtggatgcaggga

SEQ ID NO: 8396559 - DNA, 22 bp, Homo sapiens
gaagttagttggggcccaagaa

SEQ ID NO: 8396560 - DNA, 18 bp, Homo sapiens
gaagttagtggtgtgcta

SEQ ID NO: 8396561 - DNA, 22 bp, Homo sapiens
gaagttagtcttgaagttagtc

SEQ ID NO: 8396562 - DNA, 22 bp, Homo sapiens
gaagttagtcattgaagcccca

SEQ ID NO: 8396563 - DNA, 22 bp, Homo sapiens
gaagttagtacctggtatactt

SEQ ID NO: 8396564 - DNA, 22 bp, Homo sapiens
gaagttaggctttcctatgctt

SEQ ID NO: 8396565 - DNA, 22 bp, Homo sapiens
gaagttagatgtggtcactgac

SEQ ID NO: 8396566 - DNA, 22 bp, Homo sapiens
gaacttagtagtctacttctta

SEQ ID NO: 8396567 - DNA, 22 bp, Homo sapiens
gaaaacatccagagatagacct

SEQ ID NO: 8396568 - DNA, 22 bp, Homo sapiens
gaaatacaaagccagccatttt

SEQ ID NO: 8396569 - DNA, 22 bp, Homo sapiens
gaaataacagctctggaagagt

SEQ ID NO: 8396570 - DNA, 19 bp, Homo sapiens
gaacacttactatatttct

SEQ ID NO: 8396571 - DNA, 22 bp, Homo sapiens
gaacacttgctgttaataagtg

SEQ ID NO: 8396572 - DNA, 22 bp, Homo sapiens
gaacacttggctttggatttaa

SEQ ID NO: 8396573 - DNA, 22 bp, Homo sapiens
gaacactttaacattccttttc

SEQ ID NO: 8396574 - DNA, 22 bp, Homo sapiens
gaactcaacacagtatttggta

SEQ ID NO: 8396575 - DNA, 22 bp, Homo sapiens
cttgaaaataagaaagactttc

SEQ ID NO: 8396576 - DNA, 22 bp, Homo sapiens
gagataaatttttgataaatat

SEQ ID NO: 8396577 - DNA, 22 bp, Homo sapiens
gaggtcatctgttttggttact

SEQ ID NO: 8396578 - DNA, 22 bp, Homo sapiens
gatgaaaaattgctgtgtcata

SEQ ID NO: 8396579 - DNA, 22 bp, Homo sapiens
gatgaaaatcttgagatgtcga

SEQ ID NO: 8396580 - DNA, 22 bp, Homo sapiens
gatgaaaaaagacgagcatata

SEQ ID NO: 8396581 - DNA, 22 bp, Homo sapiens
gatcaacaacttttgaatagct

SEQ ID NO: 8396582 - DNA, 22 bp, Homo sapiens
gatcaacaaatgtcctttgtga

SEQ ID NO: 8396583 - DNA, 22 bp, Homo sapiens
gagtgttttactcaaagaaaga

SEQ ID NO: 8396584 - DNA, 21 bp, Homo sapiens
gagtggaacgctcttcacacc

SEQ ID NO: 8396585 - DNA, 22 bp, Homo sapiens
ggaaagatttgtcacatgaatg

SEQ ID NO: 8396586 - DNA, 22 bp, Homo sapiens
ggaaagatgtaatattatctaa

SEQ ID NO: 8396587 - DNA, 22 bp, Homo sapiens
ggaaaacaagagaatgatgttt

SEQ ID NO: 8396588 - DNA, 20 bp, Homo sapiens
ggaaaaatgcatgctcaaga

SEQ ID NO: 8396589 - DNA, 20 bp, Homo sapiens
gcttcagtttcctcactggt

SEQ ID NO: 8396590 - DNA, 22 bp, Homo sapiens
gcttacaaacaacagaaattaa

SEQ ID NO: 8396591 - DNA, 22 bp, Homo sapiens
gtgtaaggtgaaatcaacaaat

SEQ ID NO: 8396592 - DNA, 22 bp, Homo sapiens
gtttaataatgttgaattacta

SEQ ID NO: 8396593 - DNA, 22 bp, Homo sapiens
taaatgaagaaatggagattgt

SEQ ID NO: 8396594 - DNA, 22 bp, Homo sapiens
gtacagaaagtacccatagaag

SEQ ID NO: 8396595 - DNA, 22 bp, Homo sapiens
gtacagattaataatatactga

SEQ ID NO: 8396596 - DNA, 22 bp, Homo sapiens
gtacattcagcttagcacttct

SEQ ID NO: 8396597 - DNA, 22 bp, Homo sapiens
gtacagttttcagtgttcactg

SEQ ID NO: 8396598 - DNA, 22 bp, Homo sapiens
tcttatacccctaaactgcagc

SEQ ID NO: 8396599 - DNA, 23 bp, Homo sapiens
tctgttttgcaacatgtgacaag

SEQ ID NO: 8396600 - DNA, 22 bp, Homo sapiens
tctttaatgtgattgtaattat

SEQ ID NO: 8396601 - DNA, 22 bp, Homo sapiens
tctttaattgtggaagagcagc

SEQ ID NO: 8396602 - DNA, 22 bp, Homo sapiens
tctttagaaacttttcttcatg

SEQ ID NO: 8396603 - DNA, 22 bp, Homo sapiens
tctttataaaagtcattatgtc

SEQ ID NO: 8396604 - DNA, 20 bp, Homo sapiens
tctttagatttatcttatgt

SEQ ID NO: 8396605 - DNA, 22 bp, Homo sapiens
tctttcaatgagcattctttcc

SEQ ID NO: 8396606 - DNA, 22 bp, Homo sapiens
tctttgaactctgtgtattaac

SEQ ID NO: 8396607 - DNA, 22 bp, Homo sapiens
tctttgaactttttgtaagtta

SEQ ID NO: 8396608 - DNA, 22 bp, Homo sapiens
tctttgaagttgaagtagttgg

SEQ ID NO: 8396609 - DNA, 22 bp, Homo sapiens
tctttgaagtatcttaaatggt

SEQ ID NO: 8396610 - DNA, 22 bp, Homo sapiens
tctttgaattcaaactgttcaa

SEQ ID NO: 8396611 - DNA, 22 bp, Homo sapiens
tctttctacattttatatgctt

SEQ ID NO: 8396612 - DNA, 22 bp, Homo sapiens
tcttccttctttgatgacaagg

SEQ ID NO: 8396613 - DNA, 22 bp, Homo sapiens
tcttctttgaatcatagtgacc

SEQ ID NO: 8396614 - DNA, 22 bp, Homo sapiens
tcttgaaagcattttcttcatc

SEQ ID NO: 8396615 - DNA, 21 bp, Homo sapiens
tcttgaaaagttagattctct

SEQ ID NO: 8396616 - DNA, 22 bp, Homo sapiens
tcttcaaagaattttagtaatt

SEQ ID NO: 8396617 - DNA, 22 bp, Homo sapiens
tcttcaaatgctagtaatatca

SEQ ID NO: 8396618 - DNA, 22 bp, Homo sapiens
tcttcaaatacagtcatattga

SEQ ID NO: 8396619 - DNA, 22 bp, Homo sapiens
tcttcacatgaccttcatgtct

SEQ ID NO: 8396620 - DNA, 22 bp, Homo sapiens
tcttcacagatgcatatacttc

SEQ ID NO: 8396621 - DNA, 22 bp, Homo sapiens
tcttccaaatgaatatggtttt

SEQ ID NO: 8396622 - DNA, 22 bp, Homo sapiens
tcttccaaatgcagctaaagct

SEQ ID NO: 8396623 - DNA, 22 bp, Homo sapiens
tcttccaaggtgcagatcttct

SEQ ID NO: 8396624 - DNA, 22 bp, Homo sapiens
tcgatgtggtgacaaggtacgt

SEQ ID NO: 8396625 - DNA, 22 bp, Homo sapiens
tcgcatttgttaaagcatgttg

SEQ ID NO: 8396626 - DNA, 22 bp, Homo sapiens
tctagaaaaacaaagtatctga

SEQ ID NO: 8396627 - DNA, 22 bp, Homo sapiens
tctaacttgtgagtatagatga

SEQ ID NO: 8396628 - DNA, 22 bp, Homo sapiens
tctaagaaagattaagaaattt

SEQ ID NO: 8396629 - DNA, 22 bp, Homo sapiens
tctaaagtgagtcatttcgact

SEQ ID NO: 8396630 - DNA, 22 bp, Homo sapiens
tctaacttgaactcatgactgt

SEQ ID NO: 8396631 - DNA, 22 bp, Homo sapiens
tctaacattgtttttcacagat

SEQ ID NO: 8396632 - DNA, 22 bp, Homo sapiens
tctacattccttttataatatc

SEQ ID NO: 8396633 - DNA, 22 bp, Homo sapiens
tctcaatattatatgtcataaa

SEQ ID NO: 8396634 - DNA, 22 bp, Homo sapiens
tctattttatactcaaatcttc

SEQ ID NO: 8396635 - DNA, 22 bp, Homo sapiens
tctattaatgattcaatagtgt

SEQ ID NO: 8396636 - DNA, 22 bp, Homo sapiens
tcctgcttccttgtctttagac

SEQ ID NO: 8396637 - DNA, 22 bp, Homo sapiens
taagaattatctcatggataat

SEQ ID NO: 8396638 - DNA, 22 bp, Homo sapiens
taagaagtgttgcctaatgcaa

SEQ ID NO: 8396639 - DNA, 22 bp, Homo sapiens
tctgaaaactccatgagctcgt

SEQ ID NO: 8396640 - DNA, 22 bp, Homo sapiens
tgcctagcatagtatttgtcac

SEQ ID NO: 8396641 - DNA, 22 bp, Homo sapiens
tgcctacattccttgcttatgg

SEQ ID NO: 8396642 - DNA, 22 bp, Homo sapiens
tgccatccatcagtatttgtgg

SEQ ID NO: 8396643 - DNA, 22 bp, Homo sapiens
tgccatttctcaaatatgacta

SEQ ID NO: 8396644 - DNA, 22 bp, Homo sapiens
tgcccaaggtcacctagttagt

SEQ ID NO: 8396645 - DNA, 22 bp, Homo sapiens
tgcccaagattcttacatcatg

SEQ ID NO: 8396646 - DNA, 22 bp, Homo sapiens
tgcatctaagtggctaacaacc

SEQ ID NO: 8396647 - DNA, 19 bp, Homo sapiens
tgcatacatgttaacatgt

SEQ ID NO: 8396648 - DNA, 22 bp, Homo sapiens
tgcatacacttcaaatgagcat

SEQ ID NO: 8396649 - DNA, 22 bp, Homo sapiens
tgcatacacatgtgcacatacg

SEQ ID NO: 8396650 - DNA, 22 bp, Homo sapiens
tgcatacacacatcaaatgttt

SEQ ID NO: 8396651 - DNA, 22 bp, Homo sapiens
tgcatacacaagcatacatgta

SEQ ID NO: 8396652 - DNA, 22 bp, Homo sapiens
tgcatatacccgcatttacata

SEQ ID NO: 8396653 - DNA, 22 bp, Homo sapiens
tgcagtttgccctttgctcact

SEQ ID NO: 8396654 - DNA, 22 bp, Homo sapiens
tgcatctttctgcatatgtaaa

SEQ ID NO: 8396655 - DNA, 22 bp, Homo sapiens
tgcatgcactatctagatgatg

SEQ ID NO: 8396656 - DNA, 22 bp, Homo sapiens
tgcatgcacgtgctatgtatga

SEQ ID NO: 8396657 - DNA, 22 bp, Homo sapiens
tgcatgcaaaaaaatctgcatt

SEQ ID NO: 8396658 - DNA, 22 bp, Homo sapiens
tgcatgcaacaattcttctata

SEQ ID NO: 8396659 - DNA, 22 bp, Homo sapiens
tgcatgcatgtttttacccaca

SEQ ID NO: 8396660 - DNA, 22 bp, Homo sapiens
tgccaaattgccctataaatga

SEQ ID NO: 8396661 - DNA, 21 bp, Homo sapiens
tgcattcttgtgtaaggtagt

SEQ ID NO: 8396662 - DNA, 22 bp, Homo sapiens
tgcattctgaacgtaaatgtga

SEQ ID NO: 8396663 - DNA, 22 bp, Homo sapiens
tgcacacagttctcaggaaaga

SEQ ID NO: 8396664 - DNA, 22 bp, Homo sapiens
tgcacacacacgtagagaaaag

SEQ ID NO: 8396665 - DNA, 22 bp, Homo sapiens
tgcaatttggcttccattttct

SEQ ID NO: 8396666 - DNA, 22 bp, Homo sapiens
tgcacacactcgtgtatatgag

SEQ ID NO: 8396667 - DNA, 22 bp, Homo sapiens
tgcacacactctgcatatactt

SEQ ID NO: 8396668 - DNA, 20 bp, Homo sapiens
tgcacacagaaatttgcatt

SEQ ID NO: 8396669 - DNA, 22 bp, Homo sapiens
tgcaaatttgagcagactgttc

SEQ ID NO: 8396670 - DNA, 22 bp, Homo sapiens
tgcaaggtccagtataacttaa

SEQ ID NO: 8396671 - DNA, 22 bp, Homo sapiens
tgcaaggtgctttttggtgtca

SEQ ID NO: 8396672 - DNA, 22 bp, Homo sapiens
tgcaaattgcatgatgtgtatc

SEQ ID NO: 8396673 - DNA, 22 bp, Homo sapiens
tgcaaatttatatggtgactgc

SEQ ID NO: 8396674 - DNA, 22 bp, Homo sapiens
tgcaaaatgacttctgaaaaga

SEQ ID NO: 8396675 - DNA, 22 bp, Homo sapiens
tgatttcaagccagggggcgtt

SEQ ID NO: 8396676 - DNA, 22 bp, Homo sapiens
tgatttcatagtatatacatga

SEQ ID NO: 8396677 - DNA, 22 bp, Homo sapiens
tgagaattacaaatgagtcaca

SEQ ID NO: 8396678 - DNA, 22 bp, Homo sapiens
tgagaaaattactataattgtc

SEQ ID NO: 8396679 - DNA, 22 bp, Homo sapiens
tgagaaatggcagcattactgg

SEQ ID NO: 8396680 - DNA, 22 bp, Homo sapiens
tgagaaatccagatgtgcagtt

SEQ ID NO: 8396681 - DNA, 22 bp, Homo sapiens
tgagattttcctaaatataatg

SEQ ID NO: 8396682 - DNA, 22 bp, Homo sapiens
tgagattttcagcatcacttca

SEQ ID NO: 8396683 - DNA, 22 bp, Homo sapiens
tgagatttgggttgtttaacat

SEQ ID NO: 8396684 - DNA, 22 bp, Homo sapiens
tgactgaagaagccacattgga

SEQ ID NO: 8396685 - DNA, 22 bp, Homo sapiens
tgacacagtatcaaacatgatt

SEQ ID NO: 8396686 - DNA, 22 bp, Homo sapiens
tgaagtttaaggttagataagt

SEQ ID NO: 8396687 - DNA, 22 bp, Homo sapiens
tgaaggtcatggtaatattttt

SEQ ID NO: 8396688 - DNA, 22 bp, Homo sapiens
tgaatgaatcctaacaaagaca

SEQ ID NO: 8396689 - DNA, 22 bp, Homo sapiens
tgaatgaatgaattaatagagt

SEQ ID NO: 8396690 - DNA, 22 bp, Homo sapiens
tgaatacaggaaaatatactga

SEQ ID NO: 8396691 - DNA, 22 bp, Homo sapiens
tgaatcaaagctgaagttttca

SEQ ID NO: 8396692 - DNA, 22 bp, Homo sapiens
tgaatccagagctatttcgtcc

SEQ ID NO: 8396693 - DNA, 22 bp, Homo sapiens
tgaatcaatgaattgcacttca

SEQ ID NO: 8396694 - DNA, 22 bp, Homo sapiens
tgaattcatccatttatgcaag

SEQ ID NO: 8396695 - DNA, 22 bp, Homo sapiens
tgaattcacctgaaagtctgga

SEQ ID NO: 8396696 - DNA, 22 bp, Homo sapiens
tgaattcaggggctattatatt

SEQ ID NO: 8396697 - DNA, 22 bp, Homo sapiens
tgaaatcagtggtataatcggg

SEQ ID NO: 8396698 - DNA, 22 bp, Homo sapiens
tgaaatcatctgccaataagtt

SEQ ID NO: 8396699 - DNA, 22 bp, Homo sapiens
tgaaatcataacagtttggctt

SEQ ID NO: 8396700 - DNA, 22 bp, Homo sapiens
tgaaatcatcaaaagagccatt

SEQ ID NO: 8396701 - DNA, 22 bp, Homo sapiens
tgaaatcaattgcaatgtttat

SEQ ID NO: 8396702 - DNA, 17 bp, Homo sapiens
tgaaatcagcacccagg

SEQ ID NO: 8396703 - DNA, 23 bp, Homo sapiens
tgaaatcagaacccttacctctc

SEQ ID NO: 8396704 - DNA, 22 bp, Homo sapiens
tgaaatcagtatgtctttctca

SEQ ID NO: 8396705 - DNA, 22 bp, Homo sapiens
tgaaatcaactaggagacacca

SEQ ID NO: 8396706 - DNA, 22 bp, Homo sapiens
tgaaatcaataattggtgattg

SEQ ID NO: 8396707 - DNA, 22 bp, Homo sapiens
tgaaatcaatgtcttctgtctc

SEQ ID NO: 8396708 - DNA, 22 bp, Homo sapiens
tgaaagttcaataccaatttgg

SEQ ID NO: 8396709 - DNA, 23 bp, Homo sapiens
tgaaagttctgaagagatcatgc

SEQ ID NO: 8396710 - DNA, 21 bp, Homo sapiens
tgaaagttggagtcaaatgta

SEQ ID NO: 8396711 - DNA, 22 bp, Homo sapiens
tgaaagttgcacataagagaat

SEQ ID NO: 8396712 - DNA, 22 bp, Homo sapiens
tgaaagttaggatgtagtaatt

SEQ ID NO: 8396713 - DNA, 22 bp, Homo sapiens
tgaaagttacaggaaaacagat

SEQ ID NO: 8396714 - DNA, 22 bp, Homo sapiens
tgaaatgaaacagaacatatca

SEQ ID NO: 8396715 - DNA, 22 bp, Homo sapiens
tgaaatcattggggttgaataa

SEQ ID NO: 8396716 - DNA, 22 bp, Homo sapiens
tgaaatcatgagatagtgtcac

SEQ ID NO: 8396717 - DNA, 22 bp, Homo sapiens
tgaaatcatgaacaaggtaggt

SEQ ID NO: 8396718 - DNA, 22 bp, Homo sapiens
tgaaatcattgccaagtattga

SEQ ID NO: 8396719 - DNA, 22 bp, Homo sapiens
tgaaatcatgtagttattgcaa

SEQ ID NO: 8396720 - DNA, 22 bp, Homo sapiens
tgaaatgtggagatggtaagta

SEQ ID NO: 8396721 - DNA, 22 bp, Homo sapiens
tgaagaacgtgagatccagaaa

SEQ ID NO: 8396722 - DNA, 22 bp, Homo sapiens
tgaagattttcgggtacttgat

SEQ ID NO: 8396723 - DNA, 22 bp, Homo sapiens
tgaagattttgtagctttcagc

SEQ ID NO: 8396724 - DNA, 22 bp, Homo sapiens
tgaacaaactgcattcttcact

SEQ ID NO: 8396725 - DNA, 22 bp, Homo sapiens
tgaaatttaggtgcagataaat

SEQ ID NO: 8396726 - DNA, 22 bp, Homo sapiens
tgaacacacacctatgtacaaa

SEQ ID NO: 8396727 - DNA, 22 bp, Homo sapiens
tgaacaaatggaaataaccagt

SEQ ID NO: 8396728 - DNA, 22 bp, Homo sapiens
tgaactctccaggcaaatgatc

SEQ ID NO: 8396729 - DNA, 22 bp, Homo sapiens
tgaactttcacaagaatatgct

SEQ ID NO: 8396730 - DNA, 22 bp, Homo sapiens
tgaacttcagtgcataattatc

SEQ ID NO: 8396731 - DNA, 22 bp, Homo sapiens
tgaaaagtgatcatggattagg

SEQ ID NO: 8396732 - DNA, 22 bp, Homo sapiens
tgaaaagtcttatattgtctga

SEQ ID NO: 8396733 - DNA, 22 bp, Homo sapiens
tgaaaattcatctcatagcaga

SEQ ID NO: 8396734 - DNA, 22 bp, Homo sapiens
tgaaaatgccctctatgtctca

SEQ ID NO: 8396735 - DNA, 22 bp, Homo sapiens
tgaaaatggcctgaagaagcaa

SEQ ID NO: 8396736 - DNA, 22 bp, Homo sapiens
tgaaaatttccatcagttatat

SEQ ID NO: 8396737 - DNA, 22 bp, Homo sapiens
tgaaaaactgaatagttgagta

SEQ ID NO: 8396738 - DNA, 22 bp, Homo sapiens
tgaaaaacactaattggaaagc

SEQ ID NO: 8396739 - DNA, 22 bp, Homo sapiens
tgaaaacactttagtttaggtc

SEQ ID NO: 8396740 - DNA, 22 bp, Homo sapiens
tgaaaactccaagtttcatcag

SEQ ID NO: 8396741 - DNA, 22 bp, Homo sapiens
tgaaaacagaatccttgttttc

SEQ ID NO: 8396742 - DNA, 22 bp, Homo sapiens
tgaaaaactttaatccataaag

SEQ ID NO: 8396743 - DNA, 22 bp, Homo sapiens
tgaaagacaaggttttttcaga

SEQ ID NO: 8396744 - DNA, 22 bp, Homo sapiens
tgaaacttataagaatatgaat

SEQ ID NO: 8396745 - DNA, 22 bp, Homo sapiens
tgaaacttctaatatgaatagt

SEQ ID NO: 8396746 - DNA, 22 bp, Homo sapiens
tgaaacttgagtatatatggat

SEQ ID NO: 8396747 - DNA, 22 bp, Homo sapiens
tgaaacaaaattaagattctcg

SEQ ID NO: 8396748 - DNA, 23 bp, Homo sapiens
tgaaacatttagggtagaatttc

SEQ ID NO: 8396749 - DNA, 22 bp, Homo sapiens
tgaaacattgcactgtatgaat

SEQ ID NO: 8396750 - DNA, 22 bp, Homo sapiens
tgaaacattatagaatatttat

SEQ ID NO: 8396751 - DNA, 22 bp, Homo sapiens
tgaaacattaggaaatcattat

SEQ ID NO: 8396752 - DNA, 22 bp, Homo sapiens
tcttttccttccctacagatct

SEQ ID NO: 8396753 - DNA, 22 bp, Homo sapiens
tctttgtaagacatgtaagtcc

SEQ ID NO: 8396754 - DNA, 22 bp, Homo sapiens
tctttgtacaggaaggcactgt

SEQ ID NO: 8396755 - DNA, 22 bp, Homo sapiens
tctttgtatgtatgtttcaaag

SEQ ID NO: 8396756 - DNA, 22 bp, Homo sapiens
tgcttccaattcaaatctgtgg

SEQ ID NO: 8396757 - DNA, 22 bp, Homo sapiens
tgcttcatttccttatattgta

SEQ ID NO: 8396758 - DNA, 22 bp, Homo sapiens
tgctgaaaatgcgtatcttcca

SEQ ID NO: 8396759 - DNA, 22 bp, Homo sapiens
tgctgagtatttgtttgaataa

SEQ ID NO: 8396760 - DNA, 22 bp, Homo sapiens
tgctatacggagcatcttcagg

SEQ ID NO: 8396761 - DNA, 22 bp, Homo sapiens
tgctattttagacatactttgt

SEQ ID NO: 8396762 - DNA, 22 bp, Homo sapiens
tggaagatgaataaagattcta

SEQ ID NO: 8396763 - DNA, 22 bp, Homo sapiens
tggaagatatgctgattctctg

SEQ ID NO: 8396764 - DNA, 22 bp, Homo sapiens
tggaccaacattcactggcata

SEQ ID NO: 8396765 - DNA, 22 bp, Homo sapiens
tggactaaagaggaaagatgta

SEQ ID NO: 8396766 - DNA, 17 bp, Homo sapiens
tggaaacaaaacttatt

SEQ ID NO: 8396767 - DNA, 22 bp, Homo sapiens
tggaaaacattgagataccaag

SEQ ID NO: 8396768 - DNA, 22 bp, Homo sapiens
tggaaacagatcataactaagc

SEQ ID NO: 8396769 - DNA, 22 bp, Homo sapiens
tggaaaaactgagacttagaca

SEQ ID NO: 8396770 - DNA, 22 bp, Homo sapiens
tggaaaaaacccagactctaga

SEQ ID NO: 8396771 - DNA, 22 bp, Homo sapiens
tgtaacatcacagtgatgtttg

SEQ ID NO: 8396772 - DNA, 22 bp, Homo sapiens
tgtaacatatgtaaaagcacct

SEQ ID NO: 8396773 - DNA, 22 bp, Homo sapiens
tgtaacatatagcatgttcttg

SEQ ID NO: 8396774 - DNA, 22 bp, Homo sapiens
tgtaacagagcttttttatagc

SEQ ID NO: 8396775 - DNA, 23 bp, Homo sapiens
tgtaacagagcactgattgacaa

SEQ ID NO: 8396776 - DNA, 22 bp, Homo sapiens
tgtaacagctctccatgtgggg

SEQ ID NO: 8396777 - DNA, 22 bp, Homo sapiens
tgtaacagtagttactattctt

SEQ ID NO: 8396778 - DNA, 22 bp, Homo sapiens
tgtaaggacaacaggagaaaaa

SEQ ID NO: 8396779 - DNA, 22 bp, Homo sapiens
tgtaagaaaagtaaatagtgac

SEQ ID NO: 8396780 - DNA, 22 bp, Homo sapiens
tgtaagtacattgaaacatctt

SEQ ID NO: 8396781 - DNA, 22 bp, Homo sapiens
tgtaaggagtgtgagtttgagt

SEQ ID NO: 8396782 - DNA, 22 bp, Homo sapiens
tgtaaggaggaaaattagtggt

SEQ ID NO: 8396783 - DNA, 22 bp, Homo sapiens
tgtacacaatgataaattatta

SEQ ID NO: 8396784 - DNA, 22 bp, Homo sapiens
tgtacagaaggcactaaggtca

SEQ ID NO: 8396785 - DNA, 22 bp, Homo sapiens
tgtacagactgtatttacaagt

SEQ ID NO: 8396786 - DNA, 22 bp, Homo sapiens
tgtacagaaattcctactacat

SEQ ID NO: 8396787 - DNA, 22 bp, Homo sapiens
tgtacagaacttgctgtccctt

SEQ ID NO: 8396788 - DNA, 22 bp, Homo sapiens
tgtacagaggtgtacatatgat

SEQ ID NO: 8396789 - DNA, 22 bp, Homo sapiens
tgtacagactttgcagtgtgca

SEQ ID NO: 8396790 - DNA, 22 bp, Homo sapiens
tgtacagagactaccattaata

SEQ ID NO: 8396791 - DNA, 22 bp, Homo sapiens
tgtacagataaagactgtaaat

SEQ ID NO: 8396792 - DNA, 22 bp, Homo sapiens
tgtacagatatcaggagtgagg

SEQ ID NO: 8396793 - DNA, 22 bp, Homo sapiens
tgtacagattgatcatggagag

SEQ ID NO: 8396794 - DNA, 22 bp, Homo sapiens
tgtaaaataattctccatgttt

SEQ ID NO: 8396795 - DNA, 22 bp, Homo sapiens
tgtaaaagacatttctaagcaa

SEQ ID NO: 8396796 - DNA, 22 bp, Homo sapiens
tgtaaaaggttgttctttcgtt

SEQ ID NO: 8396797 - DNA, 20 bp, Homo sapiens
tgtaaaacaaggtgaatcct

SEQ ID NO: 8396798 - DNA, 22 bp, Homo sapiens
tgtatacatttggtgcatattt

SEQ ID NO: 8396799 - DNA, 22 bp, Homo sapiens
tgtatacatttggtgcatattt

SEQ ID NO: 8396800 - DNA, 21 bp, Homo sapiens
tgtatacacacatatatgtac

SEQ ID NO: 8396801 - DNA, 21 bp, Homo sapiens
tgtatacacacatatatgtac

SEQ ID NO: 8396802 - DNA, 22 bp, Homo sapiens
tgtaggaagatataaaatatct

SEQ ID NO: 8396803 - DNA, 22 bp, Homo sapiens
tgtcacatatataatgttcaat

SEQ ID NO: 8396804 - DNA, 23 bp, Homo sapiens
tgtcctatgcagctaaaattcct

SEQ ID NO: 8396805 - DNA, 22 bp, Homo sapiens
tgtccaatgccctttccacatg

SEQ ID NO: 8396806 - DNA, 22 bp, Homo sapiens
tgtcatcagcatataagacagt

SEQ ID NO: 8396807 - DNA, 22 bp, Homo sapiens
tggtattacttctagacacaag

SEQ ID NO: 8396808 - DNA, 22 bp, Homo sapiens
tggtcacagtgtattgatcagg

SEQ ID NO: 8396809 - DNA, 22 bp, Homo sapiens
tggtaaagtgctctaacttcat

SEQ ID NO: 8396810 - DNA, 22 bp, Homo sapiens
tgtttgcattaattagaaggta

SEQ ID NO: 8396811 - DNA, 22 bp, Homo sapiens
tgtttgcacattcgtttcaata

SEQ ID NO: 8396812 - DNA, 22 bp, Homo sapiens
tgtttgtggttataataagtat

SEQ ID NO: 8396813 - DNA, 22 bp, Homo sapiens
tgttttaatctcccattgctct

SEQ ID NO: 8396814 - DNA, 22 bp, Homo sapiens
tgttttaagagcgcactttata

SEQ ID NO: 8396815 - DNA, 22 bp, Homo sapiens
tgttaaatgagattggaatttg

SEQ ID NO: 8396816 - DNA, 22 bp, Homo sapiens
tgttaacatactgctttctaat

SEQ ID NO: 8396817 - DNA, 22 bp, Homo sapiens
tgttaacagccagatttggtga

SEQ ID NO: 8396818 - DNA, 22 bp, Homo sapiens
tgttaacagaggtcattttggg

SEQ ID NO: 8396819 - DNA, 22 bp, Homo sapiens
tgttagaaattattagtaatat

SEQ ID NO: 8396820 - DNA, 22 bp, Homo sapiens
tgttacatttctctttcttgga

SEQ ID NO: 8396821 - DNA, 22 bp, Homo sapiens
tgttaccaggcagtattgctta

SEQ ID NO: 8396822 - DNA, 22 bp, Homo sapiens
tgtgtgcattcacatgcatgcc

SEQ ID NO: 8396823 - DNA, 22 bp, Homo sapiens
tgtgaaatcacaggctatttag

SEQ ID NO: 8396824 - DNA, 21 bp, Homo sapiens
tgtgaaatagctatgctacat

SEQ ID NO: 8396825 - DNA, 22 bp, Homo sapiens
tgtgaaatattggcaatttcat

SEQ ID NO: 8396826 - DNA, 22 bp, Homo sapiens
tgtgaaatatttatatactcaa

SEQ ID NO: 8396827 - DNA, 22 bp, Homo sapiens
tgtgaaatgctatttccatgag

SEQ ID NO: 8396828 - DNA, 22 bp, Homo sapiens
tgtgaaatgctattgtgacaaa

SEQ ID NO: 8396829 - DNA, 22 bp, Homo sapiens
tgtgaaatgaagataattcttg

SEQ ID NO: 8396830 - DNA, 22 bp, Homo sapiens
tgtgaaatgagtatatttgaat

SEQ ID NO: 8396831 - DNA, 22 bp, Homo sapiens
tgtgaaatctgatgaattgacc

SEQ ID NO: 8396832 - DNA, 22 bp, Homo sapiens
tgtgaaatctgaactcaaagat

SEQ ID NO: 8396833 - DNA, 22 bp, Homo sapiens
tgtgaaattcttgaaatgcaca

SEQ ID NO: 8396834 - DNA, 22 bp, Homo sapiens
tgtgaaattacttaaaggaaat

SEQ ID NO: 8396835 - DNA, 22 bp, Homo sapiens
tgtgaaatgtgtgtataattaa

SEQ ID NO: 8396836 - DNA, 22 bp, Homo sapiens
tgtgaaattgagaaactttcac

SEQ ID NO: 8396837 - DNA, 22 bp, Homo sapiens
tgtgcaatcatattttaaaatg

SEQ ID NO: 8396838 - DNA, 22 bp, Homo sapiens
tgtgcaatcttgagcaatttat

SEQ ID NO: 8396839 - DNA, 18 bp, Homo sapiens
tgtgcaatattaaccacc

SEQ ID NO: 8396840 - DNA, 22 bp, Homo sapiens
tgtgcagtttctatgttgtcca

SEQ ID NO: 8396841 - DNA, 22 bp, Homo sapiens
tgtgccaagatcaaacttttct

SEQ ID NO: 8396842 - DNA, 22 bp, Homo sapiens
tgtgccaagactatattgtgct

SEQ ID NO: 8396843 - DNA, 22 bp, Homo sapiens
tgtgcctagttctgtatttaca

SEQ ID NO: 8396844 - DNA, 22 bp, Homo sapiens
tgtctacagaatgttaatattt

SEQ ID NO: 8396845 - DNA, 22 bp, Homo sapiens
ttcacattggtgatatgtttct

SEQ ID NO: 8396846 - DNA, 22 bp, Homo sapiens
ttcacattggttcttgatagct

SEQ ID NO: 8396847 - DNA, 22 bp, Homo sapiens
ttatttgtgaatcatttatcta

SEQ ID NO: 8396848 - DNA, 22 bp, Homo sapiens
ttatttgtatcaaggacggttg

SEQ ID NO: 8396849 - DNA, 22 bp, Homo sapiens
ttatttgtaaggcagggccagt

SEQ ID NO: 8396850 - DNA, 22 bp, Homo sapiens
ttatttgtaaaggtccatagta

SEQ ID NO: 8396851 - DNA, 22 bp, Homo sapiens
ttaatacatttcagactgttat

SEQ ID NO: 8396852 - DNA, 22 bp, Homo sapiens
ttacaaagagaagttgtagaat

SEQ ID NO: 8396853 - DNA, 22 bp, Homo sapiens
ttacaaagtgctgcaccatttt

SEQ ID NO: 8396854 - DNA, 22 bp, Homo sapiens
ttacagatgtaggaactgaagt

SEQ ID NO: 8396855 - DNA, 22 bp, Homo sapiens
ttacagatggggttgcaataaa

SEQ ID NO: 8396856 - DNA, 22 bp, Homo sapiens
ttacattcaaggaactcattct

SEQ ID NO: 8396857 - DNA, 22 bp, Homo sapiens
ttacattagacccactttcatg

SEQ ID NO: 8396858 - DNA, 23 bp, Homo sapiens
ttacatgtgtgcacacattctgg

SEQ ID NO: 8396859 - DNA, 22 bp, Homo sapiens
ttacagagtagtgcagaactca

SEQ ID NO: 8396860 - DNA, 22 bp, Homo sapiens
ttacagaggtatgtatgtctct

SEQ ID NO: 8396861 - DNA, 22 bp, Homo sapiens
ttacagagctcatttctaaggg

SEQ ID NO: 8396862 - DNA, 22 bp, Homo sapiens
ttacagagaggtgattgtgaag

SEQ ID NO: 8396863 - DNA, 22 bp, Homo sapiens
ttacaattacttgatctcagct

SEQ ID NO: 8396864 - DNA, 22 bp, Homo sapiens
ttacaatgtaaggcatggttct

SEQ ID NO: 8396865 - DNA, 22 bp, Homo sapiens
ttagtgataggactttaaagcc

SEQ ID NO: 8396866 - DNA, 22 bp, Homo sapiens
ttagtgatgactagacttttgt

SEQ ID NO: 8396867 - DNA, 22 bp, Homo sapiens
ttagtacattgattcattatgt

SEQ ID NO: 8396868 - DNA, 22 bp, Homo sapiens
ttagcattctcatttgcataaa

SEQ ID NO: 8396869 - DNA, 22 bp, Homo sapiens
ttagaaaggggtgaatcaatgg

SEQ ID NO: 8396870 - DNA, 22 bp, Homo sapiens
ttagaaaggaatcttcatttca

SEQ ID NO: 8396871 - DNA, 22 bp, Homo sapiens
ttagataatgttattgtaattt

SEQ ID NO: 8396872 - DNA, 22 bp, Homo sapiens
aagtttgtggttatacttgatt

SEQ ID NO: 8396873 - DNA, 22 bp, Homo sapiens
aagtttgttttagtctaatgat

SEQ ID NO: 8396874 - DNA, 22 bp, Homo sapiens
actcatcaactgttacaaatgt

SEQ ID NO: 8396875 - DNA, 22 bp, Homo sapiens
aagttttattggctatagcact

SEQ ID NO: 8396876 - DNA, 21 bp, Homo sapiens
aagtaaatcagagaaataacc

SEQ ID NO: 8396877 - DNA, 22 bp, Homo sapiens
acttatttcatggatcataatg

SEQ ID NO: 8396878 - DNA, 22 bp, Homo sapiens
aatatgacatagaattgagatg

SEQ ID NO: 8396879 - DNA, 22 bp, Homo sapiens
aatatgaattattgttacaagt

SEQ ID NO: 8396880 - DNA, 22 bp, Homo sapiens
aatactgctgcctgcaaattat

SEQ ID NO: 8396881 - DNA, 22 bp, Homo sapiens
aatactggctgtcaaagatgga

SEQ ID NO: 8396882 - DNA, 22 bp, Homo sapiens
aatacttgtgaattcaaagtct

SEQ ID NO: 8396883 - DNA, 22 bp, Homo sapiens
aatacttgtcagatgaataaga

SEQ ID NO: 8396884 - DNA, 22 bp, Homo sapiens
aatactttgccaagttcgaaga

SEQ ID NO: 8396885 - DNA, 22 bp, Homo sapiens
aatactttcctatataaggtgc

SEQ ID NO: 8396886 - DNA, 22 bp, Homo sapiens
aatacttttgaactgaaaggca

SEQ ID NO: 8396887 - DNA, 22 bp, Homo sapiens
aatatgtgggtgctaatcaaaa

SEQ ID NO: 8396888 - DNA, 22 bp, Homo sapiens
aatatgttcaaaatagatcact

SEQ ID NO: 8396889 - DNA, 22 bp, Homo sapiens
aatatgtctctggctagacatt

SEQ ID NO: 8396890 - DNA, 22 bp, Homo sapiens
aatatgatccttaaccttcatg

SEQ ID NO: 8396891 - DNA, 22 bp, Homo sapiens
agaaaattactccagagacaag

SEQ ID NO: 8396892 - DNA, 22 bp, Homo sapiens
aatctattccctttctgtaaaa

SEQ ID NO: 8396893 - DNA, 22 bp, Homo sapiens
aatcttagagtgtttttgaagc

SEQ ID NO: 8396894 - DNA, 22 bp, Homo sapiens
aatcttcaaaatgttctgcttg

SEQ ID NO: 8396895 - DNA, 22 bp, Homo sapiens
aatcttcatgtcctctctaatt

SEQ ID NO: 8396896 - DNA, 22 bp, Homo sapiens
acatacttaacattaaagtcat

SEQ ID NO: 8396897 - DNA, 22 bp, Homo sapiens
acatacaaatagagctgtagta

SEQ ID NO: 8396898 - DNA, 22 bp, Homo sapiens
acataacatagttgacattttt

SEQ ID NO: 8396899 - DNA, 22 bp, Homo sapiens
acatacttgaagcaagtgatca

SEQ ID NO: 8396900 - DNA, 22 bp, Homo sapiens
acatacttatgtgtatatgtgt

SEQ ID NO: 8396901 - DNA, 22 bp, Homo sapiens
acatactttttaaaagattgct

SEQ ID NO: 8396902 - DNA, 22 bp, Homo sapiens
acattacataagattgtaacct

SEQ ID NO: 8396903 - DNA, 22 bp, Homo sapiens
acattcttcagctttgtcaggc

SEQ ID NO: 8396904 - DNA, 22 bp, Homo sapiens
acagatgaggaatttatttggt

SEQ ID NO: 8396905 - DNA, 22 bp, Homo sapiens
acagatgagattcattgaccac

SEQ ID NO: 8396906 - DNA, 22 bp, Homo sapiens
acagatttattgaagctgctgc

SEQ ID NO: 8396907 - DNA, 22 bp, Homo sapiens
acagatttgatctgagaacaaa

SEQ ID NO: 8396908 - DNA, 22 bp, Homo sapiens
acagctttttactaatagattg

SEQ ID NO: 8396909 - DNA, 22 bp, Homo sapiens
acaggaaatgaaatggtatcta

SEQ ID NO: 8396910 - DNA, 22 bp, Homo sapiens
acagtttacagggatttgagct

SEQ ID NO: 8396911 - DNA, 22 bp, Homo sapiens
agcatccagcatcctatagaaa

SEQ ID NO: 8396912 - DNA, 22 bp, Homo sapiens
agatttctgtcaccttctatgc

SEQ ID NO: 8396913 - DNA, 22 bp, Homo sapiens
agatttgtatgtctaaatgtaa

SEQ ID NO: 8396914 - DNA, 22 bp, Homo sapiens
agatttgtcagctcagtcttta

SEQ ID NO: 8396915 - DNA, 22 bp, Homo sapiens
agatttgtcctgctttctacct

SEQ ID NO: 8396916 - DNA, 22 bp, Homo sapiens
acagaactgagaattctctatc

SEQ ID NO: 8396917 - DNA, 22 bp, Homo sapiens
acagaacatattgcttctctca

SEQ ID NO: 8396918 - DNA, 22 bp, Homo sapiens
agaatttaggatgcatgtgaat

SEQ ID NO: 8396919 - DNA, 23 bp, Homo sapiens
agacaaaagcctcagtcttaggc

SEQ ID NO: 8396920 - DNA, 22 bp, Homo sapiens
aatgctttgagggaagatgaaa

SEQ ID NO: 8396921 - DNA, 22 bp, Homo sapiens
aatgaaaattggaccctagaac

SEQ ID NO: 8396922 - DNA, 22 bp, Homo sapiens
agaataaaatagtctgaagatg

SEQ ID NO: 8396923 - DNA, 22 bp, Homo sapiens
agaataaatgctacctatcaca

SEQ ID NO: 8396924 - DNA, 22 bp, Homo sapiens
agactgaataacaagcaaataa

SEQ ID NO: 8396925 - DNA, 22 bp, Homo sapiens
agactctgctaagaatataatt

SEQ ID NO: 8396926 - DNA, 22 bp, Homo sapiens
agagatcagttaaaatcttttt

SEQ ID NO: 8396927 - DNA, 22 bp, Homo sapiens
agatatatttcctgcccaaggc

SEQ ID NO: 8396928 - DNA, 22 bp, Homo sapiens
agatgttttagagtttgacttg

SEQ ID NO: 8396929 - DNA, 20 bp, Homo sapiens
agatgttttgaagtcttgga

SEQ ID NO: 8396930 - DNA, 22 bp, Homo sapiens
agatgttttggagacactaacc

SEQ ID NO: 8396931 - DNA, 22 bp, Homo sapiens
agatgttttgtgtatttcatca

SEQ ID NO: 8396932 - DNA, 19 bp, Homo sapiens
agattattgcacattcatg

SEQ ID NO: 8396933 - DNA, 22 bp, Homo sapiens
agattatctcctgattttaagg

SEQ ID NO: 8396934 - DNA, 22 bp, Homo sapiens
aattttgtttaagtgatctgct

SEQ ID NO: 8396935 - DNA, 22 bp, Homo sapiens
aatttcaatgcactcatggttg

SEQ ID NO: 8396936 - DNA, 22 bp, Homo sapiens
aatttcaagtggcatctttgat

SEQ ID NO: 8396937 - DNA, 22 bp, Homo sapiens
aattttgttcttggaaatcagg

SEQ ID NO: 8396938 - DNA, 22 bp, Homo sapiens
aattttgtgtgggatcaaagga

SEQ ID NO: 8396939 - DNA, 22 bp, Homo sapiens
aatgtcttttgatacaagttac

SEQ ID NO: 8396940 - DNA, 22 bp, Homo sapiens
aatgttaatgtgtttgcttatg

SEQ ID NO: 8396941 - DNA, 22 bp, Homo sapiens
aactttctctacggcatttgtt

SEQ ID NO: 8396942 - DNA, 22 bp, Homo sapiens
aactttctccagtgccaactat

SEQ ID NO: 8396943 - DNA, 22 bp, Homo sapiens
aactttagaaaggaaggaagtg

SEQ ID NO: 8396944 - DNA, 22 bp, Homo sapiens
aactttctaaagtcaaattggt

SEQ ID NO: 8396945 - DNA, 22 bp, Homo sapiens
aactttctaattttggctgagc

SEQ ID NO: 8396946 - DNA, 22 bp, Homo sapiens
aatgtcaagtagccaatgcttc

SEQ ID NO: 8396947 - DNA, 22 bp, Homo sapiens
aactgaaaccaaacactttagg

SEQ ID NO: 8396948 - DNA, 22 bp, Homo sapiens
aactgaaacggtgatcttttaa

SEQ ID NO: 8396949 - DNA, 22 bp, Homo sapiens
aagaattttccagcatgtcagt

SEQ ID NO: 8396950 - DNA, 22 bp, Homo sapiens
aattcaaattacaatagttgtt

SEQ ID NO: 8396951 - DNA, 23 bp, Homo sapiens
acaactttacagatacattttgt

SEQ ID NO: 8396952 - DNA, 22 bp, Homo sapiens
acaactttctgggttatctgat

SEQ ID NO: 8396953 - DNA, 22 bp, Homo sapiens
acaactttgacccttgttctta

SEQ ID NO: 8396954 - DNA, 22 bp, Homo sapiens
aagattttcagctaatggtgca

SEQ ID NO: 8396955 - DNA, 22 bp, Homo sapiens
aagattttctcaactgtatttg

SEQ ID NO: 8396956 - DNA, 22 bp, Homo sapiens
aagatttttttccacagactca

SEQ ID NO: 8396957 - DNA, 22 bp, Homo sapiens
acagatgaatctgtgattgctg

SEQ ID NO: 8396958 - DNA, 23 bp, Homo sapiens
acagatcatctcgaaacaactat

SEQ ID NO: 8396959 - DNA, 22 bp, Homo sapiens
acacatttctcccagtctccat

SEQ ID NO: 8396960 - DNA, 22 bp, Homo sapiens
aaatttcagttacctttacgtt

SEQ ID NO: 8396961 - DNA, 22 bp, Homo sapiens
aaatttcagttggaatgagctc

SEQ ID NO: 8396962 - DNA, 22 bp, Homo sapiens
aaatttcaagcaaagtagctat

SEQ ID NO: 8396963 - DNA, 22 bp, Homo sapiens
aacaagttactcttaaagtata

SEQ ID NO: 8396964 - DNA, 22 bp, Homo sapiens
aaattataggtgccaccttgga

SEQ ID NO: 8396965 - DNA, 22 bp, Homo sapiens
aaatttaaggaggtgctcactt

SEQ ID NO: 8396966 - DNA, 22 bp, Homo sapiens
aaattgttgatctacagtaagg

SEQ ID NO: 8396967 - DNA, 19 bp, Homo sapiens
aagctttcccattaacccc

SEQ ID NO: 8396968 - DNA, 21 bp, Homo sapiens
aaggaaaagcttggtctctga

SEQ ID NO: 8396969 - DNA, 22 bp, Homo sapiens
aataaacaaatccttccttccc

SEQ ID NO: 8396970 - DNA, 22 bp, Homo sapiens
aataaacaaatctttcctgtgg

SEQ ID NO: 8396971 - DNA, 22 bp, Homo sapiens
aataaactgctcaattgcatca

SEQ ID NO: 8396972 - DNA, 20 bp, Homo sapiens
aataaactactgagagatgt

SEQ ID NO: 8396973 - DNA, 22 bp, Homo sapiens
aacagtttcagttactgatgag

SEQ ID NO: 8396974 - DNA, 18 bp, Homo sapiens
aacagtttccagattctc

SEQ ID NO: 8396975 - DNA, 22 bp, Homo sapiens
aacagtttgcctgaaatgtatt

SEQ ID NO: 8396976 - DNA, 20 bp, Homo sapiens
aagttacattgtattgtacc

SEQ ID NO: 8396977 - DNA, 22 bp, Homo sapiens
aagtatttcgttctgaaaaagt

SEQ ID NO: 8396978 - DNA, 22 bp, Homo sapiens
aagtatttctggcctgtgaaag

SEQ ID NO: 8396979 - DNA, 22 bp, Homo sapiens
aacatttacaaatccttctgca

SEQ ID NO: 8396980 - DNA, 22 bp, Homo sapiens
aacattgattgcatctgttcac

SEQ ID NO: 8396981 - DNA, 22 bp, Homo sapiens
aacattgaaatatttgcaatag

SEQ ID NO: 8396982 - DNA, 22 bp, Homo sapiens
aacataaatttgaagtggcaaa

SEQ ID NO: 8396983 - DNA, 22 bp, Homo sapiens
aacattcttaagatttgtgtct

SEQ ID NO: 8396984 - DNA, 22 bp, Homo sapiens
aatatttgaacagtcactgagt

SEQ ID NO: 8396985 - DNA, 22 bp, Homo sapiens
aatatttgcatcattagctatt

SEQ ID NO: 8396986 - DNA, 22 bp, Homo sapiens
aacatttcagcaaataagaaca

SEQ ID NO: 8396987 - DNA, 22 bp, Homo sapiens
aacatttcagcacctgattcct

SEQ ID NO: 8396988 - DNA, 22 bp, Homo sapiens
aacatttatggtagtcattgca

SEQ ID NO: 8396989 - DNA, 22 bp, Homo sapiens
aacatttattgagcacctactg

SEQ ID NO: 8396990 - DNA, 22 bp, Homo sapiens
aacatttattctaattctggga

SEQ ID NO: 8396991 - DNA, 22 bp, Homo sapiens
aacatttaggaaggacctcctc

SEQ ID NO: 8396992 - DNA, 22 bp, Homo sapiens
aacatttatgattgaggtaaat

SEQ ID NO: 8396993 - DNA, 22 bp, Homo sapiens
aacatttatatgggttcatgaa

SEQ ID NO: 8396994 - DNA, 22 bp, Homo sapiens
aaatactgtccaccatggagca

SEQ ID NO: 8396995 - DNA, 22 bp, Homo sapiens
aaatactgtgaataaaggtttt

SEQ ID NO: 8396996 - DNA, 22 bp, Homo sapiens
aaatactgttgaatgaagtaag

SEQ ID NO: 8396997 - DNA, 22 bp, Homo sapiens
aaatatgtaagattagcactag

SEQ ID NO: 8396998 - DNA, 22 bp, Homo sapiens
aaatatgatactcccttttagt

SEQ ID NO: 8396999 - DNA, 22 bp, Homo sapiens
aaatatgagggtgatgcccaga

SEQ ID NO: 8397000 - DNA, 23 bp, Homo sapiens
aaatatgtctgagggcaaagaat

SEQ ID NO: 8397001 - DNA, 21 bp, Homo sapiens
aaatccaaacactagtccaca

SEQ ID NO: 8397002 - DNA, 22 bp, Homo sapiens
aaatccaacgacaggtgtactt

SEQ ID NO: 8397003 - DNA, 19 bp, Homo sapiens
aaatccaagctcaggcctc

SEQ ID NO: 8397004 - DNA, 22 bp, Homo sapiens
aaatccaagctttggtaactga

SEQ ID NO: 8397005 - DNA, 22 bp, Homo sapiens
aaatcatggtggaagaaacaga

SEQ ID NO: 8397006 - DNA, 22 bp, Homo sapiens
aaatggcattcagcaacctttc

SEQ ID NO: 8397007 - DNA, 20 bp, Homo sapiens
aaatgccagtgattctgctt

SEQ ID NO: 8397008 - DNA, 22 bp, Homo sapiens
aaacatcaccattttacctaat

SEQ ID NO: 8397009 - DNA, 23 bp, Homo sapiens
aaagtgcagttgaggaatcatag

SEQ ID NO: 8397010 - DNA, 22 bp, Homo sapiens
aaagcaatgcccgttcattatc

SEQ ID NO: 8397011 - DNA, 22 bp, Homo sapiens
aaacaaagccagggaagttatg

SEQ ID NO: 8397012 - DNA, 22 bp, Homo sapiens
aaacaaacataggtttgaaagt

SEQ ID NO: 8397013 - DNA, 22 bp, Homo sapiens
aaacaaagcatcttgctatgca

SEQ ID NO: 8397014 - DNA, 22 bp, Homo sapiens
aaaatagcctcacataattgct

SEQ ID NO: 8397015 - DNA, 22 bp, Homo sapiens
aaaaatgaattcttcagtggca

SEQ ID NO: 8397016 - DNA, 22 bp, Homo sapiens
aaaaagatgtcctgaagtttag

SEQ ID NO: 8397017 - DNA, 22 bp, Homo sapiens
aaaaagagaaatgctctagtcc

SEQ ID NO: 8397018 - DNA, 22 bp, Homo sapiens
aaagatgaccgtatgtcagagc

SEQ ID NO: 8397019 - DNA, 22 bp, Homo sapiens
aaagatgatctacaagttcatt

SEQ ID NO: 8397020 - DNA, 22 bp, Homo sapiens
aaacttgaggcaatgaaggtgt

SEQ ID NO: 8397021 - DNA, 20 bp, Homo sapiens
aaacttgatggcatagaata

SEQ ID NO: 8397022 - DNA, 22 bp, Homo sapiens
aaacttgatttagaactaaggc

SEQ ID NO: 8397023 - DNA, 22 bp, Homo sapiens
aaacttgagcagtcagatgaag

SEQ ID NO: 8397024 - DNA, 22 bp, Homo sapiens
aaactttaggaaggaatttaca

SEQ ID NO: 8397025 - DNA, 22 bp, Homo sapiens
aaactttaaatttgtacctctg

SEQ ID NO: 8397026 - DNA, 22 bp, Homo sapiens
aaactttaagacagtcctcaag

SEQ ID NO: 8397027 - DNA, 22 bp, Homo sapiens
aaacatgagcacttgcttcata

SEQ ID NO: 8397028 - DNA, 22 bp, Homo sapiens
aaacatgaatagatattaaaca

SEQ ID NO: 8397029 - DNA, 22 bp, Homo sapiens
aaacatcttctcttgattcttt

SEQ ID NO: 8397030 - DNA, 22 bp, Homo sapiens
aaacatctttctattgcaagtt

SEQ ID NO: 8397031 - DNA, 22 bp, Homo sapiens
aaacatttttcttcatcatcct

SEQ ID NO: 8397032 - DNA, 22 bp, Homo sapiens
aaacatgagttaaaagtaactg

SEQ ID NO: 8397033 - DNA, 22 bp, Homo sapiens
aaacattgttatgataaattac

SEQ ID NO: 8397034 - DNA, 22 bp, Homo sapiens
aaacatgagcatctcttcaagc

SEQ ID NO: 8397035 - DNA, 22 bp, Homo sapiens
aaatatcatttataacttttaa

SEQ ID NO: 8397036 - DNA, 22 bp, Homo sapiens
aaatatcattctggtgcacaga

SEQ ID NO: 8397037 - DNA, 22 bp, Homo sapiens
aaatatgaatgataagagttat

SEQ ID NO: 8397038 - DNA, 17 bp, Homo sapiens
aaatatgacctcaaagt

SEQ ID NO: 8397039 - DNA, 22 bp, Homo sapiens
aaatatgactagaatgccaggt

SEQ ID NO: 8397040 - DNA, 22 bp, Homo sapiens
aagattctcagagtgaaagaat

SEQ ID NO: 8397041 - DNA, 22 bp, Homo sapiens
aactttttctgggatggagggt

SEQ ID NO: 8397042 - DNA, 22 bp, Homo sapiens
aagaagttggaaatgattgaga

SEQ ID NO: 8397043 - DNA, 22 bp, Homo sapiens
aagaagttaataatggtgagaa

SEQ ID NO: 8397044 - DNA, 22 bp, Homo sapiens
aactatttttggagctaactct

SEQ ID NO: 8397045 - DNA, 22 bp, Homo sapiens
aacatttcttctgaaactgagt

SEQ ID NO: 8397046 - DNA, 22 bp, Homo sapiens
aactgagacacgaactatgatt

SEQ ID NO: 8397047 - DNA, 22 bp, Homo sapiens
aactgaactgataacatacacg

SEQ ID NO: 8397048 - DNA, 22 bp, Homo sapiens
aactgaaagtttcacctgaggt

SEQ ID NO: 8397049 - DNA, 22 bp, Homo sapiens
aacatttctgagaatatcagtt

SEQ ID NO: 8397050 - DNA, 21 bp, Homo sapiens
aacatttctgggagaactcac

SEQ ID NO: 8397051 - DNA, 22 bp, Homo sapiens
aacatttcattggaagctatgt

SEQ ID NO: 8397052 - DNA, 22 bp, Homo sapiens
aacacatgccttaagaataagt

SEQ ID NO: 8397053 - DNA, 23 bp, Homo sapiens
aacacattgctaattacattcaa

SEQ ID NO: 8397054 - DNA, 22 bp, Homo sapiens
aacagctttgagcagttctgta

SEQ ID NO: 8397055 - DNA, 22 bp, Homo sapiens
aacaacttgcgttcagagatgt

SEQ ID NO: 8397056 - DNA, 22 bp, Homo sapiens
aacaagaacacctacagttcta

SEQ ID NO: 8397057 - DNA, 22 bp, Homo sapiens
aaatggtaaattagtagtagct

SEQ ID NO: 8397058 - DNA, 22 bp, Homo sapiens
aaatggtaagacaacacattat

SEQ ID NO: 8397059 - DNA, 22 bp, Homo sapiens
aaatggtaatgtctttctgttt

SEQ ID NO: 8397060 - DNA, 22 bp, Homo sapiens
aaatggtagtagcattccatat

SEQ ID NO: 8397061 - DNA, 22 bp, Homo sapiens
aaatggtatgaaaagagatttc

SEQ ID NO: 8397062 - DNA, 22 bp, Homo sapiens
aaatggtataatgtcatgtatt

SEQ ID NO: 8397063 - DNA, 22 bp, Homo sapiens
aaatggtccatcctaaagaagt

SEQ ID NO: 8397064 - DNA, 22 bp, Homo sapiens
aaagcaattgtggtttttgtca

SEQ ID NO: 8397065 - DNA, 22 bp, Homo sapiens
aaagcaattgtggtttttgcca

SEQ ID NO: 8397066 - DNA, 22 bp, Homo sapiens
aaagcaattacaaaagggataa

SEQ ID NO: 8397067 - DNA, 22 bp, Homo sapiens
aaagcaatgggtctaaggtaaa

SEQ ID NO: 8397068 - DNA, 22 bp, Homo sapiens
caatacatcaggtcaaaatgtg

SEQ ID NO: 8397069 - DNA, 22 bp, Homo sapiens
caatacatcaggtcaaaatgtg

SEQ ID NO: 8397070 - DNA, 21 bp, Homo sapiens
agcatgcactacttcatctta

SEQ ID NO: 8397071 - DNA, 22 bp, Homo sapiens
cacatttaatcctttataagta

SEQ ID NO: 8397072 - DNA, 22 bp, Homo sapiens
agcaggaaggggcctagcctgg

SEQ ID NO: 8397073 - DNA, 22 bp, Homo sapiens
agatatttaaatcagacaaaga

SEQ ID NO: 8397074 - DNA, 22 bp, Homo sapiens
agatcacagtcaattgcaagtt

SEQ ID NO: 8397075 - DNA, 22 bp, Homo sapiens
agatcatattgtaactttattg

SEQ ID NO: 8397076 - DNA, 22 bp, Homo sapiens
caaagataatcacagaataccc

SEQ ID NO: 8397077 - DNA, 22 bp, Homo sapiens
caaagatatgacatggaaaatg

SEQ ID NO: 8397078 - DNA, 22 bp, Homo sapiens
agatgtttaaaaagatgactct

SEQ ID NO: 8397079 - DNA, 22 bp, Homo sapiens
attacagattataaatttgagc

SEQ ID NO: 8397080 - DNA, 22 bp, Homo sapiens
attacagaagatatgctcaaca

SEQ ID NO: 8397081 - DNA, 22 bp, Homo sapiens
attacagaagatatgctcaaca

SEQ ID NO: 8397082 - DNA, 22 bp, Homo sapiens
attacagaaatatggtcaaaga

SEQ ID NO: 8397083 - DNA, 22 bp, Homo sapiens
attacagaaagcaatattgagt

SEQ ID NO: 8397084 - DNA, 22 bp, Homo sapiens
attacagagggtcggtcgtttt

SEQ ID NO: 8397085 - DNA, 22 bp, Homo sapiens
attacacagcggttactactag

SEQ ID NO: 8397086 - DNA, 22 bp, Homo sapiens
agagtcatagtttaacttttgt

SEQ ID NO: 8397087 - DNA, 22 bp, Homo sapiens
agaatcaaagagaaatactttg

SEQ ID NO: 8397088 - DNA, 22 bp, Homo sapiens
agaatatagttaccaaattctg

SEQ ID NO: 8397089 - DNA, 22 bp, Homo sapiens
atctgcttagaattcattgtcc

SEQ ID NO: 8397090 - DNA, 22 bp, Homo sapiens
atctgcttgaaacttcttatac

SEQ ID NO: 8397091 - DNA, 22 bp, Homo sapiens
atctgcttcagtgatatgtgaa

SEQ ID NO: 8397092 - DNA, 21 bp, Homo sapiens
atctgcttaggtttgttcaga

SEQ ID NO: 8397093 - DNA, 22 bp, Homo sapiens
atctgcttgccctcttaggacc

SEQ ID NO: 8397094 - DNA, 19 bp, Homo sapiens
agacttttgtaagttgaga

SEQ ID NO: 8397095 - DNA, 18 bp, Homo sapiens
aggcacagagcatacata

SEQ ID NO: 8397096 - DNA, 22 bp, Homo sapiens
acataacaatcataggacatag

SEQ ID NO: 8397097 - DNA, 22 bp, Homo sapiens
acagggtcaagggtgctacaag

SEQ ID NO: 8397098 - DNA, 22 bp, Homo sapiens
aggaaaaacctgttaatggtag

SEQ ID NO: 8397099 - DNA, 22 bp, Homo sapiens
accagtttgtaacctgttttca

SEQ ID NO: 8397100 - DNA, 22 bp, Homo sapiens
accaatctcctattttgtttca

SEQ ID NO: 8397101 - DNA, 22 bp, Homo sapiens
acatcttttttctctaattgtg

SEQ ID NO: 8397102 - DNA, 22 bp, Homo sapiens
acatctttttggaaacggctga

SEQ ID NO: 8397103 - DNA, 22 bp, Homo sapiens
acatctttgtttcttagtgtat

SEQ ID NO: 8397104 - DNA, 20 bp, Homo sapiens
acatgaaaggaaacaggaaa

SEQ ID NO: 8397105 - DNA, 22 bp, Homo sapiens
acattctagaagtctttgcaat

SEQ ID NO: 8397106 - DNA, 22 bp, Homo sapiens
acattctttcaccttgtgtcca

SEQ ID NO: 8397107 - DNA, 22 bp, Homo sapiens
acattcaccacacttatagggc

SEQ ID NO: 8397108 - DNA, 22 bp, Homo sapiens
acattgaagggaatgcaaagat

SEQ ID NO: 8397109 - DNA, 22 bp, Homo sapiens
acattgaagctgtgaaatcaaa

SEQ ID NO: 8397110 - DNA, 22 bp, Homo sapiens
acattgaacagtacaaatgatc

SEQ ID NO: 8397111 - DNA, 22 bp, Homo sapiens
agtactttacttcttacagttt

SEQ ID NO: 8397112 - DNA, 22 bp, Homo sapiens
agtacatttagtttatgaacat

SEQ ID NO: 8397113 - DNA, 22 bp, Homo sapiens
agaaatcattttaggcttgatg

SEQ ID NO: 8397114 - DNA, 22 bp, Homo sapiens
agaaatcattgaattatttgct

SEQ ID NO: 8397115 - DNA, 22 bp, Homo sapiens
agaaatcattcccaaacccata

SEQ ID NO: 8397116 - DNA, 22 bp, Homo sapiens
agaaatcatgactaagagcagt

SEQ ID NO: 8397117 - DNA, 22 bp, Homo sapiens
agaaatcatgtcttatttctat

SEQ ID NO: 8397118 - DNA, 23 bp, Homo sapiens
agaaatcatctccaccccatgtc

SEQ ID NO: 8397119 - DNA, 22 bp, Homo sapiens
agaaatcaggaacagtaaggag

SEQ ID NO: 8397120 - DNA, 22 bp, Homo sapiens
atcagtggggacgagaagttta

SEQ ID NO: 8397121 - DNA, 20 bp, Homo sapiens
atcaaaatcctattgaggtt

SEQ ID NO: 8397122 - DNA, 22 bp, Homo sapiens
actttttgcatagtaagtgtct

SEQ ID NO: 8397123 - DNA, 22 bp, Homo sapiens
actttttagtttcctcaaacat

SEQ ID NO: 8397124 - DNA, 22 bp, Homo sapiens
actttttacagggtgtatacca

SEQ ID NO: 8397125 - DNA, 21 bp, Homo sapiens
agaaaaaccagcatgttttca

SEQ ID NO: 8397126 - DNA, 19 bp, Homo sapiens
agaaaaactggtactgctg

SEQ ID NO: 8397127 - DNA, 22 bp, Homo sapiens
atattttggggtgatgtgcatc

SEQ ID NO: 8397128 - DNA, 22 bp, Homo sapiens
acttaaaaacagatccagcagg

SEQ ID NO: 8397129 - DNA, 22 bp, Homo sapiens
ataaagtagccactggaaagct

SEQ ID NO: 8397130 - DNA, 22 bp, Homo sapiens
acttaaaaacagatccagcagg

SEQ ID NO: 8397131 - DNA, 22 bp, Homo sapiens
actgttttgtgccttagtttcc

SEQ ID NO: 8397132 - DNA, 22 bp, Homo sapiens
actgttttctaaagaacagatg

SEQ ID NO: 8397133 - DNA, 22 bp, Homo sapiens
actgttttcctaatgagcaaga

SEQ ID NO: 8397134 - DNA, 22 bp, Homo sapiens
ataaaaactgacccatcctttg

SEQ ID NO: 8397135 - DNA, 21 bp, Homo sapiens
agtttttactcttaactgtgg

SEQ ID NO: 8397136 - DNA, 18 bp, Homo sapiens
agtttttaggaagaaatg

SEQ ID NO: 8397137 - DNA, 22 bp, Homo sapiens
actttacacatcttttctcatt

SEQ ID NO: 8397138 - DNA, 22 bp, Homo sapiens
atacatctagagtcataaaaac

SEQ ID NO: 8397139 - DNA, 22 bp, Homo sapiens
atacatcatgctccatatattt

SEQ ID NO: 8397140 - DNA, 22 bp, Homo sapiens
agtctttggttataagagacag

SEQ ID NO: 8397141 - DNA, 22 bp, Homo sapiens
ctcacattccacttgtgccaac

SEQ ID NO: 8397142 - DNA, 19 bp, Homo sapiens
agtgaaatggagtattcaa

SEQ ID NO: 8397143 - DNA, 22 bp, Homo sapiens
agtgaaaacctaatcatgcagt

SEQ ID NO: 8397144 - DNA, 22 bp, Homo sapiens
agtgcctagatattgtttgaac

SEQ ID NO: 8397145 - DNA, 22 bp, Homo sapiens
agtgcctaaccccttgtatgaa

SEQ ID NO: 8397146 - DNA, 17 bp, Homo sapiens
agtgtttccttatcatt

SEQ ID NO: 8397147 - DNA, 22 bp, Homo sapiens
aggtaatagggttcagaattat

SEQ ID NO: 8397148 - DNA, 22 bp, Homo sapiens
ctatcaaacagccattaatata

SEQ ID NO: 8397149 - DNA, 20 bp, Homo sapiens
agtcacatgcatacacaagt

SEQ ID NO: 8397150 - DNA, 22 bp, Homo sapiens
agtaacagagcatgggttcaga

SEQ ID NO: 8397151 - DNA, 22 bp, Homo sapiens
agtatttctgctcatgaaagag

SEQ ID NO: 8397152 - DNA, 22 bp, Homo sapiens
agtatttctgaatattatcata

SEQ ID NO: 8397153 - DNA, 22 bp, Homo sapiens
cttaacatcctgcatttttctt

SEQ ID NO: 8397154 - DNA, 19 bp, Homo sapiens
atcatacatgttacactct

SEQ ID NO: 8397155 - DNA, 22 bp, Homo sapiens
atcatacatacatggtcctcag

SEQ ID NO: 8397156 - DNA, 22 bp, Homo sapiens
atcatacagaacctgagcactt

SEQ ID NO: 8397157 - DNA, 22 bp, Homo sapiens
cttcaacttccctagatgtcat

SEQ ID NO: 8397158 - DNA, 22 bp, Homo sapiens
cttcaactgggcttcgatgtgg

SEQ ID NO: 8397159 - DNA, 22 bp, Homo sapiens
cttcaatttttggtatgatgga

SEQ ID NO: 8397160 - DNA, 22 bp, Homo sapiens
atctgtatgttgacctcctaga

SEQ ID NO: 8397161 - DNA, 22 bp, Homo sapiens
cttcttaactgtatatactatg

SEQ ID NO: 8397162 - DNA, 22 bp, Homo sapiens
atcacaaaggtctcagagcaca

SEQ ID NO: 8397163 - DNA, 22 bp, Homo sapiens
atcacaaagggttttctctgag

SEQ ID NO: 8397164 - DNA, 22 bp, Homo sapiens
ataaacatctgtttctcttctg

SEQ ID NO: 8397165 - DNA, 22 bp, Homo sapiens
ataaagctaagacttacatgaa

SEQ ID NO: 8397166 - DNA, 20 bp, Homo sapiens
ataaaactctaatctggcct

SEQ ID NO: 8397167 - DNA, 22 bp, Homo sapiens
ataaaacttattagaattgtgt

SEQ ID NO: 8397168 - DNA, 22 bp, Homo sapiens
atatactgtaggccactataag

SEQ ID NO: 8397169 - DNA, 22 bp, Homo sapiens
atatactgtgttccatggacca

SEQ ID NO: 8397170 - DNA, 22 bp, Homo sapiens
atagtttgaaggctgttctact

SEQ ID NO: 8397171 - DNA, 21 bp, Homo sapiens
aggaagatctggaggtcggcg

SEQ ID NO: 8397172 - DNA, 20 bp, Homo sapiens
aggaagatcctttcttttaa

SEQ ID NO: 8397173 - DNA, 22 bp, Homo sapiens
aggaagatgtgcaaagttggaa

SEQ ID NO: 8397174 - DNA, 22 bp, Homo sapiens
aggaagatgggagagctctgga

SEQ ID NO: 8397175 - DNA, 22 bp, Homo sapiens
aggaagatgtgtttagcaggtt

SEQ ID NO: 8397176 - DNA, 22 bp, Homo sapiens
aggaaacagttggtaatgcata

SEQ ID NO: 8397177 - DNA, 22 bp, Homo sapiens
aggaaacatccttatctattct

SEQ ID NO: 8397178 - DNA, 20 bp, Homo sapiens
aggaaaaatggaaactggag

SEQ ID NO: 8397179 - DNA, 22 bp, Homo sapiens
aggaaaatgaaacagcaactgt

SEQ ID NO: 8397180 - DNA, 20 bp, Homo sapiens
caggcagaggatgctgacca

SEQ ID NO: 8397181 - DNA, 20 bp, Homo sapiens
caggcagaggatgctgacca

SEQ ID NO: 8397182 - DNA, 22 bp, Homo sapiens
caggcagagtgagaagcccttg

SEQ ID NO: 8397183 - DNA, 17 bp, Homo sapiens
caggaaaatatgagtga

SEQ ID NO: 8397184 - DNA, 22 bp, Homo sapiens
caggaaatgctatcatagctga

SEQ ID NO: 8397185 - DNA, 22 bp, Homo sapiens
caggaaatgaaagctagctaat

SEQ ID NO: 8397186 - DNA, 22 bp, Homo sapiens
caggaaatgaacaggaatgaac

SEQ ID NO: 8397187 - DNA, 19 bp, Homo sapiens
catatttttgggctggcat

SEQ ID NO: 8397188 - DNA, 22 bp, Homo sapiens
catattttagttgctgaacagc

SEQ ID NO: 8397189 - DNA, 22 bp, Homo sapiens
catcatttcacttagatgaagt

SEQ ID NO: 8397190 - DNA, 22 bp, Homo sapiens
catcatttttgtaagctggtag

SEQ ID NO: 8397191 - DNA, 22 bp, Homo sapiens
catcattttattaaccaagaaa

SEQ ID NO: 8397192 - DNA, 22 bp, Homo sapiens
ccaaagcaagtcacatgatcaa

SEQ ID NO: 8397193 - DNA, 22 bp, Homo sapiens
ccatttcactcttcctgaagga

SEQ ID NO: 8397194 - DNA, 22 bp, Homo sapiens
ccatttcacccactgctttagg

SEQ ID NO: 8397195 - DNA, 18 bp, Homo sapiens
ccatttcatgattattac

SEQ ID NO: 8397196 - DNA, 19 bp, Homo sapiens
ccatttcatatgtattgtg

SEQ ID NO: 8397197 - DNA, 22 bp, Homo sapiens
ccatttcactgggtagttgtgg

SEQ ID NO: 8397198 - DNA, 22 bp, Homo sapiens
ccatttcattgcctgtaaagtg

SEQ ID NO: 8397199 - DNA, 22 bp, Homo sapiens
ccatttagtaaggaagaacagc

SEQ ID NO: 8397200 - DNA, 22 bp, Homo sapiens
ccatttgtaccatttctttgta

SEQ ID NO: 8397201 - DNA, 22 bp, Homo sapiens
gctaatgtgatagagcagaaag

SEQ ID NO: 8397202 - DNA, 22 bp, Homo sapiens
gctaaggagggtcttgcaaatt

SEQ ID NO: 8397203 - DNA, 22 bp, Homo sapiens
caaatgaagaaccttctcacct

SEQ ID NO: 8397204 - DNA, 22 bp, Homo sapiens
attttgaaatacttgaaggaaa

SEQ ID NO: 8397205 - DNA, 18 bp, Homo sapiens
attttgaacaatgctgta

SEQ ID NO: 8397206 - DNA, 22 bp, Homo sapiens
attttgaaaagcatttgagtaa

SEQ ID NO: 8397207 - DNA, 21 bp, Homo sapiens
atttgcattaaaatattacgc

SEQ ID NO: 8397208 - DNA, 22 bp, Homo sapiens
atttgcatttagaaagatcact

SEQ ID NO: 8397209 - DNA, 22 bp, Homo sapiens
attttaataagatccatttggt

SEQ ID NO: 8397210 - DNA, 22 bp, Homo sapiens
atttgtctttgagtgccctgct

SEQ ID NO: 8397211 - DNA, 23 bp, Homo sapiens
attttaaccttgactaacatgca

SEQ ID NO: 8397212 - DNA, 22 bp, Homo sapiens
atttgattagctgtgtaatttt

SEQ ID NO: 8397213 - DNA, 22 bp, Homo sapiens
attgtaacaacaatagtttagg

SEQ ID NO: 8397214 - DNA, 22 bp, Homo sapiens
attgtaagtagaaatgttatgg

SEQ ID NO: 8397215 - DNA, 22 bp, Homo sapiens
attgtaaagtactgtgtacaat

SEQ ID NO: 8397216 - DNA, 22 bp, Homo sapiens
gcaaatgtttttgagtgtttac

SEQ ID NO: 8397217 - DNA, 22 bp, Homo sapiens
gcaaatgttctatatttgctgt

SEQ ID NO: 8397218 - DNA, 22 bp, Homo sapiens
gcaaaacagtcgatgcctccca

SEQ ID NO: 8397219 - DNA, 22 bp, Homo sapiens
gcaaaaaatgcttgttgcttag

SEQ ID NO: 8397220 - DNA, 22 bp, Homo sapiens
gcagatcaattgattgttcact

SEQ ID NO: 8397221 - DNA, 18 bp, Homo sapiens
gcagatcattagataatt

SEQ ID NO: 8397222 - DNA, 22 bp, Homo sapiens
atggttatttcatggaaaaatt

SEQ ID NO: 8397223 - DNA, 22 bp, Homo sapiens
atgtaaattgtactgacacacg

SEQ ID NO: 8397224 - DNA, 22 bp, Homo sapiens
atgtaacaaatggtatacatgt

SEQ ID NO: 8397225 - DNA, 22 bp, Homo sapiens
atgtttcaccagcaaattacct

SEQ ID NO: 8397226 - DNA, 22 bp, Homo sapiens
atgtttcaagagaaaaagagac

SEQ ID NO: 8397227 - DNA, 22 bp, Homo sapiens
atgtttaattatctgggttttg

SEQ ID NO: 8397228 - DNA, 20 bp, Homo sapiens
atgtttaatgttgtccaccc

SEQ ID NO: 8397229 - DNA, 22 bp, Homo sapiens
atgtttcatgactgagcaaaat

SEQ ID NO: 8397230 - DNA, 22 bp, Homo sapiens
atgtttcaggcgaactaacatg

SEQ ID NO: 8397231 - DNA, 20 bp, Homo sapiens
gaatgtttcacttgctccat

SEQ ID NO: 8397232 - DNA, 22 bp, Homo sapiens
gaatgtttcatgtgtatgttag

SEQ ID NO: 8397233 - DNA, 22 bp, Homo sapiens
gaatgtttaaggaaggcgtggc

SEQ ID NO: 8397234 - DNA, 22 bp, Homo sapiens
gaatgtttaaaaggtgcagttt

SEQ ID NO: 8397235 - DNA, 22 bp, Homo sapiens
gaatgtttgactaaaggtagct

SEQ ID NO: 8397236 - DNA, 19 bp, Homo sapiens
gaatgtttctgtctcttct

SEQ ID NO: 8397237 - DNA, 22 bp, Homo sapiens
atgccctgctgccatctggccg

SEQ ID NO: 8397238 - DNA, 22 bp, Homo sapiens
gacataaaccttgagatattaa

SEQ ID NO: 8397239 - DNA, 22 bp, Homo sapiens
gactttgagggatacaaacatt

SEQ ID NO: 8397240 - DNA, 22 bp, Homo sapiens
gaaatatacatgaagtcggctg

SEQ ID NO: 8397241 - DNA, 22 bp, Homo sapiens
gaaatgacaaggacattcctgt

SEQ ID NO: 8397242 - DNA, 22 bp, Homo sapiens
gaacatcatgaagaaaacatat

SEQ ID NO: 8397243 - DNA, 22 bp, Homo sapiens
gaacatcaaggtctgtgtctag

SEQ ID NO: 8397244 - DNA, 22 bp, Homo sapiens
gaacatcagtcataatttaacg

SEQ ID NO: 8397245 - DNA, 22 bp, Homo sapiens
gaacatttatattagatagcta

SEQ ID NO: 8397246 - DNA, 22 bp, Homo sapiens
gaacatttccagaaaggaacta

SEQ ID NO: 8397247 - DNA, 22 bp, Homo sapiens
gaacatttgatgatgacattgg

SEQ ID NO: 8397248 - DNA, 22 bp, Homo sapiens
atgcaaggacatgtaatgatgt

SEQ ID NO: 8397249 - DNA, 22 bp, Homo sapiens
atgcaaatgctagagaatgttg

SEQ ID NO: 8397250 - DNA, 22 bp, Homo sapiens
gaaaacttggatctctagaatg

SEQ ID NO: 8397251 - DNA, 19 bp, Homo sapiens
gaaaacatgggtgagggtc

SEQ ID NO: 8397252 - DNA, 22 bp, Homo sapiens
atgaatcagaatctgcatttta

SEQ ID NO: 8397253 - DNA, 22 bp, Homo sapiens
atgaatatgtacacatctgtca

SEQ ID NO: 8397254 - DNA, 22 bp, Homo sapiens
atcttcagcgaggtttcctttc

SEQ ID NO: 8397255 - DNA, 22 bp, Homo sapiens
cacatttttactgccaacttaa

SEQ ID NO: 8397256 - DNA, 23 bp, Homo sapiens
caaattctaggcaggctcttttg

SEQ ID NO: 8397257 - DNA, 18 bp, Homo sapiens
caaattctcattgatttc

SEQ ID NO: 8397258 - DNA, 22 bp, Homo sapiens
caaattctcttactgtttgaca

SEQ ID NO: 8397259 - DNA, 22 bp, Homo sapiens
caaattctcaccctgtttgatt

SEQ ID NO: 8397260 - DNA, 22 bp, Homo sapiens
caaatttaagttagaaagcaat

SEQ ID NO: 8397261 - DNA, 22 bp, Homo sapiens
caagttatttcattggaacaat

SEQ ID NO: 8397262 - DNA, 22 bp, Homo sapiens
caagttagttattcttgtgagc

SEQ ID NO: 8397263 - DNA, 22 bp, Homo sapiens
ggaaatgtcatagaaatataag

SEQ ID NO: 8397264 - DNA, 22 bp, Homo sapiens
cagatacaggtttttgttagat

SEQ ID NO: 8397265 - DNA, 22 bp, Homo sapiens
gtgaatattctttgtgcagtat

SEQ ID NO: 8397266 - DNA, 22 bp, Homo sapiens
gtgcaaatgtaattgcagtttt

SEQ ID NO: 8397267 - DNA, 22 bp, Homo sapiens
gtctttggaaagacaaagttca

SEQ ID NO: 8397268 - DNA, 23 bp, Homo sapiens
gtgaaggtttctgcatttattgg

SEQ ID NO: 8397269 - DNA, 22 bp, Homo sapiens
gtgaagttcaagcttgccatct

SEQ ID NO: 8397270 - DNA, 22 bp, Homo sapiens
catgtacagtttttctgtcctg

SEQ ID NO: 8397271 - DNA, 23 bp, Homo sapiens
catggaaaactgaaagctgacct

SEQ ID NO: 8397272 - DNA, 22 bp, Homo sapiens
catgtaaagcacttcataacag

SEQ ID NO: 8397273 - DNA, 22 bp, Homo sapiens
tcataagtaatttaaacattcc

SEQ ID NO: 8397274 - DNA, 22 bp, Homo sapiens
catctagaaaaaagacctgttg

SEQ ID NO: 8397275 - DNA, 22 bp, Homo sapiens
catctacactgattaggtgaac

SEQ ID NO: 8397276 - DNA, 22 bp, Homo sapiens
catctacaggagaatgtcactg

SEQ ID NO: 8397277 - DNA, 21 bp, Homo sapiens
catcagatttagaagttctat

SEQ ID NO: 8397278 - DNA, 22 bp, Homo sapiens
catcagcactatgattaaagta

SEQ ID NO: 8397279 - DNA, 22 bp, Homo sapiens
catcaaataaagaaattccttg

SEQ ID NO: 8397280 - DNA, 22 bp, Homo sapiens
catcaaatgccatatatggttg

SEQ ID NO: 8397281 - DNA, 22 bp, Homo sapiens
catcaaacaaatgcttttagat

SEQ ID NO: 8397282 - DNA, 22 bp, Homo sapiens
catcacaaaatgattattccct

SEQ ID NO: 8397283 - DNA, 22 bp, Homo sapiens
tcaggcagaaaaatcactaatt

SEQ ID NO: 8397284 - DNA, 22 bp, Homo sapiens
tcacttcacacccactatcatg

SEQ ID NO: 8397285 - DNA, 22 bp, Homo sapiens
tccagtttgcactgtataatag

SEQ ID NO: 8397286 - DNA, 20 bp, Homo sapiens
tccagttttggagacattct

SEQ ID NO: 8397287 - DNA, 22 bp, Homo sapiens
tccatattaactaaaactagaa

SEQ ID NO: 8397288 - DNA, 22 bp, Homo sapiens
catttcactattcactaaaagg

SEQ ID NO: 8397289 - DNA, 22 bp, Homo sapiens
catttcacgcacactcattact

SEQ ID NO: 8397290 - DNA, 22 bp, Homo sapiens
catttcaccttagagaattatt

SEQ ID NO: 8397291 - DNA, 22 bp, Homo sapiens
catttcacagtatattcaaaat

SEQ ID NO: 8397292 - DNA, 22 bp, Homo sapiens
catttccacttctgaaaactgg

SEQ ID NO: 8397293 - DNA, 22 bp, Homo sapiens
catttcatagttgtcacaataa

SEQ ID NO: 8397294 - DNA, 22 bp, Homo sapiens
catttcagtgttattctaattt

SEQ ID NO: 8397295 - DNA, 21 bp, Homo sapiens
catttcagtaaggaagcctgt

SEQ ID NO: 8397296 - DNA, 20 bp, Homo sapiens
catttcattgtgtcttcact

SEQ ID NO: 8397297 - DNA, 22 bp, Homo sapiens
catttcattcctttgaaagtgg

SEQ ID NO: 8397298 - DNA, 22 bp, Homo sapiens
cattttaaatgatttaagccaa

SEQ ID NO: 8397299 - DNA, 22 bp, Homo sapiens
cattttaagatgacctggtttc

SEQ ID NO: 8397300 - DNA, 19 bp, Homo sapiens
cattttaagcatccccagt

SEQ ID NO: 8397301 - DNA, 22 bp, Homo sapiens
cattttgtgctagacactatgg

SEQ ID NO: 8397302 - DNA, 22 bp, Homo sapiens
tacactttcgtttgtggattag

SEQ ID NO: 8397303 - DNA, 22 bp, Homo sapiens
tacagagaactcatagaaagaa

SEQ ID NO: 8397304 - DNA, 22 bp, Homo sapiens
caggccaaaattcaggcattct

SEQ ID NO: 8397305 - DNA, 20 bp, Homo sapiens
tacagagagctagctctctg

SEQ ID NO: 8397306 - DNA, 22 bp, Homo sapiens
tacagagacccacaagagactg

SEQ ID NO: 8397307 - DNA, 22 bp, Homo sapiens
tacagagactttatggcacaaa

SEQ ID NO: 8397308 - DNA, 22 bp, Homo sapiens
tacagagagataagtgtaaaag

SEQ ID NO: 8397309 - DNA, 22 bp, Homo sapiens
tacagagagaggggttaccagg

SEQ ID NO: 8397310 - DNA, 22 bp, Homo sapiens
tattccaatgtcagttatatca

SEQ ID NO: 8397311 - DNA, 22 bp, Homo sapiens
tcaaattttaacatgcattaga

SEQ ID NO: 8397312 - DNA, 22 bp, Homo sapiens
tcaaatgtaatttattgtttta

SEQ ID NO: 8397313 - DNA, 17 bp, Homo sapiens
tcaaatgtacagaacta

SEQ ID NO: 8397314 - DNA, 22 bp, Homo sapiens
tagttttagcagcaatgggatg

SEQ ID NO: 8397315 - DNA, 22 bp, Homo sapiens
tagttttagtcccattttacag

SEQ ID NO: 8397316 - DNA, 22 bp, Homo sapiens
tagtttgtcaaccactgtcaca

SEQ ID NO: 8397317 - DNA, 22 bp, Homo sapiens
tatgtacatgatttcatttgct

SEQ ID NO: 8397318 - DNA, 22 bp, Homo sapiens
tatgaagaagacaaatgacact

SEQ ID NO: 8397319 - DNA, 22 bp, Homo sapiens
tatgaagaagttctgtgaaatg

SEQ ID NO: 8397320 - DNA, 22 bp, Homo sapiens
tatgaagaaatctttgaaaatc

SEQ ID NO: 8397321 - DNA, 22 bp, Homo sapiens
tatattgtagctgatgacaaat

SEQ ID NO: 8397322 - DNA, 22 bp, Homo sapiens
tatattgctagtggtactgtaa

SEQ ID NO: 8397323 - DNA, 20 bp, Homo sapiens
tctgttattgcatgtacata

SEQ ID NO: 8397324 - DNA, 22 bp, Homo sapiens
tgaaatgatatctgataacaaa

SEQ ID NO: 8397325 - DNA, 22 bp, Homo sapiens
tgaaatgagatagataatcagg

SEQ ID NO: 8397326 - DNA, 22 bp, Homo sapiens
tcttgccctcaacaagagcatg

SEQ ID NO: 8397327 - DNA, 21 bp, Homo sapiens
tgaaacaatcagacagagtct

SEQ ID NO: 8397328 - DNA, 22 bp, Homo sapiens
tgaaacaagatccacagacttg

SEQ ID NO: 8397329 - DNA, 22 bp, Homo sapiens
tgaaacaaatttggaaaatcta

SEQ ID NO: 8397330 - DNA, 23 bp, Homo sapiens
tgaaacagatgccaatgatcaag

SEQ ID NO: 8397331 - DNA, 22 bp, Homo sapiens
tgaaatgagagcacagaataaa

SEQ ID NO: 8397332 - DNA, 22 bp, Homo sapiens
tgcaatcaggtaccatttgatt

SEQ ID NO: 8397333 - DNA, 19 bp, Homo sapiens
tgcaatcagctacccaggt

SEQ ID NO: 8397334 - DNA, 22 bp, Homo sapiens
tggtaccaggggttatttctgc

SEQ ID NO: 8397335 - DNA, 22 bp, Homo sapiens
tggtaccagctgtgtgttcact

SEQ ID NO: 8397336 - DNA, 22 bp, Homo sapiens
tggccaatcactgacaaaatgc

SEQ ID NO: 8397337 - DNA, 22 bp, Homo sapiens
tgctaactattcctaaagatca

SEQ ID NO: 8397338 - DNA, 19 bp, Homo sapiens
tgctaagtcctttagaggc

SEQ ID NO: 8397339 - DNA, 22 bp, Homo sapiens
tgctaagttctgcaaaagataa

SEQ ID NO: 8397340 - DNA, 22 bp, Homo sapiens
tgctaccttttttattaaatga

SEQ ID NO: 8397341 - DNA, 22 bp, Homo sapiens
ctgtaaaatgaacctagtcatc

SEQ ID NO: 8397342 - DNA, 22 bp, Homo sapiens
ctgtacagagttctgagtgtac

SEQ ID NO: 8397343 - DNA, 22 bp, Homo sapiens
ctgtacaggagacgtctgtgca

SEQ ID NO: 8397344 - DNA, 22 bp, Homo sapiens
ctgtacaggtcaatgataagat

SEQ ID NO: 8397345 - DNA, 22 bp, Homo sapiens
ctgtacagaagctagagcaaat

SEQ ID NO: 8397346 - DNA, 22 bp, Homo sapiens
ctgtacagacctattagcccag

SEQ ID NO: 8397347 - DNA, 22 bp, Homo sapiens
ctgtcacactaaaacaagaagt

SEQ ID NO: 8397348 - DNA, 22 bp, Homo sapiens
cttacatactgagaaaatatcc

SEQ ID NO: 8397349 - DNA, 22 bp, Homo sapiens
cttaaaagagatgacggcaggg

SEQ ID NO: 8397350 - DNA, 22 bp, Homo sapiens
cttaaaagttgcttccctaact

SEQ ID NO: 8397351 - DNA, 22 bp, Homo sapiens
ctgtttgttggctattgacagt

SEQ ID NO: 8397352 - DNA, 22 bp, Homo sapiens
ctgtttatcatgtacatttcca

SEQ ID NO: 8397353 - DNA, 22 bp, Homo sapiens
cttcagtgttggttcattacga

SEQ ID NO: 8397354 - DNA, 22 bp, Homo sapiens
cttcagtgttgccagggcctag

SEQ ID NO: 8397355 - DNA, 22 bp, Homo sapiens
cttatacaccctcttcccaggc

SEQ ID NO: 8397356 - DNA, 22 bp, Homo sapiens
cttccaatagcaacaaagatta

SEQ ID NO: 8397357 - DNA, 22 bp, Homo sapiens
ctttgaaagctcccaggactta

SEQ ID NO: 8397358 - DNA, 22 bp, Homo sapiens
ctttgaaaggaagccacacagc

SEQ ID NO: 8397359 - DNA, 22 bp, Homo sapiens
ctttgatataagtatacatagt

SEQ ID NO: 8397360 - DNA, 22 bp, Homo sapiens
ctttgacatccttgttcctcag

SEQ ID NO: 8397361 - DNA, 22 bp, Homo sapiens
ctttgaaaacttaaataacagc

SEQ ID NO: 8397362 - DNA, 22 bp, Homo sapiens
gaaagagaggggctgagatgca

SEQ ID NO: 8397363 - DNA, 22 bp, Homo sapiens
gaaaatttctgccacatgtgtg

SEQ ID NO: 8397364 - DNA, 22 bp, Homo sapiens
gaaacaatacttgtcctcacta

SEQ ID NO: 8397365 - DNA, 22 bp, Homo sapiens
gaaaatttaattctcttctgtg

SEQ ID NO: 8397366 - DNA, 22 bp, Homo sapiens
ctttgattcagagagaattagc

SEQ ID NO: 8397367 - DNA, 22 bp, Homo sapiens
gaggaagaattggttattggag

SEQ ID NO: 8397368 - DNA, 22 bp, Homo sapiens
gaggaaaatgggacaggctgta

SEQ ID NO: 8397369 - DNA, 22 bp, Homo sapiens
gaggaaaatggagtgtaattaa

SEQ ID NO: 8397370 - DNA, 22 bp, Homo sapiens
gagaaacactgttagtttatta

SEQ ID NO: 8397371 - DNA, 22 bp, Homo sapiens
gacatttagaagttagattcaa

SEQ ID NO: 8397372 - DNA, 22 bp, Homo sapiens
gacatttaggtagcttccagtt

SEQ ID NO: 8397373 - DNA, 22 bp, Homo sapiens
gacatttagctgttttgcattt

SEQ ID NO: 8397374 - DNA, 22 bp, Homo sapiens
gactgaaagcttggaatgttcc

SEQ ID NO: 8397375 - DNA, 22 bp, Homo sapiens
gacatttaaattgcaggcagcc

SEQ ID NO: 8397376 - DNA, 22 bp, Homo sapiens
gacatttactgaatactgatta

SEQ ID NO: 8397377 - DNA, 22 bp, Homo sapiens
gacatttagaagtctaatggcc

SEQ ID NO: 8397378 - DNA, 22 bp, Homo sapiens
gacatttaatagtattgtggga

SEQ ID NO: 8397379 - DNA, 22 bp, Homo sapiens
gacatttaaggcagtcacttaa

SEQ ID NO: 8397380 - DNA, 22 bp, Homo sapiens
gaatgaaagatttgcattctat

SEQ ID NO: 8397381 - DNA, 22 bp, Homo sapiens
gaaagcttccattttgtacatt

SEQ ID NO: 8397382 - DNA, 22 bp, Homo sapiens
tttcaaagttgggaattgtaat

SEQ ID NO: 8397383 - DNA, 22 bp, Homo sapiens
tttcaaataccataaacctaat

SEQ ID NO: 8397384 - DNA, 22 bp, Homo sapiens
tttcaaagtcaatatcattacc

SEQ ID NO: 8397385 - DNA, 22 bp, Homo sapiens
tttcaaagtcaagaaggatact

SEQ ID NO: 8397386 - DNA, 22 bp, Homo sapiens
tttatatgtgaaggtttgcaga

SEQ ID NO: 8397387 - DNA, 22 bp, Homo sapiens
tttctctctacagtactttcat

SEQ ID NO: 8397388 - DNA, 19 bp, Homo sapiens
ctctgcttggtccatatgc

SEQ ID NO: 8397389 - DNA, 22 bp, Homo sapiens
tttcttcttgatttaaacaggg

SEQ ID NO: 8397390 - DNA, 22 bp, Homo sapiens
ctgaaaatgttacacaggaaga

SEQ ID NO: 8397391 - DNA, 22 bp, Homo sapiens
ctgaaaaacgggatttggctgg

SEQ ID NO: 8397392 - DNA, 22 bp, Homo sapiens
ctgaaactggagtccttatatc

SEQ ID NO: 8397393 - DNA, 22 bp, Homo sapiens
ttccaaattaaaatgtacaatg

SEQ ID NO: 8397394 - DNA, 22 bp, Homo sapiens
ttcagtttccacttacatttaa

SEQ ID NO: 8397395 - DNA, 22 bp, Homo sapiens
ttcagtttcgttatctatgaga

SEQ ID NO: 8397396 - DNA, 22 bp, Homo sapiens
cgtgacacattctggacatggt

SEQ ID NO: 8397397 - DNA, 22 bp, Homo sapiens
cgtgaaatgagttgaattattg

SEQ ID NO: 8397398 - DNA, 22 bp, Homo sapiens
ctaactttagcttagattatca

SEQ ID NO: 8397399 - DNA, 22 bp, Homo sapiens
ctacatcacttaattcttagaa

SEQ ID NO: 8397400 - DNA, 22 bp, Homo sapiens
ttctgaaaggcaggttgtttgc

SEQ ID NO: 8397401 - DNA, 22 bp, Homo sapiens
ctataaatctacccagcattgg

SEQ ID NO: 8397402 - DNA, 22 bp, Homo sapiens
ttctgaaaccttcagtatgaag

SEQ ID NO: 8397403 - DNA, 22 bp, Homo sapiens
ttcttaaagaggcaaaacacag

SEQ ID NO: 8397404 - DNA, 20 bp, Homo sapiens
ttcttaaagacctcactttg

SEQ ID NO: 8397405 - DNA, 21 bp, Homo sapiens
ttgcaccatgataaattcaga

SEQ ID NO: 8397406 - DNA, 22 bp, Homo sapiens
ttgcactataggaaaatgtgtc

SEQ ID NO: 8397407 - DNA, 22 bp, Homo sapiens
ttgcctatgtaactttatattt

SEQ ID NO: 8397408 - DNA, 22 bp, Homo sapiens
ttcaaaaaggtatgttcaagtc

SEQ ID NO: 8397409 - DNA, 22 bp, Homo sapiens
ttatgtatggatggctgaaagt

SEQ ID NO: 8397410 - DNA, 22 bp, Homo sapiens
ttatgtacaatgttaatgtaaa

SEQ ID NO: 8397411 - DNA, 22 bp, Homo sapiens
ttatgtactctgcaatgtttga

SEQ ID NO: 8397412 - DNA, 20 bp, Homo sapiens
ttacagaaatgatgttattt

SEQ ID NO: 8397413 - DNA, 22 bp, Homo sapiens
ttaccagatgggggactatgag

SEQ ID NO: 8397414 - DNA, 22 bp, Homo sapiens
ttaccaatgtgcttttgctaca

SEQ ID NO: 8397415 - DNA, 21 bp, Homo sapiens
ttaccaatggcttctctttcc

SEQ ID NO: 8397416 - DNA, 22 bp, Homo sapiens
ttaatgaaacattgactatgat

SEQ ID NO: 8397417 - DNA, 22 bp, Homo sapiens
ttaatagatttgattttaaagg

SEQ ID NO: 8397418 - DNA, 22 bp, Homo sapiens
ttaatatgttgaaatttattag

SEQ ID NO: 8397419 - DNA, 22 bp, Homo sapiens
ttaatatgctgcttcttgaaaa

SEQ ID NO: 8397420 - DNA, 22 bp, Homo sapiens
ttaaaatagccagtgcccctct

SEQ ID NO: 8397421 - DNA, 22 bp, Homo sapiens
ttaaaatctaaagcagttgtct

SEQ ID NO: 8397422 - DNA, 22 bp, Homo sapiens
ttaaaatgaatattgattagca

SEQ ID NO: 8397423 - DNA, 22 bp, Homo sapiens
ttaaaagtctgatgatttacat

SEQ ID NO: 8397424 - DNA, 19 bp, Homo sapiens
tgttgccaggtatcatgtt

SEQ ID NO: 8397425 - DNA, 22 bp, Homo sapiens
tgttttcatggttatgtgtcta

SEQ ID NO: 8397426 - DNA, 22 bp, Homo sapiens
ggtaacagttacagtaacagta

SEQ ID NO: 8397427 - DNA, 22 bp, Homo sapiens
gtgcaatccagttgatttttac

SEQ ID NO: 8397428 - DNA, 22 bp, Homo sapiens
gtcttcttttcagtctgcttgt

SEQ ID NO: 8397429 - DNA, 22 bp, Homo sapiens
gtaacaaacggttccaagatgc

SEQ ID NO: 8397430 - DNA, 22 bp, Homo sapiens
gtaacaaaggataacttggttt

SEQ ID NO: 8397431 - DNA, 22 bp, Homo sapiens
gtaaatcataaaatttgagctc

SEQ ID NO: 8397432 - DNA, 22 bp, Homo sapiens
gtaaatcagtgtcattttagaa

SEQ ID NO: 8397433 - DNA, 19 bp, Homo sapiens
gtaacagtggacattttag

SEQ ID NO: 8397434 - DNA, 22 bp, Homo sapiens
gtaacagtttgggttccaattg

SEQ ID NO: 8397435 - DNA, 22 bp, Homo sapiens
gtaacaaagtttctaggtgctg

SEQ ID NO: 8397436 - DNA, 22 bp, Homo sapiens
gtcaacatttactgccctggcc

SEQ ID NO: 8397437 - DNA, 22 bp, Homo sapiens
gtcaacatcggaaagcgtgtaa

SEQ ID NO: 8397438 - DNA, 22 bp, Homo sapiens
gtcaacataggcctcagtgagg

SEQ ID NO: 8397439 - DNA, 22 bp, Homo sapiens
gtcaacatgttctgggtgaatg

SEQ ID NO: 8397440 - DNA, 22 bp, Homo sapiens
gtagcagaatcagtgctacaga

SEQ ID NO: 8397441 - DNA, 23 bp, Homo sapiens
gtcctattttttgaaatactgag

SEQ ID NO: 8397442 - DNA, 22 bp, Homo sapiens
ggctctgtttactttcagaggc

SEQ ID NO: 8397443 - DNA, 22 bp, Homo sapiens
gcacaggaatcttcatttttta

SEQ ID NO: 8397444 - DNA, 22 bp, Homo sapiens
gcatccaaatgtttcatttctt

SEQ ID NO: 8397445 - DNA, 22 bp, Homo sapiens
gcatctaaataaacgtgggagt

SEQ ID NO: 8397446 - DNA, 19 bp, Homo sapiens
gcatttcatttaaccatca

SEQ ID NO: 8397447 - DNA, 22 bp, Homo sapiens
gcatttcatgtagattgagaac

SEQ ID NO: 8397448 - DNA, 22 bp, Homo sapiens
gcattttaataagattcatagg

SEQ ID NO: 8397449 - DNA, 22 bp, Homo sapiens
gcctaacttggctttgttcacc

SEQ ID NO: 8397450 - DNA, 22 bp, Homo sapiens
gctgatgagagagacaaatgct

SEQ ID NO: 8397451 - DNA, 22 bp, Homo sapiens
gctgatataaaattacagagga

SEQ ID NO: 8397452 - DNA, 22 bp, Homo sapiens
ggaaatcaagaagcagatgagt

SEQ ID NO: 8397453 - DNA, 22 bp, Homo sapiens
ggaaatcatgggagagttggaa

SEQ ID NO: 8397454 - DNA, 22 bp, Homo sapiens
ggaaatcatctgattggctttc

SEQ ID NO: 8397455 - DNA, 22 bp, Homo sapiens
ggaaatcaaggggacaaattgt

SEQ ID NO: 8397456 - DNA, 20 bp, Homo sapiens
ggaaatcaccaggctccacc

SEQ ID NO: 8397457 - DNA, 22 bp, Homo sapiens
ggaaatcaggggtgttgctttc

SEQ ID NO: 8397458 - DNA, 22 bp, Homo sapiens
ggaaatcagcagatgctggtga

SEQ ID NO: 8397459 - DNA, 22 bp, Homo sapiens
tacttgtgtgtcatgtgcagag

SEQ ID NO: 8397460 - DNA, 22 bp, Homo sapiens
tactttcatgtctatacatatt

SEQ ID NO: 8397461 - DNA, 22 bp, Homo sapiens
tagaagtttaaattcaccatgc

SEQ ID NO: 8397462 - DNA, 22 bp, Homo sapiens
tagcagaaactgttacagaagg

SEQ ID NO: 8397463 - DNA, 22 bp, Homo sapiens
tagcatttggacattgtcacct

SEQ ID NO: 8397464 - DNA, 22 bp, Homo sapiens
tagattttgcatttctaacaag

SEQ ID NO: 8397465 - DNA, 22 bp, Homo sapiens
tagattttttggagactctctg

SEQ ID NO: 8397466 - DNA, 22 bp, Homo sapiens
tagattttacttctgtcattac

SEQ ID NO: 8397467 - DNA, 22 bp, Homo sapiens
tagattttaggagattttactg

SEQ ID NO: 8397468 - DNA, 23 bp, Homo sapiens
tagatgtttggggaactttgccc

SEQ ID NO: 8397469 - DNA, 20 bp, Homo sapiens
tagatgtttcctgtcataaa

SEQ ID NO: 8397470 - DNA, 22 bp, Homo sapiens
tagatgttgaagtcatatttgg

SEQ ID NO: 8397471 - DNA, 22 bp, Homo sapiens
tagatgttccacatatatatgt

SEQ ID NO: 8397472 - DNA, 22 bp, Homo sapiens
tagtattttagaaaaccatgaa

SEQ ID NO: 8397473 - DNA, 22 bp, Homo sapiens
tagtatttcctgtaagctatag

SEQ ID NO: 8397474 - DNA, 22 bp, Homo sapiens
tagtatttataatcatgcttaa

SEQ ID NO: 8397475 - DNA, 22 bp, Homo sapiens
tagtatttaatcacttttgtct

SEQ ID NO: 8397476 - DNA, 22 bp, Homo sapiens
tagtacttatctctgtcattgt

SEQ ID NO: 8397477 - DNA, 22 bp, Homo sapiens
taggaatttttgtaatggtact

SEQ ID NO: 8397478 - DNA, 22 bp, Homo sapiens
tagtgttttctagaatggtttt

SEQ ID NO: 8397479 - DNA, 22 bp, Homo sapiens
tatactttcctgcaactttgat

SEQ ID NO: 8397480 - DNA, 22 bp, Homo sapiens
tatacagatatctaagatgtaa

SEQ ID NO: 8397481 - DNA, 22 bp, Homo sapiens
tatacctttaccttgaccaaat

SEQ ID NO: 8397482 - DNA, 22 bp, Homo sapiens
tatatgtaagctatgtaagagt

SEQ ID NO: 8397483 - DNA, 22 bp, Homo sapiens
tatagactagcagcagaattta

SEQ ID NO: 8397484 - DNA, 19 bp, Homo sapiens
tatatttgttgaataaaaa

SEQ ID NO: 8397485 - DNA, 19 bp, Homo sapiens
tatatttgagtgtgcatgc

SEQ ID NO: 8397486 - DNA, 22 bp, Homo sapiens
tatgcagtggtatcattttaaa

SEQ ID NO: 8397487 - DNA, 22 bp, Homo sapiens
tatcttgtttaggtgcacaggt

SEQ ID NO: 8397488 - DNA, 22 bp, Homo sapiens
tatcttcaactaggattcattt

SEQ ID NO: 8397489 - DNA, 22 bp, Homo sapiens
tatcttcatagatttttacacc

SEQ ID NO: 8397490 - DNA, 22 bp, Homo sapiens
tattgtactgaggaataaagct

SEQ ID NO: 8397491 - DNA, 21 bp, Homo sapiens
tattgcataacaaattaccct

SEQ ID NO: 8397492 - DNA, 22 bp, Homo sapiens
tattgcaagcaattccaaaagg

SEQ ID NO: 8397493 - DNA, 22 bp, Homo sapiens
tattgcaagtggcataaaattt

SEQ ID NO: 8397494 - DNA, 23 bp, Homo sapiens
tattgcacacatagaaacataga

SEQ ID NO: 8397495 - DNA, 22 bp, Homo sapiens
tattgtacatttccaaattgct

SEQ ID NO: 8397496 - DNA, 22 bp, Homo sapiens
tatttgtagaatggattaaggg

SEQ ID NO: 8397497 - DNA, 22 bp, Homo sapiens
tatttgttgcgggaattgctat

SEQ ID NO: 8397498 - DNA, 22 bp, Homo sapiens
tatttgtatttcatgcagtaaa

SEQ ID NO: 8397499 - DNA, 22 bp, Homo sapiens
tatttgtcagctgttgagttca

SEQ ID NO: 8397500 - DNA, 22 bp, Homo sapiens
tatttgtccaggtaaatttcag

SEQ ID NO: 8397501 - DNA, 22 bp, Homo sapiens
tatttgtccttattaagatctg

SEQ ID NO: 8397502 - DNA, 22 bp, Homo sapiens
tatttgtgtgggtatctatata

SEQ ID NO: 8397503 - DNA, 22 bp, Homo sapiens
tatttgtgagactgactgaagt

SEQ ID NO: 8397504 - DNA, 22 bp, Homo sapiens
tatgctactagaaataaaatgg

SEQ ID NO: 8397505 - DNA, 22 bp, Homo sapiens
gttccaattccaaattccaagg

SEQ ID NO: 8397506 - DNA, 22 bp, Homo sapiens
gtgttacaaatcacctgtgctg

SEQ ID NO: 8397507 - DNA, 22 bp, Homo sapiens
gtttcctacactgtagtattat

SEQ ID NO: 8397508 - DNA, 22 bp, Homo sapiens
taaagtttatttgaacatctct

SEQ ID NO: 8397509 - DNA, 22 bp, Homo sapiens
taaataagtcactgaccattta

SEQ ID NO: 8397510 - DNA, 22 bp, Homo sapiens
taaagtttggcagacaataaca

SEQ ID NO: 8397511 - DNA, 22 bp, Homo sapiens
taaacatgttgacatcttacct

SEQ ID NO: 8397512 - DNA, 22 bp, Homo sapiens
taaacatctgtagccttcagtc

SEQ ID NO: 8397513 - DNA, 22 bp, Homo sapiens
taaacatctgtcatgtgtttat

SEQ ID NO: 8397514 - DNA, 22 bp, Homo sapiens
taaacatgtgagtgtgcatata

SEQ ID NO: 8397515 - DNA, 22 bp, Homo sapiens
taaacatcaggaatgaaaacct

SEQ ID NO: 8397516 - DNA, 22 bp, Homo sapiens
taaacatcaccttctgcagttg

SEQ ID NO: 8397517 - DNA, 21 bp, Homo sapiens
taaacataaccttgtatggct

SEQ ID NO: 8397518 - DNA, 22 bp, Homo sapiens
gttttcaaggggatttaactga

SEQ ID NO: 8397519 - DNA, 22 bp, Homo sapiens
taaacagagaagactttgagca

SEQ ID NO: 8397520 - DNA, 23 bp, Homo sapiens
gttttcaacacaataaatgtaac

SEQ ID NO: 8397521 - DNA, 22 bp, Homo sapiens
gttttataggtgaaatattact

SEQ ID NO: 8397522 - DNA, 22 bp, Homo sapiens
taagaaatttagttatagaatg

SEQ ID NO: 8397523 - DNA, 22 bp, Homo sapiens
taagataagtgggttgagatgg

SEQ ID NO: 8397524 - DNA, 22 bp, Homo sapiens
taactgtaatataaatatgagt

SEQ ID NO: 8397525 - DNA, 22 bp, Homo sapiens
taaatttttgttaacagcctct

SEQ ID NO: 8397526 - DNA, 21 bp, Homo sapiens
taacaaagacttctggtcagg

SEQ ID NO: 8397527 - DNA, 18 bp, Homo sapiens
taacaatcctgagtgtct

SEQ ID NO: 8397528 - DNA, 22 bp, Homo sapiens
taagttagagcacaattcttac

SEQ ID NO: 8397529 - DNA, 22 bp, Homo sapiens
taagttagaggttaggcactta

SEQ ID NO: 8397530 - DNA, 22 bp, Homo sapiens
taagttagatcttaattaaagt

SEQ ID NO: 8397531 - DNA, 22 bp, Homo sapiens
taagttagtcctttttaaaagt

SEQ ID NO: 8397532 - DNA, 22 bp, Homo sapiens
taagttagcaaggccaaggtaa

SEQ ID NO: 8397533 - DNA, 22 bp, Homo sapiens
taagttagccctattaaattaa

SEQ ID NO: 8397534 - DNA, 22 bp, Homo sapiens
taatttcacagttcaacgcaca

SEQ ID NO: 8397535 - DNA, 22 bp, Homo sapiens
taatttctaattcattttcagt

SEQ ID NO: 8397536 - DNA, 22 bp, Homo sapiens
tacacattacataatactatct

SEQ ID NO: 8397537 - DNA, 22 bp, Homo sapiens
tacacattctagggcacagtta

SEQ ID NO: 8397538 - DNA, 22 bp, Homo sapiens
tacacattagtgaggtattttg

SEQ ID NO: 8397539 - DNA, 22 bp, Homo sapiens
tacacattagtcaagagtttga

SEQ ID NO: 8397540 - DNA, 22 bp, Homo sapiens
tacacatttctcttagagacac

SEQ ID NO: 8397541 - DNA, 22 bp, Homo sapiens
tactgaaatggcagatatataa

SEQ ID NO: 8397542 - DNA, 22 bp, Homo sapiens
tactgaaagactgaatatttag

SEQ ID NO: 8397543 - DNA, 22 bp, Homo sapiens
tactgaaagtggtcaacagtgg

SEQ ID NO: 8397544 - DNA, 22 bp, Homo sapiens
taccttggaaatgctagagtaa

SEQ ID NO: 8397545 - DNA, 22 bp, Homo sapiens
tactgcttggtgttgttgtatc

SEQ ID NO: 8397546 - DNA, 23 bp, Homo sapiens
tactgccttgttcatgtgtattt

SEQ ID NO: 8397547 - DNA, 22 bp, Homo sapiens
tacttgccatcagagtttatta

SEQ ID NO: 8397548 - DNA, 22 bp, Homo sapiens
tacaggaaggagcacatcggga

SEQ ID NO: 8397549 - DNA, 22 bp, Homo sapiens
tacaggaagcactcaagaaatg

SEQ ID NO: 8397550 - DNA, 22 bp, Homo sapiens
tacagcttttcatatttgtgtt

SEQ ID NO: 8397551 - DNA, 22 bp, Homo sapiens
tacagcttgatgtttgtgtgtt

SEQ ID NO: 8397552 - DNA, 22 bp, Homo sapiens
tacagcttgacccataatgtct

SEQ ID NO: 8397553 - DNA, 22 bp, Homo sapiens
tacagtttttattcatgacaag

SEQ ID NO: 8397554 - DNA, 22 bp, Homo sapiens
tacagttactgcatttctaata

SEQ ID NO: 8397555 - DNA, 22 bp, Homo sapiens
tacatacacaaatgctgaatgg

SEQ ID NO: 8397556 - DNA, 20 bp, Homo sapiens
tcagccattccttacctttc

SEQ ID NO: 8397557 - DNA, 22 bp, Homo sapiens
tcagttttctcatttatgagat

SEQ ID NO: 8397558 - DNA, 22 bp, Homo sapiens
tcagttttgtatgttgtaagtc

SEQ ID NO: 8397559 - DNA, 22 bp, Homo sapiens
tcatattttgcaaggtcagcta

SEQ ID NO: 8397560 - DNA, 22 bp, Homo sapiens
tcatccaaggattttattgcat

SEQ ID NO: 8397561 - DNA, 22 bp, Homo sapiens
tcatcgcctcgtgcatcttggc

SEQ ID NO: 8397562 - DNA, 22 bp, Homo sapiens
tcatctaagagtcttacattta

SEQ ID NO: 8397563 - DNA, 22 bp, Homo sapiens
tcacctgtattaatacagaact

SEQ ID NO: 8397564 - DNA, 22 bp, Homo sapiens
tcacatctgttgatacagcatc

SEQ ID NO: 8397565 - DNA, 22 bp, Homo sapiens
tcagaggcctgaaagaatttgg

SEQ ID NO: 8397566 - DNA, 22 bp, Homo sapiens
tcaattctgcctctaaatattt

SEQ ID NO: 8397567 - DNA, 22 bp, Homo sapiens
tcaatgttcaagtatgacaatg

SEQ ID NO: 8397568 - DNA, 22 bp, Homo sapiens
tcaatgtttgttcatgaaaata

SEQ ID NO: 8397569 - DNA, 18 bp, Homo sapiens
tcaaaatatttctgtgga

SEQ ID NO: 8397570 - DNA, 22 bp, Homo sapiens
tcaatacttaagcttaattcta

SEQ ID NO: 8397571 - DNA, 21 bp, Homo sapiens
tcacatctatgttaagcaaac

SEQ ID NO: 8397572 - DNA, 22 bp, Homo sapiens
ttgaaagctccatattgtagag

SEQ ID NO: 8397573 - DNA, 22 bp, Homo sapiens
ttgaaacttttcttggagaaac

SEQ ID NO: 8397574 - DNA, 22 bp, Homo sapiens
ttgaaacattctcctattgatt

SEQ ID NO: 8397575 - DNA, 22 bp, Homo sapiens
ttgaaactcatcttagtgatgt

SEQ ID NO: 8397576 - DNA, 22 bp, Homo sapiens
ttgaaactatgaagacaaccat

SEQ ID NO: 8397577 - DNA, 22 bp, Homo sapiens
ttgaaactttagtaaactaagg

SEQ ID NO: 8397578 - DNA, 22 bp, Homo sapiens
ttgaaactgggaagcagggggt

SEQ ID NO: 8397579 - DNA, 22 bp, Homo sapiens
ttgaaactgtcagcttttacgc

SEQ ID NO: 8397580 - DNA, 22 bp, Homo sapiens
ttgaaacttagaaattgagctg

SEQ ID NO: 8397581 - DNA, 22 bp, Homo sapiens
ttgaaactgcttattgaatttg

SEQ ID NO: 8397582 - DNA, 22 bp, Homo sapiens
ttgaaactgagtgtgtttgggg

SEQ ID NO: 8397583 - DNA, 22 bp, Homo sapiens
ttgaaactcccttttgtctagt

SEQ ID NO: 8397584 - DNA, 22 bp, Homo sapiens
ttgaaaacagcgtagattcaca

SEQ ID NO: 8397585 - DNA, 22 bp, Homo sapiens
ttgaaaacatttatattagaat

SEQ ID NO: 8397586 - DNA, 22 bp, Homo sapiens
ttgaaaaccgtgggaggctgaa

SEQ ID NO: 8397587 - DNA, 22 bp, Homo sapiens
ttgaaacagtagctcatagacc

SEQ ID NO: 8397588 - DNA, 22 bp, Homo sapiens
ttgaaaatggtaagcatgatat

SEQ ID NO: 8397589 - DNA, 20 bp, Homo sapiens
ttgaaaatgcattgtgcagt

SEQ ID NO: 8397590 - DNA, 22 bp, Homo sapiens
ttgaaaatatcacaggagcagc

SEQ ID NO: 8397591 - DNA, 22 bp, Homo sapiens
ttctttgcccttaatgaaataa

SEQ ID NO: 8397592 - DNA, 22 bp, Homo sapiens
ttctttctttgtagtcctgaac

SEQ ID NO: 8397593 - DNA, 22 bp, Homo sapiens
ttccaatcaggataataattag

SEQ ID NO: 8397594 - DNA, 22 bp, Homo sapiens
ttccaattgcagatcagataca

SEQ ID NO: 8397595 - DNA, 22 bp, Homo sapiens
ttccaattgtgagattttttaa

SEQ ID NO: 8397596 - DNA, 22 bp, Homo sapiens
ttccaactttgtcatatattat

SEQ ID NO: 8397597 - DNA, 22 bp, Homo sapiens
ttccaaattccaatcccctgaa

SEQ ID NO: 8397598 - DNA, 22 bp, Homo sapiens
ttccaactctgaaatgtgaaat

SEQ ID NO: 8397599 - DNA, 22 bp, Homo sapiens
ttccaacttcccatccctgctg

SEQ ID NO: 8397600 - DNA, 22 bp, Homo sapiens
ttccaactttaaaattcattct

SEQ ID NO: 8397601 - DNA, 22 bp, Homo sapiens
ttccatgagctctgagttcaca

SEQ ID NO: 8397602 - DNA, 22 bp, Homo sapiens
ttatgctagttgaaataacaca

SEQ ID NO: 8397603 - DNA, 22 bp, Homo sapiens
ttatgtgccactttttgaagat

SEQ ID NO: 8397604 - DNA, 22 bp, Homo sapiens
ttagtgtattttcaaatgtaga

SEQ ID NO: 8397605 - DNA, 22 bp, Homo sapiens
ttatgttttatggctatatcat

SEQ ID NO: 8397606 - DNA, 22 bp, Homo sapiens
ttatgtttgagtatatgactca

SEQ ID NO: 8397607 - DNA, 22 bp, Homo sapiens
ttatttgtggcatatgagacga

SEQ ID NO: 8397608 - DNA, 22 bp, Homo sapiens
ttatttgtggcatccatgttgg

SEQ ID NO: 8397609 - DNA, 22 bp, Homo sapiens
ttatttgttttctgagaagtat

SEQ ID NO: 8397610 - DNA, 20 bp, Homo sapiens
ttatttgtttactttggtcc

SEQ ID NO: 8397611 - DNA, 18 bp, Homo sapiens
ttatttgttacagcacat

SEQ ID NO: 8397612 - DNA, 22 bp, Homo sapiens
ttgctataaatggtctatcttt

SEQ ID NO: 8397613 - DNA, 22 bp, Homo sapiens
ttgcttcagtagctctttaaag

SEQ ID NO: 8397614 - DNA, 22 bp, Homo sapiens
ttgccattatcatttatgatac

SEQ ID NO: 8397615 - DNA, 22 bp, Homo sapiens
ttgccatttagtatgcttgtat

SEQ ID NO: 8397616 - DNA, 22 bp, Homo sapiens
ttgcttgcttctattttataca

SEQ ID NO: 8397617 - DNA, 22 bp, Homo sapiens
ttgtgcaatcccctcattttat

SEQ ID NO: 8397618 - DNA, 22 bp, Homo sapiens
ttgtgccatgaactgtatgaag

SEQ ID NO: 8397619 - DNA, 22 bp, Homo sapiens
ttgtgcaatttaaaatcttcct

SEQ ID NO: 8397620 - DNA, 22 bp, Homo sapiens
ttgtatgctgatcaaaagcttc

SEQ ID NO: 8397621 - DNA, 22 bp, Homo sapiens
ttgtattagtaagtcagctgct

SEQ ID NO: 8397622 - DNA, 22 bp, Homo sapiens
ttgtattaaaatgtgtttctgt

SEQ ID NO: 8397623 - DNA, 22 bp, Homo sapiens
ttgtatttatattgaatagctt

SEQ ID NO: 8397624 - DNA, 22 bp, Homo sapiens
tttagcattactaaaatgaaaa

SEQ ID NO: 8397625 - DNA, 22 bp, Homo sapiens
tttattgtctatgaactgcttg

SEQ ID NO: 8397626 - DNA, 22 bp, Homo sapiens
tttattgtgttgaaactgaatt

SEQ ID NO: 8397627 - DNA, 22 bp, Homo sapiens
tttatgaactacagatataact

SEQ ID NO: 8397628 - DNA, 21 bp, Homo sapiens
tttatgtacttcatagagtag

SEQ ID NO: 8397629 - DNA, 22 bp, Homo sapiens
ttgttgcatttcaagtatgaga

SEQ ID NO: 8397630 - DNA, 22 bp, Homo sapiens
ttgtttaaaagaaatcatagaa

SEQ ID NO: 8397631 - DNA, 22 bp, Homo sapiens
tttaacatgttcaagaaacata

SEQ ID NO: 8397632 - DNA, 22 bp, Homo sapiens
tttacagagaatgtacataaag

SEQ ID NO: 8397633 - DNA, 22 bp, Homo sapiens
tttacagaatgtcaatttctat

SEQ ID NO: 8397634 - DNA, 22 bp, Homo sapiens
tttacagaatgttgaatttggg

SEQ ID NO: 8397635 - DNA, 22 bp, Homo sapiens
tttacagatgaggaaactgaga

SEQ ID NO: 8397636 - DNA, 22 bp, Homo sapiens
tttacagatgaggatactgagg

SEQ ID NO: 8397637 - DNA, 22 bp, Homo sapiens
tttaagaagttatgttataaat

SEQ ID NO: 8397638 - DNA, 22 bp, Homo sapiens
tttacactgcttgaacaatctc

SEQ ID NO: 8397639 - DNA, 19 bp, Homo sapiens
tttacaagttctttgtatg

SEQ ID NO: 8397640 - DNA, 22 bp, Homo sapiens
tttcaagcatgtcaagttagtc

SEQ ID NO: 8397641 - DNA, 22 bp, Homo sapiens
tttcacattctctggttatcga

SEQ ID NO: 8397642 - DNA, 22 bp, Homo sapiens
tttcacattcttctgaatctac

SEQ ID NO: 8397643 - DNA, 23 bp, Homo sapiens
tttcacattaatgtttagcagga

SEQ ID NO: 8397644 - DNA, 22 bp, Homo sapiens
tttcacattcagatatagactt

SEQ ID NO: 8397645 - DNA, 22 bp, Homo sapiens
tttcacattagatatgtcattt

SEQ ID NO: 8397646 - DNA, 22 bp, Homo sapiens
tttcagtgtatcttccaaaagc

SEQ ID NO: 8397647 - DNA, 22 bp, Homo sapiens
tttcagtgtgagtgtcttattt

SEQ ID NO: 8397648 - DNA, 22 bp, Homo sapiens
tttcataaacagtagaagacta

SEQ ID NO: 8397649 - DNA, 23 bp, Homo sapiens
tttcacatttactgttagatggc

SEQ ID NO: 8397650 - DNA, 22 bp, Homo sapiens
tttcagtgtaaggtttccagga

SEQ ID NO: 8397651 - DNA, 20 bp, Homo sapiens
tttcagtggtttgtgcctag

SEQ ID NO: 8397652 - DNA, 22 bp, Homo sapiens
tttcagtgggtttatttcatgt

SEQ ID NO: 8397653 - DNA, 22 bp, Homo sapiens
tttcacatttgttttaagaagt

SEQ ID NO: 8397654 - DNA, 22 bp, Homo sapiens
tttcacatcagaggtagattag

SEQ ID NO: 8397655 - DNA, 22 bp, Homo sapiens
tttcacatggaagctctcgaga

SEQ ID NO: 8397656 - DNA, 22 bp, Homo sapiens
tttcacatgtatataggcatta

SEQ ID NO: 8397657 - DNA, 22 bp, Homo sapiens
tttcacatgtgctgttgtcaat

SEQ ID NO: 8397658 - DNA, 22 bp, Homo sapiens
tttcacatgtggaatgccaggt

SEQ ID NO: 8397659 - DNA, 22 bp, Homo sapiens
tttctaaagggtagatttggcc

SEQ ID NO: 8397660 - DNA, 22 bp, Homo sapiens
tttcggccgcgtgaagttttct

SEQ ID NO: 8397661 - DNA, 22 bp, Homo sapiens
tttcataatactgtacatgaaa

SEQ ID NO: 8397662 - DNA, 22 bp, Homo sapiens
tttcataatatccagagatttt

SEQ ID NO: 8397663 - DNA, 22 bp, Homo sapiens
tttcatcaccccaaatctatgg

SEQ ID NO: 8397664 - DNA, 22 bp, Homo sapiens
tttccaaataaggtcacattct

SEQ ID NO: 8397665 - DNA, 22 bp, Homo sapiens
tttctatatgaggagctaaagt

SEQ ID NO: 8397666 - DNA, 21 bp, Homo sapiens
tttgaaagtgggtgattcttt

SEQ ID NO: 8397667 - DNA, 22 bp, Homo sapiens
tttgaaatatgtgatgagagag

SEQ ID NO: 8397668 - DNA, 22 bp, Homo sapiens
tttgaaatgtatcagtataggt

SEQ ID NO: 8397669 - DNA, 22 bp, Homo sapiens
tttgaacagggaatgttccaca

SEQ ID NO: 8397670 - DNA, 22 bp, Homo sapiens
tttgaacaggagtatctatagt

SEQ ID NO: 8397671 - DNA, 22 bp, Homo sapiens
tttgaacagacactttctacag

SEQ ID NO: 8397672 - DNA, 22 bp, Homo sapiens
tttgaacaagagcttcacatta

SEQ ID NO: 8397673 - DNA, 22 bp, Homo sapiens
tttgaacatgctgcatgataat

SEQ ID NO: 8397674 - DNA, 23 bp, Homo sapiens
tttgaacatttctagattacata

SEQ ID NO: 8397675 - DNA, 22 bp, Homo sapiens
tttgaactgttctaggatttaa

SEQ ID NO: 8397676 - DNA, 22 bp, Homo sapiens
tttgacagcataatcctacacc

SEQ ID NO: 8397677 - DNA, 22 bp, Homo sapiens
tttgagaaggtgacaaattcta

SEQ ID NO: 8397678 - DNA, 22 bp, Homo sapiens
tttgacatgtgcttataacttt

SEQ ID NO: 8397679 - DNA, 21 bp, Homo sapiens
tttgagaattggtcagagtgc

SEQ ID NO: 8397680 - DNA, 22 bp, Homo sapiens
tttgctgactggatgcagttgg

SEQ ID NO: 8397681 - DNA, 22 bp, Homo sapiens
tttgcatttgtttagaacctga

SEQ ID NO: 8397682 - DNA, 17 bp, Homo sapiens
ttttgttcatcttcaaa

SEQ ID NO: 8397683 - DNA, 22 bp, Homo sapiens
tttttgtagtcattagaagagg

SEQ ID NO: 8397684 - DNA, 23 bp, Homo sapiens
ttttgtgtgacttaatatctctt

SEQ ID NO: 8397685 - DNA, 22 bp, Homo sapiens
ttttgtgtccttcacatcatgt

SEQ ID NO: 8397686 - DNA, 22 bp, Homo sapiens
ttttcctatatgcaaagaatgc

SEQ ID NO: 8397687 - DNA, 22 bp, Homo sapiens
tttgtcttcatccttcgagctg

SEQ ID NO: 8397688 - DNA, 22 bp, Homo sapiens
tttgtcttatccaatctctcag

SEQ ID NO: 8397689 - DNA, 22 bp, Homo sapiens
tttgtgcagatgtatatttgtg

SEQ ID NO: 8397690 - DNA, 22 bp, Homo sapiens
tttgtgcaatttatgtactata

SEQ ID NO: 8397691 - DNA, 22 bp, Homo sapiens
tttgtgcacattgcttttctat

SEQ ID NO: 8397692 - DNA, 22 bp, Homo sapiens
ttttcaaagactggaggctgat

SEQ ID NO: 8397693 - DNA, 22 bp, Homo sapiens
aagatttactagcataatagct

SEQ ID NO: 8397694 - DNA, 22 bp, Homo sapiens
aagatttctctcctggaaagca

SEQ ID NO: 8397695 - DNA, 22 bp, Homo sapiens
aagattgtcaggcttgctgtat

SEQ ID NO: 8397696 - DNA, 22 bp, Homo sapiens
aagattgttttggatgctaact

SEQ ID NO: 8397697 - DNA, 22 bp, Homo sapiens
aagattcttgactagaatgatt

SEQ ID NO: 8397698 - DNA, 22 bp, Homo sapiens
aagcatttatagataagaattt

SEQ ID NO: 8397699 - DNA, 22 bp, Homo sapiens
aagcatttggttctgaagactc

SEQ ID NO: 8397700 - DNA, 22 bp, Homo sapiens
aacttagttaagattaagtctc

SEQ ID NO: 8397701 - DNA, 22 bp, Homo sapiens
aacttcatgtaatttaaaacag

SEQ ID NO: 8397702 - DNA, 22 bp, Homo sapiens
aacttcagggacagaaaagagc

SEQ ID NO: 8397703 - DNA, 22 bp, Homo sapiens
aacttcagggggcacattcaag

SEQ ID NO: 8397704 - DNA, 22 bp, Homo sapiens
aagaataagaggatttagaaca

SEQ ID NO: 8397705 - DNA, 23 bp, Homo sapiens
aagaataaatgacattaaaggtg

SEQ ID NO: 8397706 - DNA, 22 bp, Homo sapiens
acaaagattcatttgcattatt

SEQ ID NO: 8397707 - DNA, 23 bp, Homo sapiens
aagagcagggaatatttatttgc

SEQ ID NO: 8397708 - DNA, 22 bp, Homo sapiens
aagagcagtgttttactcagct

SEQ ID NO: 8397709 - DNA, 22 bp, Homo sapiens
aatcatgtgggatagtctgctc

SEQ ID NO: 8397710 - DNA, 22 bp, Homo sapiens
aatcatgtttacgtgacatgtc

SEQ ID NO: 8397711 - DNA, 22 bp, Homo sapiens
aactgaaacttaggaagtaatc

SEQ ID NO: 8397712 - DNA, 22 bp, Homo sapiens
aatataacacagatggcctgtt

SEQ ID NO: 8397713 - DNA, 22 bp, Homo sapiens
aactgttgcttgtaatatgtgc

SEQ ID NO: 8397714 - DNA, 22 bp, Homo sapiens
aataacttcatgtaacatttaa

SEQ ID NO: 8397715 - DNA, 22 bp, Homo sapiens
aacatttttaagaccaagtgct

SEQ ID NO: 8397716 - DNA, 22 bp, Homo sapiens
aacatttcataacttgactttt

SEQ ID NO: 8397717 - DNA, 21 bp, Homo sapiens
aacatttcaggatccaaattg

SEQ ID NO: 8397718 - DNA, 22 bp, Homo sapiens
aacatgcttgcttagaatcagc

SEQ ID NO: 8397719 - DNA, 22 bp, Homo sapiens
aaattcttcaggtaattttgat

SEQ ID NO: 8397720 - DNA, 22 bp, Homo sapiens
aaattctgatttaataagtgta

SEQ ID NO: 8397721 - DNA, 22 bp, Homo sapiens
aacaaagtacttttcagtgctt

SEQ ID NO: 8397722 - DNA, 22 bp, Homo sapiens
aacaaagtcgttgcctagaaga

SEQ ID NO: 8397723 - DNA, 22 bp, Homo sapiens
aacaaagtagctgctgttctta

SEQ ID NO: 8397724 - DNA, 20 bp, Homo sapiens
aacaaactacaaaattatgt

SEQ ID NO: 8397725 - DNA, 22 bp, Homo sapiens
aaatgtgtgtatgtacatatat

SEQ ID NO: 8397726 - DNA, 22 bp, Homo sapiens
aaatgttttgctcccatgtggt

SEQ ID NO: 8397727 - DNA, 22 bp, Homo sapiens
aaatgtttaagtgtaggagcaa

SEQ ID NO: 8397728 - DNA, 22 bp, Homo sapiens
aaatgtttctacttgtgagcat

SEQ ID NO: 8397729 - DNA, 22 bp, Homo sapiens
aacaaagtttcaggaagataga

SEQ ID NO: 8397730 - DNA, 22 bp, Homo sapiens
aacaaagtgtacttccatactg

SEQ ID NO: 8397731 - DNA, 22 bp, Homo sapiens
aaaagtactattttaacaaagt

SEQ ID NO: 8397732 - DNA, 22 bp, Homo sapiens
aaacaagtttagaataatgaat

SEQ ID NO: 8397733 - DNA, 22 bp, Homo sapiens
aaacaagtgtaaactagtctgt

SEQ ID NO: 8397734 - DNA, 22 bp, Homo sapiens
aaacaagtcactttatcttgaa

SEQ ID NO: 8397735 - DNA, 22 bp, Homo sapiens
aaacaagtttgtagactagcca

SEQ ID NO: 8397736 - DNA, 22 bp, Homo sapiens
aaaatctaagtagcgagtaagg

SEQ ID NO: 8397737 - DNA, 22 bp, Homo sapiens
aaaatctgcacaggtcagtttt

SEQ ID NO: 8397738 - DNA, 22 bp, Homo sapiens
aaagacattagattaacgtaca

SEQ ID NO: 8397739 - DNA, 22 bp, Homo sapiens
aaagacattgaagaaggactta

SEQ ID NO: 8397740 - DNA, 23 bp, Homo sapiens
aaaatcattaatttaccctgaaa

SEQ ID NO: 8397741 - DNA, 22 bp, Homo sapiens
aaaatccacaacgctcatttca

SEQ ID NO: 8397742 - DNA, 23 bp, Homo sapiens
aaaatcttctgcctatgaagaaa

SEQ ID NO: 8397743 - DNA, 22 bp, Homo sapiens
aaaaacctcaattacttttgca

SEQ ID NO: 8397744 - DNA, 22 bp, Homo sapiens
aaaaaattccattctgtgcctt

SEQ ID NO: 8397745 - DNA, 22 bp, Homo sapiens
aaaaaattatcatagttcctga

SEQ ID NO: 8397746 - DNA, 22 bp, Homo sapiens
aaaaaagattgatggtggatgc

SEQ ID NO: 8397747 - DNA, 22 bp, Homo sapiens
aaacagaaatttcctcatgctc

SEQ ID NO: 8397748 - DNA, 22 bp, Homo sapiens
aaaatgacattccagtgatatt

SEQ ID NO: 8397749 - DNA, 22 bp, Homo sapiens
aaactgataaaataagtacatt

SEQ ID NO: 8397750 - DNA, 22 bp, Homo sapiens
aaactgaaacatcatcatgttg

SEQ ID NO: 8397751 - DNA, 22 bp, Homo sapiens
aaactgaagccttggagtgaca

SEQ ID NO: 8397752 - DNA, 22 bp, Homo sapiens
aaactgaagtagattctgaaat

SEQ ID NO: 8397753 - DNA, 21 bp, Homo sapiens
aaactgaccttgcctgagaca

SEQ ID NO: 8397754 - DNA, 22 bp, Homo sapiens
aaatgcactgaatattccaaat

SEQ ID NO: 8397755 - DNA, 20 bp, Homo sapiens
aaattactgccacacatttc

SEQ ID NO: 8397756 - DNA, 22 bp, Homo sapiens
aaattagaaatactttcaaagc

SEQ ID NO: 8397757 - DNA, 22 bp, Homo sapiens
aaagttactatcacaatgaaat

SEQ ID NO: 8397758 - DNA, 22 bp, Homo sapiens
aaagttagcattctctcttgct

SEQ ID NO: 8397759 - DNA, 22 bp, Homo sapiens
aaagttagaatgatatcaacga

SEQ ID NO: 8397760 - DNA, 22 bp, Homo sapiens
aaagttagtttcttatatgtct

SEQ ID NO: 8397761 - DNA, 22 bp, Homo sapiens
aaagttaggtgtggatttctca

SEQ ID NO: 8397762 - DNA, 22 bp, Homo sapiens
aaagttagtcagaaccagccat

SEQ ID NO: 8397763 - DNA, 22 bp, Homo sapiens
aaagttagtaaaatgggatata

SEQ ID NO: 8397764 - DNA, 22 bp, Homo sapiens
aaacaatttccacctctcctga

SEQ ID NO: 8397765 - DNA, 22 bp, Homo sapiens
aaacaatgttgtctccaagagg

SEQ ID NO: 8397766 - DNA, 22 bp, Homo sapiens
aaacaatgaaattcattcttca

SEQ ID NO: 8397767 - DNA, 22 bp, Homo sapiens
aaacaatgagcttttacacact

SEQ ID NO: 8397768 - DNA, 22 bp, Homo sapiens
aaacagttaattgctttcagtt

SEQ ID NO: 8397769 - DNA, 22 bp, Homo sapiens
aaacagtttataacatgatact

SEQ ID NO: 8397770 - DNA, 22 bp, Homo sapiens
aaaggtcagctgccatcgttct

SEQ ID NO: 8397771 - DNA, 22 bp, Homo sapiens
aaataacttggtttcatcagag

SEQ ID NO: 8397772 - DNA, 22 bp, Homo sapiens
aaataagaaattcttctttgca

SEQ ID NO: 8397773 - DNA, 22 bp, Homo sapiens
aaatactggttttggagatgct

SEQ ID NO: 8397774 - DNA, 22 bp, Homo sapiens
aagcatcaacactatattgatg

SEQ ID NO: 8397775 - DNA, 22 bp, Homo sapiens
aagcacagcagagccttgcttg

SEQ ID NO: 8397776 - DNA, 22 bp, Homo sapiens
aaatcctggcctcaagtggtcc

SEQ ID NO: 8397777 - DNA, 22 bp, Homo sapiens
aaatgtaccttgatagtttggt

SEQ ID NO: 8397778 - DNA, 22 bp, Homo sapiens
aaatgtacgggagtagaattag

SEQ ID NO: 8397779 - DNA, 22 bp, Homo sapiens
aaatgtacaacatccatatata

SEQ ID NO: 8397780 - DNA, 22 bp, Homo sapiens
aacaaacaaacattttgtcatc

SEQ ID NO: 8397781 - DNA, 22 bp, Homo sapiens
aacaaaacatttgtcttgtttc

SEQ ID NO: 8397782 - DNA, 22 bp, Homo sapiens
aaagatacttaatagttgtctg

SEQ ID NO: 8397783 - DNA, 22 bp, Homo sapiens
aactaaaagtgtgtctcttgta

SEQ ID NO: 8397784 - DNA, 22 bp, Homo sapiens
aactaaaactggtttgttctct

SEQ ID NO: 8397785 - DNA, 22 bp, Homo sapiens
aaagctttgtaaataaacaggt

SEQ ID NO: 8397786 - DNA, 22 bp, Homo sapiens
aaagcttttcagtatgttcatg

SEQ ID NO: 8397787 - DNA, 22 bp, Homo sapiens
aaagtcacatagcatcacttct

SEQ ID NO: 8397788 - DNA, 22 bp, Homo sapiens
acaatttcaccttttggttcaa

SEQ ID NO: 8397789 - DNA, 20 bp, Homo sapiens
acaatttcctcactatatgc

SEQ ID NO: 8397790 - DNA, 22 bp, Homo sapiens
acagaaattgctaatagctcat

SEQ ID NO: 8397791 - DNA, 22 bp, Homo sapiens
acagaaattcaaactggaattt

SEQ ID NO: 8397792 - DNA, 22 bp, Homo sapiens
acagaacaagacctgcttattg

SEQ ID NO: 8397793 - DNA, 22 bp, Homo sapiens
acacattttggctaggtggaga

SEQ ID NO: 8397794 - DNA, 22 bp, Homo sapiens
acacattttgttaaaccctgtg

SEQ ID NO: 8397795 - DNA, 22 bp, Homo sapiens
acacattttctaacagggatca

SEQ ID NO: 8397796 - DNA, 22 bp, Homo sapiens
acacattttcaacactgtcaag

SEQ ID NO: 8397797 - DNA, 23 bp, Homo sapiens
acacatttttcccgttctgaggt

SEQ ID NO: 8397798 - DNA, 22 bp, Homo sapiens
acacatttgggctcctacataa

SEQ ID NO: 8397799 - DNA, 22 bp, Homo sapiens
acacatttgcataatacctcat

SEQ ID NO: 8397800 - DNA, 22 bp, Homo sapiens
acagagatcagaggcataagca

SEQ ID NO: 8397801 - DNA, 22 bp, Homo sapiens
acaaatgtctcctcttttgtta

SEQ ID NO: 8397802 - DNA, 22 bp, Homo sapiens
acaaatgtgattgtttctgaaa

SEQ ID NO: 8397803 - DNA, 22 bp, Homo sapiens
acaaatgtggacatggataatg

SEQ ID NO: 8397804 - DNA, 18 bp, Homo sapiens
acaaatgtgtcacaggaa

SEQ ID NO: 8397805 - DNA, 18 bp, Homo sapiens
acaaatgtagtgtcttaa

SEQ ID NO: 8397806 - DNA, 23 bp, Homo sapiens
acaaatgtctagagagggtgtga

SEQ ID NO: 8397807 - DNA, 22 bp, Homo sapiens
acaaatgtctacattgagaata

SEQ ID NO: 8397808 - DNA, 22 bp, Homo sapiens
acaaatgttggatttgtcttcc

SEQ ID NO: 8397809 - DNA, 22 bp, Homo sapiens
acaaatgtgtctaattgtgcct

SEQ ID NO: 8397810 - DNA, 22 bp, Homo sapiens
acaaatgttacataagtttgga

SEQ ID NO: 8397811 - DNA, 22 bp, Homo sapiens
acaagttaggttttaatccaaa

SEQ ID NO: 8397812 - DNA, 22 bp, Homo sapiens
acaagtgggtcctacataaagc

SEQ ID NO: 8397813 - DNA, 18 bp, Homo sapiens
acaaggtcaattggttac

SEQ ID NO: 8397814 - DNA, 22 bp, Homo sapiens
acaaggtaagaaacattggctt

SEQ ID NO: 8397815 - DNA, 22 bp, Homo sapiens
acaaaattgtgttaaactttat

SEQ ID NO: 8397816 - DNA, 22 bp, Homo sapiens
acaaacttccatcatgaatttt

SEQ ID NO: 8397817 - DNA, 22 bp, Homo sapiens
acaaacttcccagacaagctcc

SEQ ID NO: 8397818 - DNA, 22 bp, Homo sapiens
acaaatgactatttggtacagg

SEQ ID NO: 8397819 - DNA, 22 bp, Homo sapiens
acaaatatggtactcggagaaa

SEQ ID NO: 8397820 - DNA, 22 bp, Homo sapiens
aatgtgtttagttaatgagttg

SEQ ID NO: 8397821 - DNA, 22 bp, Homo sapiens
aatgtcacatacaatggcaagt

SEQ ID NO: 8397822 - DNA, 22 bp, Homo sapiens
aatgtcattgagctccaatcct

SEQ ID NO: 8397823 - DNA, 22 bp, Homo sapiens
aatgttctgcaactgttttcat

SEQ ID NO: 8397824 - DNA, 22 bp, Homo sapiens
aatgttctgatgtagggtttag

SEQ ID NO: 8397825 - DNA, 22 bp, Homo sapiens
aatgttgccccaggacaaagga

SEQ ID NO: 8397826 - DNA, 22 bp, Homo sapiens
aatgtttcgtaaattgtctatg

SEQ ID NO: 8397827 - DNA, 22 bp, Homo sapiens
aatgtttcattcttgcccattg

SEQ ID NO: 8397828 - DNA, 22 bp, Homo sapiens
aatgtttcatttagttgtctcc

SEQ ID NO: 8397829 - DNA, 22 bp, Homo sapiens
aatgtttcaattaagtctttta

SEQ ID NO: 8397830 - DNA, 22 bp, Homo sapiens
aatgtttaatgttagtggtaat

SEQ ID NO: 8397831 - DNA, 22 bp, Homo sapiens
aatgtttgcatctattcacatg

SEQ ID NO: 8397832 - DNA, 22 bp, Homo sapiens
aatgtttgagcatctacatgct

SEQ ID NO: 8397833 - DNA, 20 bp, Homo sapiens
aatgtttctgaacaggtagt

SEQ ID NO: 8397834 - DNA, 22 bp, Homo sapiens
aatgtttgaccaaaaaactgca

SEQ ID NO: 8397835 - DNA, 22 bp, Homo sapiens
aatgtttctggatattgtgggt

SEQ ID NO: 8397836 - DNA, 22 bp, Homo sapiens
aatgtttgaactttgcatattt

SEQ ID NO: 8397837 - DNA, 22 bp, Homo sapiens
aatgttgtgtttcagttcaaga

SEQ ID NO: 8397838 - DNA, 22 bp, Homo sapiens
aattaccaggatttttcagtat

SEQ ID NO: 8397839 - DNA, 22 bp, Homo sapiens
aatgtttggactggaaggtccc

SEQ ID NO: 8397840 - DNA, 22 bp, Homo sapiens
aatgtttgcctgactagagtgg

SEQ ID NO: 8397841 - DNA, 22 bp, Homo sapiens
aagtcacaagcatatatgcatt

SEQ ID NO: 8397842 - DNA, 22 bp, Homo sapiens
aagtaccaagtttgtttgacgc

SEQ ID NO: 8397843 - DNA, 22 bp, Homo sapiens
aagtactaaggctattatgatg

SEQ ID NO: 8397844 - DNA, 23 bp, Homo sapiens
aagtacctacacattatttcaga

SEQ ID NO: 8397845 - DNA, 22 bp, Homo sapiens
aagtacctagaaatatttttga

SEQ ID NO: 8397846 - DNA, 22 bp, Homo sapiens
acatgtgtggacatgaatctac

SEQ ID NO: 8397847 - DNA, 22 bp, Homo sapiens
aaggcaggatgggaaaagattt

SEQ ID NO: 8397848 - DNA, 22 bp, Homo sapiens
aatgaacaggtgaatgtcagat

SEQ ID NO: 8397849 - DNA, 22 bp, Homo sapiens
agaaaacactgccccctctctc

SEQ ID NO: 8397850 - DNA, 22 bp, Homo sapiens
agaaaaatcttggcgcttgtct

SEQ ID NO: 8397851 - DNA, 22 bp, Homo sapiens
agaaaacattacataggtgtgt

SEQ ID NO: 8397852 - DNA, 22 bp, Homo sapiens
aatgaaactcgaaataatcaca

SEQ ID NO: 8397853 - DNA, 22 bp, Homo sapiens
aatatttgttagtgttttaatg

SEQ ID NO: 8397854 - DNA, 22 bp, Homo sapiens
aatatcaacagtgtccttctaa

SEQ ID NO: 8397855 - DNA, 22 bp, Homo sapiens
aatatatgaccaggaagttctg

SEQ ID NO: 8397856 - DNA, 22 bp, Homo sapiens
aatatatgactccactgcatga

SEQ ID NO: 8397857 - DNA, 22 bp, Homo sapiens
acttgaaaccttggcaaacaat

SEQ ID NO: 8397858 - DNA, 22 bp, Homo sapiens
acttgaaagaagtttccttaaa

SEQ ID NO: 8397859 - DNA, 22 bp, Homo sapiens
acttgaaaggaagctctaaaac

SEQ ID NO: 8397860 - DNA, 22 bp, Homo sapiens
acttgaaaccctgagatgataa

SEQ ID NO: 8397861 - DNA, 22 bp, Homo sapiens
acttgaaacatctttaaatgta

SEQ ID NO: 8397862 - DNA, 22 bp, Homo sapiens
acttgaaaagctcagcagtagt

SEQ ID NO: 8397863 - DNA, 22 bp, Homo sapiens
aatacaatcaaattcactagca

SEQ ID NO: 8397864 - DNA, 22 bp, Homo sapiens
aagttaggcttagttgagattt

SEQ ID NO: 8397865 - DNA, 22 bp, Homo sapiens
aagttagtgcctccttaaattt

SEQ ID NO: 8397866 - DNA, 22 bp, Homo sapiens
aagttacattttggtctaattg

SEQ ID NO: 8397867 - DNA, 22 bp, Homo sapiens
aataagaatttacttgtcaaga

SEQ ID NO: 8397868 - DNA, 22 bp, Homo sapiens
aataagactctgctagaaattc

SEQ ID NO: 8397869 - DNA, 22 bp, Homo sapiens
aataagatcctgaagatatgtt

SEQ ID NO: 8397870 - DNA, 22 bp, Homo sapiens
aataagaattgccagatttgaa

SEQ ID NO: 8397871 - DNA, 22 bp, Homo sapiens
atgcactgtaggtgccatctgc

SEQ ID NO: 8397872 - DNA, 22 bp, Homo sapiens
atgacaaacccaggatgtaaca

SEQ ID NO: 8397873 - DNA, 23 bp, Homo sapiens
atgacaaacaggacatcttgtgc

SEQ ID NO: 8397874 - DNA, 22 bp, Homo sapiens
agacatttattgaacacctagc

SEQ ID NO: 8397875 - DNA, 22 bp, Homo sapiens
agacaaatgaacaaatatgtga

SEQ ID NO: 8397876 - DNA, 23 bp, Homo sapiens
atgaaagttcttaaaatgtcatg

SEQ ID NO: 8397877 - DNA, 22 bp, Homo sapiens
atgaaactgggataactatagc

SEQ ID NO: 8397878 - DNA, 22 bp, Homo sapiens
agaagttaattcctgaaattct

SEQ ID NO: 8397879 - DNA, 19 bp, Homo sapiens
agaagttagacattgcaat

SEQ ID NO: 8397880 - DNA, 22 bp, Homo sapiens
atgaaactctaacttaacaagt

SEQ ID NO: 8397881 - DNA, 23 bp, Homo sapiens
atgaaactcaagccagatccaag

SEQ ID NO: 8397882 - DNA, 22 bp, Homo sapiens
atgaaactgaaggacaaccaga

SEQ ID NO: 8397883 - DNA, 22 bp, Homo sapiens
atgaaactctagctttcagcac

SEQ ID NO: 8397884 - DNA, 22 bp, Homo sapiens
atgaaactaaactacataagtt

SEQ ID NO: 8397885 - DNA, 22 bp, Homo sapiens
agaccaggggttgagtcctagc

SEQ ID NO: 8397886 - DNA, 22 bp, Homo sapiens
agacattttacattcttccatt

SEQ ID NO: 8397887 - DNA, 22 bp, Homo sapiens
agagccaatcttcagagcagag

SEQ ID NO: 8397888 - DNA, 22 bp, Homo sapiens
attattaaagcttaggtcttat

SEQ ID NO: 8397889 - DNA, 22 bp, Homo sapiens
attgcatatgcagcacatcagg

SEQ ID NO: 8397890 - DNA, 22 bp, Homo sapiens
caaaaaacacagatgtctgtgt

SEQ ID NO: 8397891 - DNA, 22 bp, Homo sapiens
caaaagtagtgaagttgtacat

SEQ ID NO: 8397892 - DNA, 22 bp, Homo sapiens
atttgtgccaaattatttctaa

SEQ ID NO: 8397893 - DNA, 22 bp, Homo sapiens
atttgttgaataaattagtatt

SEQ ID NO: 8397894 - DNA, 22 bp, Homo sapiens
atttcacatctatctcagattt

SEQ ID NO: 8397895 - DNA, 22 bp, Homo sapiens
atttcacagctgtcagtgttac

SEQ ID NO: 8397896 - DNA, 22 bp, Homo sapiens
atttattgaagcttattacgtt

SEQ ID NO: 8397897 - DNA, 22 bp, Homo sapiens
agataaaatgattttctggatc

SEQ ID NO: 8397898 - DNA, 17 bp, Homo sapiens
agagttttaagaaattt

SEQ ID NO: 8397899 - DNA, 22 bp, Homo sapiens
agcatacagtaggtgctcagtt

SEQ ID NO: 8397900 - DNA, 22 bp, Homo sapiens
agcaggcaggaggctactaagg

SEQ ID NO: 8397901 - DNA, 22 bp, Homo sapiens
cacaattttcctttaagtgtat

SEQ ID NO: 8397902 - DNA, 22 bp, Homo sapiens
caagacttagagcatcttgaaa

SEQ ID NO: 8397903 - DNA, 22 bp, Homo sapiens
caagactttggaggaatttgga

SEQ ID NO: 8397904 - DNA, 22 bp, Homo sapiens
caacacttcttatacttactga

SEQ ID NO: 8397905 - DNA, 22 bp, Homo sapiens
caagatttatattttcacacaa

SEQ ID NO: 8397906 - DNA, 22 bp, Homo sapiens
cagaatatgactcgggcactac

SEQ ID NO: 8397907 - DNA, 22 bp, Homo sapiens
cagaatcagcccttgctattaa

SEQ ID NO: 8397908 - DNA, 22 bp, Homo sapiens
cagactttcaaggagtgaaggc

SEQ ID NO: 8397909 - DNA, 22 bp, Homo sapiens
cagacttttgacattaatacag

SEQ ID NO: 8397910 - DNA, 22 bp, Homo sapiens
cagactttctggaagctaaaaa

SEQ ID NO: 8397911 - DNA, 20 bp, Homo sapiens
acctgccacagagaaaggta

SEQ ID NO: 8397912 - DNA, 22 bp, Homo sapiens
agtaaaatcttaagcacagtgg

SEQ ID NO: 8397913 - DNA, 22 bp, Homo sapiens
agtaaaatttctgctgaggaga

SEQ ID NO: 8397914 - DNA, 22 bp, Homo sapiens
agtaaaattgtattggaaaaca

SEQ ID NO: 8397915 - DNA, 22 bp, Homo sapiens
agtattttcgccatcacaagaa

SEQ ID NO: 8397916 - DNA, 22 bp, Homo sapiens
agtcaaacaaatgtttattgag

SEQ ID NO: 8397917 - DNA, 22 bp, Homo sapiens
agtatttcttcatatgattact

SEQ ID NO: 8397918 - DNA, 22 bp, Homo sapiens
agtctttagagtcttagtgttt

SEQ ID NO: 8397919 - DNA, 22 bp, Homo sapiens
agtgcatacccttctaaaaagt

SEQ ID NO: 8397920 - DNA, 22 bp, Homo sapiens
actggaaaacactactacatgc

SEQ ID NO: 8397921 - DNA, 22 bp, Homo sapiens
actggaaagttgattatgtcca

SEQ ID NO: 8397922 - DNA, 22 bp, Homo sapiens
agtgtttaaactgaagtgatga

SEQ ID NO: 8397923 - DNA, 22 bp, Homo sapiens
agtgtacaagaccttattgttg

SEQ ID NO: 8397924 - DNA, 22 bp, Homo sapiens
agtgtacatcagaacatatcaa

SEQ ID NO: 8397925 - DNA, 22 bp, Homo sapiens
agtgtacatagttaggaacatc

SEQ ID NO: 8397926 - DNA, 22 bp, Homo sapiens
agtgtacatgtacacattagta

SEQ ID NO: 8397927 - DNA, 22 bp, Homo sapiens
atatgcttacagcttaaaatcc

SEQ ID NO: 8397928 - DNA, 22 bp, Homo sapiens
atatgaaagtaagcatgtgtgt

SEQ ID NO: 8397929 - DNA, 22 bp, Homo sapiens
actttcaagcaagaacactttg

SEQ ID NO: 8397930 - DNA, 22 bp, Homo sapiens
actttcaagccctctagagaca

SEQ ID NO: 8397931 - DNA, 22 bp, Homo sapiens
actttcaattcactgagatata

SEQ ID NO: 8397932 - DNA, 22 bp, Homo sapiens
actttctattgtttagattctg

SEQ ID NO: 8397933 - DNA, 22 bp, Homo sapiens
actttctattcccacagagata

SEQ ID NO: 8397934 - DNA, 22 bp, Homo sapiens
atattcttatccttttctctgt

SEQ ID NO: 8397935 - DNA, 22 bp, Homo sapiens
atctcacactgggtttgagggt

SEQ ID NO: 8397936 - DNA, 22 bp, Homo sapiens
agaaagtttattcctatctagc

SEQ ID NO: 8397937 - DNA, 22 bp, Homo sapiens
ataaaatttgctactgttaaat

SEQ ID NO: 8397938 - DNA, 22 bp, Homo sapiens
actgtgcatctattgccattta

SEQ ID NO: 8397939 - DNA, 22 bp, Homo sapiens
actttcaaaagagaagtcatga

SEQ ID NO: 8397940 - DNA, 22 bp, Homo sapiens
atacatgttgtaccatatgttt

SEQ ID NO: 8397941 - DNA, 22 bp, Homo sapiens
atacattattgttaaagaacat

SEQ ID NO: 8397942 - DNA, 22 bp, Homo sapiens
atacatctatgcctttctgaca

SEQ ID NO: 8397943 - DNA, 22 bp, Homo sapiens
atacagatgttaaagcaatttc

SEQ ID NO: 8397944 - DNA, 20 bp, Homo sapiens
acatttgtatctcccagtgg

SEQ ID NO: 8397945 - DNA, 22 bp, Homo sapiens
acatgtgtaagatgtgatatat

SEQ ID NO: 8397946 - DNA, 22 bp, Homo sapiens
acatgtgttttcctacttatga

SEQ ID NO: 8397947 - DNA, 22 bp, Homo sapiens
acatgtttacattaggtgatat

SEQ ID NO: 8397948 - DNA, 22 bp, Homo sapiens
acatgtttaagtttgttatatg

SEQ ID NO: 8397949 - DNA, 22 bp, Homo sapiens
acatgtttaagtttaatgaaaa

SEQ ID NO: 8397950 - DNA, 19 bp, Homo sapiens
acatgttttgcagaacagc

SEQ ID NO: 8397951 - DNA, 22 bp, Homo sapiens
acatgtttgataaatatttggg

SEQ ID NO: 8397952 - DNA, 22 bp, Homo sapiens
acatgcttccaaattatgttgg

SEQ ID NO: 8397953 - DNA, 22 bp, Homo sapiens
acatcagagggctcacatgatc

SEQ ID NO: 8397954 - DNA, 22 bp, Homo sapiens
acatattttgaaagctttctaa

SEQ ID NO: 8397955 - DNA, 22 bp, Homo sapiens
acatcacagagcccagataaag

SEQ ID NO: 8397956 - DNA, 22 bp, Homo sapiens
acatttgattgatgaatcaaat

SEQ ID NO: 8397957 - DNA, 22 bp, Homo sapiens
acatttgataattataaagaca

SEQ ID NO: 8397958 - DNA, 22 bp, Homo sapiens
acatttgatggagttagtaggt

SEQ ID NO: 8397959 - DNA, 22 bp, Homo sapiens
acatttgaggatgttaagaatg

SEQ ID NO: 8397960 - DNA, 22 bp, Homo sapiens
acatttgactctgttcatatta

SEQ ID NO: 8397961 - DNA, 22 bp, Homo sapiens
acatttgagcatctactaagtg

SEQ ID NO: 8397962 - DNA, 22 bp, Homo sapiens
acatttgaaatgccatgtgagg

SEQ ID NO: 8397963 - DNA, 22 bp, Homo sapiens
acatttgaaattctgaacagat

SEQ ID NO: 8397964 - DNA, 20 bp, Homo sapiens
acatttgaagtcgcatttct

SEQ ID NO: 8397965 - DNA, 22 bp, Homo sapiens
acatttgacatttagtatcagc

SEQ ID NO: 8397966 - DNA, 22 bp, Homo sapiens
acatttgaaataaactcaagtg

SEQ ID NO: 8397967 - DNA, 22 bp, Homo sapiens
acatttcagaatcacacagctt

SEQ ID NO: 8397968 - DNA, 22 bp, Homo sapiens
agctgaagggaggatatgtaca

SEQ ID NO: 8397969 - DNA, 22 bp, Homo sapiens
acagtacaccactgtgtacagt

SEQ ID NO: 8397970 - DNA, 21 bp, Homo sapiens
acagtttattagagtaagtgc

SEQ ID NO: 8397971 - DNA, 20 bp, Homo sapiens
acagtttatccagttagcag

SEQ ID NO: 8397972 - DNA, 22 bp, Homo sapiens
acatatttccatgcagcatgtc

SEQ ID NO: 8397973 - DNA, 22 bp, Homo sapiens
acatatgttgtaaacattccaa

SEQ ID NO: 8397974 - DNA, 20 bp, Homo sapiens
agtttgtgtgtctatgcgct

SEQ ID NO: 8397975 - DNA, 22 bp, Homo sapiens
agtttgtatgccaacagcaaag

SEQ ID NO: 8397976 - DNA, 22 bp, Homo sapiens
ctgatacaatgctaataaattt

SEQ ID NO: 8397977 - DNA, 22 bp, Homo sapiens
atactttgctacattgtacatt

SEQ ID NO: 8397978 - DNA, 22 bp, Homo sapiens
atacttttaattccttctgagt

SEQ ID NO: 8397979 - DNA, 22 bp, Homo sapiens
atacatgactcacacattctgc

SEQ ID NO: 8397980 - DNA, 22 bp, Homo sapiens
atacatctcatgtaagagataa

SEQ ID NO: 8397981 - DNA, 22 bp, Homo sapiens
atacatctggatgtatgcattt

SEQ ID NO: 8397982 - DNA, 22 bp, Homo sapiens
atatttgtttggcagagttcag

SEQ ID NO: 8397983 - DNA, 22 bp, Homo sapiens
atatttgttagagtctatgtgt

SEQ ID NO: 8397984 - DNA, 22 bp, Homo sapiens
atatttgttgagttcttatgat

SEQ ID NO: 8397985 - DNA, 22 bp, Homo sapiens
atatcattatgttatgagcaca

SEQ ID NO: 8397986 - DNA, 22 bp, Homo sapiens
atatcacagtagttgtttagtt

SEQ ID NO: 8397987 - DNA, 22 bp, Homo sapiens
atatcaaaataaacagcatgca

SEQ ID NO: 8397988 - DNA, 22 bp, Homo sapiens
atatcaaacgaagttattttaa

SEQ ID NO: 8397989 - DNA, 22 bp, Homo sapiens
atcattcaagtgctctaaaatg

SEQ ID NO: 8397990 - DNA, 22 bp, Homo sapiens
cttcagaggggactcaaagtca

SEQ ID NO: 8397991 - DNA, 22 bp, Homo sapiens
cttcagagcatcacttcagctg

SEQ ID NO: 8397992 - DNA, 22 bp, Homo sapiens
ctacaccttgatctaacatttt

SEQ ID NO: 8397993 - DNA, 22 bp, Homo sapiens
ctaaacaagggattataattga

SEQ ID NO: 8397994 - DNA, 22 bp, Homo sapiens
agtacaaaatgcagcatcatca

SEQ ID NO: 8397995 - DNA, 22 bp, Homo sapiens
agtaatttgttataaagcaata

SEQ ID NO: 8397996 - DNA, 19 bp, Homo sapiens
aggttacaggtgtcacaga

SEQ ID NO: 8397997 - DNA, 23 bp, Homo sapiens
aggttacagttgttaagttgcaa

SEQ ID NO: 8397998 - DNA, 22 bp, Homo sapiens
catattgctgtcattgtccctc

SEQ ID NO: 8397999 - DNA, 16 bp, Homo sapiens
catattgctgaaagag

SEQ ID NO: 8398000 - DNA, 23 bp, Homo sapiens
catattcaaaactggaccactct

SEQ ID NO: 8398001 - DNA, 22 bp, Homo sapiens
cagttttatgaatgcttattag

SEQ ID NO: 8398002 - DNA, 22 bp, Homo sapiens
cagtttcagaatcaaaacatca

SEQ ID NO: 8398003 - DNA, 22 bp, Homo sapiens
cagttttacccaagcttatttt

SEQ ID NO: 8398004 - DNA, 22 bp, Homo sapiens
cagttttaaattgttagataat

SEQ ID NO: 8398005 - DNA, 22 bp, Homo sapiens
ccaagataatctgtgaaaaatc

SEQ ID NO: 8398006 - DNA, 22 bp, Homo sapiens
cattaacaattgtttatgctgt

SEQ ID NO: 8398007 - DNA, 22 bp, Homo sapiens
catttgaaattcttagaacaaa

SEQ ID NO: 8398008 - DNA, 22 bp, Homo sapiens
caaagactgcataacacatgaa

SEQ ID NO: 8398009 - DNA, 22 bp, Homo sapiens
caaaagcagcaagtttatatgt

SEQ ID NO: 8398010 - DNA, 22 bp, Homo sapiens
caaaagcaaagtccctgaatgt

SEQ ID NO: 8398011 - DNA, 22 bp, Homo sapiens
atttgtcaataagatgaacata

SEQ ID NO: 8398012 - DNA, 22 bp, Homo sapiens
atttgtctctgcactttactca

SEQ ID NO: 8398013 - DNA, 22 bp, Homo sapiens
atttgtatcaatctcaatatat

SEQ ID NO: 8398014 - DNA, 22 bp, Homo sapiens
atttgtatcttctaatattatc

SEQ ID NO: 8398015 - DNA, 22 bp, Homo sapiens
atttgtaaagtgcttaaaagta

SEQ ID NO: 8398016 - DNA, 22 bp, Homo sapiens
atttgtaatttcttatctgtgt

SEQ ID NO: 8398017 - DNA, 22 bp, Homo sapiens
atttgtaagctagagccatgat

SEQ ID NO: 8398018 - DNA, 22 bp, Homo sapiens
atttgtaacacgtgacaggttg

SEQ ID NO: 8398019 - DNA, 17 bp, Homo sapiens
atttgtaactagctctt

SEQ ID NO: 8398020 - DNA, 22 bp, Homo sapiens
atttcttcaggtcagaaataga

SEQ ID NO: 8398021 - DNA, 22 bp, Homo sapiens
atttctgtttgctactataagt

SEQ ID NO: 8398022 - DNA, 20 bp, Homo sapiens
gccctgtgatgtcttgacct

SEQ ID NO: 8398023 - DNA, 23 bp, Homo sapiens
atttcctaaaagataatcattac

SEQ ID NO: 8398024 - DNA, 22 bp, Homo sapiens
atttcctaacagaggcaacagt

SEQ ID NO: 8398025 - DNA, 23 bp, Homo sapiens
atttcctactataaaagaggtaa

SEQ ID NO: 8398026 - DNA, 22 bp, Homo sapiens
attcttttgtcctagcttgata

SEQ ID NO: 8398027 - DNA, 22 bp, Homo sapiens
attctttccagacactgattgc

SEQ ID NO: 8398028 - DNA, 22 bp, Homo sapiens
attgcacaaacacagtcagact

SEQ ID NO: 8398029 - DNA, 22 bp, Homo sapiens
attatccaacacccagttacat

SEQ ID NO: 8398030 - DNA, 22 bp, Homo sapiens
attatgtatttggtatagtttg

SEQ ID NO: 8398031 - DNA, 22 bp, Homo sapiens
atgatgtaacataaagatgtct

SEQ ID NO: 8398032 - DNA, 22 bp, Homo sapiens
atgctacagagtttgaatatgt

SEQ ID NO: 8398033 - DNA, 21 bp, Homo sapiens
atctttattacgcagagaaga

SEQ ID NO: 8398034 - DNA, 22 bp, Homo sapiens
atctttcagggccatttgtatt

SEQ ID NO: 8398035 - DNA, 22 bp, Homo sapiens
atctttcaggcctagtgtttaa

SEQ ID NO: 8398036 - DNA, 22 bp, Homo sapiens
ctttattagatgtagactttct

SEQ ID NO: 8398037 - DNA, 22 bp, Homo sapiens
atctttgaagaggacttgaagt

SEQ ID NO: 8398038 - DNA, 22 bp, Homo sapiens
atgagaatatgatttactattg

SEQ ID NO: 8398039 - DNA, 22 bp, Homo sapiens
ctttttatctcttaatgatgtt

SEQ ID NO: 8398040 - DNA, 19 bp, Homo sapiens
ctttttcaccttctagaag

SEQ ID NO: 8398041 - DNA, 22 bp, Homo sapiens
atgacacataaaacaaggactg

SEQ ID NO: 8398042 - DNA, 22 bp, Homo sapiens
ctttgctactgtgaatagtgcc

SEQ ID NO: 8398043 - DNA, 22 bp, Homo sapiens
ctttgctagtgatttgtttagg

SEQ ID NO: 8398044 - DNA, 22 bp, Homo sapiens
ctttgctaatgttgcattttca

SEQ ID NO: 8398045 - DNA, 22 bp, Homo sapiens
ctttcaaaacgctctgtatgca

SEQ ID NO: 8398046 - DNA, 22 bp, Homo sapiens
atgtcagattcctaaatatctt

SEQ ID NO: 8398047 - DNA, 22 bp, Homo sapiens
atgtcagagcttccacaatagt

SEQ ID NO: 8398048 - DNA, 22 bp, Homo sapiens
gagaatatattgaagtagttcc

SEQ ID NO: 8398049 - DNA, 22 bp, Homo sapiens
caactttagaccccaagtagct

SEQ ID NO: 8398050 - DNA, 22 bp, Homo sapiens
caagaataaccagacaatagca

SEQ ID NO: 8398051 - DNA, 22 bp, Homo sapiens
caatttcattaatagatataga

SEQ ID NO: 8398052 - DNA, 22 bp, Homo sapiens
caatttcatcttgtgcttcaat

SEQ ID NO: 8398053 - DNA, 22 bp, Homo sapiens
caatttcatggataaaagatgt

SEQ ID NO: 8398054 - DNA, 22 bp, Homo sapiens
caatttcagacctttccttgga

SEQ ID NO: 8398055 - DNA, 22 bp, Homo sapiens
caatttcagtgctgtggagagg

SEQ ID NO: 8398056 - DNA, 23 bp, Homo sapiens
caatttcatatgattctacctaa

SEQ ID NO: 8398057 - DNA, 22 bp, Homo sapiens
caatttcagtctcagagagttc

SEQ ID NO: 8398058 - DNA, 22 bp, Homo sapiens
caatttcactaataatatttac

SEQ ID NO: 8398059 - DNA, 22 bp, Homo sapiens
caatttcaatacaaaatacatt

SEQ ID NO: 8398060 - DNA, 22 bp, Homo sapiens
caatgttttgttgaatgaatag

SEQ ID NO: 8398061 - DNA, 22 bp, Homo sapiens
caatgttttcaactgacaagta

SEQ ID NO: 8398062 - DNA, 22 bp, Homo sapiens
caatcagtttctgttgtataat

SEQ ID NO: 8398063 - DNA, 22 bp, Homo sapiens
caatcagtaaccggatcatggt

SEQ ID NO: 8398064 - DNA, 22 bp, Homo sapiens
caattctttgtagaagctctcc

SEQ ID NO: 8398065 - DNA, 22 bp, Homo sapiens
cacaacttagcagcttgaaaca

SEQ ID NO: 8398066 - DNA, 22 bp, Homo sapiens
cacttaaatctgttgagaaaaa

SEQ ID NO: 8398067 - DNA, 22 bp, Homo sapiens
cactttaactcacatttcagct

SEQ ID NO: 8398068 - DNA, 22 bp, Homo sapiens
cactattttctcttcagatggc

SEQ ID NO: 8398069 - DNA, 22 bp, Homo sapiens
ggcaataatgacattttaaaaa

SEQ ID NO: 8398070 - DNA, 22 bp, Homo sapiens
cagattttgatgaatgtggaaa

SEQ ID NO: 8398071 - DNA, 22 bp, Homo sapiens
cagatttctatttcaaatacat

SEQ ID NO: 8398072 - DNA, 22 bp, Homo sapiens
gtagaaatggtgtgtttcttct

SEQ ID NO: 8398073 - DNA, 22 bp, Homo sapiens
gtagaaatagtggttgacagga

SEQ ID NO: 8398074 - DNA, 22 bp, Homo sapiens
gtcacaggaagcagcaggcact

SEQ ID NO: 8398075 - DNA, 22 bp, Homo sapiens
gtattttacttacgcatgactt

SEQ ID NO: 8398076 - DNA, 22 bp, Homo sapiens
cagaataaacagaaacgtagct

SEQ ID NO: 8398077 - DNA, 22 bp, Homo sapiens
ccacatttggagaagatacttt

SEQ ID NO: 8398078 - DNA, 20 bp, Homo sapiens
ccacattttactgtttgcca

SEQ ID NO: 8398079 - DNA, 22 bp, Homo sapiens
ccagagagctacaaggcataaa

SEQ ID NO: 8398080 - DNA, 22 bp, Homo sapiens
catgtttaattgcgatgtttga

SEQ ID NO: 8398081 - DNA, 22 bp, Homo sapiens
catttgtaatactgacttgcag

SEQ ID NO: 8398082 - DNA, 22 bp, Homo sapiens
catttgtatcatatgtatctta

SEQ ID NO: 8398083 - DNA, 22 bp, Homo sapiens
catgaaaaatttactgttaaca

SEQ ID NO: 8398084 - DNA, 22 bp, Homo sapiens
cataacacattcatcagcagag

SEQ ID NO: 8398085 - DNA, 22 bp, Homo sapiens
tactattttgacatgaaattga

SEQ ID NO: 8398086 - DNA, 22 bp, Homo sapiens
tactatttggaattttaaattg

SEQ ID NO: 8398087 - DNA, 22 bp, Homo sapiens
tagcaaggcgtggcactcaaat

SEQ ID NO: 8398088 - DNA, 22 bp, Homo sapiens
tagcaagtggcaccacatttct

SEQ ID NO: 8398089 - DNA, 22 bp, Homo sapiens
tagataatttggcatcatattg

SEQ ID NO: 8398090 - DNA, 22 bp, Homo sapiens
tagataaattagaaagtttact

SEQ ID NO: 8398091 - DNA, 22 bp, Homo sapiens
tagctagaaagtgaagatcaca

SEQ ID NO: 8398092 - DNA, 22 bp, Homo sapiens
cataaactctctgtaccaatat

SEQ ID NO: 8398093 - DNA, 22 bp, Homo sapiens
cataaagtgtataagtgaagaa

SEQ ID NO: 8398094 - DNA, 19 bp, Homo sapiens
cataaatgtacaagataca

SEQ ID NO: 8398095 - DNA, 22 bp, Homo sapiens
cagttacatgctcatgtcatca

SEQ ID NO: 8398096 - DNA, 22 bp, Homo sapiens
cagttacattaataatgcacat

SEQ ID NO: 8398097 - DNA, 21 bp, Homo sapiens
cagttacacaagtgttaccag

SEQ ID NO: 8398098 - DNA, 22 bp, Homo sapiens
cagttacacaccattgtgaaca

SEQ ID NO: 8398099 - DNA, 19 bp, Homo sapiens
cagttacagcagctaagac

SEQ ID NO: 8398100 - DNA, 18 bp, Homo sapiens
cagttacaccttcattca

SEQ ID NO: 8398101 - DNA, 22 bp, Homo sapiens
cagttacagagccagttagaga

SEQ ID NO: 8398102 - DNA, 22 bp, Homo sapiens
cagttacagctgcaccagagcc

SEQ ID NO: 8398103 - DNA, 21 bp, Homo sapiens
cagttacagccaggacaaggc

SEQ ID NO: 8398104 - DNA, 19 bp, Homo sapiens
cagttacaggcactgtggg

SEQ ID NO: 8398105 - DNA, 22 bp, Homo sapiens
cagttacataaatgataaaatg

SEQ ID NO: 8398106 - DNA, 22 bp, Homo sapiens
cagttacatatttagtaggtta

SEQ ID NO: 8398107 - DNA, 19 bp, Homo sapiens
cagtttaactaattttatc

SEQ ID NO: 8398108 - DNA, 22 bp, Homo sapiens
tcagacttgactttgtaagttt

SEQ ID NO: 8398109 - DNA, 22 bp, Homo sapiens
cagtgtttagcacagtgcttgg

SEQ ID NO: 8398110 - DNA, 23 bp, Homo sapiens
cagtgccatttgtcttgcctatg

SEQ ID NO: 8398111 - DNA, 22 bp, Homo sapiens
tcacagttcaactagttcagat

SEQ ID NO: 8398112 - DNA, 22 bp, Homo sapiens
tctttaaagttggagcttgcaa

SEQ ID NO: 8398113 - DNA, 22 bp, Homo sapiens
tgaagatttccaccaaatcaca

SEQ ID NO: 8398114 - DNA, 22 bp, Homo sapiens
tgaacactgccatatttaagaa

SEQ ID NO: 8398115 - DNA, 22 bp, Homo sapiens
tgaacacatttgggaaaatctt

SEQ ID NO: 8398116 - DNA, 22 bp, Homo sapiens
tgacagagctggagaataattt

SEQ ID NO: 8398117 - DNA, 23 bp, Homo sapiens
tgcatatcagaaatttcatatgg

SEQ ID NO: 8398118 - DNA, 22 bp, Homo sapiens
cctgacctacctgaagtctaca

SEQ ID NO: 8398119 - DNA, 22 bp, Homo sapiens
tgtacagttaatcttaagccat

SEQ ID NO: 8398120 - DNA, 22 bp, Homo sapiens
tgtcaacacacctatctcaatt

SEQ ID NO: 8398121 - DNA, 19 bp, Homo sapiens
tggctaattttatagaggc

SEQ ID NO: 8398122 - DNA, 22 bp, Homo sapiens
tggctaacagttaagatttcat

SEQ ID NO: 8398123 - DNA, 21 bp, Homo sapiens
cctaaacaagactgacacaca

SEQ ID NO: 8398124 - DNA, 22 bp, Homo sapiens
ccctgtgcctagttggcctaaa

SEQ ID NO: 8398125 - DNA, 22 bp, Homo sapiens
tgctttcactgatgtatcattt

SEQ ID NO: 8398126 - DNA, 22 bp, Homo sapiens
tgctttcatgaagtctatagag

SEQ ID NO: 8398127 - DNA, 22 bp, Homo sapiens
tttgaaagagctgatacatgaa

SEQ ID NO: 8398128 - DNA, 22 bp, Homo sapiens
tttgaaaagaaccatcgcctta

SEQ ID NO: 8398129 - DNA, 22 bp, Homo sapiens
tttgaaaaaggcctttggtatg

SEQ ID NO: 8398130 - DNA, 22 bp, Homo sapiens
tttgaaactctgaacatgtttc

SEQ ID NO: 8398131 - DNA, 22 bp, Homo sapiens
tttgaaactcatgatcatcact

SEQ ID NO: 8398132 - DNA, 22 bp, Homo sapiens
tttgaaagacagaatatttttg

SEQ ID NO: 8398133 - DNA, 22 bp, Homo sapiens
tttgaaacccgtcactttgagt

SEQ ID NO: 8398134 - DNA, 22 bp, Homo sapiens
tttgaaacctagttatatgact

SEQ ID NO: 8398135 - DNA, 22 bp, Homo sapiens
tttgaaacaggtgattcagcta

SEQ ID NO: 8398136 - DNA, 22 bp, Homo sapiens
tttgcaaacacttaagaagaga

SEQ ID NO: 8398137 - DNA, 22 bp, Homo sapiens
tttgagaagatgtaatgttaag

SEQ ID NO: 8398138 - DNA, 22 bp, Homo sapiens
tttgagaaaggggatttaattc

SEQ ID NO: 8398139 - DNA, 22 bp, Homo sapiens
tttgcaaagtgactattatatg

SEQ ID NO: 8398140 - DNA, 22 bp, Homo sapiens
tttgcaaagaaattattgctgt

SEQ ID NO: 8398141 - DNA, 22 bp, Homo sapiens
tttgcaaagtccattgaagtta

SEQ ID NO: 8398142 - DNA, 18 bp, Homo sapiens
tttgcaaaggaagtatgg

SEQ ID NO: 8398143 - DNA, 22 bp, Homo sapiens
ttttgcctgagagtgaaaataa

SEQ ID NO: 8398144 - DNA, 22 bp, Homo sapiens
tttatgtaagtggaatgatgcc

SEQ ID NO: 8398145 - DNA, 22 bp, Homo sapiens
tttatgcagcctcagtatcaga

SEQ ID NO: 8398146 - DNA, 22 bp, Homo sapiens
tttatgcatctctaggaagggc

SEQ ID NO: 8398147 - DNA, 22 bp, Homo sapiens
tttatgcctccagatcttgctt

SEQ ID NO: 8398148 - DNA, 23 bp, Homo sapiens
tttatgcagcatgtagaacatgg

SEQ ID NO: 8398149 - DNA, 22 bp, Homo sapiens
tttcacatatcaactctatcct

SEQ ID NO: 8398150 - DNA, 22 bp, Homo sapiens
tttccaatgtagatgtctctgg

SEQ ID NO: 8398151 - DNA, 22 bp, Homo sapiens
tttccaattcaagcttttacgt

SEQ ID NO: 8398152 - DNA, 22 bp, Homo sapiens
tttccaataaggtcaccttcct

SEQ ID NO: 8398153 - DNA, 22 bp, Homo sapiens
tttctcaacctcaacactattt

SEQ ID NO: 8398154 - DNA, 22 bp, Homo sapiens
tttctcaactgtattatgcaga

SEQ ID NO: 8398155 - DNA, 22 bp, Homo sapiens
ttgcatactgacctctaagctt

SEQ ID NO: 8398156 - DNA, 22 bp, Homo sapiens
ttgcataaatgcttaaaatttg

SEQ ID NO: 8398157 - DNA, 22 bp, Homo sapiens
ttgccctagggtcttatcctcc

SEQ ID NO: 8398158 - DNA, 22 bp, Homo sapiens
ttgcatgcacctaacaaattat

SEQ ID NO: 8398159 - DNA, 23 bp, Homo sapiens
ttgcatcctgacgtctattttct

SEQ ID NO: 8398160 - DNA, 22 bp, Homo sapiens
ttgcatccgggctacttccaca

SEQ ID NO: 8398161 - DNA, 22 bp, Homo sapiens
ttgcatccgaaacaatttctct

SEQ ID NO: 8398162 - DNA, 22 bp, Homo sapiens
ttgcatctaccatatcaaagat

SEQ ID NO: 8398163 - DNA, 22 bp, Homo sapiens
ttgcatcagcaggcataattgg

SEQ ID NO: 8398164 - DNA, 22 bp, Homo sapiens
ttgcatatcctccaacacatgg

SEQ ID NO: 8398165 - DNA, 22 bp, Homo sapiens
ttggaaaagtgaaactagatgc

SEQ ID NO: 8398166 - DNA, 22 bp, Homo sapiens
ctaaaaactctacgatgcacag

SEQ ID NO: 8398167 - DNA, 22 bp, Homo sapiens
ttcaaagtgtgacctgacaagc

SEQ ID NO: 8398168 - DNA, 22 bp, Homo sapiens
ttcaaagtcctgtcaggtagcc

SEQ ID NO: 8398169 - DNA, 22 bp, Homo sapiens
ttcaaagtgcatgttcctcaga

SEQ ID NO: 8398170 - DNA, 22 bp, Homo sapiens
ttcaaagtgcttttaaccttta

SEQ ID NO: 8398171 - DNA, 22 bp, Homo sapiens
ttcaaagtgctgttcaaagtag

SEQ ID NO: 8398172 - DNA, 21 bp, Homo sapiens
ttcaaagtttgcctaaagatt

SEQ ID NO: 8398173 - DNA, 22 bp, Homo sapiens
cgaaatcagcatcttgaggcaa

SEQ ID NO: 8398174 - DNA, 22 bp, Homo sapiens
cgaaatcaaacttgggcttctg

SEQ ID NO: 8398175 - DNA, 23 bp, Homo sapiens
ttattgcaaggtaaaattgctga

SEQ ID NO: 8398176 - DNA, 22 bp, Homo sapiens
ttacagttgctacaaaggataa

SEQ ID NO: 8398177 - DNA, 22 bp, Homo sapiens
ttacagtttagtccaagccaga

SEQ ID NO: 8398178 - DNA, 22 bp, Homo sapiens
ttacagttgtagaaagtggttg

SEQ ID NO: 8398179 - DNA, 22 bp, Homo sapiens
ttataacaacagtttactttaa

SEQ ID NO: 8398180 - DNA, 22 bp, Homo sapiens
ttataaaggtttgtgcatattt

SEQ ID NO: 8398181 - DNA, 22 bp, Homo sapiens
ttataaagattgttatgtatct

SEQ ID NO: 8398182 - DNA, 22 bp, Homo sapiens
ttacatacttactagatctatg

SEQ ID NO: 8398183 - DNA, 22 bp, Homo sapiens
ttagcaagataacagtaatttt

SEQ ID NO: 8398184 - DNA, 22 bp, Homo sapiens
gaaacttttaaacctcatgagt

SEQ ID NO: 8398185 - DNA, 22 bp, Homo sapiens
gaaactttcatgaatataagat

SEQ ID NO: 8398186 - DNA, 22 bp, Homo sapiens
gaaaaatgagctgatgtcaggg

SEQ ID NO: 8398187 - DNA, 22 bp, Homo sapiens
gaaatatacattgcaggaagag

SEQ ID NO: 8398188 - DNA, 22 bp, Homo sapiens
gaaagacttcctttgagagtac

SEQ ID NO: 8398189 - DNA, 22 bp, Homo sapiens
gaaagactaactagaaagtgca

SEQ ID NO: 8398190 - DNA, 22 bp, Homo sapiens
gaaatgtcatagtcttcaagcc

SEQ ID NO: 8398191 - DNA, 22 bp, Homo sapiens
gaaatgtctcttgatttttgga

SEQ ID NO: 8398192 - DNA, 22 bp, Homo sapiens
gaaatgtctctggatttgcttt

SEQ ID NO: 8398193 - DNA, 22 bp, Homo sapiens
gaaatgtctttgacaagagagg

SEQ ID NO: 8398194 - DNA, 22 bp, Homo sapiens
gaaattcactgtatttcttggg

SEQ ID NO: 8398195 - DNA, 22 bp, Homo sapiens
gaaattcaaataagatatgtag

SEQ ID NO: 8398196 - DNA, 22 bp, Homo sapiens
cttcaaatgtgattttaataac

SEQ ID NO: 8398197 - DNA, 22 bp, Homo sapiens
cttcaaagatttgataaagcca

SEQ ID NO: 8398198 - DNA, 22 bp, Homo sapiens
ctttccaatgtcactatgaatc

SEQ ID NO: 8398199 - DNA, 22 bp, Homo sapiens
ctttccaatgcatttccaatgt

SEQ ID NO: 8398200 - DNA, 22 bp, Homo sapiens
cttgcttacctagttagctcca

SEQ ID NO: 8398201 - DNA, 22 bp, Homo sapiens
cttgcctaggtgtatattaaat

SEQ ID NO: 8398202 - DNA, 22 bp, Homo sapiens
gagattttcagcttgactggga

SEQ ID NO: 8398203 - DNA, 22 bp, Homo sapiens
gagatttttcaacaagaatagg

SEQ ID NO: 8398204 - DNA, 17 bp, Homo sapiens
gagattttcgtcctgaa

SEQ ID NO: 8398205 - DNA, 22 bp, Homo sapiens
gacatcaattcagcattttaag

SEQ ID NO: 8398206 - DNA, 22 bp, Homo sapiens
gacatatttgaaaccaagagaa

SEQ ID NO: 8398207 - DNA, 22 bp, Homo sapiens
gaccttcaagcaccatatttat

SEQ ID NO: 8398208 - DNA, 22 bp, Homo sapiens
gacaaaacacattagtttaaaa

SEQ ID NO: 8398209 - DNA, 22 bp, Homo sapiens
gacaaaactgagatcacactgt

SEQ ID NO: 8398210 - DNA, 22 bp, Homo sapiens
gacaaagtgctaaaccacagag

SEQ ID NO: 8398211 - DNA, 22 bp, Homo sapiens
gacaaagtcaacagtactctca

SEQ ID NO: 8398212 - DNA, 18 bp, Homo sapiens
gacaaatgcaatttaaag

SEQ ID NO: 8398213 - DNA, 19 bp, Homo sapiens
gaatgtttgtattcagcgc

SEQ ID NO: 8398214 - DNA, 22 bp, Homo sapiens
gaatgtttttcattggtgactc

SEQ ID NO: 8398215 - DNA, 22 bp, Homo sapiens
gaatgtttttcaaacctgtggc

SEQ ID NO: 8398216 - DNA, 22 bp, Homo sapiens
gaatgtttgtgcagagtcatct

SEQ ID NO: 8398217 - DNA, 22 bp, Homo sapiens
gaatgtttttaggaatgttatg

SEQ ID NO: 8398218 - DNA, 22 bp, Homo sapiens
gaatgtttttataagtgttaca

SEQ ID NO: 8398219 - DNA, 22 bp, Homo sapiens
tccctgaatctcgaactagcct

SEQ ID NO: 8398220 - DNA, 22 bp, Homo sapiens
tcctagtcacaggaaaatttca

SEQ ID NO: 8398221 - DNA, 22 bp, Homo sapiens
tccattctatgcttacatttat

SEQ ID NO: 8398222 - DNA, 21 bp, Homo sapiens
tccaatttttaagactatggc

SEQ ID NO: 8398223 - DNA, 22 bp, Homo sapiens
tcctgcacattagtatttttta

SEQ ID NO: 8398224 - DNA, 22 bp, Homo sapiens
tccaatattcattaaaatgcag

SEQ ID NO: 8398225 - DNA, 22 bp, Homo sapiens
tccaatatttctcatatatgga

SEQ ID NO: 8398226 - DNA, 22 bp, Homo sapiens
tccaatatttctcacatatgga

SEQ ID NO: 8398227 - DNA, 22 bp, Homo sapiens
tccaattttacgtctgtataaa

SEQ ID NO: 8398228 - DNA, 22 bp, Homo sapiens
tccaatttgtttgatgatggaa

SEQ ID NO: 8398229 - DNA, 22 bp, Homo sapiens
tccaattttctgatttcacttg

SEQ ID NO: 8398230 - DNA, 22 bp, Homo sapiens
tccaatttgaaatggtatatgt

SEQ ID NO: 8398231 - DNA, 22 bp, Homo sapiens
tccaatctagtatgataaatga

SEQ ID NO: 8398232 - DNA, 22 bp, Homo sapiens
tccaaattctatgttctttcca

SEQ ID NO: 8398233 - DNA, 22 bp, Homo sapiens
tccaactaggcacacagctggt

SEQ ID NO: 8398234 - DNA, 23 bp, Homo sapiens
tccaaactcaagacattaataag

SEQ ID NO: 8398235 - DNA, 22 bp, Homo sapiens
tcatttaattggttttgctcgt

SEQ ID NO: 8398236 - DNA, 22 bp, Homo sapiens
tcatttaataatttttgagtag

SEQ ID NO: 8398237 - DNA, 22 bp, Homo sapiens
tcatttcagatgcatttagaat

SEQ ID NO: 8398238 - DNA, 22 bp, Homo sapiens
tcatttcacttctctagggaga

SEQ ID NO: 8398239 - DNA, 22 bp, Homo sapiens
tcatttcagccatttttaaatg

SEQ ID NO: 8398240 - DNA, 21 bp, Homo sapiens
tcatttcagggccttggcttc

SEQ ID NO: 8398241 - DNA, 23 bp, Homo sapiens
tcatttcacagtgagcttcctag

SEQ ID NO: 8398242 - DNA, 22 bp, Homo sapiens
tcatttcaatgatactactaag

SEQ ID NO: 8398243 - DNA, 22 bp, Homo sapiens
tcatttcatgtctcaggcactg

SEQ ID NO: 8398244 - DNA, 22 bp, Homo sapiens
tcatttcagtcctctgtgtgag

SEQ ID NO: 8398245 - DNA, 17 bp, Homo sapiens
tcatttcagtaaatcca

SEQ ID NO: 8398246 - DNA, 22 bp, Homo sapiens
tcatttcagtggcacagaagat

SEQ ID NO: 8398247 - DNA, 23 bp, Homo sapiens
tcatttcaggttgcatggtacca

SEQ ID NO: 8398248 - DNA, 23 bp, Homo sapiens
tcatttcatccagccttgagagt

SEQ ID NO: 8398249 - DNA, 22 bp, Homo sapiens
tcatttcagttgttccctggtt

SEQ ID NO: 8398250 - DNA, 22 bp, Homo sapiens
tcatttcagttcagaggccttt

SEQ ID NO: 8398251 - DNA, 22 bp, Homo sapiens
tcatacattcagcagatatttg

SEQ ID NO: 8398252 - DNA, 22 bp, Homo sapiens
tcatacatcttgtatatctatc

SEQ ID NO: 8398253 - DNA, 22 bp, Homo sapiens
tcagatttggacacaggaactt

SEQ ID NO: 8398254 - DNA, 20 bp, Homo sapiens
tcagatttttctaactttga

SEQ ID NO: 8398255 - DNA, 22 bp, Homo sapiens
tcacattttatctattttaagt

SEQ ID NO: 8398256 - DNA, 22 bp, Homo sapiens
tcacatttggagaaagcctgcc

SEQ ID NO: 8398257 - DNA, 22 bp, Homo sapiens
tcacattttagtaccatgattt

SEQ ID NO: 8398258 - DNA, 22 bp, Homo sapiens
tcacatttgtgttttattagag

SEQ ID NO: 8398259 - DNA, 22 bp, Homo sapiens
tcacatttgttcttgaatctaa

SEQ ID NO: 8398260 - DNA, 22 bp, Homo sapiens
tcacatttctttatgtagtctt

SEQ ID NO: 8398261 - DNA, 22 bp, Homo sapiens
tcacatttctgattataccaaa

SEQ ID NO: 8398262 - DNA, 21 bp, Homo sapiens
tcacatttctcatgggtaaat

SEQ ID NO: 8398263 - DNA, 22 bp, Homo sapiens
tcacatttatttcaaagttact

SEQ ID NO: 8398264 - DNA, 22 bp, Homo sapiens
tcacatttctcagcactgatga

SEQ ID NO: 8398265 - DNA, 22 bp, Homo sapiens
tcacatttaaacaggaggatta

SEQ ID NO: 8398266 - DNA, 22 bp, Homo sapiens
tcacatttatactccatttgca

SEQ ID NO: 8398267 - DNA, 22 bp, Homo sapiens
tcaacatttatgaagctgtggc

SEQ ID NO: 8398268 - DNA, 22 bp, Homo sapiens
tcaacatataggcaacctgtaa

SEQ ID NO: 8398269 - DNA, 22 bp, Homo sapiens
tcaacattcatatatagccaca

SEQ ID NO: 8398270 - DNA, 22 bp, Homo sapiens
tcaacattggaggcaacattca

SEQ ID NO: 8398271 - DNA, 22 bp, Homo sapiens
tcaacagttctgtccaattaat

SEQ ID NO: 8398272 - DNA, 22 bp, Homo sapiens
tcaacactaaagaataatcttt

SEQ ID NO: 8398273 - DNA, 22 bp, Homo sapiens
tagaacttatttggcattattt

SEQ ID NO: 8398274 - DNA, 22 bp, Homo sapiens
tagatgaattagcaattatctt

SEQ ID NO: 8398275 - DNA, 22 bp, Homo sapiens
tagtttttaagtgtacaatttc

SEQ ID NO: 8398276 - DNA, 22 bp, Homo sapiens
tagtgcataacatttaaaggtc

SEQ ID NO: 8398277 - DNA, 22 bp, Homo sapiens
tagtgcaacagggaaagagtgt

SEQ ID NO: 8398278 - DNA, 22 bp, Homo sapiens
tatgaaacattcatacaaataa

SEQ ID NO: 8398279 - DNA, 22 bp, Homo sapiens
tatgaaaaggtggccaatgtag

SEQ ID NO: 8398280 - DNA, 22 bp, Homo sapiens
tatgaaaatttagctgaagcat

SEQ ID NO: 8398281 - DNA, 22 bp, Homo sapiens
tatgaaatttctagttctgctt

SEQ ID NO: 8398282 - DNA, 18 bp, Homo sapiens
tataaacacacttaggtt

SEQ ID NO: 8398283 - DNA, 22 bp, Homo sapiens
tagttttttcaacaaatggtgc

SEQ ID NO: 8398284 - DNA, 22 bp, Homo sapiens
tatcacatagtgtttagtaaat

SEQ ID NO: 8398285 - DNA, 22 bp, Homo sapiens
tatgtcaaagttaagaaatagg

SEQ ID NO: 8398286 - DNA, 22 bp, Homo sapiens
tatgtttcttccttttcataca

SEQ ID NO: 8398287 - DNA, 22 bp, Homo sapiens
tatgtaagtgagatcatggagt

SEQ ID NO: 8398288 - DNA, 22 bp, Homo sapiens
tatggaaagtgttttcttctgt

SEQ ID NO: 8398289 - DNA, 22 bp, Homo sapiens
tatttgctgaatctgattcaga

SEQ ID NO: 8398290 - DNA, 22 bp, Homo sapiens
tatttgcaggacatagatatgg

SEQ ID NO: 8398291 - DNA, 22 bp, Homo sapiens
tatttgaaggcatacattttga

SEQ ID NO: 8398292 - DNA, 22 bp, Homo sapiens
tcaaatcagcaagcagcttccc

SEQ ID NO: 8398293 - DNA, 22 bp, Homo sapiens
tcaaatctcattgcctaaaact

SEQ ID NO: 8398294 - DNA, 22 bp, Homo sapiens
tcaaatctcatcttgaattgta

SEQ ID NO: 8398295 - DNA, 22 bp, Homo sapiens
tcaaatctcactctgcatttct

SEQ ID NO: 8398296 - DNA, 22 bp, Homo sapiens
tcaaataccagcttttccagaa

SEQ ID NO: 8398297 - DNA, 22 bp, Homo sapiens
tcaaagtactactcagttcagc

SEQ ID NO: 8398298 - DNA, 22 bp, Homo sapiens
tcaaagtaagaatttattacaa

SEQ ID NO: 8398299 - DNA, 22 bp, Homo sapiens
tcaaagtttgtggcaatttatt

SEQ ID NO: 8398300 - DNA, 22 bp, Homo sapiens
tcaaagttggaaaagctggccc

SEQ ID NO: 8398301 - DNA, 22 bp, Homo sapiens
tcaaagttacttgtggttttct

SEQ ID NO: 8398302 - DNA, 22 bp, Homo sapiens
tcaaagtttttgagaattacat

SEQ ID NO: 8398303 - DNA, 22 bp, Homo sapiens
tcaaataatgccattcatcatc

SEQ ID NO: 8398304 - DNA, 22 bp, Homo sapiens
tattttgtatttatgcaagaaa

SEQ ID NO: 8398305 - DNA, 22 bp, Homo sapiens
tattttgtaattggtcatagct

SEQ ID NO: 8398306 - DNA, 22 bp, Homo sapiens
tcaaacttctattctctgtttt

SEQ ID NO: 8398307 - DNA, 22 bp, Homo sapiens
tactgaaagaatacataatttc

SEQ ID NO: 8398308 - DNA, 22 bp, Homo sapiens
tactgtttctactacttaggga

SEQ ID NO: 8398309 - DNA, 22 bp, Homo sapiens
tactgttttaaaaggtacttgt

SEQ ID NO: 8398310 - DNA, 22 bp, Homo sapiens
tactgttttctttatagtacag

SEQ ID NO: 8398311 - DNA, 22 bp, Homo sapiens
taccatttcagtaaaaacttag

SEQ ID NO: 8398312 - DNA, 22 bp, Homo sapiens
taccatttgagagagaacataa

SEQ ID NO: 8398313 - DNA, 21 bp, Homo sapiens
taccaattgccttctagttgt

SEQ ID NO: 8398314 - DNA, 22 bp, Homo sapiens
taccatttacttgaaaataaaa

SEQ ID NO: 8398315 - DNA, 22 bp, Homo sapiens
tacatgaacaaaatagcagaaa

SEQ ID NO: 8398316 - DNA, 22 bp, Homo sapiens
tacatgaatgtttcaatattgt

SEQ ID NO: 8398317 - DNA, 22 bp, Homo sapiens
tacatgaagttgtctaaactgg

SEQ ID NO: 8398318 - DNA, 22 bp, Homo sapiens
tacatgtatgtgttaatatctg

SEQ ID NO: 8398319 - DNA, 22 bp, Homo sapiens
tacagagggtaattgatcaagg

SEQ ID NO: 8398320 - DNA, 22 bp, Homo sapiens
tacagagatgtgaaaagctcta

SEQ ID NO: 8398321 - DNA, 22 bp, Homo sapiens
tacagtattatgagtgattgaa

SEQ ID NO: 8398322 - DNA, 22 bp, Homo sapiens
tacagtatatactgtgtgtaga

SEQ ID NO: 8398323 - DNA, 22 bp, Homo sapiens
tacagtatggaaaatgtatagt

SEQ ID NO: 8398324 - DNA, 22 bp, Homo sapiens
tacagagatttattgctaaggc

SEQ ID NO: 8398325 - DNA, 22 bp, Homo sapiens
tacagtgaccctatttccaaat

SEQ ID NO: 8398326 - DNA, 22 bp, Homo sapiens
tacaagaaggaaaactagcaat

SEQ ID NO: 8398327 - DNA, 22 bp, Homo sapiens
tacaagctcacaaatttttaag

SEQ ID NO: 8398328 - DNA, 22 bp, Homo sapiens
taatagttgtgactttgtaaag

SEQ ID NO: 8398329 - DNA, 21 bp, Homo sapiens
taatataggttcacaactagt

SEQ ID NO: 8398330 - DNA, 22 bp, Homo sapiens
taaggaaaatggacatcaaaca

SEQ ID NO: 8398331 - DNA, 22 bp, Homo sapiens
taacatgctaggaagagtgatt

SEQ ID NO: 8398332 - DNA, 22 bp, Homo sapiens
taagacttgatccaaagaacta

SEQ ID NO: 8398333 - DNA, 22 bp, Homo sapiens
taagacttcattagtaatatgg

SEQ ID NO: 8398334 - DNA, 22 bp, Homo sapiens
taagacttccaggaaaaggtgg

SEQ ID NO: 8398335 - DNA, 22 bp, Homo sapiens
taagagcataggcttgaaaata

SEQ ID NO: 8398336 - DNA, 22 bp, Homo sapiens
taacagtatccccatttgcaag

SEQ ID NO: 8398337 - DNA, 22 bp, Homo sapiens
taacagtatagcctaacatttc

SEQ ID NO: 8398338 - DNA, 22 bp, Homo sapiens
taacagttttgagttttgcttc

SEQ ID NO: 8398339 - DNA, 22 bp, Homo sapiens
taacatctgggctgcgtcctga

SEQ ID NO: 8398340 - DNA, 22 bp, Homo sapiens
taacatcctacactgttgtctt

SEQ ID NO: 8398341 - DNA, 22 bp, Homo sapiens
taaaagtatactttcaaaggag

SEQ ID NO: 8398342 - DNA, 22 bp, Homo sapiens
taaaacttctcatttttatggt

SEQ ID NO: 8398343 - DNA, 22 bp, Homo sapiens
taaaactgaatacatactgagg

SEQ ID NO: 8398344 - DNA, 22 bp, Homo sapiens
taaagcaaggcaaattgttggt

SEQ ID NO: 8398345 - DNA, 22 bp, Homo sapiens
gtttgaaaaaagcagtatgtaa

SEQ ID NO: 8398346 - DNA, 22 bp, Homo sapiens
gtttcacagcaaagttccctgt

SEQ ID NO: 8398347 - DNA, 22 bp, Homo sapiens
gtttcaaataggtttcagcaaa

SEQ ID NO: 8398348 - DNA, 22 bp, Homo sapiens
gtttcaaagtcagaaaaggagg

SEQ ID NO: 8398349 - DNA, 22 bp, Homo sapiens
gtttgaaagtggcaagtccttg

SEQ ID NO: 8398350 - DNA, 20 bp, Homo sapiens
gtttgaaatgattggttggt

SEQ ID NO: 8398351 - DNA, 22 bp, Homo sapiens
gtttgaaatgtctgcaagggaa

SEQ ID NO: 8398352 - DNA, 22 bp, Homo sapiens
gtttgaaagttcaacaggaaaa

SEQ ID NO: 8398353 - DNA, 22 bp, Homo sapiens
gtttgcaaattgtgttaaagct

SEQ ID NO: 8398354 - DNA, 22 bp, Homo sapiens
gtttgcaaattatgttaaaagt

SEQ ID NO: 8398355 - DNA, 22 bp, Homo sapiens
gtttgcaaagatcattttctcc

SEQ ID NO: 8398356 - DNA, 22 bp, Homo sapiens
gtttgtcatttgtacttctagc

SEQ ID NO: 8398357 - DNA, 22 bp, Homo sapiens
gtttcaaagggaagacgctgga

SEQ ID NO: 8398358 - DNA, 22 bp, Homo sapiens
gtttcaaaggtgtcaggcagtt

SEQ ID NO: 8398359 - DNA, 22 bp, Homo sapiens
gttcttctcttgtaatggaatc

SEQ ID NO: 8398360 - DNA, 22 bp, Homo sapiens
gtgttgatgacattttagaaac

SEQ ID NO: 8398361 - DNA, 22 bp, Homo sapiens
gttatattgccaagtatattgt

SEQ ID NO: 8398362 - DNA, 22 bp, Homo sapiens
gcatttcagaagcatgccctct

SEQ ID NO: 8398363 - DNA, 22 bp, Homo sapiens
gcatttcagaaaggttaccaac

SEQ ID NO: 8398364 - DNA, 22 bp, Homo sapiens
gcatttcaaaattccaggcaag

SEQ ID NO: 8398365 - DNA, 22 bp, Homo sapiens
gcatttcagagaaaatctgctt

SEQ ID NO: 8398366 - DNA, 22 bp, Homo sapiens
gcatttcatgccgtggaagtcc

SEQ ID NO: 8398367 - DNA, 19 bp, Homo sapiens
gcatttcaggcatgtttgc

SEQ ID NO: 8398368 - DNA, 22 bp, Homo sapiens
gcatttcatgctccttggaacc

SEQ ID NO: 8398369 - DNA, 22 bp, Homo sapiens
gcatttcatgtaagtcagacca

SEQ ID NO: 8398370 - DNA, 22 bp, Homo sapiens
gccactgttccaccatcttgat

SEQ ID NO: 8398371 - DNA, 22 bp, Homo sapiens
gcagttacctattttgtagaaa

SEQ ID NO: 8398372 - DNA, 22 bp, Homo sapiens
gcagttactagcaatttgtgaa

SEQ ID NO: 8398373 - DNA, 23 bp, Homo sapiens
gcagttagtccactttgcagaga

SEQ ID NO: 8398374 - DNA, 22 bp, Homo sapiens
gcattcttggtggagtgctaaa

SEQ ID NO: 8398375 - DNA, 22 bp, Homo sapiens
gcattacaggaatttgttactg

SEQ ID NO: 8398376 - DNA, 22 bp, Homo sapiens
gcccaagactgtacagttaaag

SEQ ID NO: 8398377 - DNA, 22 bp, Homo sapiens
gccatttggcaaaactgacttc

SEQ ID NO: 8398378 - DNA, 22 bp, Homo sapiens
gccattttctgtcttgtttatt

SEQ ID NO: 8398379 - DNA, 22 bp, Homo sapiens
gcaatacagttgaagagattga

SEQ ID NO: 8398380 - DNA, 22 bp, Homo sapiens
ggaaaaatgacacatatctcaa

SEQ ID NO: 8398381 - DNA, 22 bp, Homo sapiens
ggaaaaatagagtatactttaa

SEQ ID NO: 8398382 - DNA, 18 bp, Homo sapiens
gctttttagtgcatcttc

SEQ ID NO: 8398383 - DNA, 22 bp, Homo sapiens
gcttaaaagccacttagtctat

SEQ ID NO: 8398384 - DNA, 22 bp, Homo sapiens
gctatacaagtgtagaatagag

SEQ ID NO: 8398385 - DNA, 22 bp, Homo sapiens
gctagaggcaacaactttatag

SEQ ID NO: 8398386 - DNA, 20 bp, Homo sapiens
ggttacattgtctacatgtg

SEQ ID NO: 8398387 - DNA, 22 bp, Homo sapiens
gtgaaaaatcatcatgacttga

SEQ ID NO: 8398388 - DNA, 22 bp, Homo sapiens
gtacaaggcatttatctgttca

SEQ ID NO: 8398389 - DNA, 22 bp, Homo sapiens
gtacaaatgagagttctgtttt

SEQ ID NO: 8398390 - DNA, 22 bp, Homo sapiens
ttctctacttgagattttaatg

SEQ ID NO: 8398391 - DNA, 22 bp, Homo sapiens
ttcctgccctgcctgtgccact

SEQ ID NO: 8398392 - DNA, 20 bp, Homo sapiens
ttgaaattggatggtagcta

SEQ ID NO: 8398393 - DNA, 19 bp, Homo sapiens
ttgaaattgtttgatatgg

SEQ ID NO: 8398394 - DNA, 22 bp, Homo sapiens
ttgaaattttaggccttgcaat

SEQ ID NO: 8398395 - DNA, 22 bp, Homo sapiens
ttgaaatccaattatcatatgt

SEQ ID NO: 8398396 - DNA, 22 bp, Homo sapiens
ttgaaatcaccactagcatttg

SEQ ID NO: 8398397 - DNA, 22 bp, Homo sapiens
ttctgtgaatcttttttcccac

SEQ ID NO: 8398398 - DNA, 22 bp, Homo sapiens
ttcacagatgcctgatgtgtgg

SEQ ID NO: 8398399 - DNA, 22 bp, Homo sapiens
ttcaaactgtgtaatttataaa

SEQ ID NO: 8398400 - DNA, 22 bp, Homo sapiens
ttcaaagataatgtagcatttt

SEQ ID NO: 8398401 - DNA, 22 bp, Homo sapiens
ttcacaatctggcttagcattg

SEQ ID NO: 8398402 - DNA, 22 bp, Homo sapiens
ttcagttggccatacccctaga

SEQ ID NO: 8398403 - DNA, 22 bp, Homo sapiens
ttcagtttgtttgactgttaga

SEQ ID NO: 8398404 - DNA, 22 bp, Homo sapiens
ttcagttttattgtactgctat

SEQ ID NO: 8398405 - DNA, 22 bp, Homo sapiens
ttcaaactatgacttcagctac

SEQ ID NO: 8398406 - DNA, 22 bp, Homo sapiens
ttcaaactagttaaaagtcaga

SEQ ID NO: 8398407 - DNA, 22 bp, Homo sapiens
ttatacatgtttataaggttga

SEQ ID NO: 8398408 - DNA, 22 bp, Homo sapiens
ttatacatgtgttttgagatga

SEQ ID NO: 8398409 - DNA, 23 bp, Homo sapiens
ttgtacagcccagattcctcttc

SEQ ID NO: 8398410 - DNA, 22 bp, Homo sapiens
ttgtacagggaagtaatacaag

SEQ ID NO: 8398411 - DNA, 22 bp, Homo sapiens
ttgtacagaaactgcatttgga

SEQ ID NO: 8398412 - DNA, 22 bp, Homo sapiens
ttgtaagggttacaagaaaaca

SEQ ID NO: 8398413 - DNA, 22 bp, Homo sapiens
ttgtaagatggataggaacagc

SEQ ID NO: 8398414 - DNA, 22 bp, Homo sapiens
ttgtaacaaagacactccaaaa

SEQ ID NO: 8398415 - DNA, 22 bp, Homo sapiens
ttgtaacactcccactcttctt

SEQ ID NO: 8398416 - DNA, 22 bp, Homo sapiens
ttgtaagactgtagaatgcaaa

SEQ ID NO: 8398417 - DNA, 22 bp, Homo sapiens
ttgtaactctgaatacatccta

SEQ ID NO: 8398418 - DNA, 22 bp, Homo sapiens
ttgtaacagctgtttatatagt

SEQ ID NO: 8398419 - DNA, 22 bp, Homo sapiens
ttgtaaacatctgttgcttaga

SEQ ID NO: 8398420 - DNA, 22 bp, Homo sapiens
ttgtaaagctttgagactacat

SEQ ID NO: 8398421 - DNA, 22 bp, Homo sapiens
ttgtaaaggctgttattgactt

SEQ ID NO: 8398422 - DNA, 22 bp, Homo sapiens
ttggaaatgcatttgttattat

SEQ ID NO: 8398423 - DNA, 22 bp, Homo sapiens
ttgctgaaaagctggcctttgt

SEQ ID NO: 8398424 - DNA, 22 bp, Homo sapiens
ttgctgaagaaaaaatatgtta

SEQ ID NO: 8398425 - DNA, 22 bp, Homo sapiens
ttgctgaattgaatcctttggt

SEQ ID NO: 8398426 - DNA, 22 bp, Homo sapiens
ttgcattctgttaaaatgtatt

SEQ ID NO: 8398427 - DNA, 22 bp, Homo sapiens
ttgcaggacaatgatggtccct

SEQ ID NO: 8398428 - DNA, 22 bp, Homo sapiens
ttgacaaagtttagtaataatc

SEQ ID NO: 8398429 - DNA, 22 bp, Homo sapiens
tttcagaaatggcactgaaatc

SEQ ID NO: 8398430 - DNA, 22 bp, Homo sapiens
tttcagaaagctgaacatatga

SEQ ID NO: 8398431 - DNA, 22 bp, Homo sapiens
tttcacattttatacttaagcc

SEQ ID NO: 8398432 - DNA, 22 bp, Homo sapiens
tttcatggctaggactagagtg

SEQ ID NO: 8398433 - DNA, 22 bp, Homo sapiens
tttcaagaacaacattcattca

SEQ ID NO: 8398434 - DNA, 22 bp, Homo sapiens
tttcaagaacagcagcattcca

SEQ ID NO: 8398435 - DNA, 22 bp, Homo sapiens
tttcacaatgcaatcctacttc

SEQ ID NO: 8398436 - DNA, 20 bp, Homo sapiens
tttcacaatgaacatgtctc

SEQ ID NO: 8398437 - DNA, 22 bp, Homo sapiens
tttcaaaggttttgtcatgtct

SEQ ID NO: 8398438 - DNA, 22 bp, Homo sapiens
tttcaaagtaaggattttcatc

SEQ ID NO: 8398439 - DNA, 22 bp, Homo sapiens
tttaaactaacagtacacgttg

SEQ ID NO: 8398440 - DNA, 22 bp, Homo sapiens
tttaaacatcttgttgccttaa

SEQ ID NO: 8398441 - DNA, 22 bp, Homo sapiens
tttaaatgtgttcttagtagct

SEQ ID NO: 8398442 - DNA, 22 bp, Homo sapiens
tttaatgtagcgtgaaatgatt

SEQ ID NO: 8398443 - DNA, 22 bp, Homo sapiens
tttaatgtattctttggaacca

SEQ ID NO: 8398444 - DNA, 19 bp, Homo sapiens
tttaagcaatagtatcttg

SEQ ID NO: 8398445 - DNA, 22 bp, Homo sapiens
tttagcatatcctataaaacta

SEQ ID NO: 8398446 - DNA, 22 bp, Homo sapiens
tttagcagcaaataagtagtgc

SEQ ID NO: 8398447 - DNA, 22 bp, Homo sapiens
tttagcagatctatgtatgtga

SEQ ID NO: 8398448 - DNA, 22 bp, Homo sapiens
tttagagagtgtaaaaatatat

SEQ ID NO: 8398449 - DNA, 22 bp, Homo sapiens
tttagaggtctgtttcacatca

SEQ ID NO: 8398450 - DNA, 20 bp, Homo sapiens
tttacattttgaaacagtga

SEQ ID NO: 8398451 - DNA, 22 bp, Homo sapiens
tttagaagttcacacatttaaa

SEQ ID NO: 8398452 - DNA, 22 bp, Homo sapiens
tttgaatatgtgcttgttaaat

SEQ ID NO: 8398453 - DNA, 22 bp, Homo sapiens
tttgaaagcaccatttgagtag

SEQ ID NO: 8398454 - DNA, 22 bp, Homo sapiens
tttgaaaggaagttaatacttt

SEQ ID NO: 8398455 - DNA, 21 bp, Homo sapiens
tttgaaagctacatctatagc

SEQ ID NO: 8398456 - DNA, 17 bp, Homo sapiens
tttgaaaggatgtcagt

SEQ ID NO: 8398457 - DNA, 22 bp, Homo sapiens
tttgaaagggttatgagactga

SEQ ID NO: 8398458 - DNA, 22 bp, Homo sapiens
tttgaaagggaaataaactcct

SEQ ID NO: 8398459 - DNA, 19 bp, Homo sapiens
tttgaaaggattgttattt

SEQ ID NO: 8398460 - DNA, 22 bp, Homo sapiens
tttgacaaaattatgctaatat

SEQ ID NO: 8398461 - DNA, 22 bp, Homo sapiens
tttgacaattcatgacatttat

SEQ ID NO: 8398462 - DNA, 22 bp, Homo sapiens
tttgacagacatttactacatt

SEQ ID NO: 8398463 - DNA, 22 bp, Homo sapiens
tttggaaatttcatcaatagcc

SEQ ID NO: 8398464 - DNA, 22 bp, Homo sapiens
tttgtaaaagcccaagctgtag

SEQ ID NO: 8398465 - DNA, 22 bp, Homo sapiens
tttggaaacacggtcatcttcc

SEQ ID NO: 8398466 - DNA, 22 bp, Homo sapiens
tttggaaaaagcctgaacatag

SEQ ID NO: 8398467 - DNA, 22 bp, Homo sapiens
tttggaaaaagacagcttatga

SEQ ID NO: 8398468 - DNA, 22 bp, Homo sapiens
tttggaaagttgtcactttaga

SEQ ID NO: 8398469 - DNA, 22 bp, Homo sapiens
tttggaaagacacacagtttta

SEQ ID NO: 8398470 - DNA, 22 bp, Homo sapiens
tttggaaagtgtacaaatttga

SEQ ID NO: 8398471 - DNA, 22 bp, Homo sapiens
tttgatatcctatacaagtaaa

SEQ ID NO: 8398472 - DNA, 22 bp, Homo sapiens
tttgataatacacaagagaaag

SEQ ID NO: 8398473 - DNA, 22 bp, Homo sapiens
tttgatatcttggtatacagat

SEQ ID NO: 8398474 - DNA, 22 bp, Homo sapiens
tttgataacagtgaatatcatg

SEQ ID NO: 8398475 - DNA, 22 bp, Homo sapiens
ttttccaaagtaccatgtccct

SEQ ID NO: 8398476 - DNA, 22 bp, Homo sapiens
ttttaagaaatgtatgactgtc

SEQ ID NO: 8398477 - DNA, 22 bp, Homo sapiens
ttttaatgtgctctgcaatgat

SEQ ID NO: 8398478 - DNA, 22 bp, Homo sapiens
ttttaaactgcagaatttagaa

SEQ ID NO: 8398479 - DNA, 22 bp, Homo sapiens
ttttaacactcagcactatctc

SEQ ID NO: 8398480 - DNA, 22 bp, Homo sapiens
tttgtgttggaagaaatgctac

SEQ ID NO: 8398481 - DNA, 22 bp, Homo sapiens
tttgttaaaatgcagattctgt

SEQ ID NO: 8398482 - DNA, 22 bp, Homo sapiens
tttgtgttttcccatactattg

SEQ ID NO: 8398483 - DNA, 22 bp, Homo sapiens
tttgttaattcttatgttagag

SEQ ID NO: 8398484 - DNA, 22 bp, Homo sapiens
tttgtaagagcatatgtaaagg

SEQ ID NO: 8398485 - DNA, 22 bp, Homo sapiens
tttgtaagcaagttaacatttt

SEQ ID NO: 8398486 - DNA, 22 bp, Homo sapiens
tttgtaacatcccaacaaattt

SEQ ID NO: 8398487 - DNA, 22 bp, Homo sapiens
tttgtaactctccctttgtata

SEQ ID NO: 8398488 - DNA, 22 bp, Homo sapiens
tttgtaactttagaattgatcc

SEQ ID NO: 8398489 - DNA, 22 bp, Homo sapiens
tttgtaagcagtgtttttacag

SEQ ID NO: 8398490 - DNA, 19 bp, Homo sapiens
tttgtaagtccttactgat

SEQ ID NO: 8398491 - DNA, 22 bp, Homo sapiens
tttgtaaggctaaataatattc

SEQ ID NO: 8398492 - DNA, 22 bp, Homo sapiens
tttgtaacaagttgatctggta

SEQ ID NO: 8398493 - DNA, 22 bp, Homo sapiens
tttgtaaatagcagtactcatg

SEQ ID NO: 8398494 - DNA, 22 bp, Homo sapiens
tttgtaaaggcctgaatttcag

SEQ ID NO: 8398495 - DNA, 22 bp, Homo sapiens
tttgtaaaaggaggaagcatgg

SEQ ID NO: 8398496 - DNA, 22 bp, Homo sapiens
tttgtaaaattagggaattcaa

SEQ ID NO: 8398497 - DNA, 22 bp, Homo sapiens
tttttataccacctctcactta

SEQ ID NO: 8398498 - DNA, 22 bp, Homo sapiens
tttttataactcttttgtgaca

SEQ ID NO: 8398499 - DNA, 22 bp, Homo sapiens
tttttatgcctacgctgaaaag

SEQ ID NO: 8398500 - DNA, 22 bp, Homo sapiens
aagttcagcctggttttaatgc

SEQ ID NO: 8398501 - DNA, 22 bp, Homo sapiens
actgaaaaagtatgattcactg

SEQ ID NO: 8398502 - DNA, 22 bp, Homo sapiens
actgaaaaagacatcttggtaa

SEQ ID NO: 8398503 - DNA, 22 bp, Homo sapiens
actgaaaatgaattagaaacag

SEQ ID NO: 8398504 - DNA, 22 bp, Homo sapiens
aagtgtttacttaaagtcatgg

SEQ ID NO: 8398505 - DNA, 22 bp, Homo sapiens
aagtgtttatggttattgttaa

SEQ ID NO: 8398506 - DNA, 22 bp, Homo sapiens
aagtgtttaaattatttgcagg

SEQ ID NO: 8398507 - DNA, 22 bp, Homo sapiens
aagtgtttaatggttttgatga

SEQ ID NO: 8398508 - DNA, 22 bp, Homo sapiens
aagtttttggtagagaaaagta

SEQ ID NO: 8398509 - DNA, 20 bp, Homo sapiens
aataaaagaagccttcaccc

SEQ ID NO: 8398510 - DNA, 19 bp, Homo sapiens
aataagcttgggtaaaact

SEQ ID NO: 8398511 - DNA, 22 bp, Homo sapiens
acttttaaggggccttgattta

SEQ ID NO: 8398512 - DNA, 22 bp, Homo sapiens
acttttatcaaggaagtgatct

SEQ ID NO: 8398513 - DNA, 22 bp, Homo sapiens
actttgttgaagaatatgttag

SEQ ID NO: 8398514 - DNA, 22 bp, Homo sapiens
actttgttgttccttgtctaaa

SEQ ID NO: 8398515 - DNA, 22 bp, Homo sapiens
actttgtttccatatttgtagc

SEQ ID NO: 8398516 - DNA, 22 bp, Homo sapiens
actttgaaggggaacattttaa

SEQ ID NO: 8398517 - DNA, 22 bp, Homo sapiens
aatgaagaaatggacatcttta

SEQ ID NO: 8398518 - DNA, 22 bp, Homo sapiens
aagtataagctattcttcatga

SEQ ID NO: 8398519 - DNA, 22 bp, Homo sapiens
aaggtacaaagtattatttaaa

SEQ ID NO: 8398520 - DNA, 22 bp, Homo sapiens
acatttcagatgtaatgtgatg

SEQ ID NO: 8398521 - DNA, 22 bp, Homo sapiens
acatttcagattcatgaagtga

SEQ ID NO: 8398522 - DNA, 22 bp, Homo sapiens
acatttcagcgtgcatgacatg

SEQ ID NO: 8398523 - DNA, 23 bp, Homo sapiens
acatttcatataaaagggatcag

SEQ ID NO: 8398524 - DNA, 22 bp, Homo sapiens
acatttcagtaagtgttaattt

SEQ ID NO: 8398525 - DNA, 22 bp, Homo sapiens
acatttcagtgagctattgaag

SEQ ID NO: 8398526 - DNA, 22 bp, Homo sapiens
acatgaacattatatcagcaag

SEQ ID NO: 8398527 - DNA, 22 bp, Homo sapiens
acatgacaaaatgcacaggatt

SEQ ID NO: 8398528 - DNA, 22 bp, Homo sapiens
aatttcacagtgaactttgagg

SEQ ID NO: 8398529 - DNA, 22 bp, Homo sapiens
aatttcacagctggtctatggg

SEQ ID NO: 8398530 - DNA, 22 bp, Homo sapiens
aattaactaaaattcactttat

SEQ ID NO: 8398531 - DNA, 22 bp, Homo sapiens
acaatttttcaaagaagcttat

SEQ ID NO: 8398532 - DNA, 22 bp, Homo sapiens
agattttgtctcaatacttctg

SEQ ID NO: 8398533 - DNA, 18 bp, Homo sapiens
agattttgagaaatacaa

SEQ ID NO: 8398534 - DNA, 22 bp, Homo sapiens
acaacattcttaaatacactga

SEQ ID NO: 8398535 - DNA, 22 bp, Homo sapiens
acaatactattttcagtatcct

SEQ ID NO: 8398536 - DNA, 22 bp, Homo sapiens
agagtgaagtttttgaaagtga

SEQ ID NO: 8398537 - DNA, 20 bp, Homo sapiens
aatttctcctgggtaacaga

SEQ ID NO: 8398538 - DNA, 20 bp, Homo sapiens
acaaagtattgaggacaagt

SEQ ID NO: 8398539 - DNA, 22 bp, Homo sapiens
acaaagtatttttaggtttgta

SEQ ID NO: 8398540 - DNA, 22 bp, Homo sapiens
acaaagtgaaaagcatcgaatt

SEQ ID NO: 8398541 - DNA, 22 bp, Homo sapiens
acaaagtttgtggtattccaag

SEQ ID NO: 8398542 - DNA, 22 bp, Homo sapiens
acaaagttattctttcagagga

SEQ ID NO: 8398543 - DNA, 22 bp, Homo sapiens
acaaagtttcttctaacatctg

SEQ ID NO: 8398544 - DNA, 22 bp, Homo sapiens
acaaagttaacagttggatagt

SEQ ID NO: 8398545 - DNA, 22 bp, Homo sapiens
acagaatattgtaagtgccact

SEQ ID NO: 8398546 - DNA, 22 bp, Homo sapiens
acagataataggatgtaccctg

SEQ ID NO: 8398547 - DNA, 22 bp, Homo sapiens
acagatatatgattgtgtaaat

SEQ ID NO: 8398548 - DNA, 22 bp, Homo sapiens
acacaagtgaatattttaagga

SEQ ID NO: 8398549 - DNA, 22 bp, Homo sapiens
acacatcatgccaagtttcacc

SEQ ID NO: 8398550 - DNA, 22 bp, Homo sapiens
acacatcagcctcagctttggg

SEQ ID NO: 8398551 - DNA, 23 bp, Homo sapiens
aaatgacatatggtttctgaagg

SEQ ID NO: 8398552 - DNA, 22 bp, Homo sapiens
aaatgaacatcaagaatagcct

SEQ ID NO: 8398553 - DNA, 22 bp, Homo sapiens
aaatattggtaggatgcttgtt

SEQ ID NO: 8398554 - DNA, 22 bp, Homo sapiens
aaatcacagggtctctaagtat

SEQ ID NO: 8398555 - DNA, 22 bp, Homo sapiens
aaatgcaaggattttgttaggc

SEQ ID NO: 8398556 - DNA, 22 bp, Homo sapiens
aaatgcaagttcatattttgtt

SEQ ID NO: 8398557 - DNA, 22 bp, Homo sapiens
aaatgctgcagctagtgtgttt

SEQ ID NO: 8398558 - DNA, 22 bp, Homo sapiens
aaatatgagatgttctctttcg

SEQ ID NO: 8398559 - DNA, 19 bp, Homo sapiens
aaatatcagagagatgata

SEQ ID NO: 8398560 - DNA, 22 bp, Homo sapiens
aaatataatttctgcctcaata

SEQ ID NO: 8398561 - DNA, 22 bp, Homo sapiens
aaatatagcaattatgcctact

SEQ ID NO: 8398562 - DNA, 22 bp, Homo sapiens
aaatatacggtccctaacagtc

SEQ ID NO: 8398563 - DNA, 22 bp, Homo sapiens
aaatacataaaggttgtaccag

SEQ ID NO: 8398564 - DNA, 22 bp, Homo sapiens
aaagttgtgaaaccgaacatgt

SEQ ID NO: 8398565 - DNA, 22 bp, Homo sapiens
aaattgtccttttaagaaacag

SEQ ID NO: 8398566 - DNA, 22 bp, Homo sapiens
aaattgtcagaattcagaaagt

SEQ ID NO: 8398567 - DNA, 22 bp, Homo sapiens
aacatgaaacccaaacagaata

SEQ ID NO: 8398568 - DNA, 22 bp, Homo sapiens
aacatgaagttttctatagtga

SEQ ID NO: 8398569 - DNA, 22 bp, Homo sapiens
aaagcattgtttcaagattaac

SEQ ID NO: 8398570 - DNA, 22 bp, Homo sapiens
aaagcatgctactttatatagg

SEQ ID NO: 8398571 - DNA, 22 bp, Homo sapiens
aacttctggatgtttcaaatgt

SEQ ID NO: 8398572 - DNA, 22 bp, Homo sapiens
aaagttacacatctagtaagtg

SEQ ID NO: 8398573 - DNA, 22 bp, Homo sapiens
aaagttctcctggattgtgctg

SEQ ID NO: 8398574 - DNA, 22 bp, Homo sapiens
aaagttacacgactatttatgt

SEQ ID NO: 8398575 - DNA, 22 bp, Homo sapiens
aaagtcctagcgatccacagaa

SEQ ID NO: 8398576 - DNA, 22 bp, Homo sapiens
aacatgatgtgaagcatgaact

SEQ ID NO: 8398577 - DNA, 22 bp, Homo sapiens
aaaaatttatggttcttctctg

SEQ ID NO: 8398578 - DNA, 22 bp, Homo sapiens
aaaaatgaaacggctggttggc

SEQ ID NO: 8398579 - DNA, 22 bp, Homo sapiens
aaaacattctgtgaactctcaa

SEQ ID NO: 8398580 - DNA, 22 bp, Homo sapiens
aaaacattgaattgcacactat

SEQ ID NO: 8398581 - DNA, 22 bp, Homo sapiens
aaaaccaggcgtttcctattat

SEQ ID NO: 8398582 - DNA, 22 bp, Homo sapiens
aaaagcaattgcagttcttgcc

SEQ ID NO: 8398583 - DNA, 22 bp, Homo sapiens
aaaacagtttttgctaactgct

SEQ ID NO: 8398584 - DNA, 22 bp, Homo sapiens
aaaacagtttaggcatcacagt

SEQ ID NO: 8398585 - DNA, 22 bp, Homo sapiens
aaaacagttataaacagagtca

SEQ ID NO: 8398586 - DNA, 22 bp, Homo sapiens
aaaatactgtggagtgttgaaa

SEQ ID NO: 8398587 - DNA, 22 bp, Homo sapiens
aaaatctggcaacactaagttt

SEQ ID NO: 8398588 - DNA, 22 bp, Homo sapiens
aaaagtttgtgcaaacactcag

SEQ ID NO: 8398589 - DNA, 22 bp, Homo sapiens
aaaagctttgccagatgagttg

SEQ ID NO: 8398590 - DNA, 22 bp, Homo sapiens
aaaagctttgttaataggtttg

SEQ ID NO: 8398591 - DNA, 21 bp, Homo sapiens
aaaatgtagacttttccctga

SEQ ID NO: 8398592 - DNA, 22 bp, Homo sapiens
aaagttttctgccttcattaga

SEQ ID NO: 8398593 - DNA, 22 bp, Homo sapiens
aaagttttattcaagcattagt

SEQ ID NO: 8398594 - DNA, 22 bp, Homo sapiens
aaaatttccaccatctttgtgt

SEQ ID NO: 8398595 - DNA, 22 bp, Homo sapiens
aaataaactgaagcacagagag

SEQ ID NO: 8398596 - DNA, 22 bp, Homo sapiens
aaatacagagttgcttaaaagc

SEQ ID NO: 8398597 - DNA, 22 bp, Homo sapiens
aaatgacaataaaagtccatgc

SEQ ID NO: 8398598 - DNA, 22 bp, Homo sapiens
aaatgacactaggctttttgca

SEQ ID NO: 8398599 - DNA, 22 bp, Homo sapiens
aaacttcaaggatttgcaaatc

SEQ ID NO: 8398600 - DNA, 22 bp, Homo sapiens
aaacttcatggataatataaag

SEQ ID NO: 8398601 - DNA, 22 bp, Homo sapiens
aacagttacccttaagatcttt

SEQ ID NO: 8398602 - DNA, 22 bp, Homo sapiens
aacagttatctcacatatggaa

SEQ ID NO: 8398603 - DNA, 22 bp, Homo sapiens
aagtaagtcttacattcacatt

SEQ ID NO: 8398604 - DNA, 22 bp, Homo sapiens
aatatttcaaaaggaaacacag

SEQ ID NO: 8398605 - DNA, 22 bp, Homo sapiens
aatatttcgttgcgtggctaga

SEQ ID NO: 8398606 - DNA, 22 bp, Homo sapiens
aatatttctgtagctatgttct

SEQ ID NO: 8398607 - DNA, 22 bp, Homo sapiens
aatatctgtctctaatgcatat

SEQ ID NO: 8398608 - DNA, 22 bp, Homo sapiens
aatatctgtggccatacaattt

SEQ ID NO: 8398609 - DNA, 22 bp, Homo sapiens
aatacagtcttactagaaaatc

SEQ ID NO: 8398610 - DNA, 22 bp, Homo sapiens
aacagtttatgagatatgctat

SEQ ID NO: 8398611 - DNA, 22 bp, Homo sapiens
aagttacaggagaaagagatca

SEQ ID NO: 8398612 - DNA, 22 bp, Homo sapiens
aagttacagtcagaggttaaca

SEQ ID NO: 8398613 - DNA, 22 bp, Homo sapiens
aagttacagttattatttaaaa

SEQ ID NO: 8398614 - DNA, 22 bp, Homo sapiens
aagttacataaatgtcctctag

SEQ ID NO: 8398615 - DNA, 22 bp, Homo sapiens
aatctgatgttaaatgtaaggt

SEQ ID NO: 8398616 - DNA, 18 bp, Homo sapiens
aatgaaatgtacaccttt

SEQ ID NO: 8398617 - DNA, 22 bp, Homo sapiens
aatgtaaagttgggcacaaatg

SEQ ID NO: 8398618 - DNA, 22 bp, Homo sapiens
aactttacttgaaagaacatgt

SEQ ID NO: 8398619 - DNA, 22 bp, Homo sapiens
aactttacactgctttacatga

SEQ ID NO: 8398620 - DNA, 22 bp, Homo sapiens
aactttaaaaaatatgtctgtt

SEQ ID NO: 8398621 - DNA, 22 bp, Homo sapiens
acaatgtaggctgaaaaagctt

SEQ ID NO: 8398622 - DNA, 22 bp, Homo sapiens
acaacaaaatcactagtcttcc

SEQ ID NO: 8398623 - DNA, 22 bp, Homo sapiens
acaaatttggtgagagtaaata

SEQ ID NO: 8398624 - DNA, 22 bp, Homo sapiens
acaaatttcataggcaaatttt

SEQ ID NO: 8398625 - DNA, 22 bp, Homo sapiens
acaatgttctctgagttgtgtg

SEQ ID NO: 8398626 - DNA, 22 bp, Homo sapiens
aagatacacggtcaactctcaa

SEQ ID NO: 8398627 - DNA, 22 bp, Homo sapiens
acaaaacagtgttcctgcccct

SEQ ID NO: 8398628 - DNA, 22 bp, Homo sapiens
aagaagatggttaactttcagt

SEQ ID NO: 8398629 - DNA, 23 bp, Homo sapiens
aagaactttggtcctgcagagtc

SEQ ID NO: 8398630 - DNA, 22 bp, Homo sapiens
aatgtacaataagacaaagagg

SEQ ID NO: 8398631 - DNA, 22 bp, Homo sapiens
aatgtacaagggttccagtttt

SEQ ID NO: 8398632 - DNA, 22 bp, Homo sapiens
acaaatatttactgaatccact

SEQ ID NO: 8398633 - DNA, 22 bp, Homo sapiens
acaaatctgttttatagacttt

SEQ ID NO: 8398634 - DNA, 22 bp, Homo sapiens
acaaatgaacctgaaatctcag

SEQ ID NO: 8398635 - DNA, 22 bp, Homo sapiens
aagaatatttcctgcacttggg

SEQ ID NO: 8398636 - DNA, 23 bp, Homo sapiens
acagacattccataatgtacacc

SEQ ID NO: 8398637 - DNA, 22 bp, Homo sapiens
acagaaatgatgtttggcaata

SEQ ID NO: 8398638 - DNA, 22 bp, Homo sapiens
acagagcaactttatttcatgg

SEQ ID NO: 8398639 - DNA, 22 bp, Homo sapiens
acacttcagctccacaaacatt

SEQ ID NO: 8398640 - DNA, 22 bp, Homo sapiens
aagatacacgttgtattgaata

SEQ ID NO: 8398641 - DNA, 22 bp, Homo sapiens
cacatttaaaggttgaagctga

SEQ ID NO: 8398642 - DNA, 22 bp, Homo sapiens
cacatttaaaaaatccacgatc

SEQ ID NO: 8398643 - DNA, 22 bp, Homo sapiens
cacatttaagcagatgtggacc

SEQ ID NO: 8398644 - DNA, 22 bp, Homo sapiens
cacatttaagtgcttgttcaga

SEQ ID NO: 8398645 - DNA, 22 bp, Homo sapiens
cactaaaactacattggaaaca

SEQ ID NO: 8398646 - DNA, 20 bp, Homo sapiens
agcatttgaaatatgactat

SEQ ID NO: 8398647 - DNA, 22 bp, Homo sapiens
agcatttatgactaatgtaaaa

SEQ ID NO: 8398648 - DNA, 22 bp, Homo sapiens
cactttgatttgtgatgtgaga

SEQ ID NO: 8398649 - DNA, 22 bp, Homo sapiens
cacacttttggcatgtttggtt

SEQ ID NO: 8398650 - DNA, 22 bp, Homo sapiens
caatttttgtacttatagtact

SEQ ID NO: 8398651 - DNA, 22 bp, Homo sapiens
caatgtttttccttccttaata

SEQ ID NO: 8398652 - DNA, 22 bp, Homo sapiens
caaggaaaacagatgatcaaca

SEQ ID NO: 8398653 - DNA, 22 bp, Homo sapiens
cagatattaggagctcaataat

SEQ ID NO: 8398654 - DNA, 22 bp, Homo sapiens
cagcatcaccgccatttctgat

SEQ ID NO: 8398655 - DNA, 22 bp, Homo sapiens
atgctgaagagagaactactca

SEQ ID NO: 8398656 - DNA, 22 bp, Homo sapiens
atgctgaagagttcatgattat

SEQ ID NO: 8398657 - DNA, 22 bp, Homo sapiens
atgctgaatagttcactcttct

SEQ ID NO: 8398658 - DNA, 22 bp, Homo sapiens
atgcaacaaatgctacgaatcg

SEQ ID NO: 8398659 - DNA, 22 bp, Homo sapiens
atgcaacagagaaaatattgag

SEQ ID NO: 8398660 - DNA, 22 bp, Homo sapiens
agacataagcgagcatcacagg

SEQ ID NO: 8398661 - DNA, 22 bp, Homo sapiens
atgcaaatgtcaccacttctaa

SEQ ID NO: 8398662 - DNA, 22 bp, Homo sapiens
atgatttctatataaacttaaa

SEQ ID NO: 8398663 - DNA, 22 bp, Homo sapiens
atgattttctgataaagaactg

SEQ ID NO: 8398664 - DNA, 22 bp, Homo sapiens
atcttacctcttcctctgcatt

SEQ ID NO: 8398665 - DNA, 21 bp, Homo sapiens
atcttaaaaggtcttaacttt

SEQ ID NO: 8398666 - DNA, 23 bp, Homo sapiens
atctgttgtgcctcttatatgta

SEQ ID NO: 8398667 - DNA, 22 bp, Homo sapiens
atctgttgtttgtttgctaaag

SEQ ID NO: 8398668 - DNA, 22 bp, Homo sapiens
atctgttgttttctcatatgtt

SEQ ID NO: 8398669 - DNA, 22 bp, Homo sapiens
atgtgcataaacatattgttgg

SEQ ID NO: 8398670 - DNA, 18 bp, Homo sapiens
atgtgcaattttgtattt

SEQ ID NO: 8398671 - DNA, 22 bp, Homo sapiens
atgtgcaattattaagaagaga

SEQ ID NO: 8398672 - DNA, 23 bp, Homo sapiens
atgtgcaaagtgctacagtatag

SEQ ID NO: 8398673 - DNA, 22 bp, Homo sapiens
atgtgcaaattattttgccaga

SEQ ID NO: 8398674 - DNA, 22 bp, Homo sapiens
atgtgcaacttcagcagaaagg

SEQ ID NO: 8398675 - DNA, 22 bp, Homo sapiens
atgtatactaacacatgcagtt

SEQ ID NO: 8398676 - DNA, 22 bp, Homo sapiens
atgtatacgtgcaggtcacagg

SEQ ID NO: 8398677 - DNA, 21 bp, Homo sapiens
attttgtacatagaatttgtc

SEQ ID NO: 8398678 - DNA, 22 bp, Homo sapiens
agatgatgataattgaaaggca

SEQ ID NO: 8398679 - DNA, 22 bp, Homo sapiens
agatgtttcagtaatttatctt

SEQ ID NO: 8398680 - DNA, 21 bp, Homo sapiens
agatgtttcccccttggcttc

SEQ ID NO: 8398681 - DNA, 22 bp, Homo sapiens
agatgtttgtaaacacactgct

SEQ ID NO: 8398682 - DNA, 22 bp, Homo sapiens
agattcctaaagtaagatatca

SEQ ID NO: 8398683 - DNA, 22 bp, Homo sapiens
atttacaggtagaattttaagt

SEQ ID NO: 8398684 - DNA, 23 bp, Homo sapiens
atttgaaactttcttgtttccag

SEQ ID NO: 8398685 - DNA, 22 bp, Homo sapiens
atttgaaaacctgagcctcccg

SEQ ID NO: 8398686 - DNA, 19 bp, Homo sapiens
atttgaaagctgtgcttgc

SEQ ID NO: 8398687 - DNA, 22 bp, Homo sapiens
atttgaaatcccttctactgta

SEQ ID NO: 8398688 - DNA, 22 bp, Homo sapiens
attttgtgaaccctcaagcaat

SEQ ID NO: 8398689 - DNA, 22 bp, Homo sapiens
agcaaggtgacatcatgctgag

SEQ ID NO: 8398690 - DNA, 22 bp, Homo sapiens
agcaaggtctccctgcacctgg

SEQ ID NO: 8398691 - DNA, 22 bp, Homo sapiens
agcaagttgaatgataatactc

SEQ ID NO: 8398692 - DNA, 22 bp, Homo sapiens
caaacattttgagtggtttctg

SEQ ID NO: 8398693 - DNA, 22 bp, Homo sapiens
caaacattttaaataagggata

SEQ ID NO: 8398694 - DNA, 22 bp, Homo sapiens
caaagttttagtaaacatatat

SEQ ID NO: 8398695 - DNA, 22 bp, Homo sapiens
caaagtttaaagtagatttcag

SEQ ID NO: 8398696 - DNA, 22 bp, Homo sapiens
attgaaaataaggccagaaaca

SEQ ID NO: 8398697 - DNA, 22 bp, Homo sapiens
attgaaaaattcacaattctgg

SEQ ID NO: 8398698 - DNA, 22 bp, Homo sapiens
attgaaaatgacatttgtgccc

SEQ ID NO: 8398699 - DNA, 22 bp, Homo sapiens
attgtatacaagcttaattgtt

SEQ ID NO: 8398700 - DNA, 22 bp, Homo sapiens
attgtataagtctatttacaat

SEQ ID NO: 8398701 - DNA, 22 bp, Homo sapiens
agatacacagagcatcttcaga

SEQ ID NO: 8398702 - DNA, 22 bp, Homo sapiens
attgttaataactattacattg

SEQ ID NO: 8398703 - DNA, 22 bp, Homo sapiens
attgttaaactgaagcattact

SEQ ID NO: 8398704 - DNA, 22 bp, Homo sapiens
attgttaaagtaataaccatgg

SEQ ID NO: 8398705 - DNA, 22 bp, Homo sapiens
attgaaaaatgactattgctta

SEQ ID NO: 8398706 - DNA, 22 bp, Homo sapiens
aggtgcttggtaaatattttag

SEQ ID NO: 8398707 - DNA, 22 bp, Homo sapiens
aggtgccaacagtatttctgcc

SEQ ID NO: 8398708 - DNA, 23 bp, Homo sapiens
agtaacatgcaaataacagtctg

SEQ ID NO: 8398709 - DNA, 22 bp, Homo sapiens
agtaacagtaacatcttcctag

SEQ ID NO: 8398710 - DNA, 22 bp, Homo sapiens
agttacattctgagctgagtag

SEQ ID NO: 8398711 - DNA, 22 bp, Homo sapiens
agttacatgtgaatagaaagta

SEQ ID NO: 8398712 - DNA, 22 bp, Homo sapiens
agttacatctgttatgtgtgtt

SEQ ID NO: 8398713 - DNA, 22 bp, Homo sapiens
agttacataatctgtgaatttt

SEQ ID NO: 8398714 - DNA, 22 bp, Homo sapiens
agttacatataagaagacagac

SEQ ID NO: 8398715 - DNA, 21 bp, Homo sapiens
agttacatgtatagataaagt

SEQ ID NO: 8398716 - DNA, 22 bp, Homo sapiens
agttacatgactgccggcggtg

SEQ ID NO: 8398717 - DNA, 22 bp, Homo sapiens
agttacagaatgtacagaggtt

SEQ ID NO: 8398718 - DNA, 22 bp, Homo sapiens
agtgaattagcctatttgtaaa

SEQ ID NO: 8398719 - DNA, 22 bp, Homo sapiens
agttcttttctagattctggat

SEQ ID NO: 8398720 - DNA, 22 bp, Homo sapiens
agttctttgtgatggaaattta

SEQ ID NO: 8398721 - DNA, 22 bp, Homo sapiens
ataacagaataagtcattaccg

SEQ ID NO: 8398722 - DNA, 22 bp, Homo sapiens
ataacagacttagagttacaag

SEQ ID NO: 8398723 - DNA, 20 bp, Homo sapiens
agaaacatttcttgagaact

SEQ ID NO: 8398724 - DNA, 22 bp, Homo sapiens
atattaaatggattttgggagc

SEQ ID NO: 8398725 - DNA, 22 bp, Homo sapiens
agaaatcaatgaagtctgctaa

SEQ ID NO: 8398726 - DNA, 22 bp, Homo sapiens
agaaatcaatatctatatgttg

SEQ ID NO: 8398727 - DNA, 20 bp, Homo sapiens
agaaatattgagttcagagg

SEQ ID NO: 8398728 - DNA, 20 bp, Homo sapiens
agaaatcagaccacacacta

SEQ ID NO: 8398729 - DNA, 22 bp, Homo sapiens
agaaatcagaaccctgaagttc

SEQ ID NO: 8398730 - DNA, 22 bp, Homo sapiens
agaaatcacaggaggcagaagg

SEQ ID NO: 8398731 - DNA, 22 bp, Homo sapiens
agaaatcacttaatgaacgtag

SEQ ID NO: 8398732 - DNA, 22 bp, Homo sapiens
agaaatcacttagaggaagtga

SEQ ID NO: 8398733 - DNA, 22 bp, Homo sapiens
agaaagtttgtttttatccata

SEQ ID NO: 8398734 - DNA, 20 bp, Homo sapiens
agaaatcagcatgtcctctg

SEQ ID NO: 8398735 - DNA, 22 bp, Homo sapiens
atctgcttttgagaatttactt

SEQ ID NO: 8398736 - DNA, 22 bp, Homo sapiens
atctgcttgttgcatgtctgtt

SEQ ID NO: 8398737 - DNA, 22 bp, Homo sapiens
atcctgcttgttacttatagag

SEQ ID NO: 8398738 - DNA, 22 bp, Homo sapiens
acatgtaaaagataaattaaca

SEQ ID NO: 8398739 - DNA, 22 bp, Homo sapiens
acatgtaggagagtcacaatgc

SEQ ID NO: 8398740 - DNA, 22 bp, Homo sapiens
acagtgaaaataatatcttcaa

SEQ ID NO: 8398741 - DNA, 22 bp, Homo sapiens
acatctttatactagtccttga

SEQ ID NO: 8398742 - DNA, 22 bp, Homo sapiens
aggaaataagggcacttcagat

SEQ ID NO: 8398743 - DNA, 21 bp, Homo sapiens
agcttacattaccattgttgc

SEQ ID NO: 8398744 - DNA, 22 bp, Homo sapiens
cagtatttatggcttgagtatt

SEQ ID NO: 8398745 - DNA, 22 bp, Homo sapiens
cagtatttaggattaggagaga

SEQ ID NO: 8398746 - DNA, 22 bp, Homo sapiens
cagtatttggaatatagctaag

SEQ ID NO: 8398747 - DNA, 22 bp, Homo sapiens
cagtatttcctcttcttaactt

SEQ ID NO: 8398748 - DNA, 22 bp, Homo sapiens
aggacagagccctagtttcata

SEQ ID NO: 8398749 - DNA, 22 bp, Homo sapiens
aggaatatggatttgctcagct

SEQ ID NO: 8398750 - DNA, 22 bp, Homo sapiens
catttctgattacagaatacta

SEQ ID NO: 8398751 - DNA, 22 bp, Homo sapiens
catttcaatgccttcaacatag

SEQ ID NO: 8398752 - DNA, 22 bp, Homo sapiens
catttcaattatttgctcttct

SEQ ID NO: 8398753 - DNA, 22 bp, Homo sapiens
catttcaagcattgacttctat

SEQ ID NO: 8398754 - DNA, 22 bp, Homo sapiens
catttcaaaagaattgccagaa

SEQ ID NO: 8398755 - DNA, 22 bp, Homo sapiens
cattgtaagaggctttgcagca

SEQ ID NO: 8398756 - DNA, 23 bp, Homo sapiens
catttctgggagatttataaaat

SEQ ID NO: 8398757 - DNA, 22 bp, Homo sapiens
ccaatcttatctttattttcta

SEQ ID NO: 8398758 - DNA, 22 bp, Homo sapiens
catttgaaacctggaatctacc

SEQ ID NO: 8398759 - DNA, 22 bp, Homo sapiens
cagtatttgttccctatcaatg

SEQ ID NO: 8398760 - DNA, 22 bp, Homo sapiens
cagtgtttaatcattgtgaatt

SEQ ID NO: 8398761 - DNA, 22 bp, Homo sapiens
cataacttggtgttggaaactg

SEQ ID NO: 8398762 - DNA, 22 bp, Homo sapiens
catacagaaaatatattttgat

SEQ ID NO: 8398763 - DNA, 22 bp, Homo sapiens
catacaagcgtgcatgtgcttg

SEQ ID NO: 8398764 - DNA, 22 bp, Homo sapiens
catctcctttggtctacttcca

SEQ ID NO: 8398765 - DNA, 22 bp, Homo sapiens
catcttcacatatttccaatga

SEQ ID NO: 8398766 - DNA, 22 bp, Homo sapiens
catcttcaggggctacatctgt

SEQ ID NO: 8398767 - DNA, 22 bp, Homo sapiens
catcttcaggtgttttccatca

SEQ ID NO: 8398768 - DNA, 22 bp, Homo sapiens
catcttgcctgctattctgttg

SEQ ID NO: 8398769 - DNA, 22 bp, Homo sapiens
catgagactgccttttcaaacc

SEQ ID NO: 8398770 - DNA, 22 bp, Homo sapiens
atacaactgccttagaaggaaa

SEQ ID NO: 8398771 - DNA, 22 bp, Homo sapiens
atacaacagaaaatgattattc

SEQ ID NO: 8398772 - DNA, 22 bp, Homo sapiens
atacaaatttatagatgcattt

SEQ ID NO: 8398773 - DNA, 22 bp, Homo sapiens
ataacttcagggctgtgacaga

SEQ ID NO: 8398774 - DNA, 22 bp, Homo sapiens
ataaatgattcagcaggaaata

SEQ ID NO: 8398775 - DNA, 22 bp, Homo sapiens
ataacattttgacaactggtga

SEQ ID NO: 8398776 - DNA, 19 bp, Homo sapiens
atacagatgtatccatgat

SEQ ID NO: 8398777 - DNA, 22 bp, Homo sapiens
atagacttgaggatataatgaa

SEQ ID NO: 8398778 - DNA, 22 bp, Homo sapiens
atagacttggttagtaaatttg

SEQ ID NO: 8398779 - DNA, 21 bp, Homo sapiens
atctgaaaggttagtgttgag

SEQ ID NO: 8398780 - DNA, 22 bp, Homo sapiens
atctgaaactctgacattgtct

SEQ ID NO: 8398781 - DNA, 22 bp, Homo sapiens
atcagacagggagttctgtgtc

SEQ ID NO: 8398782 - DNA, 22 bp, Homo sapiens
atcaacattccaatgtggtaga

SEQ ID NO: 8398783 - DNA, 21 bp, Homo sapiens
atcaacattgaaagagctgga

SEQ ID NO: 8398784 - DNA, 22 bp, Homo sapiens
atcaacatgtcataaagtgaaa

SEQ ID NO: 8398785 - DNA, 22 bp, Homo sapiens
atcaacatgtgagagcaccagt

SEQ ID NO: 8398786 - DNA, 22 bp, Homo sapiens
atcaacatttgcatccttccac

SEQ ID NO: 8398787 - DNA, 22 bp, Homo sapiens
atcaacatgaatttctctgaag

SEQ ID NO: 8398788 - DNA, 22 bp, Homo sapiens
atcaacatatgcatgggaaagt

SEQ ID NO: 8398789 - DNA, 22 bp, Homo sapiens
atcaacatagccactccttaga

SEQ ID NO: 8398790 - DNA, 22 bp, Homo sapiens
atcaacataaagaagtcctcag

SEQ ID NO: 8398791 - DNA, 22 bp, Homo sapiens
atcaacatactgctcaggcatt

SEQ ID NO: 8398792 - DNA, 22 bp, Homo sapiens
atcaacatgacaggagaagaga

SEQ ID NO: 8398793 - DNA, 22 bp, Homo sapiens
atcaacatggcaatgcccatct

SEQ ID NO: 8398794 - DNA, 22 bp, Homo sapiens
atcaaagtttcccagaagttgt

SEQ ID NO: 8398795 - DNA, 22 bp, Homo sapiens
atcaaataaaggtacctagctt

SEQ ID NO: 8398796 - DNA, 22 bp, Homo sapiens
atattcttgtgattataaagta

SEQ ID NO: 8398797 - DNA, 22 bp, Homo sapiens
atattgaaccctacagactgta

SEQ ID NO: 8398798 - DNA, 22 bp, Homo sapiens
atatttaaacagggtaccaata

SEQ ID NO: 8398799 - DNA, 22 bp, Homo sapiens
atcaaagtagtaggttttggac

SEQ ID NO: 8398800 - DNA, 22 bp, Homo sapiens
atcaaagtaggcatatgttttt

SEQ ID NO: 8398801 - DNA, 22 bp, Homo sapiens
atcaaagtaattaacactgaga

SEQ ID NO: 8398802 - DNA, 22 bp, Homo sapiens
atcaaagtgatttgtaaacagg

SEQ ID NO: 8398803 - DNA, 22 bp, Homo sapiens
atcaaagtatctcaatatggta

SEQ ID NO: 8398804 - DNA, 22 bp, Homo sapiens
atcaaagtgaaaagtgctgatg

SEQ ID NO: 8398805 - DNA, 22 bp, Homo sapiens
atcaaagtccatcagaaggtag

SEQ ID NO: 8398806 - DNA, 22 bp, Homo sapiens
atcaaagtggaagtttactagg

SEQ ID NO: 8398807 - DNA, 22 bp, Homo sapiens
atcaaagttcgtaactgataac

SEQ ID NO: 8398808 - DNA, 22 bp, Homo sapiens
atcaaaatggaagaatttggct

SEQ ID NO: 8398809 - DNA, 22 bp, Homo sapiens
atattcttgaaagatcctggta

SEQ ID NO: 8398810 - DNA, 22 bp, Homo sapiens
ctctcagacacccatttggaaa

SEQ ID NO: 8398811 - DNA, 22 bp, Homo sapiens
ctgaaatgggcaaaagtagatt

SEQ ID NO: 8398812 - DNA, 22 bp, Homo sapiens
ctgaaatgttaaatacttggct

SEQ ID NO: 8398813 - DNA, 22 bp, Homo sapiens
agttagtagacttttccattta

SEQ ID NO: 8398814 - DNA, 22 bp, Homo sapiens
agttagcaaataccacaatctg

SEQ ID NO: 8398815 - DNA, 22 bp, Homo sapiens
agtacagatttagacacgatag

SEQ ID NO: 8398816 - DNA, 22 bp, Homo sapiens
agtatttcagttactttaaaat

SEQ ID NO: 8398817 - DNA, 22 bp, Homo sapiens
agtatttcagttactttaaaat

SEQ ID NO: 8398818 - DNA, 22 bp, Homo sapiens
ctacatttgttcaaataagctg

SEQ ID NO: 8398819 - DNA, 22 bp, Homo sapiens
caatgtttgtgatctactgact

SEQ ID NO: 8398820 - DNA, 22 bp, Homo sapiens
caatgtttgttagagctctaga

SEQ ID NO: 8398821 - DNA, 18 bp, Homo sapiens
caatgttttagatctcta

SEQ ID NO: 8398822 - DNA, 22 bp, Homo sapiens
cacagatttctggtcttcaccc

SEQ ID NO: 8398823 - DNA, 22 bp, Homo sapiens
cacagatacctagtgaaacata

SEQ ID NO: 8398824 - DNA, 22 bp, Homo sapiens
cacagatagaccttatgagatt

SEQ ID NO: 8398825 - DNA, 22 bp, Homo sapiens
cacaggaatcagcattaatggc

SEQ ID NO: 8398826 - DNA, 22 bp, Homo sapiens
cacaggaataagtcaaacttca

SEQ ID NO: 8398827 - DNA, 22 bp, Homo sapiens
caatgtttgagtaggagcataa

SEQ ID NO: 8398828 - DNA, 22 bp, Homo sapiens
caatgtttactggggacccaga

SEQ ID NO: 8398829 - DNA, 22 bp, Homo sapiens
caatgtttcttgtaaccagtga

SEQ ID NO: 8398830 - DNA, 22 bp, Homo sapiens
caatgtcagaattacagttgat

SEQ ID NO: 8398831 - DNA, 22 bp, Homo sapiens
caatgtcatttcactgggctta

SEQ ID NO: 8398832 - DNA, 22 bp, Homo sapiens
caatgtcatgattttccattag

SEQ ID NO: 8398833 - DNA, 22 bp, Homo sapiens
caaggtcagcgtgaagttctgt

SEQ ID NO: 8398834 - DNA, 23 bp, Homo sapiens
cagaaaacccagagctcagtccc

SEQ ID NO: 8398835 - DNA, 22 bp, Homo sapiens
cacatttatttgaggctaattg

SEQ ID NO: 8398836 - DNA, 22 bp, Homo sapiens
cacatttaattggtttagggtg

SEQ ID NO: 8398837 - DNA, 18 bp, Homo sapiens
cacatttacctggctccc

SEQ ID NO: 8398838 - DNA, 22 bp, Homo sapiens
cacatttacatataaaactttc

SEQ ID NO: 8398839 - DNA, 22 bp, Homo sapiens
cacatttatgggctgggaggca

SEQ ID NO: 8398840 - DNA, 22 bp, Homo sapiens
cacatttatctgttctttctag

SEQ ID NO: 8398841 - DNA, 22 bp, Homo sapiens
cacatttatctctctccggtga

SEQ ID NO: 8398842 - DNA, 22 bp, Homo sapiens
cacatttaggttcctatagcca

SEQ ID NO: 8398843 - DNA, 22 bp, Homo sapiens
cacatttacttttatcccttgg

SEQ ID NO: 8398844 - DNA, 22 bp, Homo sapiens
cacatttagaggttagcatggt

SEQ ID NO: 8398845 - DNA, 22 bp, Homo sapiens
cacatttaggaggtggggaagc

SEQ ID NO: 8398846 - DNA, 22 bp, Homo sapiens
cacagttttatcttatactgat

SEQ ID NO: 8398847 - DNA, 22 bp, Homo sapiens
gtcagcatagttcacacacagt

SEQ ID NO: 8398848 - DNA, 22 bp, Homo sapiens
cagctacaaatacttttgtatg

SEQ ID NO: 8398849 - DNA, 22 bp, Homo sapiens
gatatatttggaccagagcatt

SEQ ID NO: 8398850 - DNA, 22 bp, Homo sapiens
atgtttaaggaactggtttgct

SEQ ID NO: 8398851 - DNA, 22 bp, Homo sapiens
atgtgactccaggcagttttgt

SEQ ID NO: 8398852 - DNA, 20 bp, Homo sapiens
atgtgaaagatcagttgtct

SEQ ID NO: 8398853 - DNA, 22 bp, Homo sapiens
atgtgaaactgaagcatccata

SEQ ID NO: 8398854 - DNA, 22 bp, Homo sapiens
gacatttatgaaggagatatgc

SEQ ID NO: 8398855 - DNA, 22 bp, Homo sapiens
gacactatatgacacttcagtt

SEQ ID NO: 8398856 - DNA, 22 bp, Homo sapiens
gacatttattggattttacgag

SEQ ID NO: 8398857 - DNA, 22 bp, Homo sapiens
gacatttattagaaaactatca

SEQ ID NO: 8398858 - DNA, 22 bp, Homo sapiens
gacacaaagtttgtcagaaatt

SEQ ID NO: 8398859 - DNA, 22 bp, Homo sapiens
gaatattttcagtacagatggt

SEQ ID NO: 8398860 - DNA, 22 bp, Homo sapiens
gaataacattttttcctttaca

SEQ ID NO: 8398861 - DNA, 22 bp, Homo sapiens
gaacaaattctcatcaacttgt

SEQ ID NO: 8398862 - DNA, 22 bp, Homo sapiens
ctttcaaagaccttggcatggg

SEQ ID NO: 8398863 - DNA, 22 bp, Homo sapiens
ctttcaaagagtaggaggtttt

SEQ ID NO: 8398864 - DNA, 22 bp, Homo sapiens
cttctttactttctagaaataa

SEQ ID NO: 8398865 - DNA, 22 bp, Homo sapiens
cttctttaatgtatacaaaaga

SEQ ID NO: 8398866 - DNA, 22 bp, Homo sapiens
atgaaaattgacagcggaagta

SEQ ID NO: 8398867 - DNA, 22 bp, Homo sapiens
atgaaaatactgtggttgatag

SEQ ID NO: 8398868 - DNA, 22 bp, Homo sapiens
atgaaaatgtacatgtgtataa

SEQ ID NO: 8398869 - DNA, 22 bp, Homo sapiens
atgaaaattctatgcaggccag

SEQ ID NO: 8398870 - DNA, 22 bp, Homo sapiens
gaaatactgtaaagttattatt

SEQ ID NO: 8398871 - DNA, 23 bp, Homo sapiens
gaaagtcaatatggtagctttga

SEQ ID NO: 8398872 - DNA, 22 bp, Homo sapiens
gaaagtacagattcctggccag

SEQ ID NO: 8398873 - DNA, 22 bp, Homo sapiens
gaaacattgtgttctacagatt

SEQ ID NO: 8398874 - DNA, 22 bp, Homo sapiens
gaaacatgtctgacaatttacc

SEQ ID NO: 8398875 - DNA, 22 bp, Homo sapiens
atttcatgtttcatctacctaa

SEQ ID NO: 8398876 - DNA, 22 bp, Homo sapiens
caaacatagtgaagcaatgaca

SEQ ID NO: 8398877 - DNA, 22 bp, Homo sapiens
attttagagctccaagtacagc

SEQ ID NO: 8398878 - DNA, 22 bp, Homo sapiens
caaatactgtactgaacactgt

SEQ ID NO: 8398879 - DNA, 22 bp, Homo sapiens
caaatactaaacataagatttt

SEQ ID NO: 8398880 - DNA, 22 bp, Homo sapiens
gatattgcacctctaatacatt

SEQ ID NO: 8398881 - DNA, 19 bp, Homo sapiens
gatattgcttgagtaactg

SEQ ID NO: 8398882 - DNA, 22 bp, Homo sapiens
gatattgccagatgtccccgga

SEQ ID NO: 8398883 - DNA, 22 bp, Homo sapiens
gatattgcatattggatgagtt

SEQ ID NO: 8398884 - DNA, 22 bp, Homo sapiens
attcaaattaagttaattcagc

SEQ ID NO: 8398885 - DNA, 22 bp, Homo sapiens
attcacatttacaaagcactca

SEQ ID NO: 8398886 - DNA, 22 bp, Homo sapiens
attctttattgctgatggttat

SEQ ID NO: 8398887 - DNA, 22 bp, Homo sapiens
attcttgcagtatacaactact

SEQ ID NO: 8398888 - DNA, 22 bp, Homo sapiens
attgtgaatagtgctgcaataa

SEQ ID NO: 8398889 - DNA, 22 bp, Homo sapiens
attgtgcaatgttttacaattt

SEQ ID NO: 8398890 - DNA, 22 bp, Homo sapiens
attgtgaataatgctgcaataa

SEQ ID NO: 8398891 - DNA, 20 bp, Homo sapiens
attgtgaatactgcatatgt

SEQ ID NO: 8398892 - DNA, 17 bp, Homo sapiens
gcatcacagataacacg

SEQ ID NO: 8398893 - DNA, 22 bp, Homo sapiens
gcatacaaaggtttacaactga

SEQ ID NO: 8398894 - DNA, 22 bp, Homo sapiens
tctttgaaagctgttctagagt

SEQ ID NO: 8398895 - DNA, 22 bp, Homo sapiens
tctttgaaaagggagatagaaa

SEQ ID NO: 8398896 - DNA, 22 bp, Homo sapiens
tcttcagactgttgttcttttg

SEQ ID NO: 8398897 - DNA, 20 bp, Homo sapiens
tcttcagatgcttttggagt

SEQ ID NO: 8398898 - DNA, 22 bp, Homo sapiens
tcttcctagaaggaagaaatct

SEQ ID NO: 8398899 - DNA, 22 bp, Homo sapiens
tgacatcacgtcctttcagaga

SEQ ID NO: 8398900 - DNA, 22 bp, Homo sapiens
tgacagtttagtgtaatagtta

SEQ ID NO: 8398901 - DNA, 22 bp, Homo sapiens
tgacagttgagcatgtaagaga

SEQ ID NO: 8398902 - DNA, 22 bp, Homo sapiens
tgaatgcaagtcacacatttct

SEQ ID NO: 8398903 - DNA, 22 bp, Homo sapiens
tgacaactctagttaatgaatt

SEQ ID NO: 8398904 - DNA, 22 bp, Homo sapiens
tgatttgtttagtgccaagttt

SEQ ID NO: 8398905 - DNA, 22 bp, Homo sapiens
tgcaaagtcgcaaaattcttct

SEQ ID NO: 8398906 - DNA, 22 bp, Homo sapiens
tgcacacatgtatgtatatgtg

SEQ ID NO: 8398907 - DNA, 22 bp, Homo sapiens
tggcttcattattgtttttcct

SEQ ID NO: 8398908 - DNA, 19 bp, Homo sapiens
tctaatatctacttccctg

SEQ ID NO: 8398909 - DNA, 22 bp, Homo sapiens
cagtttgtcttgattcagaaca

SEQ ID NO: 8398910 - DNA, 22 bp, Homo sapiens
tcagatcacaaaagtttctatt

SEQ ID NO: 8398911 - DNA, 22 bp, Homo sapiens
tcagatcatggatctattactt

SEQ ID NO: 8398912 - DNA, 22 bp, Homo sapiens
tcaatcattcttgccatttatt

SEQ ID NO: 8398913 - DNA, 22 bp, Homo sapiens
catgaaaataacattgttgtga

SEQ ID NO: 8398914 - DNA, 22 bp, Homo sapiens
catgaagatcctgtatgttttt

SEQ ID NO: 8398915 - DNA, 22 bp, Homo sapiens
catgaacagattcttcatttct

SEQ ID NO: 8398916 - DNA, 22 bp, Homo sapiens
catgacacccaggcatagcacc

SEQ ID NO: 8398917 - DNA, 22 bp, Homo sapiens
catgacaatatgttctttcatt

SEQ ID NO: 8398918 - DNA, 22 bp, Homo sapiens
catgacattttaaaaagaacat

SEQ ID NO: 8398919 - DNA, 22 bp, Homo sapiens
catgacagatgcaaaggattgg

SEQ ID NO: 8398920 - DNA, 22 bp, Homo sapiens
taatatttctaccctgctgcct

SEQ ID NO: 8398921 - DNA, 22 bp, Homo sapiens
tacaaaacagtgctctggtcct

SEQ ID NO: 8398922 - DNA, 22 bp, Homo sapiens
tacatgttcaaatttgtctttc

SEQ ID NO: 8398923 - DNA, 22 bp, Homo sapiens
tacatttacagagccttctctg

SEQ ID NO: 8398924 - DNA, 22 bp, Homo sapiens
tacatttataaggcttctctgt

SEQ ID NO: 8398925 - DNA, 22 bp, Homo sapiens
tacattgtgttaaaacagaaga

SEQ ID NO: 8398926 - DNA, 22 bp, Homo sapiens
tagattcctctacaataaatga

SEQ ID NO: 8398927 - DNA, 21 bp, Homo sapiens
cagtattttaagcagtgagtt

SEQ ID NO: 8398928 - DNA, 22 bp, Homo sapiens
cagtattttccttgttaactta

SEQ ID NO: 8398929 - DNA, 22 bp, Homo sapiens
tattttaaagtgaagggtcttg

SEQ ID NO: 8398930 - DNA, 22 bp, Homo sapiens
tattttaaagactgccagccta

SEQ ID NO: 8398931 - DNA, 22 bp, Homo sapiens
tatttgtttctagtggcagcaa

SEQ ID NO: 8398932 - DNA, 19 bp, Homo sapiens
tcaaaacacaaatggttga

SEQ ID NO: 8398933 - DNA, 22 bp, Homo sapiens
tcaaaacactattacctttaat

SEQ ID NO: 8398934 - DNA, 22 bp, Homo sapiens
tcaaaacaatcattggatgtgc

SEQ ID NO: 8398935 - DNA, 22 bp, Homo sapiens
tcaaaacaacactcaggtgtaa

SEQ ID NO: 8398936 - DNA, 22 bp, Homo sapiens
tattatgtaaaggttattgcag

SEQ ID NO: 8398937 - DNA, 22 bp, Homo sapiens
tttaacagatgtgaaattttca

SEQ ID NO: 8398938 - DNA, 22 bp, Homo sapiens
tttaatatttctttcctgaagc

SEQ ID NO: 8398939 - DNA, 22 bp, Homo sapiens
tttaatattctgcattctcctt

SEQ ID NO: 8398940 - DNA, 22 bp, Homo sapiens
tttaatatctcacacttccatg

SEQ ID NO: 8398941 - DNA, 22 bp, Homo sapiens
tttaatatccagtggatacaaa

SEQ ID NO: 8398942 - DNA, 22 bp, Homo sapiens
ttgtgtaagatgcaatatggta

SEQ ID NO: 8398943 - DNA, 22 bp, Homo sapiens
ttgtgtaacttgagcaaacaca

SEQ ID NO: 8398944 - DNA, 22 bp, Homo sapiens
ttgtgaaacattcatggatttg

SEQ ID NO: 8398945 - DNA, 22 bp, Homo sapiens
ttgaaataaggaagctcgaaat

SEQ ID NO: 8398946 - DNA, 22 bp, Homo sapiens
tttcctaaggtagtgataattt

SEQ ID NO: 8398947 - DNA, 22 bp, Homo sapiens
tttcacatagaaagtgatttac

SEQ ID NO: 8398948 - DNA, 22 bp, Homo sapiens
tttcctaaggctcattttaaaa

SEQ ID NO: 8398949 - DNA, 22 bp, Homo sapiens
tttcacataaatggagtaaaga

SEQ ID NO: 8398950 - DNA, 22 bp, Homo sapiens
tttcacaaagcatagcacttta

SEQ ID NO: 8398951 - DNA, 22 bp, Homo sapiens
tttcacaaatgtctttaacttg

SEQ ID NO: 8398952 - DNA, 22 bp, Homo sapiens
tttcaaatggagtcgtgaaatg

SEQ ID NO: 8398953 - DNA, 22 bp, Homo sapiens
tttagacatttgtggtttgcaa

SEQ ID NO: 8398954 - DNA, 22 bp, Homo sapiens
tttagtatcctatctcatttaa

SEQ ID NO: 8398955 - DNA, 22 bp, Homo sapiens
tttgctaaaagtgatgaagaca

SEQ ID NO: 8398956 - DNA, 22 bp, Homo sapiens
tttgctaaataagtgattaagt

SEQ ID NO: 8398957 - DNA, 22 bp, Homo sapiens
ttttaatactgctattgtagga

SEQ ID NO: 8398958 - DNA, 22 bp, Homo sapiens
ttttagatagtttaactgcact

SEQ ID NO: 8398959 - DNA, 20 bp, Homo sapiens
ttttagcacttgttatggtg

SEQ ID NO: 8398960 - DNA, 22 bp, Homo sapiens
tttgtacacaggtcattcaggg

SEQ ID NO: 8398961 - DNA, 22 bp, Homo sapiens
tttgtacatatataaaatctgt

SEQ ID NO: 8398962 - DNA, 22 bp, Homo sapiens
tttgtacatataaatcttgtat

SEQ ID NO: 8398963 - DNA, 22 bp, Homo sapiens
ttaaagttcattaaatgagcca

SEQ ID NO: 8398964 - DNA, 22 bp, Homo sapiens
tgttccaagctgctggataagc

SEQ ID NO: 8398965 - DNA, 22 bp, Homo sapiens
tgttccaataaggagttgaaat

SEQ ID NO: 8398966 - DNA, 22 bp, Homo sapiens
tgttaatatactaaaatccact

SEQ ID NO: 8398967 - DNA, 22 bp, Homo sapiens
tgtgtatacatacatacacacg

SEQ ID NO: 8398968 - DNA, 22 bp, Homo sapiens
tgtgtataactcttaattcatt

SEQ ID NO: 8398969 - DNA, 22 bp, Homo sapiens
tgtgtatagaaagtaggaaagg

SEQ ID NO: 8398970 - DNA, 22 bp, Homo sapiens
ctatgcatctgaacaatagaga

SEQ ID NO: 8398971 - DNA, 22 bp, Homo sapiens
ttcacaatttcccttcatcagg

SEQ ID NO: 8398972 - DNA, 22 bp, Homo sapiens
ttcaaatttggtatgcaagcca

SEQ ID NO: 8398973 - DNA, 22 bp, Homo sapiens
ttcagaggctgtatgactagat

SEQ ID NO: 8398974 - DNA, 22 bp, Homo sapiens
ttcatgaataccccttctgtaa

SEQ ID NO: 8398975 - DNA, 22 bp, Homo sapiens
ctgtgccatctttttgctacct

SEQ ID NO: 8398976 - DNA, 22 bp, Homo sapiens
ctgtgccatccgcttgacctgg

SEQ ID NO: 8398977 - DNA, 22 bp, Homo sapiens
cttcaaagattattgaaaacaa

SEQ ID NO: 8398978 - DNA, 22 bp, Homo sapiens
cttcagtgtcctctctagtaga

SEQ ID NO: 8398979 - DNA, 18 bp, Homo sapiens
cttcagtggctgctctgc

SEQ ID NO: 8398980 - DNA, 22 bp, Homo sapiens
cttcagtgttcccatctgtaaa

SEQ ID NO: 8398981 - DNA, 22 bp, Homo sapiens
cttcagctgcagttatgtttag

SEQ ID NO: 8398982 - DNA, 22 bp, Homo sapiens
cttcagctgacgtcaaaacacc

SEQ ID NO: 8398983 - DNA, 22 bp, Homo sapiens
cttcagtgcatgtttataatca

SEQ ID NO: 8398984 - DNA, 22 bp, Homo sapiens
cttcagtgatataggcttctcc

SEQ ID NO: 8398985 - DNA, 18 bp, Homo sapiens
cttcagtgacagtctggc

SEQ ID NO: 8398986 - DNA, 22 bp, Homo sapiens
gaggaaaataacaactaagggc

SEQ ID NO: 8398987 - DNA, 20 bp, Homo sapiens
gaggaaaagctgccaggcct

SEQ ID NO: 8398988 - DNA, 22 bp, Homo sapiens
gaggaaaagagacaggttattg

SEQ ID NO: 8398989 - DNA, 22 bp, Homo sapiens
gaggaaaatattcagggaggtt

SEQ ID NO: 8398990 - DNA, 22 bp, Homo sapiens
gaggaaaatgcaacaggaatgc

SEQ ID NO: 8398991 - DNA, 22 bp, Homo sapiens
gaatatgaactattcctagccc

SEQ ID NO: 8398992 - DNA, 22 bp, Homo sapiens
gaataacagcaagtttgcaggc

SEQ ID NO: 8398993 - DNA, 22 bp, Homo sapiens
gaagatttaagcacaatagtct

SEQ ID NO: 8398994 - DNA, 22 bp, Homo sapiens
gaagatttctttatgaaagatg

SEQ ID NO: 8398995 - DNA, 22 bp, Homo sapiens
gaagatcaagtgtcattctgtg

SEQ ID NO: 8398996 - DNA, 21 bp, Homo sapiens
gaacatttgggttgtttctac

SEQ ID NO: 8398997 - DNA, 20 bp, Homo sapiens
gaacatttggccatactgag

SEQ ID NO: 8398998 - DNA, 22 bp, Homo sapiens
gaagactttaagccgagattag

SEQ ID NO: 8398999 - DNA, 22 bp, Homo sapiens
gaaatcattagcaaagatatgt

SEQ ID NO: 8399000 - DNA, 22 bp, Homo sapiens
gaaatcatgagatctcttggac

SEQ ID NO: 8399001 - DNA, 22 bp, Homo sapiens
gaaatcatctgagtaataatct

SEQ ID NO: 8399002 - DNA, 22 bp, Homo sapiens
gaaatcattatatggtattgct

SEQ ID NO: 8399003 - DNA, 22 bp, Homo sapiens
gaaatggtagagtaggaagatt

SEQ ID NO: 8399004 - DNA, 22 bp, Homo sapiens
gaacatttggcatgagaatttg

SEQ ID NO: 8399005 - DNA, 22 bp, Homo sapiens
gaacatttggatttgtaaattt

SEQ ID NO: 8399006 - DNA, 22 bp, Homo sapiens
gaacagtttccctgtagaaaat

SEQ ID NO: 8399007 - DNA, 22 bp, Homo sapiens
ctttccaactctagtgaaattt

SEQ ID NO: 8399008 - DNA, 22 bp, Homo sapiens
gaaatcaatttcttggttgata

SEQ ID NO: 8399009 - DNA, 22 bp, Homo sapiens
gtgcagttgatagttttagtga

SEQ ID NO: 8399010 - DNA, 22 bp, Homo sapiens
gtgcatactttattttaatact

SEQ ID NO: 8399011 - DNA, 22 bp, Homo sapiens
gtgaagataaggatgctgcagt

SEQ ID NO: 8399012 - DNA, 22 bp, Homo sapiens
gtgaagatgcctcaggtgaccc

SEQ ID NO: 8399013 - DNA, 22 bp, Homo sapiens
gtgaaatgaatctggaaatatt

SEQ ID NO: 8399014 - DNA, 22 bp, Homo sapiens
gtatttcatcttgaaaaccagt

SEQ ID NO: 8399015 - DNA, 19 bp, Homo sapiens
gtatttcaggacaagacgt

SEQ ID NO: 8399016 - DNA, 22 bp, Homo sapiens
gtattgcattgtttcaagctgt

SEQ ID NO: 8399017 - DNA, 22 bp, Homo sapiens
gtattcttgagtggcaactagg

SEQ ID NO: 8399018 - DNA, 21 bp, Homo sapiens
gtattctttatgaagtgaaaa

SEQ ID NO: 8399019 - DNA, 22 bp, Homo sapiens
gtattcttggttatcaaaatac

SEQ ID NO: 8399020 - DNA, 22 bp, Homo sapiens
ggacacaggtaaataccactga

SEQ ID NO: 8399021 - DNA, 22 bp, Homo sapiens
ggaagatttcccgtagctgtgc

SEQ ID NO: 8399022 - DNA, 22 bp, Homo sapiens
gcttgcattctggatctatggt

SEQ ID NO: 8399023 - DNA, 22 bp, Homo sapiens
gcttgcatttggaatagattaa

SEQ ID NO: 8399024 - DNA, 22 bp, Homo sapiens
gcaaatatttctaattcctgaa

SEQ ID NO: 8399025 - DNA, 19 bp, Homo sapiens
gcacacatacaccctttgg

SEQ ID NO: 8399026 - DNA, 22 bp, Homo sapiens
gcaaagttcctactttactgga

SEQ ID NO: 8399027 - DNA, 21 bp, Homo sapiens
gcaaagtgtgggcataaacag

SEQ ID NO: 8399028 - DNA, 22 bp, Homo sapiens
tccaggccaatgtagcaggccc

SEQ ID NO: 8399029 - DNA, 22 bp, Homo sapiens
tcatggaaacagcaatgctaat

SEQ ID NO: 8399030 - DNA, 22 bp, Homo sapiens
tcatatttaggcctttaattca

SEQ ID NO: 8399031 - DNA, 22 bp, Homo sapiens
tcatatttatatgttggcacag

SEQ ID NO: 8399032 - DNA, 19 bp, Homo sapiens
tcaggcagttattcacaaa

SEQ ID NO: 8399033 - DNA, 22 bp, Homo sapiens
tcacacatgagtaaatacaggg

SEQ ID NO: 8399034 - DNA, 22 bp, Homo sapiens
tcacaaaagcttttgaatttgg

SEQ ID NO: 8399035 - DNA, 22 bp, Homo sapiens
tatttctgattgctcatgaggc

SEQ ID NO: 8399036 - DNA, 22 bp, Homo sapiens
tcagaaaagagaaaatcttata

SEQ ID NO: 8399037 - DNA, 22 bp, Homo sapiens
tcagacatctcataatgtatta

SEQ ID NO: 8399038 - DNA, 22 bp, Homo sapiens
tcacattttgttcaaggctagt

SEQ ID NO: 8399039 - DNA, 22 bp, Homo sapiens
tcacattttcttaggaaactta

SEQ ID NO: 8399040 - DNA, 22 bp, Homo sapiens
tcacattttctactactgtacg

SEQ ID NO: 8399041 - DNA, 22 bp, Homo sapiens
tcacattttccttggtatctgt

SEQ ID NO: 8399042 - DNA, 22 bp, Homo sapiens
tcacattttcatattctctgag

SEQ ID NO: 8399043 - DNA, 22 bp, Homo sapiens
taaaatttgtccctgagtgttg

SEQ ID NO: 8399044 - DNA, 22 bp, Homo sapiens
taaaattgcggtgaatatttcc

SEQ ID NO: 8399045 - DNA, 22 bp, Homo sapiens
taaacaagaaacattttctgtt

SEQ ID NO: 8399046 - DNA, 22 bp, Homo sapiens
taaacaagctgtctgatattct

SEQ ID NO: 8399047 - DNA, 22 bp, Homo sapiens
taaaatgatctctcatgttctt

SEQ ID NO: 8399048 - DNA, 22 bp, Homo sapiens
taaaagttttagttgtacataa

SEQ ID NO: 8399049 - DNA, 20 bp, Homo sapiens
gtttccaaattgtgcatttt

SEQ ID NO: 8399050 - DNA, 22 bp, Homo sapiens
gtttccaaccccaccaaagtgc

SEQ ID NO: 8399051 - DNA, 22 bp, Homo sapiens
taactgaatgtattacaacaga

SEQ ID NO: 8399052 - DNA, 22 bp, Homo sapiens
taactgaacatctcaaatcaag

SEQ ID NO: 8399053 - DNA, 22 bp, Homo sapiens
taactgaacagcctaattcttt

SEQ ID NO: 8399054 - DNA, 22 bp, Homo sapiens
taactagatatagactttctac

SEQ ID NO: 8399055 - DNA, 23 bp, Homo sapiens
taaatttcttgattcttatgtga

SEQ ID NO: 8399056 - DNA, 22 bp, Homo sapiens
gttaatgtgatataaagtattt

SEQ ID NO: 8399057 - DNA, 22 bp, Homo sapiens
gttcacatgtgttatcttcttt

SEQ ID NO: 8399058 - DNA, 22 bp, Homo sapiens
gttcacatggcattttcacatc

SEQ ID NO: 8399059 - DNA, 22 bp, Homo sapiens
gttcacatgctctcatgctttt

SEQ ID NO: 8399060 - DNA, 22 bp, Homo sapiens
tacaaaaaattgatactgacga

SEQ ID NO: 8399061 - DNA, 22 bp, Homo sapiens
tacaaactgttattattattgt

SEQ ID NO: 8399062 - DNA, 22 bp, Homo sapiens
tacaaagaggtaattgcatata

SEQ ID NO: 8399063 - DNA, 22 bp, Homo sapiens
tacaaagtagaaattcagtaaa

SEQ ID NO: 8399064 - DNA, 22 bp, Homo sapiens
tacaaagtatatttctagctgt

SEQ ID NO: 8399065 - DNA, 22 bp, Homo sapiens
tacaaagtaatgtataatatcg

SEQ ID NO: 8399066 - DNA, 22 bp, Homo sapiens
taatactgtatactgcaaattt

SEQ ID NO: 8399067 - DNA, 22 bp, Homo sapiens
taatgtttagaagcagacagct

SEQ ID NO: 8399068 - DNA, 22 bp, Homo sapiens
taatgtttccagtctatgatgg

SEQ ID NO: 8399069 - DNA, 22 bp, Homo sapiens
taatggtatttgttgaaaaact

SEQ ID NO: 8399070 - DNA, 22 bp, Homo sapiens
taatgtttgagatgttggattt

SEQ ID NO: 8399071 - DNA, 22 bp, Homo sapiens
taatgtttgggaaggtgctttg

SEQ ID NO: 8399072 - DNA, 22 bp, Homo sapiens
taatgtttttctcaacattgct

SEQ ID NO: 8399073 - DNA, 21 bp, Homo sapiens
taatactgaaagtgacatctg

SEQ ID NO: 8399074 - DNA, 22 bp, Homo sapiens
taatactgaaagggaaatgtcc

SEQ ID NO: 8399075 - DNA, 22 bp, Homo sapiens
taatactgaaaggagtatcagc

SEQ ID NO: 8399076 - DNA, 22 bp, Homo sapiens
taactgctcagtgagtattttt

SEQ ID NO: 8399077 - DNA, 22 bp, Homo sapiens
tacatctttgtctatgaccagc

SEQ ID NO: 8399078 - DNA, 23 bp, Homo sapiens
tacattctgtatttttatagagt

SEQ ID NO: 8399079 - DNA, 22 bp, Homo sapiens
tacagagttttcctgccaagaa

SEQ ID NO: 8399080 - DNA, 22 bp, Homo sapiens
tacagattgaggtttttaatat

SEQ ID NO: 8399081 - DNA, 18 bp, Homo sapiens
tacagattatagatacat

SEQ ID NO: 8399082 - DNA, 21 bp, Homo sapiens
tacagatgaggagaccaaggc

SEQ ID NO: 8399083 - DNA, 22 bp, Homo sapiens
tacagatatatagtgtgtgcct

SEQ ID NO: 8399084 - DNA, 22 bp, Homo sapiens
tacactttttactacagattct

SEQ ID NO: 8399085 - DNA, 22 bp, Homo sapiens
tacaaagttttcttggattgag

SEQ ID NO: 8399086 - DNA, 22 bp, Homo sapiens
tacaaagtttgagaatgctttc

SEQ ID NO: 8399087 - DNA, 22 bp, Homo sapiens
tacaaagtgggaaacgaaggtt

SEQ ID NO: 8399088 - DNA, 22 bp, Homo sapiens
tacaaagtgctttagaaatgaa

SEQ ID NO: 8399089 - DNA, 22 bp, Homo sapiens
tacaaagtcccattgccatgga

SEQ ID NO: 8399090 - DNA, 22 bp, Homo sapiens
tacaaagtcttgggttctaggc

SEQ ID NO: 8399091 - DNA, 22 bp, Homo sapiens
tacaaagtgattttggaattga

SEQ ID NO: 8399092 - DNA, 22 bp, Homo sapiens
tacaaagtgagcaacctctttt

SEQ ID NO: 8399093 - DNA, 22 bp, Homo sapiens
tacaaagtgaaataattctgag

SEQ ID NO: 8399094 - DNA, 22 bp, Homo sapiens
taggaaaatatctcttattggg

SEQ ID NO: 8399095 - DNA, 22 bp, Homo sapiens
taggaaaagcacaggatgttct

SEQ ID NO: 8399096 - DNA, 22 bp, Homo sapiens
taggaaaagtctagattgatga

SEQ ID NO: 8399097 - DNA, 22 bp, Homo sapiens
taggaaaacgtgattttctcac

SEQ ID NO: 8399098 - DNA, 22 bp, Homo sapiens
taggaaaaatacagaattatat

SEQ ID NO: 8399099 - DNA, 22 bp, Homo sapiens
taggaaaaagaggctggcaagg

SEQ ID NO: 8399100 - DNA, 22 bp, Homo sapiens
tagcagaagaacaacatgatct

SEQ ID NO: 8399101 - DNA, 21 bp, Homo sapiens
tagcagagagttaacttctcc

SEQ ID NO: 8399102 - DNA, 22 bp, Homo sapiens
tagaaactactagaataagaga

SEQ ID NO: 8399103 - DNA, 22 bp, Homo sapiens
taccaaaagcttgtttcataca

SEQ ID NO: 8399104 - DNA, 22 bp, Homo sapiens
tagaaaactaatacatgcttga

SEQ ID NO: 8399105 - DNA, 22 bp, Homo sapiens
tactttttgtctctttgaatgt

SEQ ID NO: 8399106 - DNA, 19 bp, Homo sapiens
tactttttcaggacagagt

SEQ ID NO: 8399107 - DNA, 22 bp, Homo sapiens
tactttttagcacagtgtgtgc

SEQ ID NO: 8399108 - DNA, 22 bp, Homo sapiens
tactttttatgataagaactga

SEQ ID NO: 8399109 - DNA, 22 bp, Homo sapiens
tagaaatcatttagaagtattg

SEQ ID NO: 8399110 - DNA, 22 bp, Homo sapiens
tagaaatcttgttactatgtgt

SEQ ID NO: 8399111 - DNA, 22 bp, Homo sapiens
tattcaaagtaccttcattgcc

SEQ ID NO: 8399112 - DNA, 22 bp, Homo sapiens
tattgaaattcttcatgtcctc

SEQ ID NO: 8399113 - DNA, 22 bp, Homo sapiens
tattgaaatccattacgttctt

SEQ ID NO: 8399114 - DNA, 22 bp, Homo sapiens
tatgtacacatacacttgtaat

SEQ ID NO: 8399115 - DNA, 22 bp, Homo sapiens
tatgagatcccttttcctagag

SEQ ID NO: 8399116 - DNA, 22 bp, Homo sapiens
tattacagctttgattatctgg

SEQ ID NO: 8399117 - DNA, 22 bp, Homo sapiens
tatgtgcagcacttgccattac

SEQ ID NO: 8399118 - DNA, 22 bp, Homo sapiens
tatgtgcagtttgctcttaaca

SEQ ID NO: 8399119 - DNA, 22 bp, Homo sapiens
tatgtgcaaattaattgctaga

SEQ ID NO: 8399120 - DNA, 22 bp, Homo sapiens
tatacagaaagaattcaagtct

SEQ ID NO: 8399121 - DNA, 22 bp, Homo sapiens
tatacaatggctgaatcatcca

SEQ ID NO: 8399122 - DNA, 22 bp, Homo sapiens
tatccaaagtttctcagaaact

SEQ ID NO: 8399123 - DNA, 22 bp, Homo sapiens
tatatattcttaagtagtgtag

SEQ ID NO: 8399124 - DNA, 22 bp, Homo sapiens
tatctacattcttgtatcttct

SEQ ID NO: 8399125 - DNA, 22 bp, Homo sapiens
tatgacatgtgatctcaagagg

SEQ ID NO: 8399126 - DNA, 22 bp, Homo sapiens
tatgactttggaaaaattactt

SEQ ID NO: 8399127 - DNA, 22 bp, Homo sapiens
tgtggccagaggtactatttta

SEQ ID NO: 8399128 - DNA, 22 bp, Homo sapiens
tgtggcaaagaccatttctttc

SEQ ID NO: 8399129 - DNA, 22 bp, Homo sapiens
tgtttacagggtgattttacct

SEQ ID NO: 8399130 - DNA, 22 bp, Homo sapiens
tgtttacaaggagtttatattg

SEQ ID NO: 8399131 - DNA, 21 bp, Homo sapiens
tgtttaatacatatttgtgga

SEQ ID NO: 8399132 - DNA, 19 bp, Homo sapiens
tgtttacatgtttcttcag

SEQ ID NO: 8399133 - DNA, 22 bp, Homo sapiens
tgtttccaaagtcttttcttaa

SEQ ID NO: 8399134 - DNA, 22 bp, Homo sapiens
tgtttccaaatggtataaagac

SEQ ID NO: 8399135 - DNA, 22 bp, Homo sapiens
tgtttgacaacaggctcacaga

SEQ ID NO: 8399136 - DNA, 22 bp, Homo sapiens
tgtttgacacctcagtgtttct

SEQ ID NO: 8399137 - DNA, 22 bp, Homo sapiens
ttactgtttgaaaaatgaatgt

SEQ ID NO: 8399138 - DNA, 18 bp, Homo sapiens
ttactgttatcaaaacag

SEQ ID NO: 8399139 - DNA, 22 bp, Homo sapiens
ttagaagtaaggtcagatttct

SEQ ID NO: 8399140 - DNA, 22 bp, Homo sapiens
ttacacatgaaggtccaatgtt

SEQ ID NO: 8399141 - DNA, 22 bp, Homo sapiens
ttacacatgctcacttatttgt

SEQ ID NO: 8399142 - DNA, 22 bp, Homo sapiens
ttacacaagttctttaacctat

SEQ ID NO: 8399143 - DNA, 22 bp, Homo sapiens
ttacagtagatacaatgagtaa

SEQ ID NO: 8399144 - DNA, 22 bp, Homo sapiens
ttacagtagattttgaatgtgg

SEQ ID NO: 8399145 - DNA, 19 bp, Homo sapiens
ttacatctgcaacactggt

SEQ ID NO: 8399146 - DNA, 22 bp, Homo sapiens
ttacatctgcactccaggacag

SEQ ID NO: 8399147 - DNA, 22 bp, Homo sapiens
ttacatcattgagacatacata

SEQ ID NO: 8399148 - DNA, 22 bp, Homo sapiens
ttacatctaaactgtgaacaat

SEQ ID NO: 8399149 - DNA, 22 bp, Homo sapiens
ttacatattgtctattgttcaa

SEQ ID NO: 8399150 - DNA, 22 bp, Homo sapiens
ttaacagaggacacatcaaact

SEQ ID NO: 8399151 - DNA, 22 bp, Homo sapiens
ttaacagacatatatatttgta

SEQ ID NO: 8399152 - DNA, 22 bp, Homo sapiens
ttaacatttgtgaagcatttag

SEQ ID NO: 8399153 - DNA, 22 bp, Homo sapiens
ttaacattgtccttagcagatt

SEQ ID NO: 8399154 - DNA, 20 bp, Homo sapiens
ttaagaaaagcacatcctgc

SEQ ID NO: 8399155 - DNA, 22 bp, Homo sapiens
ttaagaagtgattttcctcatt

SEQ ID NO: 8399156 - DNA, 22 bp, Homo sapiens
ttaaggaattacgaaaatattt

SEQ ID NO: 8399157 - DNA, 22 bp, Homo sapiens
ttaaatgaacgagatatgcaac

SEQ ID NO: 8399158 - DNA, 22 bp, Homo sapiens
ttaaatgacttttattattctc

SEQ ID NO: 8399159 - DNA, 22 bp, Homo sapiens
ttaaatgaggctgatgtagatt

SEQ ID NO: 8399160 - DNA, 22 bp, Homo sapiens
ttaacaaggtgactgcattaaa

SEQ ID NO: 8399161 - DNA, 22 bp, Homo sapiens
ttcctaatcacgaacattattt

SEQ ID NO: 8399162 - DNA, 22 bp, Homo sapiens
ttcctaatggcaaaacatgttt

SEQ ID NO: 8399163 - DNA, 22 bp, Homo sapiens
ttcctatccttttatgtttatg

SEQ ID NO: 8399164 - DNA, 22 bp, Homo sapiens
ttcctatggctcagttgcattt

SEQ ID NO: 8399165 - DNA, 22 bp, Homo sapiens
ttctaatagctgcctatgtatt

SEQ ID NO: 8399166 - DNA, 19 bp, Homo sapiens
ttcaacatgctgaggcagc

SEQ ID NO: 8399167 - DNA, 22 bp, Homo sapiens
ttcaacatgcaaactttgggag

SEQ ID NO: 8399168 - DNA, 22 bp, Homo sapiens
ttcaacatgcaaacatgtttgt

SEQ ID NO: 8399169 - DNA, 19 bp, Homo sapiens
ttcaacatgctgaggcagc

SEQ ID NO: 8399170 - DNA, 22 bp, Homo sapiens
ttcaacatgctttatttctaaa

SEQ ID NO: 8399171 - DNA, 22 bp, Homo sapiens
ttcaacatcattgtaagcctct

SEQ ID NO: 8399172 - DNA, 22 bp, Homo sapiens
ttcaacatcttggagctggaac

SEQ ID NO: 8399173 - DNA, 22 bp, Homo sapiens
ttcaacatcaagaatgcatgga

SEQ ID NO: 8399174 - DNA, 22 bp, Homo sapiens
ttcaacatatgaattttgggtg

SEQ ID NO: 8399175 - DNA, 22 bp, Homo sapiens
ttcaacatagctgaggcatata

SEQ ID NO: 8399176 - DNA, 22 bp, Homo sapiens
ttcaacatttgaaatgaatgaa

SEQ ID NO: 8399177 - DNA, 22 bp, Homo sapiens
ttcaacatttttgagtttaggt

SEQ ID NO: 8399178 - DNA, 22 bp, Homo sapiens
ttcaacatttgaaatgaatgaa

SEQ ID NO: 8399179 - DNA, 22 bp, Homo sapiens
ttcaacatttgatacaagtcag

SEQ ID NO: 8399180 - DNA, 23 bp, Homo sapiens
ttcaacatttattgagcgtccgt

SEQ ID NO: 8399181 - DNA, 22 bp, Homo sapiens
ttcaacattacacaggcaattc

SEQ ID NO: 8399182 - DNA, 22 bp, Homo sapiens
ttcaacatttatcagtttatca

SEQ ID NO: 8399183 - DNA, 22 bp, Homo sapiens
ttcaacatgttctacataaggg

SEQ ID NO: 8399184 - DNA, 22 bp, Homo sapiens
ttcaacattacacaggcaattc

SEQ ID NO: 8399185 - DNA, 22 bp, Homo sapiens
ttcaacatgttctacataaggg

SEQ ID NO: 8399186 - DNA, 17 bp, Homo sapiens
ttcaaagcttatcaagg

SEQ ID NO: 8399187 - DNA, 22 bp, Homo sapiens
ttagataaattaagactttaca

SEQ ID NO: 8399188 - DNA, 22 bp, Homo sapiens
ttagataaaagtgttcaataaa

SEQ ID NO: 8399189 - DNA, 22 bp, Homo sapiens
ttcacaaagctggttccttctg

SEQ ID NO: 8399190 - DNA, 22 bp, Homo sapiens
ttcacaaagctggagcatttcc

SEQ ID NO: 8399191 - DNA, 22 bp, Homo sapiens
ttcacattagtggttctatata

SEQ ID NO: 8399192 - DNA, 22 bp, Homo sapiens
ttcacattgaaggtgctttctt

SEQ ID NO: 8399193 - DNA, 22 bp, Homo sapiens
ttcacattctcacaagaggaaa

SEQ ID NO: 8399194 - DNA, 19 bp, Homo sapiens
ttcacattggaagaagtag

SEQ ID NO: 8399195 - DNA, 21 bp, Homo sapiens
ttcagggtttcacaatactaa

SEQ ID NO: 8399196 - DNA, 20 bp, Homo sapiens
ttctatacatatcactgaaa

SEQ ID NO: 8399197 - DNA, 21 bp, Homo sapiens
ttctgctaagaaaacattatt

SEQ ID NO: 8399198 - DNA, 22 bp, Homo sapiens
ttctgtttactcagaaatacaa

SEQ ID NO: 8399199 - DNA, 18 bp, Homo sapiens
ttctttaattcagtttga

SEQ ID NO: 8399200 - DNA, 22 bp, Homo sapiens
ttctttatcagttactcatagg

SEQ ID NO: 8399201 - DNA, 22 bp, Homo sapiens
ttctttaaaatagtgagaaaga

SEQ ID NO: 8399202 - DNA, 22 bp, Homo sapiens
ttgaagactaatttagataatg

SEQ ID NO: 8399203 - DNA, 22 bp, Homo sapiens
ttgaagacctttagtgctatgt

SEQ ID NO: 8399204 - DNA, 22 bp, Homo sapiens
ttgaagacacagacatatagag

SEQ ID NO: 8399205 - DNA, 22 bp, Homo sapiens
ttctttatgcttctgtttaggc

SEQ ID NO: 8399206 - DNA, 22 bp, Homo sapiens
ttctttatgttaatgaatctat

SEQ ID NO: 8399207 - DNA, 22 bp, Homo sapiens
ttgcaaatattgtttacctttc

SEQ ID NO: 8399208 - DNA, 21 bp, Homo sapiens
ttgcaacaacctatatatttt

SEQ ID NO: 8399209 - DNA, 22 bp, Homo sapiens
ttgcaacatctgaacatttatc

SEQ ID NO: 8399210 - DNA, 22 bp, Homo sapiens
ttgcaacattgtaagtttatat

SEQ ID NO: 8399211 - DNA, 22 bp, Homo sapiens
ttgcaaggtcatcatgcattgg

SEQ ID NO: 8399212 - DNA, 22 bp, Homo sapiens
ttgcaaggtttctctctgccta

SEQ ID NO: 8399213 - DNA, 22 bp, Homo sapiens
ttgcaaggagccactctgcctg

SEQ ID NO: 8399214 - DNA, 22 bp, Homo sapiens
ttgcaagggtgttttgaggtgt

SEQ ID NO: 8399215 - DNA, 22 bp, Homo sapiens
ttgcaagggcatgtgtgcgtgt

SEQ ID NO: 8399216 - DNA, 22 bp, Homo sapiens
ttgcaagggataccatactaag

SEQ ID NO: 8399217 - DNA, 22 bp, Homo sapiens
ttgcaaggctaggttcacccac

SEQ ID NO: 8399218 - DNA, 20 bp, Homo sapiens
ttgcaactgtaagaagcagg

SEQ ID NO: 8399219 - DNA, 22 bp, Homo sapiens
ttgcaactcttgaaaagcattg

SEQ ID NO: 8399220 - DNA, 23 bp, Homo sapiens
ttgtaaaacagtgtgacggttcc

SEQ ID NO: 8399221 - DNA, 22 bp, Homo sapiens
ttgtgaatagtgctgcaataaa

SEQ ID NO: 8399222 - DNA, 22 bp, Homo sapiens
ttgtgaaatcgtgtttggaagc

SEQ ID NO: 8399223 - DNA, 22 bp, Homo sapiens
tttattatccagtgttgtcatg

SEQ ID NO: 8399224 - DNA, 22 bp, Homo sapiens
tttatttggcatctctgccaag

SEQ ID NO: 8399225 - DNA, 19 bp, Homo sapiens
tttatttgagacatgcctt

SEQ ID NO: 8399226 - DNA, 22 bp, Homo sapiens
tttcaaacttaaatacctttcc

SEQ ID NO: 8399227 - DNA, 22 bp, Homo sapiens
tttataagaagcaatgtctgag

SEQ ID NO: 8399228 - DNA, 19 bp, Homo sapiens
tttaatgtgtgctgcaatc

SEQ ID NO: 8399229 - DNA, 22 bp, Homo sapiens
tttaatgttaaatttgtagatg

SEQ ID NO: 8399230 - DNA, 22 bp, Homo sapiens
tttaaaagttatcatctgtcca

SEQ ID NO: 8399231 - DNA, 23 bp, Homo sapiens
tttaaaagttgtaatgtaggctt

SEQ ID NO: 8399232 - DNA, 22 bp, Homo sapiens
tttacaaggcagttattttcct

SEQ ID NO: 8399233 - DNA, 22 bp, Homo sapiens
tttacaaggcagaactgattaa

SEQ ID NO: 8399234 - DNA, 22 bp, Homo sapiens
tttccaaaggtggcaggaacaa

SEQ ID NO: 8399235 - DNA, 22 bp, Homo sapiens
tttccaaataaggtcacactca

SEQ ID NO: 8399236 - DNA, 22 bp, Homo sapiens
tttccaaaggaggaaccagttt

SEQ ID NO: 8399237 - DNA, 22 bp, Homo sapiens
tttcaaagggaagttatgaagt

SEQ ID NO: 8399238 - DNA, 22 bp, Homo sapiens
tttcaaaggaggctgagaggat

SEQ ID NO: 8399239 - DNA, 22 bp, Homo sapiens
tttcaaagagttgtaaattact

SEQ ID NO: 8399240 - DNA, 22 bp, Homo sapiens
tttcaaagaccattaactatca

SEQ ID NO: 8399241 - DNA, 22 bp, Homo sapiens
tttcaaagacagccatatttgt

SEQ ID NO: 8399242 - DNA, 22 bp, Homo sapiens
tttcagtgaaagctactgttag

SEQ ID NO: 8399243 - DNA, 22 bp, Homo sapiens
tttcagtgcacgtagtttattt

SEQ ID NO: 8399244 - DNA, 22 bp, Homo sapiens
tttctaagtaagattaacttct

SEQ ID NO: 8399245 - DNA, 22 bp, Homo sapiens
tttctaagtaaacacagcatac

SEQ ID NO: 8399246 - DNA, 22 bp, Homo sapiens
tttctaatctttagttacaaaa

SEQ ID NO: 8399247 - DNA, 22 bp, Homo sapiens
tttctgaataactctatgatat

SEQ ID NO: 8399248 - DNA, 22 bp, Homo sapiens
tttctgctcgctctcaatcagg

SEQ ID NO: 8399249 - DNA, 22 bp, Homo sapiens
tttcttctctaatctcaatgat

SEQ ID NO: 8399250 - DNA, 22 bp, Homo sapiens
tttggaacaagacaaaacatta

SEQ ID NO: 8399251 - DNA, 22 bp, Homo sapiens
tttggcaagcgagtactttctg

SEQ ID NO: 8399252 - DNA, 22 bp, Homo sapiens
tttgtaatgataatgttaaatt

SEQ ID NO: 8399253 - DNA, 17 bp, Homo sapiens
tttgtacaacattttaa

SEQ ID NO: 8399254 - DNA, 22 bp, Homo sapiens
tttgtacatgtaagattgcatc

SEQ ID NO: 8399255 - DNA, 22 bp, Homo sapiens
tttgattttcagcaatagtggc

SEQ ID NO: 8399256 - DNA, 22 bp, Homo sapiens
tttgcaaaatgaggtgaagagt

SEQ ID NO: 8399257 - DNA, 22 bp, Homo sapiens
tttgcaaataccatgaaacttg

SEQ ID NO: 8399258 - DNA, 22 bp, Homo sapiens
tttgcaacagactcatcattga

SEQ ID NO: 8399259 - DNA, 22 bp, Homo sapiens
tttgtagattcattgaactttt

SEQ ID NO: 8399260 - DNA, 22 bp, Homo sapiens
tttgtagactaccagtaattgt

SEQ ID NO: 8399261 - DNA, 22 bp, Homo sapiens
tttgtagaactatacttacatt

SEQ ID NO: 8399262 - DNA, 22 bp, Homo sapiens
tttgtagacgtcagaagttact

SEQ ID NO: 8399263 - DNA, 22 bp, Homo sapiens
tttgttgacatccctgtacttt

SEQ ID NO: 8399264 - DNA, 22 bp, Homo sapiens
tttgtattccatatcatgccat

SEQ ID NO: 8399265 - DNA, 22 bp, Homo sapiens
tttgtcaaatcaaaccacattc

SEQ ID NO: 8399266 - DNA, 22 bp, Homo sapiens
tttgtcaataactaccaacagg

SEQ ID NO: 8399267 - DNA, 22 bp, Homo sapiens
tttgtcaagtttgcaaatacgt

SEQ ID NO: 8399268 - DNA, 22 bp, Homo sapiens
tttgtcaatcccttgaaaacct

SEQ ID NO: 8399269 - DNA, 22 bp, Homo sapiens
tttttggcagctcagaaacttc

SEQ ID NO: 8399270 - DNA, 22 bp, Homo sapiens
ttttgaaagggtgatttggctt

SEQ ID NO: 8399271 - DNA, 22 bp, Homo sapiens
ttttgaaagccaggtttgtatg

SEQ ID NO: 8399272 - DNA, 22 bp, Homo sapiens
ttttgaaagagtcctgctacag

SEQ ID NO: 8399273 - DNA, 22 bp, Homo sapiens
ttttgatatcatgatgaacaga

SEQ ID NO: 8399274 - DNA, 22 bp, Homo sapiens
ttttctaacatctagtaatttg

SEQ ID NO: 8399275 - DNA, 22 bp, Homo sapiens
gcagtgtgatgcttccagccac

SEQ ID NO: 8399276 - DNA, 22 bp, Homo sapiens
gcagtgtggcgtggggacctaa

SEQ ID NO: 8399277 - DNA, 22 bp, Homo sapiens
gcagtgtgtctcttggcttcct

SEQ ID NO: 8399278 - DNA, 22 bp, Homo sapiens
attgtgcaatgttttacaattt

SEQ ID NO: 8399279 - DNA, 23 bp, Homo sapiens
attgtgagattactatcacactg

SEQ ID NO: 8399280 - DNA, 22 bp, Homo sapiens
gcagggctgctgaaacttgttt

SEQ ID NO: 8399281 - DNA, 22 bp, Homo sapiens
gcagggctgagtcatgtgtgcc

SEQ ID NO: 8399282 - DNA, 21 bp, Homo sapiens
attcagaaagggaataaactc

SEQ ID NO: 8399283 - DNA, 18 bp, Homo sapiens
gcaccttaccaattctac

SEQ ID NO: 8399284 - DNA, 22 bp, Homo sapiens
gcagatgcttggcactgacagt

SEQ ID NO: 8399285 - DNA, 22 bp, Homo sapiens
caaataattactatcctcactt

SEQ ID NO: 8399286 - DNA, 22 bp, Homo sapiens
gctcttgtcaaaaattagttga

SEQ ID NO: 8399287 - DNA, 22 bp, Homo sapiens
gctctttaattcattcatggat

SEQ ID NO: 8399288 - DNA, 22 bp, Homo sapiens
gctctttagacatagtctgaag

SEQ ID NO: 8399289 - DNA, 22 bp, Homo sapiens
gctctttactgtgagggtggtc

SEQ ID NO: 8399290 - DNA, 16 bp, Homo sapiens
gctctttagagggagg

SEQ ID NO: 8399291 - DNA, 22 bp, Homo sapiens
gctctttagtccaagccatgtc

SEQ ID NO: 8399292 - DNA, 22 bp, Homo sapiens
gctctttagcgggggccaggcc

SEQ ID NO: 8399293 - DNA, 22 bp, Homo sapiens
gctctttagttgatggcctgcc

SEQ ID NO: 8399294 - DNA, 22 bp, Homo sapiens
gctgactgtccgctgctcccgg

SEQ ID NO: 8399295 - DNA, 22 bp, Homo sapiens
caaagcagcctgcagtgtggac

SEQ ID NO: 8399296 - DNA, 22 bp, Homo sapiens
gccaggtggaggttgcagtgag

SEQ ID NO: 8399297 - DNA, 22 bp, Homo sapiens
gccaggtgcatattagaagcat

SEQ ID NO: 8399298 - DNA, 22 bp, Homo sapiens
gccaggtgagtgcgcgccgtcc

SEQ ID NO: 8399299 - DNA, 17 bp, Homo sapiens
gcccacccttaggagct

SEQ ID NO: 8399300 - DNA, 23 bp, Homo sapiens
gcccaccctcagcgtcctcacgg

SEQ ID NO: 8399301 - DNA, 22 bp, Homo sapiens
atttggaaaatctggttataga

SEQ ID NO: 8399302 - DNA, 22 bp, Homo sapiens
atttggaaaagtttcttcaact

SEQ ID NO: 8399303 - DNA, 22 bp, Homo sapiens
atttggaatagctgtagaaata

SEQ ID NO: 8399304 - DNA, 22 bp, Homo sapiens
atttggaaggtttacaaagaga

SEQ ID NO: 8399305 - DNA, 22 bp, Homo sapiens
atttggaagcatttccaaagca

SEQ ID NO: 8399306 - DNA, 18 bp, Homo sapiens
atgaacactgagctgaat

SEQ ID NO: 8399307 - DNA, 22 bp, Homo sapiens
cttcttgttttagccctcatac

SEQ ID NO: 8399308 - DNA, 22 bp, Homo sapiens
ctttccaggctgagtttgcttg

SEQ ID NO: 8399309 - DNA, 22 bp, Homo sapiens
ctttccaggaatcctcacagcc

SEQ ID NO: 8399310 - DNA, 22 bp, Homo sapiens
gaaggctgctgggaagtgtggt

SEQ ID NO: 8399311 - DNA, 22 bp, Homo sapiens
gaaggctgtcagagaggagggc

SEQ ID NO: 8399312 - DNA, 22 bp, Homo sapiens
atgcacacgtaccctacaaggc

SEQ ID NO: 8399313 - DNA, 22 bp, Homo sapiens
gaatattttcagtacagatggt

SEQ ID NO: 8399314 - DNA, 22 bp, Homo sapiens
gacaatatagttgaatgagcaa

SEQ ID NO: 8399315 - DNA, 22 bp, Homo sapiens
gacaccagcaaggctgtgagga

SEQ ID NO: 8399316 - DNA, 22 bp, Homo sapiens
gacactcagtaggacttcaagg

SEQ ID NO: 8399317 - DNA, 22 bp, Homo sapiens
gaccttgtgatctgcccacctt

SEQ ID NO: 8399318 - DNA, 22 bp, Homo sapiens
gaggtagggcagaggctgaatg

SEQ ID NO: 8399319 - DNA, 23 bp, Homo sapiens
gaggtggcaatgagggcagttgg

SEQ ID NO: 8399320 - DNA, 22 bp, Homo sapiens
gaggtggcgcgccatccctgcc

SEQ ID NO: 8399321 - DNA, 22 bp, Homo sapiens
gaggtggcccttgctcagcctt

SEQ ID NO: 8399322 - DNA, 22 bp, Homo sapiens
gaggtggccaagcgaggaaggg

SEQ ID NO: 8399323 - DNA, 22 bp, Homo sapiens
gaggtggcactgtgaggagcac

SEQ ID NO: 8399324 - DNA, 22 bp, Homo sapiens
gaggaaggctaaggggcttaga

SEQ ID NO: 8399325 - DNA, 22 bp, Homo sapiens
gaggagaagctattggaaggac

SEQ ID NO: 8399326 - DNA, 22 bp, Homo sapiens
atggccagagaaggcagggtca

SEQ ID NO: 8399327 - DNA, 22 bp, Homo sapiens
atggcattcacatttccagaga

SEQ ID NO: 8399328 - DNA, 22 bp, Homo sapiens
atggctttctgtgtttccgtag

SEQ ID NO: 8399329 - DNA, 22 bp, Homo sapiens
atggctgtgttgttcctctgaa

SEQ ID NO: 8399330 - DNA, 22 bp, Homo sapiens
atggagggtggtaagacagaga

SEQ ID NO: 8399331 - DNA, 22 bp, Homo sapiens
cagccctgcagctggatctcac

SEQ ID NO: 8399332 - DNA, 22 bp, Homo sapiens
cagcctctttccacatcaggca

SEQ ID NO: 8399333 - DNA, 22 bp, Homo sapiens
cagcctctttccacatcaggca

SEQ ID NO: 8399334 - DNA, 22 bp, Homo sapiens
cagcaccattttcctggtcagc

SEQ ID NO: 8399335 - DNA, 22 bp, Homo sapiens
gtctgtggtccctgctggggac

SEQ ID NO: 8399336 - DNA, 22 bp, Homo sapiens
gtccctgggatgcccttctggg

SEQ ID NO: 8399337 - DNA, 19 bp, Homo sapiens
gtcccttcactcctgctgg

SEQ ID NO: 8399338 - DNA, 22 bp, Homo sapiens
cagactctgatgcagccttgtg

SEQ ID NO: 8399339 - DNA, 22 bp, Homo sapiens
ggtcctgggaagatgctcatga

SEQ ID NO: 8399340 - DNA, 22 bp, Homo sapiens
cagcacatgctcatcagggaag

SEQ ID NO: 8399341 - DNA, 22 bp, Homo sapiens
cagcaccatttgcagcctcttt

SEQ ID NO: 8399342 - DNA, 22 bp, Homo sapiens
ggcagggcagcgctgattaggg

SEQ ID NO: 8399343 - DNA, 22 bp, Homo sapiens
ggcagggcaggaaagtcaggaa

SEQ ID NO: 8399344 - DNA, 22 bp, Homo sapiens
cacctgtccacgcagtctgcct

SEQ ID NO: 8399345 - DNA, 22 bp, Homo sapiens
cacctttgaccttgcagcgcac

SEQ ID NO: 8399346 - DNA, 22 bp, Homo sapiens
cacctttgcaaaccaaatctga

SEQ ID NO: 8399347 - DNA, 22 bp, Homo sapiens
cacgcatttattcacgtattcg

SEQ ID NO: 8399348 - DNA, 22 bp, Homo sapiens
cagaaaacaaacctatcctgag

SEQ ID NO: 8399349 - DNA, 22 bp, Homo sapiens
ggctgccctgggaggcaagggt

SEQ ID NO: 8399350 - DNA, 22 bp, Homo sapiens
ggctggtgttgagtgcctgtag

SEQ ID NO: 8399351 - DNA, 19 bp, Homo sapiens
ggctcagggcgctgccgcc

SEQ ID NO: 8399352 - DNA, 22 bp, Homo sapiens
ggctgagccccctctgcgtagg

SEQ ID NO: 8399353 - DNA, 22 bp, Homo sapiens
ggctcaggttgggtcacatgac

SEQ ID NO: 8399354 - DNA, 21 bp, Homo sapiens
gctgttcggcggccctcgcgc

SEQ ID NO: 8399355 - DNA, 22 bp, Homo sapiens
gctggctgggacagattccatt

SEQ ID NO: 8399356 - DNA, 22 bp, Homo sapiens
gctggctggtccagcaggggct

SEQ ID NO: 8399357 - DNA, 22 bp, Homo sapiens
ggaggccaaggcaggtggatca

SEQ ID NO: 8399358 - DNA, 19 bp, Homo sapiens
cacagatgattgacacata

SEQ ID NO: 8399359 - DNA, 22 bp, Homo sapiens
cacagaggtctgggcccagcag

SEQ ID NO: 8399360 - DNA, 22 bp, Homo sapiens
ggagcaggcagggccgtgtctg

SEQ ID NO: 8399361 - DNA, 20 bp, Homo sapiens
ggaaggggcaaagtgtgtga

SEQ ID NO: 8399362 - DNA, 22 bp, Homo sapiens
ggaaggggagctggaaagggta

SEQ ID NO: 8399363 - DNA, 22 bp, Homo sapiens
ggaaggggccttgagcaaactg

SEQ ID NO: 8399364 - DNA, 22 bp, Homo sapiens
ggactggggccaacacctccct

SEQ ID NO: 8399365 - DNA, 22 bp, Homo sapiens
cacagaggctcaaagccaggtg

SEQ ID NO: 8399366 - DNA, 22 bp, Homo sapiens
cacagaggatgcccaagcgatc

SEQ ID NO: 8399367 - DNA, 22 bp, Homo sapiens
cacagaggaaaggcagttggta

SEQ ID NO: 8399368 - DNA, 22 bp, Homo sapiens
cacagaggaatgcatcagcaga

SEQ ID NO: 8399369 - DNA, 22 bp, Homo sapiens
cacagaggactgtagcggggag

SEQ ID NO: 8399370 - DNA, 22 bp, Homo sapiens
ctaccagcttctttgtctggga

SEQ ID NO: 8399371 - DNA, 22 bp, Homo sapiens
cgaggccatgcatgctgaggac

SEQ ID NO: 8399372 - DNA, 20 bp, Homo sapiens
cggctcagcctctccctccc

SEQ ID NO: 8399373 - DNA, 22 bp, Homo sapiens
aggtaggcctgacgctggggtg

SEQ ID NO: 8399374 - DNA, 22 bp, Homo sapiens
aggtaggccctgagtgctgttg

SEQ ID NO: 8399375 - DNA, 22 bp, Homo sapiens
aggtaggcctgaaagtgacagc

SEQ ID NO: 8399376 - DNA, 19 bp, Homo sapiens
aggtaggcagtggcatgga

SEQ ID NO: 8399377 - DNA, 22 bp, Homo sapiens
cctggcacaagagcagcattgg

SEQ ID NO: 8399378 - DNA, 22 bp, Homo sapiens
cctggcacagagcggtggtcac

SEQ ID NO: 8399379 - DNA, 22 bp, Homo sapiens
cctggagttgaaggaaggtggg

SEQ ID NO: 8399380 - DNA, 22 bp, Homo sapiens
cctggagtgacaggtgtagcct

SEQ ID NO: 8399381 - DNA, 22 bp, Homo sapiens
cctggctctgcagccactccag

SEQ ID NO: 8399382 - DNA, 22 bp, Homo sapiens
cctggctctgaggtatgcctgg

SEQ ID NO: 8399383 - DNA, 22 bp, Homo sapiens
aggtcctgagggttcgtctgca

SEQ ID NO: 8399384 - DNA, 20 bp, Homo sapiens
cctgtctcctcttacctggc

SEQ ID NO: 8399385 - DNA, 22 bp, Homo sapiens
cctgtcataatgtccgatgtca

SEQ ID NO: 8399386 - DNA, 22 bp, Homo sapiens
cctgtgcatgccagggtacacc

SEQ ID NO: 8399387 - DNA, 22 bp, Homo sapiens
cctggctctggttccctcagct

SEQ ID NO: 8399388 - DNA, 22 bp, Homo sapiens
cctggctctgggatcttcgctt

SEQ ID NO: 8399389 - DNA, 20 bp, Homo sapiens
cctgggctccaggagccccg

SEQ ID NO: 8399390 - DNA, 22 bp, Homo sapiens
ctgagaaaccaggtgctctgat

SEQ ID NO: 8399391 - DNA, 22 bp, Homo sapiens
ctgagaaacatatttccatcta

SEQ ID NO: 8399392 - DNA, 22 bp, Homo sapiens
ctgaatccacacaaggtgatgg

SEQ ID NO: 8399393 - DNA, 22 bp, Homo sapiens
ctgagaaaagctttcttataca

SEQ ID NO: 8399394 - DNA, 21 bp, Homo sapiens
ctctgcagccctgcttccagg

SEQ ID NO: 8399395 - DNA, 22 bp, Homo sapiens
ctctcagcaggaaagcatgcaa

SEQ ID NO: 8399396 - DNA, 22 bp, Homo sapiens
ctctcagaagtagcacgtgggc

SEQ ID NO: 8399397 - DNA, 22 bp, Homo sapiens
ctccctccctacgtgagctcac

SEQ ID NO: 8399398 - DNA, 22 bp, Homo sapiens
ctccctcatatacccagcgaga

SEQ ID NO: 8399399 - DNA, 22 bp, Homo sapiens
ctccctcaggccttagccctgc

SEQ ID NO: 8399400 - DNA, 22 bp, Homo sapiens
ctccctcaccatgacccgctgt

SEQ ID NO: 8399401 - DNA, 22 bp, Homo sapiens
ctccctcagaggagcacctgtt

SEQ ID NO: 8399402 - DNA, 22 bp, Homo sapiens
ctccctcacacccttgcccaga

SEQ ID NO: 8399403 - DNA, 22 bp, Homo sapiens
ctcctggctcgcccccagctga

SEQ ID NO: 8399404 - DNA, 22 bp, Homo sapiens
ctccctctgtccgaggccggct

SEQ ID NO: 8399405 - DNA, 22 bp, Homo sapiens
agtcctggcatggaattgtccc

SEQ ID NO: 8399406 - DNA, 22 bp, Homo sapiens
agtcctggcatataggtcctca

SEQ ID NO: 8399407 - DNA, 18 bp, Homo sapiens
agtcctggagatcaccaa

SEQ ID NO: 8399408 - DNA, 22 bp, Homo sapiens
agtcctggacttggagtcaggg

SEQ ID NO: 8399409 - DNA, 22 bp, Homo sapiens
agtcctgggtccagcaggtcct

SEQ ID NO: 8399410 - DNA, 22 bp, Homo sapiens
agtcctggccccaaggaaggat

SEQ ID NO: 8399411 - DNA, 19 bp, Homo sapiens
agtcctggcctgggggacc

SEQ ID NO: 8399412 - DNA, 22 bp, Homo sapiens
agtcctggctctacgggcttca

SEQ ID NO: 8399413 - DNA, 18 bp, Homo sapiens
agtcctggctctaccacc

SEQ ID NO: 8399414 - DNA, 22 bp, Homo sapiens
agtcttctcatttcacatgctt

SEQ ID NO: 8399415 - DNA, 22 bp, Homo sapiens
ctccagagagtccagctctggg

SEQ ID NO: 8399416 - DNA, 22 bp, Homo sapiens
atattataagttatttcaagtt

SEQ ID NO: 8399417 - DNA, 22 bp, Homo sapiens
atatttaaacagggtaccaata

SEQ ID NO: 8399418 - DNA, 22 bp, Homo sapiens
ctgtgggaacactgaggacttc

SEQ ID NO: 8399419 - DNA, 22 bp, Homo sapiens
ctgtgggaatactgcgagtgta

SEQ ID NO: 8399420 - DNA, 23 bp, Homo sapiens
ctgtgggaagtcggggagcgcgc

SEQ ID NO: 8399421 - DNA, 22 bp, Homo sapiens
ctgtgggagaagttgctggagt

SEQ ID NO: 8399422 - DNA, 22 bp, Homo sapiens
ctgtggctcaggcctgtaagcc

SEQ ID NO: 8399423 - DNA, 22 bp, Homo sapiens
atctctgatttacagcatctct

SEQ ID NO: 8399424 - DNA, 22 bp, Homo sapiens
ctggagagaatgttcattgcag

SEQ ID NO: 8399425 - DNA, 18 bp, Homo sapiens
ctgctgcaggcactcagg

SEQ ID NO: 8399426 - DNA, 22 bp, Homo sapiens
ataactctgtttttttcatgca

SEQ ID NO: 8399427 - DNA, 22 bp, Homo sapiens
ctgcatttcacatttaaacttt

SEQ ID NO: 8399428 - DNA, 22 bp, Homo sapiens
ctgcagggttcggagagttccc

SEQ ID NO: 8399429 - DNA, 22 bp, Homo sapiens
ctgcagggagaggggacagcct

SEQ ID NO: 8399430 - DNA, 22 bp, Homo sapiens
ctgcagagatgaagaaggtggc

SEQ ID NO: 8399431 - DNA, 18 bp, Homo sapiens
catgagctgcccctagac

SEQ ID NO: 8399432 - DNA, 22 bp, Homo sapiens
aggatggcttgcaggaggctgt

SEQ ID NO: 8399433 - DNA, 22 bp, Homo sapiens
aggatggggtctgcagcctggt

SEQ ID NO: 8399434 - DNA, 22 bp, Homo sapiens
aggatgggtcagctagagtcca

SEQ ID NO: 8399435 - DNA, 22 bp, Homo sapiens
catacatatgtggatgtcatat

SEQ ID NO: 8399436 - DNA, 22 bp, Homo sapiens
aggagctgtcagagtgccagag

SEQ ID NO: 8399437 - DNA, 22 bp, Homo sapiens
aggagccaggaaacctgctctg

SEQ ID NO: 8399438 - DNA, 22 bp, Homo sapiens
catttctgtcacgttcttttat

SEQ ID NO: 8399439 - DNA, 22 bp, Homo sapiens
catttctgttctcttcctgtac

SEQ ID NO: 8399440 - DNA, 22 bp, Homo sapiens
catttctgtgacacttccatct

SEQ ID NO: 8399441 - DNA, 22 bp, Homo sapiens
ccacccagcagaggaggcaaga

SEQ ID NO: 8399442 - DNA, 22 bp, Homo sapiens
cattgcacttctgcttttcctc

SEQ ID NO: 8399443 - DNA, 22 bp, Homo sapiens
aggacagagggaccagagccca

SEQ ID NO: 8399444 - DNA, 22 bp, Homo sapiens
aggaagagcattcacatggtag

SEQ ID NO: 8399445 - DNA, 22 bp, Homo sapiens
aggaagagctggaccagaggac

SEQ ID NO: 8399446 - DNA, 23 bp, Homo sapiens
aggaagaggcaatttctcttaga

SEQ ID NO: 8399447 - DNA, 22 bp, Homo sapiens
aggaaaggcctttgcatttggt

SEQ ID NO: 8399448 - DNA, 22 bp, Homo sapiens
aggaaaggcctcagcagaaacc

SEQ ID NO: 8399449 - DNA, 21 bp, Homo sapiens
aggaaaggccagcacgtaggg

SEQ ID NO: 8399450 - DNA, 22 bp, Homo sapiens
aggaaaggattggcttctctgt

SEQ ID NO: 8399451 - DNA, 22 bp, Homo sapiens
caggctcttccatcctgctgag

SEQ ID NO: 8399452 - DNA, 22 bp, Homo sapiens
agcttcctacaaccatctcaga

SEQ ID NO: 8399453 - DNA, 22 bp, Homo sapiens
agcttcctgtcttctgcacaaa

SEQ ID NO: 8399454 - DNA, 21 bp, Homo sapiens
caggctctgctagaggagcct

SEQ ID NO: 8399455 - DNA, 22 bp, Homo sapiens
agggctgacctaagctccactt

SEQ ID NO: 8399456 - DNA, 22 bp, Homo sapiens
ccctggcagtgctcctttagac

SEQ ID NO: 8399457 - DNA, 22 bp, Homo sapiens
aggggaagattatacttttgaa

SEQ ID NO: 8399458 - DNA, 22 bp, Homo sapiens
aggggaaatgccttggtggtac

SEQ ID NO: 8399459 - DNA, 21 bp, Homo sapiens
aggggaagtagagttttgatt

SEQ ID NO: 8399460 - DNA, 22 bp, Homo sapiens
agggggctccttggtgtgcaga

SEQ ID NO: 8399461 - DNA, 22 bp, Homo sapiens
ccctgaggatagggcaggaccc

SEQ ID NO: 8399462 - DNA, 21 bp, Homo sapiens
cccctgggagccctgtcagta

SEQ ID NO: 8399463 - DNA, 22 bp, Homo sapiens
agggaaaggtagtgaggtcaca

SEQ ID NO: 8399464 - DNA, 22 bp, Homo sapiens
agggaaaggtagtgaggtcaca

SEQ ID NO: 8399465 - DNA, 22 bp, Homo sapiens
agggaaaggctgatgctgtggg

SEQ ID NO: 8399466 - DNA, 22 bp, Homo sapiens
aggcctggtgtgccggatgcag

SEQ ID NO: 8399467 - DNA, 20 bp, Homo sapiens
aggctcagagcagtagtaca

SEQ ID NO: 8399468 - DNA, 22 bp, Homo sapiens
aggctcagcccctgggaggaga

SEQ ID NO: 8399469 - DNA, 22 bp, Homo sapiens
aggctcagcccaaggtggagag

SEQ ID NO: 8399470 - DNA, 20 bp, Homo sapiens
ccaggcctgggcctgctcta

SEQ ID NO: 8399471 - DNA, 22 bp, Homo sapiens
ccaggccttctgaggacactct

SEQ ID NO: 8399472 - DNA, 18 bp, Homo sapiens
cccaccctggctcttagt

SEQ ID NO: 8399473 - DNA, 18 bp, Homo sapiens
cccaccctggctcttagt

SEQ ID NO: 8399474 - DNA, 22 bp, Homo sapiens
cccaccctgggctacacatcca

SEQ ID NO: 8399475 - DNA, 22 bp, Homo sapiens
ccagtgggtgctgggctctgcc

SEQ ID NO: 8399476 - DNA, 22 bp, Homo sapiens
aggaaaggtagcgtgccagcag

SEQ ID NO: 8399477 - DNA, 22 bp, Homo sapiens
aggaaaggggtaggtgtggacg

SEQ ID NO: 8399478 - DNA, 19 bp, Homo sapiens
aggaaaggtggccttagca

SEQ ID NO: 8399479 - DNA, 17 bp, Homo sapiens
aggaaagtctgctgtcc

SEQ ID NO: 8399480 - DNA, 22 bp, Homo sapiens
acaggatgggcgcacagagcta

SEQ ID NO: 8399481 - DNA, 22 bp, Homo sapiens
acaggcaaagggtcagtagcag

SEQ ID NO: 8399482 - DNA, 22 bp, Homo sapiens
acatatattactagtaaagaca

SEQ ID NO: 8399483 - DNA, 22 bp, Homo sapiens
acatatattactagtaaagaca

SEQ ID NO: 8399484 - DNA, 22 bp, Homo sapiens
aggcaggggagctggaagggta

SEQ ID NO: 8399485 - DNA, 22 bp, Homo sapiens
aggaggccctagagctctagag

SEQ ID NO: 8399486 - DNA, 22 bp, Homo sapiens
aggctcaggaggagctgccgga

SEQ ID NO: 8399487 - DNA, 22 bp, Homo sapiens
aggctcaggtctcaggtctggc

SEQ ID NO: 8399488 - DNA, 22 bp, Homo sapiens
aggctctcaccctctgaccaga

SEQ ID NO: 8399489 - DNA, 22 bp, Homo sapiens
aggctctcagatcagccacatt

SEQ ID NO: 8399490 - DNA, 22 bp, Homo sapiens
aggctctcctccccaggaccat

SEQ ID NO: 8399491 - DNA, 22 bp, Homo sapiens
aggctctctctgcccctgggac

SEQ ID NO: 8399492 - DNA, 22 bp, Homo sapiens
accactgcccatggtgaaaact

SEQ ID NO: 8399493 - DNA, 22 bp, Homo sapiens
accagaaaggaataatagaatt

SEQ ID NO: 8399494 - DNA, 18 bp, Homo sapiens
acatttctccttctgacc

SEQ ID NO: 8399495 - DNA, 22 bp, Homo sapiens
agggccagcactcctggcagga

SEQ ID NO: 8399496 - DNA, 22 bp, Homo sapiens
agggaggatctgctccttgtct

SEQ ID NO: 8399497 - DNA, 22 bp, Homo sapiens
agggaggatagtagtcagttta

SEQ ID NO: 8399498 - DNA, 22 bp, Homo sapiens
agggctcagaaagcaggttttc

SEQ ID NO: 8399499 - DNA, 22 bp, Homo sapiens
agggctgacacaccttatcctc

SEQ ID NO: 8399500 - DNA, 22 bp, Homo sapiens
agggctgaaacataatccttct

SEQ ID NO: 8399501 - DNA, 22 bp, Homo sapiens
acctcacaagtctctgtcagct

SEQ ID NO: 8399502 - DNA, 20 bp, Homo sapiens
atcctggaatccaaatggag

SEQ ID NO: 8399503 - DNA, 22 bp, Homo sapiens
atcctggacagtttcccctatt

SEQ ID NO: 8399504 - DNA, 22 bp, Homo sapiens
atcctggaggctggaggcttgc

SEQ ID NO: 8399505 - DNA, 22 bp, Homo sapiens
agaagccatggtatgcaactac

SEQ ID NO: 8399506 - DNA, 22 bp, Homo sapiens
atatagtttaagaaagtacagt

SEQ ID NO: 8399507 - DNA, 19 bp, Homo sapiens
atacacgtgtatacataca

SEQ ID NO: 8399508 - DNA, 22 bp, Homo sapiens
atagaatagcatagaaaattga

SEQ ID NO: 8399509 - DNA, 22 bp, Homo sapiens
atagaactcgggctttggaatc

SEQ ID NO: 8399510 - DNA, 22 bp, Homo sapiens
atagttgagatcagattcaact

SEQ ID NO: 8399511 - DNA, 22 bp, Homo sapiens
atagttatttctgtcactgtca

SEQ ID NO: 8399512 - DNA, 22 bp, Homo sapiens
agtgggagataacttaacagct

SEQ ID NO: 8399513 - DNA, 22 bp, Homo sapiens
agtgggagcggcagtcggggac

SEQ ID NO: 8399514 - DNA, 20 bp, Homo sapiens
agtgggagagggcagactgc

SEQ ID NO: 8399515 - DNA, 20 bp, Homo sapiens
agtgggagagggcagactgc

SEQ ID NO: 8399516 - DNA, 22 bp, Homo sapiens
agtggcagagcaggtgctggaa

SEQ ID NO: 8399517 - DNA, 22 bp, Homo sapiens
agttacaactgtttgaatgtca

SEQ ID NO: 8399518 - DNA, 22 bp, Homo sapiens
agttacaagtacaggctttgga

SEQ ID NO: 8399519 - DNA, 22 bp, Homo sapiens
agttaccatatatcaaacatgg

SEQ ID NO: 8399520 - DNA, 22 bp, Homo sapiens
agtcagtcaaaatataaattgt

SEQ ID NO: 8399521 - DNA, 22 bp, Homo sapiens
agtcctgggtgtgcaaggcaga

SEQ ID NO: 8399522 - DNA, 22 bp, Homo sapiens
agtcctgggttctggtgttttg

SEQ ID NO: 8399523 - DNA, 22 bp, Homo sapiens
agtcctggtgacactcctcttc

SEQ ID NO: 8399524 - DNA, 22 bp, Homo sapiens
agtcctggttctgattctgaca

SEQ ID NO: 8399525 - DNA, 22 bp, Homo sapiens
agtccttcccatctgacaccct

SEQ ID NO: 8399526 - DNA, 22 bp, Homo sapiens
actctgggccccaggtggagct

SEQ ID NO: 8399527 - DNA, 22 bp, Homo sapiens
actctgggctttgatttgttac

SEQ ID NO: 8399528 - DNA, 22 bp, Homo sapiens
aggttctcacacgtctacaccc

SEQ ID NO: 8399529 - DNA, 22 bp, Homo sapiens
agaggaaacataggtttttaaa

SEQ ID NO: 8399530 - DNA, 22 bp, Homo sapiens
agaggaaaatgagttccagaat

SEQ ID NO: 8399531 - DNA, 22 bp, Homo sapiens
agaggaaatggataaagggtga

SEQ ID NO: 8399532 - DNA, 22 bp, Homo sapiens
agaggccggccgagcccatggg

SEQ ID NO: 8399533 - DNA, 22 bp, Homo sapiens
attgttaaaaaggtggaaatgc

SEQ ID NO: 8399534 - DNA, 22 bp, Homo sapiens
agatacaactgtttaaacatta

SEQ ID NO: 8399535 - DNA, 22 bp, Homo sapiens
atgtataatgctaattagctag

SEQ ID NO: 8399536 - DNA, 22 bp, Homo sapiens
agagatggcgtctcagagcctg

SEQ ID NO: 8399537 - DNA, 18 bp, Homo sapiens
atgggaggggccaagaga

SEQ ID NO: 8399538 - DNA, 22 bp, Homo sapiens
atgtgcaggatccaggctccta

SEQ ID NO: 8399539 - DNA, 22 bp, Homo sapiens
atgttattttggaaaatacaaa

SEQ ID NO: 8399540 - DNA, 22 bp, Homo sapiens
atctgggttcaccatgctcctg

SEQ ID NO: 8399541 - DNA, 21 bp, Homo sapiens
atcttaaaaggtcttaacttt

SEQ ID NO: 8399542 - DNA, 22 bp, Homo sapiens
atgacaatacttcaataagctg

SEQ ID NO: 8399543 - DNA, 22 bp, Homo sapiens
atgctgcagctgcaggatcaga

SEQ ID NO: 8399544 - DNA, 22 bp, Homo sapiens
atgctgcacaagccacatgtag

SEQ ID NO: 8399545 - DNA, 22 bp, Homo sapiens
agcgccgcccctgctggtgttg

SEQ ID NO: 8399546 - DNA, 22 bp, Homo sapiens
cagccccacacggtctagctct

SEQ ID NO: 8399547 - DNA, 22 bp, Homo sapiens
cagcctctgacaccacagtcgt

SEQ ID NO: 8399548 - DNA, 22 bp, Homo sapiens
cagcctctgtggctgccacacc

SEQ ID NO: 8399549 - DNA, 22 bp, Homo sapiens
agctctggagccggaggatttc

SEQ ID NO: 8399550 - DNA, 23 bp, Homo sapiens
agctctggcgttggggaggtagt

SEQ ID NO: 8399551 - DNA, 22 bp, Homo sapiens
agctctggcactggcgcgggat

SEQ ID NO: 8399552 - DNA, 22 bp, Homo sapiens
cagatccacccttgtagtgaca

SEQ ID NO: 8399553 - DNA, 22 bp, Homo sapiens
agcccttcaagagctctgtcct

SEQ ID NO: 8399554 - DNA, 22 bp, Homo sapiens
cagatgaactgtgactgaaaat

SEQ ID NO: 8399555 - DNA, 22 bp, Homo sapiens
agccagggacgctgcaggctac

SEQ ID NO: 8399556 - DNA, 22 bp, Homo sapiens
agccagggaagaggcctacctc

SEQ ID NO: 8399557 - DNA, 22 bp, Homo sapiens
agccagggctgcgagcagacag

SEQ ID NO: 8399558 - DNA, 22 bp, Homo sapiens
agccaggggagtcagctgctgg

SEQ ID NO: 8399559 - DNA, 22 bp, Homo sapiens
agccagggaggtggaggttgca

SEQ ID NO: 8399560 - DNA, 22 bp, Homo sapiens
cagagctgttactattcatgaa

SEQ ID NO: 8399561 - DNA, 22 bp, Homo sapiens
cagagccatggtatgggcttgt

SEQ ID NO: 8399562 - DNA, 22 bp, Homo sapiens
cagagccatcatgatatggagt

SEQ ID NO: 8399563 - DNA, 22 bp, Homo sapiens
caaggaaggagagatgatgggt

SEQ ID NO: 8399564 - DNA, 22 bp, Homo sapiens
caatgatagattttacaaatta

SEQ ID NO: 8399565 - DNA, 20 bp, Homo sapiens
caaggggagtagtatgggcc

SEQ ID NO: 8399566 - DNA, 22 bp, Homo sapiens
caatttcttgttaattctcagg

SEQ ID NO: 8399567 - DNA, 22 bp, Homo sapiens
caatttctggaactaattctga

SEQ ID NO: 8399568 - DNA, 22 bp, Homo sapiens
cacacatggtagcaggtacaag

SEQ ID NO: 8399569 - DNA, 22 bp, Homo sapiens
cactggggtgggcctggtagag

SEQ ID NO: 8399570 - DNA, 22 bp, Homo sapiens
cactggggaaaacaggcttctt

SEQ ID NO: 8399571 - DNA, 22 bp, Homo sapiens
cactgcactccatcctgggaaa

SEQ ID NO: 8399572 - DNA, 22 bp, Homo sapiens
cactgcactccagcctcggtga

SEQ ID NO: 8399573 - DNA, 22 bp, Homo sapiens
cactgcactccagcccgggcaa

SEQ ID NO: 8399574 - DNA, 22 bp, Homo sapiens
cacatttaagtgcttgttcaga

SEQ ID NO: 8399575 - DNA, 22 bp, Homo sapiens
agcaggtgggatcaagctggca

SEQ ID NO: 8399576 - DNA, 22 bp, Homo sapiens
agcaggtggccacgaggaggag

SEQ ID NO: 8399577 - DNA, 22 bp, Homo sapiens
cacatgggtgtgcctggaggaa

SEQ ID NO: 8399578 - DNA, 22 bp, Homo sapiens
cacatgggcacagagaacttgg

SEQ ID NO: 8399579 - DNA, 22 bp, Homo sapiens
cacatgggcgtaatgtccatgg

SEQ ID NO: 8399580 - DNA, 22 bp, Homo sapiens
cacatgggcttagcaggcaggg

SEQ ID NO: 8399581 - DNA, 22 bp, Homo sapiens
cacatggggcgctgcattggcc

SEQ ID NO: 8399582 - DNA, 22 bp, Homo sapiens
cacatgggtggatggatgcatg

SEQ ID NO: 8399583 - DNA, 18 bp, Homo sapiens
agcaggcgttgcctggga

SEQ ID NO: 8399584 - DNA, 20 bp, Homo sapiens
acacatatagcagcataaac

SEQ ID NO: 8399585 - DNA, 22 bp, Homo sapiens
acactttaagcatttcacactg

SEQ ID NO: 8399586 - DNA, 22 bp, Homo sapiens
aagcagggctttaagcggtttt

SEQ ID NO: 8399587 - DNA, 22 bp, Homo sapiens
aagcagggctccctggggactc

SEQ ID NO: 8399588 - DNA, 23 bp, Homo sapiens
aagcagggagattcttagctgag

SEQ ID NO: 8399589 - DNA, 22 bp, Homo sapiens
aagaatatagattttttgaagt

SEQ ID NO: 8399590 - DNA, 22 bp, Homo sapiens
aagaatatctgttttatttagg

SEQ ID NO: 8399591 - DNA, 22 bp, Homo sapiens
aagaagagaaatgtgctgctgg

SEQ ID NO: 8399592 - DNA, 17 bp, Homo sapiens
acacagacaggcagaca

SEQ ID NO: 8399593 - DNA, 22 bp, Homo sapiens
acacagagatgtaaagttaggc

SEQ ID NO: 8399594 - DNA, 22 bp, Homo sapiens
acaacaaaatcactagtcttcc

SEQ ID NO: 8399595 - DNA, 22 bp, Homo sapiens
acaatgtaggctgaaaaagctt

SEQ ID NO: 8399596 - DNA, 22 bp, Homo sapiens
acaatgtagagtaaaatatgtt

SEQ ID NO: 8399597 - DNA, 22 bp, Homo sapiens
acaatgtagttgtcatgagaca

SEQ ID NO: 8399598 - DNA, 22 bp, Homo sapiens
acaatatagtccatgagcatgc

SEQ ID NO: 8399599 - DNA, 22 bp, Homo sapiens
acaatatacacatcctaatggg

SEQ ID NO: 8399600 - DNA, 22 bp, Homo sapiens
aactttaaaaaatatgtctgtt

SEQ ID NO: 8399601 - DNA, 22 bp, Homo sapiens
aactttaaggctataaattatg

SEQ ID NO: 8399602 - DNA, 22 bp, Homo sapiens
aagttacagttggaactgtgaa

SEQ ID NO: 8399603 - DNA, 22 bp, Homo sapiens
aagttacatattcttgggctat

SEQ ID NO: 8399604 - DNA, 22 bp, Homo sapiens
aagttacagtcagaggttaaca

SEQ ID NO: 8399605 - DNA, 22 bp, Homo sapiens
aagttacagttacagaatggag

SEQ ID NO: 8399606 - DNA, 22 bp, Homo sapiens
aagttacacagagttggaggct

SEQ ID NO: 8399607 - DNA, 22 bp, Homo sapiens
aatatctggagatgctttttgt

SEQ ID NO: 8399608 - DNA, 21 bp, Homo sapiens
aagtctggttgattcctttgc

SEQ ID NO: 8399609 - DNA, 22 bp, Homo sapiens
aagtctggtgctgtcctcaccc

SEQ ID NO: 8399610 - DNA, 22 bp, Homo sapiens
aagtctgggcctccttcccaga

SEQ ID NO: 8399611 - DNA, 18 bp, Homo sapiens
aagtctggcagctttccc

SEQ ID NO: 8399612 - DNA, 22 bp, Homo sapiens
aaggagggaaagcagtgcttct

SEQ ID NO: 8399613 - DNA, 22 bp, Homo sapiens
aaggagtctcagctgggcctga

SEQ ID NO: 8399614 - DNA, 22 bp, Homo sapiens
aaggagggttcccaggtcctgg

SEQ ID NO: 8399615 - DNA, 22 bp, Homo sapiens
aaggccagtggataaaacctct

SEQ ID NO: 8399616 - DNA, 22 bp, Homo sapiens
aaggccaggtccctgcagtgca

SEQ ID NO: 8399617 - DNA, 23 bp, Homo sapiens
aaggccagagagaggctagtgtc

SEQ ID NO: 8399618 - DNA, 23 bp, Homo sapiens
aaacttcagtagtgtcatcagcc

SEQ ID NO: 8399619 - DNA, 22 bp, Homo sapiens
aaatgtctgtatgagaaagaga

SEQ ID NO: 8399620 - DNA, 22 bp, Homo sapiens
aaagtacaaggaaaggatctga

SEQ ID NO: 8399621 - DNA, 22 bp, Homo sapiens
aaaataacttctactatttgca

SEQ ID NO: 8399622 - DNA, 22 bp, Homo sapiens
aacttccttctagttcatatgt

SEQ ID NO: 8399623 - DNA, 22 bp, Homo sapiens
aaagttacacatctagtaagtg

SEQ ID NO: 8399624 - DNA, 22 bp, Homo sapiens
aaagccacagttctatgtctgc

SEQ ID NO: 8399625 - DNA, 22 bp, Homo sapiens
aaatatactagatgatgaccca

SEQ ID NO: 8399626 - DNA, 22 bp, Homo sapiens
aaatataccagttgcctgcatc

SEQ ID NO: 8399627 - DNA, 22 bp, Homo sapiens
aagagtttctttattaaccttt

SEQ ID NO: 8399628 - DNA, 22 bp, Homo sapiens
aaatcaaaagacatgtgtttta

SEQ ID NO: 8399629 - DNA, 22 bp, Homo sapiens
agcagggactgagccagtggga

SEQ ID NO: 8399630 - DNA, 22 bp, Homo sapiens
acacatatgtcattgaaaaatc

SEQ ID NO: 8399631 - DNA, 22 bp, Homo sapiens
agccagagatccatccctagga

SEQ ID NO: 8399632 - DNA, 22 bp, Homo sapiens
agccagagctgatgtcattctc

SEQ ID NO: 8399633 - DNA, 22 bp, Homo sapiens
agccagaggaagcctggccctc

SEQ ID NO: 8399634 - DNA, 22 bp, Homo sapiens
agccagagggatctttctaaga

SEQ ID NO: 8399635 - DNA, 22 bp, Homo sapiens
agccagaggccagcctgcctca

SEQ ID NO: 8399636 - DNA, 19 bp, Homo sapiens
agccagagtggcccagggg

SEQ ID NO: 8399637 - DNA, 22 bp, Homo sapiens
agcgtgtgtgcgggtcttcttt

SEQ ID NO: 8399638 - DNA, 19 bp, Homo sapiens
acagagggcaactgagaaa

SEQ ID NO: 8399639 - DNA, 22 bp, Homo sapiens
acagagggggccttggagtgca

SEQ ID NO: 8399640 - DNA, 22 bp, Homo sapiens
acagaggcctcgtaggtacaac

SEQ ID NO: 8399641 - DNA, 22 bp, Homo sapiens
acagaggccccgtgggagagcc

SEQ ID NO: 8399642 - DNA, 23 bp, Homo sapiens
acagaggcttaaatgagtggcag

SEQ ID NO: 8399643 - DNA, 17 bp, Homo sapiens
acagaggcaggagtgga

SEQ ID NO: 8399644 - DNA, 22 bp, Homo sapiens
aatttctcggttttgatattgt

SEQ ID NO: 8399645 - DNA, 22 bp, Homo sapiens
acaatagaaataattaagcaca

SEQ ID NO: 8399646 - DNA, 22 bp, Homo sapiens
acaatagaaggaaactgacata

SEQ ID NO: 8399647 - DNA, 22 bp, Homo sapiens
agcaaggcagtcagctggctgg

SEQ ID NO: 8399648 - DNA, 22 bp, Homo sapiens
agcacagaatgaggtggaagtg

SEQ ID NO: 8399649 - DNA, 22 bp, Homo sapiens
agaggaatttctggaaggaggc

SEQ ID NO: 8399650 - DNA, 22 bp, Homo sapiens
aatgccttggagagcctagagg

SEQ ID NO: 8399651 - DNA, 22 bp, Homo sapiens
agagatttgtcaatgatttcca

SEQ ID NO: 8399652 - DNA, 22 bp, Homo sapiens
agagatttctactgcactcttt

SEQ ID NO: 8399653 - DNA, 22 bp, Homo sapiens
aaggccagagcagactggagtt

SEQ ID NO: 8399654 - DNA, 22 bp, Homo sapiens
aaggccagagcgtgtcctgcct

SEQ ID NO: 8399655 - DNA, 22 bp, Homo sapiens
aaggccagagtactagaggctg

SEQ ID NO: 8399656 - DNA, 22 bp, Homo sapiens
aaggccagccttggaaccctga

SEQ ID NO: 8399657 - DNA, 22 bp, Homo sapiens
aaggccagccctaatgatgctc

SEQ ID NO: 8399658 - DNA, 22 bp, Homo sapiens
aaggccagcctgagagctaaca

SEQ ID NO: 8399659 - DNA, 22 bp, Homo sapiens
aaggccagcagtttgagaccag

SEQ ID NO: 8399660 - DNA, 22 bp, Homo sapiens
aaggccagattctctctagggg

SEQ ID NO: 8399661 - DNA, 22 bp, Homo sapiens
aaggccagagttgaactgctcc

SEQ ID NO: 8399662 - DNA, 22 bp, Homo sapiens
aaggccagattcactttacaat

SEQ ID NO: 8399663 - DNA, 22 bp, Homo sapiens
aaggaagggaaatagtgatgtc

SEQ ID NO: 8399664 - DNA, 22 bp, Homo sapiens
aagcttgtagagtttgacttcc

SEQ ID NO: 8399665 - DNA, 22 bp, Homo sapiens
aaggtacagttttaagaataag

SEQ ID NO: 8399666 - DNA, 22 bp, Homo sapiens
aagggtgggcaccgccaggtca

SEQ ID NO: 8399667 - DNA, 22 bp, Homo sapiens
aaggggaagagaccgcagagtc

SEQ ID NO: 8399668 - DNA, 22 bp, Homo sapiens
aaggggaaaaagtgttaggagt

SEQ ID NO: 8399669 - DNA, 22 bp, Homo sapiens
acctgcctatcagctgcctgct

SEQ ID NO: 8399670 - DNA, 22 bp, Homo sapiens
acctctgcaatgcaatgtcatg

SEQ ID NO: 8399671 - DNA, 22 bp, Homo sapiens
agaaggaagccaggagggtgca

SEQ ID NO: 8399672 - DNA, 22 bp, Homo sapiens
aatagcttatgggatagatgtt

SEQ ID NO: 8399673 - DNA, 22 bp, Homo sapiens
agaaagggatgaggtagctgct

SEQ ID NO: 8399674 - DNA, 22 bp, Homo sapiens
aataatacatgagattaatgtt

SEQ ID NO: 8399675 - DNA, 22 bp, Homo sapiens
aagtttttggtagagaaaagta

SEQ ID NO: 8399676 - DNA, 22 bp, Homo sapiens
actgtacacacttctctgtctt

SEQ ID NO: 8399677 - DNA, 22 bp, Homo sapiens
actcttgtttgtagagcccacc

SEQ ID NO: 8399678 - DNA, 22 bp, Homo sapiens
actcttcttgctgctcattaat

SEQ ID NO: 8399679 - DNA, 22 bp, Homo sapiens
aagttcaatggaaaagctttag

SEQ ID NO: 8399680 - DNA, 22 bp, Homo sapiens
aagttcaagtgtaatctttatt

SEQ ID NO: 8399681 - DNA, 22 bp, Homo sapiens
aagttcaatcagatgaaaaagc

SEQ ID NO: 8399682 - DNA, 22 bp, Homo sapiens
aagttcaagtctgcatcttttt

SEQ ID NO: 8399683 - DNA, 19 bp, Homo sapiens
tatgacaagtactagttct

SEQ ID NO: 8399684 - DNA, 22 bp, Homo sapiens
tatacaatggctgaatcatcca

SEQ ID NO: 8399685 - DNA, 22 bp, Homo sapiens
tattctcagcaacacacatgga

SEQ ID NO: 8399686 - DNA, 22 bp, Homo sapiens
tagagggaagactgctagattt

SEQ ID NO: 8399687 - DNA, 22 bp, Homo sapiens
tagagggaagactgctagattt

SEQ ID NO: 8399688 - DNA, 22 bp, Homo sapiens
tagaggcagaagaaattgacaa

SEQ ID NO: 8399689 - DNA, 22 bp, Homo sapiens
tagaaacagaaaactgtaatag

SEQ ID NO: 8399690 - DNA, 22 bp, Homo sapiens
taggatttaggctttaacatct

SEQ ID NO: 8399691 - DNA, 22 bp, Homo sapiens
taggctgggcattctggccagg

SEQ ID NO: 8399692 - DNA, 22 bp, Homo sapiens
tacaacaatttccacattagaa

SEQ ID NO: 8399693 - DNA, 22 bp, Homo sapiens
taatacagtagcttttacacag

SEQ ID NO: 8399694 - DNA, 22 bp, Homo sapiens
taattatagccgctattttgct

SEQ ID NO: 8399695 - DNA, 22 bp, Homo sapiens
taattatacaaaaaggcatgca

SEQ ID NO: 8399696 - DNA, 22 bp, Homo sapiens
taattataacagttacatctta

SEQ ID NO: 8399697 - DNA, 22 bp, Homo sapiens
gttgggagcagcagaccaagag

SEQ ID NO: 8399698 - DNA, 22 bp, Homo sapiens
gtgtgggacgggtgagtggcca

SEQ ID NO: 8399699 - DNA, 22 bp, Homo sapiens
gtgtgggaaggctaggatgctg

SEQ ID NO: 8399700 - DNA, 23 bp, Homo sapiens
gtgtgccaagcactgtgccagga

SEQ ID NO: 8399701 - DNA, 22 bp, Homo sapiens
gtgctctcctggctgccctgac

SEQ ID NO: 8399702 - DNA, 22 bp, Homo sapiens
taacctggatgtgccaacgtga

SEQ ID NO: 8399703 - DNA, 22 bp, Homo sapiens
taacctggggcctgaagaccat

SEQ ID NO: 8399704 - DNA, 22 bp, Homo sapiens
taaagtgcccagggaaagcggg

SEQ ID NO: 8399705 - DNA, 22 bp, Homo sapiens
gtttccagtcaacttgtgtgtg

SEQ ID NO: 8399706 - DNA, 18 bp, Homo sapiens
gttttgaattgtcttaca

SEQ ID NO: 8399707 - DNA, 22 bp, Homo sapiens
gttttcattactgctgtgattt

SEQ ID NO: 8399708 - DNA, 22 bp, Homo sapiens
gttttgaaatgaaagaaccaag

SEQ ID NO: 8399709 - DNA, 22 bp, Homo sapiens
taaacactcacttcatagccat

SEQ ID NO: 8399710 - DNA, 22 bp, Homo sapiens
taaacactgccttggtgggtca

SEQ ID NO: 8399711 - DNA, 22 bp, Homo sapiens
tcacagtagttgttctctgttt

SEQ ID NO: 8399712 - DNA, 22 bp, Homo sapiens
tcaagctgcatcagtgcagtga

SEQ ID NO: 8399713 - DNA, 22 bp, Homo sapiens
tcaggccaaggtagacatgact

SEQ ID NO: 8399714 - DNA, 22 bp, Homo sapiens
tcagctctacacacacctgtgt

SEQ ID NO: 8399715 - DNA, 22 bp, Homo sapiens
tcagctccagagttgcacagtg

SEQ ID NO: 8399716 - DNA, 22 bp, Homo sapiens
tcagcctgctccaagtgctgcc

SEQ ID NO: 8399717 - DNA, 22 bp, Homo sapiens
tcagctctgcaaggtcacctcc

SEQ ID NO: 8399718 - DNA, 22 bp, Homo sapiens
tcagctctgcactccactgtgg

SEQ ID NO: 8399719 - DNA, 21 bp, Homo sapiens
tcatatttctcttgctattgt

SEQ ID NO: 8399720 - DNA, 22 bp, Homo sapiens
tcatatttaggcctttaattca

SEQ ID NO: 8399721 - DNA, 22 bp, Homo sapiens
tcattcactttgaaataaacga

SEQ ID NO: 8399722 - DNA, 22 bp, Homo sapiens
tcagtcttgcttctcttgggtc

SEQ ID NO: 8399723 - DNA, 23 bp, Homo sapiens
tcagtcttggcttctgattttcc

SEQ ID NO: 8399724 - DNA, 22 bp, Homo sapiens
tcagtcttctaaagggatgcaa

SEQ ID NO: 8399725 - DNA, 22 bp, Homo sapiens
tccatgcagagtccaggcctca

SEQ ID NO: 8399726 - DNA, 18 bp, Homo sapiens
tccatgcacatagccccc

SEQ ID NO: 8399727 - DNA, 22 bp, Homo sapiens
tccatccaggccagcagtaatc

SEQ ID NO: 8399728 - DNA, 18 bp, Homo sapiens
tccagagctactgtggtg

SEQ ID NO: 8399729 - DNA, 22 bp, Homo sapiens
tccagagcctgcgcactggctg

SEQ ID NO: 8399730 - DNA, 22 bp, Homo sapiens
tccagagctgtcctactgtgag

SEQ ID NO: 8399731 - DNA, 22 bp, Homo sapiens
tccagaggggcagccctgtgct

SEQ ID NO: 8399732 - DNA, 22 bp, Homo sapiens
tccagctcccactctcactgct

SEQ ID NO: 8399733 - DNA, 22 bp, Homo sapiens
tccagctcatctgtctccatta

SEQ ID NO: 8399734 - DNA, 22 bp, Homo sapiens
tccagctcaaattcagcttcca

SEQ ID NO: 8399735 - DNA, 21 bp, Homo sapiens
tccagctcttatgttcatgaa

SEQ ID NO: 8399736 - DNA, 21 bp, Homo sapiens
tccagctcctgccactcctta

SEQ ID NO: 8399737 - DNA, 22 bp, Homo sapiens
tccagctctgattctcactagc

SEQ ID NO: 8399738 - DNA, 22 bp, Homo sapiens
tccagctctgcttcacagtctc

SEQ ID NO: 8399739 - DNA, 23 bp, Homo sapiens
tcccatgggctcactgccctgca

SEQ ID NO: 8399740 - DNA, 22 bp, Homo sapiens
tcccacagtgaagttcatgata

SEQ ID NO: 8399741 - DNA, 22 bp, Homo sapiens
gaggccaggaggatctctctaa

SEQ ID NO: 8399742 - DNA, 22 bp, Homo sapiens
gaggccagtgaaatgttataaa

SEQ ID NO: 8399743 - DNA, 22 bp, Homo sapiens
gaggccagtgtgctgtgttttc

SEQ ID NO: 8399744 - DNA, 22 bp, Homo sapiens
gcacacagtagggattcaatga

SEQ ID NO: 8399745 - DNA, 22 bp, Homo sapiens
gcagcctccgcactgcgagtcc

SEQ ID NO: 8399746 - DNA, 22 bp, Homo sapiens
gcaggcagttatttagtagaat

SEQ ID NO: 8399747 - DNA, 19 bp, Homo sapiens
gcaggcagctggggtatcc

SEQ ID NO: 8399748 - DNA, 22 bp, Homo sapiens
gcagtgggaaggttggcacatg

SEQ ID NO: 8399749 - DNA, 22 bp, Homo sapiens
gcagtggcagagacagcaccaa

SEQ ID NO: 8399750 - DNA, 22 bp, Homo sapiens
gccaccaggagcccagtccaaa

SEQ ID NO: 8399751 - DNA, 22 bp, Homo sapiens
gccagcctgtgcttggccaggc

SEQ ID NO: 8399752 - DNA, 22 bp, Homo sapiens
gccctggatgtacaggcatgtt

SEQ ID NO: 8399753 - DNA, 22 bp, Homo sapiens
gccctgggcaaggttctggcca

SEQ ID NO: 8399754 - DNA, 22 bp, Homo sapiens
gcctccggagttgcagtgtctt

SEQ ID NO: 8399755 - DNA, 22 bp, Homo sapiens
gcctccggagtcacagtgtctt

SEQ ID NO: 8399756 - DNA, 22 bp, Homo sapiens
gccagggtgagggctgagaggt

SEQ ID NO: 8399757 - DNA, 22 bp, Homo sapiens
gccagggtgtgcagggacagga

SEQ ID NO: 8399758 - DNA, 22 bp, Homo sapiens
gcccatggcagaactgtgagca

SEQ ID NO: 8399759 - DNA, 22 bp, Homo sapiens
gcccatggtggcgttcggtgca

SEQ ID NO: 8399760 - DNA, 22 bp, Homo sapiens
gcccatggtgaggttgttggtg

SEQ ID NO: 8399761 - DNA, 22 bp, Homo sapiens
gcccatggtcagggaggcaggg

SEQ ID NO: 8399762 - DNA, 22 bp, Homo sapiens
gctggctggaggagggaggttg

SEQ ID NO: 8399763 - DNA, 22 bp, Homo sapiens
gctggctggatggttggttcgc

SEQ ID NO: 8399764 - DNA, 22 bp, Homo sapiens
gctgctttaggttgagctcagc

SEQ ID NO: 8399765 - DNA, 22 bp, Homo sapiens
gctgctttacaggtgggggagc

SEQ ID NO: 8399766 - DNA, 22 bp, Homo sapiens
gctggctgccttactttgtgga

SEQ ID NO: 8399767 - DNA, 22 bp, Homo sapiens
ggaagagtaacaggaggtggaa

SEQ ID NO: 8399768 - DNA, 22 bp, Homo sapiens
ggaagaggctggtagtgcccgt

SEQ ID NO: 8399769 - DNA, 22 bp, Homo sapiens
ggaagaggctgagccaggtccc

SEQ ID NO: 8399770 - DNA, 22 bp, Homo sapiens
ggaccaggcaagctgaggcggg

SEQ ID NO: 8399771 - DNA, 22 bp, Homo sapiens
ggagacagtatggcttgtagct

SEQ ID NO: 8399772 - DNA, 22 bp, Homo sapiens
ggagacagtgacttagagactg

SEQ ID NO: 8399773 - DNA, 22 bp, Homo sapiens
ggagacagtggtagggcctaag

SEQ ID NO: 8399774 - DNA, 22 bp, Homo sapiens
gctgctgttcctccagtggatc

SEQ ID NO: 8399775 - DNA, 22 bp, Homo sapiens
gctgctgttgatttagtccaat

SEQ ID NO: 8399776 - DNA, 22 bp, Homo sapiens
gctgctgtgtgggagacaggcg

SEQ ID NO: 8399777 - DNA, 22 bp, Homo sapiens
gctgctgtgttctcttgaccca

SEQ ID NO: 8399778 - DNA, 22 bp, Homo sapiens
gctgctgtgttggagagggact

SEQ ID NO: 8399779 - DNA, 22 bp, Homo sapiens
gctgctgttccggctacagccc

SEQ ID NO: 8399780 - DNA, 22 bp, Homo sapiens
gctgctgttatgatgttacttt

SEQ ID NO: 8399781 - DNA, 22 bp, Homo sapiens
gctgctgtgttggccactgctt

SEQ ID NO: 8399782 - DNA, 22 bp, Homo sapiens
gctgctcagtgggcctgagcct

SEQ ID NO: 8399783 - DNA, 22 bp, Homo sapiens
gctgctgtgccccatctgcaga

SEQ ID NO: 8399784 - DNA, 22 bp, Homo sapiens
gctgctgtgcctggcgtcctgt

SEQ ID NO: 8399785 - DNA, 21 bp, Homo sapiens
gctgctgtgggccagggaggc

SEQ ID NO: 8399786 - DNA, 22 bp, Homo sapiens
gctgctgtggcagattggattc

SEQ ID NO: 8399787 - DNA, 22 bp, Homo sapiens
gctgctgtctggtctgagggct

SEQ ID NO: 8399788 - DNA, 22 bp, Homo sapiens
gctgctgtgaattttttaaatg

SEQ ID NO: 8399789 - DNA, 22 bp, Homo sapiens
gctgagacttccactgccatct

SEQ ID NO: 8399790 - DNA, 20 bp, Homo sapiens
gcctgagctattgccaggat

SEQ ID NO: 8399791 - DNA, 22 bp, Homo sapiens
gctcccactgcagccctgagcc

SEQ ID NO: 8399792 - DNA, 22 bp, Homo sapiens
gctcccacctccagcctgagtt

SEQ ID NO: 8399793 - DNA, 22 bp, Homo sapiens
gctcccaccttaaccttcacat

SEQ ID NO: 8399794 - DNA, 22 bp, Homo sapiens
gctcccaccaggcagacctacc

SEQ ID NO: 8399795 - DNA, 22 bp, Homo sapiens
gctcagctctatggacacaaag

SEQ ID NO: 8399796 - DNA, 23 bp, Homo sapiens
gctcagaggtttttctctggatg

SEQ ID NO: 8399797 - DNA, 19 bp, Homo sapiens
gctcagagggccctgtgct

SEQ ID NO: 8399798 - DNA, 22 bp, Homo sapiens
gtattctgggccgattacaaaa

SEQ ID NO: 8399799 - DNA, 22 bp, Homo sapiens
gtacctgggggatccacttctt

SEQ ID NO: 8399800 - DNA, 22 bp, Homo sapiens
gtccaagagtcaagaagggggc

SEQ ID NO: 8399801 - DNA, 22 bp, Homo sapiens
gtccacccatgacacctgcctg

SEQ ID NO: 8399802 - DNA, 22 bp, Homo sapiens
gtccctcagtagtgcacagtgg

SEQ ID NO: 8399803 - DNA, 22 bp, Homo sapiens
gtccctcactggaccatatgaa

SEQ ID NO: 8399804 - DNA, 22 bp, Homo sapiens
gtccctcaaggtccagtcatgg

SEQ ID NO: 8399805 - DNA, 23 bp, Homo sapiens
gtccctcacccctaggcaatgcc

SEQ ID NO: 8399806 - DNA, 22 bp, Homo sapiens
gtccctcacccagatgctccca

SEQ ID NO: 8399807 - DNA, 17 bp, Homo sapiens
gtcctgggaggagagag

SEQ ID NO: 8399808 - DNA, 22 bp, Homo sapiens
gtccctggaaaagagctggtga

SEQ ID NO: 8399809 - DNA, 22 bp, Homo sapiens
gtgaagcatatgcttctctgcc

SEQ ID NO: 8399810 - DNA, 22 bp, Homo sapiens
gtcctggggatacagaagtgaa

SEQ ID NO: 8399811 - DNA, 22 bp, Homo sapiens
gtcctggggattatagagtgtt

SEQ ID NO: 8399812 - DNA, 22 bp, Homo sapiens
gtctgctcatgctaccgcgggc

SEQ ID NO: 8399813 - DNA, 22 bp, Homo sapiens
gtctgctgcagtcgtggctcta

SEQ ID NO: 8399814 - DNA, 22 bp, Homo sapiens
gtctgctggtgcctggcctgcg

SEQ ID NO: 8399815 - DNA, 22 bp, Homo sapiens
gtgcatttatatttgcctttgg

SEQ ID NO: 8399816 - DNA, 22 bp, Homo sapiens
gtgcatttggtgactctcaccc

SEQ ID NO: 8399817 - DNA, 20 bp, Homo sapiens
gtgcatttcacctgtactgt

SEQ ID NO: 8399818 - DNA, 22 bp, Homo sapiens
gtgcacttgatctagacagatt

SEQ ID NO: 8399819 - DNA, 21 bp, Homo sapiens
gtgcacagtcctgcacacagg

SEQ ID NO: 8399820 - DNA, 23 bp, Homo sapiens
gtgcacagtcaagcccagcttag

SEQ ID NO: 8399821 - DNA, 22 bp, Homo sapiens
gtgcacagaagcagaagctaga

SEQ ID NO: 8399822 - DNA, 22 bp, Homo sapiens
gtgagcaggatttcatggtgta

SEQ ID NO: 8399823 - DNA, 22 bp, Homo sapiens
gtgagcaggataggggctccct

SEQ ID NO: 8399824 - DNA, 22 bp, Homo sapiens
gtgagcagctcagggtggtctc

SEQ ID NO: 8399825 - DNA, 22 bp, Homo sapiens
gtgagacaattcctcagtagac

SEQ ID NO: 8399826 - DNA, 22 bp, Homo sapiens
gtgagacaagatttgtaggcag

SEQ ID NO: 8399827 - DNA, 21 bp, Homo sapiens
ggtggctagaaagcagtgaga

SEQ ID NO: 8399828 - DNA, 18 bp, Homo sapiens
ggtggcggggatggaggt

SEQ ID NO: 8399829 - DNA, 22 bp, Homo sapiens
ggtggctcagtgtcaggccctg

SEQ ID NO: 8399830 - DNA, 22 bp, Homo sapiens
ggtctcttcaggagcttgagcg

SEQ ID NO: 8399831 - DNA, 22 bp, Homo sapiens
ggtctctgttgcctccatcaag

SEQ ID NO: 8399832 - DNA, 22 bp, Homo sapiens
ggtctctttgcttcagctacag

SEQ ID NO: 8399833 - DNA, 18 bp, Homo sapiens
ggtcctgggcctggctca

SEQ ID NO: 8399834 - DNA, 22 bp, Homo sapiens
ggtccttgggtctcctgtgttt

SEQ ID NO: 8399835 - DNA, 22 bp, Homo sapiens
ggtctcaggtagggcctaggaa

SEQ ID NO: 8399836 - DNA, 19 bp, Homo sapiens
ggtctcagtgcagctgcag

SEQ ID NO: 8399837 - DNA, 22 bp, Homo sapiens
ggtctcaggagactggagagca

SEQ ID NO: 8399838 - DNA, 22 bp, Homo sapiens
ggtctcagaggtttctgctcag

SEQ ID NO: 8399839 - DNA, 22 bp, Homo sapiens
ggtctcagactggcaggcagtg

SEQ ID NO: 8399840 - DNA, 22 bp, Homo sapiens
ggtctcagccctcgccagcagc

SEQ ID NO: 8399841 - DNA, 22 bp, Homo sapiens
ggggaagaggcgtgatggatcc

SEQ ID NO: 8399842 - DNA, 22 bp, Homo sapiens
ggggaagaatggcagaaaacat

SEQ ID NO: 8399843 - DNA, 22 bp, Homo sapiens
ggggaagaatgctctctagaga

SEQ ID NO: 8399844 - DNA, 22 bp, Homo sapiens
ggggaagatggccctccatgtg

SEQ ID NO: 8399845 - DNA, 22 bp, Homo sapiens
ggggaaggatatgattagacta

SEQ ID NO: 8399846 - DNA, 22 bp, Homo sapiens
ggggctgaacctggaggtggtc

SEQ ID NO: 8399847 - DNA, 22 bp, Homo sapiens
gggtggagtgtgaaatctggct

SEQ ID NO: 8399848 - DNA, 22 bp, Homo sapiens
gggtaggatggtagaagggacc

SEQ ID NO: 8399849 - DNA, 22 bp, Homo sapiens
gggtaggagaggtgtctgtgtg

SEQ ID NO: 8399850 - DNA, 22 bp, Homo sapiens
gggtaggaaatccagaggtggc

SEQ ID NO: 8399851 - DNA, 23 bp, Homo sapiens
ggccaggtgcaccttagagagcc

SEQ ID NO: 8399852 - DNA, 22 bp, Homo sapiens
ggccaggtaagagtgcagccgc

SEQ ID NO: 8399853 - DNA, 22 bp, Homo sapiens
ggccaggtccagtggaaggccc

SEQ ID NO: 8399854 - DNA, 22 bp, Homo sapiens
ggcaggtggaagttggcagagc

SEQ ID NO: 8399855 - DNA, 22 bp, Homo sapiens
ggcgaggccgggacaggctgga

SEQ ID NO: 8399856 - DNA, 22 bp, Homo sapiens
ggcctcttatctggctcctgca

SEQ ID NO: 8399857 - DNA, 22 bp, Homo sapiens
ggcctcttctgctcatactttc

SEQ ID NO: 8399858 - DNA, 22 bp, Homo sapiens
ggccatggcgggagccggcgtc

SEQ ID NO: 8399859 - DNA, 17 bp, Homo sapiens
ggagccaggagcccacc

SEQ ID NO: 8399860 - DNA, 22 bp, Homo sapiens
ggagtcagcctgtcagagtgta

SEQ ID NO: 8399861 - DNA, 17 bp, Homo sapiens
ggagtccaggggttagc

SEQ ID NO: 8399862 - DNA, 18 bp, Homo sapiens
ggagtctcaggagaggaa

SEQ ID NO: 8399863 - DNA, 22 bp, Homo sapiens
ggcaagaggtccaagaggtctc

SEQ ID NO: 8399864 - DNA, 22 bp, Homo sapiens
ggcaagagggcagatggagtgc

SEQ ID NO: 8399865 - DNA, 22 bp, Homo sapiens
ggcaagagtgaggagtgtctct

SEQ ID NO: 8399866 - DNA, 22 bp, Homo sapiens
ggcaacaactggacatagctgg

SEQ ID NO: 8399867 - DNA, 22 bp, Homo sapiens
ggcagaggaagctggaagtggg

SEQ ID NO: 8399868 - DNA, 20 bp, Homo sapiens
ggcagagggcctgggagaag

SEQ ID NO: 8399869 - DNA, 22 bp, Homo sapiens
ggctgggccagggcctgtggac

SEQ ID NO: 8399870 - DNA, 22 bp, Homo sapiens
ggcttctccaggtactgagcat

SEQ ID NO: 8399871 - DNA, 22 bp, Homo sapiens
ggcttctcccattcttcagggg

SEQ ID NO: 8399872 - DNA, 22 bp, Homo sapiens
ggcttctcccctttgagtcttc

SEQ ID NO: 8399873 - DNA, 22 bp, Homo sapiens
ggcttctcccttcttctgattg

SEQ ID NO: 8399874 - DNA, 22 bp, Homo sapiens
ggctgagagtggatcccaggga

SEQ ID NO: 8399875 - DNA, 22 bp, Homo sapiens
ggctgctggcctctccccggcc

SEQ ID NO: 8399876 - DNA, 22 bp, Homo sapiens
ggctccagaggccttacctgca

SEQ ID NO: 8399877 - DNA, 22 bp, Homo sapiens
ggctgagaacaggcccagcctc

SEQ ID NO: 8399878 - DNA, 22 bp, Homo sapiens
ggctgagaatcaacaacctgct

SEQ ID NO: 8399879 - DNA, 22 bp, Homo sapiens
gggagagagagctcatgttgaa

SEQ ID NO: 8399880 - DNA, 20 bp, Homo sapiens
ggcttgtctgagtccctggc

SEQ ID NO: 8399881 - DNA, 22 bp, Homo sapiens
ggcttgggagcaggcatgtgac

SEQ ID NO: 8399882 - DNA, 22 bp, Homo sapiens
gggacatgcccctcagtgggtg

SEQ ID NO: 8399883 - DNA, 22 bp, Homo sapiens
gggatggggtcgggaccctgct

SEQ ID NO: 8399884 - DNA, 22 bp, Homo sapiens
gggaggaaagagaagtggtcca

SEQ ID NO: 8399885 - DNA, 22 bp, Homo sapiens
gggaggaaggcttgggtgagta

SEQ ID NO: 8399886 - DNA, 22 bp, Homo sapiens
gaaatatttctcttgagcccct

SEQ ID NO: 8399887 - DNA, 22 bp, Homo sapiens
gaagaggatgacaggagccggt

SEQ ID NO: 8399888 - DNA, 22 bp, Homo sapiens
gacacagacagttagaggtaat

SEQ ID NO: 8399889 - DNA, 22 bp, Homo sapiens
gacacagaatgggtgctcagta

SEQ ID NO: 8399890 - DNA, 22 bp, Homo sapiens
gaccctggtgtccaggtcctgc

SEQ ID NO: 8399891 - DNA, 22 bp, Homo sapiens
gaggaaaatattcagggaggtt

SEQ ID NO: 8399892 - DNA, 22 bp, Homo sapiens
gaggcagaagttgcagtgagca

SEQ ID NO: 8399893 - DNA, 22 bp, Homo sapiens
gaggccagatgtcatgtcttat

SEQ ID NO: 8399894 - DNA, 22 bp, Homo sapiens
gaggccagcgcgcagcactttt

SEQ ID NO: 8399895 - DNA, 22 bp, Homo sapiens
gaggccagcccctcttgaaggc

SEQ ID NO: 8399896 - DNA, 22 bp, Homo sapiens
gaggccaggacatgaaagctga

SEQ ID NO: 8399897 - DNA, 22 bp, Homo sapiens
gaggccaggaagcccaagatca

SEQ ID NO: 8399898 - DNA, 22 bp, Homo sapiens
gaggccagctagtccaggaagt

SEQ ID NO: 8399899 - DNA, 22 bp, Homo sapiens
gaggccagctacccaagggtca

SEQ ID NO: 8399900 - DNA, 22 bp, Homo sapiens
gagctactgaaatattgatttt

SEQ ID NO: 8399901 - DNA, 22 bp, Homo sapiens
gagctcttagatagggcaggaa

SEQ ID NO: 8399902 - DNA, 22 bp, Homo sapiens
gagctctttcatggttctgtga

SEQ ID NO: 8399903 - DNA, 22 bp, Homo sapiens
gagctctttcctgcccatactg

SEQ ID NO: 8399904 - DNA, 22 bp, Homo sapiens
gagctctttaccaggtcaggac

SEQ ID NO: 8399905 - DNA, 22 bp, Homo sapiens
gagctctttcagttgactccta

SEQ ID NO: 8399906 - DNA, 22 bp, Homo sapiens
gagctcttttgccagtcactgc

SEQ ID NO: 8399907 - DNA, 22 bp, Homo sapiens
gagctcttttgatgaaggtagt

SEQ ID NO: 8399908 - DNA, 22 bp, Homo sapiens
gagctctttcggttgttttcga

SEQ ID NO: 8399909 - DNA, 22 bp, Homo sapiens
gagctctttgaacctgggcagt

SEQ ID NO: 8399910 - DNA, 22 bp, Homo sapiens
gagctcttgcttctagtccagg

SEQ ID NO: 8399911 - DNA, 22 bp, Homo sapiens
gagctcttgtagtatgcggtaa

SEQ ID NO: 8399912 - DNA, 22 bp, Homo sapiens
gagctcttctggggtaagggac

SEQ ID NO: 8399913 - DNA, 22 bp, Homo sapiens
gagctcttctggttagatgttg

SEQ ID NO: 8399914 - DNA, 22 bp, Homo sapiens
gagctcttctaaagatggcaat

SEQ ID NO: 8399915 - DNA, 22 bp, Homo sapiens
gagctcttccccatcttacatc

SEQ ID NO: 8399916 - DNA, 22 bp, Homo sapiens
gagctcttatagttctagcagt

SEQ ID NO: 8399917 - DNA, 18 bp, Homo sapiens
gagctcttcccttttctc

SEQ ID NO: 8399918 - DNA, 22 bp, Homo sapiens
gagctcttcctttcaggaggcc

SEQ ID NO: 8399919 - DNA, 22 bp, Homo sapiens
gagctcttcgcctgtcgctgag

SEQ ID NO: 8399920 - DNA, 22 bp, Homo sapiens
gagcttccatccttactgtgtg

SEQ ID NO: 8399921 - DNA, 22 bp, Homo sapiens
gagccagaaaagctgcctgact

SEQ ID NO: 8399922 - DNA, 22 bp, Homo sapiens
gagccaggttggaggctgcagt

SEQ ID NO: 8399923 - DNA, 22 bp, Homo sapiens
gagagggatactgagttttggt

SEQ ID NO: 8399924 - DNA, 22 bp, Homo sapiens
gagaaggaggcgaagcgtgtgc

SEQ ID NO: 8399925 - DNA, 22 bp, Homo sapiens
gagaaggactacacatctggcc

SEQ ID NO: 8399926 - DNA, 22 bp, Homo sapiens
gagaattttctagtagtttcat

SEQ ID NO: 8399927 - DNA, 20 bp, Homo sapiens
cttcaggacccatcctcccc

SEQ ID NO: 8399928 - DNA, 22 bp, Homo sapiens
cttcagctgcagttatgtttag

SEQ ID NO: 8399929 - DNA, 22 bp, Homo sapiens
cttcctctgcctcccgtgctca

SEQ ID NO: 8399930 - DNA, 22 bp, Homo sapiens
cttgcacatttcacacaatagg

SEQ ID NO: 8399931 - DNA, 22 bp, Homo sapiens
cttcctgcaacacctgtgttgc

SEQ ID NO: 8399932 - DNA, 22 bp, Homo sapiens
cttgacactgtcactcaggcca

SEQ ID NO: 8399933 - DNA, 22 bp, Homo sapiens
ctgggtgagttgatgaaggaga

SEQ ID NO: 8399934 - DNA, 22 bp, Homo sapiens
ctgtcccttcattattcactac

SEQ ID NO: 8399935 - DNA, 22 bp, Homo sapiens
ctgggtgctgtgggctcagagg

SEQ ID NO: 8399936 - DNA, 22 bp, Homo sapiens
ctgtccctgagcaactcctgtt

SEQ ID NO: 8399937 - DNA, 22 bp, Homo sapiens
ctgggtgcgtgagcgcatgcgt

SEQ ID NO: 8399938 - DNA, 22 bp, Homo sapiens
ctgggtgccacgggcaccctgg

SEQ ID NO: 8399939 - DNA, 21 bp, Homo sapiens
ctgttcactgtgctgtgcaaa

SEQ ID NO: 8399940 - DNA, 22 bp, Homo sapiens
ctggccctattccaggccttcc

SEQ ID NO: 8399941 - DNA, 22 bp, Homo sapiens
ctggctcacctccgctccagca

SEQ ID NO: 8399942 - DNA, 22 bp, Homo sapiens
ctggctcagacagctgtgcagt

SEQ ID NO: 8399943 - DNA, 22 bp, Homo sapiens
ctggccctggctggagcccagg

SEQ ID NO: 8399944 - DNA, 22 bp, Homo sapiens
ctggccctggtaaggacaccca

SEQ ID NO: 8399945 - DNA, 22 bp, Homo sapiens
ctggctcttctgggttctgtgt

SEQ ID NO: 8399946 - DNA, 21 bp, Homo sapiens
ctggctctgttgtcacccggc

SEQ ID NO: 8399947 - DNA, 22 bp, Homo sapiens
ctgggctgcgggcgcccctcca

SEQ ID NO: 8399948 - DNA, 22 bp, Homo sapiens
ttcatgaacgaacatatgtata

SEQ ID NO: 8399949 - DNA, 22 bp, Homo sapiens
ttcacagaagaggtcacatttc

SEQ ID NO: 8399950 - DNA, 22 bp, Homo sapiens
ctatggtctggaccgaggtcct

SEQ ID NO: 8399951 - DNA, 22 bp, Homo sapiens
ctattagaaagcatcttctata

SEQ ID NO: 8399952 - DNA, 22 bp, Homo sapiens
ctcaagatattccagctctcaa

SEQ ID NO: 8399953 - DNA, 22 bp, Homo sapiens
ctcacaccagcttacaagactt

SEQ ID NO: 8399954 - DNA, 22 bp, Homo sapiens
ttcctgggattattgtcaagca

SEQ ID NO: 8399955 - DNA, 22 bp, Homo sapiens
tgtgtctgcactgagtcctcac

SEQ ID NO: 8399956 - DNA, 22 bp, Homo sapiens
cctgggagtggcactcacagca

SEQ ID NO: 8399957 - DNA, 19 bp, Homo sapiens
cctgggagtcagctgaagg

SEQ ID NO: 8399958 - DNA, 22 bp, Homo sapiens
cctgggagtgtcagacttgctt

SEQ ID NO: 8399959 - DNA, 22 bp, Homo sapiens
cctgggagtgtgccatctctgt

SEQ ID NO: 8399960 - DNA, 22 bp, Homo sapiens
cctgggaggtggatgttgcggt

SEQ ID NO: 8399961 - DNA, 22 bp, Homo sapiens
cctgggcttacgacctctgact

SEQ ID NO: 8399962 - DNA, 22 bp, Homo sapiens
cctggtggcgaatggtggtagg

SEQ ID NO: 8399963 - DNA, 22 bp, Homo sapiens
cctgtgctcccatagcttctgt

SEQ ID NO: 8399964 - DNA, 22 bp, Homo sapiens
cctgtctgttctgactggtcag

SEQ ID NO: 8399965 - DNA, 22 bp, Homo sapiens
ttagaatcaggtgttataatca

SEQ ID NO: 8399966 - DNA, 22 bp, Homo sapiens
ccttcctggctgtccgcctgat

SEQ ID NO: 8399967 - DNA, 22 bp, Homo sapiens
ccttccctaaagcgtcgcttag

SEQ ID NO: 8399968 - DNA, 22 bp, Homo sapiens
ttttaagttggattgctaagta

SEQ ID NO: 8399969 - DNA, 22 bp, Homo sapiens
ttttaagttaatataattgagg

SEQ ID NO: 8399970 - DNA, 19 bp, Homo sapiens
ttttaagtgccctttcttc

SEQ ID NO: 8399971 - DNA, 22 bp, Homo sapiens
ttttcagaattagcataccatt

SEQ ID NO: 8399972 - DNA, 22 bp, Homo sapiens
ttttcacattgtcccagcacta

SEQ ID NO: 8399973 - DNA, 22 bp, Homo sapiens
ctcttcttgaaagaggaattca

SEQ ID NO: 8399974 - DNA, 20 bp, Homo sapiens
ctctttacatgtctcttcct

SEQ ID NO: 8399975 - DNA, 22 bp, Homo sapiens
ctcttcaggtttctgctctgga

SEQ ID NO: 8399976 - DNA, 21 bp, Homo sapiens
tttgccttcacgaagcatcct

SEQ ID NO: 8399977 - DNA, 22 bp, Homo sapiens
tttgccttctctgaacctattt

SEQ ID NO: 8399978 - DNA, 20 bp, Homo sapiens
ctctgctttaggagagtcag

SEQ ID NO: 8399979 - DNA, 22 bp, Homo sapiens
tttgggaaccagaagttcaaaa

SEQ ID NO: 8399980 - DNA, 22 bp, Homo sapiens
tttcctttatgacatcaccact

SEQ ID NO: 8399981 - DNA, 22 bp, Homo sapiens
ctctgcccgcggatgccacgtc

SEQ ID NO: 8399982 - DNA, 22 bp, Homo sapiens
ctccctcacaaagcattctctt

SEQ ID NO: 8399983 - DNA, 22 bp, Homo sapiens
tttaatctattccctaaacacc

SEQ ID NO: 8399984 - DNA, 22 bp, Homo sapiens
ctcctccagctctccctggggg

SEQ ID NO: 8399985 - DNA, 22 bp, Homo sapiens
ctcctggatgcaggctgtctgc

SEQ ID NO: 8399986 - DNA, 22 bp, Homo sapiens
tttcacatagaaagtgatttac

SEQ ID NO: 8399987 - DNA, 22 bp, Homo sapiens
ctctccaggttagagcacttat

SEQ ID NO: 8399988 - DNA, 22 bp, Homo sapiens
ctctccagtcatattctcagtc

SEQ ID NO: 8399989 - DNA, 22 bp, Homo sapiens
ctctcctggggagcacacacac

SEQ ID NO: 8399990 - DNA, 22 bp, Homo sapiens
ctctccaggcgaggtcctactg

SEQ ID NO: 8399991 - DNA, 22 bp, Homo sapiens
ctctccaggagagcactttgag

SEQ ID NO: 8399992 - DNA, 22 bp, Homo sapiens
ctctctgctgtatccttaggct

SEQ ID NO: 8399993 - DNA, 20 bp, Homo sapiens
ctctctctccattcccaggg

SEQ ID NO: 8399994 - DNA, 20 bp, Homo sapiens
ctctctctccattcccaggg

SEQ ID NO: 8399995 - DNA, 22 bp, Homo sapiens
ctctctcttgtgttgctgcaga

SEQ ID NO: 8399996 - DNA, 22 bp, Homo sapiens
ttcttttacattaagatttcag

SEQ ID NO: 8399997 - DNA, 22 bp, Homo sapiens
ttcttttcctacacagcgattt

SEQ ID NO: 8399998 - DNA, 22 bp, Homo sapiens
ctccagccagagtgcctctgtt

SEQ ID NO: 8399999 - DNA, 20 bp, Homo sapiens
ctccagcccctgccctggtc

SEQ ID NO: 8400000 - DNA, 20 bp, Homo sapiens
ctccagcccctgccctggtc

SEQ ID NO: 8400001 - DNA, 22 bp, Homo sapiens
ttgtctttggaaatttaatgtt

SEQ ID NO: 8400002 - DNA, 22 bp, Homo sapiens
ttgtctttcccagcttctagag

SEQ ID NO: 8400003 - DNA, 22 bp, Homo sapiens
ctcccagccttcgccagtctga

SEQ ID NO: 8400004 - DNA, 22 bp, Homo sapiens
tcaagctattggctgaggctgc

SEQ ID NO: 8400005 - DNA, 22 bp, Homo sapiens
cagtcacttacaaaaatataat

SEQ ID NO: 8400006 - DNA, 22 bp, Homo sapiens
cagtcacctagacagaacttac

SEQ ID NO: 8400007 - DNA, 22 bp, Homo sapiens
cagggagatcttggctcctggt

SEQ ID NO: 8400008 - DNA, 22 bp, Homo sapiens
taggcagggattagggttgatt

SEQ ID NO: 8400009 - DNA, 22 bp, Homo sapiens
taggccagaggagcagctttgg

SEQ ID NO: 8400010 - DNA, 19 bp, Homo sapiens
taggccagaagttttccac

SEQ ID NO: 8400011 - DNA, 22 bp, Homo sapiens
taggctgggctgagctggacgg

SEQ ID NO: 8400012 - DNA, 22 bp, Homo sapiens
caggctgccgtgaagcaggcct

SEQ ID NO: 8400013 - DNA, 22 bp, Homo sapiens
tacatttataaggcttctctgt

SEQ ID NO: 8400014 - DNA, 22 bp, Homo sapiens
caggcgagggccctgaggagcc

SEQ ID NO: 8400015 - DNA, 22 bp, Homo sapiens
tactttaaaaactgataattca

SEQ ID NO: 8400016 - DNA, 22 bp, Homo sapiens
caggctcaagccctgcttatat

SEQ ID NO: 8400017 - DNA, 22 bp, Homo sapiens
caggccagagcgcgtggttggg

SEQ ID NO: 8400018 - DNA, 22 bp, Homo sapiens
tacaaaaaattgatactgacga

SEQ ID NO: 8400019 - DNA, 22 bp, Homo sapiens
caggcattgccattcctccaga

SEQ ID NO: 8400020 - DNA, 19 bp, Homo sapiens
caggccagtgtcagggggc

SEQ ID NO: 8400021 - DNA, 22 bp, Homo sapiens
caggccagtgggaaatagggat

SEQ ID NO: 8400022 - DNA, 22 bp, Homo sapiens
caggccaggtgctctagaatca

SEQ ID NO: 8400023 - DNA, 22 bp, Homo sapiens
caggccaggtggcaggcaaaac

SEQ ID NO: 8400024 - DNA, 22 bp, Homo sapiens
caggccagggttgagaagagaa

SEQ ID NO: 8400025 - DNA, 22 bp, Homo sapiens
caggccagttttgatttaagcc

SEQ ID NO: 8400026 - DNA, 22 bp, Homo sapiens
caggccagtgtgcttcccaggc

SEQ ID NO: 8400027 - DNA, 22 bp, Homo sapiens
taatatctggcattcaaacatg

SEQ ID NO: 8400028 - DNA, 22 bp, Homo sapiens
taatcatatgggtaatccaatg

SEQ ID NO: 8400029 - DNA, 22 bp, Homo sapiens
gtgcttcactgacctgttttca

SEQ ID NO: 8400030 - DNA, 20 bp, Homo sapiens
gtgcttcagaagccattgct

SEQ ID NO: 8400031 - DNA, 22 bp, Homo sapiens
catggcattttttcatggagac

SEQ ID NO: 8400032 - DNA, 22 bp, Homo sapiens
catgcattgtaatttttagtct

SEQ ID NO: 8400033 - DNA, 17 bp, Homo sapiens
catctgctctgcccctt

SEQ ID NO: 8400034 - DNA, 22 bp, Homo sapiens
tcagtcacactcactgaggtag

SEQ ID NO: 8400035 - DNA, 22 bp, Homo sapiens
tcagtcccaaggtcctgaggtg

SEQ ID NO: 8400036 - DNA, 22 bp, Homo sapiens
tcagtgctcctaaagtgaatgc

SEQ ID NO: 8400037 - DNA, 22 bp, Homo sapiens
tcaatatagcagtgtacttgag

SEQ ID NO: 8400038 - DNA, 22 bp, Homo sapiens
tcaatatattccatgttttctc

SEQ ID NO: 8400039 - DNA, 22 bp, Homo sapiens
tcagatcaggatgcagcaacat

SEQ ID NO: 8400040 - DNA, 22 bp, Homo sapiens
cagtttttagattagttggtgg

SEQ ID NO: 8400041 - DNA, 22 bp, Homo sapiens
cagtttttgccattaagagtaa

SEQ ID NO: 8400042 - DNA, 22 bp, Homo sapiens
cagtttttcaaaattacatgat

SEQ ID NO: 8400043 - DNA, 22 bp, Homo sapiens
cataatatctccgattacttgc

SEQ ID NO: 8400044 - DNA, 23 bp, Homo sapiens
tccttgggcctgcccagagtggt

SEQ ID NO: 8400045 - DNA, 19 bp, Homo sapiens
tccttccccccagcacaga

SEQ ID NO: 8400046 - DNA, 22 bp, Homo sapiens
tccttcctcggggacccagatc

SEQ ID NO: 8400047 - DNA, 22 bp, Homo sapiens
tccttcctccatggtcttggtt

SEQ ID NO: 8400048 - DNA, 22 bp, Homo sapiens
tccttgtaaaggagctctaaca

SEQ ID NO: 8400049 - DNA, 22 bp, Homo sapiens
tccttccatggtggggctgctt

SEQ ID NO: 8400050 - DNA, 22 bp, Homo sapiens
tcctgggagcccttgctccacc

SEQ ID NO: 8400051 - DNA, 22 bp, Homo sapiens
tcctgggagcacatggtcctgc

SEQ ID NO: 8400052 - DNA, 22 bp, Homo sapiens
tcctgggagcatggtgccgtga

SEQ ID NO: 8400053 - DNA, 22 bp, Homo sapiens
tcctgggagacccagctgtgga

SEQ ID NO: 8400054 - DNA, 22 bp, Homo sapiens
tcctggcagcccgcaggtgctg

SEQ ID NO: 8400055 - DNA, 22 bp, Homo sapiens
tcctggcaggtctgagaggtct

SEQ ID NO: 8400056 - DNA, 22 bp, Homo sapiens
ccacactggcatgggatggagg

SEQ ID NO: 8400057 - DNA, 22 bp, Homo sapiens
ccaaggctggagtgcagtggcg

SEQ ID NO: 8400058 - DNA, 17 bp, Homo sapiens
cattctgtaatctttct

SEQ ID NO: 8400059 - DNA, 22 bp, Homo sapiens
tcccaccccctccaaggaggaa

SEQ ID NO: 8400060 - DNA, 22 bp, Homo sapiens
tccctcgaagagcttattcttt

SEQ ID NO: 8400061 - DNA, 22 bp, Homo sapiens
tccctcagaaattctctctgaa

SEQ ID NO: 8400062 - DNA, 22 bp, Homo sapiens
catttaaaggttgtgggtaaaa

SEQ ID NO: 8400063 - DNA, 22 bp, Homo sapiens
tcccactcactgtctctgacac

SEQ ID NO: 8400064 - DNA, 22 bp, Homo sapiens
tcccactcccaggcaggcctct

SEQ ID NO: 8400065 - DNA, 22 bp, Homo sapiens
tggcttcattattgtttttcct

SEQ ID NO: 8400066 - DNA, 17 bp, Homo sapiens
tggctctgtcctcagct

SEQ ID NO: 8400067 - DNA, 22 bp, Homo sapiens
cctcttccagctgttgcttcca

SEQ ID NO: 8400068 - DNA, 22 bp, Homo sapiens
tgggaaggacgtgtcagtggca

SEQ ID NO: 8400069 - DNA, 22 bp, Homo sapiens
cctgagcctggctcatgcactc

SEQ ID NO: 8400070 - DNA, 22 bp, Homo sapiens
cctgagcagggctctgcagggc

SEQ ID NO: 8400071 - DNA, 19 bp, Homo sapiens
cctcttctctggcagcaga

SEQ ID NO: 8400072 - DNA, 22 bp, Homo sapiens
cctcttctcaactccagccaga

SEQ ID NO: 8400073 - DNA, 22 bp, Homo sapiens
cctcttctaggtttcagcctgc

SEQ ID NO: 8400074 - DNA, 22 bp, Homo sapiens
cctcttctaccatttacatttt

SEQ ID NO: 8400075 - DNA, 22 bp, Homo sapiens
cctcttctaggacgtccttgtg

SEQ ID NO: 8400076 - DNA, 22 bp, Homo sapiens
cccttcctcaaggagctgtgtt

SEQ ID NO: 8400077 - DNA, 22 bp, Homo sapiens
cccttcctgggtgtcccggagt

SEQ ID NO: 8400078 - DNA, 22 bp, Homo sapiens
ccctgcagccttgcatgccttc

SEQ ID NO: 8400079 - DNA, 22 bp, Homo sapiens
cctaaatagagtcagatgtaat

SEQ ID NO: 8400080 - DNA, 17 bp, Homo sapiens
cctcagcttctttcctc

SEQ ID NO: 8400081 - DNA, 22 bp, Homo sapiens
cctcagcagacacgcttctcac

SEQ ID NO: 8400082 - DNA, 22 bp, Homo sapiens
ccctgaaatcctgtgctctgtg

SEQ ID NO: 8400083 - DNA, 22 bp, Homo sapiens
ccctgaaagtacactgggacgg

SEQ ID NO: 8400084 - DNA, 23 bp, Homo sapiens
ccctgagctggtccaggctcaac

SEQ ID NO: 8400085 - DNA, 22 bp, Homo sapiens
ccctgagccgctgctccaacct

SEQ ID NO: 8400086 - DNA, 22 bp, Homo sapiens
ccctgagaggttgagtgtctgc

SEQ ID NO: 8400087 - DNA, 22 bp, Homo sapiens
ccccttccttcctcagacagcc

SEQ ID NO: 8400088 - DNA, 22 bp, Homo sapiens
ccccttccaggaagcagaatcg

SEQ ID NO: 8400089 - DNA, 22 bp, Homo sapiens
cccaggctggggctcctccagc

SEQ ID NO: 8400090 - DNA, 22 bp, Homo sapiens
tgccagtgtggaactaggaaga

SEQ ID NO: 8400091 - DNA, 22 bp, Homo sapiens
tgccagtgggtgtgcagagact

SEQ ID NO: 8400092 - DNA, 22 bp, Homo sapiens
tgcacagagcaggcaccagcgg

SEQ ID NO: 8400093 - DNA, 22 bp, Homo sapiens
tgcacacatgtttacaagcatc

SEQ ID NO: 8400094 - DNA, 22 bp, Homo sapiens
cccacttcatgggcaggaagga

SEQ ID NO: 8400095 - DNA, 22 bp, Homo sapiens
cccaccctcaagggtgtctata

SEQ ID NO: 8400096 - DNA, 22 bp, Homo sapiens
ccattgtaaattctgtggaagt

SEQ ID NO: 8400097 - DNA, 22 bp, Homo sapiens
tgagggctgcttccagagctag

SEQ ID NO: 8400098 - DNA, 22 bp, Homo sapiens
tgacaacagccatcacttttag

SEQ ID NO: 8400099 - DNA, 22 bp, Homo sapiens
tgaatgcactgctctcctagga

SEQ ID NO: 8400100 - DNA, 22 bp, Homo sapiens
tgagacagttctgcagctgggt

SEQ ID NO: 8400101 - DNA, 22 bp, Homo sapiens
tgagacatgtgaatatttgtac

SEQ ID NO: 8400102 - DNA, 20 bp, Homo sapiens
tcttccaggtacagtctgca

SEQ ID NO: 8400103 - DNA, 22 bp, Homo sapiens
ccaggaggttgaggctgcagtg

SEQ ID NO: 8400104 - DNA, 22 bp, Homo sapiens
tctggaggccatagggaaggat

SEQ ID NO: 8400105 - DNA, 22 bp, Homo sapiens
tctgctcaatactgctcatgaa

SEQ ID NO: 8400106 - DNA, 22 bp, Homo sapiens
tctcagaatcaggacctacttc

SEQ ID NO: 8400107 - DNA, 22 bp, Homo sapiens
tctgggagcagatgatggtata

SEQ ID NO: 8400108 - DNA, 17 bp, Homo sapiens
tctgggtttaaatccca

SEQ ID NO: 8400109 - DNA, 22 bp, Homo sapiens
tctgggtttgaagtagagccca

SEQ ID NO: 8400110 - DNA, 22 bp, Homo sapiens
tctgggttttgtaccgtgctcg

SEQ ID NO: 8400111 - DNA, 22 bp, Homo sapiens
tttttccagggttagatgttta

SEQ ID NO: 8400112 - DNA, 20 bp, Homo sapiens
tttttccttctctacaggca

SEQ ID NO: 8400113 - DNA, 22 bp, Homo sapiens
tttgtcaatcccttgaaaacct

SEQ ID NO: 8400114 - DNA, 22 bp, Homo sapiens
tttcttctctaatctcaatgat

SEQ ID NO: 8400115 - DNA, 22 bp, Homo sapiens
tttcttctcatccctgaaatca

SEQ ID NO: 8400116 - DNA, 22 bp, Homo sapiens
tttctgccaaccatttaaactc

SEQ ID NO: 8400117 - DNA, 22 bp, Homo sapiens
tttctgataattttgtgaaatc

SEQ ID NO: 8400118 - DNA, 22 bp, Homo sapiens
tttctgaagtcttctaacagat

SEQ ID NO: 8400119 - DNA, 22 bp, Homo sapiens
tttctgggtttatgtcacagct

SEQ ID NO: 8400120 - DNA, 22 bp, Homo sapiens
tttctggaaacgggttcaagct

SEQ ID NO: 8400121 - DNA, 22 bp, Homo sapiens
tttctaagtgtgattttagatt

SEQ ID NO: 8400122 - DNA, 22 bp, Homo sapiens
tttctcagtaatgtcctggaat

SEQ ID NO: 8400123 - DNA, 22 bp, Homo sapiens
tttctcagtcacatgaaccaat

SEQ ID NO: 8400124 - DNA, 22 bp, Homo sapiens
tttctcagctcagcatctgggt

SEQ ID NO: 8400125 - DNA, 22 bp, Homo sapiens
tttctcagttactagctgtggt

SEQ ID NO: 8400126 - DNA, 22 bp, Homo sapiens
tttcctcttcgattaagtttgg

SEQ ID NO: 8400127 - DNA, 22 bp, Homo sapiens
tttcctcttatacagtgtttat

SEQ ID NO: 8400128 - DNA, 22 bp, Homo sapiens
tttacaaggcagaactgattaa

SEQ ID NO: 8400129 - DNA, 22 bp, Homo sapiens
tttacaaggcagttattttcct

SEQ ID NO: 8400130 - DNA, 22 bp, Homo sapiens
tttaaaatttagacctctccac

SEQ ID NO: 8400131 - DNA, 22 bp, Homo sapiens
tttaaaatcagatgggagttgg

SEQ ID NO: 8400132 - DNA, 22 bp, Homo sapiens
tttataattatctctactctta

SEQ ID NO: 8400133 - DNA, 22 bp, Homo sapiens
ttggttttatcttaagattctt

SEQ ID NO: 8400134 - DNA, 22 bp, Homo sapiens
ttggtgggttaatgagtgactg

SEQ ID NO: 8400135 - DNA, 22 bp, Homo sapiens
ttggtgggagagatgagggttg

SEQ ID NO: 8400136 - DNA, 22 bp, Homo sapiens
ttggtgagtgctatgtaccaca

SEQ ID NO: 8400137 - DNA, 22 bp, Homo sapiens
ttggtgggagaagactctggtt

SEQ ID NO: 8400138 - DNA, 23 bp, Homo sapiens
ttctttcaagaagttcacagtgc

SEQ ID NO: 8400139 - DNA, 22 bp, Homo sapiens
ttctgttacttgcaaccacagg

SEQ ID NO: 8400140 - DNA, 22 bp, Homo sapiens
ttctgggtgactcacgctcccc

SEQ ID NO: 8400141 - DNA, 17 bp, Homo sapiens
ttctgggtcccagggcc

SEQ ID NO: 8400142 - DNA, 22 bp, Homo sapiens
ttctgggtgcaactctgttctg

SEQ ID NO: 8400143 - DNA, 22 bp, Homo sapiens
ttctgggtaacaaggcaagaat

SEQ ID NO: 8400144 - DNA, 22 bp, Homo sapiens
ttctgggtagtatggttagttt

SEQ ID NO: 8400145 - DNA, 22 bp, Homo sapiens
ttctgggtcacccttctgctca

SEQ ID NO: 8400146 - DNA, 21 bp, Homo sapiens
ttctgggttgttaatctgaac

SEQ ID NO: 8400147 - DNA, 22 bp, Homo sapiens
ttctgggtttacatctgacttc

SEQ ID NO: 8400148 - DNA, 23 bp, Homo sapiens
ttctgggttgctgtgcttggaat

SEQ ID NO: 8400149 - DNA, 18 bp, Homo sapiens
ttctgggtgttatgttta

SEQ ID NO: 8400150 - DNA, 22 bp, Homo sapiens
ttctgggtggccagtatttaga

SEQ ID NO: 8400151 - DNA, 22 bp, Homo sapiens
ttctgggtgccacctaagacat

SEQ ID NO: 8400152 - DNA, 22 bp, Homo sapiens
ttctgctttggttccatggatg

SEQ ID NO: 8400153 - DNA, 22 bp, Homo sapiens
ttctgcttcactggcctggagg

SEQ ID NO: 8400154 - DNA, 22 bp, Homo sapiens
ttctagttaatgtagcatcttg

SEQ ID NO: 8400155 - DNA, 22 bp, Homo sapiens
ttcatgtaattccataaggtaa

SEQ ID NO: 8400156 - DNA, 22 bp, Homo sapiens
ttctaattgtgtttgcatatct

SEQ ID NO: 8400157 - DNA, 21 bp, Homo sapiens
ttctagaaaagtatgggactg

SEQ ID NO: 8400158 - DNA, 22 bp, Homo sapiens
ttctagcagagggcatctgctg

SEQ ID NO: 8400159 - DNA, 19 bp, Homo sapiens
ttctagaactgttctctca

SEQ ID NO: 8400160 - DNA, 22 bp, Homo sapiens
ttctagaagaactagccaggaa

SEQ ID NO: 8400161 - DNA, 22 bp, Homo sapiens
ttctagaatgatatgaggtact

SEQ ID NO: 8400162 - DNA, 22 bp, Homo sapiens
ttctagaaggcaggctgggcca

SEQ ID NO: 8400163 - DNA, 22 bp, Homo sapiens
ttccttctctgtggggaaggca

SEQ ID NO: 8400164 - DNA, 22 bp, Homo sapiens
ttcctgtggccttacatctgtg

SEQ ID NO: 8400165 - DNA, 22 bp, Homo sapiens
ttcctgtccgcaatggcctggg

SEQ ID NO: 8400166 - DNA, 21 bp, Homo sapiens
ttccacagtgagaactgcaag

SEQ ID NO: 8400167 - DNA, 22 bp, Homo sapiens
ttaaatgtctgtagatgtgctg

SEQ ID NO: 8400168 - DNA, 22 bp, Homo sapiens
ttaaatgtcaatagattgcttg

SEQ ID NO: 8400169 - DNA, 22 bp, Homo sapiens
tgtttttaaataatgatagaaa

SEQ ID NO: 8400170 - DNA, 20 bp, Homo sapiens
ttaagaaaagcacatcctgc

SEQ ID NO: 8400171 - DNA, 22 bp, Homo sapiens
ttacactttggcaagctattaa

SEQ ID NO: 8400172 - DNA, 22 bp, Homo sapiens
ttactacattgtaacacagtac

SEQ ID NO: 8400173 - DNA, 22 bp, Homo sapiens
tgtttccagaatgtagctgctt

SEQ ID NO: 8400174 - DNA, 22 bp, Homo sapiens
tgttcagaacaaaggtaaatga

SEQ ID NO: 8400175 - DNA, 22 bp, Homo sapiens
tgttcaaatcttttgcttattt

SEQ ID NO: 8400176 - DNA, 22 bp, Homo sapiens
tgtggatgagggagtgaacaaa

SEQ ID NO: 8400177 - DNA, 22 bp, Homo sapiens
tgtggcagagagagcttccttg

SEQ ID NO: 8400178 - DNA, 22 bp, Homo sapiens
tgtggcagctgctgcaggagct

SEQ ID NO: 8400179 - DNA, 22 bp, Homo sapiens
tgtggcagtctcactggagggc

SEQ ID NO: 8400180 - DNA, 22 bp, Homo sapiens
tgtggcagtataagagctagaa

SEQ ID NO: 8400181 - DNA, 22 bp, Homo sapiens
tgtgtgaggtggttctgagaag

SEQ ID NO: 8400182 - DNA, 22 bp, Homo sapiens
cagaatttaagtggattattct

SEQ ID NO: 8400183 - DNA, 22 bp, Homo sapiens
cagacaactggactaagatcac

SEQ ID NO: 8400184 - DNA, 22 bp, Homo sapiens
cagaatttgaagtaatattcca

SEQ ID NO: 8400185 - DNA, 22 bp, Homo sapiens
cagaatttagcacaatgtatgg

SEQ ID NO: 8400186 - DNA, 22 bp, Homo sapiens
cagaatttagaaaacaacataa

SEQ ID NO: 8400187 - DNA, 22 bp, Homo sapiens
ggctggcacagagggctggtgt

SEQ ID NO: 8400188 - DNA, 22 bp, Homo sapiens
gggaggagggtgctggctaaac

SEQ ID NO: 8400189 - DNA, 22 bp, Homo sapiens
gggaggcagtgctggaggctgg

SEQ ID NO: 8400190 - DNA, 22 bp, Homo sapiens
gggttccctgcctggccactct

SEQ ID NO: 8400191 - DNA, 22 bp, Homo sapiens
ggtcctggaaattgacggaaag

SEQ ID NO: 8400192 - DNA, 22 bp, Homo sapiens
ggtcctggcagctctgtgtcca

SEQ ID NO: 8400193 - DNA, 22 bp, Homo sapiens
ggtcctggaagtgtaagtggca

SEQ ID NO: 8400194 - DNA, 22 bp, Homo sapiens
ggtcctggatgagacaggtagt

SEQ ID NO: 8400195 - DNA, 22 bp, Homo sapiens
ggtcctggcagtctttggttgt

SEQ ID NO: 8400196 - DNA, 22 bp, Homo sapiens
cagatggcaacagctctgtgac

SEQ ID NO: 8400197 - DNA, 20 bp, Homo sapiens
cagatggcacgtcagggcat

SEQ ID NO: 8400198 - DNA, 22 bp, Homo sapiens
ggggaggaagctctcagttcca

SEQ ID NO: 8400199 - DNA, 22 bp, Homo sapiens
cagagccactgtctgccaggca

SEQ ID NO: 8400200 - DNA, 20 bp, Homo sapiens
gtagggaaggaatctgcagg

SEQ ID NO: 8400201 - DNA, 22 bp, Homo sapiens
gtcacactagggccaagtggag

SEQ ID NO: 8400202 - DNA, 22 bp, Homo sapiens
gtaggcaggtggaggagtgaag

SEQ ID NO: 8400203 - DNA, 22 bp, Homo sapiens
gtaggctgtgtgaggctagaga

SEQ ID NO: 8400204 - DNA, 22 bp, Homo sapiens
gtaggcagtggttggaagagaa

SEQ ID NO: 8400205 - DNA, 22 bp, Homo sapiens
cagatttaagatatttgtattg

SEQ ID NO: 8400206 - DNA, 23 bp, Homo sapiens
gtgagcagcaccatgaggctaga

SEQ ID NO: 8400207 - DNA, 22 bp, Homo sapiens
gtgagcaatgttatcaggttga

SEQ ID NO: 8400208 - DNA, 18 bp, Homo sapiens
gtgagcagagagcatcac

SEQ ID NO: 8400209 - DNA, 22 bp, Homo sapiens
gtgagcagaataagggttgaga

SEQ ID NO: 8400210 - DNA, 22 bp, Homo sapiens
cagccctcctaccctgccaggc

SEQ ID NO: 8400211 - DNA, 22 bp, Homo sapiens
gtcctgtgccctgggtggcgct

SEQ ID NO: 8400212 - DNA, 22 bp, Homo sapiens
gtcctgtgcaccgtgggatgtt

SEQ ID NO: 8400213 - DNA, 17 bp, Homo sapiens
gtcctggtgtgtgagga

SEQ ID NO: 8400214 - DNA, 22 bp, Homo sapiens
gtcctggtgccacctgcgggat

SEQ ID NO: 8400215 - DNA, 22 bp, Homo sapiens
gtcctggtataattgtttaaaa

SEQ ID NO: 8400216 - DNA, 22 bp, Homo sapiens
gtcctggtgaggtagtgggagg

SEQ ID NO: 8400217 - DNA, 22 bp, Homo sapiens
cagccctgtccagcagagggtg

SEQ ID NO: 8400218 - DNA, 22 bp, Homo sapiens
cacatgcttagatttcagtgga

SEQ ID NO: 8400219 - DNA, 22 bp, Homo sapiens
cacattcctgagcttcgacctg

SEQ ID NO: 8400220 - DNA, 22 bp, Homo sapiens
cactgcactccagcctgggaga

SEQ ID NO: 8400221 - DNA, 22 bp, Homo sapiens
cactgcactccagcctgcgcaa

SEQ ID NO: 8400222 - DNA, 22 bp, Homo sapiens
cactctcacatgccctgtcagt

SEQ ID NO: 8400223 - DNA, 22 bp, Homo sapiens
cactccctctagttgcattctg

SEQ ID NO: 8400224 - DNA, 22 bp, Homo sapiens
cactccagcctcagtgacagag

SEQ ID NO: 8400225 - DNA, 22 bp, Homo sapiens
cacctggcccagctccagtgct

SEQ ID NO: 8400226 - DNA, 20 bp, Homo sapiens
cacctggctgactgtctcca

SEQ ID NO: 8400227 - DNA, 22 bp, Homo sapiens
ggccaggctgccctgggagcag

SEQ ID NO: 8400228 - DNA, 22 bp, Homo sapiens
cactgtattattaggaatgaca

SEQ ID NO: 8400229 - DNA, 21 bp, Homo sapiens
cactgtatagcaggagaaaac

SEQ ID NO: 8400230 - DNA, 22 bp, Homo sapiens
cacacagggagaaagaaagcct

SEQ ID NO: 8400231 - DNA, 22 bp, Homo sapiens
ggagaagggtatgtgtggcgga

SEQ ID NO: 8400232 - DNA, 22 bp, Homo sapiens
ggagagaggagcccactgctgt

SEQ ID NO: 8400233 - DNA, 22 bp, Homo sapiens
caatatagagagaaaattatgt

SEQ ID NO: 8400234 - DNA, 22 bp, Homo sapiens
caatatataatgagtactttcc

SEQ ID NO: 8400235 - DNA, 22 bp, Homo sapiens
caagaattaagaattttgatgt

SEQ ID NO: 8400236 - DNA, 22 bp, Homo sapiens
caagcgtggctgctctgatgga

SEQ ID NO: 8400237 - DNA, 22 bp, Homo sapiens
gctggctgagcactggtttata

SEQ ID NO: 8400238 - DNA, 22 bp, Homo sapiens
gagaatattagagttagtttat

SEQ ID NO: 8400239 - DNA, 22 bp, Homo sapiens
atggatcttccctcatttctga

SEQ ID NO: 8400240 - DNA, 22 bp, Homo sapiens
gagctctgtgaatgtggggagg

SEQ ID NO: 8400241 - DNA, 22 bp, Homo sapiens
gagcacagggaatagacagata

SEQ ID NO: 8400242 - DNA, 22 bp, Homo sapiens
atggctctgagaacctgagcta

SEQ ID NO: 8400243 - DNA, 22 bp, Homo sapiens
atggctctcttgacctaggcac

SEQ ID NO: 8400244 - DNA, 20 bp, Homo sapiens
atggctctgtttggcagtga

SEQ ID NO: 8400245 - DNA, 22 bp, Homo sapiens
atggctctagaatacccctcag

SEQ ID NO: 8400246 - DNA, 22 bp, Homo sapiens
gaggttggcgccctgcctggcc

SEQ ID NO: 8400247 - DNA, 22 bp, Homo sapiens
gaggcacagagccctaggagct

SEQ ID NO: 8400248 - DNA, 22 bp, Homo sapiens
gaggcacagagtaggtgcacac

SEQ ID NO: 8400249 - DNA, 22 bp, Homo sapiens
gaggaggggcacttgtctccta

SEQ ID NO: 8400250 - DNA, 22 bp, Homo sapiens
ctttctttcgaagacgtgatta

SEQ ID NO: 8400251 - DNA, 22 bp, Homo sapiens
ctttgcttgacactgtgattgt

SEQ ID NO: 8400252 - DNA, 22 bp, Homo sapiens
atgacaatggacatagttaaaa

SEQ ID NO: 8400253 - DNA, 22 bp, Homo sapiens
ctttacataaggataaacctgg

SEQ ID NO: 8400254 - DNA, 22 bp, Homo sapiens
ctttacattaatttctactgat

SEQ ID NO: 8400255 - DNA, 22 bp, Homo sapiens
cttctccagccacgcccactcc

SEQ ID NO: 8400256 - DNA, 22 bp, Homo sapiens
cttctcctaaggtcagaattgc

SEQ ID NO: 8400257 - DNA, 22 bp, Homo sapiens
cttctcctctgagtcctgggag

SEQ ID NO: 8400258 - DNA, 22 bp, Homo sapiens
gaagaaagggaattaacttgag

SEQ ID NO: 8400259 - DNA, 22 bp, Homo sapiens
gaaggagggagcggcgcggatt

SEQ ID NO: 8400260 - DNA, 22 bp, Homo sapiens
gaaggagggtgcggatctgagc

SEQ ID NO: 8400261 - DNA, 22 bp, Homo sapiens
gaaggaggcgttagccctagga

SEQ ID NO: 8400262 - DNA, 22 bp, Homo sapiens
gcagagaggaatgaagccatcc

SEQ ID NO: 8400263 - DNA, 22 bp, Homo sapiens
gcacacagaattgattcactgt

SEQ ID NO: 8400264 - DNA, 22 bp, Homo sapiens
attataggcttgagccaccgtg

SEQ ID NO: 8400265 - DNA, 22 bp, Homo sapiens
atgttatttattgaaacacttt

SEQ ID NO: 8400266 - DNA, 22 bp, Homo sapiens
gattcctgctattcacagggct

SEQ ID NO: 8400267 - DNA, 22 bp, Homo sapiens
gattctggagttaaggatgcct

SEQ ID NO: 8400268 - DNA, 17 bp, Homo sapiens
attccacagggaatctg

SEQ ID NO: 8400269 - DNA, 22 bp, Homo sapiens
gccctgggctccctgctccaca

SEQ ID NO: 8400270 - DNA, 20 bp, Homo sapiens
gccctgtgatgtcttgacct

SEQ ID NO: 8400271 - DNA, 22 bp, Homo sapiens
atttcaacgttagatgtaatag

SEQ ID NO: 8400272 - DNA, 22 bp, Homo sapiens
gccaggtggctgagcagctgca

SEQ ID NO: 8400273 - DNA, 22 bp, Homo sapiens
atttggaatgtgtttgatcacc

SEQ ID NO: 8400274 - DNA, 17 bp, Homo sapiens
gccttccagcatgtggg

SEQ ID NO: 8400275 - DNA, 22 bp, Homo sapiens
gctcagacttgttttacaggct

SEQ ID NO: 8400276 - DNA, 22 bp, Homo sapiens
caaagaatcactcatctttagc

SEQ ID NO: 8400277 - DNA, 21 bp, Homo sapiens
aggatttctgtcatttcagat

SEQ ID NO: 8400278 - DNA, 16 bp, Homo sapiens
aggaggggaattagga

SEQ ID NO: 8400279 - DNA, 22 bp, Homo sapiens
cagtttctccaaacgcaggctg

SEQ ID NO: 8400280 - DNA, 22 bp, Homo sapiens
aggagggagcttaagccaggca

SEQ ID NO: 8400281 - DNA, 19 bp, Homo sapiens
aggagaagtagcagaaatt

SEQ ID NO: 8400282 - DNA, 22 bp, Homo sapiens
caggtgggagcgaggagctact

SEQ ID NO: 8400283 - DNA, 22 bp, Homo sapiens
caggtgggaccatgatagggca

SEQ ID NO: 8400284 - DNA, 22 bp, Homo sapiens
caggaggattgcttgaggccag

SEQ ID NO: 8400285 - DNA, 22 bp, Homo sapiens
caggaggacatactggctcaca

SEQ ID NO: 8400286 - DNA, 22 bp, Homo sapiens
caggccagaggctgttgttgcg

SEQ ID NO: 8400287 - DNA, 22 bp, Homo sapiens
caggccagcgtccagaacaagc

SEQ ID NO: 8400288 - DNA, 22 bp, Homo sapiens
caggccaggctgcatttgcccc

SEQ ID NO: 8400289 - DNA, 22 bp, Homo sapiens
caggccagcttcctgacatcct

SEQ ID NO: 8400290 - DNA, 22 bp, Homo sapiens
caggccagcggcccgcgcgttc

SEQ ID NO: 8400291 - DNA, 22 bp, Homo sapiens
caggccagcagggcctccgtgg

SEQ ID NO: 8400292 - DNA, 22 bp, Homo sapiens
caggccagagtccaactccaga

SEQ ID NO: 8400293 - DNA, 20 bp, Homo sapiens
caggccagaggtttgatggc

SEQ ID NO: 8400294 - DNA, 22 bp, Homo sapiens
caggccagggagaatatgaagc

SEQ ID NO: 8400295 - DNA, 22 bp, Homo sapiens
cagggtgagcctctggagccct

SEQ ID NO: 8400296 - DNA, 22 bp, Homo sapiens
cagggatgtgatgagctgagcc

SEQ ID NO: 8400297 - DNA, 22 bp, Homo sapiens
cagggatgggatggagtcagtt

SEQ ID NO: 8400298 - DNA, 22 bp, Homo sapiens
cagggagaaatctccaggaggt

SEQ ID NO: 8400299 - DNA, 22 bp, Homo sapiens
caggctcagctctggccagtgc

SEQ ID NO: 8400300 - DNA, 22 bp, Homo sapiens
agctgtgctgccaagttgctga

SEQ ID NO: 8400301 - DNA, 23 bp, Homo sapiens
aggcatggcatggatggtggctc

SEQ ID NO: 8400302 - DNA, 22 bp, Homo sapiens
aggcatggatggatccagggct

SEQ ID NO: 8400303 - DNA, 22 bp, Homo sapiens
aggcatggatgtagcagtgacc

SEQ ID NO: 8400304 - DNA, 22 bp, Homo sapiens
aggccagatgtcgggctagaag

SEQ ID NO: 8400305 - DNA, 17 bp, Homo sapiens
aggccagatgaggcaag

SEQ ID NO: 8400306 - DNA, 22 bp, Homo sapiens
aggctgaggtaggaggatcgct

SEQ ID NO: 8400307 - DNA, 20 bp, Homo sapiens
aggctgagggtgattgtgtc

SEQ ID NO: 8400308 - DNA, 22 bp, Homo sapiens
aggctgaggggcgagggaccct

SEQ ID NO: 8400309 - DNA, 22 bp, Homo sapiens
cccagagccgctcccctacttc

SEQ ID NO: 8400310 - DNA, 22 bp, Homo sapiens
cccagagccggtggtgctcaca

SEQ ID NO: 8400311 - DNA, 22 bp, Homo sapiens
aggctcagttctgtggtgagcc

SEQ ID NO: 8400312 - DNA, 22 bp, Homo sapiens
agggctcataattcctgacttc

SEQ ID NO: 8400313 - DNA, 22 bp, Homo sapiens
agggaggagtcctcaaagtcat

SEQ ID NO: 8400314 - DNA, 17 bp, Homo sapiens
agggagtcagaggatcg

SEQ ID NO: 8400315 - DNA, 17 bp, Homo sapiens
agggagtcagtaggagc

SEQ ID NO: 8400316 - DNA, 22 bp, Homo sapiens
agggatggatcttggccctgga

SEQ ID NO: 8400317 - DNA, 22 bp, Homo sapiens
ccctggaggaccccaatgtggc

SEQ ID NO: 8400318 - DNA, 22 bp, Homo sapiens
aggctggctggcaggggacaca

SEQ ID NO: 8400319 - DNA, 21 bp, Homo sapiens
aggcttggatctagacaggcc

SEQ ID NO: 8400320 - DNA, 23 bp, Homo sapiens
agggaagaaacatgaagggctgt

SEQ ID NO: 8400321 - DNA, 22 bp, Homo sapiens
agtaatcaatttttcggtggat

SEQ ID NO: 8400322 - DNA, 22 bp, Homo sapiens
aggtttctactgtgttaagaaa

SEQ ID NO: 8400323 - DNA, 22 bp, Homo sapiens
aggtttctcctttaaagcatgg

SEQ ID NO: 8400324 - DNA, 22 bp, Homo sapiens
agtcagagtgtgcaggccggct

SEQ ID NO: 8400325 - DNA, 22 bp, Homo sapiens
agtcagaggaatgggccaggct

SEQ ID NO: 8400326 - DNA, 19 bp, Homo sapiens
aggtgagtgtgggaaaggg

SEQ ID NO: 8400327 - DNA, 22 bp, Homo sapiens
cctgggcagggctggactctca

SEQ ID NO: 8400328 - DNA, 22 bp, Homo sapiens
cctgggcaggtgtggcttcccc

SEQ ID NO: 8400329 - DNA, 22 bp, Homo sapiens
cctggtcccattgcggctgcct

SEQ ID NO: 8400330 - DNA, 22 bp, Homo sapiens
cctggtcaggtaactgggctga

SEQ ID NO: 8400331 - DNA, 22 bp, Homo sapiens
cctgggttccagcaccctctag

SEQ ID NO: 8400332 - DNA, 22 bp, Homo sapiens
cctggtcacccctctctctgca

SEQ ID NO: 8400333 - DNA, 22 bp, Homo sapiens
cctgggtttggagcctgcagaa

SEQ ID NO: 8400334 - DNA, 22 bp, Homo sapiens
cctgggttattttggtctagtg

SEQ ID NO: 8400335 - DNA, 22 bp, Homo sapiens
aggtggagtgaaggaaaggcag

SEQ ID NO: 8400336 - DNA, 22 bp, Homo sapiens
aggtcctgtccttggtctctga

SEQ ID NO: 8400337 - DNA, 22 bp, Homo sapiens
cctggctcagtgttgaaggggt

SEQ ID NO: 8400338 - DNA, 22 bp, Homo sapiens
cctggccttaagggcagggagc

SEQ ID NO: 8400339 - DNA, 22 bp, Homo sapiens
cctggctcaaggcgaggactcc

SEQ ID NO: 8400340 - DNA, 23 bp, Homo sapiens
cctggctcaccccttatgtccag

SEQ ID NO: 8400341 - DNA, 22 bp, Homo sapiens
cctggctcagcagctctttctc

SEQ ID NO: 8400342 - DNA, 22 bp, Homo sapiens
agggtggctgagtagatggaag

SEQ ID NO: 8400343 - DNA, 22 bp, Homo sapiens
ctccagttggccccagttggtt

SEQ ID NO: 8400344 - DNA, 22 bp, Homo sapiens
agtcattttctgcctgtaatct

SEQ ID NO: 8400345 - DNA, 22 bp, Homo sapiens
agtcattttgccagtcttcagg

SEQ ID NO: 8400346 - DNA, 22 bp, Homo sapiens
agtctggatttagaggtgggcc

SEQ ID NO: 8400347 - DNA, 22 bp, Homo sapiens
agtctggacctgctgggtctcc

SEQ ID NO: 8400348 - DNA, 19 bp, Homo sapiens
ctcttacagaatagacaca

SEQ ID NO: 8400349 - DNA, 19 bp, Homo sapiens
ctcttaaattgtctcttgc

SEQ ID NO: 8400350 - DNA, 22 bp, Homo sapiens
ctgagaaaggacctcaaacagg

SEQ ID NO: 8400351 - DNA, 22 bp, Homo sapiens
agtgggagggccatatggtgaa

SEQ ID NO: 8400352 - DNA, 22 bp, Homo sapiens
agtggcaggcggagatgtagga

SEQ ID NO: 8400353 - DNA, 22 bp, Homo sapiens
cttcacacccactaaaatgatg

SEQ ID NO: 8400354 - DNA, 22 bp, Homo sapiens
cttcacacccactaggatggct

SEQ ID NO: 8400355 - DNA, 22 bp, Homo sapiens
atccttggtaagagagttggat

SEQ ID NO: 8400356 - DNA, 22 bp, Homo sapiens
atccttggcacagtggaattca

SEQ ID NO: 8400357 - DNA, 22 bp, Homo sapiens
atccttggatcctgtgttcctg

SEQ ID NO: 8400358 - DNA, 22 bp, Homo sapiens
atctcataactcatttgaagac

SEQ ID NO: 8400359 - DNA, 22 bp, Homo sapiens
cttcagttatgtgccaaggaca

SEQ ID NO: 8400360 - DNA, 22 bp, Homo sapiens
atcattctagctgttgtgttga

SEQ ID NO: 8400361 - DNA, 22 bp, Homo sapiens
ctgtgctccctctggcgccccg

SEQ ID NO: 8400362 - DNA, 22 bp, Homo sapiens
atatcacagtagttgtttagtt

SEQ ID NO: 8400363 - DNA, 22 bp, Homo sapiens
atatcacagctctttcattgct

SEQ ID NO: 8400364 - DNA, 22 bp, Homo sapiens
atatcattatgttatgagcaca

SEQ ID NO: 8400365 - DNA, 22 bp, Homo sapiens
ctgggctgtaatgtggcactga

SEQ ID NO: 8400366 - DNA, 22 bp, Homo sapiens
ctgtattcaagcttctgcccaa

SEQ ID NO: 8400367 - DNA, 22 bp, Homo sapiens
ctgggctgtcaatggccctctg

SEQ ID NO: 8400368 - DNA, 22 bp, Homo sapiens
ctggggatgggacctggcataa

SEQ ID NO: 8400369 - DNA, 22 bp, Homo sapiens
ctggaagacgtttgaagccatg

SEQ ID NO: 8400370 - DNA, 22 bp, Homo sapiens
atacagaaaatgatgcagagtt

SEQ ID NO: 8400371 - DNA, 22 bp, Homo sapiens
atagaatatgacttttagatcc

SEQ ID NO: 8400372 - DNA, 20 bp, Homo sapiens
atagtaatgaagtcttgttc

SEQ ID NO: 8400373 - DNA, 22 bp, Homo sapiens
atagtaactggcatgtttatga

SEQ ID NO: 8400374 - DNA, 22 bp, Homo sapiens
ctgccctctagggatgcactgg

SEQ ID NO: 8400375 - DNA, 22 bp, Homo sapiens
agttttctgggatcactggaat

SEQ ID NO: 8400376 - DNA, 22 bp, Homo sapiens
agttttgaaatgaaatgtagtt

SEQ ID NO: 8400377 - DNA, 22 bp, Homo sapiens
aggatgagattccagggtcaat

SEQ ID NO: 8400378 - DNA, 22 bp, Homo sapiens
acagtatatatagtctaaaagc

SEQ ID NO: 8400379 - DNA, 22 bp, Homo sapiens
acagtgtggtttgagcactggg

SEQ ID NO: 8400380 - DNA, 22 bp, Homo sapiens
agctctggttattgaagcaggg

SEQ ID NO: 8400381 - DNA, 22 bp, Homo sapiens
agctggtgtgccagttccagtt

SEQ ID NO: 8400382 - DNA, 21 bp, Homo sapiens
agctggtgtcagagctctggg

SEQ ID NO: 8400383 - DNA, 22 bp, Homo sapiens
agctggtggggaagctgcaggt

SEQ ID NO: 8400384 - DNA, 22 bp, Homo sapiens
aggaagagcatctttgggtctg

SEQ ID NO: 8400385 - DNA, 22 bp, Homo sapiens
acagggaccttggaagctggaa

SEQ ID NO: 8400386 - DNA, 22 bp, Homo sapiens
acagggacctgtgagctccata

SEQ ID NO: 8400387 - DNA, 22 bp, Homo sapiens
acattgcaattaggtacctatg

SEQ ID NO: 8400388 - DNA, 22 bp, Homo sapiens
acattgcagatgtgtttaatgt

SEQ ID NO: 8400389 - DNA, 22 bp, Homo sapiens
aggctgagctggtagtgagtac

SEQ ID NO: 8400390 - DNA, 22 bp, Homo sapiens
aggccagggtagggcccattgt

SEQ ID NO: 8400391 - DNA, 22 bp, Homo sapiens
agggggctcagcatggatggag

SEQ ID NO: 8400392 - DNA, 22 bp, Homo sapiens
acccaggaaaacatggtgcaga

SEQ ID NO: 8400393 - DNA, 21 bp, Homo sapiens
acttaaattccttgatattta

SEQ ID NO: 8400394 - DNA, 22 bp, Homo sapiens
acttctcttccccggaactcta

SEQ ID NO: 8400395 - DNA, 22 bp, Homo sapiens
atacattagtgaacaaaagaga

SEQ ID NO: 8400396 - DNA, 22 bp, Homo sapiens
atacattattgttaaagaacat

SEQ ID NO: 8400397 - DNA, 22 bp, Homo sapiens
ataaaatttgctactgttaaat

SEQ ID NO: 8400398 - DNA, 22 bp, Homo sapiens
ataaaaactgacccatcctttg

SEQ ID NO: 8400399 - DNA, 22 bp, Homo sapiens
actgtgcaaatgacaggcacac

SEQ ID NO: 8400400 - DNA, 22 bp, Homo sapiens
ataaaaactgacccatcctttg

SEQ ID NO: 8400401 - DNA, 22 bp, Homo sapiens
agaaagggttctctgaggtgct

SEQ ID NO: 8400402 - DNA, 22 bp, Homo sapiens
agaaagggctattttgaggtag

SEQ ID NO: 8400403 - DNA, 22 bp, Homo sapiens
agaaagggtcactgaaagagga

SEQ ID NO: 8400404 - DNA, 22 bp, Homo sapiens
agaaagtctgctttctggatgg

SEQ ID NO: 8400405 - DNA, 22 bp, Homo sapiens
atctcacatcctcagtagtgca

SEQ ID NO: 8400406 - DNA, 21 bp, Homo sapiens
atctcacagcccagagaagcc

SEQ ID NO: 8400407 - DNA, 22 bp, Homo sapiens
atattcttccaaaacatcattt

SEQ ID NO: 8400408 - DNA, 22 bp, Homo sapiens
agtggcagggctggctgctgca

SEQ ID NO: 8400409 - DNA, 22 bp, Homo sapiens
actagctgtgacagctgcgtgt

SEQ ID NO: 8400410 - DNA, 22 bp, Homo sapiens
aggtggctcctcccatggctgg

SEQ ID NO: 8400411 - DNA, 20 bp, Homo sapiens
aggtggctcctgctgggggt

SEQ ID NO: 8400412 - DNA, 22 bp, Homo sapiens
acgcagtttgtggacatttttt

SEQ ID NO: 8400413 - DNA, 21 bp, Homo sapiens
acctgagctccacctcctgcc

SEQ ID NO: 8400414 - DNA, 22 bp, Homo sapiens
acctgaaactcaactttatctc

SEQ ID NO: 8400415 - DNA, 22 bp, Homo sapiens
acctgaaaattattatttccgc

SEQ ID NO: 8400416 - DNA, 22 bp, Homo sapiens
acctggatgctggccttgcctt

SEQ ID NO: 8400417 - DNA, 22 bp, Homo sapiens
aggtggctatgaggatgcagtc

SEQ ID NO: 8400418 - DNA, 20 bp, Homo sapiens
acctggctctcaggagcaac

SEQ ID NO: 8400419 - DNA, 22 bp, Homo sapiens
acctggctgagaacgtgcagct

SEQ ID NO: 8400420 - DNA, 22 bp, Homo sapiens
aggtggagatcagggactaagg

SEQ ID NO: 8400421 - DNA, 22 bp, Homo sapiens
cagagggagccctccaggagca

SEQ ID NO: 8400422 - DNA, 22 bp, Homo sapiens
cagagggacagtgtaatgcata

SEQ ID NO: 8400423 - DNA, 22 bp, Homo sapiens
cagagggacagtatgatgaaag

SEQ ID NO: 8400424 - DNA, 22 bp, Homo sapiens
agccacagtctgtagccagctt

SEQ ID NO: 8400425 - DNA, 22 bp, Homo sapiens
agccacctctatcttgggctcc

SEQ ID NO: 8400426 - DNA, 22 bp, Homo sapiens
agcctctgggggagctgggagc

SEQ ID NO: 8400427 - DNA, 22 bp, Homo sapiens
cagagggagtttctgaggttgc

SEQ ID NO: 8400428 - DNA, 22 bp, Homo sapiens
cagaggtcaagatctgaagtga

SEQ ID NO: 8400429 - DNA, 22 bp, Homo sapiens
cagaggtctgacactgaatggt

SEQ ID NO: 8400430 - DNA, 22 bp, Homo sapiens
cagcagtgtctccagcatcaca

SEQ ID NO: 8400431 - DNA, 22 bp, Homo sapiens
agctcagcttcctctccatgct

SEQ ID NO: 8400432 - DNA, 20 bp, Homo sapiens
caacactgcccattgtttgc

SEQ ID NO: 8400433 - DNA, 22 bp, Homo sapiens
caaatatctttggcaaagagaa

SEQ ID NO: 8400434 - DNA, 22 bp, Homo sapiens
agcaggctgatgggcatgcttg

SEQ ID NO: 8400435 - DNA, 22 bp, Homo sapiens
cactgctacctctgcctcccgg

SEQ ID NO: 8400436 - DNA, 22 bp, Homo sapiens
cacccttcagctttcttagctc

SEQ ID NO: 8400437 - DNA, 22 bp, Homo sapiens
atttcacagctgctgttcaggt

SEQ ID NO: 8400438 - DNA, 22 bp, Homo sapiens
atttcacagctgtcagtgttac

SEQ ID NO: 8400439 - DNA, 22 bp, Homo sapiens
agaggtgacataggagaggctc

SEQ ID NO: 8400440 - DNA, 22 bp, Homo sapiens
agagggaaatccaggagtgctt

SEQ ID NO: 8400441 - DNA, 22 bp, Homo sapiens
agagcctgggcagctcctctgg

SEQ ID NO: 8400442 - DNA, 17 bp, Homo sapiens
atggctcacctgtgggc

SEQ ID NO: 8400443 - DNA, 22 bp, Homo sapiens
agagaaggaaagctgacatggg

SEQ ID NO: 8400444 - DNA, 22 bp, Homo sapiens
atctttgttgctctcatttctg

SEQ ID NO: 8400445 - DNA, 22 bp, Homo sapiens
agaagtttggtcctataaactc

SEQ ID NO: 8400446 - DNA, 20 bp, Homo sapiens
aagtttcatgctctggggat

SEQ ID NO: 8400447 - DNA, 22 bp, Homo sapiens
aagtttaacttgaattctttct

SEQ ID NO: 8400448 - DNA, 22 bp, Homo sapiens
aagttacattttggtctaattg

SEQ ID NO: 8400449 - DNA, 22 bp, Homo sapiens
aagttcaaaaatgtaatcagtg

SEQ ID NO: 8400450 - DNA, 22 bp, Homo sapiens
aagttcaagagtgacatattag

SEQ ID NO: 8400451 - DNA, 21 bp, Homo sapiens
actcccatcataactggtggg

SEQ ID NO: 8400452 - DNA, 22 bp, Homo sapiens
aatatttttgaggccctgttat

SEQ ID NO: 8400453 - DNA, 22 bp, Homo sapiens
aatcctggcatgtgccttggga

SEQ ID NO: 8400454 - DNA, 22 bp, Homo sapiens
aatcctggaatgagtttgctga

SEQ ID NO: 8400455 - DNA, 22 bp, Homo sapiens
agaagggagagaaagttggtta

SEQ ID NO: 8400456 - DNA, 22 bp, Homo sapiens
aatgagggggatgggaaagtgt

SEQ ID NO: 8400457 - DNA, 22 bp, Homo sapiens
acagtataaactcctaaaagcc

SEQ ID NO: 8400458 - DNA, 22 bp, Homo sapiens
aaggcagaaagggatgtgagtg

SEQ ID NO: 8400459 - DNA, 22 bp, Homo sapiens
acagtacagctgaaactttagt

SEQ ID NO: 8400460 - DNA, 22 bp, Homo sapiens
acaggccacagtggagtctctg

SEQ ID NO: 8400461 - DNA, 22 bp, Homo sapiens
aaggaaagacatataaatgact

SEQ ID NO: 8400462 - DNA, 22 bp, Homo sapiens
aaggaaaggatgagcatgcatt

SEQ ID NO: 8400463 - DNA, 22 bp, Homo sapiens
aaggaaagctgtggttctgaga

SEQ ID NO: 8400464 - DNA, 22 bp, Homo sapiens
aaggaaagattctctctctaga

SEQ ID NO: 8400465 - DNA, 22 bp, Homo sapiens
aaggaaagagtatgcaccttgt

SEQ ID NO: 8400466 - DNA, 22 bp, Homo sapiens
aagctgcagatgtgcctgtgga

SEQ ID NO: 8400467 - DNA, 22 bp, Homo sapiens
aaggctgcctctgccagaggag

SEQ ID NO: 8400468 - DNA, 22 bp, Homo sapiens
aaggctcttgagtggtgatagt

SEQ ID NO: 8400469 - DNA, 22 bp, Homo sapiens
aattatacattgaacaatctag

SEQ ID NO: 8400470 - DNA, 22 bp, Homo sapiens
acaaacttcccagacaagctcc

SEQ ID NO: 8400471 - DNA, 22 bp, Homo sapiens
acaaactaaaattctttattga

SEQ ID NO: 8400472 - DNA, 22 bp, Homo sapiens
acaaaattgtgttaaactttat

SEQ ID NO: 8400473 - DNA, 22 bp, Homo sapiens
acaaaattacctagttattttc

SEQ ID NO: 8400474 - DNA, 22 bp, Homo sapiens
agagctgggtgaagtgccatca

SEQ ID NO: 8400475 - DNA, 22 bp, Homo sapiens
acaagctttgtgatagtagaga

SEQ ID NO: 8400476 - DNA, 22 bp, Homo sapiens
acaaatgtctacattgagaata

SEQ ID NO: 8400477 - DNA, 22 bp, Homo sapiens
acaaatgtgattgtttctgaaa

SEQ ID NO: 8400478 - DNA, 21 bp, Homo sapiens
agcaaggcagcctctcagcct

SEQ ID NO: 8400479 - DNA, 22 bp, Homo sapiens
agccacagtcaacctgtccata

SEQ ID NO: 8400480 - DNA, 22 bp, Homo sapiens
acagataatacattgtgctaca

SEQ ID NO: 8400481 - DNA, 18 bp, Homo sapiens
agctctggggagatgggc

SEQ ID NO: 8400482 - DNA, 22 bp, Homo sapiens
agctctccacacataggactag

SEQ ID NO: 8400483 - DNA, 22 bp, Homo sapiens
agcagtgttcaatgatacactg

SEQ ID NO: 8400484 - DNA, 22 bp, Homo sapiens
acactgtgcatgcatatacaca

SEQ ID NO: 8400485 - DNA, 22 bp, Homo sapiens
agcagtgggtgacagagctgag

SEQ ID NO: 8400486 - DNA, 23 bp, Homo sapiens
aaagtgcttggcacgacacctgg

SEQ ID NO: 8400487 - DNA, 22 bp, Homo sapiens
aaaggaagatgccaggactctg

SEQ ID NO: 8400488 - DNA, 22 bp, Homo sapiens
aacaaaacatttgtcttgtttc

SEQ ID NO: 8400489 - DNA, 22 bp, Homo sapiens
aaatcctgtccatttaccagat

SEQ ID NO: 8400490 - DNA, 23 bp, Homo sapiens
aaatcctgcctcttgtatttatc

SEQ ID NO: 8400491 - DNA, 22 bp, Homo sapiens
aagcacagattgctgcatccat

SEQ ID NO: 8400492 - DNA, 23 bp, Homo sapiens
aaataggagtatctggatcatga

SEQ ID NO: 8400493 - DNA, 22 bp, Homo sapiens
aaataatcaatttttgtagata

SEQ ID NO: 8400494 - DNA, 22 bp, Homo sapiens
aaagttacccaatctctatgaa

SEQ ID NO: 8400495 - DNA, 22 bp, Homo sapiens
aaagttacacgactatttatgt

SEQ ID NO: 8400496 - DNA, 21 bp, Homo sapiens
aaagttacagtcagtgggtgc

SEQ ID NO: 8400497 - DNA, 19 bp, Homo sapiens
aaacctgttagtagagcac

SEQ ID NO: 8400498 - DNA, 22 bp, Homo sapiens
aaactctgttgagataatattt

SEQ ID NO: 8400499 - DNA, 22 bp, Homo sapiens
aaacacatcattcatgtcgtca

SEQ ID NO: 8400500 - DNA, 22 bp, Homo sapiens
aaacactttagaaagggacttg

SEQ ID NO: 8400501 - DNA, 22 bp, Homo sapiens
aaaaacacaactgtctttctct

SEQ ID NO: 8400502 - DNA, 22 bp, Homo sapiens
aaaatcttgtgacttaggaagg

SEQ ID NO: 8400503 - DNA, 22 bp, Homo sapiens
aaaatcctgctgactcgagatg

SEQ ID NO: 8400504 - DNA, 22 bp, Homo sapiens
aaactcctgcatactcagaagc

SEQ ID NO: 8400505 - DNA, 22 bp, Homo sapiens
aaactcctgggctcaagcagtt

SEQ ID NO: 8400506 - DNA, 22 bp, Homo sapiens
aaaagtatggtggtccttttta

SEQ ID NO: 8400507 - DNA, 22 bp, Homo sapiens
aaaagtattggccaccatttct

SEQ ID NO: 8400508 - DNA, 22 bp, Homo sapiens
aacaaatgacctgatttcttcc

SEQ ID NO: 8400509 - DNA, 19 bp, Homo sapiens
aacaccagagtcaggagtc

SEQ ID NO: 8400510 - DNA, 22 bp, Homo sapiens
aacaaacattacctggtgctgg

SEQ ID NO: 8400511 - DNA, 20 bp, Homo sapiens
aacaaactacaaaattatgt

SEQ ID NO: 8400512 - DNA, 22 bp, Homo sapiens
aacttacaaggatgatagctgc

SEQ ID NO: 8400513 - DNA, 22 bp, Homo sapiens
aacttacaatgttagagtctca

SEQ ID NO: 8400514 - DNA, 22 bp, Homo sapiens
aagagctggaagtgaagataac

SEQ ID NO: 8400515 - DNA, 21 bp, Homo sapiens
aagagctggatcaaggataag

SEQ ID NO: 8400516 - DNA, 17 bp, Homo sapiens
aagagaggctgagctgg

SEQ ID NO: 8400517 - DNA, 17 bp, Homo sapiens
aagagaggctgagctgg

SEQ ID NO: 8400518 - DNA, 22 bp, Homo sapiens
aagaaatattgggccttataaa

SEQ ID NO: 8400519 - DNA, 22 bp, Homo sapiens
aagcattgtaagcagaagatgc

SEQ ID NO: 8400520 - DNA, 22 bp, Homo sapiens
acactggaccatttaaacttga

SEQ ID NO: 8400521 - DNA, 22 bp, Homo sapiens
acactgggtaacatatctgtta

SEQ ID NO: 8400522 - DNA, 22 bp, Homo sapiens
acactggtaggaagagatggct

SEQ ID NO: 8400523 - DNA, 22 bp, Homo sapiens
gtacaaaagttattgcggtttt

SEQ ID NO: 8400524 - DNA, 22 bp, Homo sapiens
gtacaacatgattttactctct

SEQ ID NO: 8400525 - DNA, 22 bp, Homo sapiens
gtacaataactagtcttatagt

SEQ ID NO: 8400526 - DNA, 22 bp, Homo sapiens
gtcctggattgaacataggcag

SEQ ID NO: 8400527 - DNA, 22 bp, Homo sapiens
gtcctggaatcctagaacagtg

SEQ ID NO: 8400528 - DNA, 22 bp, Homo sapiens
gtcctggagtggcatggcatgg

SEQ ID NO: 8400529 - DNA, 22 bp, Homo sapiens
gtcctctgtagggctgggccac

SEQ ID NO: 8400530 - DNA, 22 bp, Homo sapiens
gtcctctgggcagctgccccac

SEQ ID NO: 8400531 - DNA, 22 bp, Homo sapiens
gtcactcaggctggagttcagt

SEQ ID NO: 8400532 - DNA, 22 bp, Homo sapiens
gtcaccttgaacaggctactca

SEQ ID NO: 8400533 - DNA, 22 bp, Homo sapiens
gtcacctcgctgtcttcctgag

SEQ ID NO: 8400534 - DNA, 22 bp, Homo sapiens
gtgagcagggcaggactgggga

SEQ ID NO: 8400535 - DNA, 22 bp, Homo sapiens
gtgagccagttcgactgtttct

SEQ ID NO: 8400536 - DNA, 22 bp, Homo sapiens
gtgagcagtggccagggtccta

SEQ ID NO: 8400537 - DNA, 22 bp, Homo sapiens
gtgagccattctactcctaacc

SEQ ID NO: 8400538 - DNA, 18 bp, Homo sapiens
gtgccaggaggcgcagcc

SEQ ID NO: 8400539 - DNA, 22 bp, Homo sapiens
gtgccagggagtggaggagctt

SEQ ID NO: 8400540 - DNA, 22 bp, Homo sapiens
gtgccagggagtggaggagctt

SEQ ID NO: 8400541 - DNA, 20 bp, Homo sapiens
gtgctggagttaggaaaggt

SEQ ID NO: 8400542 - DNA, 21 bp, Homo sapiens
ggttggtgtgtccagtggcca

SEQ ID NO: 8400543 - DNA, 22 bp, Homo sapiens
ggtgggtgagccctgggagctg

SEQ ID NO: 8400544 - DNA, 22 bp, Homo sapiens
ggtggggagtcaggcattcttg

SEQ ID NO: 8400545 - DNA, 19 bp, Homo sapiens
ggtggcagaacgtgggtcc

SEQ ID NO: 8400546 - DNA, 22 bp, Homo sapiens
ggtggcagaataattgaaggtc

SEQ ID NO: 8400547 - DNA, 19 bp, Homo sapiens
ggtgagccctcgcctgcct

SEQ ID NO: 8400548 - DNA, 22 bp, Homo sapiens
ggtgaggaaagatggtgacagt

SEQ ID NO: 8400549 - DNA, 22 bp, Homo sapiens
ggtggaaggcctggaaggaggc

SEQ ID NO: 8400550 - DNA, 22 bp, Homo sapiens
ggtccccgtggaggctggagcg

SEQ ID NO: 8400551 - DNA, 22 bp, Homo sapiens
gggtgtagaaagaaccctctgg

SEQ ID NO: 8400552 - DNA, 22 bp, Homo sapiens
gggttgtcaatcaaaagaaaac

SEQ ID NO: 8400553 - DNA, 22 bp, Homo sapiens
ggggaggaagctggaacacggg

SEQ ID NO: 8400554 - DNA, 22 bp, Homo sapiens
ggggaggagtgtacaggtttat

SEQ ID NO: 8400555 - DNA, 22 bp, Homo sapiens
ggggaggagccatgtaactagt

SEQ ID NO: 8400556 - DNA, 22 bp, Homo sapiens
ggggaggacctttccaaggctt

SEQ ID NO: 8400557 - DNA, 22 bp, Homo sapiens
ggggagtgttttcatgggcttg

SEQ ID NO: 8400558 - DNA, 22 bp, Homo sapiens
ggggagtgacgcagggccatag

SEQ ID NO: 8400559 - DNA, 22 bp, Homo sapiens
gggagtggtcctttcctatctg

SEQ ID NO: 8400560 - DNA, 22 bp, Homo sapiens
gggaaggcatacctgagggaga

SEQ ID NO: 8400561 - DNA, 22 bp, Homo sapiens
gggaagagtgtcggttgaagtg

SEQ ID NO: 8400562 - DNA, 18 bp, Homo sapiens
gggaagaggatctggccc

SEQ ID NO: 8400563 - DNA, 22 bp, Homo sapiens
gggaagagggagctggaatgat

SEQ ID NO: 8400564 - DNA, 22 bp, Homo sapiens
ggctgtggcagctggaagtggt

SEQ ID NO: 8400565 - DNA, 22 bp, Homo sapiens
ggctggaggagaatgggtgtga

SEQ ID NO: 8400566 - DNA, 22 bp, Homo sapiens
ggctcactgcaacctctgcctc

SEQ ID NO: 8400567 - DNA, 22 bp, Homo sapiens
ggctctctgaggaaacccttcc

SEQ ID NO: 8400568 - DNA, 22 bp, Homo sapiens
ggctcactgcaacttccgcctc

SEQ ID NO: 8400569 - DNA, 22 bp, Homo sapiens
ggccagagtctatatgcagaca

SEQ ID NO: 8400570 - DNA, 23 bp, Homo sapiens
ggaggagttcccagccctcctgg

SEQ ID NO: 8400571 - DNA, 22 bp, Homo sapiens
ggaggagtgtggggcactctgc

SEQ ID NO: 8400572 - DNA, 22 bp, Homo sapiens
ggaggatgagctacgaggagct

SEQ ID NO: 8400573 - DNA, 20 bp, Homo sapiens
gcctggcacccggggctggc

SEQ ID NO: 8400574 - DNA, 22 bp, Homo sapiens
gctcatccagcaagccagggcc

SEQ ID NO: 8400575 - DNA, 22 bp, Homo sapiens
gctctctgaggtgctggcagag

SEQ ID NO: 8400576 - DNA, 22 bp, Homo sapiens
gctctcttgacagcttgctgtt

SEQ ID NO: 8400577 - DNA, 22 bp, Homo sapiens
gctctctgcctttctcaatgac

SEQ ID NO: 8400578 - DNA, 19 bp, Homo sapiens
gctggatggatcctggagt

SEQ ID NO: 8400579 - DNA, 22 bp, Homo sapiens
gctgctgtccttcaagtctgcg

SEQ ID NO: 8400580 - DNA, 22 bp, Homo sapiens
gctgctgtctcatgcgatgcgg

SEQ ID NO: 8400581 - DNA, 22 bp, Homo sapiens
gctgctgtcagtggtggcagtt

SEQ ID NO: 8400582 - DNA, 22 bp, Homo sapiens
gctgctgtcagtggtggcagtt

SEQ ID NO: 8400583 - DNA, 22 bp, Homo sapiens
gctgctgtcagtctgaatctga

SEQ ID NO: 8400584 - DNA, 22 bp, Homo sapiens
gctgctgtccttagggagttct

SEQ ID NO: 8400585 - DNA, 22 bp, Homo sapiens
gctgctgtccttagggagttct

SEQ ID NO: 8400586 - DNA, 22 bp, Homo sapiens
gctgctgtaacactaagtgcag

SEQ ID NO: 8400587 - DNA, 22 bp, Homo sapiens
gctgctgtaatgtgttaagtca

SEQ ID NO: 8400588 - DNA, 22 bp, Homo sapiens
gctgctgtcacccacatctgtc

SEQ ID NO: 8400589 - DNA, 22 bp, Homo sapiens
gctgctgtacttggggggtgct

SEQ ID NO: 8400590 - DNA, 22 bp, Homo sapiens
gctgctgtcacggtgctaaggg

SEQ ID NO: 8400591 - DNA, 22 bp, Homo sapiens
gctgctgtcagcaggccttgtt

SEQ ID NO: 8400592 - DNA, 22 bp, Homo sapiens
gctgtgtggctgtgccgtcacg

SEQ ID NO: 8400593 - DNA, 19 bp, Homo sapiens
gctgtgtgaccttgggcaa

SEQ ID NO: 8400594 - DNA, 22 bp, Homo sapiens
ggaaggaggggcaaagcagttc

SEQ ID NO: 8400595 - DNA, 22 bp, Homo sapiens
ggaaggaggatgctctggcctt

SEQ ID NO: 8400596 - DNA, 22 bp, Homo sapiens
ggaaggctttgtagaagtgcca

SEQ ID NO: 8400597 - DNA, 22 bp, Homo sapiens
ggagccaggggaccttcacaga

SEQ ID NO: 8400598 - DNA, 22 bp, Homo sapiens
ggagcctggtatagtgttgcat

SEQ ID NO: 8400599 - DNA, 22 bp, Homo sapiens
gcacagagagggaaggtaactt

SEQ ID NO: 8400600 - DNA, 22 bp, Homo sapiens
gcacagagtcactagctaagca

SEQ ID NO: 8400601 - DNA, 22 bp, Homo sapiens
gcacagatggtactagcttggt

SEQ ID NO: 8400602 - DNA, 22 bp, Homo sapiens
gcagagtcccagcaggtggtgg

SEQ ID NO: 8400603 - DNA, 22 bp, Homo sapiens
gcagaaggcctcttggttaata

SEQ ID NO: 8400604 - DNA, 22 bp, Homo sapiens
gcagcagaaggccaaggggagc

SEQ ID NO: 8400605 - DNA, 21 bp, Homo sapiens
gcagggtttgtgctgtgagtt

SEQ ID NO: 8400606 - DNA, 22 bp, Homo sapiens
gcaggccagctgtgcagatggg

SEQ ID NO: 8400607 - DNA, 22 bp, Homo sapiens
gcaggccattcaggagatgtgc

SEQ ID NO: 8400608 - DNA, 22 bp, Homo sapiens
gccaggcgggtctcaaactcct

SEQ ID NO: 8400609 - DNA, 22 bp, Homo sapiens
gccaggctccaggccctcctga

SEQ ID NO: 8400610 - DNA, 22 bp, Homo sapiens
gcagttttattatgatggaaat

SEQ ID NO: 8400611 - DNA, 18 bp, Homo sapiens
gccaccctcctcgtctcc

SEQ ID NO: 8400612 - DNA, 22 bp, Homo sapiens
gccaccctggaccaccctgggc

SEQ ID NO: 8400613 - DNA, 22 bp, Homo sapiens
gcattgcaggtgtacccagtta

SEQ ID NO: 8400614 - DNA, 22 bp, Homo sapiens
gcattgcaaaaagcagcttgat

SEQ ID NO: 8400615 - DNA, 22 bp, Homo sapiens
gcattgcaactgacagatcatt

SEQ ID NO: 8400616 - DNA, 22 bp, Homo sapiens
gccctagcccgggccacctgtt

SEQ ID NO: 8400617 - DNA, 23 bp, Homo sapiens
gttgaagtggtcggggaggcaga

SEQ ID NO: 8400618 - DNA, 22 bp, Homo sapiens
gttgaagtttatatgagtgctt

SEQ ID NO: 8400619 - DNA, 20 bp, Homo sapiens
gttttaaggcacaggccttt

SEQ ID NO: 8400620 - DNA, 22 bp, Homo sapiens
gtttcacagggccatggaggaa

SEQ ID NO: 8400621 - DNA, 21 bp, Homo sapiens
gttttaagggagaaaacctag

SEQ ID NO: 8400622 - DNA, 22 bp, Homo sapiens
taatatatacctttgttaggaa

SEQ ID NO: 8400623 - DNA, 22 bp, Homo sapiens
taatatatacctttgttaggaa

SEQ ID NO: 8400624 - DNA, 22 bp, Homo sapiens
taatataccaaactgtaatttt

SEQ ID NO: 8400625 - DNA, 22 bp, Homo sapiens
taatatacttcccatagtttga

SEQ ID NO: 8400626 - DNA, 22 bp, Homo sapiens
taatatctacttcatagagttt

SEQ ID NO: 8400627 - DNA, 22 bp, Homo sapiens
taatcctgtcttgaccatcagg

SEQ ID NO: 8400628 - DNA, 22 bp, Homo sapiens
taccaggaattattttacattt

SEQ ID NO: 8400629 - DNA, 22 bp, Homo sapiens
tactcctgctgatcctgccagc

SEQ ID NO: 8400630 - DNA, 22 bp, Homo sapiens
tcaaataggcttgtagtgactg

SEQ ID NO: 8400631 - DNA, 22 bp, Homo sapiens
tatttggaatagcttgctaatg

SEQ ID NO: 8400632 - DNA, 22 bp, Homo sapiens
tatttggaaacaattcacatgc

SEQ ID NO: 8400633 - DNA, 22 bp, Homo sapiens
tattacaatttacattgcactt

SEQ ID NO: 8400634 - DNA, 22 bp, Homo sapiens
tattgtcacgtcttaattctag

SEQ ID NO: 8400635 - DNA, 22 bp, Homo sapiens
tatttaaaataagccccagtgg

SEQ ID NO: 8400636 - DNA, 22 bp, Homo sapiens
tatttaaaatagtgctccagca

SEQ ID NO: 8400637 - DNA, 22 bp, Homo sapiens
tatttaaaaagaggccagctgg

SEQ ID NO: 8400638 - DNA, 22 bp, Homo sapiens
taggggaggggatcatgtgctg

SEQ ID NO: 8400639 - DNA, 22 bp, Homo sapiens
taggggaggccaggaagtttta

SEQ ID NO: 8400640 - DNA, 22 bp, Homo sapiens
taggggaactggcacagggcag

SEQ ID NO: 8400641 - DNA, 22 bp, Homo sapiens
tagttacaaaccaacaggcagc

SEQ ID NO: 8400642 - DNA, 22 bp, Homo sapiens
tagttacaattatgcatggaaa

SEQ ID NO: 8400643 - DNA, 22 bp, Homo sapiens
tagttacaatgggttctgtgac

SEQ ID NO: 8400644 - DNA, 22 bp, Homo sapiens
tagttacataaagtggactgtt

SEQ ID NO: 8400645 - DNA, 22 bp, Homo sapiens
taggccagattactagagtagg

SEQ ID NO: 8400646 - DNA, 22 bp, Homo sapiens
taggccagattgttatccatgg

SEQ ID NO: 8400647 - DNA, 22 bp, Homo sapiens
taggccagcccttagtcctgtc

SEQ ID NO: 8400648 - DNA, 22 bp, Homo sapiens
taggccaggaatcagcaagctt

SEQ ID NO: 8400649 - DNA, 23 bp, Homo sapiens
taggccagggtgacctggggaga

SEQ ID NO: 8400650 - DNA, 22 bp, Homo sapiens
taggccagtaaaatgtttcagt

SEQ ID NO: 8400651 - DNA, 18 bp, Homo sapiens
taggccagtatacttttc

SEQ ID NO: 8400652 - DNA, 22 bp, Homo sapiens
taggccagtggcaggttgtgtg

SEQ ID NO: 8400653 - DNA, 22 bp, Homo sapiens
taggccaggacagagcttccag

SEQ ID NO: 8400654 - DNA, 22 bp, Homo sapiens
taggccaggagtcagacagatt

SEQ ID NO: 8400655 - DNA, 22 bp, Homo sapiens
tagggctgtttaaaagtgaggt

SEQ ID NO: 8400656 - DNA, 22 bp, Homo sapiens
taggccagttggtggccctgga

SEQ ID NO: 8400657 - DNA, 22 bp, Homo sapiens
tagagaggccgcgggtcccctc

SEQ ID NO: 8400658 - DNA, 22 bp, Homo sapiens
tcaacccttcctccatatttcc

SEQ ID NO: 8400659 - DNA, 21 bp, Homo sapiens
tcaacccttgcgtcaccaagc

SEQ ID NO: 8400660 - DNA, 22 bp, Homo sapiens
tcactgcaacctccacctcccg

SEQ ID NO: 8400661 - DNA, 22 bp, Homo sapiens
tcactgcaacctccacctcccg

SEQ ID NO: 8400662 - DNA, 22 bp, Homo sapiens
tcagaaaatgaaatggactctc

SEQ ID NO: 8400663 - DNA, 22 bp, Homo sapiens
tcagcatgtacttctcctccat

SEQ ID NO: 8400664 - DNA, 22 bp, Homo sapiens
tcatttctctgagtctgataat

SEQ ID NO: 8400665 - DNA, 22 bp, Homo sapiens
tcatttctccgacctgctgtcc

SEQ ID NO: 8400666 - DNA, 23 bp, Homo sapiens
tcattgtgactgtgccacataac

SEQ ID NO: 8400667 - DNA, 22 bp, Homo sapiens
tccaaagagcttaggagagaaa

SEQ ID NO: 8400668 - DNA, 22 bp, Homo sapiens
tcctgcagacatttacaccttt

SEQ ID NO: 8400669 - DNA, 19 bp, Homo sapiens
tcctgcagaccagacctgt

SEQ ID NO: 8400670 - DNA, 22 bp, Homo sapiens
tcctgcagagacagaggcctca

SEQ ID NO: 8400671 - DNA, 22 bp, Homo sapiens
tcctgcagtctgcactctgcct

SEQ ID NO: 8400672 - DNA, 22 bp, Homo sapiens
tcctgcagctgcagacctgggg

SEQ ID NO: 8400673 - DNA, 20 bp, Homo sapiens
tcctgagatttaaggggttc

SEQ ID NO: 8400674 - DNA, 22 bp, Homo sapiens
tcctgagatgtggagctccatg

SEQ ID NO: 8400675 - DNA, 22 bp, Homo sapiens
tcctctgggctccctgcaacag

SEQ ID NO: 8400676 - DNA, 22 bp, Homo sapiens
tcctcttcaaaaggatttcctt

SEQ ID NO: 8400677 - DNA, 22 bp, Homo sapiens
tcctctggttatacttgcaccc

SEQ ID NO: 8400678 - DNA, 22 bp, Homo sapiens
tcctcttcaaaatagctctgaa

SEQ ID NO: 8400679 - DNA, 22 bp, Homo sapiens
tcctcttcagagggacctcggg

SEQ ID NO: 8400680 - DNA, 22 bp, Homo sapiens
tcctcttctgcctatatctgcc

SEQ ID NO: 8400681 - DNA, 22 bp, Homo sapiens
tcctcttctgtggattccctga

SEQ ID NO: 8400682 - DNA, 22 bp, Homo sapiens
tcctgaaggcctgagttccacc

SEQ ID NO: 8400683 - DNA, 22 bp, Homo sapiens
tccatggagatggatgactgta

SEQ ID NO: 8400684 - DNA, 22 bp, Homo sapiens
tcctagttctctgccagtcgct

SEQ ID NO: 8400685 - DNA, 22 bp, Homo sapiens
tcctagttctctgccagtcgct

SEQ ID NO: 8400686 - DNA, 23 bp, Homo sapiens
tcctcagcatgttttgtcatgta

SEQ ID NO: 8400687 - DNA, 22 bp, Homo sapiens
tccgtggagattttgtgcaggg

SEQ ID NO: 8400688 - DNA, 22 bp, Homo sapiens
tccctgggaccggcagctcaca

SEQ ID NO: 8400689 - DNA, 20 bp, Homo sapiens
tccctggaggtggtggcatc

SEQ ID NO: 8400690 - DNA, 22 bp, Homo sapiens
tccctggacaacagacttcact

SEQ ID NO: 8400691 - DNA, 22 bp, Homo sapiens
tccctgagagcactggggagcc

SEQ ID NO: 8400692 - DNA, 22 bp, Homo sapiens
tccctcagcttgtctccatgca

SEQ ID NO: 8400693 - DNA, 23 bp, Homo sapiens
tccctcaggccttatctccatct

SEQ ID NO: 8400694 - DNA, 20 bp, Homo sapiens
tccctcagcacttctacctc

SEQ ID NO: 8400695 - DNA, 22 bp, Homo sapiens
tccctcagcaggaatgtggcag

SEQ ID NO: 8400696 - DNA, 22 bp, Homo sapiens
tccctcagcaggaactggcctg

SEQ ID NO: 8400697 - DNA, 22 bp, Homo sapiens
gaagaaggtggcccaggggtag

SEQ ID NO: 8400698 - DNA, 22 bp, Homo sapiens
gaagaaggtgctacacagggca

SEQ ID NO: 8400699 - DNA, 22 bp, Homo sapiens
gaatgcagtggtgagatcttgg

SEQ ID NO: 8400700 - DNA, 22 bp, Homo sapiens
gaatgcagctgacagtcgtttt

SEQ ID NO: 8400701 - DNA, 22 bp, Homo sapiens
gacctggaatttgtgtgtgttc

SEQ ID NO: 8400702 - DNA, 22 bp, Homo sapiens
gagcaaagcttttagggccttt

SEQ ID NO: 8400703 - DNA, 22 bp, Homo sapiens
gagcaggaaggccagaagggtc

SEQ ID NO: 8400704 - DNA, 22 bp, Homo sapiens
gagcagagcttctcaaagtaaa

SEQ ID NO: 8400705 - DNA, 22 bp, Homo sapiens
gagaaggaagttgagccagcat

SEQ ID NO: 8400706 - DNA, 22 bp, Homo sapiens
gagaactaatcatgcatggagt

SEQ ID NO: 8400707 - DNA, 22 bp, Homo sapiens
gaggagagaacattcctccata

SEQ ID NO: 8400708 - DNA, 22 bp, Homo sapiens
gaggacatagtggactagggtt

SEQ ID NO: 8400709 - DNA, 22 bp, Homo sapiens
gaggccagaagtctgagatcag

SEQ ID NO: 8400710 - DNA, 22 bp, Homo sapiens
gaggccagaatgagctgaatgc

SEQ ID NO: 8400711 - DNA, 22 bp, Homo sapiens
gaggccagaagtgcctcgggct

SEQ ID NO: 8400712 - DNA, 22 bp, Homo sapiens
gaggccagatactctcttctgc

SEQ ID NO: 8400713 - DNA, 22 bp, Homo sapiens
gaggccagaatgagtctctggg

SEQ ID NO: 8400714 - DNA, 22 bp, Homo sapiens
gaggccagactgccttttatga

SEQ ID NO: 8400715 - DNA, 22 bp, Homo sapiens
gaggccagagttccccgagtca

SEQ ID NO: 8400716 - DNA, 22 bp, Homo sapiens
gagggtggaagagctgctgaga

SEQ ID NO: 8400717 - DNA, 22 bp, Homo sapiens
gagggtggcctttagagcccat

SEQ ID NO: 8400718 - DNA, 22 bp, Homo sapiens
gagggtctcttaatgccagggg

SEQ ID NO: 8400719 - DNA, 22 bp, Homo sapiens
gagggtggggaatagactgcta

SEQ ID NO: 8400720 - DNA, 22 bp, Homo sapiens
gagggtgggtacaccagccctc

SEQ ID NO: 8400721 - DNA, 22 bp, Homo sapiens
gaggtggctggctcagagccag

SEQ ID NO: 8400722 - DNA, 22 bp, Homo sapiens
gaggtggctgcttgctgggaaa

SEQ ID NO: 8400723 - DNA, 18 bp, Homo sapiens
gaggtggctgggccatct

SEQ ID NO: 8400724 - DNA, 22 bp, Homo sapiens
gaggctggggtctgcctttctg

SEQ ID NO: 8400725 - DNA, 22 bp, Homo sapiens
gaggctggttcccttgatcttt

SEQ ID NO: 8400726 - DNA, 22 bp, Homo sapiens
cttcttccaagcttatgctcaa

SEQ ID NO: 8400727 - DNA, 22 bp, Homo sapiens
cttcttcctgaaagctggctct

SEQ ID NO: 8400728 - DNA, 22 bp, Homo sapiens
cttcttcctgctgcagcctcca

SEQ ID NO: 8400729 - DNA, 22 bp, Homo sapiens
ctttccagatttgtccagttat

SEQ ID NO: 8400730 - DNA, 22 bp, Homo sapiens
ctttccagacctccttgtagct

SEQ ID NO: 8400731 - DNA, 22 bp, Homo sapiens
cttcttcaagagaatgggagac

SEQ ID NO: 8400732 - DNA, 22 bp, Homo sapiens
gaagaagggagtgacaaatgca

SEQ ID NO: 8400733 - DNA, 22 bp, Homo sapiens
gaaatattgggactcagagctt

SEQ ID NO: 8400734 - DNA, 22 bp, Homo sapiens
gaaatattgtactggagatgtt

SEQ ID NO: 8400735 - DNA, 22 bp, Homo sapiens
gaaatattacagtggaggggat

SEQ ID NO: 8400736 - DNA, 22 bp, Homo sapiens
gaaatattcttgtcttgttttc

SEQ ID NO: 8400737 - DNA, 22 bp, Homo sapiens
ctggtgtttatctgactgccta

SEQ ID NO: 8400738 - DNA, 22 bp, Homo sapiens
ctggtgtggcggcgccctgtag

SEQ ID NO: 8400739 - DNA, 22 bp, Homo sapiens
ctggtcacctccttcccagcta

SEQ ID NO: 8400740 - DNA, 22 bp, Homo sapiens
ctgggttgatctcagccctaag

SEQ ID NO: 8400741 - DNA, 22 bp, Homo sapiens
ctgggttgccctgggcctgtga

SEQ ID NO: 8400742 - DNA, 22 bp, Homo sapiens
ctgggttgcaaagcgctggctg

SEQ ID NO: 8400743 - DNA, 22 bp, Homo sapiens
ctgggttggggttacatgactg

SEQ ID NO: 8400744 - DNA, 22 bp, Homo sapiens
ctgggtttagggtctccccttg

SEQ ID NO: 8400745 - DNA, 22 bp, Homo sapiens
ctggggtgtctcgtctgccatt

SEQ ID NO: 8400746 - DNA, 22 bp, Homo sapiens
ctgggggcaatggtcagagtgt

SEQ ID NO: 8400747 - DNA, 22 bp, Homo sapiens
ctgggatgtctatagaacactt

SEQ ID NO: 8400748 - DNA, 22 bp, Homo sapiens
ctgggagtgttctaggtcacat

SEQ ID NO: 8400749 - DNA, 22 bp, Homo sapiens
ctgggagttgacgaggcttgta

SEQ ID NO: 8400750 - DNA, 22 bp, Homo sapiens
ctgtgacagtttctcagaattt

SEQ ID NO: 8400751 - DNA, 22 bp, Homo sapiens
ctgtgacagtttctcagacttt

SEQ ID NO: 8400752 - DNA, 22 bp, Homo sapiens
ctgtccctcatcacctctgggt

SEQ ID NO: 8400753 - DNA, 19 bp, Homo sapiens
ctgtcccagactctgctct

SEQ ID NO: 8400754 - DNA, 22 bp, Homo sapiens
ctgtgggagggaaggcgcggcc

SEQ ID NO: 8400755 - DNA, 22 bp, Homo sapiens
ctgtgggagcactggggaccga

SEQ ID NO: 8400756 - DNA, 22 bp, Homo sapiens
ctgtgtgtgctacaggcttcca

SEQ ID NO: 8400757 - DNA, 22 bp, Homo sapiens
ccttcagcgtcccctttacccg

SEQ ID NO: 8400758 - DNA, 22 bp, Homo sapiens
ccttcaagttcctggtccctgg

SEQ ID NO: 8400759 - DNA, 22 bp, Homo sapiens
ccttgcctcattgtgcttctcc

SEQ ID NO: 8400760 - DNA, 22 bp, Homo sapiens
ccttaaattctccatttgaaag

SEQ ID NO: 8400761 - DNA, 22 bp, Homo sapiens
ttaaattccagcctcataatag

SEQ ID NO: 8400762 - DNA, 22 bp, Homo sapiens
cgctgcacgtgtcacactaacc

SEQ ID NO: 8400763 - DNA, 22 bp, Homo sapiens
cgagagttagctaggagtcaca

SEQ ID NO: 8400764 - DNA, 22 bp, Homo sapiens
ccttttgaaggtgttgttaagt

SEQ ID NO: 8400765 - DNA, 22 bp, Homo sapiens
cgggaggaaaggcgaggctctg

SEQ ID NO: 8400766 - DNA, 17 bp, Homo sapiens
cgtgtgcttgtgtgcac

SEQ ID NO: 8400767 - DNA, 22 bp, Homo sapiens
ctcagaggcaagcaaggagctg

SEQ ID NO: 8400768 - DNA, 22 bp, Homo sapiens
ctcagtcatgacgctcaggacc

SEQ ID NO: 8400769 - DNA, 22 bp, Homo sapiens
ttggaagcgagcacatggagga

SEQ ID NO: 8400770 - DNA, 22 bp, Homo sapiens
ttggaagccctgtgataggcca

SEQ ID NO: 8400771 - DNA, 23 bp, Homo sapiens
ttggaagccagacagctgtgcag

SEQ ID NO: 8400772 - DNA, 22 bp, Homo sapiens
ctccagcctcatctcctggctg

SEQ ID NO: 8400773 - DNA, 22 bp, Homo sapiens
ctccagagggtcagactctgag

SEQ ID NO: 8400774 - DNA, 22 bp, Homo sapiens
ctccagaggcgacttgcatcac

SEQ ID NO: 8400775 - DNA, 17 bp, Homo sapiens
ttggctctattgcctct

SEQ ID NO: 8400776 - DNA, 22 bp, Homo sapiens
ctccagaggttctcatctggga

SEQ ID NO: 8400777 - DNA, 22 bp, Homo sapiens
ctccagagtcacactgcctggg

SEQ ID NO: 8400778 - DNA, 22 bp, Homo sapiens
ttgccctggggctggcctggca

SEQ ID NO: 8400779 - DNA, 22 bp, Homo sapiens
ctctctgtggtggctgtcccat

SEQ ID NO: 8400780 - DNA, 22 bp, Homo sapiens
tttcagaaattatattagatgc

SEQ ID NO: 8400781 - DNA, 22 bp, Homo sapiens
tttcagaaccaagagagacatc

SEQ ID NO: 8400782 - DNA, 22 bp, Homo sapiens
tttcagaaccgctaaaataaat

SEQ ID NO: 8400783 - DNA, 22 bp, Homo sapiens
tttcagaaggggagaaaggtca

SEQ ID NO: 8400784 - DNA, 22 bp, Homo sapiens
tttcagaagtcaactaggtaaa

SEQ ID NO: 8400785 - DNA, 22 bp, Homo sapiens
tttcagaatagcaaagcaagct

SEQ ID NO: 8400786 - DNA, 23 bp, Homo sapiens
tttcagaagtggtcctaggaagc

SEQ ID NO: 8400787 - DNA, 22 bp, Homo sapiens
ttttgcctgagagtgaaaataa

SEQ ID NO: 8400788 - DNA, 22 bp, Homo sapiens
ctctgggtgttaatgtcagtgt

SEQ ID NO: 8400789 - DNA, 22 bp, Homo sapiens
tttgttcattagtacagttgta

SEQ ID NO: 8400790 - DNA, 17 bp, Homo sapiens
ctctgggtctcctgctt

SEQ ID NO: 8400791 - DNA, 22 bp, Homo sapiens
ctctgggtctataatgcagctg

SEQ ID NO: 8400792 - DNA, 22 bp, Homo sapiens
ctctgggtctacctgtggccag

SEQ ID NO: 8400793 - DNA, 20 bp, Homo sapiens
ctctgggtcgagacagactt

SEQ ID NO: 8400794 - DNA, 22 bp, Homo sapiens
ctctgggtgcagcgctgaccgg

SEQ ID NO: 8400795 - DNA, 22 bp, Homo sapiens
ctctgggtgggcagcagatgga

SEQ ID NO: 8400796 - DNA, 22 bp, Homo sapiens
ctctgggtggtctcactgagtg

SEQ ID NO: 8400797 - DNA, 23 bp, Homo sapiens
ctctgggtccgatgtcctgacag

SEQ ID NO: 8400798 - DNA, 22 bp, Homo sapiens
tttggaagtcctgaaatagagg

SEQ ID NO: 8400799 - DNA, 22 bp, Homo sapiens
ctctgaggtctaggaccatggc

SEQ ID NO: 8400800 - DNA, 22 bp, Homo sapiens
ctgctctgaccctttcaccttc

SEQ ID NO: 8400801 - DNA, 22 bp, Homo sapiens
ctgctgggtctatgcaagtgga

SEQ ID NO: 8400802 - DNA, 22 bp, Homo sapiens
ctgctgggtccccctgctgatt

SEQ ID NO: 8400803 - DNA, 22 bp, Homo sapiens
ctggaagaggaagccagctgga

SEQ ID NO: 8400804 - DNA, 22 bp, Homo sapiens
ctggaagaggacacacgaatca

SEQ ID NO: 8400805 - DNA, 22 bp, Homo sapiens
ctggaagagtcctaaacagata

SEQ ID NO: 8400806 - DNA, 22 bp, Homo sapiens
tgctttcacctgtttgcaccca

SEQ ID NO: 8400807 - DNA, 22 bp, Homo sapiens
tgctttcacatgtatgcacaaa

SEQ ID NO: 8400808 - DNA, 22 bp, Homo sapiens
tgctttcacaccatgcctataa

SEQ ID NO: 8400809 - DNA, 22 bp, Homo sapiens
cccgtcccttttgcccgctggt

SEQ ID NO: 8400810 - DNA, 22 bp, Homo sapiens
ccctggagctagtctgagcaga

SEQ ID NO: 8400811 - DNA, 23 bp, Homo sapiens
ccctggagctagtctgagcagag

SEQ ID NO: 8400812 - DNA, 22 bp, Homo sapiens
ccctgtctgtaccgtgatgagc

SEQ ID NO: 8400813 - DNA, 22 bp, Homo sapiens
ccctggaggaagaaacaatggc

SEQ ID NO: 8400814 - DNA, 22 bp, Homo sapiens
cctcacccagtcacctaggtgg

SEQ ID NO: 8400815 - DNA, 22 bp, Homo sapiens
tggctcagcgcggcctggtctt

SEQ ID NO: 8400816 - DNA, 22 bp, Homo sapiens
cctgctgtgtccctggctttct

SEQ ID NO: 8400817 - DNA, 22 bp, Homo sapiens
tgggtagtttcccctgccctgc

SEQ ID NO: 8400818 - DNA, 22 bp, Homo sapiens
cctgctgtccctctgggctcca

SEQ ID NO: 8400819 - DNA, 22 bp, Homo sapiens
cctgctgtgaaactggcatatg

SEQ ID NO: 8400820 - DNA, 22 bp, Homo sapiens
cctgctgtcagcatcctcgcga

SEQ ID NO: 8400821 - DNA, 22 bp, Homo sapiens
cctcttctgcttcaggagcact

SEQ ID NO: 8400822 - DNA, 22 bp, Homo sapiens
cctcttctgagtgagactccct

SEQ ID NO: 8400823 - DNA, 22 bp, Homo sapiens
tggctctcaggcctgctgcgtt

SEQ ID NO: 8400824 - DNA, 20 bp, Homo sapiens
tggctctctctagtaagtgg

SEQ ID NO: 8400825 - DNA, 22 bp, Homo sapiens
cccaagatctttcgtgcactaa

SEQ ID NO: 8400826 - DNA, 22 bp, Homo sapiens
tgaggacattgagactggagac

SEQ ID NO: 8400827 - DNA, 22 bp, Homo sapiens
tgaggacatgagtgggacagag

SEQ ID NO: 8400828 - DNA, 22 bp, Homo sapiens
tgaggaatgttttgagtgccga

SEQ ID NO: 8400829 - DNA, 22 bp, Homo sapiens
tgaggaatgctgagcagaggaa

SEQ ID NO: 8400830 - DNA, 20 bp, Homo sapiens
tgaagaggaagaggacggcc

SEQ ID NO: 8400831 - DNA, 22 bp, Homo sapiens
tgaagatctgtcaaccccatat

SEQ ID NO: 8400832 - DNA, 19 bp, Homo sapiens
tgaaggacagtgcacatca

SEQ ID NO: 8400833 - DNA, 22 bp, Homo sapiens
tatttgaaagtgtacaaaaact

SEQ ID NO: 8400834 - DNA, 22 bp, Homo sapiens
cagggtggggaaatagcgccct

SEQ ID NO: 8400835 - DNA, 22 bp, Homo sapiens
cagtggctgtttctggaaggca

SEQ ID NO: 8400836 - DNA, 22 bp, Homo sapiens
cagtggcttcttcctagagcca

SEQ ID NO: 8400837 - DNA, 22 bp, Homo sapiens
cagtgggacatgggcactgggc

SEQ ID NO: 8400838 - DNA, 22 bp, Homo sapiens
cagtttatagctctagcagctt

SEQ ID NO: 8400839 - DNA, 22 bp, Homo sapiens
cagggctcaggaaatcagacgt

SEQ ID NO: 8400840 - DNA, 22 bp, Homo sapiens
caggggaagatgccaagggaga

SEQ ID NO: 8400841 - DNA, 22 bp, Homo sapiens
tagcgttttgtaatcaagtatg

SEQ ID NO: 8400842 - DNA, 19 bp, Homo sapiens
tagaggagaagggaagtgg

SEQ ID NO: 8400843 - DNA, 22 bp, Homo sapiens
tagagctgggcagtgctctgag

SEQ ID NO: 8400844 - DNA, 22 bp, Homo sapiens
gtgaggggccaagagtagggca

SEQ ID NO: 8400845 - DNA, 22 bp, Homo sapiens
gtgaggggtggctgagcagttt

SEQ ID NO: 8400846 - DNA, 19 bp, Homo sapiens
tagaatagttacacagatt

SEQ ID NO: 8400847 - DNA, 22 bp, Homo sapiens
tagaatatacactacagcttaa

SEQ ID NO: 8400848 - DNA, 22 bp, Homo sapiens
caggctggagtgcagtggcgcc

SEQ ID NO: 8400849 - DNA, 22 bp, Homo sapiens
caggctggagtgcagtggcgct

SEQ ID NO: 8400850 - DNA, 22 bp, Homo sapiens
caggctggagtgcagtggggcg

SEQ ID NO: 8400851 - DNA, 22 bp, Homo sapiens
caggctgcctggaagaggactg

SEQ ID NO: 8400852 - DNA, 22 bp, Homo sapiens
tcatttatcgctgccttttaaa

SEQ ID NO: 8400853 - DNA, 22 bp, Homo sapiens
tcattctgcatcactcttgctc

SEQ ID NO: 8400854 - DNA, 22 bp, Homo sapiens
tccagcccagctgtccccttca

SEQ ID NO: 8400855 - DNA, 22 bp, Homo sapiens
tccagccctgtgtctgggagag

SEQ ID NO: 8400856 - DNA, 22 bp, Homo sapiens
tccagccctgtggcttccaccc

SEQ ID NO: 8400857 - DNA, 19 bp, Homo sapiens
tccagccctgttccctttt

SEQ ID NO: 8400858 - DNA, 22 bp, Homo sapiens
tcctcaggatctaggagtgctt

SEQ ID NO: 8400859 - DNA, 22 bp, Homo sapiens
tccctcactggttctgcatccc

SEQ ID NO: 8400860 - DNA, 22 bp, Homo sapiens
cattgcacatctgagaagagat

SEQ ID NO: 8400861 - DNA, 22 bp, Homo sapiens
cattcagtcatgctggttttga

SEQ ID NO: 8400862 - DNA, 22 bp, Homo sapiens
cattcagagctttcttatcata

SEQ ID NO: 8400863 - DNA, 21 bp, Homo sapiens
tcccactctaaatggactgaa

SEQ ID NO: 8400864 - DNA, 22 bp, Homo sapiens
tctccctcattcctgcttccat

SEQ ID NO: 8400865 - DNA, 22 bp, Homo sapiens
tctccctctttgtctgctttgg

SEQ ID NO: 8400866 - DNA, 22 bp, Homo sapiens
tctccgatcacaggttttcaat

SEQ ID NO: 8400867 - DNA, 18 bp, Homo sapiens
tcctttcaccccttctct

SEQ ID NO: 8400868 - DNA, 22 bp, Homo sapiens
ccacccttccattcttcctctt

SEQ ID NO: 8400869 - DNA, 19 bp, Homo sapiens
ccacatggctggatgacag

SEQ ID NO: 8400870 - DNA, 23 bp, Homo sapiens
ccacatggcaagatgatgcattc

SEQ ID NO: 8400871 - DNA, 22 bp, Homo sapiens
tctctgttcatggcactatgtc

SEQ ID NO: 8400872 - DNA, 22 bp, Homo sapiens
ccagccctcactgaggcctctc

SEQ ID NO: 8400873 - DNA, 19 bp, Homo sapiens
tctctgcagcgcgcccggc

SEQ ID NO: 8400874 - DNA, 22 bp, Homo sapiens
tctctcttgtcaccccatctgc

SEQ ID NO: 8400875 - DNA, 22 bp, Homo sapiens
tctctgagttctcctccagccc

SEQ ID NO: 8400876 - DNA, 23 bp, Homo sapiens
tctcctggctgcactgtggccac

SEQ ID NO: 8400877 - DNA, 22 bp, Homo sapiens
tttgtaaagtctgttctgagtt

SEQ ID NO: 8400878 - DNA, 22 bp, Homo sapiens
ttttctgaagtttaagacattt

SEQ ID NO: 8400879 - DNA, 22 bp, Homo sapiens
ttttcattgttcctcgagcatt

SEQ ID NO: 8400880 - DNA, 22 bp, Homo sapiens
ttttcattgtaaatcaggaaac

SEQ ID NO: 8400881 - DNA, 22 bp, Homo sapiens
ttttcacacaaggtgataagtt

SEQ ID NO: 8400882 - DNA, 22 bp, Homo sapiens
tttgatccgttgctggtgagga

SEQ ID NO: 8400883 - DNA, 18 bp, Homo sapiens
tttgctttccttcttcag

SEQ ID NO: 8400884 - DNA, 22 bp, Homo sapiens
tttggaaatttcatcaatagcc

SEQ ID NO: 8400885 - DNA, 22 bp, Homo sapiens
tttgcttttgtgctctagtggt

SEQ ID NO: 8400886 - DNA, 22 bp, Homo sapiens
tttgacagacatttactacatt

SEQ ID NO: 8400887 - DNA, 22 bp, Homo sapiens
tttccctctgtgccagcttctc

SEQ ID NO: 8400888 - DNA, 22 bp, Homo sapiens
tttcacagatataagatttcac

SEQ ID NO: 8400889 - DNA, 22 bp, Homo sapiens
tttcaagactcattgagtattg

SEQ ID NO: 8400890 - DNA, 22 bp, Homo sapiens
tttcacagctagtgagcttcta

SEQ ID NO: 8400891 - DNA, 22 bp, Homo sapiens
tttcagaaagctgaacatatga

SEQ ID NO: 8400892 - DNA, 22 bp, Homo sapiens
tttcagaaatggcactgaaatc

SEQ ID NO: 8400893 - DNA, 22 bp, Homo sapiens
tttcagaaagcatcatcaaagt

SEQ ID NO: 8400894 - DNA, 22 bp, Homo sapiens
tttcagaaacgattatgaacac

SEQ ID NO: 8400895 - DNA, 22 bp, Homo sapiens
tttcagaaaacttatcatcagt

SEQ ID NO: 8400896 - DNA, 22 bp, Homo sapiens
tttcagagatgtctagcctatt

SEQ ID NO: 8400897 - DNA, 22 bp, Homo sapiens
ttgacaagtaatacttaaatta

SEQ ID NO: 8400898 - DNA, 22 bp, Homo sapiens
ttgctgttttacatctggtggg

SEQ ID NO: 8400899 - DNA, 22 bp, Homo sapiens
ttggacagtactttaaagcaga

SEQ ID NO: 8400900 - DNA, 22 bp, Homo sapiens
ttggacagcacagacatagaat

SEQ ID NO: 8400901 - DNA, 22 bp, Homo sapiens
ttgctttccgtcatgtgctaat

SEQ ID NO: 8400902 - DNA, 22 bp, Homo sapiens
ttggaaagtgacgttcaactgt

SEQ ID NO: 8400903 - DNA, 22 bp, Homo sapiens
ttggaaacgtcaccttttcctt

SEQ ID NO: 8400904 - DNA, 22 bp, Homo sapiens
ttgtcattggggttatttgtta

SEQ ID NO: 8400905 - DNA, 22 bp, Homo sapiens
ttggagaatgttttcctgcagt

SEQ ID NO: 8400906 - DNA, 20 bp, Homo sapiens
tcctgctgccacctcttctt

SEQ ID NO: 8400907 - DNA, 22 bp, Homo sapiens
ttcaaacagatgactctgctct

SEQ ID NO: 8400908 - DNA, 22 bp, Homo sapiens
ttattcttttctccagaatccc

SEQ ID NO: 8400909 - DNA, 22 bp, Homo sapiens
ttcagttttattgtactgctat

SEQ ID NO: 8400910 - DNA, 22 bp, Homo sapiens
ttccagtctagtacctggatgc

SEQ ID NO: 8400911 - DNA, 22 bp, Homo sapiens
ttcacagagagaactcaaacca

SEQ ID NO: 8400912 - DNA, 22 bp, Homo sapiens
ttcacagatttccctgcacatg

SEQ ID NO: 8400913 - DNA, 19 bp, Homo sapiens
ttctgtgttaattccttta

SEQ ID NO: 8400914 - DNA, 22 bp, Homo sapiens
ttctctggacagtgaagagagg

SEQ ID NO: 8400915 - DNA, 22 bp, Homo sapiens
ttctctgggacaggaacagttt

SEQ ID NO: 8400916 - DNA, 22 bp, Homo sapiens
ttcttttctgcagctggtattt

SEQ ID NO: 8400917 - DNA, 17 bp, Homo sapiens
ttcctggaagtcattcc

SEQ ID NO: 8400918 - DNA, 22 bp, Homo sapiens
ttcctggaaattatgctcacct

SEQ ID NO: 8400919 - DNA, 22 bp, Homo sapiens
ttcctggagagttttcccaaag

SEQ ID NO: 8400920 - DNA, 21 bp, Homo sapiens
ttcctggaggcagaaacgtga

SEQ ID NO: 8400921 - DNA, 22 bp, Homo sapiens
ttcctggtgagatttcgttctg

SEQ ID NO: 8400922 - DNA, 22 bp, Homo sapiens
ttcctggtcccgttcttcactg

SEQ ID NO: 8400923 - DNA, 22 bp, Homo sapiens
ttcctggtctgtgccattcaga

SEQ ID NO: 8400924 - DNA, 22 bp, Homo sapiens
ttcctggtagtaagacatctgg

SEQ ID NO: 8400925 - DNA, 22 bp, Homo sapiens
ttcctggtcactgctgttccct

SEQ ID NO: 8400926 - DNA, 22 bp, Homo sapiens
ttctctatcttgaatgcgtcaa

SEQ ID NO: 8400927 - DNA, 22 bp, Homo sapiens
ttctctctgagagcatctggaa

SEQ ID NO: 8400928 - DNA, 22 bp, Homo sapiens
ttctctggaactgaaacaagat

SEQ ID NO: 8400929 - DNA, 22 bp, Homo sapiens
ttctctcttccagttcccactt

SEQ ID NO: 8400930 - DNA, 22 bp, Homo sapiens
ttctctgaaggttgtggaacta

SEQ ID NO: 8400931 - DNA, 22 bp, Homo sapiens
ttctctgaaggccatgctcact

SEQ ID NO: 8400932 - DNA, 22 bp, Homo sapiens
ttctccagaccctcctgcagac

SEQ ID NO: 8400933 - DNA, 22 bp, Homo sapiens
ttctccagaccttgtgactatg

SEQ ID NO: 8400934 - DNA, 22 bp, Homo sapiens
ttctcctgagttcccaggtcta

SEQ ID NO: 8400935 - DNA, 16 bp, Homo sapiens
gtctcttccctgctga

SEQ ID NO: 8400936 - DNA, 22 bp, Homo sapiens
gtctcttctttgccggtcctgc

SEQ ID NO: 8400937 - DNA, 22 bp, Homo sapiens
gtcctgtgctcagacatggggg

SEQ ID NO: 8400938 - DNA, 22 bp, Homo sapiens
gtcctctgtgtaggctgcagac

SEQ ID NO: 8400939 - DNA, 22 bp, Homo sapiens
gtcctctgtttccatctgactt

SEQ ID NO: 8400940 - DNA, 22 bp, Homo sapiens
cagcaggttaacagaggctggt

SEQ ID NO: 8400941 - DNA, 22 bp, Homo sapiens
cagcaggtcccactgagggccc

SEQ ID NO: 8400942 - DNA, 22 bp, Homo sapiens
cagcaggtcctgggcgtggcct

SEQ ID NO: 8400943 - DNA, 22 bp, Homo sapiens
gtgcctgggacttgctccggat

SEQ ID NO: 8400944 - DNA, 22 bp, Homo sapiens
gtgctgagattacaggtgtgag

SEQ ID NO: 8400945 - DNA, 22 bp, Homo sapiens
gtgctgaggagagggggtggtc

SEQ ID NO: 8400946 - DNA, 22 bp, Homo sapiens
gtgcctggtttggggagtgttc

SEQ ID NO: 8400947 - DNA, 22 bp, Homo sapiens
cagctccagcctgacaccaaga

SEQ ID NO: 8400948 - DNA, 22 bp, Homo sapiens
cagagttcaaagcctgctggga

SEQ ID NO: 8400949 - DNA, 22 bp, Homo sapiens
ggtgggaaggggccagtgtgcg

SEQ ID NO: 8400950 - DNA, 18 bp, Homo sapiens
ggtggctggggacggaca

SEQ ID NO: 8400951 - DNA, 22 bp, Homo sapiens
ggtggcagtagcactgggcctg

SEQ ID NO: 8400952 - DNA, 22 bp, Homo sapiens
ggtggcagtgcttgcgggtcta

SEQ ID NO: 8400953 - DNA, 16 bp, Homo sapiens
cagagaggacagaggc

SEQ ID NO: 8400954 - DNA, 22 bp, Homo sapiens
cagaagcacatgtttacatgta

SEQ ID NO: 8400955 - DNA, 21 bp, Homo sapiens
caatggcgagatcttggctca

SEQ ID NO: 8400956 - DNA, 22 bp, Homo sapiens
gctggtgtctaacctggctctt

SEQ ID NO: 8400957 - DNA, 22 bp, Homo sapiens
gctggtggcagagctccgcggc

SEQ ID NO: 8400958 - DNA, 22 bp, Homo sapiens
cacagagacagaagcacttatg

SEQ ID NO: 8400959 - DNA, 22 bp, Homo sapiens
cacagagacagatctattttgc

SEQ ID NO: 8400960 - DNA, 22 bp, Homo sapiens
ggaacaggaaaggagggatgct

SEQ ID NO: 8400961 - DNA, 19 bp, Homo sapiens
ggaagagaggaaaggtgga

SEQ ID NO: 8400962 - DNA, 22 bp, Homo sapiens
ggacagagggttgacagagtat

SEQ ID NO: 8400963 - DNA, 22 bp, Homo sapiens
ggagcaggagtctcttgaattt

SEQ ID NO: 8400964 - DNA, 22 bp, Homo sapiens
ggaggggatggtttgaccctgg

SEQ ID NO: 8400965 - DNA, 22 bp, Homo sapiens
ggagtgaagtggcgcgatctcg

SEQ ID NO: 8400966 - DNA, 22 bp, Homo sapiens
ggcaggtgtgagatcgaggcca

SEQ ID NO: 8400967 - DNA, 22 bp, Homo sapiens
ggctgctcctttaccctggcag

SEQ ID NO: 8400968 - DNA, 18 bp, Homo sapiens
ggctgctcctctccctac

SEQ ID NO: 8400969 - DNA, 22 bp, Homo sapiens
cagaagagtagctgaacaagtt

SEQ ID NO: 8400970 - DNA, 23 bp, Homo sapiens
ggctgggagctccgggtgcacgt

SEQ ID NO: 8400971 - DNA, 20 bp, Homo sapiens
ggctgctggtttggctctgt

SEQ ID NO: 8400972 - DNA, 22 bp, Homo sapiens
gaaaagaactgcatgggattaa

SEQ ID NO: 8400973 - DNA, 22 bp, Homo sapiens
gaacataactattgtgaatagt

SEQ ID NO: 8400974 - DNA, 22 bp, Homo sapiens
atgcttttccaggagaaatata

SEQ ID NO: 8400975 - DNA, 22 bp, Homo sapiens
gatcctgggactgaatgggtgc

SEQ ID NO: 8400976 - DNA, 22 bp, Homo sapiens
gatcctggcacaggttggtccc

SEQ ID NO: 8400977 - DNA, 22 bp, Homo sapiens
gatcctgggcccttctgggtca

SEQ ID NO: 8400978 - DNA, 17 bp, Homo sapiens
gaggtaggaagtgagtc

SEQ ID NO: 8400979 - DNA, 22 bp, Homo sapiens
gaggtaagggcaggagagtgaa

SEQ ID NO: 8400980 - DNA, 22 bp, Homo sapiens
gagggaaacagatgggttgtgg

SEQ ID NO: 8400981 - DNA, 22 bp, Homo sapiens
gaggaaggatttagtttgaggg

SEQ ID NO: 8400982 - DNA, 22 bp, Homo sapiens
gaggaaggagggaaagcgcgcg

SEQ ID NO: 8400983 - DNA, 22 bp, Homo sapiens
gaggaagatggttgagtggtcc

SEQ ID NO: 8400984 - DNA, 22 bp, Homo sapiens
gagaggtggaggttgcagtgag

SEQ ID NO: 8400985 - DNA, 22 bp, Homo sapiens
gagaggtgaaggctgccctggg

SEQ ID NO: 8400986 - DNA, 22 bp, Homo sapiens
gagaggctccgccactgctcag

SEQ ID NO: 8400987 - DNA, 22 bp, Homo sapiens
gagaggctgactggctgtcctg

SEQ ID NO: 8400988 - DNA, 17 bp, Homo sapiens
gagcagggatgcggttc

SEQ ID NO: 8400989 - DNA, 22 bp, Homo sapiens
gagcctgggtccttccctggga

SEQ ID NO: 8400990 - DNA, 22 bp, Homo sapiens
gcagatgccactaggtgaagtg

SEQ ID NO: 8400991 - DNA, 22 bp, Homo sapiens
gatttctgggctttatttcaga

SEQ ID NO: 8400992 - DNA, 22 bp, Homo sapiens
atgtttctagttgtatgtcact

SEQ ID NO: 8400993 - DNA, 22 bp, Homo sapiens
gcaaacaaggacatacatcctg

SEQ ID NO: 8400994 - DNA, 18 bp, Homo sapiens
gcaacagatcaacagaaa

SEQ ID NO: 8400995 - DNA, 22 bp, Homo sapiens
gcactcaggactctcatcagta

SEQ ID NO: 8400996 - DNA, 18 bp, Homo sapiens
gcacagagcccaggctct

SEQ ID NO: 8400997 - DNA, 22 bp, Homo sapiens
gcacagaggaagcacagactct

SEQ ID NO: 8400998 - DNA, 22 bp, Homo sapiens
gcaggggtagagattgctggtg

SEQ ID NO: 8400999 - DNA, 22 bp, Homo sapiens
attgttgggtctcactcctaga

SEQ ID NO: 8401000 - DNA, 22 bp, Homo sapiens
gcattcactgggtgttcatggg

SEQ ID NO: 8401001 - DNA, 22 bp, Homo sapiens
atttgacattgacacacctatg

SEQ ID NO: 8401002 - DNA, 22 bp, Homo sapiens
attttaaggcttatttaaaggc

SEQ ID NO: 8401003 - DNA, 22 bp, Homo sapiens
atttgcctttcgaatcaacagg

SEQ ID NO: 8401004 - DNA, 22 bp, Homo sapiens
attttacataaggaaggtttaa

SEQ ID NO: 8401005 - DNA, 22 bp, Homo sapiens
gccctccatgagacacagtgta

SEQ ID NO: 8401006 - DNA, 19 bp, Homo sapiens
gccctcctcactgagctct

SEQ ID NO: 8401007 - DNA, 18 bp, Homo sapiens
gccagagggaagcaggtg

SEQ ID NO: 8401008 - DNA, 22 bp, Homo sapiens
atttacattccatggtggttac

SEQ ID NO: 8401009 - DNA, 22 bp, Homo sapiens
gccagaggtatcaaagatagta

SEQ ID NO: 8401010 - DNA, 22 bp, Homo sapiens
gccagaggggctcgaaggcgcg

SEQ ID NO: 8401011 - DNA, 22 bp, Homo sapiens
gctctggtgagtgtagttcagg

SEQ ID NO: 8401012 - DNA, 20 bp, Homo sapiens
gctgaggagcagtgtggttg

SEQ ID NO: 8401013 - DNA, 22 bp, Homo sapiens
gctgaggaagtcaggtggccca

SEQ ID NO: 8401014 - DNA, 21 bp, Homo sapiens
gcctggctctcactggcctgg

SEQ ID NO: 8401015 - DNA, 17 bp, Homo sapiens
gctccaggcgtgagtga

SEQ ID NO: 8401016 - DNA, 22 bp, Homo sapiens
aggctggcgtcaggggctgtac

SEQ ID NO: 8401017 - DNA, 17 bp, Homo sapiens
aggctggccttcacagt

SEQ ID NO: 8401018 - DNA, 22 bp, Homo sapiens
aggccagttgttcagtgggccg

SEQ ID NO: 8401019 - DNA, 22 bp, Homo sapiens
aggccaggtggtcatgcttgct

SEQ ID NO: 8401020 - DNA, 22 bp, Homo sapiens
aggccagaaatgtcagggagtg

SEQ ID NO: 8401021 - DNA, 22 bp, Homo sapiens
agggtagggcccggagacagac

SEQ ID NO: 8401022 - DNA, 22 bp, Homo sapiens
cctgaagaattcaaatccagat

SEQ ID NO: 8401023 - DNA, 22 bp, Homo sapiens
cctgaagatgctgtggcctggt

SEQ ID NO: 8401024 - DNA, 22 bp, Homo sapiens
ccctcagctcaagcccctgtgc

SEQ ID NO: 8401025 - DNA, 20 bp, Homo sapiens
ccctcccagatgcttcccaa

SEQ ID NO: 8401026 - DNA, 22 bp, Homo sapiens
ccctgcagtgtgacctcaccta

SEQ ID NO: 8401027 - DNA, 22 bp, Homo sapiens
cccatccctgattttcactcgt

SEQ ID NO: 8401028 - DNA, 20 bp, Homo sapiens
aggagggtttctctgacaca

SEQ ID NO: 8401029 - DNA, 22 bp, Homo sapiens
aggagggttctctggacagagg

SEQ ID NO: 8401030 - DNA, 22 bp, Homo sapiens
aggaattcaagaccagctgggc

SEQ ID NO: 8401031 - DNA, 22 bp, Homo sapiens
cagtgaggagtccagggcagag

SEQ ID NO: 8401032 - DNA, 22 bp, Homo sapiens
aggagccaagatgctgtctggc

SEQ ID NO: 8401033 - DNA, 22 bp, Homo sapiens
aggagctggccactaggatgca

SEQ ID NO: 8401034 - DNA, 22 bp, Homo sapiens
aggagctgggcccaaggatgct

SEQ ID NO: 8401035 - DNA, 22 bp, Homo sapiens
caggaactcaaggtttgtaaca

SEQ ID NO: 8401036 - DNA, 20 bp, Homo sapiens
agctctttttagctaaggta

SEQ ID NO: 8401037 - DNA, 22 bp, Homo sapiens
agctcttttgctctccaagttt

SEQ ID NO: 8401038 - DNA, 22 bp, Homo sapiens
agctcttttgtgagcatttggc

SEQ ID NO: 8401039 - DNA, 22 bp, Homo sapiens
agctcttttgattctccctgtc

SEQ ID NO: 8401040 - DNA, 22 bp, Homo sapiens
agctcttttatcatgaggagag

SEQ ID NO: 8401041 - DNA, 22 bp, Homo sapiens
agctctttggcactgagcagca

SEQ ID NO: 8401042 - DNA, 22 bp, Homo sapiens
agctgcttttattaggacaatg

SEQ ID NO: 8401043 - DNA, 22 bp, Homo sapiens
aggaaaagtgtgaagtatggag

SEQ ID NO: 8401044 - DNA, 20 bp, Homo sapiens
aggaaaagggtggtggtaga

SEQ ID NO: 8401045 - DNA, 22 bp, Homo sapiens
aggaaaaataaggcagcagggc

SEQ ID NO: 8401046 - DNA, 22 bp, Homo sapiens
cagggacccgcacaggtagcat

SEQ ID NO: 8401047 - DNA, 22 bp, Homo sapiens
agcttctcctggtacagaactg

SEQ ID NO: 8401048 - DNA, 22 bp, Homo sapiens
agcttctctctttgcactcaca

SEQ ID NO: 8401049 - DNA, 22 bp, Homo sapiens
caggcttcttttctttccagac

SEQ ID NO: 8401050 - DNA, 22 bp, Homo sapiens
cagggttcagtgggccctcttg

SEQ ID NO: 8401051 - DNA, 22 bp, Homo sapiens
aggaagaggtgtgcaatggtgt

SEQ ID NO: 8401052 - DNA, 22 bp, Homo sapiens
aggaagagggtggcagataatc

SEQ ID NO: 8401053 - DNA, 22 bp, Homo sapiens
aggaagaggtagctgtcaaggg

SEQ ID NO: 8401054 - DNA, 22 bp, Homo sapiens
aggaaggtaatgaactgaggag

SEQ ID NO: 8401055 - DNA, 22 bp, Homo sapiens
ctggctcttgcgactcagcttg

SEQ ID NO: 8401056 - DNA, 22 bp, Homo sapiens
ctggctgaggcagagcctgggg

SEQ ID NO: 8401057 - DNA, 22 bp, Homo sapiens
atatacacatgtgtatacattt

SEQ ID NO: 8401058 - DNA, 22 bp, Homo sapiens
ctggcacaactccacctcagcg

SEQ ID NO: 8401059 - DNA, 22 bp, Homo sapiens
ctggcacagagtgagcattcaa

SEQ ID NO: 8401060 - DNA, 22 bp, Homo sapiens
ctggccactgcgggcctctgcc

SEQ ID NO: 8401061 - DNA, 22 bp, Homo sapiens
ctggcctaaaattgcttctgca

SEQ ID NO: 8401062 - DNA, 22 bp, Homo sapiens
agttttgtaattctcaaaaata

SEQ ID NO: 8401063 - DNA, 22 bp, Homo sapiens
ctgcagggacccaagtctttgg

SEQ ID NO: 8401064 - DNA, 22 bp, Homo sapiens
ctgcagggaccacaagcaggtt

SEQ ID NO: 8401065 - DNA, 19 bp, Homo sapiens
ctgctcagagcagctccag

SEQ ID NO: 8401066 - DNA, 22 bp, Homo sapiens
ctgctgggctcctcatgtgact

SEQ ID NO: 8401067 - DNA, 22 bp, Homo sapiens
ctgctggggtcagagcactggg

SEQ ID NO: 8401068 - DNA, 22 bp, Homo sapiens
ctgtaaataatgacagttgact

SEQ ID NO: 8401069 - DNA, 22 bp, Homo sapiens
atcacactgttattttagttaa

SEQ ID NO: 8401070 - DNA, 22 bp, Homo sapiens
ctgtaaatggaactatgtagta

SEQ ID NO: 8401071 - DNA, 22 bp, Homo sapiens
atcagtttcacttgcttgcaaa

SEQ ID NO: 8401072 - DNA, 22 bp, Homo sapiens
ctgggtggcagagcctgcagtg

SEQ ID NO: 8401073 - DNA, 22 bp, Homo sapiens
ctgggtggatcgcagccccagg

SEQ ID NO: 8401074 - DNA, 22 bp, Homo sapiens
ctggtccctggacctccctgga

SEQ ID NO: 8401075 - DNA, 22 bp, Homo sapiens
ctgggtggctgtccagccagcc

SEQ ID NO: 8401076 - DNA, 22 bp, Homo sapiens
atctgggtttaaatctcagctt

SEQ ID NO: 8401077 - DNA, 22 bp, Homo sapiens
atctgggtttcaaagaagcctt

SEQ ID NO: 8401078 - DNA, 23 bp, Homo sapiens
atctgtgtgtgggtagggatgat

SEQ ID NO: 8401079 - DNA, 22 bp, Homo sapiens
cttccttgtggtccttctcatt

SEQ ID NO: 8401080 - DNA, 22 bp, Homo sapiens
atctctatctttattgaaatct

SEQ ID NO: 8401081 - DNA, 22 bp, Homo sapiens
atctctgaaggctccaggagag

SEQ ID NO: 8401082 - DNA, 22 bp, Homo sapiens
cttcaaattcgaggagtagatg

SEQ ID NO: 8401083 - DNA, 22 bp, Homo sapiens
agtagggagaccggaggccgcc

SEQ ID NO: 8401084 - DNA, 22 bp, Homo sapiens
ccttctccctctgagaggaacc

SEQ ID NO: 8401085 - DNA, 22 bp, Homo sapiens
ccttctcctgccttgggttcat

SEQ ID NO: 8401086 - DNA, 22 bp, Homo sapiens
ccttctcccctctgcagggtgt

SEQ ID NO: 8401087 - DNA, 22 bp, Homo sapiens
ccttccagtgactaaggaggaa

SEQ ID NO: 8401088 - DNA, 20 bp, Homo sapiens
ccttctccagcttgttcttg

SEQ ID NO: 8401089 - DNA, 21 bp, Homo sapiens
ccttctccattacagtaagct

SEQ ID NO: 8401090 - DNA, 22 bp, Homo sapiens
agtcacatcgattataaaattt

SEQ ID NO: 8401091 - DNA, 22 bp, Homo sapiens
aggtacaaaagagtatatgaga

SEQ ID NO: 8401092 - DNA, 22 bp, Homo sapiens
aggtaaagactgcaaggagaat

SEQ ID NO: 8401093 - DNA, 22 bp, Homo sapiens
aggtaaagacagtgaaagaggg

SEQ ID NO: 8401094 - DNA, 22 bp, Homo sapiens
agggttttggctgaagttcagc

SEQ ID NO: 8401095 - DNA, 22 bp, Homo sapiens
cctgggagaactgctgggttgg

SEQ ID NO: 8401096 - DNA, 22 bp, Homo sapiens
cctgggaggctgaggctgcagt

SEQ ID NO: 8401097 - DNA, 22 bp, Homo sapiens
cctgggaggtggaggttgcagc

SEQ ID NO: 8401098 - DNA, 22 bp, Homo sapiens
cctgggaggtggaggttgcagt

SEQ ID NO: 8401099 - DNA, 22 bp, Homo sapiens
cctgggagggcaagtgctgatg

SEQ ID NO: 8401100 - DNA, 22 bp, Homo sapiens
cctgggtacgcagggctcctct

SEQ ID NO: 8401101 - DNA, 22 bp, Homo sapiens
cctgggggccaggaaggtgtga

SEQ ID NO: 8401102 - DNA, 23 bp, Homo sapiens
aggtcctggacatatgtgcatca

SEQ ID NO: 8401103 - DNA, 22 bp, Homo sapiens
aggtcctggtcttgagtcttaa

SEQ ID NO: 8401104 - DNA, 22 bp, Homo sapiens
agtgtgggcccccaggttagcc

SEQ ID NO: 8401105 - DNA, 22 bp, Homo sapiens
agtgtggccaatgaggatgggc

SEQ ID NO: 8401106 - DNA, 22 bp, Homo sapiens
agtgtggacttttcctaggagg

SEQ ID NO: 8401107 - DNA, 22 bp, Homo sapiens
ctgagctgctcccgctgcagcg

SEQ ID NO: 8401108 - DNA, 22 bp, Homo sapiens
agtggctcttgggtcactgggc

SEQ ID NO: 8401109 - DNA, 19 bp, Homo sapiens
agtgggtaatagaggctcc

SEQ ID NO: 8401110 - DNA, 22 bp, Homo sapiens
ctctggagttctcatgaggaac

SEQ ID NO: 8401111 - DNA, 20 bp, Homo sapiens
ctctggagttggggaacatt

SEQ ID NO: 8401112 - DNA, 20 bp, Homo sapiens
agtgccagggcaggtgagag

SEQ ID NO: 8401113 - DNA, 22 bp, Homo sapiens
agtggcagtggggcagggccct

SEQ ID NO: 8401114 - DNA, 22 bp, Homo sapiens
agtgagggactagtgctgggga

SEQ ID NO: 8401115 - DNA, 22 bp, Homo sapiens
ctcaccacagagcctgtccagc

SEQ ID NO: 8401116 - DNA, 22 bp, Homo sapiens
agtcctgggtctggagaatgga

SEQ ID NO: 8401117 - DNA, 22 bp, Homo sapiens
atacaaaatatatactggagac

SEQ ID NO: 8401118 - DNA, 22 bp, Homo sapiens
atacaaaaattagccgggagta

SEQ ID NO: 8401119 - DNA, 22 bp, Homo sapiens
acttcctggctgggtgacctgg

SEQ ID NO: 8401120 - DNA, 22 bp, Homo sapiens
acttttcccttggtagagttgc

SEQ ID NO: 8401121 - DNA, 22 bp, Homo sapiens
atctgccaatgccatgagaaga

SEQ ID NO: 8401122 - DNA, 21 bp, Homo sapiens
aggtgggcaggtggagtggcc

SEQ ID NO: 8401123 - DNA, 22 bp, Homo sapiens
aggtgggcggattcatgaggtc

SEQ ID NO: 8401124 - DNA, 22 bp, Homo sapiens
agtcaccaggttttagagacct

SEQ ID NO: 8401125 - DNA, 22 bp, Homo sapiens
agtcactctgctacatgacagc

SEQ ID NO: 8401126 - DNA, 22 bp, Homo sapiens
actccctccaaatctgcacagt

SEQ ID NO: 8401127 - DNA, 22 bp, Homo sapiens
actctcttgggggagagcagag

SEQ ID NO: 8401128 - DNA, 22 bp, Homo sapiens
aggtcttggtaggccagagtct

SEQ ID NO: 8401129 - DNA, 22 bp, Homo sapiens
acattcatgtcccacttctagc

SEQ ID NO: 8401130 - DNA, 22 bp, Homo sapiens
acattctagatatgttatattt

SEQ ID NO: 8401131 - DNA, 22 bp, Homo sapiens
aggcatggctttaggcaggcgt

SEQ ID NO: 8401132 - DNA, 17 bp, Homo sapiens
aggcatggtctggggtg

SEQ ID NO: 8401133 - DNA, 18 bp, Homo sapiens
aggcatggtggtgcgcac

SEQ ID NO: 8401134 - DNA, 22 bp, Homo sapiens
accagtcatagaaagcagtggt

SEQ ID NO: 8401135 - DNA, 22 bp, Homo sapiens
agctttttcactttggatggga

SEQ ID NO: 8401136 - DNA, 22 bp, Homo sapiens
agctgggagcagagccacagcc

SEQ ID NO: 8401137 - DNA, 22 bp, Homo sapiens
aggagcctccttctcatgtgca

SEQ ID NO: 8401138 - DNA, 20 bp, Homo sapiens
aggaaggagaatctgagcaa

SEQ ID NO: 8401139 - DNA, 22 bp, Homo sapiens
aggaagggatacataggatagt

SEQ ID NO: 8401140 - DNA, 22 bp, Homo sapiens
acatacatcaagtatcacaaga

SEQ ID NO: 8401141 - DNA, 22 bp, Homo sapiens
aggaggggttctcgggtgctga

SEQ ID NO: 8401142 - DNA, 22 bp, Homo sapiens
aggaggggcatagaaatgtaat

SEQ ID NO: 8401143 - DNA, 22 bp, Homo sapiens
agagaagggtgtagcctgggcc

SEQ ID NO: 8401144 - DNA, 22 bp, Homo sapiens
agagctgaaaaagctgacccgg

SEQ ID NO: 8401145 - DNA, 21 bp, Homo sapiens
agagcctgagatcttccagca

SEQ ID NO: 8401146 - DNA, 22 bp, Homo sapiens
agagctggatggtcaagatggc

SEQ ID NO: 8401147 - DNA, 22 bp, Homo sapiens
agaatatagttaccaaattctg

SEQ ID NO: 8401148 - DNA, 22 bp, Homo sapiens
atgagggaggcaaggagatgct

SEQ ID NO: 8401149 - DNA, 22 bp, Homo sapiens
agacaccagaatctgttgagca

SEQ ID NO: 8401150 - DNA, 22 bp, Homo sapiens
atgccaagctctatccctgacc

SEQ ID NO: 8401151 - DNA, 22 bp, Homo sapiens
agacctggagtgaagagttccc

SEQ ID NO: 8401152 - DNA, 22 bp, Homo sapiens
agacctggatgtgagggaagta

SEQ ID NO: 8401153 - DNA, 22 bp, Homo sapiens
agacctgggttcgagtcctaac

SEQ ID NO: 8401154 - DNA, 22 bp, Homo sapiens
atgcctttgccacagattagga

SEQ ID NO: 8401155 - DNA, 22 bp, Homo sapiens
atgcctggtatgaagcaaggaa

SEQ ID NO: 8401156 - DNA, 22 bp, Homo sapiens
agagtcagaaccaagatgaggc

SEQ ID NO: 8401157 - DNA, 22 bp, Homo sapiens
agagtcagactaagccatggtg

SEQ ID NO: 8401158 - DNA, 22 bp, Homo sapiens
agagtctgatatttgtaccaga

SEQ ID NO: 8401159 - DNA, 22 bp, Homo sapiens
agaggggagtcctaatctgatt

SEQ ID NO: 8401160 - DNA, 18 bp, Homo sapiens
agaggggaggtaagtctg

SEQ ID NO: 8401161 - DNA, 22 bp, Homo sapiens
agaggggagagctaagcaattc

SEQ ID NO: 8401162 - DNA, 22 bp, Homo sapiens
agaggggaagtaatgaatgata

SEQ ID NO: 8401163 - DNA, 22 bp, Homo sapiens
agaggggaggcgaaccagagtc

SEQ ID NO: 8401164 - DNA, 22 bp, Homo sapiens
agaggggaaggatgtgatgtga

SEQ ID NO: 8401165 - DNA, 22 bp, Homo sapiens
agagggctgggatgtgctgtgt

SEQ ID NO: 8401166 - DNA, 21 bp, Homo sapiens
agagctgggacttgcctgaga

SEQ ID NO: 8401167 - DNA, 22 bp, Homo sapiens
agcaaagctcatgacattacag

SEQ ID NO: 8401168 - DNA, 22 bp, Homo sapiens
agatccactcgaatccaggaat

SEQ ID NO: 8401169 - DNA, 22 bp, Homo sapiens
agatggctgatggcaggagcca

SEQ ID NO: 8401170 - DNA, 22 bp, Homo sapiens
agatggctccagtgtccagagg

SEQ ID NO: 8401171 - DNA, 22 bp, Homo sapiens
agatggctagattgcaagaact

SEQ ID NO: 8401172 - DNA, 22 bp, Homo sapiens
agcagggaggcggtgtgctggc

SEQ ID NO: 8401173 - DNA, 22 bp, Homo sapiens
agcagggaggcggtgtgctggc

SEQ ID NO: 8401174 - DNA, 17 bp, Homo sapiens
agcagggagtcaaggga

SEQ ID NO: 8401175 - DNA, 22 bp, Homo sapiens
agcagggctctgtggagggtgg

SEQ ID NO: 8401176 - DNA, 22 bp, Homo sapiens
agcaggtgttggctgggccatc

SEQ ID NO: 8401177 - DNA, 22 bp, Homo sapiens
agcagcctttgatcatctggga

SEQ ID NO: 8401178 - DNA, 22 bp, Homo sapiens
cacagagattagaattagacta

SEQ ID NO: 8401179 - DNA, 22 bp, Homo sapiens
agcaccaggtcgctggcacgct

SEQ ID NO: 8401180 - DNA, 22 bp, Homo sapiens
agccctggcagagccaggtagt

SEQ ID NO: 8401181 - DNA, 22 bp, Homo sapiens
agccctggcccggctgtgcttt

SEQ ID NO: 8401182 - DNA, 22 bp, Homo sapiens
agccctgggaggccagcttgta

SEQ ID NO: 8401183 - DNA, 22 bp, Homo sapiens
cagatggccagaggcagctgca

SEQ ID NO: 8401184 - DNA, 22 bp, Homo sapiens
cagatggctgccttcttgctgt

SEQ ID NO: 8401185 - DNA, 22 bp, Homo sapiens
agctctttgctggcagtaggct

SEQ ID NO: 8401186 - DNA, 22 bp, Homo sapiens
agctctttggaaggtgtgcact

SEQ ID NO: 8401187 - DNA, 19 bp, Homo sapiens
agctctttgctgcattcca

SEQ ID NO: 8401188 - DNA, 22 bp, Homo sapiens
agctctttgagcaaggcagctc

SEQ ID NO: 8401189 - DNA, 22 bp, Homo sapiens
agctctttctacaagcaggcag

SEQ ID NO: 8401190 - DNA, 15 bp, Homo sapiens
agctctttcagctac

SEQ ID NO: 8401191 - DNA, 22 bp, Homo sapiens
agctctttcccctccctatggc

SEQ ID NO: 8401192 - DNA, 22 bp, Homo sapiens
agctctttgagaaggcagtgtg

SEQ ID NO: 8401193 - DNA, 22 bp, Homo sapiens
agctctttgactaatcttgctt

SEQ ID NO: 8401194 - DNA, 22 bp, Homo sapiens
agctctttatgtggaagaggca

SEQ ID NO: 8401195 - DNA, 22 bp, Homo sapiens
agctctttatgggtaaatgcca

SEQ ID NO: 8401196 - DNA, 22 bp, Homo sapiens
agctctttagagtctcccttct

SEQ ID NO: 8401197 - DNA, 22 bp, Homo sapiens
agctctttaatcttagccccag

SEQ ID NO: 8401198 - DNA, 22 bp, Homo sapiens
agctctttacacagagtccctc

SEQ ID NO: 8401199 - DNA, 22 bp, Homo sapiens
agctctggtttagaaggggaaa

SEQ ID NO: 8401200 - DNA, 19 bp, Homo sapiens
agctcaggcccatcgtccc

SEQ ID NO: 8401201 - DNA, 22 bp, Homo sapiens
aaagcacagagctcccacagga

SEQ ID NO: 8401202 - DNA, 22 bp, Homo sapiens
aacacaaagaagctgcaggatc

SEQ ID NO: 8401203 - DNA, 22 bp, Homo sapiens
aacacatggcaagagcaggaaa

SEQ ID NO: 8401204 - DNA, 20 bp, Homo sapiens
aactcagagatgaaaaagac

SEQ ID NO: 8401205 - DNA, 22 bp, Homo sapiens
aagaaagtgtggagagcctagc

SEQ ID NO: 8401206 - DNA, 22 bp, Homo sapiens
aagaaagtgatgagctacagat

SEQ ID NO: 8401207 - DNA, 22 bp, Homo sapiens
aagaaagggagaaggatggtgt

SEQ ID NO: 8401208 - DNA, 18 bp, Homo sapiens
aagaggaggagcaggttg

SEQ ID NO: 8401209 - DNA, 22 bp, Homo sapiens
aagcagaaagaacaactgagtg

SEQ ID NO: 8401210 - DNA, 22 bp, Homo sapiens
aaacttctggctacaagcaata

SEQ ID NO: 8401211 - DNA, 22 bp, Homo sapiens
aaaaatgcttggacttaataaa

SEQ ID NO: 8401212 - DNA, 22 bp, Homo sapiens
aaaatagctatggaatgtcact

SEQ ID NO: 8401213 - DNA, 22 bp, Homo sapiens
aaaatagatgaaaggaagtctg

SEQ ID NO: 8401214 - DNA, 22 bp, Homo sapiens
aaaatagattctaggatgtctt

SEQ ID NO: 8401215 - DNA, 22 bp, Homo sapiens
aaacactgatggatatttttcc

SEQ ID NO: 8401216 - DNA, 22 bp, Homo sapiens
aaagtgctaaataagccctgaa

SEQ ID NO: 8401217 - DNA, 22 bp, Homo sapiens
aaacactggtatgatgtatagt

SEQ ID NO: 8401218 - DNA, 22 bp, Homo sapiens
aaacactggcaatttcatgcac

SEQ ID NO: 8401219 - DNA, 22 bp, Homo sapiens
aaacactgcagggtttacttga

SEQ ID NO: 8401220 - DNA, 22 bp, Homo sapiens
aaagtgctgggattccaggcgt

SEQ ID NO: 8401221 - DNA, 22 bp, Homo sapiens
aaagtgctgaagacctagctgt

SEQ ID NO: 8401222 - DNA, 22 bp, Homo sapiens
aaagtgctgaagacctagctgt

SEQ ID NO: 8401223 - DNA, 22 bp, Homo sapiens
aaatgctcgccttggccgagac

SEQ ID NO: 8401224 - DNA, 22 bp, Homo sapiens
aaatactgttgaatgaagtaag

SEQ ID NO: 8401225 - DNA, 22 bp, Homo sapiens
aactcattctaagtataccaaa

SEQ ID NO: 8401226 - DNA, 20 bp, Homo sapiens
aagttacattgtattgtacc

SEQ ID NO: 8401227 - DNA, 22 bp, Homo sapiens
aacactgtaacagcatcatttt

SEQ ID NO: 8401228 - DNA, 22 bp, Homo sapiens
aacactgtaacagcatcatttt

SEQ ID NO: 8401229 - DNA, 22 bp, Homo sapiens
aataaacaaatctttcctgtgg

SEQ ID NO: 8401230 - DNA, 22 bp, Homo sapiens
aaggacatttctgactaatgca

SEQ ID NO: 8401231 - DNA, 22 bp, Homo sapiens
aaattattacaagctagttggc

SEQ ID NO: 8401232 - DNA, 22 bp, Homo sapiens
aaggccagactctggaatgaca

SEQ ID NO: 8401233 - DNA, 23 bp, Homo sapiens
aaggccagaatttcaatggtgcc

SEQ ID NO: 8401234 - DNA, 22 bp, Homo sapiens
aaggccagacaggaccacatct

SEQ ID NO: 8401235 - DNA, 22 bp, Homo sapiens
aacaataggctatatgctaggc

SEQ ID NO: 8401236 - DNA, 22 bp, Homo sapiens
aaggggaagtagcaccagaggt

SEQ ID NO: 8401237 - DNA, 22 bp, Homo sapiens
acacctggtctttgcatgagca

SEQ ID NO: 8401238 - DNA, 22 bp, Homo sapiens
acacctttgtgaagtgatgatg

SEQ ID NO: 8401239 - DNA, 22 bp, Homo sapiens
acacgcatgatgatgcacgtac

SEQ ID NO: 8401240 - DNA, 22 bp, Homo sapiens
aagagtggagctggaaagtggg

SEQ ID NO: 8401241 - DNA, 22 bp, Homo sapiens
aagagtggagctggaaagtggg

SEQ ID NO: 8401242 - DNA, 21 bp, Homo sapiens
aagagtggctgaggaggtgat

SEQ ID NO: 8401243 - DNA, 22 bp, Homo sapiens
aagagttagctcaataacttga

SEQ ID NO: 8401244 - DNA, 22 bp, Homo sapiens
aagaggttgtctgtgatgagtt

SEQ ID NO: 8401245 - DNA, 22 bp, Homo sapiens
aagaggaactgggggctgagtc

SEQ ID NO: 8401246 - DNA, 22 bp, Homo sapiens
aagcacattgcctggcacatag

SEQ ID NO: 8401247 - DNA, 22 bp, Homo sapiens
aagcacattgtacatttgtgct

SEQ ID NO: 8401248 - DNA, 22 bp, Homo sapiens
aagcacatttggaaaacatgga

SEQ ID NO: 8401249 - DNA, 22 bp, Homo sapiens
aagcacatctcctgtgcagaac

SEQ ID NO: 8401250 - DNA, 22 bp, Homo sapiens
aagcacattaaggaacattgaa

SEQ ID NO: 8401251 - DNA, 22 bp, Homo sapiens
acaactgtcagtaaagaatatt

SEQ ID NO: 8401252 - DNA, 22 bp, Homo sapiens
aactctacttgggactcctctg

SEQ ID NO: 8401253 - DNA, 22 bp, Homo sapiens
aatgttacgatcaacaacacat

SEQ ID NO: 8401254 - DNA, 22 bp, Homo sapiens
agagggcataaaatagagcacg

SEQ ID NO: 8401255 - DNA, 22 bp, Homo sapiens
aatttcaaagctcactggcata

SEQ ID NO: 8401256 - DNA, 22 bp, Homo sapiens
agagggtaacaagaggcctgga

SEQ ID NO: 8401257 - DNA, 22 bp, Homo sapiens
agaggggttaagtgctagtccg

SEQ ID NO: 8401258 - DNA, 22 bp, Homo sapiens
agaggttgggtctgaggtgaga

SEQ ID NO: 8401259 - DNA, 22 bp, Homo sapiens
agaggtgtggccaggactcaag

SEQ ID NO: 8401260 - DNA, 22 bp, Homo sapiens
agaggtggccatgggcgctgga

SEQ ID NO: 8401261 - DNA, 22 bp, Homo sapiens
agatataataatttacaagtgt

SEQ ID NO: 8401262 - DNA, 22 bp, Homo sapiens
agagtctgttacttgtccccta

SEQ ID NO: 8401263 - DNA, 19 bp, Homo sapiens
agagtctgtgctcttccta

SEQ ID NO: 8401264 - DNA, 22 bp, Homo sapiens
agagtctgtgagtccctgagca

SEQ ID NO: 8401265 - DNA, 21 bp, Homo sapiens
agagtctgcatttctgacaag

SEQ ID NO: 8401266 - DNA, 22 bp, Homo sapiens
agagtctgcctttttctcctgc

SEQ ID NO: 8401267 - DNA, 22 bp, Homo sapiens
agagtctggaagcgcttctaaa

SEQ ID NO: 8401268 - DNA, 22 bp, Homo sapiens
agatatcttacactttgaagtt

SEQ ID NO: 8401269 - DNA, 23 bp, Homo sapiens
agagagagtttgtgtcaggtacc

SEQ ID NO: 8401270 - DNA, 21 bp, Homo sapiens
agagaaagtcatggctgtggc

SEQ ID NO: 8401271 - DNA, 22 bp, Homo sapiens
agagaaagtcctgatctctcta

SEQ ID NO: 8401272 - DNA, 23 bp, Homo sapiens
agagaaagggataacacgttgaa

SEQ ID NO: 8401273 - DNA, 22 bp, Homo sapiens
agaattgtaagcaatttgatta

SEQ ID NO: 8401274 - DNA, 22 bp, Homo sapiens
agaatccttgactcaggctgag

SEQ ID NO: 8401275 - DNA, 22 bp, Homo sapiens
agaatcctggccaggtcagagc

SEQ ID NO: 8401276 - DNA, 22 bp, Homo sapiens
agcattgaggtgggtttctctt

SEQ ID NO: 8401277 - DNA, 22 bp, Homo sapiens
agcattgctaaagctaattttt

SEQ ID NO: 8401278 - DNA, 22 bp, Homo sapiens
agcattgcctgcctattgctaa

SEQ ID NO: 8401279 - DNA, 22 bp, Homo sapiens
agcctggcttaatcctcctttt

SEQ ID NO: 8401280 - DNA, 22 bp, Homo sapiens
agctccaggtcagtgcacccct

SEQ ID NO: 8401281 - DNA, 22 bp, Homo sapiens
agctcaggccggagctacaggc

SEQ ID NO: 8401282 - DNA, 22 bp, Homo sapiens
agccctggggctggtgcttacc

SEQ ID NO: 8401283 - DNA, 22 bp, Homo sapiens
agccctggggctggtcttggaa

SEQ ID NO: 8401284 - DNA, 22 bp, Homo sapiens
agcctggccctgctgaactctg

SEQ ID NO: 8401285 - DNA, 22 bp, Homo sapiens
agcctggcctgggcaggcacat

SEQ ID NO: 8401286 - DNA, 22 bp, Homo sapiens
agccctggtagcctgctgccat

SEQ ID NO: 8401287 - DNA, 22 bp, Homo sapiens
agccctggtttgcagcatttgc

SEQ ID NO: 8401288 - DNA, 22 bp, Homo sapiens
agccctgggtcccagtcctggc

SEQ ID NO: 8401289 - DNA, 22 bp, Homo sapiens
acacacagaaggaagccccact

SEQ ID NO: 8401290 - DNA, 22 bp, Homo sapiens
agatttctgggcttcaccacct

SEQ ID NO: 8401291 - DNA, 22 bp, Homo sapiens
acacactgagtgccataggacc

SEQ ID NO: 8401292 - DNA, 21 bp, Homo sapiens
acacactgagttttccactgt

SEQ ID NO: 8401293 - DNA, 22 bp, Homo sapiens
acacactgctcatgaggagcat

SEQ ID NO: 8401294 - DNA, 22 bp, Homo sapiens
acacactggcaggagctataaa

SEQ ID NO: 8401295 - DNA, 22 bp, Homo sapiens
acacactgaattttgtggaaac

SEQ ID NO: 8401296 - DNA, 22 bp, Homo sapiens
acacactgagtgccataggacc

SEQ ID NO: 8401297 - DNA, 22 bp, Homo sapiens
acacactggcccccagtactga

SEQ ID NO: 8401298 - DNA, 22 bp, Homo sapiens
acacactgggcatggtttatgc

SEQ ID NO: 8401299 - DNA, 22 bp, Homo sapiens
acacactgtaaggactatcact

SEQ ID NO: 8401300 - DNA, 22 bp, Homo sapiens
agcatccagatgcctgatgtca

SEQ ID NO: 8401301 - DNA, 20 bp, Homo sapiens
agcaggtgacggggcctgct

SEQ ID NO: 8401302 - DNA, 22 bp, Homo sapiens
agcaggtgacagggctgtggtg

SEQ ID NO: 8401303 - DNA, 22 bp, Homo sapiens
acagatgaggaaacagggtcag

SEQ ID NO: 8401304 - DNA, 22 bp, Homo sapiens
acaggccagaggtggggcagcc

SEQ ID NO: 8401305 - DNA, 22 bp, Homo sapiens
accaccctcagcagagctgaaa

SEQ ID NO: 8401306 - DNA, 21 bp, Homo sapiens
accaccctgtttatccagagg

SEQ ID NO: 8401307 - DNA, 22 bp, Homo sapiens
aaggccaggcctagcacggagg

SEQ ID NO: 8401308 - DNA, 22 bp, Homo sapiens
aaggccagggatgccagctcgg

SEQ ID NO: 8401309 - DNA, 22 bp, Homo sapiens
aaggccaggccagatgacagtc

SEQ ID NO: 8401310 - DNA, 22 bp, Homo sapiens
aaggccaggcagggagctgtga

SEQ ID NO: 8401311 - DNA, 22 bp, Homo sapiens
aaggccaggagacttggagtca

SEQ ID NO: 8401312 - DNA, 22 bp, Homo sapiens
aaggccagcttgtagggctggt

SEQ ID NO: 8401313 - DNA, 22 bp, Homo sapiens
aaggccaggaaattatccctat

SEQ ID NO: 8401314 - DNA, 22 bp, Homo sapiens
aaggccaggacaccaggggact

SEQ ID NO: 8401315 - DNA, 22 bp, Homo sapiens
aaggccagcgcagaccattgtc

SEQ ID NO: 8401316 - DNA, 22 bp, Homo sapiens
aaggccagctggagggatgagg

SEQ ID NO: 8401317 - DNA, 22 bp, Homo sapiens
acatgggacagagaaagaggcc

SEQ ID NO: 8401318 - DNA, 21 bp, Homo sapiens
acatgggacctgcgaaaggaa

SEQ ID NO: 8401319 - DNA, 22 bp, Homo sapiens
acatgggagagaaataaatgta

SEQ ID NO: 8401320 - DNA, 23 bp, Homo sapiens
acatgggagggacatggaggctg

SEQ ID NO: 8401321 - DNA, 23 bp, Homo sapiens
acatgggaaatgcaaagagaagt

SEQ ID NO: 8401322 - DNA, 22 bp, Homo sapiens
acatggctcagtctcatgacag

SEQ ID NO: 8401323 - DNA, 22 bp, Homo sapiens
acatgggatcaatgaggcaggc

SEQ ID NO: 8401324 - DNA, 22 bp, Homo sapiens
acatgggatgacctccgatggt

SEQ ID NO: 8401325 - DNA, 22 bp, Homo sapiens
acatgggttattgtgaggttaa

SEQ ID NO: 8401326 - DNA, 22 bp, Homo sapiens
agaaaataatttcttggctggt

SEQ ID NO: 8401327 - DNA, 22 bp, Homo sapiens
aatattcatttgcagaagaagt

SEQ ID NO: 8401328 - DNA, 22 bp, Homo sapiens
agaaaatattcattgagaggct

SEQ ID NO: 8401329 - DNA, 22 bp, Homo sapiens
aatatgatccttaaccttcatg

SEQ ID NO: 8401330 - DNA, 22 bp, Homo sapiens
aatatgttcaaaatagatcact

SEQ ID NO: 8401331 - DNA, 22 bp, Homo sapiens
aatatcttctaaggatagaact

SEQ ID NO: 8401332 - DNA, 23 bp, Homo sapiens
acttccagttataggaactcttc

SEQ ID NO: 8401333 - DNA, 20 bp, Homo sapiens
acctggcttcctcttggcat

SEQ ID NO: 8401334 - DNA, 22 bp, Homo sapiens
accttggaaatgcccattgcct

SEQ ID NO: 8401335 - DNA, 22 bp, Homo sapiens
accttggaactgaagtgttttt

SEQ ID NO: 8401336 - DNA, 23 bp, Homo sapiens
accttggacttcccagcttccag

SEQ ID NO: 8401337 - DNA, 22 bp, Homo sapiens
actgagaagattctcactctta

SEQ ID NO: 8401338 - DNA, 22 bp, Homo sapiens
actgagaacttggggacagagg

SEQ ID NO: 8401339 - DNA, 22 bp, Homo sapiens
actgagacaactgtgtttctaa

SEQ ID NO: 8401340 - DNA, 22 bp, Homo sapiens
actgagactgagaatgtttctt

SEQ ID NO: 8401341 - DNA, 22 bp, Homo sapiens
aataaaatggtcagttttctca

SEQ ID NO: 8401342 - DNA, 22 bp, Homo sapiens
tcacatctaattccatttctgc

SEQ ID NO: 8401343 - DNA, 21 bp, Homo sapiens
tcacatctatgttaagcaaac

SEQ ID NO: 8401344 - DNA, 22 bp, Homo sapiens
tcacatctctcattgcctctgc

SEQ ID NO: 8401345 - DNA, 22 bp, Homo sapiens
tcacagcatttttagaaagatt

SEQ ID NO: 8401346 - DNA, 22 bp, Homo sapiens
tcacacagtgagaaagtgcgga

SEQ ID NO: 8401347 - DNA, 22 bp, Homo sapiens
tcacacagggttctggtctcat

SEQ ID NO: 8401348 - DNA, 18 bp, Homo sapiens
tcaaaatatttctgtgga

SEQ ID NO: 8401349 - DNA, 22 bp, Homo sapiens
tcacacagggtcggaaagagtg

SEQ ID NO: 8401350 - DNA, 22 bp, Homo sapiens
tcacacagcttggagttatggt

SEQ ID NO: 8401351 - DNA, 23 bp, Homo sapiens
tcacacagctggtcaggtacaga

SEQ ID NO: 8401352 - DNA, 22 bp, Homo sapiens
tcacacagattggtagagctga

SEQ ID NO: 8401353 - DNA, 22 bp, Homo sapiens
tcacacagctagtaagggccga

SEQ ID NO: 8401354 - DNA, 22 bp, Homo sapiens
tcacctctctggccgtctacct

SEQ ID NO: 8401355 - DNA, 22 bp, Homo sapiens
tcacccctaccaaggagcactg

SEQ ID NO: 8401356 - DNA, 22 bp, Homo sapiens
tcacccttagtgtactatcatg

SEQ ID NO: 8401357 - DNA, 22 bp, Homo sapiens
tcactgtccctgtcctcttatc

SEQ ID NO: 8401358 - DNA, 22 bp, Homo sapiens
tcactgggtaggacatgctgat

SEQ ID NO: 8401359 - DNA, 22 bp, Homo sapiens
tcactgtagagtctgtttccac

SEQ ID NO: 8401360 - DNA, 17 bp, Homo sapiens
tcactgggcctgctccc

SEQ ID NO: 8401361 - DNA, 22 bp, Homo sapiens
tcatcctgtatcctcagaccat

SEQ ID NO: 8401362 - DNA, 22 bp, Homo sapiens
tcatccctaaggacagctctgc

SEQ ID NO: 8401363 - DNA, 22 bp, Homo sapiens
tcatccctctgccaggcccagg

SEQ ID NO: 8401364 - DNA, 22 bp, Homo sapiens
tcagggtcagattccagagcct

SEQ ID NO: 8401365 - DNA, 22 bp, Homo sapiens
tcagggtcaggacccagctgtt

SEQ ID NO: 8401366 - DNA, 22 bp, Homo sapiens
tccctgcagcccctgagccttc

SEQ ID NO: 8401367 - DNA, 22 bp, Homo sapiens
tccctgcacagccgagccatgc

SEQ ID NO: 8401368 - DNA, 21 bp, Homo sapiens
tccctgagttctctgagcatc

SEQ ID NO: 8401369 - DNA, 22 bp, Homo sapiens
tcccttcaataattcaacatta

SEQ ID NO: 8401370 - DNA, 19 bp, Homo sapiens
tcccttcctgtcgggctcc

SEQ ID NO: 8401371 - DNA, 22 bp, Homo sapiens
tccggtccgggtactcctctct

SEQ ID NO: 8401372 - DNA, 22 bp, Homo sapiens
tcctccaggcacctcactggct

SEQ ID NO: 8401373 - DNA, 23 bp, Homo sapiens
tcctccagaggccctccttggcc

SEQ ID NO: 8401374 - DNA, 22 bp, Homo sapiens
tcctccaggtctagggtggctt

SEQ ID NO: 8401375 - DNA, 22 bp, Homo sapiens
tcctccagtggtactggccaat

SEQ ID NO: 8401376 - DNA, 22 bp, Homo sapiens
tccagcctgaactttgtccaga

SEQ ID NO: 8401377 - DNA, 22 bp, Homo sapiens
tccagcctggttgcgggcatcc

SEQ ID NO: 8401378 - DNA, 20 bp, Homo sapiens
tccagccctgcttctctctt

SEQ ID NO: 8401379 - DNA, 22 bp, Homo sapiens
tccagccttctcaaggctggct

SEQ ID NO: 8401380 - DNA, 22 bp, Homo sapiens
tccagccttctcaaggctggct

SEQ ID NO: 8401381 - DNA, 20 bp, Homo sapiens
tccagcccaggtcctgcctg

SEQ ID NO: 8401382 - DNA, 22 bp, Homo sapiens
tccagcccaggctggagtgtag

SEQ ID NO: 8401383 - DNA, 22 bp, Homo sapiens
tccagcccagtttggtgaattg

SEQ ID NO: 8401384 - DNA, 22 bp, Homo sapiens
tccagcccatccctagcctggg

SEQ ID NO: 8401385 - DNA, 22 bp, Homo sapiens
tccagccccgaggccggcgacg

SEQ ID NO: 8401386 - DNA, 19 bp, Homo sapiens
tccagcccctctgtgtgtg

SEQ ID NO: 8401387 - DNA, 22 bp, Homo sapiens
tccagcccctcctgagccaagc

SEQ ID NO: 8401388 - DNA, 22 bp, Homo sapiens
tccagccccgggatgttcttca

SEQ ID NO: 8401389 - DNA, 22 bp, Homo sapiens
tccagccccggcttccttacag

SEQ ID NO: 8401390 - DNA, 22 bp, Homo sapiens
tccagccctgcttcctgcctca

SEQ ID NO: 8401391 - DNA, 22 bp, Homo sapiens
tccagccctgcccattctctcg

SEQ ID NO: 8401392 - DNA, 17 bp, Homo sapiens
tccagccctgcccgacg

SEQ ID NO: 8401393 - DNA, 22 bp, Homo sapiens
tccagccctcctgggatcacag

SEQ ID NO: 8401394 - DNA, 20 bp, Homo sapiens
tccagccctcatgtcgctca

SEQ ID NO: 8401395 - DNA, 22 bp, Homo sapiens
tccagccctgcactgattagat

SEQ ID NO: 8401396 - DNA, 22 bp, Homo sapiens
tccagccctctggcccgcggtg

SEQ ID NO: 8401397 - DNA, 22 bp, Homo sapiens
tccagccccttttactcattca

SEQ ID NO: 8401398 - DNA, 20 bp, Homo sapiens
tccagcccctgcatgttgct

SEQ ID NO: 8401399 - DNA, 22 bp, Homo sapiens
tccagcccgggggcaggtgacc

SEQ ID NO: 8401400 - DNA, 22 bp, Homo sapiens
tccagcccgagggcgctgatga

SEQ ID NO: 8401401 - DNA, 22 bp, Homo sapiens
tccagcccgactgggcctgccg

SEQ ID NO: 8401402 - DNA, 22 bp, Homo sapiens
tccagccctcagccaagtggaa

SEQ ID NO: 8401403 - DNA, 22 bp, Homo sapiens
tcatggcttcaaggaagcaggc

SEQ ID NO: 8401404 - DNA, 22 bp, Homo sapiens
tcccagattcctgctcttatat

SEQ ID NO: 8401405 - DNA, 22 bp, Homo sapiens
tacatacacaaatatactgttt

SEQ ID NO: 8401406 - DNA, 22 bp, Homo sapiens
taccttgggagacgccaggccc

SEQ ID NO: 8401407 - DNA, 22 bp, Homo sapiens
taccttggaggccaagcagttt

SEQ ID NO: 8401408 - DNA, 22 bp, Homo sapiens
taccttggaaatgctagagtaa

SEQ ID NO: 8401409 - DNA, 22 bp, Homo sapiens
taccttggggttttgttgctct

SEQ ID NO: 8401410 - DNA, 22 bp, Homo sapiens
taccttgggttgagttcattct

SEQ ID NO: 8401411 - DNA, 22 bp, Homo sapiens
taccttgggctattatctttga

SEQ ID NO: 8401412 - DNA, 22 bp, Homo sapiens
tacctggggctgggctttgatt

SEQ ID NO: 8401413 - DNA, 22 bp, Homo sapiens
tacctggagcaggaggcagaat

SEQ ID NO: 8401414 - DNA, 22 bp, Homo sapiens
tacctggatatcattcattctc

SEQ ID NO: 8401415 - DNA, 22 bp, Homo sapiens
tacctggaatcacagaggctga

SEQ ID NO: 8401416 - DNA, 22 bp, Homo sapiens
tacctggaatagagtctctcca

SEQ ID NO: 8401417 - DNA, 22 bp, Homo sapiens
tacctttgatctggaattttaa

SEQ ID NO: 8401418 - DNA, 20 bp, Homo sapiens
tacaatattcccactttgct

SEQ ID NO: 8401419 - DNA, 20 bp, Homo sapiens
tacaatattcccactttgct

SEQ ID NO: 8401420 - DNA, 22 bp, Homo sapiens
tacaatatgtggccttttgtga

SEQ ID NO: 8401421 - DNA, 22 bp, Homo sapiens
taatgcttttccttcaaataag

SEQ ID NO: 8401422 - DNA, 22 bp, Homo sapiens
taatgaggaaatagagggaatg

SEQ ID NO: 8401423 - DNA, 22 bp, Homo sapiens
taagttacctgttttgtcatca

SEQ ID NO: 8401424 - DNA, 22 bp, Homo sapiens
taacttctctgctatcatagga

SEQ ID NO: 8401425 - DNA, 22 bp, Homo sapiens
taaacatgttgacatcttacct

SEQ ID NO: 8401426 - DNA, 22 bp, Homo sapiens
gtttctctttgaagcctggctg

SEQ ID NO: 8401427 - DNA, 22 bp, Homo sapiens
gttcctgggaggcatgggctgg

SEQ ID NO: 8401428 - DNA, 22 bp, Homo sapiens
tatgttaagtgggataatcaaa

SEQ ID NO: 8401429 - DNA, 22 bp, Homo sapiens
tatgttcatctggtgcatcagt

SEQ ID NO: 8401430 - DNA, 22 bp, Homo sapiens
tattcatagtaaacaaaagtgg

SEQ ID NO: 8401431 - DNA, 22 bp, Homo sapiens
tatttctaagctgtaagtctga

SEQ ID NO: 8401432 - DNA, 22 bp, Homo sapiens
tatttcacataccacagagtgt

SEQ ID NO: 8401433 - DNA, 22 bp, Homo sapiens
tatttcacagcagctcatttaa

SEQ ID NO: 8401434 - DNA, 22 bp, Homo sapiens
tatacgtgcaggtcacagggga

SEQ ID NO: 8401435 - DNA, 22 bp, Homo sapiens
taggaattatgatgctatcaag

SEQ ID NO: 8401436 - DNA, 22 bp, Homo sapiens
taggaaagcagtagagccagga

SEQ ID NO: 8401437 - DNA, 22 bp, Homo sapiens
taggaaagaaatgagtagtgat

SEQ ID NO: 8401438 - DNA, 22 bp, Homo sapiens
taggctggaacttaggcagagg

SEQ ID NO: 8401439 - DNA, 21 bp, Homo sapiens
tagcacagctgtagacagttt

SEQ ID NO: 8401440 - DNA, 22 bp, Homo sapiens
tagcacagggctcctcaaccca

SEQ ID NO: 8401441 - DNA, 22 bp, Homo sapiens
tagcacagtgttcacaacagtg

SEQ ID NO: 8401442 - DNA, 22 bp, Homo sapiens
tagcacagtatttctcaactgg

SEQ ID NO: 8401443 - DNA, 23 bp, Homo sapiens
tagaatcctctgagatggaatag

SEQ ID NO: 8401444 - DNA, 22 bp, Homo sapiens
tagaggagggctgttcttcagt

SEQ ID NO: 8401445 - DNA, 21 bp, Homo sapiens
tagagatgacgagctctagca

SEQ ID NO: 8401446 - DNA, 22 bp, Homo sapiens
tagagaggtttgaattggctgc

SEQ ID NO: 8401447 - DNA, 22 bp, Homo sapiens
ggaaagggcagaggccttggag

SEQ ID NO: 8401448 - DNA, 22 bp, Homo sapiens
ggaaaggagatattggagagtg

SEQ ID NO: 8401449 - DNA, 22 bp, Homo sapiens
gcttcccaggcgcctgaccttt

SEQ ID NO: 8401450 - DNA, 22 bp, Homo sapiens
gcttccgcgatgtcctaggtgg

SEQ ID NO: 8401451 - DNA, 23 bp, Homo sapiens
gcttcccagacaatactgcttcc

SEQ ID NO: 8401452 - DNA, 22 bp, Homo sapiens
ggaagcaggaggctggggtaaa

SEQ ID NO: 8401453 - DNA, 22 bp, Homo sapiens
ggaacagggatttggcctggtt

SEQ ID NO: 8401454 - DNA, 20 bp, Homo sapiens
ggaacatgaatgtgagtggc

SEQ ID NO: 8401455 - DNA, 22 bp, Homo sapiens
ggagagagagctcattagctgc

SEQ ID NO: 8401456 - DNA, 17 bp, Homo sapiens
ggacacctggagtctcc

SEQ ID NO: 8401457 - DNA, 22 bp, Homo sapiens
gctgggagtcgcgtctgtggcc

SEQ ID NO: 8401458 - DNA, 22 bp, Homo sapiens
gctgggtggatcggaggctctg

SEQ ID NO: 8401459 - DNA, 22 bp, Homo sapiens
gctgggtttccagcaggcagga

SEQ ID NO: 8401460 - DNA, 22 bp, Homo sapiens
gctggctcccagaggccccagc

SEQ ID NO: 8401461 - DNA, 22 bp, Homo sapiens
gctggctgcacaggggctcact

SEQ ID NO: 8401462 - DNA, 22 bp, Homo sapiens
gctggctctgcacccaggcctc

SEQ ID NO: 8401463 - DNA, 19 bp, Homo sapiens
gctgcacacccagcaactg

SEQ ID NO: 8401464 - DNA, 22 bp, Homo sapiens
gctgcacatggcagaggccttt

SEQ ID NO: 8401465 - DNA, 22 bp, Homo sapiens
gctgccagccctcggggtctga

SEQ ID NO: 8401466 - DNA, 22 bp, Homo sapiens
gctgcagactgggaggcaggtg

SEQ ID NO: 8401467 - DNA, 20 bp, Homo sapiens
gctcctgtcctggtggaggg

SEQ ID NO: 8401468 - DNA, 22 bp, Homo sapiens
gctcagggaaagagctcctgtc

SEQ ID NO: 8401469 - DNA, 22 bp, Homo sapiens
gctcaccaagcagagactctgg

SEQ ID NO: 8401470 - DNA, 22 bp, Homo sapiens
gctcaccttcgtccagcagccg

SEQ ID NO: 8401471 - DNA, 22 bp, Homo sapiens
gcctggctgcttagcctacttc

SEQ ID NO: 8401472 - DNA, 21 bp, Homo sapiens
gcctggcttcacaggcactga

SEQ ID NO: 8401473 - DNA, 22 bp, Homo sapiens
gcctggcttgccagccctggcg

SEQ ID NO: 8401474 - DNA, 22 bp, Homo sapiens
gcctggctgccggccttggcaa

SEQ ID NO: 8401475 - DNA, 22 bp, Homo sapiens
gcctggctgctcagccactcac

SEQ ID NO: 8401476 - DNA, 22 bp, Homo sapiens
gcctcagccggcggacgccagg

SEQ ID NO: 8401477 - DNA, 22 bp, Homo sapiens
gcctcagctcccagcccaggct

SEQ ID NO: 8401478 - DNA, 22 bp, Homo sapiens
gcccataattcaaatataacac

SEQ ID NO: 8401479 - DNA, 22 bp, Homo sapiens
gccagtggcatgcggcagggac

SEQ ID NO: 8401480 - DNA, 22 bp, Homo sapiens
gccaggtgtagtggccacacct

SEQ ID NO: 8401481 - DNA, 22 bp, Homo sapiens
gcagtcacagggagatggtgac

SEQ ID NO: 8401482 - DNA, 22 bp, Homo sapiens
gcagtcctagggtgctctgcag

SEQ ID NO: 8401483 - DNA, 22 bp, Homo sapiens
gcagtcctctcattggcctcct

SEQ ID NO: 8401484 - DNA, 22 bp, Homo sapiens
gcacaggcaatagatacagcta

SEQ ID NO: 8401485 - DNA, 22 bp, Homo sapiens
gaggggtcacatgggctggctt

SEQ ID NO: 8401486 - DNA, 22 bp, Homo sapiens
gaggggtcctgccttggctgga

SEQ ID NO: 8401487 - DNA, 22 bp, Homo sapiens
gagggggagatgtgcacacact

SEQ ID NO: 8401488 - DNA, 23 bp, Homo sapiens
gcactgccatgtgctctgcaggc

SEQ ID NO: 8401489 - DNA, 22 bp, Homo sapiens
gcaggagttaggcgtcgtggat

SEQ ID NO: 8401490 - DNA, 22 bp, Homo sapiens
gcagcagcggggcccctgcgcg

SEQ ID NO: 8401491 - DNA, 22 bp, Homo sapiens
ggctaggctcacctggagagtt

SEQ ID NO: 8401492 - DNA, 22 bp, Homo sapiens
ggctaggcgggcacatggtgga

SEQ ID NO: 8401493 - DNA, 23 bp, Homo sapiens
ggctggtgcccttggccagtcgg

SEQ ID NO: 8401494 - DNA, 22 bp, Homo sapiens
ggctggagaagggtggttgaca

SEQ ID NO: 8401495 - DNA, 21 bp, Homo sapiens
ggctgctgggggttggcacag

SEQ ID NO: 8401496 - DNA, 22 bp, Homo sapiens
gggcagtgacaaaggggatgaa

SEQ ID NO: 8401497 - DNA, 22 bp, Homo sapiens
gggaggtgattaggaccatgta

SEQ ID NO: 8401498 - DNA, 22 bp, Homo sapiens
gggaatgaccttaataagtagg

SEQ ID NO: 8401499 - DNA, 23 bp, Homo sapiens
gggaagtggggatttgaagtcat

SEQ ID NO: 8401500 - DNA, 22 bp, Homo sapiens
gggaagtgtgcagagttctctt

SEQ ID NO: 8401501 - DNA, 17 bp, Homo sapiens
gggaagtggagaaagct

SEQ ID NO: 8401502 - DNA, 22 bp, Homo sapiens
gggagctggagctggaagactc

SEQ ID NO: 8401503 - DNA, 22 bp, Homo sapiens
gggaaggctgcctgagggatgg

SEQ ID NO: 8401504 - DNA, 21 bp, Homo sapiens
ggccctggttacgcctcctct

SEQ ID NO: 8401505 - DNA, 22 bp, Homo sapiens
ggcgggtgcacagacccttccc

SEQ ID NO: 8401506 - DNA, 17 bp, Homo sapiens
ggcagggtgctgggtat

SEQ ID NO: 8401507 - DNA, 22 bp, Homo sapiens
ggcagaaggcaattagagactg

SEQ ID NO: 8401508 - DNA, 22 bp, Homo sapiens
ggatgctcagtgcctgtgtcca

SEQ ID NO: 8401509 - DNA, 22 bp, Homo sapiens
gtccctggaatggactctgcgc

SEQ ID NO: 8401510 - DNA, 22 bp, Homo sapiens
gtcctctgagggggctgcacgc

SEQ ID NO: 8401511 - DNA, 22 bp, Homo sapiens
gtcctctgaaagatgaaccatg

SEQ ID NO: 8401512 - DNA, 22 bp, Homo sapiens
gtcaccaggtctgatgcagcca

SEQ ID NO: 8401513 - DNA, 22 bp, Homo sapiens
gtagcaggtattctggtgtgag

SEQ ID NO: 8401514 - DNA, 22 bp, Homo sapiens
gtcaacataggcctcagtgagg

SEQ ID NO: 8401515 - DNA, 22 bp, Homo sapiens
gtaggaaagggagtgaagggaa

SEQ ID NO: 8401516 - DNA, 22 bp, Homo sapiens
ggtgggcacccgagactggatc

SEQ ID NO: 8401517 - DNA, 22 bp, Homo sapiens
ggtgggcagctcttggcaggca

SEQ ID NO: 8401518 - DNA, 22 bp, Homo sapiens
gtctgggtctccacagtcagca

SEQ ID NO: 8401519 - DNA, 22 bp, Homo sapiens
gtgattttgagacctatatagt

SEQ ID NO: 8401520 - DNA, 23 bp, Homo sapiens
gtgccgacgctccagcaccatcc

SEQ ID NO: 8401521 - DNA, 16 bp, Homo sapiens
ggtgggaggtgaggtg

SEQ ID NO: 8401522 - DNA, 22 bp, Homo sapiens
ggtgggcaacatttggcctgag

SEQ ID NO: 8401523 - DNA, 22 bp, Homo sapiens
ggtgccagtgggtctcaggata

SEQ ID NO: 8401524 - DNA, 22 bp, Homo sapiens
gggctgggcatggtgttccctc

SEQ ID NO: 8401525 - DNA, 23 bp, Homo sapiens
cctggggcacttgagtcctcatc

SEQ ID NO: 8401526 - DNA, 22 bp, Homo sapiens
tgttgattagtgtttagactta

SEQ ID NO: 8401527 - DNA, 22 bp, Homo sapiens
cctgctcagagcgtcttgtgtg

SEQ ID NO: 8401528 - DNA, 23 bp, Homo sapiens
cctgctcaggcgtgtgccctgct

SEQ ID NO: 8401529 - DNA, 22 bp, Homo sapiens
cctgctcatgggtccctggcag

SEQ ID NO: 8401530 - DNA, 22 bp, Homo sapiens
cctgctcacctgatgtggcaac

SEQ ID NO: 8401531 - DNA, 22 bp, Homo sapiens
cctggtttgggtgccagtgagt

SEQ ID NO: 8401532 - DNA, 22 bp, Homo sapiens
cctgtggaccaggaggcagccc

SEQ ID NO: 8401533 - DNA, 22 bp, Homo sapiens
ttacaataccacatcacctcat

SEQ ID NO: 8401534 - DNA, 21 bp, Homo sapiens
ccttctccacagggtctccgg

SEQ ID NO: 8401535 - DNA, 19 bp, Homo sapiens
ccttgtctggtgaaggact

SEQ ID NO: 8401536 - DNA, 22 bp, Homo sapiens
cctttaaatggatgttcaactg

SEQ ID NO: 8401537 - DNA, 22 bp, Homo sapiens
ttacctggtgtttatggtccat

SEQ ID NO: 8401538 - DNA, 22 bp, Homo sapiens
ctcagccagtgatctttccttt

SEQ ID NO: 8401539 - DNA, 22 bp, Homo sapiens
ttctacattgtgaagttcttta

SEQ ID NO: 8401540 - DNA, 22 bp, Homo sapiens
ttcctccagcctggagcacttc

SEQ ID NO: 8401541 - DNA, 22 bp, Homo sapiens
cgtcctgggtctgggaaggcat

SEQ ID NO: 8401542 - DNA, 18 bp, Homo sapiens
ttcagtttctagttcctt

SEQ ID NO: 8401543 - DNA, 22 bp, Homo sapiens
ttccacggggctccccgctctt

SEQ ID NO: 8401544 - DNA, 22 bp, Homo sapiens
ctgaaggatgtgtggtgggagt

SEQ ID NO: 8401545 - DNA, 22 bp, Homo sapiens
ctctggagtgcagcctggtggc

SEQ ID NO: 8401546 - DNA, 22 bp, Homo sapiens
ctgaggaaggagttaggcagtt

SEQ ID NO: 8401547 - DNA, 22 bp, Homo sapiens
ctgagctgtttaatcccagata

SEQ ID NO: 8401548 - DNA, 22 bp, Homo sapiens
ctgcagggtttttcaaggacaa

SEQ ID NO: 8401549 - DNA, 22 bp, Homo sapiens
ctgctccccagcctgcgccttt

SEQ ID NO: 8401550 - DNA, 22 bp, Homo sapiens
ctgctggcctcggccatgcctg

SEQ ID NO: 8401551 - DNA, 22 bp, Homo sapiens
ctgctgctgctatctacccagg

SEQ ID NO: 8401552 - DNA, 22 bp, Homo sapiens
ctgctgctgagagctcagcctg

SEQ ID NO: 8401553 - DNA, 22 bp, Homo sapiens
tttgaagtgtatgaaaatacag

SEQ ID NO: 8401554 - DNA, 21 bp, Homo sapiens
ctctggaggcaagggagagtg

SEQ ID NO: 8401555 - DNA, 22 bp, Homo sapiens
ctctggaggccgttggccctta

SEQ ID NO: 8401556 - DNA, 22 bp, Homo sapiens
ctctggaggtggaggttgcagt

SEQ ID NO: 8401557 - DNA, 19 bp, Homo sapiens
tttctctccctcatcccga

SEQ ID NO: 8401558 - DNA, 22 bp, Homo sapiens
tttctctctggccctgattgtc

SEQ ID NO: 8401559 - DNA, 22 bp, Homo sapiens
tttctgcaaacttccacgtctc

SEQ ID NO: 8401560 - DNA, 22 bp, Homo sapiens
tttctgatatactgtagaatcc

SEQ ID NO: 8401561 - DNA, 22 bp, Homo sapiens
tttctgatattcatttagaaga

SEQ ID NO: 8401562 - DNA, 19 bp, Homo sapiens
tttctgtttgcttctggtt

SEQ ID NO: 8401563 - DNA, 22 bp, Homo sapiens
ctctgacagccttcattatgca

SEQ ID NO: 8401564 - DNA, 22 bp, Homo sapiens
ctcctggaagcccgccctgctg

SEQ ID NO: 8401565 - DNA, 22 bp, Homo sapiens
ctcctggacatggagcggagga

SEQ ID NO: 8401566 - DNA, 22 bp, Homo sapiens
ctcctggagcagcaggcgcagg

SEQ ID NO: 8401567 - DNA, 22 bp, Homo sapiens
ctcctggaccaccttgtggcca

SEQ ID NO: 8401568 - DNA, 22 bp, Homo sapiens
ctcctggaccagggctattggg

SEQ ID NO: 8401569 - DNA, 22 bp, Homo sapiens
ctcctggagggccaaagaaata

SEQ ID NO: 8401570 - DNA, 22 bp, Homo sapiens
ctcctggaggatagtgactggg

SEQ ID NO: 8401571 - DNA, 22 bp, Homo sapiens
ctcctggaggctccaagggaga

SEQ ID NO: 8401572 - DNA, 23 bp, Homo sapiens
ctcctggagggtccggccctgcc

SEQ ID NO: 8401573 - DNA, 22 bp, Homo sapiens
ctcctggagtcctttcctattc

SEQ ID NO: 8401574 - DNA, 22 bp, Homo sapiens
ctcctggatcttagccagattc

SEQ ID NO: 8401575 - DNA, 22 bp, Homo sapiens
tttacaattggttttctctaat

SEQ ID NO: 8401576 - DNA, 22 bp, Homo sapiens
ctcctgtggtactcccagggcc

SEQ ID NO: 8401577 - DNA, 20 bp, Homo sapiens
ctcctgtgcctctctgggcc

SEQ ID NO: 8401578 - DNA, 22 bp, Homo sapiens
ctcctgtcagaagcatcctgag

SEQ ID NO: 8401579 - DNA, 22 bp, Homo sapiens
ctcctgtcaataggctcctggc

SEQ ID NO: 8401580 - DNA, 22 bp, Homo sapiens
tttcaaataccataaacctaat

SEQ ID NO: 8401581 - DNA, 22 bp, Homo sapiens
ctctaaatccaaataagtgtcc

SEQ ID NO: 8401582 - DNA, 22 bp, Homo sapiens
ctctaaatccacggtatagttg

SEQ ID NO: 8401583 - DNA, 22 bp, Homo sapiens
ctctaatactgaccaagtcacc

SEQ ID NO: 8401584 - DNA, 22 bp, Homo sapiens
ctccctgaaattcagatgcctc

SEQ ID NO: 8401585 - DNA, 22 bp, Homo sapiens
gaagggaatttggagggtttca

SEQ ID NO: 8401586 - DNA, 22 bp, Homo sapiens
gaagggagaaggttgggtgacg

SEQ ID NO: 8401587 - DNA, 22 bp, Homo sapiens
gacagaaggcatctagggcacg

SEQ ID NO: 8401588 - DNA, 22 bp, Homo sapiens
gacagacaggagctcacaggca

SEQ ID NO: 8401589 - DNA, 22 bp, Homo sapiens
gacagacaggaggcattcaggg

SEQ ID NO: 8401590 - DNA, 22 bp, Homo sapiens
gaaggggagtggctagtgtgtg

SEQ ID NO: 8401591 - DNA, 22 bp, Homo sapiens
gaaggtagctgctgagatgaca

SEQ ID NO: 8401592 - DNA, 22 bp, Homo sapiens
gaatatttgtaattactgttga

SEQ ID NO: 8401593 - DNA, 22 bp, Homo sapiens
gactctttcaaacagaaagcca

SEQ ID NO: 8401594 - DNA, 22 bp, Homo sapiens
gactctgggaggtggactgagg

SEQ ID NO: 8401595 - DNA, 22 bp, Homo sapiens
gagactggtgtttgctgggctg

SEQ ID NO: 8401596 - DNA, 22 bp, Homo sapiens
gagacctgcagctgtagtctgc

SEQ ID NO: 8401597 - DNA, 22 bp, Homo sapiens
gaggaaagaaccccagtcaata

SEQ ID NO: 8401598 - DNA, 23 bp, Homo sapiens
gaggaaagaatatagatgcaatc

SEQ ID NO: 8401599 - DNA, 22 bp, Homo sapiens
gaggaaagagtcaaatctgaag

SEQ ID NO: 8401600 - DNA, 22 bp, Homo sapiens
gaggaaagctggtttaaagtat

SEQ ID NO: 8401601 - DNA, 22 bp, Homo sapiens
gaggagagagggactgtctgca

SEQ ID NO: 8401602 - DNA, 22 bp, Homo sapiens
gaggaacagagacgggatcgct

SEQ ID NO: 8401603 - DNA, 18 bp, Homo sapiens
gagccctgagtctgcaca

SEQ ID NO: 8401604 - DNA, 22 bp, Homo sapiens
gagccctggcagtctgggatgg

SEQ ID NO: 8401605 - DNA, 22 bp, Homo sapiens
gagcatggatagaaggtgggat

SEQ ID NO: 8401606 - DNA, 22 bp, Homo sapiens
gagcatggatcatgtgctgggt

SEQ ID NO: 8401607 - DNA, 22 bp, Homo sapiens
gagcatggcagctgagggcagg

SEQ ID NO: 8401608 - DNA, 22 bp, Homo sapiens
gagaggggcgcgcagctcgcga

SEQ ID NO: 8401609 - DNA, 22 bp, Homo sapiens
gagagggtgcctggaagccagg

SEQ ID NO: 8401610 - DNA, 22 bp, Homo sapiens
gagagggtgcctggaagccagg

SEQ ID NO: 8401611 - DNA, 22 bp, Homo sapiens
gagcatggttccataggttggt

SEQ ID NO: 8401612 - DNA, 16 bp, Homo sapiens
gagcatggtggcgggc

SEQ ID NO: 8401613 - DNA, 22 bp, Homo sapiens
gaggcaggccctgaatgagtca

SEQ ID NO: 8401614 - DNA, 22 bp, Homo sapiens
gaggagaggctggacgcggtga

SEQ ID NO: 8401615 - DNA, 22 bp, Homo sapiens
gagggagctggagcagacgccg

SEQ ID NO: 8401616 - DNA, 22 bp, Homo sapiens
gaggggctgccctggtgtcagg

SEQ ID NO: 8401617 - DNA, 22 bp, Homo sapiens
gagggagtgccagagggccagc

SEQ ID NO: 8401618 - DNA, 18 bp, Homo sapiens
gagggagtagctgaggtt

SEQ ID NO: 8401619 - DNA, 22 bp, Homo sapiens
gaaagctctgcttcagcctgca

SEQ ID NO: 8401620 - DNA, 22 bp, Homo sapiens
gaaacacatgcagctccataga

SEQ ID NO: 8401621 - DNA, 22 bp, Homo sapiens
cttctgggtgtggagtgaggac

SEQ ID NO: 8401622 - DNA, 22 bp, Homo sapiens
cttccagctgattacaggctat

SEQ ID NO: 8401623 - DNA, 22 bp, Homo sapiens
cttccagctgattggcatccag

SEQ ID NO: 8401624 - DNA, 22 bp, Homo sapiens
cttccagcttgtggcgctttcc

SEQ ID NO: 8401625 - DNA, 22 bp, Homo sapiens
cttctcagcatggttactgtga

SEQ ID NO: 8401626 - DNA, 19 bp, Homo sapiens
cttcattcttcagcttttg

SEQ ID NO: 8401627 - DNA, 22 bp, Homo sapiens
ctgtgcttcgcaactccaaggt

SEQ ID NO: 8401628 - DNA, 22 bp, Homo sapiens
cttaaaatctggcagttagcta

SEQ ID NO: 8401629 - DNA, 20 bp, Homo sapiens
cttaaacacagagatagatt

SEQ ID NO: 8401630 - DNA, 22 bp, Homo sapiens
cttacaaatacacttaggagag

SEQ ID NO: 8401631 - DNA, 22 bp, Homo sapiens
cttacaaaggagaggagatagg

SEQ ID NO: 8401632 - DNA, 22 bp, Homo sapiens
ctgtcacttaaattcaggctga

SEQ ID NO: 8401633 - DNA, 22 bp, Homo sapiens
ctgtgctggtgaaacccacaga

SEQ ID NO: 8401634 - DNA, 16 bp, Homo sapiens
ctggtcttgctgccga

SEQ ID NO: 8401635 - DNA, 22 bp, Homo sapiens
ctggggacgtcgggcagtgttc

SEQ ID NO: 8401636 - DNA, 22 bp, Homo sapiens
ctgggatgtgaggagcgcctct

SEQ ID NO: 8401637 - DNA, 22 bp, Homo sapiens
ctgggcacttgctcacagctct

SEQ ID NO: 8401638 - DNA, 22 bp, Homo sapiens
ctgggagccctgactagcctgg

SEQ ID NO: 8401639 - DNA, 22 bp, Homo sapiens
ctgggagaggctgctccgctct

SEQ ID NO: 8401640 - DNA, 22 bp, Homo sapiens
ctgggaccatctgtgtctactt

SEQ ID NO: 8401641 - DNA, 22 bp, Homo sapiens
ctgggacatagatcagcctttt

SEQ ID NO: 8401642 - DNA, 22 bp, Homo sapiens
ctgctgtgttcctcctgcatct

SEQ ID NO: 8401643 - DNA, 22 bp, Homo sapiens
ctgctgttgccacctgcatgga

SEQ ID NO: 8401644 - DNA, 20 bp, Homo sapiens
ctgcttccaggctcaccccc

SEQ ID NO: 8401645 - DNA, 22 bp, Homo sapiens
tgctacaggcgatcctcaacta

SEQ ID NO: 8401646 - DNA, 21 bp, Homo sapiens
tgcttccctgggccacactga

SEQ ID NO: 8401647 - DNA, 22 bp, Homo sapiens
tggagactcagaaggggaagca

SEQ ID NO: 8401648 - DNA, 22 bp, Homo sapiens
ccctggatttacatcattctga

SEQ ID NO: 8401649 - DNA, 22 bp, Homo sapiens
ccctggagtgtgacgaggcatt

SEQ ID NO: 8401650 - DNA, 19 bp, Homo sapiens
tggcaggcccaggatggac

SEQ ID NO: 8401651 - DNA, 22 bp, Homo sapiens
tggcaggctgagttggcctggt

SEQ ID NO: 8401652 - DNA, 22 bp, Homo sapiens
tggcaggctctgagtagcacct

SEQ ID NO: 8401653 - DNA, 22 bp, Homo sapiens
tggcaggcggaggttgcagtga

SEQ ID NO: 8401654 - DNA, 22 bp, Homo sapiens
ccctttaaagttttaccagcag

SEQ ID NO: 8401655 - DNA, 22 bp, Homo sapiens
cccttggaggaagctctaggct

SEQ ID NO: 8401656 - DNA, 19 bp, Homo sapiens
tggcagtgtggggtatgaa

SEQ ID NO: 8401657 - DNA, 22 bp, Homo sapiens
tggcagtgtataggtggctcct

SEQ ID NO: 8401658 - DNA, 22 bp, Homo sapiens
tggcagtggctttgctggtgga

SEQ ID NO: 8401659 - DNA, 22 bp, Homo sapiens
tggcagtgggaagctggaagtc

SEQ ID NO: 8401660 - DNA, 22 bp, Homo sapiens
tggcagtggtgtctgcacaggc

SEQ ID NO: 8401661 - DNA, 17 bp, Homo sapiens
cctcccacaccgccctg

SEQ ID NO: 8401662 - DNA, 19 bp, Homo sapiens
cctctcccatgcttacctc

SEQ ID NO: 8401663 - DNA, 23 bp, Homo sapiens
tgggatagaatttcatggctgct

SEQ ID NO: 8401664 - DNA, 21 bp, Homo sapiens
tgggatagaaatatggctgct

SEQ ID NO: 8401665 - DNA, 22 bp, Homo sapiens
tgggagagagaattcccagtgg

SEQ ID NO: 8401666 - DNA, 22 bp, Homo sapiens
tgggtggattaggatagggtat

SEQ ID NO: 8401667 - DNA, 22 bp, Homo sapiens
tgcacagatgggcttgttcata

SEQ ID NO: 8401668 - DNA, 22 bp, Homo sapiens
tgcactccaggctgggtgacag

SEQ ID NO: 8401669 - DNA, 22 bp, Homo sapiens
tgcactccaggctgggtgacag

SEQ ID NO: 8401670 - DNA, 22 bp, Homo sapiens
cccagagcctcattctgttggg

SEQ ID NO: 8401671 - DNA, 22 bp, Homo sapiens
ccatccctgggccatgtcccct

SEQ ID NO: 8401672 - DNA, 22 bp, Homo sapiens
tgagtctggcggagggaggagc

SEQ ID NO: 8401673 - DNA, 22 bp, Homo sapiens
tgagtcctgctctgggcagggt

SEQ ID NO: 8401674 - DNA, 22 bp, Homo sapiens
tgagtcctggctttgggatgta

SEQ ID NO: 8401675 - DNA, 18 bp, Homo sapiens
tgaggcccatctctctga

SEQ ID NO: 8401676 - DNA, 22 bp, Homo sapiens
ccagtcagccaagctgcagcgg

SEQ ID NO: 8401677 - DNA, 22 bp, Homo sapiens
ccagtcactggaaaatgggaat

SEQ ID NO: 8401678 - DNA, 22 bp, Homo sapiens
ccaggcttattatcttctccat

SEQ ID NO: 8401679 - DNA, 22 bp, Homo sapiens
ccaggcctgattgggaatcttg

SEQ ID NO: 8401680 - DNA, 21 bp, Homo sapiens
ccagggatgttgaactgaaag

SEQ ID NO: 8401681 - DNA, 22 bp, Homo sapiens
ccagggctctgcttctgccatg

SEQ ID NO: 8401682 - DNA, 22 bp, Homo sapiens
ccagggctgagctgtgaccatg

SEQ ID NO: 8401683 - DNA, 22 bp, Homo sapiens
tctgttcatgtctttttaagtg

SEQ ID NO: 8401684 - DNA, 17 bp, Homo sapiens
tcttctcttccagtctt

SEQ ID NO: 8401685 - DNA, 22 bp, Homo sapiens
tcttctctgtggcctggtggtg

SEQ ID NO: 8401686 - DNA, 17 bp, Homo sapiens
tcttctcttccagtctt

SEQ ID NO: 8401687 - DNA, 22 bp, Homo sapiens
cagtaattccaagtgcttatac

SEQ ID NO: 8401688 - DNA, 22 bp, Homo sapiens
caggtggggagagtgtggagca

SEQ ID NO: 8401689 - DNA, 22 bp, Homo sapiens
caggtggggcagctgtgggagc

SEQ ID NO: 8401690 - DNA, 22 bp, Homo sapiens
tcacactggcagtgctgaaggc

SEQ ID NO: 8401691 - DNA, 22 bp, Homo sapiens
tcacactggcagtgctgaaggc

SEQ ID NO: 8401692 - DNA, 23 bp, Homo sapiens
tcacactggatacacatgcaaga

SEQ ID NO: 8401693 - DNA, 22 bp, Homo sapiens
tcacactgtgaagagacaagca

SEQ ID NO: 8401694 - DNA, 22 bp, Homo sapiens
tcacactgtgaagagacaagca

SEQ ID NO: 8401695 - DNA, 22 bp, Homo sapiens
cagtgctgttgtaagctcattg

SEQ ID NO: 8401696 - DNA, 22 bp, Homo sapiens
tcactgcaacctccacctcctg

SEQ ID NO: 8401697 - DNA, 22 bp, Homo sapiens
tcactgcaacctccacctcctg

SEQ ID NO: 8401698 - DNA, 22 bp, Homo sapiens
tacagcctcttccctggagtgg

SEQ ID NO: 8401699 - DNA, 22 bp, Homo sapiens
tacaatatgtgaactttggtgt

SEQ ID NO: 8401700 - DNA, 22 bp, Homo sapiens
gtggagcaggactagctgagaa

SEQ ID NO: 8401701 - DNA, 22 bp, Homo sapiens
cagggatgagcagatggagcaa

SEQ ID NO: 8401702 - DNA, 22 bp, Homo sapiens
cagggagaggctggtggagtaa

SEQ ID NO: 8401703 - DNA, 22 bp, Homo sapiens
cagggagaggcatcatagggaa

SEQ ID NO: 8401704 - DNA, 22 bp, Homo sapiens
cagggagaagtctggtcagtcc

SEQ ID NO: 8401705 - DNA, 22 bp, Homo sapiens
tagaaagactgtccagatttca

SEQ ID NO: 8401706 - DNA, 22 bp, Homo sapiens
taccctggagcaagtttcctca

SEQ ID NO: 8401707 - DNA, 20 bp, Homo sapiens
taccctggctatgcttctga

SEQ ID NO: 8401708 - DNA, 22 bp, Homo sapiens
catttcacgcacactcattact

SEQ ID NO: 8401709 - DNA, 22 bp, Homo sapiens
ccaagaggtatcttgccataaa

SEQ ID NO: 8401710 - DNA, 22 bp, Homo sapiens
tcctggctccactgagcaggcc

SEQ ID NO: 8401711 - DNA, 22 bp, Homo sapiens
tcctggctaacacggtgacacc

SEQ ID NO: 8401712 - DNA, 20 bp, Homo sapiens
tcctggccttctcgggcagt

SEQ ID NO: 8401713 - DNA, 22 bp, Homo sapiens
tcctggagcttccttcatggta

SEQ ID NO: 8401714 - DNA, 22 bp, Homo sapiens
tcctggagcttcagtttccttt

SEQ ID NO: 8401715 - DNA, 22 bp, Homo sapiens
tctcagcttgagtggatgagct

SEQ ID NO: 8401716 - DNA, 19 bp, Homo sapiens
ccacccctttgctgggccc

SEQ ID NO: 8401717 - DNA, 22 bp, Homo sapiens
tctctgtaaggaagaattagat

SEQ ID NO: 8401718 - DNA, 22 bp, Homo sapiens
ccagattcagatatggcagtgg

SEQ ID NO: 8401719 - DNA, 18 bp, Homo sapiens
ccagagggtgcgtcagct

SEQ ID NO: 8401720 - DNA, 22 bp, Homo sapiens
catcagcaggcaacactcttgg

SEQ ID NO: 8401721 - DNA, 22 bp, Homo sapiens
catctacctccaccctatatat

SEQ ID NO: 8401722 - DNA, 22 bp, Homo sapiens
catccctgtctgccactctgaa

SEQ ID NO: 8401723 - DNA, 20 bp, Homo sapiens
catggtggaggagcagggcc

SEQ ID NO: 8401724 - DNA, 22 bp, Homo sapiens
catgctttttgacaacaagctg

SEQ ID NO: 8401725 - DNA, 22 bp, Homo sapiens
tccagaggtgaacacccaggca

SEQ ID NO: 8401726 - DNA, 22 bp, Homo sapiens
tttgtcttaaatcttgttactg

SEQ ID NO: 8401727 - DNA, 22 bp, Homo sapiens
tttgctgtgaatccattactgt

SEQ ID NO: 8401728 - DNA, 22 bp, Homo sapiens
tttggctcatctcagtcctagg

SEQ ID NO: 8401729 - DNA, 22 bp, Homo sapiens
tttggcatttaataggtgatca

SEQ ID NO: 8401730 - DNA, 22 bp, Homo sapiens
tttgacatgtgcttataacttt

SEQ ID NO: 8401731 - DNA, 22 bp, Homo sapiens
tttgacagtgctgctaaaatgc

SEQ ID NO: 8401732 - DNA, 22 bp, Homo sapiens
tttgacagtgctattaagaaac

SEQ ID NO: 8401733 - DNA, 22 bp, Homo sapiens
tttgacagcttgttacaaagtt

SEQ ID NO: 8401734 - DNA, 22 bp, Homo sapiens
tttgacagcataatcctacacc

SEQ ID NO: 8401735 - DNA, 22 bp, Homo sapiens
tttctattggcgtcactgttgt

SEQ ID NO: 8401736 - DNA, 22 bp, Homo sapiens
tttctattgatctaataaacat

SEQ ID NO: 8401737 - DNA, 22 bp, Homo sapiens
tttctagtggttaagatttaca

SEQ ID NO: 8401738 - DNA, 22 bp, Homo sapiens
tttctagtcagccatatctagt

SEQ ID NO: 8401739 - DNA, 22 bp, Homo sapiens
tttctagtctcgatctcttaat

SEQ ID NO: 8401740 - DNA, 22 bp, Homo sapiens
tttcataatatccagagatttt

SEQ ID NO: 8401741 - DNA, 22 bp, Homo sapiens
tttcacattcttctgaatctac

SEQ ID NO: 8401742 - DNA, 22 bp, Homo sapiens
tttcacattggcttctatttct

SEQ ID NO: 8401743 - DNA, 22 bp, Homo sapiens
tttcaagtcattctataatatc

SEQ ID NO: 8401744 - DNA, 22 bp, Homo sapiens
tttcaagttgttgcattaaatg

SEQ ID NO: 8401745 - DNA, 22 bp, Homo sapiens
tttcaagttctgttcctaaact

SEQ ID NO: 8401746 - DNA, 22 bp, Homo sapiens
tttaacatgttcaagaaacata

SEQ ID NO: 8401747 - DNA, 21 bp, Homo sapiens
tttatgtacttcatagagtag

SEQ ID NO: 8401748 - DNA, 22 bp, Homo sapiens
tttagcattaagcttttcaaat

SEQ ID NO: 8401749 - DNA, 22 bp, Homo sapiens
ttggctctaggaaccaaagtga

SEQ ID NO: 8401750 - DNA, 22 bp, Homo sapiens
ttggcgcccaggacgccgccgc

SEQ ID NO: 8401751 - DNA, 22 bp, Homo sapiens
ttggggagttaatgccaaagat

SEQ ID NO: 8401752 - DNA, 22 bp, Homo sapiens
ttggaagttgatttaaaaagga

SEQ ID NO: 8401753 - DNA, 22 bp, Homo sapiens
ttgcttcctctgtgcaatcctc

SEQ ID NO: 8401754 - DNA, 22 bp, Homo sapiens
ttgcatttttagatgcttctgt

SEQ ID NO: 8401755 - DNA, 22 bp, Homo sapiens
tcctctccagcaaactggctat

SEQ ID NO: 8401756 - DNA, 22 bp, Homo sapiens
ttatggaaaatacaattataag

SEQ ID NO: 8401757 - DNA, 22 bp, Homo sapiens
ttccatgcaagaagtatggctc

SEQ ID NO: 8401758 - DNA, 22 bp, Homo sapiens
ttcatacatttttactaacagc

SEQ ID NO: 8401759 - DNA, 22 bp, Homo sapiens
ttcagaaggattttaacacatg

SEQ ID NO: 8401760 - DNA, 22 bp, Homo sapiens
ttcaatatgatattagctgtgg

SEQ ID NO: 8401761 - DNA, 22 bp, Homo sapiens
ttctgggaacaaagtggagtgg

SEQ ID NO: 8401762 - DNA, 22 bp, Homo sapiens
ttgaaaatggtaagcatgatat

SEQ ID NO: 8401763 - DNA, 22 bp, Homo sapiens
ttgagaaacctggcagtagaga

SEQ ID NO: 8401764 - DNA, 16 bp, Homo sapiens
ttgagaaatgaagttt

SEQ ID NO: 8401765 - DNA, 22 bp, Homo sapiens
ttgagaaatgttttttaagctg

SEQ ID NO: 8401766 - DNA, 18 bp, Homo sapiens
ttgagaaataagcactaa

SEQ ID NO: 8401767 - DNA, 22 bp, Homo sapiens
ttctcccatctcagtcttacat

SEQ ID NO: 8401768 - DNA, 22 bp, Homo sapiens
ttctcccactccgtgcttcagt

SEQ ID NO: 8401769 - DNA, 20 bp, Homo sapiens
ttctccagtgcggtagccat

SEQ ID NO: 8401770 - DNA, 22 bp, Homo sapiens
ttctccgctaagttctctgcag

SEQ ID NO: 8401771 - DNA, 22 bp, Homo sapiens
ttctcttagctgtaaagtcaat

SEQ ID NO: 8401772 - DNA, 22 bp, Homo sapiens
ttctcttcatctcagtaaatgt

SEQ ID NO: 8401773 - DNA, 17 bp, Homo sapiens
ttctcttcctggatagt

SEQ ID NO: 8401774 - DNA, 22 bp, Homo sapiens
ttctcttctgttcagtgcccaa

SEQ ID NO: 8401775 - DNA, 22 bp, Homo sapiens
ttctggaggctccagggaagaa

SEQ ID NO: 8401776 - DNA, 22 bp, Homo sapiens
ttctccagctcatcagggaggg

SEQ ID NO: 8401777 - DNA, 19 bp, Homo sapiens
ttctccagcctgacctgag

SEQ ID NO: 8401778 - DNA, 19 bp, Homo sapiens
ttctccaggctgcagaggg

SEQ ID NO: 8401779 - DNA, 19 bp, Homo sapiens
ttctccagggacttaggga

SEQ ID NO: 8401780 - DNA, 22 bp, Homo sapiens
ttccctgagtctccctgagtct

SEQ ID NO: 8401781 - DNA, 22 bp, Homo sapiens
ttccctgaagacctcatgtgac

SEQ ID NO: 8401782 - DNA, 22 bp, Homo sapiens
ttccctccatttcattttataa

SEQ ID NO: 8401783 - DNA, 22 bp, Homo sapiens
ttccctccctggctgccatttc

SEQ ID NO: 8401784 - DNA, 22 bp, Homo sapiens
attgctggcagctggatctgca

SEQ ID NO: 8401785 - DNA, 22 bp, Homo sapiens
atgtttctgaagtttacagata

SEQ ID NO: 8401786 - DNA, 22 bp, Homo sapiens
atgtttttgagatacaaacaga

SEQ ID NO: 8401787 - DNA, 22 bp, Homo sapiens
attaaaattccaaggtatgcca

SEQ ID NO: 8401788 - DNA, 22 bp, Homo sapiens
gatgaggggtcattggctggga

SEQ ID NO: 8401789 - DNA, 22 bp, Homo sapiens
gatgagggcctggtggctgtgc

SEQ ID NO: 8401790 - DNA, 22 bp, Homo sapiens
atttcacaaaccatcctgattt

SEQ ID NO: 8401791 - DNA, 22 bp, Homo sapiens
atttcagaatgtcctaatttag

SEQ ID NO: 8401792 - DNA, 22 bp, Homo sapiens
attgcttttgagctagaatttt

SEQ ID NO: 8401793 - DNA, 22 bp, Homo sapiens
caaaaactgcaattacttttac

SEQ ID NO: 8401794 - DNA, 22 bp, Homo sapiens
gcctgggagggcagcagtgtgg

SEQ ID NO: 8401795 - DNA, 22 bp, Homo sapiens
gctcaggagctgacagcctcaa

SEQ ID NO: 8401796 - DNA, 22 bp, Homo sapiens
gcgagtgccgagagggcagggc

SEQ ID NO: 8401797 - DNA, 22 bp, Homo sapiens
gcctctccgagccactgcctct

SEQ ID NO: 8401798 - DNA, 22 bp, Homo sapiens
gcctgctgccaccctggctccg

SEQ ID NO: 8401799 - DNA, 22 bp, Homo sapiens
atcttctcaagcagcatcctgt

SEQ ID NO: 8401800 - DNA, 22 bp, Homo sapiens
cttggctctgtgttgatgggac

SEQ ID NO: 8401801 - DNA, 22 bp, Homo sapiens
cttgctcacagtacctggcttg

SEQ ID NO: 8401802 - DNA, 20 bp, Homo sapiens
ctttggtgggggtagcccag

SEQ ID NO: 8401803 - DNA, 18 bp, Homo sapiens
gaaagatgaacttttttc

SEQ ID NO: 8401804 - DNA, 22 bp, Homo sapiens
atgcagaaggagccatgcttgc

SEQ ID NO: 8401805 - DNA, 22 bp, Homo sapiens
atgcacttaaataacataactt

SEQ ID NO: 8401806 - DNA, 22 bp, Homo sapiens
atgcattgtcaggcaatttcat

SEQ ID NO: 8401807 - DNA, 22 bp, Homo sapiens
atgcattgtctggtttcatttt

SEQ ID NO: 8401808 - DNA, 22 bp, Homo sapiens
gaggggagcatgatctagattg

SEQ ID NO: 8401809 - DNA, 22 bp, Homo sapiens
gagctgggcctgcgagtgctgc

SEQ ID NO: 8401810 - DNA, 22 bp, Homo sapiens
gagctgggctggcttcctccct

SEQ ID NO: 8401811 - DNA, 21 bp, Homo sapiens
atggtaggtggagcaggtgat

SEQ ID NO: 8401812 - DNA, 22 bp, Homo sapiens
gaggccagggtaccatcaacat

SEQ ID NO: 8401813 - DNA, 22 bp, Homo sapiens
gaggccaggggtcagcaattgg

SEQ ID NO: 8401814 - DNA, 22 bp, Homo sapiens
gaggccaggggcctggagatga

SEQ ID NO: 8401815 - DNA, 15 bp, Homo sapiens
gaggccaggcatgtg

SEQ ID NO: 8401816 - DNA, 22 bp, Homo sapiens
gaggccagggatgcaatgagag

SEQ ID NO: 8401817 - DNA, 22 bp, Homo sapiens
gaggccaggggagtcagcgtcc

SEQ ID NO: 8401818 - DNA, 22 bp, Homo sapiens
gaggccaggagtgctgtaagtt

SEQ ID NO: 8401819 - DNA, 18 bp, Homo sapiens
gagaaagtttgggcagaa

SEQ ID NO: 8401820 - DNA, 23 bp, Homo sapiens
gacagagtgagaccttgtcttac

SEQ ID NO: 8401821 - DNA, 22 bp, Homo sapiens
gagaggaactcccagtgcctgg

SEQ ID NO: 8401822 - DNA, 22 bp, Homo sapiens
gagaggaagccagggggtgttg

SEQ ID NO: 8401823 - DNA, 22 bp, Homo sapiens
gagagctgtccggctgagcagc

SEQ ID NO: 8401824 - DNA, 22 bp, Homo sapiens
atggccagtgttgagatcaggc

SEQ ID NO: 8401825 - DNA, 22 bp, Homo sapiens
cagcattgccctttttctcaga

SEQ ID NO: 8401826 - DNA, 19 bp, Homo sapiens
ggttggagaagagcggccc

SEQ ID NO: 8401827 - DNA, 23 bp, Homo sapiens
ggttcctgagcagggatctggaa

SEQ ID NO: 8401828 - DNA, 22 bp, Homo sapiens
ggtgggtaaaactgctggcact

SEQ ID NO: 8401829 - DNA, 22 bp, Homo sapiens
gggtgggagtctggccctcaaa

SEQ ID NO: 8401830 - DNA, 22 bp, Homo sapiens
gggtgggactctttggcctgag

SEQ ID NO: 8401831 - DNA, 22 bp, Homo sapiens
gggaaggacattctgggctcag

SEQ ID NO: 8401832 - DNA, 22 bp, Homo sapiens
gggaaggaggtggcttgaagtg

SEQ ID NO: 8401833 - DNA, 22 bp, Homo sapiens
gggaaggaaatcttgcttgtga

SEQ ID NO: 8401834 - DNA, 22 bp, Homo sapiens
gggaaggacacagccatgactg

SEQ ID NO: 8401835 - DNA, 23 bp, Homo sapiens
gggaaaggatatgatcctagggg

SEQ ID NO: 8401836 - DNA, 22 bp, Homo sapiens
cagacaggaagttcagaagaaa

SEQ ID NO: 8401837 - DNA, 22 bp, Homo sapiens
gggagggtgttctcccaagaac

SEQ ID NO: 8401838 - DNA, 22 bp, Homo sapiens
ggggaagaaatctgggttcttc

SEQ ID NO: 8401839 - DNA, 20 bp, Homo sapiens
ggggaagaaaaggatgtgat

SEQ ID NO: 8401840 - DNA, 22 bp, Homo sapiens
cagagctgtatttatctttcca

SEQ ID NO: 8401841 - DNA, 23 bp, Homo sapiens
ggggaaagaccatgcttgaggac

SEQ ID NO: 8401842 - DNA, 22 bp, Homo sapiens
cagagctgcgctttttcctggt

SEQ ID NO: 8401843 - DNA, 23 bp, Homo sapiens
cagagctgattaaacttaatctc

SEQ ID NO: 8401844 - DNA, 22 bp, Homo sapiens
caaggacactccctgctgggca

SEQ ID NO: 8401845 - DNA, 22 bp, Homo sapiens
caaggaggaagatgcaggggac

SEQ ID NO: 8401846 - DNA, 22 bp, Homo sapiens
caaggacagcgtcaggtgcaac

SEQ ID NO: 8401847 - DNA, 22 bp, Homo sapiens
gctgcagatcccacccattccc

SEQ ID NO: 8401848 - DNA, 22 bp, Homo sapiens
gctgcagagtgatgaagtgggg

SEQ ID NO: 8401849 - DNA, 19 bp, Homo sapiens
gctcctggatgacctgtgg

SEQ ID NO: 8401850 - DNA, 22 bp, Homo sapiens
caaccccactacacgttggaga

SEQ ID NO: 8401851 - DNA, 22 bp, Homo sapiens
caacactgacaatggactgatt

SEQ ID NO: 8401852 - DNA, 22 bp, Homo sapiens
cacaatattggccgggctggtc

SEQ ID NO: 8401853 - DNA, 22 bp, Homo sapiens
ggaaaaggccacagggacacat

SEQ ID NO: 8401854 - DNA, 22 bp, Homo sapiens
cacacctgtaatcctagcactt

SEQ ID NO: 8401855 - DNA, 22 bp, Homo sapiens
gcttctctttctcccctggcgg

SEQ ID NO: 8401856 - DNA, 22 bp, Homo sapiens
caatttctctttatatctcaca

SEQ ID NO: 8401857 - DNA, 22 bp, Homo sapiens
gctgtggccgggcccaggccgc

SEQ ID NO: 8401858 - DNA, 22 bp, Homo sapiens
gcttctccagaccttcatcccc

SEQ ID NO: 8401859 - DNA, 15 bp, Homo sapiens
gcttctccagatgac

SEQ ID NO: 8401860 - DNA, 22 bp, Homo sapiens
gcttctccctacagatgtcagt

SEQ ID NO: 8401861 - DNA, 22 bp, Homo sapiens
gcttctcctcccgctcccaggc

SEQ ID NO: 8401862 - DNA, 22 bp, Homo sapiens
gcttctcctcccgctcccaggc

SEQ ID NO: 8401863 - DNA, 22 bp, Homo sapiens
gcttctctcaggagcatcagcc

SEQ ID NO: 8401864 - DNA, 22 bp, Homo sapiens
gcttctctcaggagcatcagcc

SEQ ID NO: 8401865 - DNA, 22 bp, Homo sapiens
gcttctctggctggtctgccac

SEQ ID NO: 8401866 - DNA, 22 bp, Homo sapiens
gcttctcttaatgcctggcttt

SEQ ID NO: 8401867 - DNA, 22 bp, Homo sapiens
ggctagggatctagaccaggac

SEQ ID NO: 8401868 - DNA, 22 bp, Homo sapiens
ggcctctcgaagcttcagtcca

SEQ ID NO: 8401869 - DNA, 19 bp, Homo sapiens
cactgagctctgttcacta

SEQ ID NO: 8401870 - DNA, 22 bp, Homo sapiens
ggatccttctttgacctcacag

SEQ ID NO: 8401871 - DNA, 22 bp, Homo sapiens
ggagggaggttagattcaagct

SEQ ID NO: 8401872 - DNA, 22 bp, Homo sapiens
ggaggccaaggcaggtggatcg

SEQ ID NO: 8401873 - DNA, 22 bp, Homo sapiens
cacactgtcaggtaaataacac

SEQ ID NO: 8401874 - DNA, 22 bp, Homo sapiens
cacactagcacttcagaggttc

SEQ ID NO: 8401875 - DNA, 22 bp, Homo sapiens
cacagctgtatccaggagatcc

SEQ ID NO: 8401876 - DNA, 22 bp, Homo sapiens
atcattttgtgacaatgcctgt

SEQ ID NO: 8401877 - DNA, 22 bp, Homo sapiens
atccctcagccacctttgagga

SEQ ID NO: 8401878 - DNA, 22 bp, Homo sapiens
atccctcagcagacagcaaaat

SEQ ID NO: 8401879 - DNA, 22 bp, Homo sapiens
atcctagaatcagcccttgctg

SEQ ID NO: 8401880 - DNA, 22 bp, Homo sapiens
ctgggtagaagattcctcagga

SEQ ID NO: 8401881 - DNA, 22 bp, Homo sapiens
ctgggtagctgctgctccttca

SEQ ID NO: 8401882 - DNA, 22 bp, Homo sapiens
ctgggtagctgctgctccttca

SEQ ID NO: 8401883 - DNA, 22 bp, Homo sapiens
ctgggtagggtgatatcccaca

SEQ ID NO: 8401884 - DNA, 22 bp, Homo sapiens
ctgtctttggtcctgtctgtta

SEQ ID NO: 8401885 - DNA, 20 bp, Homo sapiens
atatttcttaagaactttca

SEQ ID NO: 8401886 - DNA, 22 bp, Homo sapiens
atatgattgtccttagcaaatt

SEQ ID NO: 8401887 - DNA, 22 bp, Homo sapiens
atatgacataaaatcatttttg

SEQ ID NO: 8401888 - DNA, 22 bp, Homo sapiens
atatataacctggataaggctt

SEQ ID NO: 8401889 - DNA, 22 bp, Homo sapiens
ctgggaaggggaaggtcctctc

SEQ ID NO: 8401890 - DNA, 22 bp, Homo sapiens
ctgggcacagcgttgggctctt

SEQ ID NO: 8401891 - DNA, 20 bp, Homo sapiens
ctgggcacctgtctgcagtt

SEQ ID NO: 8401892 - DNA, 22 bp, Homo sapiens
ctgggcacagtggctcacgcct

SEQ ID NO: 8401893 - DNA, 22 bp, Homo sapiens
ctgggcacaggggagcagagtc

SEQ ID NO: 8401894 - DNA, 22 bp, Homo sapiens
ctgctctggcgtactcggcatc

SEQ ID NO: 8401895 - DNA, 22 bp, Homo sapiens
ataatataatcctacttcccat

SEQ ID NO: 8401896 - DNA, 22 bp, Homo sapiens
ctgcagcctcctggggtacatg

SEQ ID NO: 8401897 - DNA, 20 bp, Homo sapiens
ataaaataactgccacaaga

SEQ ID NO: 8401898 - DNA, 22 bp, Homo sapiens
ataaatatcactgttgtccctc

SEQ ID NO: 8401899 - DNA, 22 bp, Homo sapiens
ccttgccttggtccttcgcagg

SEQ ID NO: 8401900 - DNA, 22 bp, Homo sapiens
aggtggctgaagagtgggtgag

SEQ ID NO: 8401901 - DNA, 22 bp, Homo sapiens
aggtggctggtccaggctgcag

SEQ ID NO: 8401902 - DNA, 22 bp, Homo sapiens
aggtgggaacccagcagggccc

SEQ ID NO: 8401903 - DNA, 22 bp, Homo sapiens
aggtggcttctggccaggtgtg

SEQ ID NO: 8401904 - DNA, 22 bp, Homo sapiens
aggtgggacccgtggggtgcga

SEQ ID NO: 8401905 - DNA, 22 bp, Homo sapiens
aggtgggaacccagcagggccc

SEQ ID NO: 8401906 - DNA, 21 bp, Homo sapiens
aggtgggagaccatgtaggtc

SEQ ID NO: 8401907 - DNA, 22 bp, Homo sapiens
aggtgggacccgtggggtgcga

SEQ ID NO: 8401908 - DNA, 21 bp, Homo sapiens
aggtgggagaccatgtaggtc

SEQ ID NO: 8401909 - DNA, 21 bp, Homo sapiens
aggtgggagaccatgtaggtc

SEQ ID NO: 8401910 - DNA, 22 bp, Homo sapiens
ccttctctctgaagaccccaaa

SEQ ID NO: 8401911 - DNA, 22 bp, Homo sapiens
cgaggaaatatttacaactgat

SEQ ID NO: 8401912 - DNA, 22 bp, Homo sapiens
cgaggaaaggcgatggctctcg

SEQ ID NO: 8401913 - DNA, 20 bp, Homo sapiens
cgaggccaaggggctgggcc

SEQ ID NO: 8401914 - DNA, 22 bp, Homo sapiens
cggaggggtttgaacagaggag

SEQ ID NO: 8401915 - DNA, 22 bp, Homo sapiens
cggctcactgcagctccgcctc

SEQ ID NO: 8401916 - DNA, 22 bp, Homo sapiens
cctctgcatctggctgctgcag

SEQ ID NO: 8401917 - DNA, 22 bp, Homo sapiens
cctgctctagactctgggaagg

SEQ ID NO: 8401918 - DNA, 22 bp, Homo sapiens
cctggacaatgagatgtcaggg

SEQ ID NO: 8401919 - DNA, 22 bp, Homo sapiens
cctggacacccattccttggct

SEQ ID NO: 8401920 - DNA, 22 bp, Homo sapiens
cctggcacataatagtggctca

SEQ ID NO: 8401921 - DNA, 23 bp, Homo sapiens
cctggctggattctctgcattca

SEQ ID NO: 8401922 - DNA, 17 bp, Homo sapiens
cctggctgggaatctga

SEQ ID NO: 8401923 - DNA, 22 bp, Homo sapiens
cctggctgctttcactatggag

SEQ ID NO: 8401924 - DNA, 22 bp, Homo sapiens
cctggctggactggaccgtggc

SEQ ID NO: 8401925 - DNA, 22 bp, Homo sapiens
ctccagagagaaaggaggccgc

SEQ ID NO: 8401926 - DNA, 22 bp, Homo sapiens
ctccagagacacttctcatgat

SEQ ID NO: 8401927 - DNA, 22 bp, Homo sapiens
ctcagctctttatactagctgt

SEQ ID NO: 8401928 - DNA, 22 bp, Homo sapiens
ctcagctccaggtgtgcatctt

SEQ ID NO: 8401929 - DNA, 22 bp, Homo sapiens
ctcagctccagccctcagcagc

SEQ ID NO: 8401930 - DNA, 22 bp, Homo sapiens
cgggtaggaacaaagagctgca

SEQ ID NO: 8401931 - DNA, 22 bp, Homo sapiens
ctcagaggtcaagagcagagct

SEQ ID NO: 8401932 - DNA, 22 bp, Homo sapiens
ctcagaggggatgcttggagaa

SEQ ID NO: 8401933 - DNA, 22 bp, Homo sapiens
ctcagagggtacaggtgaaccc

SEQ ID NO: 8401934 - DNA, 19 bp, Homo sapiens
ctctctccagtggctggct

SEQ ID NO: 8401935 - DNA, 22 bp, Homo sapiens
ctctggagaggttcccatggga

SEQ ID NO: 8401936 - DNA, 22 bp, Homo sapiens
agtggctgtgaaatacatggga

SEQ ID NO: 8401937 - DNA, 22 bp, Homo sapiens
ctctccattccctacagttttc

SEQ ID NO: 8401938 - DNA, 22 bp, Homo sapiens
agtgctgggattgcaggcatga

SEQ ID NO: 8401939 - DNA, 22 bp, Homo sapiens
agtgctgggctatctactgcta

SEQ ID NO: 8401940 - DNA, 22 bp, Homo sapiens
agtgctgggattacaggcataa

SEQ ID NO: 8401941 - DNA, 22 bp, Homo sapiens
ctctccttgcagatggctgcct

SEQ ID NO: 8401942 - DNA, 20 bp, Homo sapiens
ctctcccagcacagcttcct

SEQ ID NO: 8401943 - DNA, 22 bp, Homo sapiens
ctctcccagtcaggctcaggat

SEQ ID NO: 8401944 - DNA, 22 bp, Homo sapiens
agtgctggattacaggcgtgag

SEQ ID NO: 8401945 - DNA, 22 bp, Homo sapiens
agtgctggagggaggcaggttc

SEQ ID NO: 8401946 - DNA, 22 bp, Homo sapiens
agtgctggaaagggacggagga

SEQ ID NO: 8401947 - DNA, 23 bp, Homo sapiens
agtgctggagaagcttctggctt

SEQ ID NO: 8401948 - DNA, 22 bp, Homo sapiens
ccatgaattcactccatgctag

SEQ ID NO: 8401949 - DNA, 22 bp, Homo sapiens
agggaagggcagggtctatgca

SEQ ID NO: 8401950 - DNA, 22 bp, Homo sapiens
agggaatgctccgtataaatct

SEQ ID NO: 8401951 - DNA, 22 bp, Homo sapiens
agggaagaagctggtagtaggt

SEQ ID NO: 8401952 - DNA, 22 bp, Homo sapiens
agggaaggaggccatgtgtccc

SEQ ID NO: 8401953 - DNA, 22 bp, Homo sapiens
agggagccaggaacgcaggtcg

SEQ ID NO: 8401954 - DNA, 22 bp, Homo sapiens
agggagccaggggccagctatt

SEQ ID NO: 8401955 - DNA, 22 bp, Homo sapiens
agggaggaaggaactccttcta

SEQ ID NO: 8401956 - DNA, 22 bp, Homo sapiens
ccccatggcaactgctgggggt

SEQ ID NO: 8401957 - DNA, 22 bp, Homo sapiens
ccccatgggtgtagggaggtgg

SEQ ID NO: 8401958 - DNA, 22 bp, Homo sapiens
cctcacacagttatctcttcat

SEQ ID NO: 8401959 - DNA, 22 bp, Homo sapiens
ccctgggctcagagcaggtagc

SEQ ID NO: 8401960 - DNA, 22 bp, Homo sapiens
agggaggagaatggactccttc

SEQ ID NO: 8401961 - DNA, 22 bp, Homo sapiens
agggaggagtcctcaaagtcat

SEQ ID NO: 8401962 - DNA, 22 bp, Homo sapiens
agggaggaccaatgtgtggtta

SEQ ID NO: 8401963 - DNA, 22 bp, Homo sapiens
agggaggaaggatgttccaaag

SEQ ID NO: 8401964 - DNA, 22 bp, Homo sapiens
ccagtcactctgtgagagctac

SEQ ID NO: 8401965 - DNA, 22 bp, Homo sapiens
aggctgagcctgggcgtggtgg

SEQ ID NO: 8401966 - DNA, 22 bp, Homo sapiens
aggctgagccacggggctggct

SEQ ID NO: 8401967 - DNA, 22 bp, Homo sapiens
aggcctagaggaatggccaggg

SEQ ID NO: 8401968 - DNA, 22 bp, Homo sapiens
aggcatggcatggggcagatgt

SEQ ID NO: 8401969 - DNA, 22 bp, Homo sapiens
aggcattctagaagtagaagta

SEQ ID NO: 8401970 - DNA, 22 bp, Homo sapiens
aggccaagattttggatcagct

SEQ ID NO: 8401971 - DNA, 22 bp, Homo sapiens
aggccaagtgctgggacaggtg

SEQ ID NO: 8401972 - DNA, 22 bp, Homo sapiens
aggccaagttacttgggaaagc

SEQ ID NO: 8401973 - DNA, 22 bp, Homo sapiens
aggccaagggcaaagcggagag

SEQ ID NO: 8401974 - DNA, 22 bp, Homo sapiens
aggccaggaccattagcccaga

SEQ ID NO: 8401975 - DNA, 22 bp, Homo sapiens
aggcctagagctttggagggca

SEQ ID NO: 8401976 - DNA, 22 bp, Homo sapiens
aggccctattcaatggggccca

SEQ ID NO: 8401977 - DNA, 22 bp, Homo sapiens
cattccacactgcaggaaatat

SEQ ID NO: 8401978 - DNA, 22 bp, Homo sapiens
catggcctctctcctggaatgg

SEQ ID NO: 8401979 - DNA, 22 bp, Homo sapiens
catggcctgcctcctcctggtg

SEQ ID NO: 8401980 - DNA, 22 bp, Homo sapiens
catggccagggcagatggcagg

SEQ ID NO: 8401981 - DNA, 22 bp, Homo sapiens
aggaggaattgacacagaagcc

SEQ ID NO: 8401982 - DNA, 20 bp, Homo sapiens
aggagctgaattagagggtt

SEQ ID NO: 8401983 - DNA, 22 bp, Homo sapiens
aggagagagaacacttgggtcc

SEQ ID NO: 8401984 - DNA, 22 bp, Homo sapiens
aggagagaatgttccaggcttg

SEQ ID NO: 8401985 - DNA, 22 bp, Homo sapiens
aggagccatgagcaggaggcaa

SEQ ID NO: 8401986 - DNA, 22 bp, Homo sapiens
cagtcctgagctcctgggctga

SEQ ID NO: 8401987 - DNA, 22 bp, Homo sapiens
aggaaatgggaatagatggtat

SEQ ID NO: 8401988 - DNA, 22 bp, Homo sapiens
agctgggaagagttttctgcag

SEQ ID NO: 8401989 - DNA, 22 bp, Homo sapiens
agctgctcattcccagcacatg

SEQ ID NO: 8401990 - DNA, 22 bp, Homo sapiens
agctgctctgggaaacagaagt

SEQ ID NO: 8401991 - DNA, 22 bp, Homo sapiens
agctgctctttgaaggacactt

SEQ ID NO: 8401992 - DNA, 22 bp, Homo sapiens
atggtttcacaaacaaaaggtt

SEQ ID NO: 8401993 - DNA, 22 bp, Homo sapiens
atggctgtcacgccactgtgag

SEQ ID NO: 8401994 - DNA, 22 bp, Homo sapiens
atgggaggaagagaagatgtct

SEQ ID NO: 8401995 - DNA, 22 bp, Homo sapiens
atgggaggaaggaggcccttga

SEQ ID NO: 8401996 - DNA, 22 bp, Homo sapiens
atgggaggcagcagagcccagc

SEQ ID NO: 8401997 - DNA, 22 bp, Homo sapiens
agaagtttggtccttttcaagg

SEQ ID NO: 8401998 - DNA, 22 bp, Homo sapiens
agaaggctcactaagagtgact

SEQ ID NO: 8401999 - DNA, 22 bp, Homo sapiens
agacaatacatttattcccttt

SEQ ID NO: 8402000 - DNA, 22 bp, Homo sapiens
agagggtgggcacgtgatggat

SEQ ID NO: 8402001 - DNA, 22 bp, Homo sapiens
agaggtagaggttgcagtgagc

SEQ ID NO: 8402002 - DNA, 22 bp, Homo sapiens
atttaagattgcgtattcatgt

SEQ ID NO: 8402003 - DNA, 22 bp, Homo sapiens
agagggtgctggagagacattg

SEQ ID NO: 8402004 - DNA, 22 bp, Homo sapiens
agagggtagaagacagggttgc

SEQ ID NO: 8402005 - DNA, 21 bp, Homo sapiens
agagggagagtggcccttcca

SEQ ID NO: 8402006 - DNA, 22 bp, Homo sapiens
attctgtaattgaactgtgttg

SEQ ID NO: 8402007 - DNA, 22 bp, Homo sapiens
attctgggttcatgagtgagct

SEQ ID NO: 8402008 - DNA, 22 bp, Homo sapiens
attctgggcgcctatggctgca

SEQ ID NO: 8402009 - DNA, 22 bp, Homo sapiens
attctgggaactttgtctctca

SEQ ID NO: 8402010 - DNA, 22 bp, Homo sapiens
attctgggagtgtaggatggtt

SEQ ID NO: 8402011 - DNA, 22 bp, Homo sapiens
cagaacttcatattgacgttag

SEQ ID NO: 8402012 - DNA, 22 bp, Homo sapiens
agccacagcctgacttaactgt

SEQ ID NO: 8402013 - DNA, 22 bp, Homo sapiens
cagagatgggtcgcagagatgg

SEQ ID NO: 8402014 - DNA, 22 bp, Homo sapiens
cagagagggcggccctggcttc

SEQ ID NO: 8402015 - DNA, 20 bp, Homo sapiens
agccagggttctggatgcac

SEQ ID NO: 8402016 - DNA, 23 bp, Homo sapiens
agccaggggatcttgggccctgg

SEQ ID NO: 8402017 - DNA, 22 bp, Homo sapiens
agccctcatggaacagctccta

SEQ ID NO: 8402018 - DNA, 22 bp, Homo sapiens
cagagctggcctgtgatttttg

SEQ ID NO: 8402019 - DNA, 22 bp, Homo sapiens
agcctcagtgtcaccatctacc

SEQ ID NO: 8402020 - DNA, 22 bp, Homo sapiens
agctcacagggagaaacgacca

SEQ ID NO: 8402021 - DNA, 22 bp, Homo sapiens
agcaaacattcagcagattggc

SEQ ID NO: 8402022 - DNA, 19 bp, Homo sapiens
agcacagacaagaccagca

SEQ ID NO: 8402023 - DNA, 22 bp, Homo sapiens
agcacagagaaactaagacatt

SEQ ID NO: 8402024 - DNA, 22 bp, Homo sapiens
agcacagactggtcccaggtct

SEQ ID NO: 8402025 - DNA, 22 bp, Homo sapiens
agcacagatggatgtattcatt

SEQ ID NO: 8402026 - DNA, 22 bp, Homo sapiens
agcacagatgcatgatcaccag

SEQ ID NO: 8402027 - DNA, 22 bp, Homo sapiens
agcacagagttgctcactgccg

SEQ ID NO: 8402028 - DNA, 22 bp, Homo sapiens
agcacagatttgtcaacataga

SEQ ID NO: 8402029 - DNA, 22 bp, Homo sapiens
agcacagatgtgagtggaggct

SEQ ID NO: 8402030 - DNA, 22 bp, Homo sapiens
agcacagatgtactttgagggg

SEQ ID NO: 8402031 - DNA, 22 bp, Homo sapiens
agcacagagagctctaggtaaa

SEQ ID NO: 8402032 - DNA, 22 bp, Homo sapiens
agcacagagctaggagtggagg

SEQ ID NO: 8402033 - DNA, 22 bp, Homo sapiens
agcacagagttgcagagagcgt

SEQ ID NO: 8402034 - DNA, 22 bp, Homo sapiens
agcacagagctcggggaatgga

SEQ ID NO: 8402035 - DNA, 22 bp, Homo sapiens
caaatattccaggtacatccct

SEQ ID NO: 8402036 - DNA, 22 bp, Homo sapiens
caactcctccccagcatgccaa

SEQ ID NO: 8402037 - DNA, 22 bp, Homo sapiens
caactcctggctgttaggcaca

SEQ ID NO: 8402038 - DNA, 22 bp, Homo sapiens
agcaggtgatcgcgtgtgctcc

SEQ ID NO: 8402039 - DNA, 22 bp, Homo sapiens
agcaggtgatgtgagtctggaa

SEQ ID NO: 8402040 - DNA, 22 bp, Homo sapiens
cacatccttcatactcagctct

SEQ ID NO: 8402041 - DNA, 22 bp, Homo sapiens
cacatccttcagctgagcccag

SEQ ID NO: 8402042 - DNA, 22 bp, Homo sapiens
cacagtcaccttatcaggatgt

SEQ ID NO: 8402043 - DNA, 21 bp, Homo sapiens
agcaggtgctgttggaggaaa

SEQ ID NO: 8402044 - DNA, 22 bp, Homo sapiens
agcaggtgccaggtgtacccgc

SEQ ID NO: 8402045 - DNA, 22 bp, Homo sapiens
agcaggagagcagtgcgtggtc

SEQ ID NO: 8402046 - DNA, 22 bp, Homo sapiens
agcaggagacatgggggtggtg

SEQ ID NO: 8402047 - DNA, 22 bp, Homo sapiens
actgtaaaatacataagtattg

SEQ ID NO: 8402048 - DNA, 22 bp, Homo sapiens
actgtaaaatgagatatgtata

SEQ ID NO: 8402049 - DNA, 22 bp, Homo sapiens
acttccagatggccccatctaa

SEQ ID NO: 8402050 - DNA, 22 bp, Homo sapiens
acttggcttttccatctctgca

SEQ ID NO: 8402051 - DNA, 22 bp, Homo sapiens
acttgggaaagaagtttcaccg

SEQ ID NO: 8402052 - DNA, 20 bp, Homo sapiens
agaaacagcacaattctgtt

SEQ ID NO: 8402053 - DNA, 22 bp, Homo sapiens
atatatttgagaatattcatga

SEQ ID NO: 8402054 - DNA, 22 bp, Homo sapiens
atataatagtttcataaaggct

SEQ ID NO: 8402055 - DNA, 22 bp, Homo sapiens
atatacaaagggcaacctcgct

SEQ ID NO: 8402056 - DNA, 22 bp, Homo sapiens
actcttcatacagtcatctaat

SEQ ID NO: 8402057 - DNA, 22 bp, Homo sapiens
actccagggctccatcccttgt

SEQ ID NO: 8402058 - DNA, 21 bp, Homo sapiens
actccaaacaagttaagctgt

SEQ ID NO: 8402059 - DNA, 22 bp, Homo sapiens
actgctgtgttcggctccccgt

SEQ ID NO: 8402060 - DNA, 22 bp, Homo sapiens
acctggacacctgctgtcatct

SEQ ID NO: 8402061 - DNA, 22 bp, Homo sapiens
acctggagaaagcctctccctg

SEQ ID NO: 8402062 - DNA, 22 bp, Homo sapiens
acctggacacctgctgtcatct

SEQ ID NO: 8402063 - DNA, 22 bp, Homo sapiens
aggtagaggcctccaggcagca

SEQ ID NO: 8402064 - DNA, 23 bp, Homo sapiens
acctggctgctcaacctgcaggg

SEQ ID NO: 8402065 - DNA, 22 bp, Homo sapiens
acatggcaggaatcatgtgttt

SEQ ID NO: 8402066 - DNA, 17 bp, Homo sapiens
acatggcagttcacgct

SEQ ID NO: 8402067 - DNA, 22 bp, Homo sapiens
aggctgagggctcctgagggca

SEQ ID NO: 8402068 - DNA, 22 bp, Homo sapiens
accatgttggccaagctggtct

SEQ ID NO: 8402069 - DNA, 22 bp, Homo sapiens
accattgccccctagtgtctgt

SEQ ID NO: 8402070 - DNA, 22 bp, Homo sapiens
agggaagaatcactgggatgtt

SEQ ID NO: 8402071 - DNA, 22 bp, Homo sapiens
aggctggcaaggcagatgtgtg

SEQ ID NO: 8402072 - DNA, 22 bp, Homo sapiens
agggaagaggcaaggtttatgg

SEQ ID NO: 8402073 - DNA, 22 bp, Homo sapiens
agggaagaggaccagagtctct

SEQ ID NO: 8402074 - DNA, 22 bp, Homo sapiens
agggaatgtagcaagatgccaa

SEQ ID NO: 8402075 - DNA, 22 bp, Homo sapiens
agggaattcactggaacgccct

SEQ ID NO: 8402076 - DNA, 23 bp, Homo sapiens
aggaggaaaagttatctgctgag

SEQ ID NO: 8402077 - DNA, 22 bp, Homo sapiens
aggaggaactcagaaagaaggt

SEQ ID NO: 8402078 - DNA, 22 bp, Homo sapiens
aggagtcagatatgggaaagtt

SEQ ID NO: 8402079 - DNA, 22 bp, Homo sapiens
aggagtcaggaccaaatggaaa

SEQ ID NO: 8402080 - DNA, 22 bp, Homo sapiens
aggagtcagatatgggaaagtt

SEQ ID NO: 8402081 - DNA, 22 bp, Homo sapiens
acaggccataaaggcaggccct

SEQ ID NO: 8402082 - DNA, 22 bp, Homo sapiens
aacatatttggctgatattccc

SEQ ID NO: 8402083 - DNA, 22 bp, Homo sapiens
aacctttgaggggagctctttc

SEQ ID NO: 8402084 - DNA, 22 bp, Homo sapiens
aacctgttttcttctcatctag

SEQ ID NO: 8402085 - DNA, 22 bp, Homo sapiens
aaggaaagacaggacggaattc

SEQ ID NO: 8402086 - DNA, 22 bp, Homo sapiens
aaggctggggtgcagacggcct

SEQ ID NO: 8402087 - DNA, 22 bp, Homo sapiens
aaggctgggtttgggatgtgat

SEQ ID NO: 8402088 - DNA, 22 bp, Homo sapiens
aaggctgggtaacctgtccact

SEQ ID NO: 8402089 - DNA, 19 bp, Homo sapiens
aaggctggtaccataggtt

SEQ ID NO: 8402090 - DNA, 22 bp, Homo sapiens
aaattattcaaaaagctgtgtt

SEQ ID NO: 8402091 - DNA, 22 bp, Homo sapiens
aaatttctaagtcaagaagaac

SEQ ID NO: 8402092 - DNA, 22 bp, Homo sapiens
aaggctggtggattatgaggtc

SEQ ID NO: 8402093 - DNA, 22 bp, Homo sapiens
aaggctggtcagatgtggtgaa

SEQ ID NO: 8402094 - DNA, 22 bp, Homo sapiens
aacactttggaatagagatagg

SEQ ID NO: 8402095 - DNA, 22 bp, Homo sapiens
aacactttcttccttgctcagg

SEQ ID NO: 8402096 - DNA, 22 bp, Homo sapiens
aacactgtatcagtcttcaata

SEQ ID NO: 8402097 - DNA, 22 bp, Homo sapiens
aatttcactgtggagcacattt

SEQ ID NO: 8402098 - DNA, 22 bp, Homo sapiens
aatttcactggaaaagataatt

SEQ ID NO: 8402099 - DNA, 22 bp, Homo sapiens
aagagaagaaagtgtctacaca

SEQ ID NO: 8402100 - DNA, 22 bp, Homo sapiens
aagagcagcctccaggggtgga

SEQ ID NO: 8402101 - DNA, 22 bp, Homo sapiens
acacattgcagacatctcatta

SEQ ID NO: 8402102 - DNA, 22 bp, Homo sapiens
aagatccttctcactgcagtgt

SEQ ID NO: 8402103 - DNA, 22 bp, Homo sapiens
acagcagagacactcaggaggc

SEQ ID NO: 8402104 - DNA, 22 bp, Homo sapiens
aaagactcttaactccctagcg

SEQ ID NO: 8402105 - DNA, 22 bp, Homo sapiens
aaactgtgaagcaagtacaagg

SEQ ID NO: 8402106 - DNA, 22 bp, Homo sapiens
aaagaacaaattagctgtttta

SEQ ID NO: 8402107 - DNA, 22 bp, Homo sapiens
aaagaaacctatcagccacatg

SEQ ID NO: 8402108 - DNA, 22 bp, Homo sapiens
aaacactgaagacctatctggt

SEQ ID NO: 8402109 - DNA, 22 bp, Homo sapiens
aaacactgtgggacatcttact

SEQ ID NO: 8402110 - DNA, 22 bp, Homo sapiens
aaaatattttagggccaggaga

SEQ ID NO: 8402111 - DNA, 22 bp, Homo sapiens
aaacacattttaggaaaatcta

SEQ ID NO: 8402112 - DNA, 22 bp, Homo sapiens
aaacactcatgtgttactctcc

SEQ ID NO: 8402113 - DNA, 22 bp, Homo sapiens
aaacagctttcagaatctctca

SEQ ID NO: 8402114 - DNA, 22 bp, Homo sapiens
aagaacatgaacacaatgttta

SEQ ID NO: 8402115 - DNA, 22 bp, Homo sapiens
aagaacatgaacctcttctaac

SEQ ID NO: 8402116 - DNA, 22 bp, Homo sapiens
aagaacataacagaagctgtgt

SEQ ID NO: 8402117 - DNA, 22 bp, Homo sapiens
aacactgtgcccaccctagtcc

SEQ ID NO: 8402118 - DNA, 22 bp, Homo sapiens
aacactgtggtcttttcagtaa

SEQ ID NO: 8402119 - DNA, 22 bp, Homo sapiens
aacactgtcttatacttcaatg

SEQ ID NO: 8402120 - DNA, 23 bp, Homo sapiens
aacatactgtttaatattcacag

SEQ ID NO: 8402121 - DNA, 22 bp, Homo sapiens
aagatattttagaacattcact

SEQ ID NO: 8402122 - DNA, 22 bp, Homo sapiens
aagatattcaaagatttattag

SEQ ID NO: 8402123 - DNA, 22 bp, Homo sapiens
aaatctctgaacttaataatgc

SEQ ID NO: 8402124 - DNA, 22 bp, Homo sapiens
aagcctggcacattggagtctg

SEQ ID NO: 8402125 - DNA, 22 bp, Homo sapiens
aaatactgctgctattcctttt

SEQ ID NO: 8402126 - DNA, 22 bp, Homo sapiens
aagagggaggtgcgggtgcaga

SEQ ID NO: 8402127 - DNA, 22 bp, Homo sapiens
aagagggaaattgttggctgct

SEQ ID NO: 8402128 - DNA, 22 bp, Homo sapiens
aagagggagggcaaaggcactg

SEQ ID NO: 8402129 - DNA, 23 bp, Homo sapiens
aatgggtgcaactatccatgaca

SEQ ID NO: 8402130 - DNA, 22 bp, Homo sapiens
agaagcagactctgaggcaagg

SEQ ID NO: 8402131 - DNA, 22 bp, Homo sapiens
agagcctgctacctcattccag

SEQ ID NO: 8402132 - DNA, 22 bp, Homo sapiens
agagccaggctcccatggggca

SEQ ID NO: 8402133 - DNA, 22 bp, Homo sapiens
agagccaggctctacctgggtt

SEQ ID NO: 8402134 - DNA, 23 bp, Homo sapiens
acaagatagggataaaaagataa

SEQ ID NO: 8402135 - DNA, 22 bp, Homo sapiens
agagggggaaaatagaggtgtt

SEQ ID NO: 8402136 - DNA, 22 bp, Homo sapiens
agagggggaaaatagaggtgtt

SEQ ID NO: 8402137 - DNA, 22 bp, Homo sapiens
agaggggtgggcacagcgccca

SEQ ID NO: 8402138 - DNA, 22 bp, Homo sapiens
agccaggggattcatcagggac

SEQ ID NO: 8402139 - DNA, 22 bp, Homo sapiens
agcctctgatgatcacaggggg

SEQ ID NO: 8402140 - DNA, 22 bp, Homo sapiens
agcctctctccagcttggcaga

SEQ ID NO: 8402141 - DNA, 22 bp, Homo sapiens
agctcccagaaggccctgcgcc

SEQ ID NO: 8402142 - DNA, 22 bp, Homo sapiens
acacatgtgattctaagacagc

SEQ ID NO: 8402143 - DNA, 22 bp, Homo sapiens
acacatgtgtctgcatgcagtg

SEQ ID NO: 8402144 - DNA, 22 bp, Homo sapiens
acacatggtggctggactatag

SEQ ID NO: 8402145 - DNA, 22 bp, Homo sapiens
acactgagtgagaaaaggaaat

SEQ ID NO: 8402146 - DNA, 22 bp, Homo sapiens
agcagatgagcctcatgactgg

SEQ ID NO: 8402147 - DNA, 22 bp, Homo sapiens
agcagatgaatcccagataaag

SEQ ID NO: 8402148 - DNA, 22 bp, Homo sapiens
acacagagtttgacacatggga

SEQ ID NO: 8402149 - DNA, 22 bp, Homo sapiens
aatatagaatcactttccttca

SEQ ID NO: 8402150 - DNA, 22 bp, Homo sapiens
aatatactatactactttctgg

SEQ ID NO: 8402151 - DNA, 22 bp, Homo sapiens
aatatagttctagaaatatttt

SEQ ID NO: 8402152 - DNA, 22 bp, Homo sapiens
actctaccatgccactccatag

SEQ ID NO: 8402153 - DNA, 22 bp, Homo sapiens
actgagactttgttgagttctt

SEQ ID NO: 8402154 - DNA, 22 bp, Homo sapiens
acatatgtgttgtacatgcatg

SEQ ID NO: 8402155 - DNA, 22 bp, Homo sapiens
acagtcttcagaagggattggg

SEQ ID NO: 8402156 - DNA, 22 bp, Homo sapiens
aaggagagagctttgctggaac

SEQ ID NO: 8402157 - DNA, 22 bp, Homo sapiens
aaggctggacctggatgaatct

SEQ ID NO: 8402158 - DNA, 21 bp, Homo sapiens
aaggctggagatgcaggtctg

SEQ ID NO: 8402159 - DNA, 19 bp, Homo sapiens
aaggctggagaaggcctct

SEQ ID NO: 8402160 - DNA, 22 bp, Homo sapiens
aaggctgggaaacatgcaggcc

SEQ ID NO: 8402161 - DNA, 22 bp, Homo sapiens
aaggctggagatggttggaatg

SEQ ID NO: 8402162 - DNA, 22 bp, Homo sapiens
aaggctctgggtttcataggtg

SEQ ID NO: 8402163 - DNA, 22 bp, Homo sapiens
aaggctctgcaaaacctccaag

SEQ ID NO: 8402164 - DNA, 22 bp, Homo sapiens
aaggccaggggctggcgcctcc

SEQ ID NO: 8402165 - DNA, 22 bp, Homo sapiens
accccttctcctggctgttcca

SEQ ID NO: 8402166 - DNA, 22 bp, Homo sapiens
accctgagaaagtcacatgcat

SEQ ID NO: 8402167 - DNA, 22 bp, Homo sapiens
ggtggcagagaggaggtagttt

SEQ ID NO: 8402168 - DNA, 22 bp, Homo sapiens
gggtggggtgtatcggatccta

SEQ ID NO: 8402169 - DNA, 23 bp, Homo sapiens
ggtggcaggagtggatgctgagc

SEQ ID NO: 8402170 - DNA, 22 bp, Homo sapiens
gtcaggagagatcaggacagca

SEQ ID NO: 8402171 - DNA, 21 bp, Homo sapiens
gtcaggcccatagcagtgcct

SEQ ID NO: 8402172 - DNA, 22 bp, Homo sapiens
gtccttggcttcttgttgactg

SEQ ID NO: 8402173 - DNA, 22 bp, Homo sapiens
gtccttggctgtggctgtaatg

SEQ ID NO: 8402174 - DNA, 22 bp, Homo sapiens
gtccttggaggtgtggaatctg

SEQ ID NO: 8402175 - DNA, 22 bp, Homo sapiens
gtccttggcacccatgtgattc

SEQ ID NO: 8402176 - DNA, 22 bp, Homo sapiens
gtccttcagcacctccctcggc

SEQ ID NO: 8402177 - DNA, 22 bp, Homo sapiens
gtccttcaagtaacctgggacc

SEQ ID NO: 8402178 - DNA, 22 bp, Homo sapiens
gtccttcatttcctgatctcta

SEQ ID NO: 8402179 - DNA, 22 bp, Homo sapiens
gtctcttttatggtgagttgat

SEQ ID NO: 8402180 - DNA, 22 bp, Homo sapiens
gtctgggcaagggagatggcgc

SEQ ID NO: 8402181 - DNA, 22 bp, Homo sapiens
gtctgggctcccagggtcggcg

SEQ ID NO: 8402182 - DNA, 20 bp, Homo sapiens
gtggcaggcagtgaaggagc

SEQ ID NO: 8402183 - DNA, 22 bp, Homo sapiens
gtggcaggatcacggctcactg

SEQ ID NO: 8402184 - DNA, 22 bp, Homo sapiens
gtggcagggcaatgctccctct

SEQ ID NO: 8402185 - DNA, 22 bp, Homo sapiens
gtggcaggagtgggccttgaag

SEQ ID NO: 8402186 - DNA, 22 bp, Homo sapiens
gtggcaggagactggaagatgg

SEQ ID NO: 8402187 - DNA, 22 bp, Homo sapiens
gtggcatgatgtcggcttagtg

SEQ ID NO: 8402188 - DNA, 22 bp, Homo sapiens
gtggcatgacagtgaatgggca

SEQ ID NO: 8402189 - DNA, 22 bp, Homo sapiens
gtggcatggagaaggaggcagt

SEQ ID NO: 8402190 - DNA, 22 bp, Homo sapiens
gtgggagccctcagggaggtgc

SEQ ID NO: 8402191 - DNA, 22 bp, Homo sapiens
gtggctctctggtcccctgcca

SEQ ID NO: 8402192 - DNA, 22 bp, Homo sapiens
gtggctctctggtcccctgcca

SEQ ID NO: 8402193 - DNA, 22 bp, Homo sapiens
gtgcctggcatgcgccggtgct

SEQ ID NO: 8402194 - DNA, 22 bp, Homo sapiens
gtgcgcttcttcctgagccagg

SEQ ID NO: 8402195 - DNA, 22 bp, Homo sapiens
gtgcctggaatgcgcctcggcg

SEQ ID NO: 8402196 - DNA, 22 bp, Homo sapiens
gtggagaggaacccagctctgt

SEQ ID NO: 8402197 - DNA, 22 bp, Homo sapiens
gtggagagagataagcctggtc

SEQ ID NO: 8402198 - DNA, 22 bp, Homo sapiens
taacactgatttgttctcaggg

SEQ ID NO: 8402199 - DNA, 22 bp, Homo sapiens
taacactgtccaaagaattcca

SEQ ID NO: 8402200 - DNA, 22 bp, Homo sapiens
taacactgtaaacctagatgtt

SEQ ID NO: 8402201 - DNA, 22 bp, Homo sapiens
taaaacacataaactctctatt

SEQ ID NO: 8402202 - DNA, 22 bp, Homo sapiens
taaaggaggagttaatgagact

SEQ ID NO: 8402203 - DNA, 22 bp, Homo sapiens
gtggttgggatcatgggctatg

SEQ ID NO: 8402204 - DNA, 22 bp, Homo sapiens
gtggtcctttagaggatgtaat

SEQ ID NO: 8402205 - DNA, 22 bp, Homo sapiens
gtggggaaaggagtggggctca

SEQ ID NO: 8402206 - DNA, 22 bp, Homo sapiens
gtgggcagagcaagggaactca

SEQ ID NO: 8402207 - DNA, 22 bp, Homo sapiens
gtgggcagaacatttgtaggct

SEQ ID NO: 8402208 - DNA, 22 bp, Homo sapiens
gtgggcagcaccagggaagtgt

SEQ ID NO: 8402209 - DNA, 22 bp, Homo sapiens
gtgggcagattatagatgatgc

SEQ ID NO: 8402210 - DNA, 22 bp, Homo sapiens
gtgtgggaggaaggtgaacaga

SEQ ID NO: 8402211 - DNA, 22 bp, Homo sapiens
gcttcctggaacaactgttgct

SEQ ID NO: 8402212 - DNA, 17 bp, Homo sapiens
gcttcctgtgctgggga

SEQ ID NO: 8402213 - DNA, 22 bp, Homo sapiens
ggaaagaggatagtgggtaggt

SEQ ID NO: 8402214 - DNA, 22 bp, Homo sapiens
ggaaagagctaaaagggtgaga

SEQ ID NO: 8402215 - DNA, 23 bp, Homo sapiens
ggaaagagaggagttgtgcatag

SEQ ID NO: 8402216 - DNA, 22 bp, Homo sapiens
ggaaagagcccagcagtgcttg

SEQ ID NO: 8402217 - DNA, 22 bp, Homo sapiens
ggaaggtgctccctggacagag

SEQ ID NO: 8402218 - DNA, 22 bp, Homo sapiens
ggaactgattaagtcatgagaa

SEQ ID NO: 8402219 - DNA, 22 bp, Homo sapiens
ggaggaaatgaaaggagggttt

SEQ ID NO: 8402220 - DNA, 22 bp, Homo sapiens
ggaggaaatccttagtaaggca

SEQ ID NO: 8402221 - DNA, 22 bp, Homo sapiens
ggaggaaaggctccctccctct

SEQ ID NO: 8402222 - DNA, 21 bp, Homo sapiens
ggaggaaaaaggaatgacttg

SEQ ID NO: 8402223 - DNA, 22 bp, Homo sapiens
ggagctgaggtaacagtgagtg

SEQ ID NO: 8402224 - DNA, 22 bp, Homo sapiens
ggagctctatctgggagttctt

SEQ ID NO: 8402225 - DNA, 22 bp, Homo sapiens
ggagctctgaggatgcattggt

SEQ ID NO: 8402226 - DNA, 22 bp, Homo sapiens
ggagctctcctgatgtgaagat

SEQ ID NO: 8402227 - DNA, 20 bp, Homo sapiens
ggagctctgcatttatcttc

SEQ ID NO: 8402228 - DNA, 22 bp, Homo sapiens
ggagctcttccagcttgttgct

SEQ ID NO: 8402229 - DNA, 22 bp, Homo sapiens
ggaggcagaatagagtgtgggt

SEQ ID NO: 8402230 - DNA, 22 bp, Homo sapiens
ggaggccagaatctgtgttgga

SEQ ID NO: 8402231 - DNA, 22 bp, Homo sapiens
ggaggccatagtttgggagtca

SEQ ID NO: 8402232 - DNA, 22 bp, Homo sapiens
ggaggccagggtgggtggatcg

SEQ ID NO: 8402233 - DNA, 22 bp, Homo sapiens
ggaggccagtcctggccgggct

SEQ ID NO: 8402234 - DNA, 22 bp, Homo sapiens
ggagagggtaggggtcctgccc

SEQ ID NO: 8402235 - DNA, 22 bp, Homo sapiens
ggagagggggctccctgcttgg

SEQ ID NO: 8402236 - DNA, 22 bp, Homo sapiens
ggagaaggaatattggagtagg

SEQ ID NO: 8402237 - DNA, 22 bp, Homo sapiens
ggaagtttgggagctggtaatc

SEQ ID NO: 8402238 - DNA, 22 bp, Homo sapiens
ggcagctgtctcattcacacct

SEQ ID NO: 8402239 - DNA, 22 bp, Homo sapiens
ggcaggcctgagaggcagggct

SEQ ID NO: 8402240 - DNA, 22 bp, Homo sapiens
ggcacagagcccagcttcctag

SEQ ID NO: 8402241 - DNA, 22 bp, Homo sapiens
ggcacagacttttgcttgcgtt

SEQ ID NO: 8402242 - DNA, 22 bp, Homo sapiens
ggcacagagctccagccttggc

SEQ ID NO: 8402243 - DNA, 22 bp, Homo sapiens
ggcacagagctttgtcccagtt

SEQ ID NO: 8402244 - DNA, 23 bp, Homo sapiens
ggcacagatgctgagcatgtgca

SEQ ID NO: 8402245 - DNA, 22 bp, Homo sapiens
ggcacagagttggcagagctgc

SEQ ID NO: 8402246 - DNA, 22 bp, Homo sapiens
ggcagacctctccagccccaca

SEQ ID NO: 8402247 - DNA, 20 bp, Homo sapiens
ggcagacctgctgagagccc

SEQ ID NO: 8402248 - DNA, 22 bp, Homo sapiens
ggagggggaattcagccccagc

SEQ ID NO: 8402249 - DNA, 22 bp, Homo sapiens
ggagggggaaactttggctgcc

SEQ ID NO: 8402250 - DNA, 22 bp, Homo sapiens
ggaggggagatgtttgggctca

SEQ ID NO: 8402251 - DNA, 22 bp, Homo sapiens
ggaggggaggattaatgacaaa

SEQ ID NO: 8402252 - DNA, 22 bp, Homo sapiens
ggaggggagtctcccaaagccg

SEQ ID NO: 8402253 - DNA, 22 bp, Homo sapiens
ggaggggaggtccagctgatct

SEQ ID NO: 8402254 - DNA, 22 bp, Homo sapiens
ggaggggtgagaatggctgcct

SEQ ID NO: 8402255 - DNA, 22 bp, Homo sapiens
ggaggggtggaaggagtgcctg

SEQ ID NO: 8402256 - DNA, 22 bp, Homo sapiens
ggagggtgcattttaccctgtg

SEQ ID NO: 8402257 - DNA, 22 bp, Homo sapiens
ggaggcccagaaggaagcccag

SEQ ID NO: 8402258 - DNA, 22 bp, Homo sapiens
ggaggggaactaatcccgtgac

SEQ ID NO: 8402259 - DNA, 22 bp, Homo sapiens
ggagggaaccttggctggattg

SEQ ID NO: 8402260 - DNA, 22 bp, Homo sapiens
gggctagaagttagctagagaa

SEQ ID NO: 8402261 - DNA, 22 bp, Homo sapiens
gggatgccagtcctggccctgc

SEQ ID NO: 8402262 - DNA, 22 bp, Homo sapiens
gggatggactgacggtagcgcg

SEQ ID NO: 8402263 - DNA, 22 bp, Homo sapiens
gggatggagggtagagcaagtg

SEQ ID NO: 8402264 - DNA, 22 bp, Homo sapiens
gggatggatcttggctgaggct

SEQ ID NO: 8402265 - DNA, 22 bp, Homo sapiens
gggctgagaagttgatcccaag

SEQ ID NO: 8402266 - DNA, 23 bp, Homo sapiens
ggggaagtggcagtgagtgaggc

SEQ ID NO: 8402267 - DNA, 22 bp, Homo sapiens
gggtgaagctcctgcaggggcc

SEQ ID NO: 8402268 - DNA, 22 bp, Homo sapiens
gggtgggatgccgctgtctcca

SEQ ID NO: 8402269 - DNA, 22 bp, Homo sapiens
ggctgatgggcatgagctgtca

SEQ ID NO: 8402270 - DNA, 22 bp, Homo sapiens
ggctgcacagcaaagaagcctt

SEQ ID NO: 8402271 - DNA, 22 bp, Homo sapiens
ggctgctcggagcctcctgtga

SEQ ID NO: 8402272 - DNA, 22 bp, Homo sapiens
ggcttcccagtccctgctctca

SEQ ID NO: 8402273 - DNA, 22 bp, Homo sapiens
ggcttcccaggcggtccccaca

SEQ ID NO: 8402274 - DNA, 22 bp, Homo sapiens
ggcttccctgtttgctgtgcct

SEQ ID NO: 8402275 - DNA, 22 bp, Homo sapiens
ggcttccctgcctcacttattc

SEQ ID NO: 8402276 - DNA, 18 bp, Homo sapiens
ggcttccctactcacttc

SEQ ID NO: 8402277 - DNA, 22 bp, Homo sapiens
ggcttcccctccagtgctctgt

SEQ ID NO: 8402278 - DNA, 20 bp, Homo sapiens
ggcttccccgccatcttccg

SEQ ID NO: 8402279 - DNA, 18 bp, Homo sapiens
ggcttctcactgacctca

SEQ ID NO: 8402280 - DNA, 22 bp, Homo sapiens
gggaagagaggaggtggtttcg

SEQ ID NO: 8402281 - DNA, 22 bp, Homo sapiens
gggaagagaccgtaccctggcc

SEQ ID NO: 8402282 - DNA, 20 bp, Homo sapiens
ggctcatcttgtctgctgac

SEQ ID NO: 8402283 - DNA, 22 bp, Homo sapiens
ggctcaggtttccttcccagct

SEQ ID NO: 8402284 - DNA, 22 bp, Homo sapiens
ggctcaggatgagccttctcat

SEQ ID NO: 8402285 - DNA, 18 bp, Homo sapiens
ggctcagcaggctctctc

SEQ ID NO: 8402286 - DNA, 22 bp, Homo sapiens
ggccagagagcagccaggattc

SEQ ID NO: 8402287 - DNA, 22 bp, Homo sapiens
ggccagaggccacagctgtgtc

SEQ ID NO: 8402288 - DNA, 17 bp, Homo sapiens
ggccagaggcggggctg

SEQ ID NO: 8402289 - DNA, 22 bp, Homo sapiens
gagtgctgtatctgagaaagca

SEQ ID NO: 8402290 - DNA, 22 bp, Homo sapiens
gagtgctgctaatgcaagggtg

SEQ ID NO: 8402291 - DNA, 22 bp, Homo sapiens
gagtgctggaggtgtgagtggg

SEQ ID NO: 8402292 - DNA, 22 bp, Homo sapiens
gagtgctgcttgggatagtgag

SEQ ID NO: 8402293 - DNA, 17 bp, Homo sapiens
gagtgctggtggagctc

SEQ ID NO: 8402294 - DNA, 21 bp, Homo sapiens
gagtcctggctagggtggcag

SEQ ID NO: 8402295 - DNA, 22 bp, Homo sapiens
gagtcctgcccttgtgtagtcc

SEQ ID NO: 8402296 - DNA, 22 bp, Homo sapiens
gagtcctggagaaacgcaggtg

SEQ ID NO: 8402297 - DNA, 22 bp, Homo sapiens
gagtctggtcattttctctccc

SEQ ID NO: 8402298 - DNA, 22 bp, Homo sapiens
gagtgagtggccaggaggcaga

SEQ ID NO: 8402299 - DNA, 22 bp, Homo sapiens
gagtgagtgctgggctgaggct

SEQ ID NO: 8402300 - DNA, 22 bp, Homo sapiens
gagtgtggtgaacaggagcacc

SEQ ID NO: 8402301 - DNA, 22 bp, Homo sapiens
gagtgtgggggtgctgaggaca

SEQ ID NO: 8402302 - DNA, 22 bp, Homo sapiens
gagtgggtgaatgtgctcataa

SEQ ID NO: 8402303 - DNA, 22 bp, Homo sapiens
gatccctgccctcagcctggac

SEQ ID NO: 8402304 - DNA, 22 bp, Homo sapiens
gatgatgggttgatgtgaaggg

SEQ ID NO: 8402305 - DNA, 22 bp, Homo sapiens
gagggtgtctggatgctagact

SEQ ID NO: 8402306 - DNA, 22 bp, Homo sapiens
gaggtgggtgtatcacaggtca

SEQ ID NO: 8402307 - DNA, 22 bp, Homo sapiens
gagtcaggctagggtgacaggc

SEQ ID NO: 8402308 - DNA, 22 bp, Homo sapiens
gagtcctgaatcctgtggcaac

SEQ ID NO: 8402309 - DNA, 22 bp, Homo sapiens
gaggggaaagtgtgaggctgcg

SEQ ID NO: 8402310 - DNA, 22 bp, Homo sapiens
gaggctggacgtgcatttctac

SEQ ID NO: 8402311 - DNA, 22 bp, Homo sapiens
gaggctggagatattccaatct

SEQ ID NO: 8402312 - DNA, 22 bp, Homo sapiens
gaggctgggggctgccttcctc

SEQ ID NO: 8402313 - DNA, 22 bp, Homo sapiens
gagagtggatggagctgcgaag

SEQ ID NO: 8402314 - DNA, 22 bp, Homo sapiens
gagagtggaaagcaagctgagt

SEQ ID NO: 8402315 - DNA, 22 bp, Homo sapiens
gagctgggacatgggtcctctc

SEQ ID NO: 8402316 - DNA, 22 bp, Homo sapiens
gaggaatgttattaaaggagct

SEQ ID NO: 8402317 - DNA, 22 bp, Homo sapiens
gaggaatgggtgtctcgtgatt

SEQ ID NO: 8402318 - DNA, 22 bp, Homo sapiens
gaggagggagctggaagctctt

SEQ ID NO: 8402319 - DNA, 22 bp, Homo sapiens
gaggcagaggttgcagtgagct

SEQ ID NO: 8402320 - DNA, 22 bp, Homo sapiens
gaggcagagtgcaccccaggag

SEQ ID NO: 8402321 - DNA, 22 bp, Homo sapiens
cttctctctgcataggcatggg

SEQ ID NO: 8402322 - DNA, 22 bp, Homo sapiens
cttctctgcaccccacttttgc

SEQ ID NO: 8402323 - DNA, 22 bp, Homo sapiens
cttctctgcccataggaaatgc

SEQ ID NO: 8402324 - DNA, 22 bp, Homo sapiens
cttctctggctcctcagcgccc

SEQ ID NO: 8402325 - DNA, 22 bp, Homo sapiens
ctggctgggagctcgcctgcgg

SEQ ID NO: 8402326 - DNA, 22 bp, Homo sapiens
cttctctcggtgcatccctcac

SEQ ID NO: 8402327 - DNA, 22 bp, Homo sapiens
cttctctccctggcactcagac

SEQ ID NO: 8402328 - DNA, 22 bp, Homo sapiens
cttctcagtcacctgtgagtct

SEQ ID NO: 8402329 - DNA, 22 bp, Homo sapiens
gaacagaattaccgaagatctg

SEQ ID NO: 8402330 - DNA, 22 bp, Homo sapiens
gaacactgaggacactgagaat

SEQ ID NO: 8402331 - DNA, 22 bp, Homo sapiens
gaaaacactttgatctgaaagt

SEQ ID NO: 8402332 - DNA, 22 bp, Homo sapiens
cttttaagggataataagatgt

SEQ ID NO: 8402333 - DNA, 22 bp, Homo sapiens
ctttgtttatatttctcctcga

SEQ ID NO: 8402334 - DNA, 22 bp, Homo sapiens
gaaagtgcttttgagtgtgtgc

SEQ ID NO: 8402335 - DNA, 22 bp, Homo sapiens
gaaagtgcttagagtgtggtat

SEQ ID NO: 8402336 - DNA, 18 bp, Homo sapiens
gaaagtgcggggcagggg

SEQ ID NO: 8402337 - DNA, 22 bp, Homo sapiens
gaaagtgcctcagtcctcttat

SEQ ID NO: 8402338 - DNA, 22 bp, Homo sapiens
gaaagtgccagaataggaggcc

SEQ ID NO: 8402339 - DNA, 19 bp, Homo sapiens
gaaggagagctgagttagg

SEQ ID NO: 8402340 - DNA, 21 bp, Homo sapiens
gaaggagaaagcaagtgctgc

SEQ ID NO: 8402341 - DNA, 22 bp, Homo sapiens
gaaggctgcgaggggagtgccg

SEQ ID NO: 8402342 - DNA, 22 bp, Homo sapiens
gaagttcaactgccatgcttgg

SEQ ID NO: 8402343 - DNA, 22 bp, Homo sapiens
gaagttcaatgtcagcatctat

SEQ ID NO: 8402344 - DNA, 22 bp, Homo sapiens
gaatttaagaggatgaatctgt

SEQ ID NO: 8402345 - DNA, 22 bp, Homo sapiens
gacccaggctcgtgggacggct

SEQ ID NO: 8402346 - DNA, 22 bp, Homo sapiens
gacaggaggcagagctcaggtg

SEQ ID NO: 8402347 - DNA, 22 bp, Homo sapiens
gagaaaagcgaaggacctggag

SEQ ID NO: 8402348 - DNA, 22 bp, Homo sapiens
gagagtccttagtttgcaggta

SEQ ID NO: 8402349 - DNA, 20 bp, Homo sapiens
gagagctggggatgaggctg

SEQ ID NO: 8402350 - DNA, 22 bp, Homo sapiens
gagagctggattctggataggt

SEQ ID NO: 8402351 - DNA, 19 bp, Homo sapiens
gatttaaacgtggctctat

SEQ ID NO: 8402352 - DNA, 22 bp, Homo sapiens
gatttaaagtagacctttgttt

SEQ ID NO: 8402353 - DNA, 20 bp, Homo sapiens
gatgggaatcggagctggta

SEQ ID NO: 8402354 - DNA, 22 bp, Homo sapiens
gatgcctgtggtgagcacacat

SEQ ID NO: 8402355 - DNA, 22 bp, Homo sapiens
gcaatataaccagttgtcatgc

SEQ ID NO: 8402356 - DNA, 22 bp, Homo sapiens
gcaatataatttgtgggatatc

SEQ ID NO: 8402357 - DNA, 22 bp, Homo sapiens
gcaatatactttctggcagtga

SEQ ID NO: 8402358 - DNA, 20 bp, Homo sapiens
gcaatatatgagtgcaataa

SEQ ID NO: 8402359 - DNA, 22 bp, Homo sapiens
gcaccgccttggaccgcccgct

SEQ ID NO: 8402360 - DNA, 22 bp, Homo sapiens
gccagaggctcaggttgccatg

SEQ ID NO: 8402361 - DNA, 22 bp, Homo sapiens
gcaggtggcagaggtgggatct

SEQ ID NO: 8402362 - DNA, 22 bp, Homo sapiens
gcagggtgatagtgaggctcag

SEQ ID NO: 8402363 - DNA, 22 bp, Homo sapiens
gcagctgagagaagaacagggc

SEQ ID NO: 8402364 - DNA, 22 bp, Homo sapiens
gcagggcaaacccaggtgttca

SEQ ID NO: 8402365 - DNA, 22 bp, Homo sapiens
gcagggcagccacaggccccct

SEQ ID NO: 8402366 - DNA, 20 bp, Homo sapiens
gcccaggatctctgaggcat

SEQ ID NO: 8402367 - DNA, 22 bp, Homo sapiens
gcctgctgggagacacccccag

SEQ ID NO: 8402368 - DNA, 21 bp, Homo sapiens
gcctgctgttcaccctgccac

SEQ ID NO: 8402369 - DNA, 22 bp, Homo sapiens
gcctggcaggcctgttggggct

SEQ ID NO: 8402370 - DNA, 22 bp, Homo sapiens
gcctggcccagggctccgcagg

SEQ ID NO: 8402371 - DNA, 23 bp, Homo sapiens
gcctggccaccccagggctgctt

SEQ ID NO: 8402372 - DNA, 22 bp, Homo sapiens
gcctggccgctccgagctccgc

SEQ ID NO: 8402373 - DNA, 23 bp, Homo sapiens
gcctgggactggtagtgtgacct

SEQ ID NO: 8402374 - DNA, 22 bp, Homo sapiens
gcctgggactggatgtgtttgt

SEQ ID NO: 8402375 - DNA, 22 bp, Homo sapiens
gctcactgcaagctctgcctcc

SEQ ID NO: 8402376 - DNA, 22 bp, Homo sapiens
gctcactgcaacctctgcctcc

SEQ ID NO: 8402377 - DNA, 22 bp, Homo sapiens
gctcagacctgtaatcttagca

SEQ ID NO: 8402378 - DNA, 22 bp, Homo sapiens
gctcctggccagcacagggccc

SEQ ID NO: 8402379 - DNA, 22 bp, Homo sapiens
gctcctcttatttcatcagggc

SEQ ID NO: 8402380 - DNA, 22 bp, Homo sapiens
gctcctctcccagagctgcagg

SEQ ID NO: 8402381 - DNA, 22 bp, Homo sapiens
gctctcttggtggctgtcctgg

SEQ ID NO: 8402382 - DNA, 22 bp, Homo sapiens
gctctctttaaactgcatggct

SEQ ID NO: 8402383 - DNA, 22 bp, Homo sapiens
gctcttctcagattgtacactc

SEQ ID NO: 8402384 - DNA, 22 bp, Homo sapiens
gctcttctaaagaatgtacagg

SEQ ID NO: 8402385 - DNA, 19 bp, Homo sapiens
gctgctgctcctccctcgc

SEQ ID NO: 8402386 - DNA, 22 bp, Homo sapiens
gctgctctacccatgcatctgt

SEQ ID NO: 8402387 - DNA, 22 bp, Homo sapiens
gctgctctcagagctcatgctg

SEQ ID NO: 8402388 - DNA, 22 bp, Homo sapiens
gctgctctccaagcctccttga

SEQ ID NO: 8402389 - DNA, 22 bp, Homo sapiens
gctgaggattacttgaagtcag

SEQ ID NO: 8402390 - DNA, 22 bp, Homo sapiens
ttgagaaaatagttcgaatgtt

SEQ ID NO: 8402391 - DNA, 22 bp, Homo sapiens
ttgactgtacaaccttttgtag

SEQ ID NO: 8402392 - DNA, 22 bp, Homo sapiens
ttccttcccctagctgagaaac

SEQ ID NO: 8402393 - DNA, 22 bp, Homo sapiens
ttccttcctctttcacaacagc

SEQ ID NO: 8402394 - DNA, 22 bp, Homo sapiens
ctacaaaagtaattgtggtttt

SEQ ID NO: 8402395 - DNA, 22 bp, Homo sapiens
ttcacagacattgcagactgaa

SEQ ID NO: 8402396 - DNA, 22 bp, Homo sapiens
cctgggtggttccggcaaggag

SEQ ID NO: 8402397 - DNA, 22 bp, Homo sapiens
cctgggtggcagaggttgcagt

SEQ ID NO: 8402398 - DNA, 21 bp, Homo sapiens
cggctcagtgcctgctccttc

SEQ ID NO: 8402399 - DNA, 22 bp, Homo sapiens
ctcagtttctgaagtggacagg

SEQ ID NO: 8402400 - DNA, 20 bp, Homo sapiens
ctcagtttcctcatggctca

SEQ ID NO: 8402401 - DNA, 22 bp, Homo sapiens
ctcagtttccccggcctgggcg

SEQ ID NO: 8402402 - DNA, 22 bp, Homo sapiens
ctcagtttttgtgggcatcagc

SEQ ID NO: 8402403 - DNA, 22 bp, Homo sapiens
ctcagttttgaaaaggtaagct

SEQ ID NO: 8402404 - DNA, 22 bp, Homo sapiens
ctcagttttgctagctggagtt

SEQ ID NO: 8402405 - DNA, 22 bp, Homo sapiens
ctcagttttcccttgggagcgt

SEQ ID NO: 8402406 - DNA, 22 bp, Homo sapiens
ctcagtttctggataagctggg

SEQ ID NO: 8402407 - DNA, 20 bp, Homo sapiens
ctccaggggaagagccttcc

SEQ ID NO: 8402408 - DNA, 22 bp, Homo sapiens
ttgggttgaagggcgcttcctt

SEQ ID NO: 8402409 - DNA, 22 bp, Homo sapiens
ttgggtggtggggagagttcag

SEQ ID NO: 8402410 - DNA, 22 bp, Homo sapiens
ctcctctggaaattcctctgcc

SEQ ID NO: 8402411 - DNA, 22 bp, Homo sapiens
ctcctctgtctaccacgagggt

SEQ ID NO: 8402412 - DNA, 22 bp, Homo sapiens
ctcctctgtctggccctgagcc

SEQ ID NO: 8402413 - DNA, 22 bp, Homo sapiens
ctcctctgggtcctggtggcca

SEQ ID NO: 8402414 - DNA, 22 bp, Homo sapiens
ctcctctggcttcctggaggca

SEQ ID NO: 8402415 - DNA, 22 bp, Homo sapiens
ctcctgacacagtccacacttg

SEQ ID NO: 8402416 - DNA, 21 bp, Homo sapiens
ctctccagtggttcctgattc

SEQ ID NO: 8402417 - DNA, 22 bp, Homo sapiens
ctctccagccaggggcttcctg

SEQ ID NO: 8402418 - DNA, 22 bp, Homo sapiens
ctctccagagcccttccggccc

SEQ ID NO: 8402419 - DNA, 22 bp, Homo sapiens
ctctccagaattattactatta

SEQ ID NO: 8402420 - DNA, 22 bp, Homo sapiens
ctcctgggagctgtggcagagc

SEQ ID NO: 8402421 - DNA, 22 bp, Homo sapiens
ctctcctctgaagtggtgaccc

SEQ ID NO: 8402422 - DNA, 22 bp, Homo sapiens
ctctcctgggctgaccgtccga

SEQ ID NO: 8402423 - DNA, 22 bp, Homo sapiens
ctctggcttagtatgctccaaa

SEQ ID NO: 8402424 - DNA, 22 bp, Homo sapiens
ttttattctcagctccagagag

SEQ ID NO: 8402425 - DNA, 22 bp, Homo sapiens
tttttaagagattctccagtct

SEQ ID NO: 8402426 - DNA, 22 bp, Homo sapiens
tttttaagctcctttgatgtca

SEQ ID NO: 8402427 - DNA, 22 bp, Homo sapiens
tttttaagagtctggaaatagt

SEQ ID NO: 8402428 - DNA, 22 bp, Homo sapiens
ctctgggttctggcctgcaccc

SEQ ID NO: 8402429 - DNA, 22 bp, Homo sapiens
ctctgggttttgtcagctgagg

SEQ ID NO: 8402430 - DNA, 22 bp, Homo sapiens
ctctgggttcagaacagcaagc

SEQ ID NO: 8402431 - DNA, 22 bp, Homo sapiens
ctctgggttcactgaggctctg

SEQ ID NO: 8402432 - DNA, 22 bp, Homo sapiens
ctgagaaagtgagggttaaaca

SEQ ID NO: 8402433 - DNA, 22 bp, Homo sapiens
ctgagaaatacccaagtctggt

SEQ ID NO: 8402434 - DNA, 22 bp, Homo sapiens
ctgagaataaagccagcaggag

SEQ ID NO: 8402435 - DNA, 22 bp, Homo sapiens
ctgagaaattctttctttcact

SEQ ID NO: 8402436 - DNA, 22 bp, Homo sapiens
ctgcctcatgctgcctgcagcc

SEQ ID NO: 8402437 - DNA, 22 bp, Homo sapiens
ctgcagaggggttgaagggtcc

SEQ ID NO: 8402438 - DNA, 22 bp, Homo sapiens
ctgagacacggagaggctgtgt

SEQ ID NO: 8402439 - DNA, 22 bp, Homo sapiens
ctgagacaggagaatggcgtga

SEQ ID NO: 8402440 - DNA, 22 bp, Homo sapiens
ctgagacacagtggctgaaaag

SEQ ID NO: 8402441 - DNA, 22 bp, Homo sapiens
ctgagaattactctgatgagta

SEQ ID NO: 8402442 - DNA, 22 bp, Homo sapiens
ctgctttgtgtggtccctccag

SEQ ID NO: 8402443 - DNA, 22 bp, Homo sapiens
ctgctttgtggaatcacactgg

SEQ ID NO: 8402444 - DNA, 22 bp, Homo sapiens
ctggagctcttctgagtgtgct

SEQ ID NO: 8402445 - DNA, 22 bp, Homo sapiens
ctggatggtcccatgagcagct

SEQ ID NO: 8402446 - DNA, 22 bp, Homo sapiens
ctggcacatagtcagcactcaa

SEQ ID NO: 8402447 - DNA, 22 bp, Homo sapiens
ctggcatgccttgggtgcctct

SEQ ID NO: 8402448 - DNA, 22 bp, Homo sapiens
ctggccacatgtgtgctgagca

SEQ ID NO: 8402449 - DNA, 22 bp, Homo sapiens
ctggctctgggcctcagacact

SEQ ID NO: 8402450 - DNA, 22 bp, Homo sapiens
ctggctctgaccgcgctggcct

SEQ ID NO: 8402451 - DNA, 22 bp, Homo sapiens
ctggctctgactccgcatattt

SEQ ID NO: 8402452 - DNA, 22 bp, Homo sapiens
ctggctctgggctaagctccca

SEQ ID NO: 8402453 - DNA, 22 bp, Homo sapiens
ctggctctcgctgggagtactt

SEQ ID NO: 8402454 - DNA, 22 bp, Homo sapiens
ctggctctctgatttcacattc

SEQ ID NO: 8402455 - DNA, 22 bp, Homo sapiens
ctggctctaagtgtcagctccc

SEQ ID NO: 8402456 - DNA, 22 bp, Homo sapiens
cctggagagctcgggccaggca

SEQ ID NO: 8402457 - DNA, 22 bp, Homo sapiens
cctggagatttcttcaagcttt

SEQ ID NO: 8402458 - DNA, 23 bp, Homo sapiens
tgtaaaccattttgcatcccatg

SEQ ID NO: 8402459 - DNA, 22 bp, Homo sapiens
cctggcacctgtgttttctgga

SEQ ID NO: 8402460 - DNA, 22 bp, Homo sapiens
cctggcacatgatagatgctca

SEQ ID NO: 8402461 - DNA, 22 bp, Homo sapiens
cctggagacccacttctgccaa

SEQ ID NO: 8402462 - DNA, 22 bp, Homo sapiens
cctggagagagaggccaactgc

SEQ ID NO: 8402463 - DNA, 22 bp, Homo sapiens
cctggactgtgtcctgtggtca

SEQ ID NO: 8402464 - DNA, 22 bp, Homo sapiens
cctggactcagaggtgctggtg

SEQ ID NO: 8402465 - DNA, 22 bp, Homo sapiens
cctggagaccagaggatacttc

SEQ ID NO: 8402466 - DNA, 21 bp, Homo sapiens
cctggagacaaagacagggtg

SEQ ID NO: 8402467 - DNA, 20 bp, Homo sapiens
tggtcctcacaggtcctccc

SEQ ID NO: 8402468 - DNA, 22 bp, Homo sapiens
cctggcagttttgcccaggatt

SEQ ID NO: 8402469 - DNA, 22 bp, Homo sapiens
cctggcatgtcctcctggcatg

SEQ ID NO: 8402470 - DNA, 23 bp, Homo sapiens
cctggcagcaaacgaggaggtta

SEQ ID NO: 8402471 - DNA, 22 bp, Homo sapiens
cctggcaggctggggacagtgc

SEQ ID NO: 8402472 - DNA, 22 bp, Homo sapiens
cctggcaggttacaaccagtta

SEQ ID NO: 8402473 - DNA, 22 bp, Homo sapiens
cctggctcgctgacctcagggg

SEQ ID NO: 8402474 - DNA, 22 bp, Homo sapiens
cctggctcctgcctctgcaggg

SEQ ID NO: 8402475 - DNA, 22 bp, Homo sapiens
cctggcctcagcctagggctga

SEQ ID NO: 8402476 - DNA, 22 bp, Homo sapiens
tgtcctggacaacagcccctag

SEQ ID NO: 8402477 - DNA, 22 bp, Homo sapiens
tgtcctggaaaaatggagagtt

SEQ ID NO: 8402478 - DNA, 22 bp, Homo sapiens
tgtcctggagttataatgcctg

SEQ ID NO: 8402479 - DNA, 22 bp, Homo sapiens
tgtcctggagtgcttgggggaa

SEQ ID NO: 8402480 - DNA, 22 bp, Homo sapiens
tgtcctggagacacaaggtggt

SEQ ID NO: 8402481 - DNA, 22 bp, Homo sapiens
tgtcctggatcatgcctctgaa

SEQ ID NO: 8402482 - DNA, 22 bp, Homo sapiens
tgtctcagagtatccctgaact

SEQ ID NO: 8402483 - DNA, 22 bp, Homo sapiens
tgtctcaggtacatgcgtcctg

SEQ ID NO: 8402484 - DNA, 19 bp, Homo sapiens
tgtctcagtgtcccttcct

SEQ ID NO: 8402485 - DNA, 22 bp, Homo sapiens
cctgggtgatgtgctgccctcg

SEQ ID NO: 8402486 - DNA, 22 bp, Homo sapiens
cctgggtgatgtgctgccctcg

SEQ ID NO: 8402487 - DNA, 22 bp, Homo sapiens
cctgggtgacagagtgagacct

SEQ ID NO: 8402488 - DNA, 22 bp, Homo sapiens
cctgggaggcggaggttgcagt

SEQ ID NO: 8402489 - DNA, 19 bp, Homo sapiens
cctgggaggcggaggttgc

SEQ ID NO: 8402490 - DNA, 22 bp, Homo sapiens
cctgggaggcggaggttgcagg

SEQ ID NO: 8402491 - DNA, 22 bp, Homo sapiens
cctgggaggcagaggttgcagt

SEQ ID NO: 8402492 - DNA, 22 bp, Homo sapiens
tgtggcagggatactgaggcag

SEQ ID NO: 8402493 - DNA, 22 bp, Homo sapiens
tgtggcaggcattctgaggctg

SEQ ID NO: 8402494 - DNA, 20 bp, Homo sapiens
tgtggcaggatgagggcgga

SEQ ID NO: 8402495 - DNA, 22 bp, Homo sapiens
tgtggcaggaagagcttctgag

SEQ ID NO: 8402496 - DNA, 23 bp, Homo sapiens
tgtctggggcgccagaagagaga

SEQ ID NO: 8402497 - DNA, 22 bp, Homo sapiens
tgtctgggggttctgaaagctg

SEQ ID NO: 8402498 - DNA, 22 bp, Homo sapiens
tgtctgggttttgggtcatatt

SEQ ID NO: 8402499 - DNA, 22 bp, Homo sapiens
cctggctgaggggccaaggacc

SEQ ID NO: 8402500 - DNA, 22 bp, Homo sapiens
cctggctgaacaaagtccctcc

SEQ ID NO: 8402501 - DNA, 21 bp, Homo sapiens
cctggctgcacagttgctggt

SEQ ID NO: 8402502 - DNA, 22 bp, Homo sapiens
tgtgcttctgcagagactattt

SEQ ID NO: 8402503 - DNA, 22 bp, Homo sapiens
tgtgccagttttgtctaagccc

SEQ ID NO: 8402504 - DNA, 22 bp, Homo sapiens
cctgggagagctgcccgggtga

SEQ ID NO: 8402505 - DNA, 22 bp, Homo sapiens
cctgggagagccatctgtggcc

SEQ ID NO: 8402506 - DNA, 22 bp, Homo sapiens
cctgggagagtctgtggtctcc

SEQ ID NO: 8402507 - DNA, 22 bp, Homo sapiens
tgtgccaggcacttgcccaggc

SEQ ID NO: 8402508 - DNA, 22 bp, Homo sapiens
cctgggagccgactgactgtgc

SEQ ID NO: 8402509 - DNA, 21 bp, Homo sapiens
cctgggagatcagctgccttc

SEQ ID NO: 8402510 - DNA, 22 bp, Homo sapiens
cctgggaaagtgaggtcattat

SEQ ID NO: 8402511 - DNA, 19 bp, Homo sapiens
cctggctgtgaagcctgca

SEQ ID NO: 8402512 - DNA, 22 bp, Homo sapiens
cctggctgctgtcactgaccat

SEQ ID NO: 8402513 - DNA, 22 bp, Homo sapiens
cctggctgcccatggaccctct

SEQ ID NO: 8402514 - DNA, 20 bp, Homo sapiens
cctggctgcattcaggacgg

SEQ ID NO: 8402515 - DNA, 22 bp, Homo sapiens
cccagcctgtctttcccaatga

SEQ ID NO: 8402516 - DNA, 22 bp, Homo sapiens
cccagcctgtgacagccgtcct

SEQ ID NO: 8402517 - DNA, 22 bp, Homo sapiens
tgccacaccaacatctttcagc

SEQ ID NO: 8402518 - DNA, 22 bp, Homo sapiens
tgctgcacaattggaaagtatc

SEQ ID NO: 8402519 - DNA, 22 bp, Homo sapiens
tgctcccagctgtaggaatgtt

SEQ ID NO: 8402520 - DNA, 22 bp, Homo sapiens
tgcctgggccttcccacctctg

SEQ ID NO: 8402521 - DNA, 22 bp, Homo sapiens
cccaggctcctgactcattcta

SEQ ID NO: 8402522 - DNA, 22 bp, Homo sapiens
tgctcccaaacctgacaggctc

SEQ ID NO: 8402523 - DNA, 22 bp, Homo sapiens
tgctcccaaacgacctactgtg

SEQ ID NO: 8402524 - DNA, 23 bp, Homo sapiens
tgctggagacaagtgtgagaagg

SEQ ID NO: 8402525 - DNA, 22 bp, Homo sapiens
ccctcagctccaccctcagcag

SEQ ID NO: 8402526 - DNA, 22 bp, Homo sapiens
cctctgggctgcctgcacgggt

SEQ ID NO: 8402527 - DNA, 22 bp, Homo sapiens
cctccagactttggccatcctc

SEQ ID NO: 8402528 - DNA, 22 bp, Homo sapiens
cctccagcattactggcccatg

SEQ ID NO: 8402529 - DNA, 22 bp, Homo sapiens
tggccctgctgtatcatctgct

SEQ ID NO: 8402530 - DNA, 22 bp, Homo sapiens
ccctccagggagccatgctggg

SEQ ID NO: 8402531 - DNA, 22 bp, Homo sapiens
tggatgagattaaagtgaggtt

SEQ ID NO: 8402532 - DNA, 22 bp, Homo sapiens
tggatgagggctgagcactggg

SEQ ID NO: 8402533 - DNA, 22 bp, Homo sapiens
tggatgagttcaatgaggcaga

SEQ ID NO: 8402534 - DNA, 22 bp, Homo sapiens
ccctggctgccagtcaccagac

SEQ ID NO: 8402535 - DNA, 22 bp, Homo sapiens
ccctggcctccaggcagtcctg

SEQ ID NO: 8402536 - DNA, 22 bp, Homo sapiens
tggccaggcattcagataagac

SEQ ID NO: 8402537 - DNA, 22 bp, Homo sapiens
tggccaggcaggtagaacggcc

SEQ ID NO: 8402538 - DNA, 23 bp, Homo sapiens
tggccaggcataaaggtgggtgg

SEQ ID NO: 8402539 - DNA, 22 bp, Homo sapiens
tggccaggaggctgcttctgac

SEQ ID NO: 8402540 - DNA, 22 bp, Homo sapiens
tggccaggaggctgcttctgac

SEQ ID NO: 8402541 - DNA, 22 bp, Homo sapiens
tggcagcaagttcttgggaggt

SEQ ID NO: 8402542 - DNA, 22 bp, Homo sapiens
taagatttttaaaatgtcctca

SEQ ID NO: 8402543 - DNA, 22 bp, Homo sapiens
caggcaagatccagaggctgct

SEQ ID NO: 8402544 - DNA, 22 bp, Homo sapiens
caggcacaagatcggctagata

SEQ ID NO: 8402545 - DNA, 22 bp, Homo sapiens
taaaaaacattactctgtcctg

SEQ ID NO: 8402546 - DNA, 22 bp, Homo sapiens
taaactatctgtgtttgaagtt

SEQ ID NO: 8402547 - DNA, 22 bp, Homo sapiens
caggacatcgtcatcatgggga

SEQ ID NO: 8402548 - DNA, 22 bp, Homo sapiens
caggacagctgggccaccacca

SEQ ID NO: 8402549 - DNA, 22 bp, Homo sapiens
caggacaggccctgtggggtct

SEQ ID NO: 8402550 - DNA, 22 bp, Homo sapiens
taaatatcacctggaattgtta

SEQ ID NO: 8402551 - DNA, 22 bp, Homo sapiens
taaatatcagtccagctcttcc

SEQ ID NO: 8402552 - DNA, 22 bp, Homo sapiens
taaatatgcatgtatccttatc

SEQ ID NO: 8402553 - DNA, 22 bp, Homo sapiens
caggagatgacagggaagaacc

SEQ ID NO: 8402554 - DNA, 22 bp, Homo sapiens
caggaaagagctgccaggcagg

SEQ ID NO: 8402555 - DNA, 22 bp, Homo sapiens
caggaaagagagctattcactt

SEQ ID NO: 8402556 - DNA, 22 bp, Homo sapiens
caggaaagaaatgagaacacca

SEQ ID NO: 8402557 - DNA, 21 bp, Homo sapiens
caggaaagaaaacgtacatat

SEQ ID NO: 8402558 - DNA, 22 bp, Homo sapiens
cagctgtgagcagccagttgcc

SEQ ID NO: 8402559 - DNA, 22 bp, Homo sapiens
caggaaagtctgtaaaggaacc

SEQ ID NO: 8402560 - DNA, 22 bp, Homo sapiens
caggaaagccgagtgccatagg

SEQ ID NO: 8402561 - DNA, 22 bp, Homo sapiens
caggaaagggatgggctgccac

SEQ ID NO: 8402562 - DNA, 22 bp, Homo sapiens
caggaaaggtgtgtcatgatgg

SEQ ID NO: 8402563 - DNA, 22 bp, Homo sapiens
caggaaaggtagtcacaatgta

SEQ ID NO: 8402564 - DNA, 22 bp, Homo sapiens
gttcttcagaggggaaagaacc

SEQ ID NO: 8402565 - DNA, 22 bp, Homo sapiens
caggaacacaagttcagggatg

SEQ ID NO: 8402566 - DNA, 22 bp, Homo sapiens
gtgtgacccaaggacactctct

SEQ ID NO: 8402567 - DNA, 22 bp, Homo sapiens
gtgtgagcagaaaccatgagta

SEQ ID NO: 8402568 - DNA, 22 bp, Homo sapiens
gtgtctttattcctctatgttt

SEQ ID NO: 8402569 - DNA, 22 bp, Homo sapiens
cagctgctctggtggtctctcc

SEQ ID NO: 8402570 - DNA, 22 bp, Homo sapiens
gtggcaggtcccattggagcag

SEQ ID NO: 8402571 - DNA, 22 bp, Homo sapiens
gtggcaggtggagcctcctgca

SEQ ID NO: 8402572 - DNA, 22 bp, Homo sapiens
gtggcaggttccgtagacagca

SEQ ID NO: 8402573 - DNA, 22 bp, Homo sapiens
gtgggaagaacttcaagtggct

SEQ ID NO: 8402574 - DNA, 22 bp, Homo sapiens
gtgggcaggccctaggcgattt

SEQ ID NO: 8402575 - DNA, 22 bp, Homo sapiens
cagctcttcctagccatgccac

SEQ ID NO: 8402576 - DNA, 22 bp, Homo sapiens
cagctcttagagggagacagac

SEQ ID NO: 8402577 - DNA, 22 bp, Homo sapiens
cagctcttaacacagcttgtat

SEQ ID NO: 8402578 - DNA, 22 bp, Homo sapiens
cagctcttccctcttcttgtag

SEQ ID NO: 8402579 - DNA, 22 bp, Homo sapiens
cagctcttcagtgcctgagata

SEQ ID NO: 8402580 - DNA, 22 bp, Homo sapiens
cagctgagtggaccctagaggc

SEQ ID NO: 8402581 - DNA, 22 bp, Homo sapiens
cagctgagtttccaagtctgcc

SEQ ID NO: 8402582 - DNA, 22 bp, Homo sapiens
cagctgagcatcactagtctgg

SEQ ID NO: 8402583 - DNA, 22 bp, Homo sapiens
cagctgagctcccaggccatca

SEQ ID NO: 8402584 - DNA, 22 bp, Homo sapiens
cagctgaggaatactagatgta

SEQ ID NO: 8402585 - DNA, 22 bp, Homo sapiens
cagctgagctgccagactactg

SEQ ID NO: 8402586 - DNA, 17 bp, Homo sapiens
ccagatcccagtcctta

SEQ ID NO: 8402587 - DNA, 22 bp, Homo sapiens
ccagatccctgtttgcctctgg

SEQ ID NO: 8402588 - DNA, 21 bp, Homo sapiens
ccagatcctgcttcctcaccc

SEQ ID NO: 8402589 - DNA, 23 bp, Homo sapiens
tcctggtgacatgcctgagcatc

SEQ ID NO: 8402590 - DNA, 19 bp, Homo sapiens
tcctggtgcttgacactga

SEQ ID NO: 8402591 - DNA, 22 bp, Homo sapiens
tcctggtgcttgtatttgaagt

SEQ ID NO: 8402592 - DNA, 16 bp, Homo sapiens
ccacctgcagctctca

SEQ ID NO: 8402593 - DNA, 22 bp, Homo sapiens
ccactcttgaatcaagagctca

SEQ ID NO: 8402594 - DNA, 22 bp, Homo sapiens
tctgtcacccgagcaggcgaga

SEQ ID NO: 8402595 - DNA, 22 bp, Homo sapiens
tctgtcaccgagggcatccaaa

SEQ ID NO: 8402596 - DNA, 22 bp, Homo sapiens
ccagctgtttctgatgctaggc

SEQ ID NO: 8402597 - DNA, 22 bp, Homo sapiens
tctggctcatacaagcctgcaa

SEQ ID NO: 8402598 - DNA, 23 bp, Homo sapiens
ccagctccgtgagcctcgggctc

SEQ ID NO: 8402599 - DNA, 22 bp, Homo sapiens
ccagccttcacctgctctggtc

SEQ ID NO: 8402600 - DNA, 22 bp, Homo sapiens
ccagcctggggaggcagcttct

SEQ ID NO: 8402601 - DNA, 23 bp, Homo sapiens
ccagcgctcactcagagcatgtt

SEQ ID NO: 8402602 - DNA, 22 bp, Homo sapiens
ccagccttgcaccgagccagcc

SEQ ID NO: 8402603 - DNA, 22 bp, Homo sapiens
ccagccttgactgccccagcac

SEQ ID NO: 8402604 - DNA, 22 bp, Homo sapiens
tctctcttgaagtattagctag

SEQ ID NO: 8402605 - DNA, 23 bp, Homo sapiens
tctctcttagctatgcttatggc

SEQ ID NO: 8402606 - DNA, 22 bp, Homo sapiens
tctctcttcaacccttaactag

SEQ ID NO: 8402607 - DNA, 22 bp, Homo sapiens
ccagccccgggaacctggccgt

SEQ ID NO: 8402608 - DNA, 22 bp, Homo sapiens
ccagcccctatcctcgctccac

SEQ ID NO: 8402609 - DNA, 22 bp, Homo sapiens
tctgaggacagtgctgtgcctg

SEQ ID NO: 8402610 - DNA, 22 bp, Homo sapiens
cagtttatatataagcacattg

SEQ ID NO: 8402611 - DNA, 22 bp, Homo sapiens
tcagctcttccccccagccagg

SEQ ID NO: 8402612 - DNA, 22 bp, Homo sapiens
tcagctcttaaccctctggcct

SEQ ID NO: 8402613 - DNA, 20 bp, Homo sapiens
tcagctctgtgcctgggatg

SEQ ID NO: 8402614 - DNA, 19 bp, Homo sapiens
tcagctctggggtcagtgg

SEQ ID NO: 8402615 - DNA, 20 bp, Homo sapiens
catatatacctagaagtgga

SEQ ID NO: 8402616 - DNA, 20 bp, Homo sapiens
tcagtttaaatcctggcttt

SEQ ID NO: 8402617 - DNA, 22 bp, Homo sapiens
tccagcccacacctgaagctgg

SEQ ID NO: 8402618 - DNA, 22 bp, Homo sapiens
tccagcccagctcctctcagaa

SEQ ID NO: 8402619 - DNA, 20 bp, Homo sapiens
tccagcccagcagcctgaca

SEQ ID NO: 8402620 - DNA, 18 bp, Homo sapiens
tccagcccacattttctg

SEQ ID NO: 8402621 - DNA, 22 bp, Homo sapiens
tcactccatagcttaactcttt

SEQ ID NO: 8402622 - DNA, 22 bp, Homo sapiens
tcactcctcaggctagcatcat

SEQ ID NO: 8402623 - DNA, 22 bp, Homo sapiens
tcactccatctttgctactggt

SEQ ID NO: 8402624 - DNA, 22 bp, Homo sapiens
cagtcctgggcacagccctggg

SEQ ID NO: 8402625 - DNA, 22 bp, Homo sapiens
cagtctacctttcagacattga

SEQ ID NO: 8402626 - DNA, 22 bp, Homo sapiens
tattggaaggaagcaagagagg

SEQ ID NO: 8402627 - DNA, 22 bp, Homo sapiens
cagggtggaagctgtagagtgg

SEQ ID NO: 8402628 - DNA, 22 bp, Homo sapiens
caggtctcttttgtcacaccac

SEQ ID NO: 8402629 - DNA, 20 bp, Homo sapiens
ttacactttgtagcattttt

SEQ ID NO: 8402630 - DNA, 22 bp, Homo sapiens
ttcacctggcacatgtgagcct

SEQ ID NO: 8402631 - DNA, 22 bp, Homo sapiens
ttcaccctgagccccacctctg

SEQ ID NO: 8402632 - DNA, 22 bp, Homo sapiens
ttcaggaataattatcatatga

SEQ ID NO: 8402633 - DNA, 23 bp, Homo sapiens
ttcaggaaatgaatacagacaca

SEQ ID NO: 8402634 - DNA, 22 bp, Homo sapiens
ttccagccagatttgctgggtt

SEQ ID NO: 8402635 - DNA, 22 bp, Homo sapiens
ttccagccagatttgctgggtt

SEQ ID NO: 8402636 - DNA, 22 bp, Homo sapiens
ttccagcttagagcatcatgtt

SEQ ID NO: 8402637 - DNA, 22 bp, Homo sapiens
tgtctgttattggtgtataaga

SEQ ID NO: 8402638 - DNA, 22 bp, Homo sapiens
tgtctgggagggacagggctac

SEQ ID NO: 8402639 - DNA, 22 bp, Homo sapiens
tgtcttttgccaaagatcagtt

SEQ ID NO: 8402640 - DNA, 22 bp, Homo sapiens
tgtgctcttctgttacttgtag

SEQ ID NO: 8402641 - DNA, 22 bp, Homo sapiens
tgtgctctgactttctcctggt

SEQ ID NO: 8402642 - DNA, 17 bp, Homo sapiens
tgtgctctctcactcag

SEQ ID NO: 8402643 - DNA, 22 bp, Homo sapiens
tgtgctctgaagagtgcatgtc

SEQ ID NO: 8402644 - DNA, 22 bp, Homo sapiens
tgtggggacccatgccatgggc

SEQ ID NO: 8402645 - DNA, 22 bp, Homo sapiens
tgtggggactgagtggaggctt

SEQ ID NO: 8402646 - DNA, 23 bp, Homo sapiens
tgtgggaatgttggagaggaaac

SEQ ID NO: 8402647 - DNA, 22 bp, Homo sapiens
tgtgggaatgacgaggaagagg

SEQ ID NO: 8402648 - DNA, 22 bp, Homo sapiens
tgtgggaatcagccaggggggc

SEQ ID NO: 8402649 - DNA, 22 bp, Homo sapiens
tgtgggaagagcagtggcagca

SEQ ID NO: 8402650 - DNA, 22 bp, Homo sapiens
tgtgggaaatgggagtggaaga

SEQ ID NO: 8402651 - DNA, 22 bp, Homo sapiens
tgtgggaagatgttgcaggaga

SEQ ID NO: 8402652 - DNA, 22 bp, Homo sapiens
tgtgggaagtttggagggaaag

SEQ ID NO: 8402653 - DNA, 22 bp, Homo sapiens
ttaaaccatagtttaacataag

SEQ ID NO: 8402654 - DNA, 22 bp, Homo sapiens
ttaaaatgtacaggggaaagtg

SEQ ID NO: 8402655 - DNA, 22 bp, Homo sapiens
tgggttgttgtgacagttacca

SEQ ID NO: 8402656 - DNA, 22 bp, Homo sapiens
tgggttgttccccaagtccaca

SEQ ID NO: 8402657 - DNA, 22 bp, Homo sapiens
tgggttgtctttgtctccactt

SEQ ID NO: 8402658 - DNA, 22 bp, Homo sapiens
tgggttgttcccatccaggccc

SEQ ID NO: 8402659 - DNA, 22 bp, Homo sapiens
tgggttgtcctctttctgttaa

SEQ ID NO: 8402660 - DNA, 22 bp, Homo sapiens
tgggttgtcatgggtccaaccc

SEQ ID NO: 8402661 - DNA, 19 bp, Homo sapiens
tgggttgtatctctaatgg

SEQ ID NO: 8402662 - DNA, 22 bp, Homo sapiens
tgggttgtaagagagtgcactt

SEQ ID NO: 8402663 - DNA, 22 bp, Homo sapiens
tgggtctcctgtgcctgggagg

SEQ ID NO: 8402664 - DNA, 22 bp, Homo sapiens
tgggtagggacttagctggctg

SEQ ID NO: 8402665 - DNA, 23 bp, Homo sapiens
tggggctgatggagacggaccag

SEQ ID NO: 8402666 - DNA, 22 bp, Homo sapiens
tgggctgcaccctcagcctctg

SEQ ID NO: 8402667 - DNA, 22 bp, Homo sapiens
tgggaggccgaggcaggtggat

SEQ ID NO: 8402668 - DNA, 22 bp, Homo sapiens
tgggaggcaggtaggtgatgat

SEQ ID NO: 8402669 - DNA, 22 bp, Homo sapiens
tgggagtgcacctgggacacga

SEQ ID NO: 8402670 - DNA, 22 bp, Homo sapiens
tgggatgagggtgagccacatg

SEQ ID NO: 8402671 - DNA, 22 bp, Homo sapiens
tgggcatcccgcgtctggctgc

SEQ ID NO: 8402672 - DNA, 22 bp, Homo sapiens
tgtcatttattctcttattcta

SEQ ID NO: 8402673 - DNA, 22 bp, Homo sapiens
tgtcatttatgcttcttcagtg

SEQ ID NO: 8402674 - DNA, 22 bp, Homo sapiens
tgtcatttattttgctgtctgt

SEQ ID NO: 8402675 - DNA, 22 bp, Homo sapiens
tgtcatttaaagctttccagat

SEQ ID NO: 8402676 - DNA, 20 bp, Homo sapiens
tgtcattcttctttcacagg

SEQ ID NO: 8402677 - DNA, 22 bp, Homo sapiens
tgtcatttagtcctctgtgtgt

SEQ ID NO: 8402678 - DNA, 22 bp, Homo sapiens
tgtcattttgtctcactgctat

SEQ ID NO: 8402679 - DNA, 22 bp, Homo sapiens
tgtccagcggcctggctgctga

SEQ ID NO: 8402680 - DNA, 22 bp, Homo sapiens
tgtcatttcacaatatcactca

SEQ ID NO: 8402681 - DNA, 22 bp, Homo sapiens
tgtcatttcctgaatgctgagt

SEQ ID NO: 8402682 - DNA, 22 bp, Homo sapiens
tgtcattttctaatctgttgtc

SEQ ID NO: 8402683 - DNA, 22 bp, Homo sapiens
tgtcactcaagttccaatttac

SEQ ID NO: 8402684 - DNA, 22 bp, Homo sapiens
tgtcctggccaaggccttgctt

SEQ ID NO: 8402685 - DNA, 22 bp, Homo sapiens
tgtcctggcctccagaaagtcg

SEQ ID NO: 8402686 - DNA, 22 bp, Homo sapiens
tgtcctgggaaatcccttaggc

SEQ ID NO: 8402687 - DNA, 22 bp, Homo sapiens
tgtcctggggcgacttggggcc

SEQ ID NO: 8402688 - DNA, 22 bp, Homo sapiens
tgtcctgggtcaaccaggtcga

SEQ ID NO: 8402689 - DNA, 22 bp, Homo sapiens
tgtcctgggtcaaatcctggtc

SEQ ID NO: 8402690 - DNA, 22 bp, Homo sapiens
tgtcctggggacaagaggccct

SEQ ID NO: 8402691 - DNA, 22 bp, Homo sapiens
tgtcctgggaactcacagtcca

SEQ ID NO: 8402692 - DNA, 22 bp, Homo sapiens
tgtcctgggaggcggggtccag

SEQ ID NO: 8402693 - DNA, 22 bp, Homo sapiens
tgtcctgggccggcgactggtc

SEQ ID NO: 8402694 - DNA, 22 bp, Homo sapiens
tgtcctgggaatgggatgcagt

SEQ ID NO: 8402695 - DNA, 22 bp, Homo sapiens
tgtcctggtgcttcttgggatt

SEQ ID NO: 8402696 - DNA, 22 bp, Homo sapiens
tgtcctggtgctccaggtggct

SEQ ID NO: 8402697 - DNA, 22 bp, Homo sapiens
tgtcctgggtggatgcttcatt

SEQ ID NO: 8402698 - DNA, 21 bp, Homo sapiens
tgtcctggtcactgctctccc

SEQ ID NO: 8402699 - DNA, 22 bp, Homo sapiens
tgtcctgggtccctgctagaag

SEQ ID NO: 8402700 - DNA, 22 bp, Homo sapiens
tgtcacacctcgtttagcattc

SEQ ID NO: 8402701 - DNA, 22 bp, Homo sapiens
tgtaggaatggattctagaagg

SEQ ID NO: 8402702 - DNA, 22 bp, Homo sapiens
tgtaggaaaaacaatgatctgc

SEQ ID NO: 8402703 - DNA, 22 bp, Homo sapiens
tgtagctctccagccagcaagg

SEQ ID NO: 8402704 - DNA, 22 bp, Homo sapiens
tgtaaataattcctaggctttt

SEQ ID NO: 8402705 - DNA, 22 bp, Homo sapiens
tgtaaatagttagcttgcctct

SEQ ID NO: 8402706 - DNA, 20 bp, Homo sapiens
tgtaaataggcattgtagtt

SEQ ID NO: 8402707 - DNA, 22 bp, Homo sapiens
tgtaaagtccaagatcaaagag

SEQ ID NO: 8402708 - DNA, 22 bp, Homo sapiens
tggtgtgaggcgggagtgtagt

SEQ ID NO: 8402709 - DNA, 22 bp, Homo sapiens
tggtctctgagccttcctgtgg

SEQ ID NO: 8402710 - DNA, 22 bp, Homo sapiens
tggtcctggccttgaccccagg

SEQ ID NO: 8402711 - DNA, 22 bp, Homo sapiens
tggtcctgagcaccagcctgac

SEQ ID NO: 8402712 - DNA, 22 bp, Homo sapiens
tggtcctcaggttctctgtgcg

SEQ ID NO: 8402713 - DNA, 22 bp, Homo sapiens
tggtggcaacattgctggagtg

SEQ ID NO: 8402714 - DNA, 22 bp, Homo sapiens
tggtggcaacattgctggagtg

SEQ ID NO: 8402715 - DNA, 22 bp, Homo sapiens
tggtggcaaatcaggacacttc

SEQ ID NO: 8402716 - DNA, 22 bp, Homo sapiens
tggtgggggaggctgtctagca

SEQ ID NO: 8402717 - DNA, 22 bp, Homo sapiens
tggtggcagctgagtgtcaggt

SEQ ID NO: 8402718 - DNA, 22 bp, Homo sapiens
tggtggcagctgggacagaggt

SEQ ID NO: 8402719 - DNA, 22 bp, Homo sapiens
tggtggcatgatagtgtgaatg

SEQ ID NO: 8402720 - DNA, 22 bp, Homo sapiens
tggtggcagtgagaaggagagg

SEQ ID NO: 8402721 - DNA, 22 bp, Homo sapiens
tggtggcacaagggagagaatc

SEQ ID NO: 8402722 - DNA, 22 bp, Homo sapiens
tggtggcaatgtcctggagaag

SEQ ID NO: 8402723 - DNA, 23 bp, Homo sapiens
tggtggcagaagtagcagatgac

SEQ ID NO: 8402724 - DNA, 22 bp, Homo sapiens
tggtggcagagcaagagctgga

SEQ ID NO: 8402725 - DNA, 22 bp, Homo sapiens
tgctttgtgacagattagtttt

SEQ ID NO: 8402726 - DNA, 22 bp, Homo sapiens
tggaaagtctcttttgactgta

SEQ ID NO: 8402727 - DNA, 22 bp, Homo sapiens
tggaaaggtgtaaagcagaacc

SEQ ID NO: 8402728 - DNA, 22 bp, Homo sapiens
tggaaagtgctctagactttct

SEQ ID NO: 8402729 - DNA, 22 bp, Homo sapiens
tggaaaggaggcttgtggaata

SEQ ID NO: 8402730 - DNA, 22 bp, Homo sapiens
tggacctgagcctggccctgcc

SEQ ID NO: 8402731 - DNA, 22 bp, Homo sapiens
tggaagaggtggaagtggcttc

SEQ ID NO: 8402732 - DNA, 22 bp, Homo sapiens
tggaagagggagctgggtggcc

SEQ ID NO: 8402733 - DNA, 22 bp, Homo sapiens
tggaagaggcccatgactgcct

SEQ ID NO: 8402734 - DNA, 22 bp, Homo sapiens
tggaagaggccagaaagtggga

SEQ ID NO: 8402735 - DNA, 20 bp, Homo sapiens
tggaagaggagatgcctctg

SEQ ID NO: 8402736 - DNA, 19 bp, Homo sapiens
tggaagaggaagggaaata

SEQ ID NO: 8402737 - DNA, 22 bp, Homo sapiens
tggaagagaaaggagtggatct

SEQ ID NO: 8402738 - DNA, 22 bp, Homo sapiens
tggaagagaaaatccaccctta

SEQ ID NO: 8402739 - DNA, 22 bp, Homo sapiens
tggaagcctcagtttgccttct

SEQ ID NO: 8402740 - DNA, 22 bp, Homo sapiens
tggagcagaggctgaggttggg

SEQ ID NO: 8402741 - DNA, 22 bp, Homo sapiens
tggagcagagttcagcggggag

SEQ ID NO: 8402742 - DNA, 22 bp, Homo sapiens
tggagcaggacggggagtggta

SEQ ID NO: 8402743 - DNA, 22 bp, Homo sapiens
tggagcaggtgccaggtgtgtg

SEQ ID NO: 8402744 - DNA, 22 bp, Homo sapiens
tggagccagcaggactcagagg

SEQ ID NO: 8402745 - DNA, 22 bp, Homo sapiens
tggagccactcactatctgagt

SEQ ID NO: 8402746 - DNA, 22 bp, Homo sapiens
tggagctggaatttctgggcct

SEQ ID NO: 8402747 - DNA, 22 bp, Homo sapiens
tggaggctggagtgcagtggcg

SEQ ID NO: 8402748 - DNA, 19 bp, Homo sapiens
tggaggagaggaaaagtca

SEQ ID NO: 8402749 - DNA, 23 bp, Homo sapiens
tggagctgggcagctgggaaagt

SEQ ID NO: 8402750 - DNA, 22 bp, Homo sapiens
tggagctggttctggggaagct

SEQ ID NO: 8402751 - DNA, 22 bp, Homo sapiens
tggaggaaaaaaccaggcagag

SEQ ID NO: 8402752 - DNA, 22 bp, Homo sapiens
tggatggattgacgaaggcagc

SEQ ID NO: 8402753 - DNA, 19 bp, Homo sapiens
tgctcagtggctaaaagca

SEQ ID NO: 8402754 - DNA, 22 bp, Homo sapiens
tgcctgtctttcctccctcgta

SEQ ID NO: 8402755 - DNA, 22 bp, Homo sapiens
tgcctgggtgtaaagggccaac

SEQ ID NO: 8402756 - DNA, 22 bp, Homo sapiens
tgcctggccctgacagccctgg

SEQ ID NO: 8402757 - DNA, 22 bp, Homo sapiens
tgcctggctctatcagtggtgg

SEQ ID NO: 8402758 - DNA, 22 bp, Homo sapiens
tgcctggctgggctgctcatgg

SEQ ID NO: 8402759 - DNA, 22 bp, Homo sapiens
tgccttgcttcaatcaaaccgt

SEQ ID NO: 8402760 - DNA, 22 bp, Homo sapiens
tgcgatgcaacagcttggcgga

SEQ ID NO: 8402761 - DNA, 22 bp, Homo sapiens
tgcgaccctagccccctcactt

SEQ ID NO: 8402762 - DNA, 20 bp, Homo sapiens
tgctctgggggtggagagac

SEQ ID NO: 8402763 - DNA, 22 bp, Homo sapiens
tgctctccggcttccgtggcct

SEQ ID NO: 8402764 - DNA, 22 bp, Homo sapiens
tgctctcctgctcctcagccca

SEQ ID NO: 8402765 - DNA, 22 bp, Homo sapiens
tgctctcctgctcctcagccca

SEQ ID NO: 8402766 - DNA, 22 bp, Homo sapiens
tgctctggctgggatgagtgca

SEQ ID NO: 8402767 - DNA, 19 bp, Homo sapiens
tgctctctggtgcttcatg

SEQ ID NO: 8402768 - DNA, 22 bp, Homo sapiens
tgctcctggactggtgtgagat

SEQ ID NO: 8402769 - DNA, 22 bp, Homo sapiens
tgctcccagggactctggctgg

SEQ ID NO: 8402770 - DNA, 22 bp, Homo sapiens
tgcttccaggaatccatctggc

SEQ ID NO: 8402771 - DNA, 22 bp, Homo sapiens
tgcttctcaaaaggaggtaggt

SEQ ID NO: 8402772 - DNA, 22 bp, Homo sapiens
tgcttctccattgatgctaagt

SEQ ID NO: 8402773 - DNA, 22 bp, Homo sapiens
tgcttctcaaagaagcataatg

SEQ ID NO: 8402774 - DNA, 21 bp, Homo sapiens
tgcttctctagatcaactact

SEQ ID NO: 8402775 - DNA, 23 bp, Homo sapiens
tgcttctctgcttgacagttctg

SEQ ID NO: 8402776 - DNA, 22 bp, Homo sapiens
tgcttctctgttctaacccttg

SEQ ID NO: 8402777 - DNA, 22 bp, Homo sapiens
tgcttctctttatttgtaggtt

SEQ ID NO: 8402778 - DNA, 17 bp, Homo sapiens
tgctgtctgcttcccta

SEQ ID NO: 8402779 - DNA, 22 bp, Homo sapiens
tgctggcaggcacctcctgggg

SEQ ID NO: 8402780 - DNA, 20 bp, Homo sapiens
tgctgctgtgagcgtccctg

SEQ ID NO: 8402781 - DNA, 20 bp, Homo sapiens
tgctgctgcttcacccccat

SEQ ID NO: 8402782 - DNA, 20 bp, Homo sapiens
tgctgctgcctccgcctctg

SEQ ID NO: 8402783 - DNA, 22 bp, Homo sapiens
tgctgccacctggtggctgaag

SEQ ID NO: 8402784 - DNA, 22 bp, Homo sapiens
tgctgctctcagccaccaggaa

SEQ ID NO: 8402785 - DNA, 22 bp, Homo sapiens
tgctgctccccagcacacagca

SEQ ID NO: 8402786 - DNA, 22 bp, Homo sapiens
tggccaggcctcttggtgccca

SEQ ID NO: 8402787 - DNA, 22 bp, Homo sapiens
tggccaggctggtctggaacgc

SEQ ID NO: 8402788 - DNA, 23 bp, Homo sapiens
tggccagggtactacacccaccc

SEQ ID NO: 8402789 - DNA, 22 bp, Homo sapiens
tggccaggggagttcccctcca

SEQ ID NO: 8402790 - DNA, 23 bp, Homo sapiens
tggccaggtagaggaggtagtga

SEQ ID NO: 8402791 - DNA, 22 bp, Homo sapiens
tggccaggtgtgggttctcaga

SEQ ID NO: 8402792 - DNA, 17 bp, Homo sapiens
tggccaggccccgccag

SEQ ID NO: 8402793 - DNA, 22 bp, Homo sapiens
tggccaggccggggacagaact

SEQ ID NO: 8402794 - DNA, 22 bp, Homo sapiens
tggcatggccagtgctgggagt

SEQ ID NO: 8402795 - DNA, 22 bp, Homo sapiens
tggcatgggtggagagagcaca

SEQ ID NO: 8402796 - DNA, 22 bp, Homo sapiens
tggcatgggccagggagagctg

SEQ ID NO: 8402797 - DNA, 22 bp, Homo sapiens
tggcatggcaaccctgcaggga

SEQ ID NO: 8402798 - DNA, 21 bp, Homo sapiens
tggcatggaggtagcagtgtg

SEQ ID NO: 8402799 - DNA, 22 bp, Homo sapiens
tggcatggactagtgctgaggt

SEQ ID NO: 8402800 - DNA, 22 bp, Homo sapiens
tggcagtggctcagagtgcaga

SEQ ID NO: 8402801 - DNA, 22 bp, Homo sapiens
tggcagtggataggggagcggt

SEQ ID NO: 8402802 - DNA, 18 bp, Homo sapiens
tggcagtgaggtaggcat

SEQ ID NO: 8402803 - DNA, 22 bp, Homo sapiens
tggcagtgatgcggcaggacat

SEQ ID NO: 8402804 - DNA, 22 bp, Homo sapiens
tggcagtgccccttgaccagtg

SEQ ID NO: 8402805 - DNA, 22 bp, Homo sapiens
tggccctgccactcactgctga

SEQ ID NO: 8402806 - DNA, 22 bp, Homo sapiens
tggccctgggcagaggcaacat

SEQ ID NO: 8402807 - DNA, 22 bp, Homo sapiens
tggccctgaggacccagtgtgg

SEQ ID NO: 8402808 - DNA, 22 bp, Homo sapiens
tggatgtgagaaggatcaggct

SEQ ID NO: 8402809 - DNA, 22 bp, Homo sapiens
tggatgggttgaaatgtgagcc

SEQ ID NO: 8402810 - DNA, 17 bp, Homo sapiens
tggatgtgggatctgga

SEQ ID NO: 8402811 - DNA, 22 bp, Homo sapiens
tggatgtgtcgccctggctctc

SEQ ID NO: 8402812 - DNA, 22 bp, Homo sapiens
tggcaaccgcatggcctgcttc

SEQ ID NO: 8402813 - DNA, 22 bp, Homo sapiens
tggcaattgtccactgtctgcc

SEQ ID NO: 8402814 - DNA, 22 bp, Homo sapiens
tggcacttccactgtggctgct

SEQ ID NO: 8402815 - DNA, 22 bp, Homo sapiens
tggcactgaccccaggcctgtg

SEQ ID NO: 8402816 - DNA, 22 bp, Homo sapiens
tggcactggaatcgtagccttg

SEQ ID NO: 8402817 - DNA, 22 bp, Homo sapiens
tggcacgacaattggcaccaat

SEQ ID NO: 8402818 - DNA, 22 bp, Homo sapiens
tggcaggcattgatgcgagttc

SEQ ID NO: 8402819 - DNA, 21 bp, Homo sapiens
tggcaggcagctggaagcttg

SEQ ID NO: 8402820 - DNA, 22 bp, Homo sapiens
tggcaggcagtgtgggagctgg

SEQ ID NO: 8402821 - DNA, 22 bp, Homo sapiens
tggcaggaagacgtggggcacc

SEQ ID NO: 8402822 - DNA, 22 bp, Homo sapiens
tgggaagactcctcaggaggcg

SEQ ID NO: 8402823 - DNA, 22 bp, Homo sapiens
tgggaagaggagcactggaatg

SEQ ID NO: 8402824 - DNA, 22 bp, Homo sapiens
tgggagcagcagggagatgcgg

SEQ ID NO: 8402825 - DNA, 22 bp, Homo sapiens
tgggaggagccctctgggaagg

SEQ ID NO: 8402826 - DNA, 22 bp, Homo sapiens
tgggaggatcgcttgagcccag

SEQ ID NO: 8402827 - DNA, 22 bp, Homo sapiens
tgggaggatctcttgaggccag

SEQ ID NO: 8402828 - DNA, 22 bp, Homo sapiens
tgggaggaagtgctaatgggag

SEQ ID NO: 8402829 - DNA, 22 bp, Homo sapiens
tgggaggaatgtcactgagcca

SEQ ID NO: 8402830 - DNA, 22 bp, Homo sapiens
tgggaggacttgtgggcttcat

SEQ ID NO: 8402831 - DNA, 22 bp, Homo sapiens
tgggagaagcagtgggacagta

SEQ ID NO: 8402832 - DNA, 22 bp, Homo sapiens
tgggagaacccagggtcaggct

SEQ ID NO: 8402833 - DNA, 22 bp, Homo sapiens
tgggagaagcagcagccaagtg

SEQ ID NO: 8402834 - DNA, 20 bp, Homo sapiens
tgggagatgatctccttgct

SEQ ID NO: 8402835 - DNA, 22 bp, Homo sapiens
tgggaatgctgagcccatgtat

SEQ ID NO: 8402836 - DNA, 23 bp, Homo sapiens
tgggaagatatgtatgttcaagg

SEQ ID NO: 8402837 - DNA, 22 bp, Homo sapiens
tgggaagatatgagtgaccaac

SEQ ID NO: 8402838 - DNA, 22 bp, Homo sapiens
tgggaagaggcgggaggctgtt

SEQ ID NO: 8402839 - DNA, 22 bp, Homo sapiens
tgggaagggtcaacagctggaa

SEQ ID NO: 8402840 - DNA, 22 bp, Homo sapiens
tgggaagggcctgcccttcctc

SEQ ID NO: 8402841 - DNA, 22 bp, Homo sapiens
tgggaaggtacacgggaaagag

SEQ ID NO: 8402842 - DNA, 22 bp, Homo sapiens
tgggaagggtcaacagctggaa

SEQ ID NO: 8402843 - DNA, 22 bp, Homo sapiens
tggctcacaatctcccatgaag

SEQ ID NO: 8402844 - DNA, 22 bp, Homo sapiens
tggctcacaggactctctgggc

SEQ ID NO: 8402845 - DNA, 22 bp, Homo sapiens
tggctcaccttcagaatatacc

SEQ ID NO: 8402846 - DNA, 22 bp, Homo sapiens
tggctcacaatctcccatgaag

SEQ ID NO: 8402847 - DNA, 22 bp, Homo sapiens
tggctcacttccgtggagaggt

SEQ ID NO: 8402848 - DNA, 22 bp, Homo sapiens
tggctcactgtagccttgacct

SEQ ID NO: 8402849 - DNA, 22 bp, Homo sapiens
tggctcactgtagccttgacct

SEQ ID NO: 8402850 - DNA, 22 bp, Homo sapiens
tggctcctcacgtcctcagagc

SEQ ID NO: 8402851 - DNA, 18 bp, Homo sapiens
tggctcctgcctcctgca

SEQ ID NO: 8402852 - DNA, 22 bp, Homo sapiens
tggctcctgcagaccatctgga

SEQ ID NO: 8402853 - DNA, 20 bp, Homo sapiens
tggctctcaccctgtgcgat

SEQ ID NO: 8402854 - DNA, 20 bp, Homo sapiens
tggctcctggctcctccctc

SEQ ID NO: 8402855 - DNA, 21 bp, Homo sapiens
tggctctgctcagagcagtcc

SEQ ID NO: 8402856 - DNA, 22 bp, Homo sapiens
tggctctgccccatacccctgc

SEQ ID NO: 8402857 - DNA, 22 bp, Homo sapiens
tggctctttctgtctgggatcc

SEQ ID NO: 8402858 - DNA, 22 bp, Homo sapiens
tggctcttttcacgtcccctct

SEQ ID NO: 8402859 - DNA, 22 bp, Homo sapiens
tggctcttaaggtccctgtgct

SEQ ID NO: 8402860 - DNA, 22 bp, Homo sapiens
tggctctgttgtgctgagccag

SEQ ID NO: 8402861 - DNA, 22 bp, Homo sapiens
tggctctgttcgccatcaggag

SEQ ID NO: 8402862 - DNA, 22 bp, Homo sapiens
tggctctggccaccgggagggc

SEQ ID NO: 8402863 - DNA, 22 bp, Homo sapiens
tggctctgtggatgttctgacc

SEQ ID NO: 8402864 - DNA, 22 bp, Homo sapiens
tggctgaggctggagtgcagtg

SEQ ID NO: 8402865 - DNA, 22 bp, Homo sapiens
tggctgagaaaaaagagctata

SEQ ID NO: 8402866 - DNA, 22 bp, Homo sapiens
tggctgagagcaattgactctg

SEQ ID NO: 8402867 - DNA, 22 bp, Homo sapiens
tggctgagttcctggcacacgg

SEQ ID NO: 8402868 - DNA, 22 bp, Homo sapiens
tggctgagtgttccaaggagca

SEQ ID NO: 8402869 - DNA, 22 bp, Homo sapiens
tgaaaatatagttttccagact

SEQ ID NO: 8402870 - DNA, 22 bp, Homo sapiens
tgaaagttaggatgtagtaatt

SEQ ID NO: 8402871 - DNA, 22 bp, Homo sapiens
tgaaagttacaggaaaacagat

SEQ ID NO: 8402872 - DNA, 22 bp, Homo sapiens
tgaaagttattactgatgatgt

SEQ ID NO: 8402873 - DNA, 22 bp, Homo sapiens
tgaaatagacttgcactatatg

SEQ ID NO: 8402874 - DNA, 22 bp, Homo sapiens
tgacaaaactgcaattactttt

SEQ ID NO: 8402875 - DNA, 22 bp, Homo sapiens
tgaataaatcaaagactgccct

SEQ ID NO: 8402876 - DNA, 22 bp, Homo sapiens
tgaaggagctcaggagatagtc

SEQ ID NO: 8402877 - DNA, 22 bp, Homo sapiens
tgacacagttgtcgactctaca

SEQ ID NO: 8402878 - DNA, 22 bp, Homo sapiens
tgacagcataacactggtcttg

SEQ ID NO: 8402879 - DNA, 22 bp, Homo sapiens
tgacaggggctggtggataaat

SEQ ID NO: 8402880 - DNA, 22 bp, Homo sapiens
tgagagggcccagagcacacca

SEQ ID NO: 8402881 - DNA, 22 bp, Homo sapiens
tgagaggatattttgggaggat

SEQ ID NO: 8402882 - DNA, 22 bp, Homo sapiens
tgagagcacacagaaatatttt

SEQ ID NO: 8402883 - DNA, 22 bp, Homo sapiens
tgagaacttgtgctattgcaca

SEQ ID NO: 8402884 - DNA, 22 bp, Homo sapiens
tgagacaatatcctttgtaacc

SEQ ID NO: 8402885 - DNA, 17 bp, Homo sapiens
tgagacagggcaggccc

SEQ ID NO: 8402886 - DNA, 22 bp, Homo sapiens
tgagacagtcaccaggcaggcc

SEQ ID NO: 8402887 - DNA, 22 bp, Homo sapiens
tgagcagagatgactgggcatt

SEQ ID NO: 8402888 - DNA, 22 bp, Homo sapiens
tgagccaaggcctcaagaattt

SEQ ID NO: 8402889 - DNA, 22 bp, Homo sapiens
tgagcatggtgggtgcagagca

SEQ ID NO: 8402890 - DNA, 19 bp, Homo sapiens
tgagcatgcgagctgagaa

SEQ ID NO: 8402891 - DNA, 22 bp, Homo sapiens
tgaggaaactgaggcacagatg

SEQ ID NO: 8402892 - DNA, 22 bp, Homo sapiens
tgaggaaacttacaaggcagaa

SEQ ID NO: 8402893 - DNA, 22 bp, Homo sapiens
tgaggaaaatgtcttatagatt

SEQ ID NO: 8402894 - DNA, 22 bp, Homo sapiens
tgaggaaaacgtattgaaagga

SEQ ID NO: 8402895 - DNA, 19 bp, Homo sapiens
tgagctgctgctgcccatc

SEQ ID NO: 8402896 - DNA, 23 bp, Homo sapiens
tgagctctatggaggactgaacc

SEQ ID NO: 8402897 - DNA, 22 bp, Homo sapiens
tgaggaaatatggtgaactctt

SEQ ID NO: 8402898 - DNA, 22 bp, Homo sapiens
tgaggaaatatggtgaactctt

SEQ ID NO: 8402899 - DNA, 22 bp, Homo sapiens
tgaggaaagaaaggcatgcatg

SEQ ID NO: 8402900 - DNA, 22 bp, Homo sapiens
tgaggaaattgaggctcacaga

SEQ ID NO: 8402901 - DNA, 22 bp, Homo sapiens
tgaggaaattgaggctcacaga

SEQ ID NO: 8402902 - DNA, 22 bp, Homo sapiens
tgaggatggcagtgtgctcagc

SEQ ID NO: 8402903 - DNA, 22 bp, Homo sapiens
tgaggcatggtcctgagggagc

SEQ ID NO: 8402904 - DNA, 22 bp, Homo sapiens
tgaggggagacagagtggactc

SEQ ID NO: 8402905 - DNA, 22 bp, Homo sapiens
tgaggggagaagcagcagcctg

SEQ ID NO: 8402906 - DNA, 22 bp, Homo sapiens
tgaggggaactgatgcccattg

SEQ ID NO: 8402907 - DNA, 22 bp, Homo sapiens
tgagggagtcatgattaaggaa

SEQ ID NO: 8402908 - DNA, 22 bp, Homo sapiens
tgaggggaggttggggcacatc

SEQ ID NO: 8402909 - DNA, 22 bp, Homo sapiens
tgaggggagcccgccctggacg

SEQ ID NO: 8402910 - DNA, 22 bp, Homo sapiens
tgaggggagctagcatgccttg

SEQ ID NO: 8402911 - DNA, 19 bp, Homo sapiens
tgaggggaggagaggcctg

SEQ ID NO: 8402912 - DNA, 22 bp, Homo sapiens
tgagggagagggcgaaaatgaa

SEQ ID NO: 8402913 - DNA, 22 bp, Homo sapiens
tgcaagacgtgaaattgagaca

SEQ ID NO: 8402914 - DNA, 22 bp, Homo sapiens
tgcacacacgcggcacatctgt

SEQ ID NO: 8402915 - DNA, 22 bp, Homo sapiens
tgcacacaccgtgcttcactga

SEQ ID NO: 8402916 - DNA, 22 bp, Homo sapiens
tgagttatctaaaatagtcaaa

SEQ ID NO: 8402917 - DNA, 22 bp, Homo sapiens
tgagtgggttatcaggaaaggt

SEQ ID NO: 8402918 - DNA, 22 bp, Homo sapiens
tgagtgggattaaatgaggtga

SEQ ID NO: 8402919 - DNA, 22 bp, Homo sapiens
tgagtgggatgagttagaggtg

SEQ ID NO: 8402920 - DNA, 16 bp, Homo sapiens
tgagtgggagaagggg

SEQ ID NO: 8402921 - DNA, 22 bp, Homo sapiens
tgagtgggacctgcgtgtgtca

SEQ ID NO: 8402922 - DNA, 22 bp, Homo sapiens
tgatggatgtggctctggagct

SEQ ID NO: 8402923 - DNA, 22 bp, Homo sapiens
tgatggctccttcattatgggt

SEQ ID NO: 8402924 - DNA, 22 bp, Homo sapiens
tgattctgatcatcatcatggt

SEQ ID NO: 8402925 - DNA, 22 bp, Homo sapiens
tgattcctaggcactcttctcc

SEQ ID NO: 8402926 - DNA, 21 bp, Homo sapiens
tgcacagccataccctccttg

SEQ ID NO: 8402927 - DNA, 22 bp, Homo sapiens
tgcacagctgcctcctctctgc

SEQ ID NO: 8402928 - DNA, 22 bp, Homo sapiens
tgcaccttccacaagaactacc

SEQ ID NO: 8402929 - DNA, 22 bp, Homo sapiens
tgcacatggcaatgctgctccc

SEQ ID NO: 8402930 - DNA, 22 bp, Homo sapiens
tgcagaggagctggaaggctgg

SEQ ID NO: 8402931 - DNA, 22 bp, Homo sapiens
tgcagacctcccatggctgcct

SEQ ID NO: 8402932 - DNA, 22 bp, Homo sapiens
tgcagcacctatggacacttgt

SEQ ID NO: 8402933 - DNA, 22 bp, Homo sapiens
tgcagcagcagggaggaggctc

SEQ ID NO: 8402934 - DNA, 22 bp, Homo sapiens
tgcccacacctgggggaggctg

SEQ ID NO: 8402935 - DNA, 22 bp, Homo sapiens
tgcccacagcaaagaggtagga

SEQ ID NO: 8402936 - DNA, 22 bp, Homo sapiens
tgcccacatggtgccatggcca

SEQ ID NO: 8402937 - DNA, 22 bp, Homo sapiens
tgccctgggaacacagatgcca

SEQ ID NO: 8402938 - DNA, 22 bp, Homo sapiens
tgccctcagaattgctccctgc

SEQ ID NO: 8402939 - DNA, 22 bp, Homo sapiens
tgcctggcatctagccctggga

SEQ ID NO: 8402940 - DNA, 22 bp, Homo sapiens
tgcctggcacagagcaggtggc

SEQ ID NO: 8402941 - DNA, 22 bp, Homo sapiens
tctcttctttggggtgggctca

SEQ ID NO: 8402942 - DNA, 22 bp, Homo sapiens
tctcttcttgtgttttcctgcc

SEQ ID NO: 8402943 - DNA, 22 bp, Homo sapiens
tctcttctgaaacctgtcttta

SEQ ID NO: 8402944 - DNA, 22 bp, Homo sapiens
tctcttctgacctagccttgga

SEQ ID NO: 8402945 - DNA, 20 bp, Homo sapiens
tctcttctggggagataaaa

SEQ ID NO: 8402946 - DNA, 18 bp, Homo sapiens
tctcttcttggcagtcaa

SEQ ID NO: 8402947 - DNA, 22 bp, Homo sapiens
tctcttcttgattttcactgga

SEQ ID NO: 8402948 - DNA, 22 bp, Homo sapiens
tctcttctatttgagactattt

SEQ ID NO: 8402949 - DNA, 22 bp, Homo sapiens
tctcttctctagtgagcaactg

SEQ ID NO: 8402950 - DNA, 19 bp, Homo sapiens
tctcttctccctggtttta

SEQ ID NO: 8402951 - DNA, 22 bp, Homo sapiens
tctcttctagcttcttgtggtt

SEQ ID NO: 8402952 - DNA, 22 bp, Homo sapiens
tctcttctaattagggtccatg

SEQ ID NO: 8402953 - DNA, 22 bp, Homo sapiens
tctcttctaattttcccgagta

SEQ ID NO: 8402954 - DNA, 22 bp, Homo sapiens
tctcttaatccggtgctttctg

SEQ ID NO: 8402955 - DNA, 22 bp, Homo sapiens
tctcttctaacactagaaattc

SEQ ID NO: 8402956 - DNA, 22 bp, Homo sapiens
tctcttccctttatggtatgtg

SEQ ID NO: 8402957 - DNA, 22 bp, Homo sapiens
tctctcagaaagcccatgtctg

SEQ ID NO: 8402958 - DNA, 22 bp, Homo sapiens
tctctatattatatgtagtttg

SEQ ID NO: 8402959 - DNA, 22 bp, Homo sapiens
tctctcagctttgagacctgct

SEQ ID NO: 8402960 - DNA, 22 bp, Homo sapiens
tctctctttttaatcatgtaat

SEQ ID NO: 8402961 - DNA, 21 bp, Homo sapiens
tctctgagacactctggagcc

SEQ ID NO: 8402962 - DNA, 20 bp, Homo sapiens
tctctgagcttctcttgggg

SEQ ID NO: 8402963 - DNA, 21 bp, Homo sapiens
tctctggagttagcagagaga

SEQ ID NO: 8402964 - DNA, 19 bp, Homo sapiens
tctctgcttctcttggcat

SEQ ID NO: 8402965 - DNA, 22 bp, Homo sapiens
tctctgctctgtgcctcagttt

SEQ ID NO: 8402966 - DNA, 22 bp, Homo sapiens
tctctgctctgtgcctcagttt

SEQ ID NO: 8402967 - DNA, 22 bp, Homo sapiens
tctctgctaagattgtgtctag

SEQ ID NO: 8402968 - DNA, 23 bp, Homo sapiens
tctctggaactggagagtacggt

SEQ ID NO: 8402969 - DNA, 22 bp, Homo sapiens
tctctggaattttgagagtgac

SEQ ID NO: 8402970 - DNA, 22 bp, Homo sapiens
tctctggagtataaccagggat

SEQ ID NO: 8402971 - DNA, 22 bp, Homo sapiens
tctccccagctgagctgccctt

SEQ ID NO: 8402972 - DNA, 22 bp, Homo sapiens
tctcccaggtgggtgcctggag

SEQ ID NO: 8402973 - DNA, 22 bp, Homo sapiens
tctcccagaggatcccagtgga

SEQ ID NO: 8402974 - DNA, 22 bp, Homo sapiens
tctctagtctcctttaacctga

SEQ ID NO: 8402975 - DNA, 22 bp, Homo sapiens
tctcctgtatgggactggcgag

SEQ ID NO: 8402976 - DNA, 22 bp, Homo sapiens
tctcctgtgcaccctccctgtg

SEQ ID NO: 8402977 - DNA, 22 bp, Homo sapiens
tctcctctcttacctggtacaa

SEQ ID NO: 8402978 - DNA, 22 bp, Homo sapiens
tctcatcttgttcatctaccct

SEQ ID NO: 8402979 - DNA, 19 bp, Homo sapiens
tctcacagtttccttgcct

SEQ ID NO: 8402980 - DNA, 22 bp, Homo sapiens
tctcactgggtcacagcagagg

SEQ ID NO: 8402981 - DNA, 22 bp, Homo sapiens
tctcactgatttgagaccaagg

SEQ ID NO: 8402982 - DNA, 22 bp, Homo sapiens
tctcagctcagcttccacagag

SEQ ID NO: 8402983 - DNA, 22 bp, Homo sapiens
tcctgctgggtctaactctggt

SEQ ID NO: 8402984 - DNA, 22 bp, Homo sapiens
tcctggagagaggcctggaaga

SEQ ID NO: 8402985 - DNA, 22 bp, Homo sapiens
tcctggagaagaggggcttgga

SEQ ID NO: 8402986 - DNA, 22 bp, Homo sapiens
tcctggaggcactcgctggggc

SEQ ID NO: 8402987 - DNA, 22 bp, Homo sapiens
tcctggagccaatgtgctgctg

SEQ ID NO: 8402988 - DNA, 22 bp, Homo sapiens
tcctggagggctcacaggcggc

SEQ ID NO: 8402989 - DNA, 22 bp, Homo sapiens
tcctggagggaggcggtgctac

SEQ ID NO: 8402990 - DNA, 22 bp, Homo sapiens
tcctggaggggacagcatgggc

SEQ ID NO: 8402991 - DNA, 22 bp, Homo sapiens
tcctggagtttgtggtgatatg

SEQ ID NO: 8402992 - DNA, 22 bp, Homo sapiens
tcctggagttgtctgtactcat

SEQ ID NO: 8402993 - DNA, 19 bp, Homo sapiens
tcctggcacagtggaacca

SEQ ID NO: 8402994 - DNA, 22 bp, Homo sapiens
tcctggatttaaccctggctct

SEQ ID NO: 8402995 - DNA, 22 bp, Homo sapiens
tcctggatttagaagagcctcc

SEQ ID NO: 8402996 - DNA, 17 bp, Homo sapiens
tcctggatccatggtgg

SEQ ID NO: 8402997 - DNA, 22 bp, Homo sapiens
tcctggattctgccctgaaggc

SEQ ID NO: 8402998 - DNA, 22 bp, Homo sapiens
tcctggattaatagggagctgt

SEQ ID NO: 8402999 - DNA, 22 bp, Homo sapiens
tcctggatggagctgccctcgc

SEQ ID NO: 8403000 - DNA, 18 bp, Homo sapiens
tcctggccacactacctt

SEQ ID NO: 8403001 - DNA, 22 bp, Homo sapiens
tcctggccaggatgacctaaca

SEQ ID NO: 8403002 - DNA, 21 bp, Homo sapiens
tcctggccagggcactaggca

SEQ ID NO: 8403003 - DNA, 22 bp, Homo sapiens
tcctggcattgtgcagggtgtg

SEQ ID NO: 8403004 - DNA, 20 bp, Homo sapiens
tcctggcctccctggggctc

SEQ ID NO: 8403005 - DNA, 22 bp, Homo sapiens
tcctggcctctgagtcaagaac

SEQ ID NO: 8403006 - DNA, 22 bp, Homo sapiens
tcctggctcggcttggggactt

SEQ ID NO: 8403007 - DNA, 22 bp, Homo sapiens
tcctggctcctggagacctgct

SEQ ID NO: 8403008 - DNA, 22 bp, Homo sapiens
tcctggccctgtggcctgcagt

SEQ ID NO: 8403009 - DNA, 22 bp, Homo sapiens
tcctggcccggccgggcctgct

SEQ ID NO: 8403010 - DNA, 22 bp, Homo sapiens
tcctgggtagcctgtccaagat

SEQ ID NO: 8403011 - DNA, 18 bp, Homo sapiens
tcctggtattgcaagcac

SEQ ID NO: 8403012 - DNA, 22 bp, Homo sapiens
tcctggtggctctttgggaagg

SEQ ID NO: 8403013 - DNA, 22 bp, Homo sapiens
tcctgggtcctgggaagccctg

SEQ ID NO: 8403014 - DNA, 22 bp, Homo sapiens
tcctgggtctgggtgtctgagg

SEQ ID NO: 8403015 - DNA, 22 bp, Homo sapiens
tcctggggctgcaaggcctgtc

SEQ ID NO: 8403016 - DNA, 22 bp, Homo sapiens
tcctgtcagtgaggcagatgaa

SEQ ID NO: 8403017 - DNA, 22 bp, Homo sapiens
tcctgtctaaagacctgcaggc

SEQ ID NO: 8403018 - DNA, 22 bp, Homo sapiens
tcctggtttatagactgatggc

SEQ ID NO: 8403019 - DNA, 18 bp, Homo sapiens
tcctggttctgtggccac

SEQ ID NO: 8403020 - DNA, 22 bp, Homo sapiens
tcctggtgggacagaaaacctc

SEQ ID NO: 8403021 - DNA, 22 bp, Homo sapiens
tcctggtgtaatggtaagcatg

SEQ ID NO: 8403022 - DNA, 22 bp, Homo sapiens
tcctgtggggaaaagcctatct

SEQ ID NO: 8403023 - DNA, 22 bp, Homo sapiens
tcctgtggcttccacgacctaa

SEQ ID NO: 8403024 - DNA, 22 bp, Homo sapiens
tcctgtctgtctttggtccctt

SEQ ID NO: 8403025 - DNA, 22 bp, Homo sapiens
tcctgggaagtggctggctgag

SEQ ID NO: 8403026 - DNA, 22 bp, Homo sapiens
tcctgggaagagacctgagcat

SEQ ID NO: 8403027 - DNA, 22 bp, Homo sapiens
tcctgggaagcgccggcctgcg

SEQ ID NO: 8403028 - DNA, 22 bp, Homo sapiens
tcctgggaggctgtgcctggct

SEQ ID NO: 8403029 - DNA, 22 bp, Homo sapiens
tcctgggaggcaggaccccttt

SEQ ID NO: 8403030 - DNA, 22 bp, Homo sapiens
tcctgggactctgcctcaggct

SEQ ID NO: 8403031 - DNA, 18 bp, Homo sapiens
tcctgggaaaggcataca

SEQ ID NO: 8403032 - DNA, 22 bp, Homo sapiens
tcctggctgcaccagtgaccct

SEQ ID NO: 8403033 - DNA, 22 bp, Homo sapiens
tcctgggattaaggtggtgatt

SEQ ID NO: 8403034 - DNA, 21 bp, Homo sapiens
tcctgggagtctgagatcctg

SEQ ID NO: 8403035 - DNA, 22 bp, Homo sapiens
tcctgggagtaattgagtcatg

SEQ ID NO: 8403036 - DNA, 22 bp, Homo sapiens
tcctgggatcaagtgatcctcc

SEQ ID NO: 8403037 - DNA, 22 bp, Homo sapiens
tctattcaggcagagtgcagca

SEQ ID NO: 8403038 - DNA, 22 bp, Homo sapiens
tctcacacttctgtgttgcaca

SEQ ID NO: 8403039 - DNA, 22 bp, Homo sapiens
tctacaggtggggcctggcaat

SEQ ID NO: 8403040 - DNA, 22 bp, Homo sapiens
tctaccactttgacctctctgt

SEQ ID NO: 8403041 - DNA, 22 bp, Homo sapiens
tcgcaccattgcactccagcca

SEQ ID NO: 8403042 - DNA, 19 bp, Homo sapiens
tcgagtcaagacactaggc

SEQ ID NO: 8403043 - DNA, 22 bp, Homo sapiens
tcgagctgggcaagcttccata

SEQ ID NO: 8403044 - DNA, 19 bp, Homo sapiens
tccttctccggccaccccg

SEQ ID NO: 8403045 - DNA, 22 bp, Homo sapiens
tccttcctggggtctctgctgc

SEQ ID NO: 8403046 - DNA, 22 bp, Homo sapiens
tccttggagtcatgatggaggt

SEQ ID NO: 8403047 - DNA, 22 bp, Homo sapiens
tccttggaggtcaacgggacgg

SEQ ID NO: 8403048 - DNA, 22 bp, Homo sapiens
tccttggagcccaggagtagca

SEQ ID NO: 8403049 - DNA, 22 bp, Homo sapiens
tccttgaggaggtgacactgga

SEQ ID NO: 8403050 - DNA, 22 bp, Homo sapiens
tccttgagccgtggccagggcc

SEQ ID NO: 8403051 - DNA, 22 bp, Homo sapiens
tccttgagaggacagagccata

SEQ ID NO: 8403052 - DNA, 22 bp, Homo sapiens
tccttcaccttagccctcctag

SEQ ID NO: 8403053 - DNA, 22 bp, Homo sapiens
tccttcaagtgcagtacctgag

SEQ ID NO: 8403054 - DNA, 22 bp, Homo sapiens
tccttcaagatgccacagcttt

SEQ ID NO: 8403055 - DNA, 22 bp, Homo sapiens
tccttcaactttttacttgccc

SEQ ID NO: 8403056 - DNA, 22 bp, Homo sapiens
tccttaggcaatttgggagagt

SEQ ID NO: 8403057 - DNA, 22 bp, Homo sapiens
tcttatttgcaactggctcaga

SEQ ID NO: 8403058 - DNA, 20 bp, Homo sapiens
tcttctgttgccttgttctg

SEQ ID NO: 8403059 - DNA, 22 bp, Homo sapiens
tcttctccagttcatcctacca

SEQ ID NO: 8403060 - DNA, 22 bp, Homo sapiens
tcttctccagtgcttctgcaca

SEQ ID NO: 8403061 - DNA, 22 bp, Homo sapiens
tcttctcccatctccaggcagg

SEQ ID NO: 8403062 - DNA, 22 bp, Homo sapiens
tcttctcccatcggccgcaggg

SEQ ID NO: 8403063 - DNA, 22 bp, Homo sapiens
tcttctcccagggtcgcccaag

SEQ ID NO: 8403064 - DNA, 22 bp, Homo sapiens
tcttctccataatcaacactct

SEQ ID NO: 8403065 - DNA, 22 bp, Homo sapiens
tcttctgtgatctatgtgtttt

SEQ ID NO: 8403066 - DNA, 22 bp, Homo sapiens
tcttctgtgagaattcaagcaa

SEQ ID NO: 8403067 - DNA, 22 bp, Homo sapiens
tcttctcctttgccatgtgttt

SEQ ID NO: 8403068 - DNA, 22 bp, Homo sapiens
tcttcctgtcaatgagaattaa

SEQ ID NO: 8403069 - DNA, 21 bp, Homo sapiens
tcttcctgctccacactcccc

SEQ ID NO: 8403070 - DNA, 22 bp, Homo sapiens
tcttcctccctacagagctcag

SEQ ID NO: 8403071 - DNA, 23 bp, Homo sapiens
tcttcctgaactatcaggcacat

SEQ ID NO: 8403072 - DNA, 22 bp, Homo sapiens
tctttacatcacaattgtatgg

SEQ ID NO: 8403073 - DNA, 22 bp, Homo sapiens
tctgtttctccaacattgtgag

SEQ ID NO: 8403074 - DNA, 22 bp, Homo sapiens
tctgtttcctcttgtgtaaagt

SEQ ID NO: 8403075 - DNA, 22 bp, Homo sapiens
tctgggttgggttcctggaatt

SEQ ID NO: 8403076 - DNA, 22 bp, Homo sapiens
tctgggttcttcgattcttccc

SEQ ID NO: 8403077 - DNA, 23 bp, Homo sapiens
tctgggttctaatcatgtgtgat

SEQ ID NO: 8403078 - DNA, 22 bp, Homo sapiens
tctgggttattatgatggctac

SEQ ID NO: 8403079 - DNA, 22 bp, Homo sapiens
tctgggttcaaggggagtctgc

SEQ ID NO: 8403080 - DNA, 20 bp, Homo sapiens
tctgggttgaaatcaagatc

SEQ ID NO: 8403081 - DNA, 22 bp, Homo sapiens
tctgggttcttgatgctacctt

SEQ ID NO: 8403082 - DNA, 22 bp, Homo sapiens
tctgggttgaattggataaaca

SEQ ID NO: 8403083 - DNA, 22 bp, Homo sapiens
tctgggttgggagaaaagaggg

SEQ ID NO: 8403084 - DNA, 22 bp, Homo sapiens
tctgggcttggttagggctgtt

SEQ ID NO: 8403085 - DNA, 22 bp, Homo sapiens
tctgggctttgtaatgggaggt

SEQ ID NO: 8403086 - DNA, 22 bp, Homo sapiens
tctgtctcctgccagtgcctct

SEQ ID NO: 8403087 - DNA, 22 bp, Homo sapiens
tctgtctcctcagatgactcca

SEQ ID NO: 8403088 - DNA, 22 bp, Homo sapiens
tctgtctcctctgaggtgccag

SEQ ID NO: 8403089 - DNA, 22 bp, Homo sapiens
tctgtctcaagttcttgcactc

SEQ ID NO: 8403090 - DNA, 22 bp, Homo sapiens
tctgtcacccaggctggagtgc

SEQ ID NO: 8403091 - DNA, 22 bp, Homo sapiens
tctgccctggggtcagcctcca

SEQ ID NO: 8403092 - DNA, 22 bp, Homo sapiens
tctgcctggctcatggcagtga

SEQ ID NO: 8403093 - DNA, 22 bp, Homo sapiens
tctgctcaggttacctagctag

SEQ ID NO: 8403094 - DNA, 22 bp, Homo sapiens
tctgctcagggagggtcactac

SEQ ID NO: 8403095 - DNA, 22 bp, Homo sapiens
tctgctcagccgatctgctccg

SEQ ID NO: 8403096 - DNA, 20 bp, Homo sapiens
tctgctcagccctcagtggc

SEQ ID NO: 8403097 - DNA, 22 bp, Homo sapiens
tctgctcagcatccctctgaga

SEQ ID NO: 8403098 - DNA, 22 bp, Homo sapiens
tctgaggaatcttgacacattt

SEQ ID NO: 8403099 - DNA, 17 bp, Homo sapiens
tctggatgtcatggaag

SEQ ID NO: 8403100 - DNA, 22 bp, Homo sapiens
tctggcacactaggtctcaggt

SEQ ID NO: 8403101 - DNA, 22 bp, Homo sapiens
tctggcatctgttttcatattt

SEQ ID NO: 8403102 - DNA, 22 bp, Homo sapiens
tctgctgaacttgctgcccaga

SEQ ID NO: 8403103 - DNA, 22 bp, Homo sapiens
tctgctgtgtccctggtctcct

SEQ ID NO: 8403104 - DNA, 22 bp, Homo sapiens
tctgctgttcattcttttagct

SEQ ID NO: 8403105 - DNA, 22 bp, Homo sapiens
tctgctgtgtccctggtctcct

SEQ ID NO: 8403106 - DNA, 22 bp, Homo sapiens
tctgctgtgaaaggtgaatatt

SEQ ID NO: 8403107 - DNA, 22 bp, Homo sapiens
tctgctgtgattctactagtgt

SEQ ID NO: 8403108 - DNA, 22 bp, Homo sapiens
tctgctgtgatttgctacctgt

SEQ ID NO: 8403109 - DNA, 22 bp, Homo sapiens
tctgctgtacttttggtctgtt

SEQ ID NO: 8403110 - DNA, 22 bp, Homo sapiens
tctgctgtctgattcccacttc

SEQ ID NO: 8403111 - DNA, 22 bp, Homo sapiens
tctgctgtctgattcccacttc

SEQ ID NO: 8403112 - DNA, 23 bp, Homo sapiens
tctgggctgagctcgagtgtaga

SEQ ID NO: 8403113 - DNA, 22 bp, Homo sapiens
tctgggctgctatgaggcagag

SEQ ID NO: 8403114 - DNA, 20 bp, Homo sapiens
tctgggcagggcacatggaa

SEQ ID NO: 8403115 - DNA, 22 bp, Homo sapiens
tctgggcagaagcagtgcaaag

SEQ ID NO: 8403116 - DNA, 22 bp, Homo sapiens
tctgggagtttctgtgggagct

SEQ ID NO: 8403117 - DNA, 22 bp, Homo sapiens
tctgggatgagatcagagacac

SEQ ID NO: 8403118 - DNA, 22 bp, Homo sapiens
tctgggaggtactgggaggtgt

SEQ ID NO: 8403119 - DNA, 22 bp, Homo sapiens
tctgggaggggctgccattgct

SEQ ID NO: 8403120 - DNA, 22 bp, Homo sapiens
tctgggagagcacgtggctgac

SEQ ID NO: 8403121 - DNA, 22 bp, Homo sapiens
tctggcttttatgggatgagag

SEQ ID NO: 8403122 - DNA, 19 bp, Homo sapiens
tctggctcctgccaggctg

SEQ ID NO: 8403123 - DNA, 22 bp, Homo sapiens
tctggctctcatactcgccagt

SEQ ID NO: 8403124 - DNA, 22 bp, Homo sapiens
tctggctctataactcctagct

SEQ ID NO: 8403125 - DNA, 23 bp, Homo sapiens
tctggctctatgtgacagctctc

SEQ ID NO: 8403126 - DNA, 22 bp, Homo sapiens
tctggctctctcatcacccaat

SEQ ID NO: 8403127 - DNA, 22 bp, Homo sapiens
tctggctctgtgtcctcaccca

SEQ ID NO: 8403128 - DNA, 22 bp, Homo sapiens
tctggctctgtgtccccaccca

SEQ ID NO: 8403129 - DNA, 22 bp, Homo sapiens
tctggctctggagtccacctgc

SEQ ID NO: 8403130 - DNA, 22 bp, Homo sapiens
tctggctcctgagtccatgctc

SEQ ID NO: 8403131 - DNA, 22 bp, Homo sapiens
tctggctccgtgtccgctccca

SEQ ID NO: 8403132 - DNA, 22 bp, Homo sapiens
tctggctcccagcctgctctca

SEQ ID NO: 8403133 - DNA, 22 bp, Homo sapiens
acccagagtcatggcacttagc

SEQ ID NO: 8403134 - DNA, 22 bp, Homo sapiens
acccagagtgtctgtctcagtc

SEQ ID NO: 8403135 - DNA, 22 bp, Homo sapiens
acattttacaccaagacttctt

SEQ ID NO: 8403136 - DNA, 22 bp, Homo sapiens
acattgttcctgagaacttggg

SEQ ID NO: 8403137 - DNA, 22 bp, Homo sapiens
aaggctcaattaactaagaagt

SEQ ID NO: 8403138 - DNA, 22 bp, Homo sapiens
aaggctcaaagaagctaagtga

SEQ ID NO: 8403139 - DNA, 22 bp, Homo sapiens
aaggctcagctactcagcctgc

SEQ ID NO: 8403140 - DNA, 22 bp, Homo sapiens
acatttcatttgcagtatggat

SEQ ID NO: 8403141 - DNA, 19 bp, Homo sapiens
aaggctggagaaggcctct

SEQ ID NO: 8403142 - DNA, 22 bp, Homo sapiens
acattgtttgagaatacagatg

SEQ ID NO: 8403143 - DNA, 22 bp, Homo sapiens
aaggaggaataaagaggtggtg

SEQ ID NO: 8403144 - DNA, 22 bp, Homo sapiens
aaggcagagggctggatcagag

SEQ ID NO: 8403145 - DNA, 22 bp, Homo sapiens
aagcgccatggttcctgcgcag

SEQ ID NO: 8403146 - DNA, 22 bp, Homo sapiens
actgaggtctatcatgagccag

SEQ ID NO: 8403147 - DNA, 22 bp, Homo sapiens
actgcactccagcctcggggtc

SEQ ID NO: 8403148 - DNA, 22 bp, Homo sapiens
actgagtggctggggagtggca

SEQ ID NO: 8403149 - DNA, 22 bp, Homo sapiens
acgggtggctgaggaggcctct

SEQ ID NO: 8403150 - DNA, 22 bp, Homo sapiens
acgggtggctgaggaggcctct

SEQ ID NO: 8403151 - DNA, 23 bp, Homo sapiens
actttattgaccccaggtcagtt

SEQ ID NO: 8403152 - DNA, 22 bp, Homo sapiens
aatgatgacaggataaagaaca

SEQ ID NO: 8403153 - DNA, 22 bp, Homo sapiens
agcagctgggtccggcggagca

SEQ ID NO: 8403154 - DNA, 22 bp, Homo sapiens
agcagagtgtgaaggcagggct

SEQ ID NO: 8403155 - DNA, 22 bp, Homo sapiens
acactttagaaaaaagaatggt

SEQ ID NO: 8403156 - DNA, 22 bp, Homo sapiens
acactagctattaacttcacat

SEQ ID NO: 8403157 - DNA, 22 bp, Homo sapiens
acacagggcaatgctttgacct

SEQ ID NO: 8403158 - DNA, 22 bp, Homo sapiens
acacagggaggaggtgctgtgc

SEQ ID NO: 8403159 - DNA, 22 bp, Homo sapiens
acagaaaaatgagggagctgga

SEQ ID NO: 8403160 - DNA, 22 bp, Homo sapiens
agccagggtctctcgctctgtt

SEQ ID NO: 8403161 - DNA, 19 bp, Homo sapiens
agccagggtccagacatgt

SEQ ID NO: 8403162 - DNA, 22 bp, Homo sapiens
agaggctctggtgggagttggt

SEQ ID NO: 8403163 - DNA, 18 bp, Homo sapiens
agaggctcgatactagaa

SEQ ID NO: 8403164 - DNA, 22 bp, Homo sapiens
acaaccatcgtctttgcagcca

SEQ ID NO: 8403165 - DNA, 22 bp, Homo sapiens
acaaccatgtcagttcaaacca

SEQ ID NO: 8403166 - DNA, 22 bp, Homo sapiens
agagccaggctcccatggggca

SEQ ID NO: 8403167 - DNA, 22 bp, Homo sapiens
agagccagttacaactgtggag

SEQ ID NO: 8403168 - DNA, 22 bp, Homo sapiens
agagcaggtggcaactctggga

SEQ ID NO: 8403169 - DNA, 23 bp, Homo sapiens
agaagcagcttctggagtatcgg

SEQ ID NO: 8403170 - DNA, 22 bp, Homo sapiens
aatggcagaggcaaagatggta

SEQ ID NO: 8403171 - DNA, 19 bp, Homo sapiens
aatggcagatgccatatct

SEQ ID NO: 8403172 - DNA, 22 bp, Homo sapiens
aatggcagtagttgcatgagag

SEQ ID NO: 8403173 - DNA, 22 bp, Homo sapiens
aatgggcacacttagagagtaa

SEQ ID NO: 8403174 - DNA, 22 bp, Homo sapiens
aatggaggtgtctggcctggta

SEQ ID NO: 8403175 - DNA, 22 bp, Homo sapiens
aatggcactttataaatgttaa

SEQ ID NO: 8403176 - DNA, 20 bp, Homo sapiens
aatgggctttgatgagtgtg

SEQ ID NO: 8403177 - DNA, 22 bp, Homo sapiens
aatgggcatttgtttgtggtac

SEQ ID NO: 8403178 - DNA, 22 bp, Homo sapiens
aatgggcatttggggttgagaa

SEQ ID NO: 8403179 - DNA, 22 bp, Homo sapiens
aatgggctgaatttcatgaaat

SEQ ID NO: 8403180 - DNA, 22 bp, Homo sapiens
aatggtatcacctcacagaatt

SEQ ID NO: 8403181 - DNA, 22 bp, Homo sapiens
aatggtttcaaacacactaagt

SEQ ID NO: 8403182 - DNA, 23 bp, Homo sapiens
aatggtcttcctccacccctctg

SEQ ID NO: 8403183 - DNA, 22 bp, Homo sapiens
aatgtggatccttacagatacc

SEQ ID NO: 8403184 - DNA, 17 bp, Homo sapiens
aatgtggaagtacatgc

SEQ ID NO: 8403185 - DNA, 22 bp, Homo sapiens
aatgtgcttctggctgtggtca

SEQ ID NO: 8403186 - DNA, 22 bp, Homo sapiens
aagcaggagatgcaggaatgta

SEQ ID NO: 8403187 - DNA, 22 bp, Homo sapiens
aaagtaagatttgcatttcaga

SEQ ID NO: 8403188 - DNA, 22 bp, Homo sapiens
aaagtaagggttaatctacttt

SEQ ID NO: 8403189 - DNA, 22 bp, Homo sapiens
aactgtagaagggacacaaaag

SEQ ID NO: 8403190 - DNA, 22 bp, Homo sapiens
aacccattaatccttgcaagca

SEQ ID NO: 8403191 - DNA, 19 bp, Homo sapiens
aaaggcagtgggtggcgtg

SEQ ID NO: 8403192 - DNA, 22 bp, Homo sapiens
aaaggcagtgggtatgtggatc

SEQ ID NO: 8403193 - DNA, 22 bp, Homo sapiens
aaaactgcccagtcagtaagca

SEQ ID NO: 8403194 - DNA, 22 bp, Homo sapiens
aaaaatacttcacttctgggtg

SEQ ID NO: 8403195 - DNA, 22 bp, Homo sapiens
aaaaccaggcttgctgtgctcg

SEQ ID NO: 8403196 - DNA, 22 bp, Homo sapiens
aaaactctgcagttagtttcta

SEQ ID NO: 8403197 - DNA, 22 bp, Homo sapiens
aaacatctcaaagaggtatttg

SEQ ID NO: 8403198 - DNA, 22 bp, Homo sapiens
aaacattgctaaataatgctgc

SEQ ID NO: 8403199 - DNA, 22 bp, Homo sapiens
aaacatgtaagttcagatcacc

SEQ ID NO: 8403200 - DNA, 22 bp, Homo sapiens
aaagactgggactgcagcaggc

SEQ ID NO: 8403201 - DNA, 22 bp, Homo sapiens
aagatgcttgagaactgtttga

SEQ ID NO: 8403202 - DNA, 22 bp, Homo sapiens
aagactttctggggtgtaaagg

SEQ ID NO: 8403203 - DNA, 22 bp, Homo sapiens
aagactttctgtaaagctacag

SEQ ID NO: 8403204 - DNA, 22 bp, Homo sapiens
aagactttcaagtatgcatgca

SEQ ID NO: 8403205 - DNA, 22 bp, Homo sapiens
aagactttcaaacctatgtttg

SEQ ID NO: 8403206 - DNA, 22 bp, Homo sapiens
aagagatttctgtaaaatgtaa

SEQ ID NO: 8403207 - DNA, 22 bp, Homo sapiens
acaatgtttctctttagtcatt

SEQ ID NO: 8403208 - DNA, 22 bp, Homo sapiens
aactggaatagcacaggaaaag

SEQ ID NO: 8403209 - DNA, 22 bp, Homo sapiens
aactgggcccagtctgagttgg

SEQ ID NO: 8403210 - DNA, 22 bp, Homo sapiens
aacactttgttgcctatgaacg

SEQ ID NO: 8403211 - DNA, 22 bp, Homo sapiens
aacacaggcatactggctccag

SEQ ID NO: 8403212 - DNA, 22 bp, Homo sapiens
aacagctgtctgcctatctctg

SEQ ID NO: 8403213 - DNA, 22 bp, Homo sapiens
aacagctattcactactatggg

SEQ ID NO: 8403214 - DNA, 22 bp, Homo sapiens
aacagcctgagagaacaatgat

SEQ ID NO: 8403215 - DNA, 22 bp, Homo sapiens
aacatgtaaccagcattcatct

SEQ ID NO: 8403216 - DNA, 22 bp, Homo sapiens
acaggctgctgggctccgtgct

SEQ ID NO: 8403217 - DNA, 22 bp, Homo sapiens
acaggctggtggtcctggccat

SEQ ID NO: 8403218 - DNA, 22 bp, Homo sapiens
acaggctggtggtcctggccat

SEQ ID NO: 8403219 - DNA, 22 bp, Homo sapiens
aggaatgacttgtagctctgag

SEQ ID NO: 8403220 - DNA, 22 bp, Homo sapiens
acaggctgtacttctaatcatc

SEQ ID NO: 8403221 - DNA, 22 bp, Homo sapiens
aggaatgtcatagaataatcat

SEQ ID NO: 8403222 - DNA, 22 bp, Homo sapiens
aggaatgtcaagtagatgtgcg

SEQ ID NO: 8403223 - DNA, 22 bp, Homo sapiens
aggaatgtattgacctgttgca

SEQ ID NO: 8403224 - DNA, 22 bp, Homo sapiens
aggaatgtattattccttctgg

SEQ ID NO: 8403225 - DNA, 22 bp, Homo sapiens
aggaatgtagtttgagtagaaa

SEQ ID NO: 8403226 - DNA, 22 bp, Homo sapiens
aggaatgtaatagtgtggctca

SEQ ID NO: 8403227 - DNA, 22 bp, Homo sapiens
aggaatgtaacaggagtaaaaa

SEQ ID NO: 8403228 - DNA, 22 bp, Homo sapiens
aggaatgtaaatctagatttta

SEQ ID NO: 8403229 - DNA, 21 bp, Homo sapiens
aggaatgctgaggctcacttt

SEQ ID NO: 8403230 - DNA, 22 bp, Homo sapiens
aggaatggtgctcagcagaaat

SEQ ID NO: 8403231 - DNA, 22 bp, Homo sapiens
agctggggctgcagagaacagg

SEQ ID NO: 8403232 - DNA, 22 bp, Homo sapiens
agctggggctgcagagaacagg

SEQ ID NO: 8403233 - DNA, 22 bp, Homo sapiens
agctggggttgcacacattttg

SEQ ID NO: 8403234 - DNA, 22 bp, Homo sapiens
agctgggggttggataagggta

SEQ ID NO: 8403235 - DNA, 22 bp, Homo sapiens
acagccttgtagcatcttagcc

SEQ ID NO: 8403236 - DNA, 21 bp, Homo sapiens
acagctaagcaacaactactg

SEQ ID NO: 8403237 - DNA, 22 bp, Homo sapiens
agctgcaggcccatgctcagtc

SEQ ID NO: 8403238 - DNA, 22 bp, Homo sapiens
acagtacaagcaatgcattttt

SEQ ID NO: 8403239 - DNA, 22 bp, Homo sapiens
aggagggtgatccgggctggtc

SEQ ID NO: 8403240 - DNA, 22 bp, Homo sapiens
aggagtgcaaatagtccagaga

SEQ ID NO: 8403241 - DNA, 22 bp, Homo sapiens
aggagtgctgcaagttgacaga

SEQ ID NO: 8403242 - DNA, 20 bp, Homo sapiens
aggagtccctgtgctctctc

SEQ ID NO: 8403243 - DNA, 22 bp, Homo sapiens
aggagctggagtccaggcaagt

SEQ ID NO: 8403244 - DNA, 22 bp, Homo sapiens
acagttcaagtcttagacaaca

SEQ ID NO: 8403245 - DNA, 22 bp, Homo sapiens
aggcaggattgctgacaacaat

SEQ ID NO: 8403246 - DNA, 22 bp, Homo sapiens
aggcagcatgggcccagagtcc

SEQ ID NO: 8403247 - DNA, 22 bp, Homo sapiens
aggcagcatgggccccagctcc

SEQ ID NO: 8403248 - DNA, 22 bp, Homo sapiens
agggacagatgaatgactgagt

SEQ ID NO: 8403249 - DNA, 17 bp, Homo sapiens
agggacagcagtttagg

SEQ ID NO: 8403250 - DNA, 22 bp, Homo sapiens
agggacagtatccatctcacag

SEQ ID NO: 8403251 - DNA, 22 bp, Homo sapiens
agggagccttcctggctgtggt

SEQ ID NO: 8403252 - DNA, 22 bp, Homo sapiens
aggctggcaaggcagatgtgtg

SEQ ID NO: 8403253 - DNA, 22 bp, Homo sapiens
agggaagagcttgcaagaaacc

SEQ ID NO: 8403254 - DNA, 22 bp, Homo sapiens
agggaagaggaccagagtctct

SEQ ID NO: 8403255 - DNA, 22 bp, Homo sapiens
agggaagaatcactgggatgtt

SEQ ID NO: 8403256 - DNA, 22 bp, Homo sapiens
aggctggcagccacctcagcag

SEQ ID NO: 8403257 - DNA, 22 bp, Homo sapiens
agggcatctagttccctctctt

SEQ ID NO: 8403258 - DNA, 22 bp, Homo sapiens
accctcagagtaggcactgctg

SEQ ID NO: 8403259 - DNA, 19 bp, Homo sapiens
acatttagaatgtacttgc

SEQ ID NO: 8403260 - DNA, 22 bp, Homo sapiens
acatttagatggtgttatagta

SEQ ID NO: 8403261 - DNA, 22 bp, Homo sapiens
acatttacctagttaagtcaat

SEQ ID NO: 8403262 - DNA, 22 bp, Homo sapiens
acatttacttatcaaaagtcag

SEQ ID NO: 8403263 - DNA, 22 bp, Homo sapiens
acatttaccctggaacattgga

SEQ ID NO: 8403264 - DNA, 22 bp, Homo sapiens
acatttacagtgctagacaatc

SEQ ID NO: 8403265 - DNA, 22 bp, Homo sapiens
acatttaatgatcctactgtga

SEQ ID NO: 8403266 - DNA, 22 bp, Homo sapiens
aggctagctgtttcagggctag

SEQ ID NO: 8403267 - DNA, 22 bp, Homo sapiens
aggcagggctgggattagactc

SEQ ID NO: 8403268 - DNA, 22 bp, Homo sapiens
acctggacacctgctgtcatct

SEQ ID NO: 8403269 - DNA, 22 bp, Homo sapiens
agggcttgacaagggctggagc

SEQ ID NO: 8403270 - DNA, 20 bp, Homo sapiens
agggtggggacgttctgact

SEQ ID NO: 8403271 - DNA, 20 bp, Homo sapiens
agggtggggacgttctgact

SEQ ID NO: 8403272 - DNA, 22 bp, Homo sapiens
actaaactgaagcatgaaaagg

SEQ ID NO: 8403273 - DNA, 22 bp, Homo sapiens
actaaactgcacagatgggtca

SEQ ID NO: 8403274 - DNA, 22 bp, Homo sapiens
actaaactgttcatcagcatct

SEQ ID NO: 8403275 - DNA, 22 bp, Homo sapiens
actggcagaacgtgatgcgggt

SEQ ID NO: 8403276 - DNA, 22 bp, Homo sapiens
actgaataatggtctgtgatct

SEQ ID NO: 8403277 - DNA, 22 bp, Homo sapiens
actgcaacctccgcctgccagg

SEQ ID NO: 8403278 - DNA, 22 bp, Homo sapiens
actgcaacacctcctgggttca

SEQ ID NO: 8403279 - DNA, 22 bp, Homo sapiens
actgcaacctccacctcctggg

SEQ ID NO: 8403280 - DNA, 22 bp, Homo sapiens
actccagacacagacactatga

SEQ ID NO: 8403281 - DNA, 22 bp, Homo sapiens
agaaacatcttggcaactggaa

SEQ ID NO: 8403282 - DNA, 22 bp, Homo sapiens
atcagagtgggtctggcatgag

SEQ ID NO: 8403283 - DNA, 22 bp, Homo sapiens
atcacccaagctggagtgcagt

SEQ ID NO: 8403284 - DNA, 22 bp, Homo sapiens
atcacccaggctggagtgcagt

SEQ ID NO: 8403285 - DNA, 22 bp, Homo sapiens
atcatttccctttagatcacaa

SEQ ID NO: 8403286 - DNA, 21 bp, Homo sapiens
acttggccaggcccccacctg

SEQ ID NO: 8403287 - DNA, 22 bp, Homo sapiens
acttggccttatttccacagaa

SEQ ID NO: 8403288 - DNA, 22 bp, Homo sapiens
actggcaggctgctggccggcg

SEQ ID NO: 8403289 - DNA, 22 bp, Homo sapiens
actggcagctgtaggatgcatg

SEQ ID NO: 8403290 - DNA, 22 bp, Homo sapiens
cacagggcagtgctgcccactc

SEQ ID NO: 8403291 - DNA, 19 bp, Homo sapiens
cacagggcaggtctcatgt

SEQ ID NO: 8403292 - DNA, 22 bp, Homo sapiens
agcagctgggctcagagctggg

SEQ ID NO: 8403293 - DNA, 22 bp, Homo sapiens
agcagctgtttgttgaattggt

SEQ ID NO: 8403294 - DNA, 22 bp, Homo sapiens
caccagggccccaggctgtgcc

SEQ ID NO: 8403295 - DNA, 22 bp, Homo sapiens
agcagggctcacattagtggat

SEQ ID NO: 8403296 - DNA, 22 bp, Homo sapiens
cagcaggagcagtcagactcct

SEQ ID NO: 8403297 - DNA, 22 bp, Homo sapiens
agcctccacagatgcaaagggc

SEQ ID NO: 8403298 - DNA, 22 bp, Homo sapiens
cagcagcaggcgcacggccgtc

SEQ ID NO: 8403299 - DNA, 22 bp, Homo sapiens
cagcagcagccccaggaaggtt

SEQ ID NO: 8403300 - DNA, 22 bp, Homo sapiens
cagcagaggttttgctccatga

SEQ ID NO: 8403301 - DNA, 22 bp, Homo sapiens
cagcagcatgaattcgagccac

SEQ ID NO: 8403302 - DNA, 22 bp, Homo sapiens
agcctcagcacgcagctctgtg

SEQ ID NO: 8403303 - DNA, 22 bp, Homo sapiens
cagaggctaagatgagtgggtg

SEQ ID NO: 8403304 - DNA, 19 bp, Homo sapiens
agcccccagacagcaggcc

SEQ ID NO: 8403305 - DNA, 22 bp, Homo sapiens
agcccaggagcctttggagggt

SEQ ID NO: 8403306 - DNA, 22 bp, Homo sapiens
agcccagctttgaaccatatca

SEQ ID NO: 8403307 - DNA, 22 bp, Homo sapiens
agccagggttagaagatagtca

SEQ ID NO: 8403308 - DNA, 22 bp, Homo sapiens
cagagagggagcagtagtctct

SEQ ID NO: 8403309 - DNA, 22 bp, Homo sapiens
agccacagagcaggagaccttt

SEQ ID NO: 8403310 - DNA, 22 bp, Homo sapiens
agccacagagagggagctgcaa

SEQ ID NO: 8403311 - DNA, 22 bp, Homo sapiens
agccacacagcttaatgacaga

SEQ ID NO: 8403312 - DNA, 22 bp, Homo sapiens
cagaagcctaaatagtgcacca

SEQ ID NO: 8403313 - DNA, 22 bp, Homo sapiens
agccaggatggtctcgatcggc

SEQ ID NO: 8403314 - DNA, 22 bp, Homo sapiens
agccaggacgttgctcagctcc

SEQ ID NO: 8403315 - DNA, 22 bp, Homo sapiens
agagggtgagcaggtacacatg

SEQ ID NO: 8403316 - DNA, 22 bp, Homo sapiens
attcacagagtggttagtggta

SEQ ID NO: 8403317 - DNA, 22 bp, Homo sapiens
attatacattttgtgtagagat

SEQ ID NO: 8403318 - DNA, 22 bp, Homo sapiens
attaaactgagcaaattaacat

SEQ ID NO: 8403319 - DNA, 22 bp, Homo sapiens
attaaagaaacccagcatgtga

SEQ ID NO: 8403320 - DNA, 22 bp, Homo sapiens
attacagtagcaaaagaccgga

SEQ ID NO: 8403321 - DNA, 22 bp, Homo sapiens
atgttacacataggcataaatg

SEQ ID NO: 8403322 - DNA, 22 bp, Homo sapiens
atgtgtatccatctgtctattt

SEQ ID NO: 8403323 - DNA, 23 bp, Homo sapiens
atgtgtgggaggtcagagagcca

SEQ ID NO: 8403324 - DNA, 22 bp, Homo sapiens
atttaagggatttggagaccaa

SEQ ID NO: 8403325 - DNA, 17 bp, Homo sapiens
atttagcaagtagacag

SEQ ID NO: 8403326 - DNA, 22 bp, Homo sapiens
atttagagtgaaacattatgca

SEQ ID NO: 8403327 - DNA, 22 bp, Homo sapiens
atttagagtgttcactctgagc

SEQ ID NO: 8403328 - DNA, 22 bp, Homo sapiens
agagtgggcctctgagtcccag

SEQ ID NO: 8403329 - DNA, 22 bp, Homo sapiens
agatggtgatagagctgggatt

SEQ ID NO: 8403330 - DNA, 20 bp, Homo sapiens
agatggtgaaggccagggag

SEQ ID NO: 8403331 - DNA, 22 bp, Homo sapiens
agatggtgtttccccaggtgga

SEQ ID NO: 8403332 - DNA, 20 bp, Homo sapiens
agatggtgggctggaacacc

SEQ ID NO: 8403333 - DNA, 22 bp, Homo sapiens
agaattacagcttttagaatag

SEQ ID NO: 8403334 - DNA, 22 bp, Homo sapiens
agacacagtttgggatgggttg

SEQ ID NO: 8403335 - DNA, 22 bp, Homo sapiens
agacacagctgcaggaggtggg

SEQ ID NO: 8403336 - DNA, 22 bp, Homo sapiens
agacaggtagcaggacagatat

SEQ ID NO: 8403337 - DNA, 22 bp, Homo sapiens
agaaggctgagactgggatgaa

SEQ ID NO: 8403338 - DNA, 22 bp, Homo sapiens
atgggaggcaaagatcgcagaa

SEQ ID NO: 8403339 - DNA, 22 bp, Homo sapiens
atgggaggatcacttgaggcca

SEQ ID NO: 8403340 - DNA, 22 bp, Homo sapiens
atgggtggccccgtgtgcagtc

SEQ ID NO: 8403341 - DNA, 22 bp, Homo sapiens
atgtacagtggaaactaacaaa

SEQ ID NO: 8403342 - DNA, 22 bp, Homo sapiens
atgtacagtttctagactcaaa

SEQ ID NO: 8403343 - DNA, 22 bp, Homo sapiens
atgtacagccacttcacagtta

SEQ ID NO: 8403344 - DNA, 22 bp, Homo sapiens
atgtacatactgcattttcaaa

SEQ ID NO: 8403345 - DNA, 22 bp, Homo sapiens
atgtccagccaaccactggatt

SEQ ID NO: 8403346 - DNA, 22 bp, Homo sapiens
atggagtgctgttgatcaaggt

SEQ ID NO: 8403347 - DNA, 22 bp, Homo sapiens
atggaggtctgtgactcccaaa

SEQ ID NO: 8403348 - DNA, 22 bp, Homo sapiens
atggaggtggaagaatgagtta

SEQ ID NO: 8403349 - DNA, 21 bp, Homo sapiens
atggagtcaggggaatgggcc

SEQ ID NO: 8403350 - DNA, 22 bp, Homo sapiens
atggctgggatggggtagagaa

SEQ ID NO: 8403351 - DNA, 22 bp, Homo sapiens
atggctgggtcaccatcagggt

SEQ ID NO: 8403352 - DNA, 22 bp, Homo sapiens
atggcagcatgggattggtaga

SEQ ID NO: 8403353 - DNA, 22 bp, Homo sapiens
atggcagccagtgttggaggaa

SEQ ID NO: 8403354 - DNA, 22 bp, Homo sapiens
atggcagcccacgatggcaatg

SEQ ID NO: 8403355 - DNA, 22 bp, Homo sapiens
agctgctgaagtgagagaattg

SEQ ID NO: 8403356 - DNA, 22 bp, Homo sapiens
agctgctgagccaggctgatgt

SEQ ID NO: 8403357 - DNA, 22 bp, Homo sapiens
agctgctgagccaggctgatgt

SEQ ID NO: 8403358 - DNA, 22 bp, Homo sapiens
caggacagaccaagatcgtgct

SEQ ID NO: 8403359 - DNA, 22 bp, Homo sapiens
caggaggttgagggtgcagtga

SEQ ID NO: 8403360 - DNA, 22 bp, Homo sapiens
caggaggtacatagattcagat

SEQ ID NO: 8403361 - DNA, 22 bp, Homo sapiens
caggagtctctcttgagcccag

SEQ ID NO: 8403362 - DNA, 22 bp, Homo sapiens
agctgcagtatgaggctggtgg

SEQ ID NO: 8403363 - DNA, 22 bp, Homo sapiens
agctgcagtcaagctgggccac

SEQ ID NO: 8403364 - DNA, 23 bp, Homo sapiens
agctgaggctgtgggtgtcagag

SEQ ID NO: 8403365 - DNA, 22 bp, Homo sapiens
agctgaggctctgagagggaag

SEQ ID NO: 8403366 - DNA, 22 bp, Homo sapiens
cagctctccaccctcctggttc

SEQ ID NO: 8403367 - DNA, 22 bp, Homo sapiens
agctgggaagactggaagacag

SEQ ID NO: 8403368 - DNA, 23 bp, Homo sapiens
agctgggaattttctgaagcttt

SEQ ID NO: 8403369 - DNA, 22 bp, Homo sapiens
agctgtggccagatgtgagcgg

SEQ ID NO: 8403370 - DNA, 22 bp, Homo sapiens
caggcctgggttcaaatccctt

SEQ ID NO: 8403371 - DNA, 22 bp, Homo sapiens
caggcctggctgcagctcgcct

SEQ ID NO: 8403372 - DNA, 22 bp, Homo sapiens
caggcctggttgagccctgaga

SEQ ID NO: 8403373 - DNA, 22 bp, Homo sapiens
agctgtgtgtttccactgagct

SEQ ID NO: 8403374 - DNA, 22 bp, Homo sapiens
aggaaaggggtaggtgtggacg

SEQ ID NO: 8403375 - DNA, 22 bp, Homo sapiens
cagggccagcgtctcgggctat

SEQ ID NO: 8403376 - DNA, 22 bp, Homo sapiens
cagggccagccgcagcatccac

SEQ ID NO: 8403377 - DNA, 22 bp, Homo sapiens
cagggccagcgcccaggcccag

SEQ ID NO: 8403378 - DNA, 17 bp, Homo sapiens
aggaaacattttctttc

SEQ ID NO: 8403379 - DNA, 21 bp, Homo sapiens
aggaaaggaagtccccagggt

SEQ ID NO: 8403380 - DNA, 22 bp, Homo sapiens
cagggccagccgcagcatccac

SEQ ID NO: 8403381 - DNA, 22 bp, Homo sapiens
cagggccagcccgacgtggtgc

SEQ ID NO: 8403382 - DNA, 22 bp, Homo sapiens
cagggccagcccactagcgagg

SEQ ID NO: 8403383 - DNA, 22 bp, Homo sapiens
cagggccactgtagatgaggag

SEQ ID NO: 8403384 - DNA, 22 bp, Homo sapiens
cagggccagagagggctggctg

SEQ ID NO: 8403385 - DNA, 22 bp, Homo sapiens
cagggccagccatcctgctggg

SEQ ID NO: 8403386 - DNA, 20 bp, Homo sapiens
aggacagcagctgccacttg

SEQ ID NO: 8403387 - DNA, 19 bp, Homo sapiens
aggaaggaacctgagtctg

SEQ ID NO: 8403388 - DNA, 22 bp, Homo sapiens
aggaaggaagagacaccatttg

SEQ ID NO: 8403389 - DNA, 20 bp, Homo sapiens
aggaaggaagtttgcatgga

SEQ ID NO: 8403390 - DNA, 22 bp, Homo sapiens
aggacagcccttgagagcacat

SEQ ID NO: 8403391 - DNA, 22 bp, Homo sapiens
aggacagcattttcagcatctc

SEQ ID NO: 8403392 - DNA, 22 bp, Homo sapiens
aggacagcatatgggaaccagt

SEQ ID NO: 8403393 - DNA, 22 bp, Homo sapiens
aggacagcagtgctggcacttg

SEQ ID NO: 8403394 - DNA, 18 bp, Homo sapiens
aggagcctttgcactgga

SEQ ID NO: 8403395 - DNA, 22 bp, Homo sapiens
aggagaggggtaggattaattt

SEQ ID NO: 8403396 - DNA, 22 bp, Homo sapiens
aggaggaaggcttcattaggtt

SEQ ID NO: 8403397 - DNA, 22 bp, Homo sapiens
aggaggaagggaagacaagtaa

SEQ ID NO: 8403398 - DNA, 21 bp, Homo sapiens
aggaggagagcttggcctacc

SEQ ID NO: 8403399 - DNA, 22 bp, Homo sapiens
aggaggaggtgggacacagtga

SEQ ID NO: 8403400 - DNA, 22 bp, Homo sapiens
catgccctccttgccttcactg

SEQ ID NO: 8403401 - DNA, 22 bp, Homo sapiens
catgcctgtaatcccagctctt

SEQ ID NO: 8403402 - DNA, 22 bp, Homo sapiens
catgcctgtaatcccagcactt

SEQ ID NO: 8403403 - DNA, 22 bp, Homo sapiens
aggaggtggcctgagcgtgccc

SEQ ID NO: 8403404 - DNA, 22 bp, Homo sapiens
catggccctcttctggagcaat

SEQ ID NO: 8403405 - DNA, 22 bp, Homo sapiens
cattcccttggggagttcatgc

SEQ ID NO: 8403406 - DNA, 22 bp, Homo sapiens
aggcagcagaggttgaggaaag

SEQ ID NO: 8403407 - DNA, 22 bp, Homo sapiens
catttacagtgagagtttttac

SEQ ID NO: 8403408 - DNA, 21 bp, Homo sapiens
catttacatgacagattggtt

SEQ ID NO: 8403409 - DNA, 22 bp, Homo sapiens
catttacataacagtaacgctg

SEQ ID NO: 8403410 - DNA, 19 bp, Homo sapiens
aggcagcattctggggctt

SEQ ID NO: 8403411 - DNA, 22 bp, Homo sapiens
aggcagcagtcatgaggaaaga

SEQ ID NO: 8403412 - DNA, 22 bp, Homo sapiens
catttacatttaaggttaatat

SEQ ID NO: 8403413 - DNA, 22 bp, Homo sapiens
aggcagccagatggcagcctgc

SEQ ID NO: 8403414 - DNA, 22 bp, Homo sapiens
aggcagccacatgagctcctga

SEQ ID NO: 8403415 - DNA, 22 bp, Homo sapiens
aggccccatcaggaaggaggcc

SEQ ID NO: 8403416 - DNA, 20 bp, Homo sapiens
aggccccaggtggacactag

SEQ ID NO: 8403417 - DNA, 20 bp, Homo sapiens
aggccccaggtggacactag

SEQ ID NO: 8403418 - DNA, 22 bp, Homo sapiens
aggccccaaagcagtgcaagta

SEQ ID NO: 8403419 - DNA, 22 bp, Homo sapiens
aggccccaaagcagtgcaagta

SEQ ID NO: 8403420 - DNA, 22 bp, Homo sapiens
aggccaggatagcatggatcag

SEQ ID NO: 8403421 - DNA, 22 bp, Homo sapiens
aggccaggatagcatggatcag

SEQ ID NO: 8403422 - DNA, 22 bp, Homo sapiens
aggccagatgtcgggctagaag

SEQ ID NO: 8403423 - DNA, 22 bp, Homo sapiens
aggccacaaccaccctgtgccc

SEQ ID NO: 8403424 - DNA, 22 bp, Homo sapiens
aggccagctctacccttggact

SEQ ID NO: 8403425 - DNA, 22 bp, Homo sapiens
aggccagctgttactagagcca

SEQ ID NO: 8403426 - DNA, 22 bp, Homo sapiens
aggcagccattaccaagggcat

SEQ ID NO: 8403427 - DNA, 22 bp, Homo sapiens
aggcagccatctgcaggaagga

SEQ ID NO: 8403428 - DNA, 22 bp, Homo sapiens
aggcagcccacaggacacagga

SEQ ID NO: 8403429 - DNA, 22 bp, Homo sapiens
aggcagtggctgagaccagggg

SEQ ID NO: 8403430 - DNA, 22 bp, Homo sapiens
aggcctcactctcagagcttct

SEQ ID NO: 8403431 - DNA, 22 bp, Homo sapiens
aggcctcaggaaggtaaagaag

SEQ ID NO: 8403432 - DNA, 22 bp, Homo sapiens
ccaggcagggctcaaggaacct

SEQ ID NO: 8403433 - DNA, 22 bp, Homo sapiens
ccaggcagggctcaaggaacct

SEQ ID NO: 8403434 - DNA, 22 bp, Homo sapiens
ccaggcatcacgggcatgtggc

SEQ ID NO: 8403435 - DNA, 21 bp, Homo sapiens
ccaggcatgactgcagagagc

SEQ ID NO: 8403436 - DNA, 22 bp, Homo sapiens
ccagttcatacacttagaaatt

SEQ ID NO: 8403437 - DNA, 22 bp, Homo sapiens
agggcagctaaggtgctgactg

SEQ ID NO: 8403438 - DNA, 22 bp, Homo sapiens
agggcagcctgagtgctggccc

SEQ ID NO: 8403439 - DNA, 22 bp, Homo sapiens
agggcagctctcacctctggcc

SEQ ID NO: 8403440 - DNA, 22 bp, Homo sapiens
agggccagccccaccctctctg

SEQ ID NO: 8403441 - DNA, 22 bp, Homo sapiens
agggccagggaaacgatcagca

SEQ ID NO: 8403442 - DNA, 22 bp, Homo sapiens
agggccagggaaacgatcagca

SEQ ID NO: 8403443 - DNA, 22 bp, Homo sapiens
agggccaggctcccatgtcagg

SEQ ID NO: 8403444 - DNA, 22 bp, Homo sapiens
agggccaggctcccatgtcagg

SEQ ID NO: 8403445 - DNA, 22 bp, Homo sapiens
agggccagggaagctgtatttt

SEQ ID NO: 8403446 - DNA, 22 bp, Homo sapiens
agggccaggatcacagccaaga

SEQ ID NO: 8403447 - DNA, 22 bp, Homo sapiens
agggccaggaacacctgaaggg

SEQ ID NO: 8403448 - DNA, 22 bp, Homo sapiens
agggccaggaacacctgaaggg

SEQ ID NO: 8403449 - DNA, 22 bp, Homo sapiens
agggccagctgatgagaatgag

SEQ ID NO: 8403450 - DNA, 22 bp, Homo sapiens
agggccagctgcagaattagca

SEQ ID NO: 8403451 - DNA, 22 bp, Homo sapiens
agggccagccgacttccagcct

SEQ ID NO: 8403452 - DNA, 22 bp, Homo sapiens
agggccagctagagccctcgcc

SEQ ID NO: 8403453 - DNA, 21 bp, Homo sapiens
cctcagtctccctgctccact

SEQ ID NO: 8403454 - DNA, 22 bp, Homo sapiens
ccccatcttccctgagggattt

SEQ ID NO: 8403455 - DNA, 22 bp, Homo sapiens
ccccagcagactcagggcaggt

SEQ ID NO: 8403456 - DNA, 22 bp, Homo sapiens
agggagccagagttgggagctc

SEQ ID NO: 8403457 - DNA, 22 bp, Homo sapiens
agggagcatgggtgaagcaggc

SEQ ID NO: 8403458 - DNA, 21 bp, Homo sapiens
agggagcatgttagctttcga

SEQ ID NO: 8403459 - DNA, 22 bp, Homo sapiens
agggagaggctgaactatccta

SEQ ID NO: 8403460 - DNA, 22 bp, Homo sapiens
ccatgaccatacctgggcctga

SEQ ID NO: 8403461 - DNA, 22 bp, Homo sapiens
cccagcagttgttggtgcacat

SEQ ID NO: 8403462 - DNA, 22 bp, Homo sapiens
cccagcagtggttctcaaactt

SEQ ID NO: 8403463 - DNA, 22 bp, Homo sapiens
cccagcagtgacccagtgatac

SEQ ID NO: 8403464 - DNA, 22 bp, Homo sapiens
cccagcagtagagctcatatgg

SEQ ID NO: 8403465 - DNA, 23 bp, Homo sapiens
agtgctggagaagcttctggctt

SEQ ID NO: 8403466 - DNA, 22 bp, Homo sapiens
agtgctggagggaggcaggttc

SEQ ID NO: 8403467 - DNA, 22 bp, Homo sapiens
agtgctggagggaggcaggttc

SEQ ID NO: 8403468 - DNA, 22 bp, Homo sapiens
agtgctggattacaggcgtgag

SEQ ID NO: 8403469 - DNA, 22 bp, Homo sapiens
agtgctgggattacaggcataa

SEQ ID NO: 8403470 - DNA, 22 bp, Homo sapiens
agtgctgggattacaggcataa

SEQ ID NO: 8403471 - DNA, 22 bp, Homo sapiens
ctcggcaggtggaggttgtagt

SEQ ID NO: 8403472 - DNA, 22 bp, Homo sapiens
agtgctgggattgcaggcatga

SEQ ID NO: 8403473 - DNA, 22 bp, Homo sapiens
agtgctgggattgcaggcatga

SEQ ID NO: 8403474 - DNA, 22 bp, Homo sapiens
agtggtcttagcttgctgggct

SEQ ID NO: 8403475 - DNA, 22 bp, Homo sapiens
agtggtggagccaggaaatgtg

SEQ ID NO: 8403476 - DNA, 22 bp, Homo sapiens
ctctttggcgttggcagagcca

SEQ ID NO: 8403477 - DNA, 22 bp, Homo sapiens
ctcagaagaacccagggtccca

SEQ ID NO: 8403478 - DNA, 22 bp, Homo sapiens
ctcagaagaatcagcagctatt

SEQ ID NO: 8403479 - DNA, 22 bp, Homo sapiens
ctcagaagccttcagtcttggc

SEQ ID NO: 8403480 - DNA, 22 bp, Homo sapiens
agtcccagatctccattcggtc

SEQ ID NO: 8403481 - DNA, 22 bp, Homo sapiens
agtcccagagaggtcggggcca

SEQ ID NO: 8403482 - DNA, 22 bp, Homo sapiens
cgggttcacgccattctcctgc

SEQ ID NO: 8403483 - DNA, 22 bp, Homo sapiens
ctcaacagctctgccatactcc

SEQ ID NO: 8403484 - DNA, 22 bp, Homo sapiens
ctcagctccaggtgtgcatctt

SEQ ID NO: 8403485 - DNA, 17 bp, Homo sapiens
ctcagctgaaccccaga

SEQ ID NO: 8403486 - DNA, 22 bp, Homo sapiens
ctcagggaggtcctgtgctgaa

SEQ ID NO: 8403487 - DNA, 22 bp, Homo sapiens
ctcagggaggcctctgctggtt

SEQ ID NO: 8403488 - DNA, 22 bp, Homo sapiens
ctcagggagtagcacatgtgga

SEQ ID NO: 8403489 - DNA, 22 bp, Homo sapiens
cctggctgcttcctctgccatg

SEQ ID NO: 8403490 - DNA, 23 bp, Homo sapiens
cctggctggattctctgcattca

SEQ ID NO: 8403491 - DNA, 22 bp, Homo sapiens
cctggccaatctagggctgtta

SEQ ID NO: 8403492 - DNA, 21 bp, Homo sapiens
cctggccaatctgatagggtt

SEQ ID NO: 8403493 - DNA, 22 bp, Homo sapiens
cctggccactcaggtgtggggc

SEQ ID NO: 8403494 - DNA, 22 bp, Homo sapiens
cctggccagaggcgtgcctgtg

SEQ ID NO: 8403495 - DNA, 20 bp, Homo sapiens
cctggccaatgagataggaa

SEQ ID NO: 8403496 - DNA, 22 bp, Homo sapiens
cctgctctagactctgggaagg

SEQ ID NO: 8403497 - DNA, 22 bp, Homo sapiens
cctgctgagaccctgaggtggg

SEQ ID NO: 8403498 - DNA, 19 bp, Homo sapiens
cctgctgaagtgatgcagc

SEQ ID NO: 8403499 - DNA, 22 bp, Homo sapiens
agggtctgttgtttgttctgga

SEQ ID NO: 8403500 - DNA, 20 bp, Homo sapiens
agggtctgatgtggtggccc

SEQ ID NO: 8403501 - DNA, 20 bp, Homo sapiens
cggctcagcctctccctccc

SEQ ID NO: 8403502 - DNA, 22 bp, Homo sapiens
cggctcagacttcccaagaaca

SEQ ID NO: 8403503 - DNA, 22 bp, Homo sapiens
aggtgggggctgtgtccttgac

SEQ ID NO: 8403504 - DNA, 22 bp, Homo sapiens
aggtggggtgagctgcagacta

SEQ ID NO: 8403505 - DNA, 22 bp, Homo sapiens
aggtggcttctggccaggtgtg

SEQ ID NO: 8403506 - DNA, 22 bp, Homo sapiens
aggtggctggtccaggctgcag

SEQ ID NO: 8403507 - DNA, 22 bp, Homo sapiens
aggtggctgtattcagctgtaa

SEQ ID NO: 8403508 - DNA, 22 bp, Homo sapiens
aggtggctgtattcagctgtaa

SEQ ID NO: 8403509 - DNA, 22 bp, Homo sapiens
ccttggctaggcagcggctgtc

SEQ ID NO: 8403510 - DNA, 20 bp, Homo sapiens
aggtggctcttcctgggctt

SEQ ID NO: 8403511 - DNA, 22 bp, Homo sapiens
aggtgctgttaacatatgaggt

SEQ ID NO: 8403512 - DNA, 22 bp, Homo sapiens
aggtgctgaactggtgaggtct

SEQ ID NO: 8403513 - DNA, 22 bp, Homo sapiens
aggtgctgaactggtgaggtct

SEQ ID NO: 8403514 - DNA, 21 bp, Homo sapiens
aggtgctggcgccccaggaga

SEQ ID NO: 8403515 - DNA, 22 bp, Homo sapiens
aggtgcctgtcgtctctggtta

SEQ ID NO: 8403516 - DNA, 22 bp, Homo sapiens
aggtgctctaggtatctacttt

SEQ ID NO: 8403517 - DNA, 22 bp, Homo sapiens
ctgagggaacttgggcaagtct

SEQ ID NO: 8403518 - DNA, 22 bp, Homo sapiens
ctgaggctgggctgagggtata

SEQ ID NO: 8403519 - DNA, 22 bp, Homo sapiens
ctgaggcctctctcctgggctt

SEQ ID NO: 8403520 - DNA, 22 bp, Homo sapiens
ctgaggcaggggcagctggaga

SEQ ID NO: 8403521 - DNA, 22 bp, Homo sapiens
ctgaggcatgaatgtgggcttt

SEQ ID NO: 8403522 - DNA, 22 bp, Homo sapiens
ctgcttggggttagggtgtcct

SEQ ID NO: 8403523 - DNA, 22 bp, Homo sapiens
ctggagggctgcagcgaggctg

SEQ ID NO: 8403524 - DNA, 22 bp, Homo sapiens
ctggagggaggaggctgctatt

SEQ ID NO: 8403525 - DNA, 22 bp, Homo sapiens
ctgggcacaagtggccctggat

SEQ ID NO: 8403526 - DNA, 22 bp, Homo sapiens
ctgggactttgtaggccagttg

SEQ ID NO: 8403527 - DNA, 22 bp, Homo sapiens
ctgggaagtagaatcagatgag

SEQ ID NO: 8403528 - DNA, 22 bp, Homo sapiens
ctgggaaggagggttgcgaagg

SEQ ID NO: 8403529 - DNA, 22 bp, Homo sapiens
ctgggaagcttcgagcaggaaa

SEQ ID NO: 8403530 - DNA, 22 bp, Homo sapiens
ctgggaagcatggtgatggtat

SEQ ID NO: 8403531 - DNA, 22 bp, Homo sapiens
ctgggaagccacagggtgtggg

SEQ ID NO: 8403532 - DNA, 22 bp, Homo sapiens
ctgggcaggatacttcatggga

SEQ ID NO: 8403533 - DNA, 22 bp, Homo sapiens
ctgggcagtggtggcccttccc

SEQ ID NO: 8403534 - DNA, 22 bp, Homo sapiens
ctgggcagtggtggcatctttg

SEQ ID NO: 8403535 - DNA, 22 bp, Homo sapiens
atatgtacacttacgttacaaa

SEQ ID NO: 8403536 - DNA, 20 bp, Homo sapiens
ctgggtcacttggctgctct

SEQ ID NO: 8403537 - DNA, 22 bp, Homo sapiens
ctgggtcagtctgtccctaggg

SEQ ID NO: 8403538 - DNA, 22 bp, Homo sapiens
atctacaaaaactgtctcagga

SEQ ID NO: 8403539 - DNA, 22 bp, Homo sapiens
atccccctcttggatggcggca

SEQ ID NO: 8403540 - DNA, 22 bp, Homo sapiens
ctgtggagcagggcagggtcac

SEQ ID NO: 8403541 - DNA, 22 bp, Homo sapiens
ggaggcggacacaggtagtgtt

SEQ ID NO: 8403542 - DNA, 22 bp, Homo sapiens
ggagggagcatccccttgctga

SEQ ID NO: 8403543 - DNA, 22 bp, Homo sapiens
ggatgggagcagaggacgacca

SEQ ID NO: 8403544 - DNA, 19 bp, Homo sapiens
ggatggtggggtgcccatc

SEQ ID NO: 8403545 - DNA, 22 bp, Homo sapiens
ggcactgggcaccggctgaggg

SEQ ID NO: 8403546 - DNA, 22 bp, Homo sapiens
ggcactgggaatgcagtgatga

SEQ ID NO: 8403547 - DNA, 22 bp, Homo sapiens
ggcactggcctggggccaagag

SEQ ID NO: 8403548 - DNA, 22 bp, Homo sapiens
cacagggcagagggtccgtggc

SEQ ID NO: 8403549 - DNA, 22 bp, Homo sapiens
ggcacaattgcagcaataaaca

SEQ ID NO: 8403550 - DNA, 17 bp, Homo sapiens
ggcagagctgacagggc

SEQ ID NO: 8403551 - DNA, 22 bp, Homo sapiens
cacagtggaagtccaggatccc

SEQ ID NO: 8403552 - DNA, 20 bp, Homo sapiens
ggcagccaatcagcgtgccg

SEQ ID NO: 8403553 - DNA, 22 bp, Homo sapiens
ggcctcgcggcttctggtggct

SEQ ID NO: 8403554 - DNA, 22 bp, Homo sapiens
ggctagggatctagaccaggac

SEQ ID NO: 8403555 - DNA, 22 bp, Homo sapiens
ggctagggatctagaccaggac

SEQ ID NO: 8403556 - DNA, 22 bp, Homo sapiens
ggctagggagacagagggcatg

SEQ ID NO: 8403557 - DNA, 22 bp, Homo sapiens
cactgccacctgcatgccctga

SEQ ID NO: 8403558 - DNA, 22 bp, Homo sapiens
cactggaggtcagtggagcact

SEQ ID NO: 8403559 - DNA, 22 bp, Homo sapiens
cactggaatggatagagcagag

SEQ ID NO: 8403560 - DNA, 22 bp, Homo sapiens
cacccactgagctcatgtccca

SEQ ID NO: 8403561 - DNA, 22 bp, Homo sapiens
cacccacattccatcactctgc

SEQ ID NO: 8403562 - DNA, 22 bp, Homo sapiens
cacccagcacagagggaggcga

SEQ ID NO: 8403563 - DNA, 22 bp, Homo sapiens
ggcagttgctgtggatgaggtt

SEQ ID NO: 8403564 - DNA, 22 bp, Homo sapiens
ggcagctgattagcatcaagga

SEQ ID NO: 8403565 - DNA, 22 bp, Homo sapiens
cacccaggttggagtgcagtgg

SEQ ID NO: 8403566 - DNA, 22 bp, Homo sapiens
cacccattaaccaaagagtgaa

SEQ ID NO: 8403567 - DNA, 22 bp, Homo sapiens
gctgtggcctggcgcagagctg

SEQ ID NO: 8403568 - DNA, 22 bp, Homo sapiens
gctgtggcctggcgcagagctg

SEQ ID NO: 8403569 - DNA, 22 bp, Homo sapiens
gcttggctgtgttcaagggcgg

SEQ ID NO: 8403570 - DNA, 21 bp, Homo sapiens
cacaccaggcatgtcttgagc

SEQ ID NO: 8403571 - DNA, 22 bp, Homo sapiens
cacaccagcatggtctcagtgt

SEQ ID NO: 8403572 - DNA, 22 bp, Homo sapiens
gctgcaggtttgtctagtctgg

SEQ ID NO: 8403573 - DNA, 22 bp, Homo sapiens
caaggaggaagatgcaggggac

SEQ ID NO: 8403574 - DNA, 22 bp, Homo sapiens
gctgctggagagcgagactgtt

SEQ ID NO: 8403575 - DNA, 22 bp, Homo sapiens
gggctgtgtactatgaggaggg

SEQ ID NO: 8403576 - DNA, 20 bp, Homo sapiens
ggggaagaaaaggatgtgat

SEQ ID NO: 8403577 - DNA, 22 bp, Homo sapiens
gggcgaggactgactctgggca

SEQ ID NO: 8403578 - DNA, 21 bp, Homo sapiens
gggcgaggcctgatgtggctc

SEQ ID NO: 8403579 - DNA, 22 bp, Homo sapiens
gggcagagaaatggacagttgg

SEQ ID NO: 8403580 - DNA, 22 bp, Homo sapiens
gggcagaatttgtagatgacat

SEQ ID NO: 8403581 - DNA, 22 bp, Homo sapiens
cagagcccatggcacatgtgga

SEQ ID NO: 8403582 - DNA, 22 bp, Homo sapiens
cagagccagctgtccttggcat

SEQ ID NO: 8403583 - DNA, 22 bp, Homo sapiens
gggcacagagggtcttgaagaa

SEQ ID NO: 8403584 - DNA, 22 bp, Homo sapiens
ggggaagaaccgggattcccat

SEQ ID NO: 8403585 - DNA, 22 bp, Homo sapiens
gggtgccctgggtaggtcagtt

SEQ ID NO: 8403586 - DNA, 22 bp, Homo sapiens
gggtgcctgagttagggcagaa

SEQ ID NO: 8403587 - DNA, 22 bp, Homo sapiens
gggtgcctgcctcaggcagtgt

SEQ ID NO: 8403588 - DNA, 22 bp, Homo sapiens
gggtgctgactggggcctgaaa

SEQ ID NO: 8403589 - DNA, 22 bp, Homo sapiens
gggaggtcctaaaggggaccag

SEQ ID NO: 8403590 - DNA, 22 bp, Homo sapiens
gggagcagttaaaatgattcct

SEQ ID NO: 8403591 - DNA, 22 bp, Homo sapiens
cagacagggccctgtgatggta

SEQ ID NO: 8403592 - DNA, 22 bp, Homo sapiens
cagacaggaattctggcgtggt

SEQ ID NO: 8403593 - DNA, 22 bp, Homo sapiens
gggagcagcctgcctcccacct

SEQ ID NO: 8403594 - DNA, 22 bp, Homo sapiens
gggaatgtggcaggcagcagtt

SEQ ID NO: 8403595 - DNA, 22 bp, Homo sapiens
gggaatgtggccctggggctcc

SEQ ID NO: 8403596 - DNA, 15 bp, Homo sapiens
gggaatgttttacaa

SEQ ID NO: 8403597 - DNA, 22 bp, Homo sapiens
gggaatgttgactgagagcagg

SEQ ID NO: 8403598 - DNA, 22 bp, Homo sapiens
gggaatgtggtgatagtctata

SEQ ID NO: 8403599 - DNA, 22 bp, Homo sapiens
gggaatgtgtctgatggaaaga

SEQ ID NO: 8403600 - DNA, 16 bp, Homo sapiens
gggaatgtgtcttctc

SEQ ID NO: 8403601 - DNA, 22 bp, Homo sapiens
gggacagacccatgggccaggt

SEQ ID NO: 8403602 - DNA, 22 bp, Homo sapiens
gggacagagcaacttgggatgg

SEQ ID NO: 8403603 - DNA, 22 bp, Homo sapiens
gggacagaaggaagtgagcaca

SEQ ID NO: 8403604 - DNA, 22 bp, Homo sapiens
gggacagaaggaagtgagcaca

SEQ ID NO: 8403605 - DNA, 22 bp, Homo sapiens
gggactggaactactggtgcag

SEQ ID NO: 8403606 - DNA, 22 bp, Homo sapiens
gggactggcacagggctgggag

SEQ ID NO: 8403607 - DNA, 22 bp, Homo sapiens
gggaaagagaggtggacgcagg

SEQ ID NO: 8403608 - DNA, 22 bp, Homo sapiens
gggtgggactctttggcctgag

SEQ ID NO: 8403609 - DNA, 22 bp, Homo sapiens
gggtgggactgaagtctgaggg

SEQ ID NO: 8403610 - DNA, 22 bp, Homo sapiens
gggtgggactgaagtctgaggg

SEQ ID NO: 8403611 - DNA, 20 bp, Homo sapiens
gggtgggagagtctgagggt

SEQ ID NO: 8403612 - DNA, 22 bp, Homo sapiens
ggtggggttttaggctgctgca

SEQ ID NO: 8403613 - DNA, 22 bp, Homo sapiens
cagcaaggccattggatgcagt

SEQ ID NO: 8403614 - DNA, 22 bp, Homo sapiens
cagcaaggcattctgtggatta

SEQ ID NO: 8403615 - DNA, 22 bp, Homo sapiens
ggtgggtgaaatctaggtgtgt

SEQ ID NO: 8403616 - DNA, 22 bp, Homo sapiens
gtaaacaggaatgtggtcatgg

SEQ ID NO: 8403617 - DNA, 22 bp, Homo sapiens
cagcagagtatggcactcaact

SEQ ID NO: 8403618 - DNA, 22 bp, Homo sapiens
cagcagagtaattctcacctct

SEQ ID NO: 8403619 - DNA, 22 bp, Homo sapiens
cagcagcaaggtgagggtggag

SEQ ID NO: 8403620 - DNA, 22 bp, Homo sapiens
cagccacagctgggtgcctgac

SEQ ID NO: 8403621 - DNA, 22 bp, Homo sapiens
cagccacgtagcccttggccgt

SEQ ID NO: 8403622 - DNA, 22 bp, Homo sapiens
cagcccagcactaagtagattt

SEQ ID NO: 8403623 - DNA, 21 bp, Homo sapiens
cagcccagcccattgacagtg

SEQ ID NO: 8403624 - DNA, 22 bp, Homo sapiens
atggccagtgtttccctcagtt

SEQ ID NO: 8403625 - DNA, 19 bp, Homo sapiens
atggccagtttagaggttt

SEQ ID NO: 8403626 - DNA, 22 bp, Homo sapiens
gagccagccttcttctgaggtc

SEQ ID NO: 8403627 - DNA, 22 bp, Homo sapiens
gagccagcgccttgcctctggg

SEQ ID NO: 8403628 - DNA, 22 bp, Homo sapiens
atggcagtttcactctgggatt

SEQ ID NO: 8403629 - DNA, 22 bp, Homo sapiens
atggccagcaaggtagggcaat

SEQ ID NO: 8403630 - DNA, 22 bp, Homo sapiens
atggccagtctattcatggtta

SEQ ID NO: 8403631 - DNA, 22 bp, Homo sapiens
atggcagtgacttgaagggtag

SEQ ID NO: 8403632 - DNA, 22 bp, Homo sapiens
atggcagtgataggctagtgat

SEQ ID NO: 8403633 - DNA, 22 bp, Homo sapiens
atggcagggtctgtcttcagct

SEQ ID NO: 8403634 - DNA, 22 bp, Homo sapiens
atggcagggcacagctctagtt

SEQ ID NO: 8403635 - DNA, 22 bp, Homo sapiens
atggcagctttcattgtccaca

SEQ ID NO: 8403636 - DNA, 22 bp, Homo sapiens
atggcagctggcttgggcacct

SEQ ID NO: 8403637 - DNA, 22 bp, Homo sapiens
atgccactgcacttcagcttgg

SEQ ID NO: 8403638 - DNA, 22 bp, Homo sapiens
atggagatttttagaattacag

SEQ ID NO: 8403639 - DNA, 22 bp, Homo sapiens
atggagctgtagggagcagtgg

SEQ ID NO: 8403640 - DNA, 22 bp, Homo sapiens
atggaatgccaagttcactgct

SEQ ID NO: 8403641 - DNA, 22 bp, Homo sapiens
gaggccaggagtgctgtaagtt

SEQ ID NO: 8403642 - DNA, 22 bp, Homo sapiens
gaggagctgggctgagagggtc

SEQ ID NO: 8403643 - DNA, 22 bp, Homo sapiens
gaggccaggggagtcagcgtcc

SEQ ID NO: 8403644 - DNA, 22 bp, Homo sapiens
gaggccagggatgcaatgagag

SEQ ID NO: 8403645 - DNA, 22 bp, Homo sapiens
gaggccaggggcctggagatga

SEQ ID NO: 8403646 - DNA, 22 bp, Homo sapiens
gaggccaggggcctggagatga

SEQ ID NO: 8403647 - DNA, 21 bp, Homo sapiens
atgtacattcggcaacagata

SEQ ID NO: 8403648 - DNA, 22 bp, Homo sapiens
atgtacattcttctcaccgaag

SEQ ID NO: 8403649 - DNA, 18 bp, Homo sapiens
atgtacatttgctaaagc

SEQ ID NO: 8403650 - DNA, 17 bp, Homo sapiens
gaggagctccagtaggt

SEQ ID NO: 8403651 - DNA, 19 bp, Homo sapiens
atgtacccagtgtcaatcc

SEQ ID NO: 8403652 - DNA, 19 bp, Homo sapiens
atggtacagtgtacacttg

SEQ ID NO: 8403653 - DNA, 22 bp, Homo sapiens
atgtacaattctccttggtagg

SEQ ID NO: 8403654 - DNA, 22 bp, Homo sapiens
atgtacaatttttgcttagggg

SEQ ID NO: 8403655 - DNA, 22 bp, Homo sapiens
atgtacatctttataacaagct

SEQ ID NO: 8403656 - DNA, 21 bp, Homo sapiens
gagctgggcgaggctccgggg

SEQ ID NO: 8403657 - DNA, 22 bp, Homo sapiens
atgtgtattttgtactattggg

SEQ ID NO: 8403658 - DNA, 22 bp, Homo sapiens
atgtgtattagttagtttaatg

SEQ ID NO: 8403659 - DNA, 22 bp, Homo sapiens
atgtggcttggcagggaatatg

SEQ ID NO: 8403660 - DNA, 22 bp, Homo sapiens
atgtgtattacctcgattgtga

SEQ ID NO: 8403661 - DNA, 22 bp, Homo sapiens
atgtgtattaccctttcattcc

SEQ ID NO: 8403662 - DNA, 22 bp, Homo sapiens
atgcacagtatgtagggtctat

SEQ ID NO: 8403663 - DNA, 22 bp, Homo sapiens
atgaggcaggagtgcagtggca

SEQ ID NO: 8403664 - DNA, 22 bp, Homo sapiens
atgaggcaggaaaggcgtatct

SEQ ID NO: 8403665 - DNA, 22 bp, Homo sapiens
atgaggcagcacatgggattgt

SEQ ID NO: 8403666 - DNA, 22 bp, Homo sapiens
atgaggcagatgttgcatgagg

SEQ ID NO: 8403667 - DNA, 22 bp, Homo sapiens
atgaggcagagggctgtgccag

SEQ ID NO: 8403668 - DNA, 22 bp, Homo sapiens
cttgttattggaaatgtcatgc

SEQ ID NO: 8403669 - DNA, 22 bp, Homo sapiens
cttggcctgtggctcaagaatt

SEQ ID NO: 8403670 - DNA, 22 bp, Homo sapiens
cttggcctgggccgcagccact

SEQ ID NO: 8403671 - DNA, 22 bp, Homo sapiens
cttggcctgcccagccagaagg

SEQ ID NO: 8403672 - DNA, 22 bp, Homo sapiens
cttggcctgcaggcagcagcgc

SEQ ID NO: 8403673 - DNA, 22 bp, Homo sapiens
cttggcctgacatgtggcaggg

SEQ ID NO: 8403674 - DNA, 22 bp, Homo sapiens
cttggcctcttctcagggtggg

SEQ ID NO: 8403675 - DNA, 21 bp, Homo sapiens
cttggcctctagctagagctg

SEQ ID NO: 8403676 - DNA, 20 bp, Homo sapiens
cttggcctacttagctttgt

SEQ ID NO: 8403677 - DNA, 21 bp, Homo sapiens
cttggcctactagaaaacctt

SEQ ID NO: 8403678 - DNA, 22 bp, Homo sapiens
gcgagggcacgcggttgaaggc

SEQ ID NO: 8403679 - DNA, 22 bp, Homo sapiens
gctcaggaaaacagtctagtaa

SEQ ID NO: 8403680 - DNA, 22 bp, Homo sapiens
atttacagaaacttaatcatag

SEQ ID NO: 8403681 - DNA, 22 bp, Homo sapiens
atttacactggttctcagagct

SEQ ID NO: 8403682 - DNA, 22 bp, Homo sapiens
atttactactgctatctagaag

SEQ ID NO: 8403683 - DNA, 19 bp, Homo sapiens
gccaggcctggacctgcag

SEQ ID NO: 8403684 - DNA, 22 bp, Homo sapiens
gatgaggctgtagagggtggca

SEQ ID NO: 8403685 - DNA, 22 bp, Homo sapiens
gatgaggcaagccagaggactg

SEQ ID NO: 8403686 - DNA, 22 bp, Homo sapiens
attaaatgttccttaaattata

SEQ ID NO: 8403687 - DNA, 17 bp, Homo sapiens
gcaagggatgggagatt

SEQ ID NO: 8403688 - DNA, 22 bp, Homo sapiens
gcaaggtgttttataggcagga

SEQ ID NO: 8403689 - DNA, 22 bp, Homo sapiens
gcaaggtgttttaacaggaaaa

SEQ ID NO: 8403690 - DNA, 22 bp, Homo sapiens
attacaaaagaagggagaaggt

SEQ ID NO: 8403691 - DNA, 21 bp, Homo sapiens
attctcaggcccatcctcagg

SEQ ID NO: 8403692 - DNA, 22 bp, Homo sapiens
attctacacctctctcatttag

SEQ ID NO: 8403693 - DNA, 22 bp, Homo sapiens
caggtctcttttgtcacaccac

SEQ ID NO: 8403694 - DNA, 22 bp, Homo sapiens
caggtctgaagagtcacatgcc

SEQ ID NO: 8403695 - DNA, 22 bp, Homo sapiens
caggtccacggcgcccaggggt

SEQ ID NO: 8403696 - DNA, 22 bp, Homo sapiens
caggtccagaaaccaaaggatt

SEQ ID NO: 8403697 - DNA, 22 bp, Homo sapiens
tatctatgtgctctgacctctc

SEQ ID NO: 8403698 - DNA, 22 bp, Homo sapiens
cagggtggaagctgtagagtgg

SEQ ID NO: 8403699 - DNA, 22 bp, Homo sapiens
cagggtggaatggaatgctggc

SEQ ID NO: 8403700 - DNA, 22 bp, Homo sapiens
cagggtggcacatcacagcatt

SEQ ID NO: 8403701 - DNA, 22 bp, Homo sapiens
cagggtggaatggaatgctggc

SEQ ID NO: 8403702 - DNA, 22 bp, Homo sapiens
cagggtggaagctgtagagtgg

SEQ ID NO: 8403703 - DNA, 22 bp, Homo sapiens
cagggtggaacaggcaatactt

SEQ ID NO: 8403704 - DNA, 22 bp, Homo sapiens
cagggtggaaaagctagttgga

SEQ ID NO: 8403705 - DNA, 22 bp, Homo sapiens
cagggtggaaaagctagttgga

SEQ ID NO: 8403706 - DNA, 22 bp, Homo sapiens
caggggcctggctgtctaggaa

SEQ ID NO: 8403707 - DNA, 22 bp, Homo sapiens
tattaaagggaagttatgcatg

SEQ ID NO: 8403708 - DNA, 22 bp, Homo sapiens
tattaaagagagaatcatcatc

SEQ ID NO: 8403709 - DNA, 22 bp, Homo sapiens
tatgcacacattagcacagggt

SEQ ID NO: 8403710 - DNA, 19 bp, Homo sapiens
tatggcaggccgaggcact

SEQ ID NO: 8403711 - DNA, 22 bp, Homo sapiens
tatggcagttacccttgatgat

SEQ ID NO: 8403712 - DNA, 22 bp, Homo sapiens
tatggcagaggagaggcactag

SEQ ID NO: 8403713 - DNA, 20 bp, Homo sapiens
cagtgaggaggtgctggggg

SEQ ID NO: 8403714 - DNA, 22 bp, Homo sapiens
cagtgaggtagacagctttttc

SEQ ID NO: 8403715 - DNA, 22 bp, Homo sapiens
cagtgaggtggagtagttccca

SEQ ID NO: 8403716 - DNA, 22 bp, Homo sapiens
cagtgcagacgtggagggggca

SEQ ID NO: 8403717 - DNA, 20 bp, Homo sapiens
tatttacaacttagagcctc

SEQ ID NO: 8403718 - DNA, 22 bp, Homo sapiens
tcactcagcattcactgggcct

SEQ ID NO: 8403719 - DNA, 22 bp, Homo sapiens
tcagaaggatgtgcaggtggca

SEQ ID NO: 8403720 - DNA, 22 bp, Homo sapiens
tcagaaggaagaagtcatggga

SEQ ID NO: 8403721 - DNA, 23 bp, Homo sapiens
tcagaacaatgccttaggggcat

SEQ ID NO: 8403722 - DNA, 22 bp, Homo sapiens
tcagaaatgtaagctgatgact

SEQ ID NO: 8403723 - DNA, 22 bp, Homo sapiens
tcagaaataatgaatgatgggg

SEQ ID NO: 8403724 - DNA, 22 bp, Homo sapiens
cagtgcagaggccagggaggat

SEQ ID NO: 8403725 - DNA, 22 bp, Homo sapiens
catgtacatgcctactatcaat

SEQ ID NO: 8403726 - DNA, 22 bp, Homo sapiens
tccagccaggatggcccaggga

SEQ ID NO: 8403727 - DNA, 22 bp, Homo sapiens
tccagccaggatggcccaggga

SEQ ID NO: 8403728 - DNA, 22 bp, Homo sapiens
tccagccacttgcacagttaaa

SEQ ID NO: 8403729 - DNA, 22 bp, Homo sapiens
catggcttgtcttgtcttctga

SEQ ID NO: 8403730 - DNA, 22 bp, Homo sapiens
tcagttgcacctgcatggtact

SEQ ID NO: 8403731 - DNA, 22 bp, Homo sapiens
catccccagagcagttccacta

SEQ ID NO: 8403732 - DNA, 22 bp, Homo sapiens
catccccaattagcgcccagct

SEQ ID NO: 8403733 - DNA, 22 bp, Homo sapiens
tcaggaagtgctgaggctgctt

SEQ ID NO: 8403734 - DNA, 22 bp, Homo sapiens
tcaggaagtggtaaaggatgtt

SEQ ID NO: 8403735 - DNA, 22 bp, Homo sapiens
tcaggaagtctcaattagctac

SEQ ID NO: 8403736 - DNA, 22 bp, Homo sapiens
tcaggaagtgcctaggctggcc

SEQ ID NO: 8403737 - DNA, 22 bp, Homo sapiens
tcaggaagttgaggcgtagaga

SEQ ID NO: 8403738 - DNA, 19 bp, Homo sapiens
tcaggaagttgatgaggtg

SEQ ID NO: 8403739 - DNA, 22 bp, Homo sapiens
catcacagatgttgtgtggagt

SEQ ID NO: 8403740 - DNA, 22 bp, Homo sapiens
tcagggcattcaagaggcctgg

SEQ ID NO: 8403741 - DNA, 22 bp, Homo sapiens
ccagccatgcacaaaccatgag

SEQ ID NO: 8403742 - DNA, 22 bp, Homo sapiens
tctcttgggaggaaagagagaa

SEQ ID NO: 8403743 - DNA, 22 bp, Homo sapiens
tctcttggtacacagatgatca

SEQ ID NO: 8403744 - DNA, 22 bp, Homo sapiens
tctcttggggaaagagaagaat

SEQ ID NO: 8403745 - DNA, 22 bp, Homo sapiens
ccagccttgggggatccaggac

SEQ ID NO: 8403746 - DNA, 22 bp, Homo sapiens
ccagcctggagggcagtggtgg

SEQ ID NO: 8403747 - DNA, 22 bp, Homo sapiens
ccagcctggagggcagtggtgg

SEQ ID NO: 8403748 - DNA, 22 bp, Homo sapiens
ccagctcctcttcccagtgtca

SEQ ID NO: 8403749 - DNA, 22 bp, Homo sapiens
ccagctcctgggtcttagtcag

SEQ ID NO: 8403750 - DNA, 22 bp, Homo sapiens
ccagctccttctgtctgtggag

SEQ ID NO: 8403751 - DNA, 23 bp, Homo sapiens
ccagctgtgcctggcccaggagc

SEQ ID NO: 8403752 - DNA, 18 bp, Homo sapiens
ccagctgtgcagcatctg

SEQ ID NO: 8403753 - DNA, 22 bp, Homo sapiens
ccagctggtctgtgctcatgtt

SEQ ID NO: 8403754 - DNA, 22 bp, Homo sapiens
ccagctggtgacatccccaacc

SEQ ID NO: 8403755 - DNA, 22 bp, Homo sapiens
ccagctgggattaagggaaaat

SEQ ID NO: 8403756 - DNA, 22 bp, Homo sapiens
ccagctggggaagtggggcata

SEQ ID NO: 8403757 - DNA, 22 bp, Homo sapiens
ccagctggtaagtgatggagcc

SEQ ID NO: 8403758 - DNA, 22 bp, Homo sapiens
tctgcctgaaccactcttggag

SEQ ID NO: 8403759 - DNA, 22 bp, Homo sapiens
tctgtcacccctgtttctggct

SEQ ID NO: 8403760 - DNA, 22 bp, Homo sapiens
tctgtcacttttatttactgaa

SEQ ID NO: 8403761 - DNA, 22 bp, Homo sapiens
ccaggaggcggaggttgcagcg

SEQ ID NO: 8403762 - DNA, 22 bp, Homo sapiens
ccaggaggcggaaggtacagtg

SEQ ID NO: 8403763 - DNA, 22 bp, Homo sapiens
ccaggaggcagaggttacagtg

SEQ ID NO: 8403764 - DNA, 22 bp, Homo sapiens
ccaggaggcagaggttgtagtg

SEQ ID NO: 8403765 - DNA, 22 bp, Homo sapiens
ccaggaagcctgtgtctctgga

SEQ ID NO: 8403766 - DNA, 22 bp, Homo sapiens
ccaggaagcctcagatgctgag

SEQ ID NO: 8403767 - DNA, 23 bp, Homo sapiens
ccaggaagaggccatccacagtc

SEQ ID NO: 8403768 - DNA, 22 bp, Homo sapiens
ccaggaagacacatgctcatcc

SEQ ID NO: 8403769 - DNA, 22 bp, Homo sapiens
ccaggaagatttattttggctt

SEQ ID NO: 8403770 - DNA, 22 bp, Homo sapiens
ccaggaagcataatgtagtggg

SEQ ID NO: 8403771 - DNA, 22 bp, Homo sapiens
ccaggaagaaacagtctttata

SEQ ID NO: 8403772 - DNA, 22 bp, Homo sapiens
ccaggaagcggtgagggctgcc

SEQ ID NO: 8403773 - DNA, 22 bp, Homo sapiens
ccaggaagcctttttctttgac

SEQ ID NO: 8403774 - DNA, 22 bp, Homo sapiens
ccaggaagctgtgagattccaa

SEQ ID NO: 8403775 - DNA, 22 bp, Homo sapiens
ccaggaaggaagcaggggtttc

SEQ ID NO: 8403776 - DNA, 22 bp, Homo sapiens
ccaggaagctgtctgatatgaa

SEQ ID NO: 8403777 - DNA, 22 bp, Homo sapiens
ccaggaagctctgctccacggg

SEQ ID NO: 8403778 - DNA, 22 bp, Homo sapiens
ccaggaggcagaagttgcagtg

SEQ ID NO: 8403779 - DNA, 22 bp, Homo sapiens
ccaggaggcaatatcaagtcca

SEQ ID NO: 8403780 - DNA, 21 bp, Homo sapiens
ccaggaaggactgagctccct

SEQ ID NO: 8403781 - DNA, 22 bp, Homo sapiens
ccaggaggatgattttaagagg

SEQ ID NO: 8403782 - DNA, 22 bp, Homo sapiens
ccaggaggatggttgttaggtg

SEQ ID NO: 8403783 - DNA, 22 bp, Homo sapiens
ccacagggtcagccactctgca

SEQ ID NO: 8403784 - DNA, 22 bp, Homo sapiens
ccacagggtcagccactctgca

SEQ ID NO: 8403785 - DNA, 22 bp, Homo sapiens
ccagaaaagcatctggttcttt

SEQ ID NO: 8403786 - DNA, 22 bp, Homo sapiens
ccagaagagatcacagttcttg

SEQ ID NO: 8403787 - DNA, 22 bp, Homo sapiens
ccagaagagatcacagttcttg

SEQ ID NO: 8403788 - DNA, 19 bp, Homo sapiens
ccagaagggcagctatgga

SEQ ID NO: 8403789 - DNA, 22 bp, Homo sapiens
ccagatggaaatgatgttctca

SEQ ID NO: 8403790 - DNA, 22 bp, Homo sapiens
ccagatggtccagagtctagcc

SEQ ID NO: 8403791 - DNA, 22 bp, Homo sapiens
ccagaggagcatggccttgaga

SEQ ID NO: 8403792 - DNA, 22 bp, Homo sapiens
ccagaggacttgggggctgaat

SEQ ID NO: 8403793 - DNA, 22 bp, Homo sapiens
ccagaggacttgggggctgaat

SEQ ID NO: 8403794 - DNA, 19 bp, Homo sapiens
ccagaggactgttaatgaa

SEQ ID NO: 8403795 - DNA, 22 bp, Homo sapiens
tcctcccaacttttccatctca

SEQ ID NO: 8403796 - DNA, 22 bp, Homo sapiens
ccaagggccatcctatcacttg

SEQ ID NO: 8403797 - DNA, 22 bp, Homo sapiens
ccacagaggacaactgcctggc

SEQ ID NO: 8403798 - DNA, 20 bp, Homo sapiens
ccacagaggacagggctgtg

SEQ ID NO: 8403799 - DNA, 22 bp, Homo sapiens
ccacagctgaaagcagaggctc

SEQ ID NO: 8403800 - DNA, 22 bp, Homo sapiens
ccacagccattccagggaggct

SEQ ID NO: 8403801 - DNA, 22 bp, Homo sapiens
ccacagccattccagggaggct

SEQ ID NO: 8403802 - DNA, 19 bp, Homo sapiens
ccacagcctgctgtcttcc

SEQ ID NO: 8403803 - DNA, 22 bp, Homo sapiens
ccacagcaccgctgccagtccc

SEQ ID NO: 8403804 - DNA, 22 bp, Homo sapiens
ccacagcatgcaggcctgacac

SEQ ID NO: 8403805 - DNA, 22 bp, Homo sapiens
catttagagaagattacaagga

SEQ ID NO: 8403806 - DNA, 22 bp, Homo sapiens
catttagaagtcttagaactat

SEQ ID NO: 8403807 - DNA, 22 bp, Homo sapiens
catttagaagtcttagaactat

SEQ ID NO: 8403808 - DNA, 22 bp, Homo sapiens
catttacagcagactgatgaaa

SEQ ID NO: 8403809 - DNA, 22 bp, Homo sapiens
cagctgagcatcactagtctgg

SEQ ID NO: 8403810 - DNA, 22 bp, Homo sapiens
gtggcctgtcagaagccgtggg

SEQ ID NO: 8403811 - DNA, 22 bp, Homo sapiens
cagctgagtggaccctagaggc

SEQ ID NO: 8403812 - DNA, 22 bp, Homo sapiens
cagctgagtttccaagtctgcc

SEQ ID NO: 8403813 - DNA, 22 bp, Homo sapiens
gtgggcaggtaggcaccagcta

SEQ ID NO: 8403814 - DNA, 22 bp, Homo sapiens
gtgggaagaacttcaagtggct

SEQ ID NO: 8403815 - DNA, 22 bp, Homo sapiens
gtgggaagaacttcaagtggct

SEQ ID NO: 8403816 - DNA, 22 bp, Homo sapiens
gtgggaagtctctcggaggaag

SEQ ID NO: 8403817 - DNA, 22 bp, Homo sapiens
gtggcgcagagggtggcagaga

SEQ ID NO: 8403818 - DNA, 19 bp, Homo sapiens
gtggccagggcaggggctg

SEQ ID NO: 8403819 - DNA, 19 bp, Homo sapiens
gtggccagggcaggggctg

SEQ ID NO: 8403820 - DNA, 22 bp, Homo sapiens
gtggccaggtcagggacttgtg

SEQ ID NO: 8403821 - DNA, 22 bp, Homo sapiens
gtggccagggcccacaggatga

SEQ ID NO: 8403822 - DNA, 22 bp, Homo sapiens
gtggccagtgggaatgggctca

SEQ ID NO: 8403823 - DNA, 22 bp, Homo sapiens
gtggccatgtgcttgcagggta

SEQ ID NO: 8403824 - DNA, 22 bp, Homo sapiens
gtggccatctttggccctgact

SEQ ID NO: 8403825 - DNA, 22 bp, Homo sapiens
gtggccatttggaaggcaagta

SEQ ID NO: 8403826 - DNA, 22 bp, Homo sapiens
gtggccagtggtgggcgccctg

SEQ ID NO: 8403827 - DNA, 22 bp, Homo sapiens
gtggccattttttcctagcaca

SEQ ID NO: 8403828 - DNA, 22 bp, Homo sapiens
gtggcaggttataagcatctca

SEQ ID NO: 8403829 - DNA, 22 bp, Homo sapiens
gtggcaggtcccattggagcag

SEQ ID NO: 8403830 - DNA, 22 bp, Homo sapiens
gtggcaggtcccattggagcag

SEQ ID NO: 8403831 - DNA, 22 bp, Homo sapiens
gtggcagagccaaggctggagc

SEQ ID NO: 8403832 - DNA, 22 bp, Homo sapiens
gtggcagggtgctcatcatgca

SEQ ID NO: 8403833 - DNA, 22 bp, Homo sapiens
gtggcagagcaggagacaggac

SEQ ID NO: 8403834 - DNA, 22 bp, Homo sapiens
gtggcagagaacaaggagaggt

SEQ ID NO: 8403835 - DNA, 22 bp, Homo sapiens
cagcccagcgcaaacaactggc

SEQ ID NO: 8403836 - DNA, 22 bp, Homo sapiens
cagcccagctctgactaaccct

SEQ ID NO: 8403837 - DNA, 22 bp, Homo sapiens
gtggcagaaactggcagaggag

SEQ ID NO: 8403838 - DNA, 22 bp, Homo sapiens
gtggcactgggtgagtgagtga

SEQ ID NO: 8403839 - DNA, 22 bp, Homo sapiens
cagctgctgaggaaggggttgg

SEQ ID NO: 8403840 - DNA, 22 bp, Homo sapiens
gtgggtggatcatgaggtcagg

SEQ ID NO: 8403841 - DNA, 22 bp, Homo sapiens
gtggggcatgcacgctgctcct

SEQ ID NO: 8403842 - DNA, 22 bp, Homo sapiens
gtggggagggagatgctgaagt

SEQ ID NO: 8403843 - DNA, 22 bp, Homo sapiens
gtggggagtgttctgtgattgg

SEQ ID NO: 8403844 - DNA, 22 bp, Homo sapiens
cagctgcccctccagggctggg

SEQ ID NO: 8403845 - DNA, 22 bp, Homo sapiens
cagctgcatgtctgtggtggtc

SEQ ID NO: 8403846 - DNA, 19 bp, Homo sapiens
gtgtagctattggtcaaaa

SEQ ID NO: 8403847 - DNA, 22 bp, Homo sapiens
cagctggggagagacatggcag

SEQ ID NO: 8403848 - DNA, 22 bp, Homo sapiens
cagctgggcctcctgagccctg

SEQ ID NO: 8403849 - DNA, 22 bp, Homo sapiens
cagctgggcctcctgagccctg

SEQ ID NO: 8403850 - DNA, 22 bp, Homo sapiens
cagctggggcagccacgtgcgg

SEQ ID NO: 8403851 - DNA, 22 bp, Homo sapiens
cagctggggagagacatggcag

SEQ ID NO: 8403852 - DNA, 22 bp, Homo sapiens
cagctggctgcggtgaggggac

SEQ ID NO: 8403853 - DNA, 19 bp, Homo sapiens
gtgtggcagagagtgacca

SEQ ID NO: 8403854 - DNA, 22 bp, Homo sapiens
caggaacaggctgatgggcagg

SEQ ID NO: 8403855 - DNA, 23 bp, Homo sapiens
caggaagcagatggggtagaaga

SEQ ID NO: 8403856 - DNA, 22 bp, Homo sapiens
caggaagcacagtgaggagacc

SEQ ID NO: 8403857 - DNA, 22 bp, Homo sapiens
gttggcctgaatggtcaagagg

SEQ ID NO: 8403858 - DNA, 22 bp, Homo sapiens
gttggccttgaggtggtagagt

SEQ ID NO: 8403859 - DNA, 22 bp, Homo sapiens
gttggccattaattggaggaca

SEQ ID NO: 8403860 - DNA, 22 bp, Homo sapiens
cagcttcccagctcactcataa

SEQ ID NO: 8403861 - DNA, 22 bp, Homo sapiens
caggaaacattcccataacaca

SEQ ID NO: 8403862 - DNA, 19 bp, Homo sapiens
caggaaacacctactgcta

SEQ ID NO: 8403863 - DNA, 22 bp, Homo sapiens
caggagctctcatcgtcagggc

SEQ ID NO: 8403864 - DNA, 22 bp, Homo sapiens
caggagtgagatgcgatcactt

SEQ ID NO: 8403865 - DNA, 22 bp, Homo sapiens
caggagtggtgtgagggactcc

SEQ ID NO: 8403866 - DNA, 22 bp, Homo sapiens
caggaggccaactgtgggactt

SEQ ID NO: 8403867 - DNA, 22 bp, Homo sapiens
caggaggctttgggatccaagt

SEQ ID NO: 8403868 - DNA, 22 bp, Homo sapiens
caggaggaaagttccactcaac

SEQ ID NO: 8403869 - DNA, 22 bp, Homo sapiens
caggaggcagcgctctcaggac

SEQ ID NO: 8403870 - DNA, 22 bp, Homo sapiens
taaatgtataggcactaaacct

SEQ ID NO: 8403871 - DNA, 22 bp, Homo sapiens
caggacaggccctgtggggtct

SEQ ID NO: 8403872 - DNA, 22 bp, Homo sapiens
caggacagctcaacacctcctc

SEQ ID NO: 8403873 - DNA, 22 bp, Homo sapiens
caggaatgatattcgaggagat

SEQ ID NO: 8403874 - DNA, 22 bp, Homo sapiens
caggaatgatctgctgagtgat

SEQ ID NO: 8403875 - DNA, 22 bp, Homo sapiens
caggaatgcattctagaatggc

SEQ ID NO: 8403876 - DNA, 22 bp, Homo sapiens
caggaatgccaaccagtgcatg

SEQ ID NO: 8403877 - DNA, 19 bp, Homo sapiens
caggaatgaggtaatggct

SEQ ID NO: 8403878 - DNA, 22 bp, Homo sapiens
caggaatgaggtcgtaagtgtc

SEQ ID NO: 8403879 - DNA, 22 bp, Homo sapiens
caggaatgagttctggtgctct

SEQ ID NO: 8403880 - DNA, 22 bp, Homo sapiens
caggaatgtagcagcgatggaa

SEQ ID NO: 8403881 - DNA, 22 bp, Homo sapiens
caggaatgtagcagcgatggaa

SEQ ID NO: 8403882 - DNA, 22 bp, Homo sapiens
caggaatgtatgatacagtggt

SEQ ID NO: 8403883 - DNA, 22 bp, Homo sapiens
caggaatggttgggactatgtt

SEQ ID NO: 8403884 - DNA, 22 bp, Homo sapiens
caggaatggttaatctaaagtg

SEQ ID NO: 8403885 - DNA, 18 bp, Homo sapiens
caggaatggatgggattt

SEQ ID NO: 8403886 - DNA, 22 bp, Homo sapiens
caggaatgccttcttcagccat

SEQ ID NO: 8403887 - DNA, 22 bp, Homo sapiens
caggaatggaggcatttatgaa

SEQ ID NO: 8403888 - DNA, 22 bp, Homo sapiens
caggaatgggtgacagtcagct

SEQ ID NO: 8403889 - DNA, 22 bp, Homo sapiens
caggacacagggtgtggctgat

SEQ ID NO: 8403890 - DNA, 22 bp, Homo sapiens
caggacacagaataaggcagtt

SEQ ID NO: 8403891 - DNA, 22 bp, Homo sapiens
caggaatgttgcatgtgatctt

SEQ ID NO: 8403892 - DNA, 22 bp, Homo sapiens
caggaatgtttgtgctccttta

SEQ ID NO: 8403893 - DNA, 22 bp, Homo sapiens
caggaatgtgagggttccctgc

SEQ ID NO: 8403894 - DNA, 22 bp, Homo sapiens
caggaatgtccttgtcatttca

SEQ ID NO: 8403895 - DNA, 22 bp, Homo sapiens
caggaatgtcccatccccttca

SEQ ID NO: 8403896 - DNA, 22 bp, Homo sapiens
caggaagctcttagcagtcacc

SEQ ID NO: 8403897 - DNA, 22 bp, Homo sapiens
caggaagccacaggacaggtag

SEQ ID NO: 8403898 - DNA, 22 bp, Homo sapiens
caggaatgactgcagatggggc

SEQ ID NO: 8403899 - DNA, 22 bp, Homo sapiens
caggaatgactgcagatggggc

SEQ ID NO: 8403900 - DNA, 22 bp, Homo sapiens
caggaatgaaaggtcagggttg

SEQ ID NO: 8403901 - DNA, 22 bp, Homo sapiens
caggaatgacccaacagtttca

SEQ ID NO: 8403902 - DNA, 22 bp, Homo sapiens
caggaagctgccggtgagcgag

SEQ ID NO: 8403903 - DNA, 22 bp, Homo sapiens
caggaagctgtgaaggagacgg

SEQ ID NO: 8403904 - DNA, 22 bp, Homo sapiens
caggaagggggatccttggaag

SEQ ID NO: 8403905 - DNA, 22 bp, Homo sapiens
caggaaggaaagggtgtggaga

SEQ ID NO: 8403906 - DNA, 22 bp, Homo sapiens
caggacccatcagccaggcact

SEQ ID NO: 8403907 - DNA, 22 bp, Homo sapiens
caggacagtttgctttgccctg

SEQ ID NO: 8403908 - DNA, 22 bp, Homo sapiens
caggacagtgcaggtccatcct

SEQ ID NO: 8403909 - DNA, 22 bp, Homo sapiens
caggcacaagaagcaaatgtta

SEQ ID NO: 8403910 - DNA, 22 bp, Homo sapiens
caggcacaaatttctagataag

SEQ ID NO: 8403911 - DNA, 22 bp, Homo sapiens
caggcacaatgagcgccatctt

SEQ ID NO: 8403912 - DNA, 22 bp, Homo sapiens
caggcacagctgggcaattgcg

SEQ ID NO: 8403913 - DNA, 22 bp, Homo sapiens
caggcacaggggaatgtctttt

SEQ ID NO: 8403914 - DNA, 22 bp, Homo sapiens
caggcacagagagaataccttt

SEQ ID NO: 8403915 - DNA, 22 bp, Homo sapiens
caggcacatgggagctcatcat

SEQ ID NO: 8403916 - DNA, 17 bp, Homo sapiens
caggcacatgaagccag

SEQ ID NO: 8403917 - DNA, 22 bp, Homo sapiens
caggcacagtgttgctgttcaa

SEQ ID NO: 8403918 - DNA, 22 bp, Homo sapiens
caggcacagtggggtcctctct

SEQ ID NO: 8403919 - DNA, 22 bp, Homo sapiens
caggcaagattagagatgagca

SEQ ID NO: 8403920 - DNA, 22 bp, Homo sapiens
caggcacaaaaggaccccagca

SEQ ID NO: 8403921 - DNA, 22 bp, Homo sapiens
caggcaaggaggcactgaggga

SEQ ID NO: 8403922 - DNA, 22 bp, Homo sapiens
taaggcagaaatatgagcaggg

SEQ ID NO: 8403923 - DNA, 22 bp, Homo sapiens
taaggcagccgctcagagaggt

SEQ ID NO: 8403924 - DNA, 22 bp, Homo sapiens
taacatttgctgtctcctatgt

SEQ ID NO: 8403925 - DNA, 22 bp, Homo sapiens
taacatttagaaagtgtccatt

SEQ ID NO: 8403926 - DNA, 22 bp, Homo sapiens
caggatggtggcatgatcagaa

SEQ ID NO: 8403927 - DNA, 22 bp, Homo sapiens
caggatggtctcgatctcctga

SEQ ID NO: 8403928 - DNA, 22 bp, Homo sapiens
tacatatgaactttataacttg

SEQ ID NO: 8403929 - DNA, 22 bp, Homo sapiens
tacaagtttatccatcattgtt

SEQ ID NO: 8403930 - DNA, 22 bp, Homo sapiens
caggcagctgcgacaagagagc

SEQ ID NO: 8403931 - DNA, 22 bp, Homo sapiens
caggcagctgggtcaccgtccc

SEQ ID NO: 8403932 - DNA, 22 bp, Homo sapiens
caggcagctgctgggttcagcc

SEQ ID NO: 8403933 - DNA, 22 bp, Homo sapiens
caggcagctgctgggttcagcc

SEQ ID NO: 8403934 - DNA, 22 bp, Homo sapiens
caggcagctgactgtcagatat

SEQ ID NO: 8403935 - DNA, 22 bp, Homo sapiens
caggcagccctgcaccaagtgt

SEQ ID NO: 8403936 - DNA, 22 bp, Homo sapiens
tggcagatttaacattggaact

SEQ ID NO: 8403937 - DNA, 22 bp, Homo sapiens
tggcagatgtggcatagagcat

SEQ ID NO: 8403938 - DNA, 22 bp, Homo sapiens
tggcagaggtatattgggagga

SEQ ID NO: 8403939 - DNA, 22 bp, Homo sapiens
tggcacaggagcactgccctgg

SEQ ID NO: 8403940 - DNA, 22 bp, Homo sapiens
tggcacaggcggtaagggtgtg

SEQ ID NO: 8403941 - DNA, 22 bp, Homo sapiens
tggcacaggatctcagcggcca

SEQ ID NO: 8403942 - DNA, 23 bp, Homo sapiens
tggcaaggaatgggatggagact

SEQ ID NO: 8403943 - DNA, 22 bp, Homo sapiens
tggccacacccacctagaggag

SEQ ID NO: 8403944 - DNA, 23 bp, Homo sapiens
tggccaggcataaaggtgggtgg

SEQ ID NO: 8403945 - DNA, 23 bp, Homo sapiens
tggccaggcataaaggtgggtgg

SEQ ID NO: 8403946 - DNA, 22 bp, Homo sapiens
tggccaggcaggtagaacggcc

SEQ ID NO: 8403947 - DNA, 22 bp, Homo sapiens
tggccaggcaggtagaacggcc

SEQ ID NO: 8403948 - DNA, 18 bp, Homo sapiens
tggagctgagggcaatgc

SEQ ID NO: 8403949 - DNA, 22 bp, Homo sapiens
tggctcagctgactcggcttct

SEQ ID NO: 8403950 - DNA, 22 bp, Homo sapiens
tggctcagctgtcacagcctgg

SEQ ID NO: 8403951 - DNA, 22 bp, Homo sapiens
tggctcagtttctgcccagctg

SEQ ID NO: 8403952 - DNA, 22 bp, Homo sapiens
tggctcagtttgggggattgaa

SEQ ID NO: 8403953 - DNA, 22 bp, Homo sapiens
tggctcagtttagcagctcagt

SEQ ID NO: 8403954 - DNA, 22 bp, Homo sapiens
tggctcagtttcagtcctggtt

SEQ ID NO: 8403955 - DNA, 22 bp, Homo sapiens
tggccccatcaagggatgagtt

SEQ ID NO: 8403956 - DNA, 22 bp, Homo sapiens
tggcccgaagatccgagggtca

SEQ ID NO: 8403957 - DNA, 22 bp, Homo sapiens
tggccccattttacagatgaaa

SEQ ID NO: 8403958 - DNA, 22 bp, Homo sapiens
tggccccattttacagatgaaa

SEQ ID NO: 8403959 - DNA, 22 bp, Homo sapiens
cctccagcattactggcccatg

SEQ ID NO: 8403960 - DNA, 22 bp, Homo sapiens
cctccagactttggccatcctc

SEQ ID NO: 8403961 - DNA, 22 bp, Homo sapiens
cctccagcgcgatccactccgg

SEQ ID NO: 8403962 - DNA, 20 bp, Homo sapiens
cctctctgcatgctccctga

SEQ ID NO: 8403963 - DNA, 19 bp, Homo sapiens
ccctcaggtctgagcagtc

SEQ ID NO: 8403964 - DNA, 22 bp, Homo sapiens
cccccaccgtgttcctgctcgg

SEQ ID NO: 8403965 - DNA, 22 bp, Homo sapiens
cccccacctgaggacagtctta

SEQ ID NO: 8403966 - DNA, 22 bp, Homo sapiens
ccccaggcctgttggatggcgc

SEQ ID NO: 8403967 - DNA, 22 bp, Homo sapiens
ccccaggcagggcctaacagag

SEQ ID NO: 8403968 - DNA, 22 bp, Homo sapiens
ccccagcaggaatacaggggtc

SEQ ID NO: 8403969 - DNA, 22 bp, Homo sapiens
ccccagcatatcatggtttcgt

SEQ ID NO: 8403970 - DNA, 18 bp, Homo sapiens
ccccagcagtgtggtgcc

SEQ ID NO: 8403971 - DNA, 22 bp, Homo sapiens
cccaggctcctagaggcccaga

SEQ ID NO: 8403972 - DNA, 19 bp, Homo sapiens
tgctgactgagctgcaaaa

SEQ ID NO: 8403973 - DNA, 22 bp, Homo sapiens
tgctgagacaacaggaaacaag

SEQ ID NO: 8403974 - DNA, 20 bp, Homo sapiens
cccaggcagagctagcggca

SEQ ID NO: 8403975 - DNA, 22 bp, Homo sapiens
cccaggcagcccttctgacgca

SEQ ID NO: 8403976 - DNA, 22 bp, Homo sapiens
cccaggcagtgtgtgcatgcgt

SEQ ID NO: 8403977 - DNA, 22 bp, Homo sapiens
cccaggcagtgctgatccctca

SEQ ID NO: 8403978 - DNA, 22 bp, Homo sapiens
cccaggcagggacgtgctctgg

SEQ ID NO: 8403979 - DNA, 22 bp, Homo sapiens
cccaggcagggacgtgctctgg

SEQ ID NO: 8403980 - DNA, 19 bp, Homo sapiens
cccagcttgaccacctgct

SEQ ID NO: 8403981 - DNA, 19 bp, Homo sapiens
cccagctgttcttccacca

SEQ ID NO: 8403982 - DNA, 18 bp, Homo sapiens
cccagcttagcgcccctc

SEQ ID NO: 8403983 - DNA, 22 bp, Homo sapiens
cccagcttgtctgattcagcct

SEQ ID NO: 8403984 - DNA, 22 bp, Homo sapiens
cccagctgcacctctatggcct

SEQ ID NO: 8403985 - DNA, 22 bp, Homo sapiens
cccagctgatttttgcagagat

SEQ ID NO: 8403986 - DNA, 23 bp, Homo sapiens
cccagctgagacttcctgaactc

SEQ ID NO: 8403987 - DNA, 17 bp, Homo sapiens
cccagctggcagtgccg

SEQ ID NO: 8403988 - DNA, 17 bp, Homo sapiens
cccagctggcagtgccg

SEQ ID NO: 8403989 - DNA, 17 bp, Homo sapiens
cccagctgcgtctgagg

SEQ ID NO: 8403990 - DNA, 23 bp, Homo sapiens
cccagctgcagacaagggagggt

SEQ ID NO: 8403991 - DNA, 22 bp, Homo sapiens
cctggctgccgagtgtgcagcg

SEQ ID NO: 8403992 - DNA, 22 bp, Homo sapiens
cctggctgtggcggtgctctca

SEQ ID NO: 8403993 - DNA, 21 bp, Homo sapiens
cctgggagatcagctgccttc

SEQ ID NO: 8403994 - DNA, 22 bp, Homo sapiens
cctgggagagtctgtggtctcc

SEQ ID NO: 8403995 - DNA, 21 bp, Homo sapiens
tgtgccagggatggggagccc

SEQ ID NO: 8403996 - DNA, 22 bp, Homo sapiens
tgtgccagcctctggctgtgtc

SEQ ID NO: 8403997 - DNA, 22 bp, Homo sapiens
tgtgctggggtccagctgagcc

SEQ ID NO: 8403998 - DNA, 22 bp, Homo sapiens
tgtgctgggagatagagggagg

SEQ ID NO: 8403999 - DNA, 22 bp, Homo sapiens
tgtgcccattacacagaggcat

SEQ ID NO: 8404000 - DNA, 20 bp, Homo sapiens
tgtggcaggatgagggcgga

SEQ ID NO: 8404001 - DNA, 18 bp, Homo sapiens
tgtggcaggggtgggaga

SEQ ID NO: 8404002 - DNA, 22 bp, Homo sapiens
cctgggaggcagaggttgcagt

SEQ ID NO: 8404003 - DNA, 22 bp, Homo sapiens
cctgggaggcagaggttgcagt

SEQ ID NO: 8404004 - DNA, 22 bp, Homo sapiens
tgtgggaaatgggagtggaaga

SEQ ID NO: 8404005 - DNA, 22 bp, Homo sapiens
tgtggctgctcctgggtggtca

SEQ ID NO: 8404006 - DNA, 22 bp, Homo sapiens
cctgggaggcggaggttgcagt

SEQ ID NO: 8404007 - DNA, 22 bp, Homo sapiens
cctgggaggcggaggttgcagt

SEQ ID NO: 8404008 - DNA, 22 bp, Homo sapiens
cctgggaggcggaggttgcagg

SEQ ID NO: 8404009 - DNA, 22 bp, Homo sapiens
cctgggaggcggaggttgcagg

SEQ ID NO: 8404010 - DNA, 22 bp, Homo sapiens
tgtgtgggtggtaaggaaggcc

SEQ ID NO: 8404011 - DNA, 22 bp, Homo sapiens
tgtgtggggaaggaaggagctg

SEQ ID NO: 8404012 - DNA, 22 bp, Homo sapiens
cctggcctgtgaatctgagagc

SEQ ID NO: 8404013 - DNA, 22 bp, Homo sapiens
cctggccagcgccggctgctcg

SEQ ID NO: 8404014 - DNA, 22 bp, Homo sapiens
cctggccaggctccaagtactg

SEQ ID NO: 8404015 - DNA, 22 bp, Homo sapiens
cctggccagctaattgcccatc

SEQ ID NO: 8404016 - DNA, 22 bp, Homo sapiens
cctggccaggcatggagtcaca

SEQ ID NO: 8404017 - DNA, 22 bp, Homo sapiens
cctggccagggtctgggctgct

SEQ ID NO: 8404018 - DNA, 22 bp, Homo sapiens
cctggccatagggcccaggaaa

SEQ ID NO: 8404019 - DNA, 22 bp, Homo sapiens
tgtccatggagaagctcagggc

SEQ ID NO: 8404020 - DNA, 22 bp, Homo sapiens
tgtccatgggcgtcaggcagga

SEQ ID NO: 8404021 - DNA, 22 bp, Homo sapiens
tgtccatgcgtatccagggagc

SEQ ID NO: 8404022 - DNA, 22 bp, Homo sapiens
tgtcccagacataagtggacat

SEQ ID NO: 8404023 - DNA, 22 bp, Homo sapiens
tgtcctcatcttttccagaaat

SEQ ID NO: 8404024 - DNA, 20 bp, Homo sapiens
tggtcctcacaggtcctccc

SEQ ID NO: 8404025 - DNA, 22 bp, Homo sapiens
tggtaggagatatggtctccga

SEQ ID NO: 8404026 - DNA, 22 bp, Homo sapiens
tggtcccattgttctgcccagg

SEQ ID NO: 8404027 - DNA, 22 bp, Homo sapiens
tggtgggacatctgaggagagg

SEQ ID NO: 8404028 - DNA, 22 bp, Homo sapiens
tggtggccttgatggcatctgc

SEQ ID NO: 8404029 - DNA, 22 bp, Homo sapiens
tggtggccgaagccctctctca

SEQ ID NO: 8404030 - DNA, 16 bp, Homo sapiens
tggtggccatagttat

SEQ ID NO: 8404031 - DNA, 22 bp, Homo sapiens
tggtggccccctcaagtctttg

SEQ ID NO: 8404032 - DNA, 22 bp, Homo sapiens
tggtgctggtgccacgcccctt

SEQ ID NO: 8404033 - DNA, 22 bp, Homo sapiens
tggtgctgataatggcaggatt

SEQ ID NO: 8404034 - DNA, 22 bp, Homo sapiens
tggtgctgcaggtgggcacagt

SEQ ID NO: 8404035 - DNA, 22 bp, Homo sapiens
cctggcacatagtgggcatgca

SEQ ID NO: 8404036 - DNA, 22 bp, Homo sapiens
ctggccagttgtcctggcttgg

SEQ ID NO: 8404037 - DNA, 22 bp, Homo sapiens
ctggccatgttgcctctgagac

SEQ ID NO: 8404038 - DNA, 22 bp, Homo sapiens
ctggcctgagcacagcggctgc

SEQ ID NO: 8404039 - DNA, 22 bp, Homo sapiens
ctggacagtgggcagaggagac

SEQ ID NO: 8404040 - DNA, 22 bp, Homo sapiens
ctggaggcaaagcagaggcatg

SEQ ID NO: 8404041 - DNA, 22 bp, Homo sapiens
ctggaggttgggtccaggccag

SEQ ID NO: 8404042 - DNA, 22 bp, Homo sapiens
ctggagggactttctcacggat

SEQ ID NO: 8404043 - DNA, 22 bp, Homo sapiens
ctggaggggccatccacagtct

SEQ ID NO: 8404044 - DNA, 21 bp, Homo sapiens
ctggagggtagagttgggctg

SEQ ID NO: 8404045 - DNA, 22 bp, Homo sapiens
ctggaaaatgaagaagcagagg

SEQ ID NO: 8404046 - DNA, 22 bp, Homo sapiens
ctggaaagacagagggcatggg

SEQ ID NO: 8404047 - DNA, 22 bp, Homo sapiens
ctggaaagagatggcagggttt

SEQ ID NO: 8404048 - DNA, 22 bp, Homo sapiens
ctggacagaagtggctgggcag

SEQ ID NO: 8404049 - DNA, 22 bp, Homo sapiens
ctggacaggctggggactgcaa

SEQ ID NO: 8404050 - DNA, 22 bp, Homo sapiens
ctgaggcactgtcagctgaggc

SEQ ID NO: 8404051 - DNA, 22 bp, Homo sapiens
ctgaggcacctacagtctcggg

SEQ ID NO: 8404052 - DNA, 22 bp, Homo sapiens
ctgaggatctactgtgggctca

SEQ ID NO: 8404053 - DNA, 19 bp, Homo sapiens
ctgaggcaagtggtggtca

SEQ ID NO: 8404054 - DNA, 22 bp, Homo sapiens
ctgaggagtgggtgggcagtga

SEQ ID NO: 8404055 - DNA, 19 bp, Homo sapiens
ctctccagctccagtagct

SEQ ID NO: 8404056 - DNA, 22 bp, Homo sapiens
tttagacacactttgtatattt

SEQ ID NO: 8404057 - DNA, 22 bp, Homo sapiens
tttagacaggggcaaaataagg

SEQ ID NO: 8404058 - DNA, 22 bp, Homo sapiens
ttggtaggggactagagtccag

SEQ ID NO: 8404059 - DNA, 22 bp, Homo sapiens
ctccagggaggagcacgggttc

SEQ ID NO: 8404060 - DNA, 22 bp, Homo sapiens
ctccagggctaccaggttttag

SEQ ID NO: 8404061 - DNA, 22 bp, Homo sapiens
ctccagggatgagacagagtag

SEQ ID NO: 8404062 - DNA, 22 bp, Homo sapiens
ctccagggaggtctgcaggact

SEQ ID NO: 8404063 - DNA, 22 bp, Homo sapiens
ctccaggtagttatttcaagaa

SEQ ID NO: 8404064 - DNA, 21 bp, Homo sapiens
cggctcagtgcctgctccttc

SEQ ID NO: 8404065 - DNA, 22 bp, Homo sapiens
cggctgggtagaggtgccgggt

SEQ ID NO: 8404066 - DNA, 22 bp, Homo sapiens
ttcagaaaggttaatctggatt

SEQ ID NO: 8404067 - DNA, 22 bp, Homo sapiens
ttcacatggcaatagagaggga

SEQ ID NO: 8404068 - DNA, 22 bp, Homo sapiens
ttcacatgttggacatagagga

SEQ ID NO: 8404069 - DNA, 22 bp, Homo sapiens
cgctgggggaacagcgagggtg

SEQ ID NO: 8404070 - DNA, 22 bp, Homo sapiens
cggaatgtccttcttaaggtgt

SEQ ID NO: 8404071 - DNA, 22 bp, Homo sapiens
cggaatgtcccaggtcctgatc

SEQ ID NO: 8404072 - DNA, 22 bp, Homo sapiens
cggctcaggccacaggacggca

SEQ ID NO: 8404073 - DNA, 22 bp, Homo sapiens
cgctgtgcctggcacccagtgt

SEQ ID NO: 8404074 - DNA, 22 bp, Homo sapiens
ctaagggcttgctggagccagg

SEQ ID NO: 8404075 - DNA, 22 bp, Homo sapiens
ctaattgtaagctccttgaggg

SEQ ID NO: 8404076 - DNA, 22 bp, Homo sapiens
ttgaggagtggcgctggactta

SEQ ID NO: 8404077 - DNA, 22 bp, Homo sapiens
ttgaggagtacaaagcatgctt

SEQ ID NO: 8404078 - DNA, 22 bp, Homo sapiens
ctcagcactgacccaggagatg

SEQ ID NO: 8404079 - DNA, 22 bp, Homo sapiens
ctaggctggagtgcagtggcat

SEQ ID NO: 8404080 - DNA, 22 bp, Homo sapiens
ctaggctggagtgcagtggcac

SEQ ID NO: 8404081 - DNA, 22 bp, Homo sapiens
gctgaggattacttgaagtcag

SEQ ID NO: 8404082 - DNA, 22 bp, Homo sapiens
gctgaggatatagcaggaacaa

SEQ ID NO: 8404083 - DNA, 22 bp, Homo sapiens
gctgagctagaaaaggaccaca

SEQ ID NO: 8404084 - DNA, 22 bp, Homo sapiens
gctgagctgaggcagggctggg

SEQ ID NO: 8404085 - DNA, 22 bp, Homo sapiens
gctgcctgatcatacaccaggg

SEQ ID NO: 8404086 - DNA, 22 bp, Homo sapiens
gctgcctggatttgcaatcctc

SEQ ID NO: 8404087 - DNA, 22 bp, Homo sapiens
gctgcctggctttagtccactt

SEQ ID NO: 8404088 - DNA, 21 bp, Homo sapiens
gctgctcgagatccagtgctt

SEQ ID NO: 8404089 - DNA, 22 bp, Homo sapiens
gctgggcaaggctgaagctacc

SEQ ID NO: 8404090 - DNA, 22 bp, Homo sapiens
gctgggcaatgccagagaggag

SEQ ID NO: 8404091 - DNA, 22 bp, Homo sapiens
gctgggcaccggagagacccca

SEQ ID NO: 8404092 - DNA, 22 bp, Homo sapiens
gctgggcaggcctcgtgagggc

SEQ ID NO: 8404093 - DNA, 22 bp, Homo sapiens
gctggcctgggcagcctgtcgg

SEQ ID NO: 8404094 - DNA, 22 bp, Homo sapiens
gctggcctgggcagaggctatg

SEQ ID NO: 8404095 - DNA, 22 bp, Homo sapiens
gctggcctgggcagaggctatg

SEQ ID NO: 8404096 - DNA, 22 bp, Homo sapiens
gctggcctgcgagggcaggctg

SEQ ID NO: 8404097 - DNA, 22 bp, Homo sapiens
gctgggagtgggcaagatgaga

SEQ ID NO: 8404098 - DNA, 22 bp, Homo sapiens
gctggcctgcaaagcccggctg

SEQ ID NO: 8404099 - DNA, 22 bp, Homo sapiens
gctggcctgaccagccacaggc

SEQ ID NO: 8404100 - DNA, 22 bp, Homo sapiens
gctggagatagaatggccactg

SEQ ID NO: 8404101 - DNA, 22 bp, Homo sapiens
gctggagatgctatgcagaggg

SEQ ID NO: 8404102 - DNA, 22 bp, Homo sapiens
gctggagatagaatggccactg

SEQ ID NO: 8404103 - DNA, 22 bp, Homo sapiens
gctgagattacgggcatgagcc

SEQ ID NO: 8404104 - DNA, 22 bp, Homo sapiens
gctgagatgtcgttagatatct

SEQ ID NO: 8404105 - DNA, 22 bp, Homo sapiens
gctgagcacacctagggtagag

SEQ ID NO: 8404106 - DNA, 22 bp, Homo sapiens
gcctgggaagactaagtgggag

SEQ ID NO: 8404107 - DNA, 19 bp, Homo sapiens
gcctgggatgggcagaact

SEQ ID NO: 8404108 - DNA, 22 bp, Homo sapiens
gcctgggattctcaaaggggtg

SEQ ID NO: 8404109 - DNA, 22 bp, Homo sapiens
gcctgtgtttttaactctagga

SEQ ID NO: 8404110 - DNA, 22 bp, Homo sapiens
gcctgtgtctgggtggccagag

SEQ ID NO: 8404111 - DNA, 21 bp, Homo sapiens
gcctgggaaatctgggaagcc

SEQ ID NO: 8404112 - DNA, 22 bp, Homo sapiens
gcctggcaggcctgggccagca

SEQ ID NO: 8404113 - DNA, 22 bp, Homo sapiens
gcctggcagtggggccctggga

SEQ ID NO: 8404114 - DNA, 22 bp, Homo sapiens
gcctggcattggagccggggca

SEQ ID NO: 8404115 - DNA, 22 bp, Homo sapiens
gcctggcagggcccggacggca

SEQ ID NO: 8404116 - DNA, 22 bp, Homo sapiens
gcctggcaggggcctgggagtg

SEQ ID NO: 8404117 - DNA, 22 bp, Homo sapiens
gcctgccttttggaggcacatt

SEQ ID NO: 8404118 - DNA, 22 bp, Homo sapiens
gcccaggatctgctcagatcat

SEQ ID NO: 8404119 - DNA, 22 bp, Homo sapiens
gccatggggctcagctgcacta

SEQ ID NO: 8404120 - DNA, 21 bp, Homo sapiens
gccatttcacacagacatttg

SEQ ID NO: 8404121 - DNA, 21 bp, Homo sapiens
gccatttcacacagacatttg

SEQ ID NO: 8404122 - DNA, 22 bp, Homo sapiens
gccagttcctgtggagtcagag

SEQ ID NO: 8404123 - DNA, 18 bp, Homo sapiens
gccagtgggtccaggtgc

SEQ ID NO: 8404124 - DNA, 22 bp, Homo sapiens
gccaggctgactcccccggcct

SEQ ID NO: 8404125 - DNA, 22 bp, Homo sapiens
gccaggctgctggctgctgtcc

SEQ ID NO: 8404126 - DNA, 22 bp, Homo sapiens
gccaggctgctccagggaggcc

SEQ ID NO: 8404127 - DNA, 22 bp, Homo sapiens
gcccaggctggagtgcagtggc

SEQ ID NO: 8404128 - DNA, 22 bp, Homo sapiens
gccgggttcaagccattctcct

SEQ ID NO: 8404129 - DNA, 22 bp, Homo sapiens
gccggggctggggagagacatg

SEQ ID NO: 8404130 - DNA, 22 bp, Homo sapiens
gcaggggctgagcaccagcggg

SEQ ID NO: 8404131 - DNA, 22 bp, Homo sapiens
gcagggcagacctccagcctat

SEQ ID NO: 8404132 - DNA, 22 bp, Homo sapiens
gcagggcacagacagtgccaag

SEQ ID NO: 8404133 - DNA, 22 bp, Homo sapiens
gcagggcacagacagtgccaag

SEQ ID NO: 8404134 - DNA, 22 bp, Homo sapiens
gcagggcacaaggacgcacagg

SEQ ID NO: 8404135 - DNA, 22 bp, Homo sapiens
gcagggacgccagggacagcaa

SEQ ID NO: 8404136 - DNA, 22 bp, Homo sapiens
gcaggctggtctgaccatccct

SEQ ID NO: 8404137 - DNA, 21 bp, Homo sapiens
gcaggctggtcaaacctcagt

SEQ ID NO: 8404138 - DNA, 22 bp, Homo sapiens
gcaggctggaggctgttctggg

SEQ ID NO: 8404139 - DNA, 22 bp, Homo sapiens
gcaggagctgctctcctgacga

SEQ ID NO: 8404140 - DNA, 22 bp, Homo sapiens
gcagcgtggggacaggagctca

SEQ ID NO: 8404141 - DNA, 22 bp, Homo sapiens
gcagctgaaagggatctctaca

SEQ ID NO: 8404142 - DNA, 22 bp, Homo sapiens
gcagctgaagctgcagttccag

SEQ ID NO: 8404143 - DNA, 22 bp, Homo sapiens
gcagctgaatgtccattgctgc

SEQ ID NO: 8404144 - DNA, 22 bp, Homo sapiens
gcagggtgatagtgaggctcag

SEQ ID NO: 8404145 - DNA, 22 bp, Homo sapiens
gcagggtgccgacttcagggat

SEQ ID NO: 8404146 - DNA, 22 bp, Homo sapiens
gcagggtggatggcagggccag

SEQ ID NO: 8404147 - DNA, 19 bp, Homo sapiens
gcaggtggatgtggtcagc

SEQ ID NO: 8404148 - DNA, 22 bp, Homo sapiens
gcagtgggcaacaagagctgga

SEQ ID NO: 8404149 - DNA, 22 bp, Homo sapiens
gcagtggggaatgctggggaga

SEQ ID NO: 8404150 - DNA, 22 bp, Homo sapiens
gccacaggctccagcatcagta

SEQ ID NO: 8404151 - DNA, 22 bp, Homo sapiens
gccacagcccgagcaccatgag

SEQ ID NO: 8404152 - DNA, 22 bp, Homo sapiens
gcatgtggcccaaggaggctgt

SEQ ID NO: 8404153 - DNA, 22 bp, Homo sapiens
gcatgtggccttcaggctggaa

SEQ ID NO: 8404154 - DNA, 22 bp, Homo sapiens
gcatgggaggacagtctgggct

SEQ ID NO: 8404155 - DNA, 22 bp, Homo sapiens
gcactttaaagtttggtggcat

SEQ ID NO: 8404156 - DNA, 22 bp, Homo sapiens
gcactttagcattggtttacac

SEQ ID NO: 8404157 - DNA, 22 bp, Homo sapiens
gcactttaaatgttcacggaaa

SEQ ID NO: 8404158 - DNA, 22 bp, Homo sapiens
gcactttatagtagaaagagca

SEQ ID NO: 8404159 - DNA, 22 bp, Homo sapiens
gcaatgagcacccagagggcag

SEQ ID NO: 8404160 - DNA, 22 bp, Homo sapiens
gatttggcctttcgcatggtat

SEQ ID NO: 8404161 - DNA, 22 bp, Homo sapiens
gatgctgagctgtatggctggt

SEQ ID NO: 8404162 - DNA, 22 bp, Homo sapiens
gatgctgattttactgttttct

SEQ ID NO: 8404163 - DNA, 22 bp, Homo sapiens
gatggaatgaatggcagataca

SEQ ID NO: 8404164 - DNA, 21 bp, Homo sapiens
gatgtacatcaagcactttgc

SEQ ID NO: 8404165 - DNA, 22 bp, Homo sapiens
gatgtacaggagtttttcaagg

SEQ ID NO: 8404166 - DNA, 22 bp, Homo sapiens
gatgtacatgcaagcacttaga

SEQ ID NO: 8404167 - DNA, 22 bp, Homo sapiens
gatgtacatggattcctttcct

SEQ ID NO: 8404168 - DNA, 22 bp, Homo sapiens
gatgtacaagattgtaggaatg

SEQ ID NO: 8404169 - DNA, 22 bp, Homo sapiens
gatgtacaaagagaggatttca

SEQ ID NO: 8404170 - DNA, 22 bp, Homo sapiens
gatgtacactcagaaaagtcat

SEQ ID NO: 8404171 - DNA, 22 bp, Homo sapiens
gatgtacaatgtcactatgacc

SEQ ID NO: 8404172 - DNA, 22 bp, Homo sapiens
gatgtacaagtaaaatatgtgt

SEQ ID NO: 8404173 - DNA, 22 bp, Homo sapiens
gatttacaaagctctctagtgt

SEQ ID NO: 8404174 - DNA, 22 bp, Homo sapiens
gatttacagatctaagggtcac

SEQ ID NO: 8404175 - DNA, 22 bp, Homo sapiens
gattggcctagtccctattata

SEQ ID NO: 8404176 - DNA, 22 bp, Homo sapiens
gatttacagctatacccaatgg

SEQ ID NO: 8404177 - DNA, 22 bp, Homo sapiens
gatttacaggttaggtcctgta

SEQ ID NO: 8404178 - DNA, 22 bp, Homo sapiens
gacaggaggcagagctcaggtg

SEQ ID NO: 8404179 - DNA, 22 bp, Homo sapiens
gaccatgcttctccctggtgtg

SEQ ID NO: 8404180 - DNA, 22 bp, Homo sapiens
gacttgtttcaggtttgattgc

SEQ ID NO: 8404181 - DNA, 22 bp, Homo sapiens
gacccagggtggtcacctgaaa

SEQ ID NO: 8404182 - DNA, 22 bp, Homo sapiens
gacaggaacataaatgtaggag

SEQ ID NO: 8404183 - DNA, 22 bp, Homo sapiens
gacacagctttctgaagagcat

SEQ ID NO: 8404184 - DNA, 22 bp, Homo sapiens
gaaggctgagtgggtacggagg

SEQ ID NO: 8404185 - DNA, 22 bp, Homo sapiens
gaagttacaggcttatgggggc

SEQ ID NO: 8404186 - DNA, 22 bp, Homo sapiens
gaagtgcaaaaccacatggtaa

SEQ ID NO: 8404187 - DNA, 22 bp, Homo sapiens
gaaggagaggattgtgaggctg

SEQ ID NO: 8404188 - DNA, 22 bp, Homo sapiens
gaaagggataccatgttacttg

SEQ ID NO: 8404189 - DNA, 22 bp, Homo sapiens
gaaagttacagaaaccattagt

SEQ ID NO: 8404190 - DNA, 22 bp, Homo sapiens
gaaagttatatcatgattttag

SEQ ID NO: 8404191 - DNA, 22 bp, Homo sapiens
gaaagttattcagcctctctga

SEQ ID NO: 8404192 - DNA, 22 bp, Homo sapiens
gaaagttcacacatccacatgg

SEQ ID NO: 8404193 - DNA, 22 bp, Homo sapiens
gaaagttattgaaccttattta

SEQ ID NO: 8404194 - DNA, 22 bp, Homo sapiens
gaaaggctaaaattataagggt

SEQ ID NO: 8404195 - DNA, 22 bp, Homo sapiens
gaaagggaatggatttctgttg

SEQ ID NO: 8404196 - DNA, 22 bp, Homo sapiens
gaaaggcttaaattgtaagggc

SEQ ID NO: 8404197 - DNA, 22 bp, Homo sapiens
gaaaggctcactttagatcatg

SEQ ID NO: 8404198 - DNA, 18 bp, Homo sapiens
gaaaatactctgggctca

SEQ ID NO: 8404199 - DNA, 21 bp, Homo sapiens
gaaaatacaatgagcttgacc

SEQ ID NO: 8404200 - DNA, 22 bp, Homo sapiens
ctggctgtatgctggcctcaga

SEQ ID NO: 8404201 - DNA, 22 bp, Homo sapiens
gaggcagaggttgttgcagtga

SEQ ID NO: 8404202 - DNA, 22 bp, Homo sapiens
gaggcagaggttgcagtgagct

SEQ ID NO: 8404203 - DNA, 22 bp, Homo sapiens
gaggcagaggttgcagtgagct

SEQ ID NO: 8404204 - DNA, 22 bp, Homo sapiens
gaggcagaggttgcagtgagct

SEQ ID NO: 8404205 - DNA, 22 bp, Homo sapiens
gaggaggtggaattccaggaat

SEQ ID NO: 8404206 - DNA, 22 bp, Homo sapiens
gaggaggtctcctccgcagggg

SEQ ID NO: 8404207 - DNA, 22 bp, Homo sapiens
gaggaggtcccccgacatgcct

SEQ ID NO: 8404208 - DNA, 22 bp, Homo sapiens
gaggaggtcgctgctgagcccc

SEQ ID NO: 8404209 - DNA, 23 bp, Homo sapiens
gaggagggtctgacaagtgtagc

SEQ ID NO: 8404210 - DNA, 22 bp, Homo sapiens
gaggagggagaattaggcttaa

SEQ ID NO: 8404211 - DNA, 22 bp, Homo sapiens
gaggaggcttccgggaggcacg

SEQ ID NO: 8404212 - DNA, 22 bp, Homo sapiens
gaggaggctgtttctctgcatt

SEQ ID NO: 8404213 - DNA, 22 bp, Homo sapiens
gaggcagcaggctgaggaggat

SEQ ID NO: 8404214 - DNA, 21 bp, Homo sapiens
gaggaatggtttgcaaagcac

SEQ ID NO: 8404215 - DNA, 22 bp, Homo sapiens
gaggaatgggtgtctcgtgatt

SEQ ID NO: 8404216 - DNA, 22 bp, Homo sapiens
gaggaaggtcccatcagaattt

SEQ ID NO: 8404217 - DNA, 22 bp, Homo sapiens
gaggaatgtcagcacaggcctc

SEQ ID NO: 8404218 - DNA, 22 bp, Homo sapiens
gaggaatgttattaaaggagct

SEQ ID NO: 8404219 - DNA, 22 bp, Homo sapiens
gaggacacctcacagcctcaca

SEQ ID NO: 8404220 - DNA, 22 bp, Homo sapiens
gaggacagcttagggcttcctg

SEQ ID NO: 8404221 - DNA, 22 bp, Homo sapiens
gaggacagcttagggcttcctg

SEQ ID NO: 8404222 - DNA, 22 bp, Homo sapiens
gaggaagggctgcctgccgggc

SEQ ID NO: 8404223 - DNA, 22 bp, Homo sapiens
gaggaagggactttattatctg

SEQ ID NO: 8404224 - DNA, 22 bp, Homo sapiens
gagctgggacttggaatccaca

SEQ ID NO: 8404225 - DNA, 22 bp, Homo sapiens
gagctgggacatgggtcctctc

SEQ ID NO: 8404226 - DNA, 22 bp, Homo sapiens
gagctgggaagatagcttgagc

SEQ ID NO: 8404227 - DNA, 22 bp, Homo sapiens
gagctggccgcagagagggcag

SEQ ID NO: 8404228 - DNA, 16 bp, Homo sapiens
gagggcagaggcggaa

SEQ ID NO: 8404229 - DNA, 22 bp, Homo sapiens
gaggctggaggtcaaagatgaa

SEQ ID NO: 8404230 - DNA, 22 bp, Homo sapiens
gagggccaatggatttcaactg

SEQ ID NO: 8404231 - DNA, 22 bp, Homo sapiens
gagggccaatgtgtccctgagc

SEQ ID NO: 8404232 - DNA, 22 bp, Homo sapiens
gagggcagtgaattttgaagct

SEQ ID NO: 8404233 - DNA, 22 bp, Homo sapiens
gagggccaactagcaccacttt

SEQ ID NO: 8404234 - DNA, 22 bp, Homo sapiens
gagggccaaagagcaagagcct

SEQ ID NO: 8404235 - DNA, 21 bp, Homo sapiens
gaggggcagctcttagcatta

SEQ ID NO: 8404236 - DNA, 22 bp, Homo sapiens
gaggtgtcagggtagtcatgat

SEQ ID NO: 8404237 - DNA, 22 bp, Homo sapiens
gaggtgtcctcagccaactctg

SEQ ID NO: 8404238 - DNA, 22 bp, Homo sapiens
gagggttggtgcaaatgggatg

SEQ ID NO: 8404239 - DNA, 22 bp, Homo sapiens
gaggggcctggcactgagctgg

SEQ ID NO: 8404240 - DNA, 22 bp, Homo sapiens
gaggtaggtgtaggaggcctgc

SEQ ID NO: 8404241 - DNA, 22 bp, Homo sapiens
gatgagctgtctagctgttgga

SEQ ID NO: 8404242 - DNA, 22 bp, Homo sapiens
gatccccagggcaggcctcccg

SEQ ID NO: 8404243 - DNA, 22 bp, Homo sapiens
gatccccaggactagggggtgg

SEQ ID NO: 8404244 - DNA, 22 bp, Homo sapiens
gatcattttgtatagcaaaggt

SEQ ID NO: 8404245 - DNA, 22 bp, Homo sapiens
gataccagacagggagggagaa

SEQ ID NO: 8404246 - DNA, 22 bp, Homo sapiens
gagtgggtgaatgtgctcataa

SEQ ID NO: 8404247 - DNA, 22 bp, Homo sapiens
gagtgtcagtgcttggggctac

SEQ ID NO: 8404248 - DNA, 18 bp, Homo sapiens
gagtgtggcactgggccc

SEQ ID NO: 8404249 - DNA, 22 bp, Homo sapiens
gagtgtgggcacgggggccttg

SEQ ID NO: 8404250 - DNA, 22 bp, Homo sapiens
gagtgagggcagcaggggctgc

SEQ ID NO: 8404251 - DNA, 22 bp, Homo sapiens
gagtgagggcagcaggggctgc

SEQ ID NO: 8404252 - DNA, 22 bp, Homo sapiens
gagtcctggagaaacgcaggtg

SEQ ID NO: 8404253 - DNA, 22 bp, Homo sapiens
gagtgctggaggtgtgagtggg

SEQ ID NO: 8404254 - DNA, 22 bp, Homo sapiens
gagtgcagtatgagaggctgct

SEQ ID NO: 8404255 - DNA, 22 bp, Homo sapiens
gagtggcaggcactgtgacgga

SEQ ID NO: 8404256 - DNA, 22 bp, Homo sapiens
gagtggccagtggtggcatgtc

SEQ ID NO: 8404257 - DNA, 22 bp, Homo sapiens
ggcaggtgctctgtgggcctgg

SEQ ID NO: 8404258 - DNA, 22 bp, Homo sapiens
ggccatggtgaggtcttctcag

SEQ ID NO: 8404259 - DNA, 20 bp, Homo sapiens
ggccatgggttgcctgaggt

SEQ ID NO: 8404260 - DNA, 22 bp, Homo sapiens
ggccatggtggtttgagcacct

SEQ ID NO: 8404261 - DNA, 22 bp, Homo sapiens
ggccatggttggggaagacatg

SEQ ID NO: 8404262 - DNA, 17 bp, Homo sapiens
ggccatggtgcaaggtt

SEQ ID NO: 8404263 - DNA, 22 bp, Homo sapiens
ggccatggtgaggtcttctcag

SEQ ID NO: 8404264 - DNA, 22 bp, Homo sapiens
ggccatggtggtttgagcacct

SEQ ID NO: 8404265 - DNA, 17 bp, Homo sapiens
ggccccggagcctgaca

SEQ ID NO: 8404266 - DNA, 22 bp, Homo sapiens
ggccccaggtctgaacacgctg

SEQ ID NO: 8404267 - DNA, 22 bp, Homo sapiens
ggccccagttcactcctggccg

SEQ ID NO: 8404268 - DNA, 22 bp, Homo sapiens
ggccccacgggggagtcctagt

SEQ ID NO: 8404269 - DNA, 22 bp, Homo sapiens
ggctcaggactgcagcgtagag

SEQ ID NO: 8404270 - DNA, 22 bp, Homo sapiens
ggctcaggtttaaagtgcttta

SEQ ID NO: 8404271 - DNA, 22 bp, Homo sapiens
gggaacagggcctgagctgggg

SEQ ID NO: 8404272 - DNA, 22 bp, Homo sapiens
ggcttccctgtttgctgtgcct

SEQ ID NO: 8404273 - DNA, 22 bp, Homo sapiens
ggcttcctgggcatgtgttcta

SEQ ID NO: 8404274 - DNA, 22 bp, Homo sapiens
ggcttcccctccagtgctctgt

SEQ ID NO: 8404275 - DNA, 22 bp, Homo sapiens
ggcttccccacagtcctgagct

SEQ ID NO: 8404276 - DNA, 22 bp, Homo sapiens
ggcttccctaaacctttccact

SEQ ID NO: 8404277 - DNA, 22 bp, Homo sapiens
ggcttcccagtccctgctctca

SEQ ID NO: 8404278 - DNA, 22 bp, Homo sapiens
ggcttcagtgagctgagctcac

SEQ ID NO: 8404279 - DNA, 22 bp, Homo sapiens
ggctggcctctacagggaggca

SEQ ID NO: 8404280 - DNA, 22 bp, Homo sapiens
ggctggcctctacagggaggca

SEQ ID NO: 8404281 - DNA, 22 bp, Homo sapiens
ggctggcctctacagggaggca

SEQ ID NO: 8404282 - DNA, 22 bp, Homo sapiens
ggctgcctggtttagtgctgac

SEQ ID NO: 8404283 - DNA, 22 bp, Homo sapiens
ggctgccttcagactccagctt

SEQ ID NO: 8404284 - DNA, 20 bp, Homo sapiens
ggctgcaggactcattggct

SEQ ID NO: 8404285 - DNA, 22 bp, Homo sapiens
gggtgggaacaggatgccagga

SEQ ID NO: 8404286 - DNA, 19 bp, Homo sapiens
gggtgaggaagagcgttgc

SEQ ID NO: 8404287 - DNA, 22 bp, Homo sapiens
gggtgggcccagcccagagaag

SEQ ID NO: 8404288 - DNA, 23 bp, Homo sapiens
gggtgggccaaattaggtagcct

SEQ ID NO: 8404289 - DNA, 22 bp, Homo sapiens
gggtgggatggcaggagccgct

SEQ ID NO: 8404290 - DNA, 22 bp, Homo sapiens
gggtctggacggctgcaggaag

SEQ ID NO: 8404291 - DNA, 22 bp, Homo sapiens
gggtccagggccagtggctgag

SEQ ID NO: 8404292 - DNA, 20 bp, Homo sapiens
gggtccaggactctgaattt

SEQ ID NO: 8404293 - DNA, 23 bp, Homo sapiens
ggggaagtggcagtgagtgaggc

SEQ ID NO: 8404294 - DNA, 23 bp, Homo sapiens
ggggacagagggcagcccgcatc

SEQ ID NO: 8404295 - DNA, 23 bp, Homo sapiens
ggggacagagggcagcccgcatc

SEQ ID NO: 8404296 - DNA, 23 bp, Homo sapiens
ggggacagttcccactggggtct

SEQ ID NO: 8404297 - DNA, 22 bp, Homo sapiens
ggggacagtcgatctagtgatt

SEQ ID NO: 8404298 - DNA, 23 bp, Homo sapiens
ggggacagagggcagcccgcatc

SEQ ID NO: 8404299 - DNA, 22 bp, Homo sapiens
ggggacagttaaagaccaagac

SEQ ID NO: 8404300 - DNA, 22 bp, Homo sapiens
gggctggatctcctgcaggcag

SEQ ID NO: 8404301 - DNA, 22 bp, Homo sapiens
gggctggatctcctgcaggcag

SEQ ID NO: 8404302 - DNA, 22 bp, Homo sapiens
gggctggcaggacctgggctga

SEQ ID NO: 8404303 - DNA, 22 bp, Homo sapiens
gggctggagccagctgtggctg

SEQ ID NO: 8404304 - DNA, 22 bp, Homo sapiens
gggctgagacgatggggtcttc

SEQ ID NO: 8404305 - DNA, 21 bp, Homo sapiens
gggctggacatggtggctcat

SEQ ID NO: 8404306 - DNA, 21 bp, Homo sapiens
gggctggacatggtggctcat

SEQ ID NO: 8404307 - DNA, 22 bp, Homo sapiens
gggctagcctcttccctgctcc

SEQ ID NO: 8404308 - DNA, 22 bp, Homo sapiens
gggctagggcctgctatggttt

SEQ ID NO: 8404309 - DNA, 22 bp, Homo sapiens
gggatggctcaaaggagtcagg

SEQ ID NO: 8404310 - DNA, 22 bp, Homo sapiens
gggatggatcttggctgaggct

SEQ ID NO: 8404311 - DNA, 22 bp, Homo sapiens
gggatggggagctggaaagggg

SEQ ID NO: 8404312 - DNA, 22 bp, Homo sapiens
gggatggggagctggaaagggg

SEQ ID NO: 8404313 - DNA, 20 bp, Homo sapiens
gggagaagggctgatgagag

SEQ ID NO: 8404314 - DNA, 22 bp, Homo sapiens
gggctagaagttagctagagaa

SEQ ID NO: 8404315 - DNA, 22 bp, Homo sapiens
gggccatgagaggttcatcaac

SEQ ID NO: 8404316 - DNA, 22 bp, Homo sapiens
gggccaggtcggtgaatggtca

SEQ ID NO: 8404317 - DNA, 22 bp, Homo sapiens
gggccaggtggaccccagcctc

SEQ ID NO: 8404318 - DNA, 22 bp, Homo sapiens
gggccaggtatcgtctttagta

SEQ ID NO: 8404319 - DNA, 22 bp, Homo sapiens
gggccaggagtggagatatggg

SEQ ID NO: 8404320 - DNA, 20 bp, Homo sapiens
gggcagcaagacatttgaca

SEQ ID NO: 8404321 - DNA, 22 bp, Homo sapiens
gggcagcacagacagtgaaggc

SEQ ID NO: 8404322 - DNA, 22 bp, Homo sapiens
gggcagcagaattggacagaaa

SEQ ID NO: 8404323 - DNA, 22 bp, Homo sapiens
gggcagcacgtttcaggaggat

SEQ ID NO: 8404324 - DNA, 18 bp, Homo sapiens
ggagggctttggggactg

SEQ ID NO: 8404325 - DNA, 22 bp, Homo sapiens
ggagggctgtagaggagacctg

SEQ ID NO: 8404326 - DNA, 22 bp, Homo sapiens
ggagggctgtagaggagacctg

SEQ ID NO: 8404327 - DNA, 22 bp, Homo sapiens
ggagggctgccaggtggagcgg

SEQ ID NO: 8404328 - DNA, 22 bp, Homo sapiens
ggagggctgccaggtggagcgg

SEQ ID NO: 8404329 - DNA, 22 bp, Homo sapiens
ggagggctccctgggagtggat

SEQ ID NO: 8404330 - DNA, 22 bp, Homo sapiens
ggaggccatgggcagaatcttt

SEQ ID NO: 8404331 - DNA, 22 bp, Homo sapiens
ggaggctccatgagctcctgca

SEQ ID NO: 8404332 - DNA, 22 bp, Homo sapiens
ggaggctgctgcctcacgtggg

SEQ ID NO: 8404333 - DNA, 22 bp, Homo sapiens
ggaggctctgcttatgaaaggc

SEQ ID NO: 8404334 - DNA, 22 bp, Homo sapiens
ggagggtgcattttaccctgtg

SEQ ID NO: 8404335 - DNA, 22 bp, Homo sapiens
ggagggtgcttaagttgtgttt

SEQ ID NO: 8404336 - DNA, 22 bp, Homo sapiens
ggaggggctgagcaactttcag

SEQ ID NO: 8404337 - DNA, 22 bp, Homo sapiens
ggaggggctcctgttcgccccc

SEQ ID NO: 8404338 - DNA, 22 bp, Homo sapiens
ggaggtgggctaaggactctct

SEQ ID NO: 8404339 - DNA, 22 bp, Homo sapiens
ggaggtgggagcctccagtggt

SEQ ID NO: 8404340 - DNA, 22 bp, Homo sapiens
ggaggtgggagacataggcggc

SEQ ID NO: 8404341 - DNA, 22 bp, Homo sapiens
ggaggtcaaatggagggctggg

SEQ ID NO: 8404342 - DNA, 22 bp, Homo sapiens
ggagggtggcagcgtcctgggc

SEQ ID NO: 8404343 - DNA, 20 bp, Homo sapiens
ggagggtggaagaaagcaag

SEQ ID NO: 8404344 - DNA, 22 bp, Homo sapiens
ggagggtgcttaagttgtgttt

SEQ ID NO: 8404345 - DNA, 23 bp, Homo sapiens
ggcacagatgctgagcatgtgca

SEQ ID NO: 8404346 - DNA, 22 bp, Homo sapiens
ggcacagagctttgtcccagtt

SEQ ID NO: 8404347 - DNA, 22 bp, Homo sapiens
ggcacagaggttgcctccagat

SEQ ID NO: 8404348 - DNA, 22 bp, Homo sapiens
ggagtggcactctgaggcgggg

SEQ ID NO: 8404349 - DNA, 22 bp, Homo sapiens
ggagtggcagcgaggatcagat

SEQ ID NO: 8404350 - DNA, 22 bp, Homo sapiens
ggagtggcaggccacagtgctg

SEQ ID NO: 8404351 - DNA, 22 bp, Homo sapiens
ggcaggcctgagaggcagggct

SEQ ID NO: 8404352 - DNA, 22 bp, Homo sapiens
ggcaggcagcctccatccacag

SEQ ID NO: 8404353 - DNA, 22 bp, Homo sapiens
ggcaggctgcttgggtcatgtc

SEQ ID NO: 8404354 - DNA, 22 bp, Homo sapiens
ggcaggctgggagtcatcagag

SEQ ID NO: 8404355 - DNA, 20 bp, Homo sapiens
ggcaggtgctcgcttggtct

SEQ ID NO: 8404356 - DNA, 22 bp, Homo sapiens
ggcaggtgctaagagaggtaaa

SEQ ID NO: 8404357 - DNA, 22 bp, Homo sapiens
ggcagctggttctttccattaa

SEQ ID NO: 8404358 - DNA, 22 bp, Homo sapiens
ggcagctgggttggccagaaac

SEQ ID NO: 8404359 - DNA, 22 bp, Homo sapiens
ggcagaggaagctggaagtggg

SEQ ID NO: 8404360 - DNA, 22 bp, Homo sapiens
ggaatagtttatgtagctgaat

SEQ ID NO: 8404361 - DNA, 18 bp, Homo sapiens
ggaaggtgctggagtgca

SEQ ID NO: 8404362 - DNA, 22 bp, Homo sapiens
ggaagtgtagtccgaagttgcg

SEQ ID NO: 8404363 - DNA, 22 bp, Homo sapiens
ggaagtgtgcaatattgggctg

SEQ ID NO: 8404364 - DNA, 22 bp, Homo sapiens
ggaagtgtttccttgggcagca

SEQ ID NO: 8404365 - DNA, 22 bp, Homo sapiens
ggaagtgtttgtgcagatggcc

SEQ ID NO: 8404366 - DNA, 22 bp, Homo sapiens
ggagaggtgcaggtcagtggca

SEQ ID NO: 8404367 - DNA, 22 bp, Homo sapiens
ggagaggtgcaggtcagtggca

SEQ ID NO: 8404368 - DNA, 22 bp, Homo sapiens
ggagaggtgtattcagtgggtc

SEQ ID NO: 8404369 - DNA, 22 bp, Homo sapiens
ggagatgcaatgtagaatctgg

SEQ ID NO: 8404370 - DNA, 22 bp, Homo sapiens
ggagatgccagaattgcaaatt

SEQ ID NO: 8404371 - DNA, 20 bp, Homo sapiens
ggagatgcagcccaggtgcc

SEQ ID NO: 8404372 - DNA, 20 bp, Homo sapiens
ggagatgcctctcagtccat

SEQ ID NO: 8404373 - DNA, 22 bp, Homo sapiens
ggagatgcgactcgcggggctg

SEQ ID NO: 8404374 - DNA, 22 bp, Homo sapiens
ggagatgccttgtttcaggaac

SEQ ID NO: 8404375 - DNA, 23 bp, Homo sapiens
ggagatgcttaagagtggttgag

SEQ ID NO: 8404376 - DNA, 22 bp, Homo sapiens
ggagatgctatgtagtttggtt

SEQ ID NO: 8404377 - DNA, 22 bp, Homo sapiens
ggagatgctacagttcagctct

SEQ ID NO: 8404378 - DNA, 22 bp, Homo sapiens
ggagatgctttccagtggggat

SEQ ID NO: 8404379 - DNA, 22 bp, Homo sapiens
ggagatgcttcttgtgtttatt

SEQ ID NO: 8404380 - DNA, 22 bp, Homo sapiens
ggaggccaggtgggagtcatct

SEQ ID NO: 8404381 - DNA, 22 bp, Homo sapiens
ggaggccatcagggagggcatt

SEQ ID NO: 8404382 - DNA, 22 bp, Homo sapiens
ggaggccagcctgaggctgagg

SEQ ID NO: 8404383 - DNA, 22 bp, Homo sapiens
ggaggcagaatagagtgtgggt

SEQ ID NO: 8404384 - DNA, 22 bp, Homo sapiens
ggaggcagaatagagtgtgggt

SEQ ID NO: 8404385 - DNA, 22 bp, Homo sapiens
ggaggaggcggcagaagttcct

SEQ ID NO: 8404386 - DNA, 22 bp, Homo sapiens
ggaggaggcaagtaccagatgc

SEQ ID NO: 8404387 - DNA, 22 bp, Homo sapiens
ggaggagcatgagagggtagtg

SEQ ID NO: 8404388 - DNA, 22 bp, Homo sapiens
ggaaggtgctccctggacagag

SEQ ID NO: 8404389 - DNA, 22 bp, Homo sapiens
ggaaggtcgagctgcatctggc

SEQ ID NO: 8404390 - DNA, 19 bp, Homo sapiens
ggaaggtgacagtggtgaa

SEQ ID NO: 8404391 - DNA, 22 bp, Homo sapiens
ggaaggtgaggtaaggtcttgt

SEQ ID NO: 8404392 - DNA, 22 bp, Homo sapiens
ggaaggtcacgattggaaccca

SEQ ID NO: 8404393 - DNA, 22 bp, Homo sapiens
ggaaggtcacagatgagggaag

SEQ ID NO: 8404394 - DNA, 17 bp, Homo sapiens
ggaaggtcaaggggagg

SEQ ID NO: 8404395 - DNA, 22 bp, Homo sapiens
ggaagggagtagttggaatgca

SEQ ID NO: 8404396 - DNA, 22 bp, Homo sapiens
ggaaagagcccagcagtgcttg

SEQ ID NO: 8404397 - DNA, 22 bp, Homo sapiens
ggaaacacacccagagaagcag

SEQ ID NO: 8404398 - DNA, 22 bp, Homo sapiens
ggaaacacagaggctgagctca

SEQ ID NO: 8404399 - DNA, 22 bp, Homo sapiens
ggaaacacatgatcagacatct

SEQ ID NO: 8404400 - DNA, 22 bp, Homo sapiens
gcttaaggaattggagagtctg

SEQ ID NO: 8404401 - DNA, 22 bp, Homo sapiens
gctgggctgcgtcggggaagcc

SEQ ID NO: 8404402 - DNA, 22 bp, Homo sapiens
gtgtgggctgcagaggcacagc

SEQ ID NO: 8404403 - DNA, 22 bp, Homo sapiens
gtgtccagagaaactcacagct

SEQ ID NO: 8404404 - DNA, 22 bp, Homo sapiens
gtgggcagattatagatgatgc

SEQ ID NO: 8404405 - DNA, 22 bp, Homo sapiens
gtgggcagcaccagggaagtgt

SEQ ID NO: 8404406 - DNA, 22 bp, Homo sapiens
gtgggcagacagtgctttgcag

SEQ ID NO: 8404407 - DNA, 20 bp, Homo sapiens
gtgggcagagcaccacctgg

SEQ ID NO: 8404408 - DNA, 22 bp, Homo sapiens
gtgggccaggccggagtgcaga

SEQ ID NO: 8404409 - DNA, 22 bp, Homo sapiens
gtgggccactgggaggcaaggg

SEQ ID NO: 8404410 - DNA, 22 bp, Homo sapiens
gtgggccacatcccagggctct

SEQ ID NO: 8404411 - DNA, 22 bp, Homo sapiens
gtgggcagcctgtccggagacc

SEQ ID NO: 8404412 - DNA, 22 bp, Homo sapiens
gtgggcaggaggccctgccctg

SEQ ID NO: 8404413 - DNA, 22 bp, Homo sapiens
gtggggaggcctaagcaagttg

SEQ ID NO: 8404414 - DNA, 22 bp, Homo sapiens
gtgggctgcccttgaggtcagc

SEQ ID NO: 8404415 - DNA, 22 bp, Homo sapiens
gtggtcctgccagccaggtcca

SEQ ID NO: 8404416 - DNA, 22 bp, Homo sapiens
gtggtccatcatgcagagctcc

SEQ ID NO: 8404417 - DNA, 17 bp, Homo sapiens
gtgtacaagcagaaggc

SEQ ID NO: 8404418 - DNA, 22 bp, Homo sapiens
gtgtacaaaatgtctccatgga

SEQ ID NO: 8404419 - DNA, 22 bp, Homo sapiens
gtggggtgtccagcagcgagct

SEQ ID NO: 8404420 - DNA, 18 bp, Homo sapiens
gtggggtgttgtgaggat

SEQ ID NO: 8404421 - DNA, 22 bp, Homo sapiens
gtggggtagatctttctcagga

SEQ ID NO: 8404422 - DNA, 22 bp, Homo sapiens
gtggtcagagatgacagtgggt

SEQ ID NO: 8404423 - DNA, 22 bp, Homo sapiens
gtggtcagggagcagagccatg

SEQ ID NO: 8404424 - DNA, 22 bp, Homo sapiens
gtgggtgctgtcaggcagggaa

SEQ ID NO: 8404425 - DNA, 22 bp, Homo sapiens
gtgggtggagactgggtgcaag

SEQ ID NO: 8404426 - DNA, 22 bp, Homo sapiens
taaaggaatcagttttagagat

SEQ ID NO: 8404427 - DNA, 22 bp, Homo sapiens
gtggacagcttctaggtgccag

SEQ ID NO: 8404428 - DNA, 22 bp, Homo sapiens
gtggaggaaaagaagttgggtg

SEQ ID NO: 8404429 - DNA, 22 bp, Homo sapiens
gtggagccctggtagggacccc

SEQ ID NO: 8404430 - DNA, 22 bp, Homo sapiens
gtggagggtttgcaatgtgcag

SEQ ID NO: 8404431 - DNA, 22 bp, Homo sapiens
gtggattacaagacagttgaga

SEQ ID NO: 8404432 - DNA, 22 bp, Homo sapiens
gtggcacagagatggggcatga

SEQ ID NO: 8404433 - DNA, 22 bp, Homo sapiens
gtggcacagggttgttggtcat

SEQ ID NO: 8404434 - DNA, 22 bp, Homo sapiens
gtggcacagggtgtggcacaca

SEQ ID NO: 8404435 - DNA, 22 bp, Homo sapiens
gtggcacacaggagagagctca

SEQ ID NO: 8404436 - DNA, 22 bp, Homo sapiens
gtggcaagtgttccaagaggcg

SEQ ID NO: 8404437 - DNA, 22 bp, Homo sapiens
gtggcacataggatcctgtggc

SEQ ID NO: 8404438 - DNA, 22 bp, Homo sapiens
gtggcacattggtagggtctgt

SEQ ID NO: 8404439 - DNA, 22 bp, Homo sapiens
gtggcacagtgggagagcccca

SEQ ID NO: 8404440 - DNA, 22 bp, Homo sapiens
gtggcagcggtgtgcaaggagg

SEQ ID NO: 8404441 - DNA, 20 bp, Homo sapiens
gtgcctggagaagaggctgt

SEQ ID NO: 8404442 - DNA, 22 bp, Homo sapiens
gtggaaggaagagatggcccca

SEQ ID NO: 8404443 - DNA, 22 bp, Homo sapiens
gtggctcagcggagctctgcac

SEQ ID NO: 8404444 - DNA, 22 bp, Homo sapiens
gtggcctgagcttcagagttgg

SEQ ID NO: 8404445 - DNA, 22 bp, Homo sapiens
gtggcctgatgccagccctgtg

SEQ ID NO: 8404446 - DNA, 22 bp, Homo sapiens
gtggcctgccagcagatggcgc

SEQ ID NO: 8404447 - DNA, 22 bp, Homo sapiens
gtggcctagaggtgcaaggaac

SEQ ID NO: 8404448 - DNA, 22 bp, Homo sapiens
gtggccctgtgaacagcgcagt

SEQ ID NO: 8404449 - DNA, 22 bp, Homo sapiens
gtggcttcatcaactgtgctta

SEQ ID NO: 8404450 - DNA, 22 bp, Homo sapiens
gtggctgggctccgagcggctt

SEQ ID NO: 8404451 - DNA, 22 bp, Homo sapiens
gtggctgggctccgagcggctt

SEQ ID NO: 8404452 - DNA, 22 bp, Homo sapiens
gtggctggagtatgaggaaagg

SEQ ID NO: 8404453 - DNA, 22 bp, Homo sapiens
gtggccaaaaggaagaaggtta

SEQ ID NO: 8404454 - DNA, 22 bp, Homo sapiens
gtggccaataggagcagctatc

SEQ ID NO: 8404455 - DNA, 22 bp, Homo sapiens
gtggccaaggtgcagagcagct

SEQ ID NO: 8404456 - DNA, 22 bp, Homo sapiens
gtggccaagaggggactggata

SEQ ID NO: 8404457 - DNA, 22 bp, Homo sapiens
gtggcaggggtattccagctga

SEQ ID NO: 8404458 - DNA, 22 bp, Homo sapiens
gtggcaggagactggaagatgg

SEQ ID NO: 8404459 - DNA, 22 bp, Homo sapiens
gtggcaggagagacacagccat

SEQ ID NO: 8404460 - DNA, 22 bp, Homo sapiens
gtggcagggagaagccattggg

SEQ ID NO: 8404461 - DNA, 22 bp, Homo sapiens
gtggcaggatcacggctcactg

SEQ ID NO: 8404462 - DNA, 22 bp, Homo sapiens
gtggcaggatcacggctcactg

SEQ ID NO: 8404463 - DNA, 20 bp, Homo sapiens
gtggcaggcagtgaaggagc

SEQ ID NO: 8404464 - DNA, 22 bp, Homo sapiens
gtggccaggagagggtgggaca

SEQ ID NO: 8404465 - DNA, 22 bp, Homo sapiens
gtggccaggccgactgccaggc

SEQ ID NO: 8404466 - DNA, 22 bp, Homo sapiens
gtggccaggacattgccaggca

SEQ ID NO: 8404467 - DNA, 22 bp, Homo sapiens
gtggccaggagaccttgggcat

SEQ ID NO: 8404468 - DNA, 22 bp, Homo sapiens
gtggccagctgtcagcaccctt

SEQ ID NO: 8404469 - DNA, 22 bp, Homo sapiens
gtggccaggacattgccaggca

SEQ ID NO: 8404470 - DNA, 22 bp, Homo sapiens
gtggcccaggcttggcgctggc

SEQ ID NO: 8404471 - DNA, 22 bp, Homo sapiens
gtggcccaggttggagtgcagt

SEQ ID NO: 8404472 - DNA, 22 bp, Homo sapiens
gtggcccaggctggagtgcagt

SEQ ID NO: 8404473 - DNA, 22 bp, Homo sapiens
gtggccctctgatagggtcagg

SEQ ID NO: 8404474 - DNA, 18 bp, Homo sapiens
gtggccagcctggtcttg

SEQ ID NO: 8404475 - DNA, 18 bp, Homo sapiens
gtggccagcctggtcttg

SEQ ID NO: 8404476 - DNA, 22 bp, Homo sapiens
gtggccagccccatggacagtt

SEQ ID NO: 8404477 - DNA, 22 bp, Homo sapiens
gtggccagccccatggacagtt

SEQ ID NO: 8404478 - DNA, 22 bp, Homo sapiens
gtggccagcaagtgctgcctct

SEQ ID NO: 8404479 - DNA, 22 bp, Homo sapiens
gtggccagccagggtgctgatg

SEQ ID NO: 8404480 - DNA, 22 bp, Homo sapiens
gtggccagaatcttgaggcctt

SEQ ID NO: 8404481 - DNA, 22 bp, Homo sapiens
gtggccagaggtcccatgtgtc

SEQ ID NO: 8404482 - DNA, 22 bp, Homo sapiens
gtggccagaggtcccatgtgtc

SEQ ID NO: 8404483 - DNA, 22 bp, Homo sapiens
gtggccagaaccaggagaatga

SEQ ID NO: 8404484 - DNA, 22 bp, Homo sapiens
gtggccagaaccaggagaatga

SEQ ID NO: 8404485 - DNA, 22 bp, Homo sapiens
gtggccagaagttaagtggtta

SEQ ID NO: 8404486 - DNA, 22 bp, Homo sapiens
gtctgagggacagagtcctggc

SEQ ID NO: 8404487 - DNA, 22 bp, Homo sapiens
gtctgagggagaaggatctggg

SEQ ID NO: 8404488 - DNA, 22 bp, Homo sapiens
gtccagggaaatagcgacaggg

SEQ ID NO: 8404489 - DNA, 22 bp, Homo sapiens
gtccagggaaatagcgacaggg

SEQ ID NO: 8404490 - DNA, 22 bp, Homo sapiens
gtcagctgcagtgggcacagcc

SEQ ID NO: 8404491 - DNA, 22 bp, Homo sapiens
gtccagggccccgagcaccagg

SEQ ID NO: 8404492 - DNA, 22 bp, Homo sapiens
ggtggcaggctggcattggcaa

SEQ ID NO: 8404493 - DNA, 22 bp, Homo sapiens
ggtggcagttacaggggcaaat

SEQ ID NO: 8404494 - DNA, 22 bp, Homo sapiens
ggtggccaggagacatttgtca

SEQ ID NO: 8404495 - DNA, 22 bp, Homo sapiens
ggtggccaggccagctctggcc

SEQ ID NO: 8404496 - DNA, 22 bp, Homo sapiens
ggtggccataggaccagcctgg

SEQ ID NO: 8404497 - DNA, 22 bp, Homo sapiens
ggtggccatggtcaggtagcgg

SEQ ID NO: 8404498 - DNA, 22 bp, Homo sapiens
ggtggccattctaccgccttct

SEQ ID NO: 8404499 - DNA, 22 bp, Homo sapiens
ggtggtggtcccgacttgggag

SEQ ID NO: 8404500 - DNA, 22 bp, Homo sapiens
ggtggccctaaccgcagcctcc

SEQ ID NO: 8404501 - DNA, 22 bp, Homo sapiens
gggtggggccaggcaatttgca

SEQ ID NO: 8404502 - DNA, 22 bp, Homo sapiens
ggtgcaggcggtggggcaagta

SEQ ID NO: 8404503 - DNA, 22 bp, Homo sapiens
gtacagtagtaaaagtgaatga

SEQ ID NO: 8404504 - DNA, 22 bp, Homo sapiens
gtacagtaatcccgttcttctg

SEQ ID NO: 8404505 - DNA, 22 bp, Homo sapiens
gtacagtacttcagaaccagcc

SEQ ID NO: 8404506 - DNA, 22 bp, Homo sapiens
gtacatattacagacaaagctt

SEQ ID NO: 8404507 - DNA, 22 bp, Homo sapiens
gtacatttaggattcattgaaa

SEQ ID NO: 8404508 - DNA, 22 bp, Homo sapiens
tctgggaaagtaaatgtaaagg

SEQ ID NO: 8404509 - DNA, 22 bp, Homo sapiens
tctgggaggtcacattggtctt

SEQ ID NO: 8404510 - DNA, 22 bp, Homo sapiens
tctgggatgagatcagagacac

SEQ ID NO: 8404511 - DNA, 22 bp, Homo sapiens
tctgggatgaagccagaaactt

SEQ ID NO: 8404512 - DNA, 22 bp, Homo sapiens
tctgggattttatagacatgct

SEQ ID NO: 8404513 - DNA, 22 bp, Homo sapiens
tctgggatttttgacactgaag

SEQ ID NO: 8404514 - DNA, 22 bp, Homo sapiens
tctgggatgcaaacagaatctg

SEQ ID NO: 8404515 - DNA, 22 bp, Homo sapiens
tctgggatagggccagaacatg

SEQ ID NO: 8404516 - DNA, 22 bp, Homo sapiens
tctgggctgctatgaggcagag

SEQ ID NO: 8404517 - DNA, 23 bp, Homo sapiens
tctgggctgagacttggaaggtc

SEQ ID NO: 8404518 - DNA, 22 bp, Homo sapiens
tctgggctgaaatgaaggcctt

SEQ ID NO: 8404519 - DNA, 22 bp, Homo sapiens
tctggaataggacaaaaccaaa

SEQ ID NO: 8404520 - DNA, 22 bp, Homo sapiens
tctgaggaaagagagtgggatg

SEQ ID NO: 8404521 - DNA, 22 bp, Homo sapiens
tctgattacttgagttatttag

SEQ ID NO: 8404522 - DNA, 22 bp, Homo sapiens
tctgattagctccatttgctaa

SEQ ID NO: 8404523 - DNA, 22 bp, Homo sapiens
tctgcaggcttataggatgggt

SEQ ID NO: 8404524 - DNA, 20 bp, Homo sapiens
tctgtcctttctgctaaggc

SEQ ID NO: 8404525 - DNA, 22 bp, Homo sapiens
tctgtcctctttgaagctgctc

SEQ ID NO: 8404526 - DNA, 22 bp, Homo sapiens
tctgtcacatacacttttcagg

SEQ ID NO: 8404527 - DNA, 22 bp, Homo sapiens
tctggggcagttactggggcct

SEQ ID NO: 8404528 - DNA, 22 bp, Homo sapiens
tctgggcttggttagggctgtt

SEQ ID NO: 8404529 - DNA, 20 bp, Homo sapiens
tctgggcttcccccagctcc

SEQ ID NO: 8404530 - DNA, 22 bp, Homo sapiens
tctgggctgtggttccactccg

SEQ ID NO: 8404531 - DNA, 21 bp, Homo sapiens
tctgggctgctgctgcccatc

SEQ ID NO: 8404532 - DNA, 22 bp, Homo sapiens
tctgggctgcttcagccttcgc

SEQ ID NO: 8404533 - DNA, 22 bp, Homo sapiens
tcttaagcagagaagaagttga

SEQ ID NO: 8404534 - DNA, 22 bp, Homo sapiens
tctgtgccctcggtgctgggcc

SEQ ID NO: 8404535 - DNA, 22 bp, Homo sapiens
tctgtgcatttcaggacctgaa

SEQ ID NO: 8404536 - DNA, 22 bp, Homo sapiens
tctgtgcattgtaacaactaaa

SEQ ID NO: 8404537 - DNA, 20 bp, Homo sapiens
tctgtgcattgcctgctggt

SEQ ID NO: 8404538 - DNA, 22 bp, Homo sapiens
tctgtgcatccttaacgcctgc

SEQ ID NO: 8404539 - DNA, 22 bp, Homo sapiens
tctgtgcagttcttgtcttgac

SEQ ID NO: 8404540 - DNA, 20 bp, Homo sapiens
tctgtgcagtttaggaaggc

SEQ ID NO: 8404541 - DNA, 20 bp, Homo sapiens
tctgtgcagtggaggggcag

SEQ ID NO: 8404542 - DNA, 22 bp, Homo sapiens
tctgtgcagggaccccaagagt

SEQ ID NO: 8404543 - DNA, 22 bp, Homo sapiens
tctgtgcagtcagggctcagtc

SEQ ID NO: 8404544 - DNA, 22 bp, Homo sapiens
tctgtgcagaactcacagaagg

SEQ ID NO: 8404545 - DNA, 22 bp, Homo sapiens
tctgtgcactgtgtcattaggt

SEQ ID NO: 8404546 - DNA, 22 bp, Homo sapiens
tctgtgcagacatggggaagcc

SEQ ID NO: 8404547 - DNA, 22 bp, Homo sapiens
tctgtgcagaatcaaggagctt

SEQ ID NO: 8404548 - DNA, 22 bp, Homo sapiens
tctgtgcaggatttgaggaacc

SEQ ID NO: 8404549 - DNA, 22 bp, Homo sapiens
tctgtgcaggaagtcattatga

SEQ ID NO: 8404550 - DNA, 15 bp, Homo sapiens
tctgtgcagcaaggg

SEQ ID NO: 8404551 - DNA, 22 bp, Homo sapiens
tctgtgcagatgtagaccagtt

SEQ ID NO: 8404552 - DNA, 22 bp, Homo sapiens
tctgtgcacaataggcattttt

SEQ ID NO: 8404553 - DNA, 22 bp, Homo sapiens
tctgtgcaatagtttgttttac

SEQ ID NO: 8404554 - DNA, 20 bp, Homo sapiens
tctgtgcacctgctacaagg

SEQ ID NO: 8404555 - DNA, 22 bp, Homo sapiens
tctgtgcaccagaatgatattt

SEQ ID NO: 8404556 - DNA, 22 bp, Homo sapiens
tctgtgcaccttctaatgagta

SEQ ID NO: 8404557 - DNA, 22 bp, Homo sapiens
tctgtgcactaacattcctggt

SEQ ID NO: 8404558 - DNA, 22 bp, Homo sapiens
tctgtgcaagtatttgacattt

SEQ ID NO: 8404559 - DNA, 22 bp, Homo sapiens
tctgtgcaagaccaactttcaa

SEQ ID NO: 8404560 - DNA, 22 bp, Homo sapiens
tcttggctttctcctagggatg

SEQ ID NO: 8404561 - DNA, 22 bp, Homo sapiens
tcttggcttttcccctatggtc

SEQ ID NO: 8404562 - DNA, 18 bp, Homo sapiens
tcttggcagcatctggca

SEQ ID NO: 8404563 - DNA, 22 bp, Homo sapiens
tctttattgctactggtttgtc

SEQ ID NO: 8404564 - DNA, 22 bp, Homo sapiens
tcttccttttgtaccttctgaa

SEQ ID NO: 8404565 - DNA, 22 bp, Homo sapiens
tcttccagctccccacggtgtc

SEQ ID NO: 8404566 - DNA, 22 bp, Homo sapiens
tcgcccaggctggaagtgcagt

SEQ ID NO: 8404567 - DNA, 22 bp, Homo sapiens
tctaaacttcactttaagtgct

SEQ ID NO: 8404568 - DNA, 22 bp, Homo sapiens
tctaaactgcgagcatgccccc

SEQ ID NO: 8404569 - DNA, 22 bp, Homo sapiens
tctaaactgctagctgactgag

SEQ ID NO: 8404570 - DNA, 22 bp, Homo sapiens
tctaaacttgtaaacaagcata

SEQ ID NO: 8404571 - DNA, 22 bp, Homo sapiens
tctaaactagggttaaaggaaa

SEQ ID NO: 8404572 - DNA, 22 bp, Homo sapiens
tctaaactcctttacccagacc

SEQ ID NO: 8404573 - DNA, 19 bp, Homo sapiens
tctaaactctatactggta

SEQ ID NO: 8404574 - DNA, 22 bp, Homo sapiens
tctaaactctgattaatccaca

SEQ ID NO: 8404575 - DNA, 22 bp, Homo sapiens
tctaaactctgcaatttacggt

SEQ ID NO: 8404576 - DNA, 22 bp, Homo sapiens
tctaaactctctttgaattatg

SEQ ID NO: 8404577 - DNA, 22 bp, Homo sapiens
tctaccctgcggtcttggggca

SEQ ID NO: 8404578 - DNA, 22 bp, Homo sapiens
tctacatgcagcgaggggactt

SEQ ID NO: 8404579 - DNA, 22 bp, Homo sapiens
tctaaatgtatcacatctggat

SEQ ID NO: 8404580 - DNA, 22 bp, Homo sapiens
tctaaatgtcagtacagaatga

SEQ ID NO: 8404581 - DNA, 22 bp, Homo sapiens
tctatgaacctctgcaatgaca

SEQ ID NO: 8404582 - DNA, 22 bp, Homo sapiens
tctaggtggatgaggaacatag

SEQ ID NO: 8404583 - DNA, 22 bp, Homo sapiens
tcctgggattaaggtggtgatt

SEQ ID NO: 8404584 - DNA, 22 bp, Homo sapiens
tcctggggaggtcgaggctgag

SEQ ID NO: 8404585 - DNA, 22 bp, Homo sapiens
tcctgggaagactgtgaggaca

SEQ ID NO: 8404586 - DNA, 22 bp, Homo sapiens
tcctgggaccgagggaagagct

SEQ ID NO: 8404587 - DNA, 22 bp, Homo sapiens
tcctggtgtcgcctggtcagtt

SEQ ID NO: 8404588 - DNA, 22 bp, Homo sapiens
tcctggggctgcaaggcctgtc

SEQ ID NO: 8404589 - DNA, 19 bp, Homo sapiens
tcctggggatgtggtcacc

SEQ ID NO: 8404590 - DNA, 22 bp, Homo sapiens
tcctggggccagcactggtgga

SEQ ID NO: 8404591 - DNA, 22 bp, Homo sapiens
tcctggctcgattgctaccaat

SEQ ID NO: 8404592 - DNA, 19 bp, Homo sapiens
tcctggcacagtggaacca

SEQ ID NO: 8404593 - DNA, 22 bp, Homo sapiens
tctcagctgactgctttcctcg

SEQ ID NO: 8404594 - DNA, 22 bp, Homo sapiens
tctcagctgcctgccctgctcc

SEQ ID NO: 8404595 - DNA, 22 bp, Homo sapiens
tctcaccccgttttctgtgtga

SEQ ID NO: 8404596 - DNA, 22 bp, Homo sapiens
tctcatggagtcaggagcagaa

SEQ ID NO: 8404597 - DNA, 22 bp, Homo sapiens
tctccaggcactacctgggtaa

SEQ ID NO: 8404598 - DNA, 22 bp, Homo sapiens
tctccaggaagccctccctgac

SEQ ID NO: 8404599 - DNA, 22 bp, Homo sapiens
tctcctggagcaggaaggtggg

SEQ ID NO: 8404600 - DNA, 22 bp, Homo sapiens
tctcgctctgtcgcccaggctg

SEQ ID NO: 8404601 - DNA, 20 bp, Homo sapiens
tctcccaggctcagggaaga

SEQ ID NO: 8404602 - DNA, 22 bp, Homo sapiens
tctcccaggtgggtgcctggag

SEQ ID NO: 8404603 - DNA, 22 bp, Homo sapiens
tctcccagtggtgcagaaagca

SEQ ID NO: 8404604 - DNA, 22 bp, Homo sapiens
tctcccagaggatcccagtgga

SEQ ID NO: 8404605 - DNA, 22 bp, Homo sapiens
tctcccagaagtcctcagtaca

SEQ ID NO: 8404606 - DNA, 22 bp, Homo sapiens
tctccaggcttaatctcagctt

SEQ ID NO: 8404607 - DNA, 22 bp, Homo sapiens
tctgaagaaatacagctggggt

SEQ ID NO: 8404608 - DNA, 22 bp, Homo sapiens
tctgaagattctttccactatt

SEQ ID NO: 8404609 - DNA, 22 bp, Homo sapiens
tgcctggatgtgctggcctcac

SEQ ID NO: 8404610 - DNA, 22 bp, Homo sapiens
tgccctcaagcaacagagagga

SEQ ID NO: 8404611 - DNA, 22 bp, Homo sapiens
tgcccttgaggacagctcccag

SEQ ID NO: 8404612 - DNA, 20 bp, Homo sapiens
tgcccagcaagagtgcagtt

SEQ ID NO: 8404613 - DNA, 20 bp, Homo sapiens
tgccatggtaacagagtgtg

SEQ ID NO: 8404614 - DNA, 22 bp, Homo sapiens
tgccccagacctactgaatggg

SEQ ID NO: 8404615 - DNA, 22 bp, Homo sapiens
tgcccatggaccaagcaagggg

SEQ ID NO: 8404616 - DNA, 22 bp, Homo sapiens
tgccagggtgtcaggagagcta

SEQ ID NO: 8404617 - DNA, 22 bp, Homo sapiens
tgccagggtgtcaggagagcta

SEQ ID NO: 8404618 - DNA, 23 bp, Homo sapiens
tgccagggtttgtttgtggttca

SEQ ID NO: 8404619 - DNA, 22 bp, Homo sapiens
tgccagggtcagctgcagctct

SEQ ID NO: 8404620 - DNA, 22 bp, Homo sapiens
tgccaggggacctagggatgtc

SEQ ID NO: 8404621 - DNA, 22 bp, Homo sapiens
tgccagggtcctgagggccttg

SEQ ID NO: 8404622 - DNA, 22 bp, Homo sapiens
tgccagggccatagggagtcta

SEQ ID NO: 8404623 - DNA, 22 bp, Homo sapiens
tgccagggccatagggagtcta

SEQ ID NO: 8404624 - DNA, 22 bp, Homo sapiens
tgccaggctcaggatgtccctg

SEQ ID NO: 8404625 - DNA, 22 bp, Homo sapiens
tgccaggctgccctccagtctg

SEQ ID NO: 8404626 - DNA, 22 bp, Homo sapiens
tgccaggctgtcaattcaccca

SEQ ID NO: 8404627 - DNA, 22 bp, Homo sapiens
tgccaggctgtcctgggcctgg

SEQ ID NO: 8404628 - DNA, 20 bp, Homo sapiens
tgccagggccagcagaggct

SEQ ID NO: 8404629 - DNA, 22 bp, Homo sapiens
tgccaggcatatggcctctttg

SEQ ID NO: 8404630 - DNA, 22 bp, Homo sapiens
tgccaggcaactgcccagccat

SEQ ID NO: 8404631 - DNA, 22 bp, Homo sapiens
tgccaggccctgcggggtccca

SEQ ID NO: 8404632 - DNA, 22 bp, Homo sapiens
tgccaggctcagcccctatctt

SEQ ID NO: 8404633 - DNA, 22 bp, Homo sapiens
tgccacaggcaatccctgcacg

SEQ ID NO: 8404634 - DNA, 23 bp, Homo sapiens
tgcatggggctatactgctgttc

SEQ ID NO: 8404635 - DNA, 22 bp, Homo sapiens
tgcagggtgtccggaggatcac

SEQ ID NO: 8404636 - DNA, 22 bp, Homo sapiens
tgcagggtagacaggtgaggtc

SEQ ID NO: 8404637 - DNA, 22 bp, Homo sapiens
tgcagggtggagcggaagcgga

SEQ ID NO: 8404638 - DNA, 22 bp, Homo sapiens
tgcagggtggtttgaagggtct

SEQ ID NO: 8404639 - DNA, 22 bp, Homo sapiens
tgcagggtgcacagtggggtgc

SEQ ID NO: 8404640 - DNA, 22 bp, Homo sapiens
tgcagggtcccgaagggaagac

SEQ ID NO: 8404641 - DNA, 22 bp, Homo sapiens
tgcagggctcctggctccaatc

SEQ ID NO: 8404642 - DNA, 21 bp, Homo sapiens
tgcagcagagtaagcagggga

SEQ ID NO: 8404643 - DNA, 22 bp, Homo sapiens
tgcagcagacataatgtggatt

SEQ ID NO: 8404644 - DNA, 22 bp, Homo sapiens
tgcagcagcagggaggaggctc

SEQ ID NO: 8404645 - DNA, 22 bp, Homo sapiens
tgcagcaggcacaggacggaag

SEQ ID NO: 8404646 - DNA, 22 bp, Homo sapiens
tgcagctggaacttagaggaga

SEQ ID NO: 8404647 - DNA, 22 bp, Homo sapiens
tgcagctgataattacatgttc

SEQ ID NO: 8404648 - DNA, 22 bp, Homo sapiens
tgcagctgctggcccaggtgct

SEQ ID NO: 8404649 - DNA, 22 bp, Homo sapiens
tgcagctgctggtggctgaaag

SEQ ID NO: 8404650 - DNA, 22 bp, Homo sapiens
tgcagctgaacctagagtctgt

SEQ ID NO: 8404651 - DNA, 22 bp, Homo sapiens
tgcagctctgggcaagtgcctt

SEQ ID NO: 8404652 - DNA, 22 bp, Homo sapiens
tgcagctgacccactccagtcc

SEQ ID NO: 8404653 - DNA, 21 bp, Homo sapiens
tgcagctgacactggtatgcc

SEQ ID NO: 8404654 - DNA, 22 bp, Homo sapiens
tgcaggaggctttattcaggat

SEQ ID NO: 8404655 - DNA, 21 bp, Homo sapiens
tgcaggagtgtaatgtgaccc

SEQ ID NO: 8404656 - DNA, 22 bp, Homo sapiens
tgcagcttatctctttggcagt

SEQ ID NO: 8404657 - DNA, 22 bp, Homo sapiens
tgcagcttgctgtaggctaagt

SEQ ID NO: 8404658 - DNA, 19 bp, Homo sapiens
tgcagctgtatgagcttaa

SEQ ID NO: 8404659 - DNA, 22 bp, Homo sapiens
tgcagctgtgcctgaaaagtac

SEQ ID NO: 8404660 - DNA, 22 bp, Homo sapiens
tgcaggaaattccagggtggcc

SEQ ID NO: 8404661 - DNA, 22 bp, Homo sapiens
tgcaggaactgggagggatagt

SEQ ID NO: 8404662 - DNA, 22 bp, Homo sapiens
tgcagcagaatatggctgcagg

SEQ ID NO: 8404663 - DNA, 22 bp, Homo sapiens
tgcagatggggatcagtggctc

SEQ ID NO: 8404664 - DNA, 22 bp, Homo sapiens
tgcagatgagggatgaaaatga

SEQ ID NO: 8404665 - DNA, 22 bp, Homo sapiens
tgcacagcgcttgtcgggtgtg

SEQ ID NO: 8404666 - DNA, 21 bp, Homo sapiens
tgcacagccataccctccttg

SEQ ID NO: 8404667 - DNA, 22 bp, Homo sapiens
tgcacaggccttgaagggagag

SEQ ID NO: 8404668 - DNA, 22 bp, Homo sapiens
tgagtgggatgagttagaggtg

SEQ ID NO: 8404669 - DNA, 22 bp, Homo sapiens
tgagtgagttttcacggtcagc

SEQ ID NO: 8404670 - DNA, 22 bp, Homo sapiens
tgagtgaggctgggcagtccct

SEQ ID NO: 8404671 - DNA, 22 bp, Homo sapiens
tgagtgaggtgcttagggcaca

SEQ ID NO: 8404672 - DNA, 20 bp, Homo sapiens
tgagtgagtttgtggcagga

SEQ ID NO: 8404673 - DNA, 22 bp, Homo sapiens
tgagtgagacaccaaaggctgt

SEQ ID NO: 8404674 - DNA, 22 bp, Homo sapiens
tgagtgggattaaatgaggtga

SEQ ID NO: 8404675 - DNA, 22 bp, Homo sapiens
tgatcaaaacattactccacca

SEQ ID NO: 8404676 - DNA, 22 bp, Homo sapiens
tgcaacaggctgtgacatggaa

SEQ ID NO: 8404677 - DNA, 22 bp, Homo sapiens
tgatttacacatcaaagcagca

SEQ ID NO: 8404678 - DNA, 22 bp, Homo sapiens
tgattttctccattgtaaattc

SEQ ID NO: 8404679 - DNA, 22 bp, Homo sapiens
tgcaaatgggtgagggttagga

SEQ ID NO: 8404680 - DNA, 22 bp, Homo sapiens
tgcaaatgtgtaggtttacata

SEQ ID NO: 8404681 - DNA, 22 bp, Homo sapiens
tgagggagcacacactgaagtg

SEQ ID NO: 8404682 - DNA, 22 bp, Homo sapiens
tgagggaggcctccatctgcca

SEQ ID NO: 8404683 - DNA, 22 bp, Homo sapiens
tgagggaggccctttgagcaga

SEQ ID NO: 8404684 - DNA, 22 bp, Homo sapiens
tgaggctcagagaagtgctgtt

SEQ ID NO: 8404685 - DNA, 18 bp, Homo sapiens
tgaggctcagctcctggt

SEQ ID NO: 8404686 - DNA, 21 bp, Homo sapiens
tgaggctctgttgtgcctgca

SEQ ID NO: 8404687 - DNA, 17 bp, Homo sapiens
tgaggctcggtgaggag

SEQ ID NO: 8404688 - DNA, 22 bp, Homo sapiens
tgaggcttggagaggtcaggga

SEQ ID NO: 8404689 - DNA, 21 bp, Homo sapiens
tgaggctgttgtaccagggag

SEQ ID NO: 8404690 - DNA, 21 bp, Homo sapiens
tgaggctgttgtaccagggag

SEQ ID NO: 8404691 - DNA, 22 bp, Homo sapiens
tgaggctgttctaccagggcca

SEQ ID NO: 8404692 - DNA, 22 bp, Homo sapiens
tgaggctgttctaccagggcca

SEQ ID NO: 8404693 - DNA, 22 bp, Homo sapiens
tgaggtgaatggtgtccctgga

SEQ ID NO: 8404694 - DNA, 22 bp, Homo sapiens
tgaggtctgctcaagtccctgg

SEQ ID NO: 8404695 - DNA, 22 bp, Homo sapiens
tgaggtctcagctgggaagact

SEQ ID NO: 8404696 - DNA, 22 bp, Homo sapiens
tgaggtcttttatagtgtgtca

SEQ ID NO: 8404697 - DNA, 22 bp, Homo sapiens
tgaggtgaagagtggagctcag

SEQ ID NO: 8404698 - DNA, 19 bp, Homo sapiens
tgaggggctcacagtctca

SEQ ID NO: 8404699 - DNA, 22 bp, Homo sapiens
tgaggggcgctggcaggttcct

SEQ ID NO: 8404700 - DNA, 22 bp, Homo sapiens
tgaggtgggtgtcaggtcagag

SEQ ID NO: 8404701 - DNA, 22 bp, Homo sapiens
tgaggtggctagggaggcactc

SEQ ID NO: 8404702 - DNA, 22 bp, Homo sapiens
tgaggtggctggatctcagcct

SEQ ID NO: 8404703 - DNA, 22 bp, Homo sapiens
tgaggtggccgaggagcaggac

SEQ ID NO: 8404704 - DNA, 22 bp, Homo sapiens
tgaggcagttgagcttcctgag

SEQ ID NO: 8404705 - DNA, 22 bp, Homo sapiens
tgaggccaagcctcctctgcca

SEQ ID NO: 8404706 - DNA, 22 bp, Homo sapiens
tgaggcagggagtttaattgtc

SEQ ID NO: 8404707 - DNA, 22 bp, Homo sapiens
tgaggcagggagagtggatatg

SEQ ID NO: 8404708 - DNA, 23 bp, Homo sapiens
tgaggcaggcggatcacgaggtc

SEQ ID NO: 8404709 - DNA, 23 bp, Homo sapiens
tgaggcaggcggatcacgaggtc

SEQ ID NO: 8404710 - DNA, 22 bp, Homo sapiens
tgaggcagttcttacttgtatt

SEQ ID NO: 8404711 - DNA, 21 bp, Homo sapiens
tgaggcaggggtgcttttgtc

SEQ ID NO: 8404712 - DNA, 22 bp, Homo sapiens
tgaggcaggatgcttgcacagg

SEQ ID NO: 8404713 - DNA, 22 bp, Homo sapiens
tgaggcaggagttcaggctgcg

SEQ ID NO: 8404714 - DNA, 22 bp, Homo sapiens
tgaggcaggaggattgcaggat

SEQ ID NO: 8404715 - DNA, 22 bp, Homo sapiens
tgaggcaggagttaatgtgctc

SEQ ID NO: 8404716 - DNA, 22 bp, Homo sapiens
tgaggcaggaggttgagaactg

SEQ ID NO: 8404717 - DNA, 22 bp, Homo sapiens
tgaggcaggagaatggcgggaa

SEQ ID NO: 8404718 - DNA, 18 bp, Homo sapiens
tgaggccagagtgggcat

SEQ ID NO: 8404719 - DNA, 22 bp, Homo sapiens
tgaggccagcttcagcagtgga

SEQ ID NO: 8404720 - DNA, 22 bp, Homo sapiens
tgaggccaagaaaagctgggtg

SEQ ID NO: 8404721 - DNA, 22 bp, Homo sapiens
tgaggccaatgaccctgggcag

SEQ ID NO: 8404722 - DNA, 22 bp, Homo sapiens
tgaggccacaggaaagggcccg

SEQ ID NO: 8404723 - DNA, 22 bp, Homo sapiens
tgaggatggcagtgtgctcagc

SEQ ID NO: 8404724 - DNA, 22 bp, Homo sapiens
tgaggatggaatgctgtgcaag

SEQ ID NO: 8404725 - DNA, 22 bp, Homo sapiens
tgaggatggtgttggagagggc

SEQ ID NO: 8404726 - DNA, 22 bp, Homo sapiens
tgaggagtatggtggggtcatt

SEQ ID NO: 8404727 - DNA, 22 bp, Homo sapiens
tgaggatggaatgctgtgcaag

SEQ ID NO: 8404728 - DNA, 22 bp, Homo sapiens
tgaggaggtcagagtctggctg

SEQ ID NO: 8404729 - DNA, 22 bp, Homo sapiens
tgaggaaggaattgaggtttta

SEQ ID NO: 8404730 - DNA, 22 bp, Homo sapiens
tgaggaagggtgtgacggcacc

SEQ ID NO: 8404731 - DNA, 19 bp, Homo sapiens
tgaggcaagatggctctgg

SEQ ID NO: 8404732 - DNA, 22 bp, Homo sapiens
tgaggatttaatgggactcatt

SEQ ID NO: 8404733 - DNA, 21 bp, Homo sapiens
tgaggatttcagtagatgcct

SEQ ID NO: 8404734 - DNA, 22 bp, Homo sapiens
tgaggcaggaatggggaaaagt

SEQ ID NO: 8404735 - DNA, 22 bp, Homo sapiens
tgaggcaggaagttatataatg

SEQ ID NO: 8404736 - DNA, 22 bp, Homo sapiens
tgaggcaggacatggacaactg

SEQ ID NO: 8404737 - DNA, 22 bp, Homo sapiens
tgaggcagaaaatagcagttca

SEQ ID NO: 8404738 - DNA, 22 bp, Homo sapiens
tgaggcagctttttctgtgtgt

SEQ ID NO: 8404739 - DNA, 22 bp, Homo sapiens
tgaggcaggactgagcgggatg

SEQ ID NO: 8404740 - DNA, 22 bp, Homo sapiens
tgaggcaggacttgcataaagt

SEQ ID NO: 8404741 - DNA, 22 bp, Homo sapiens
tgaggcaggagaatcacatgaa

SEQ ID NO: 8404742 - DNA, 20 bp, Homo sapiens
tgaggcaggagaatggcatg

SEQ ID NO: 8404743 - DNA, 22 bp, Homo sapiens
tgaggcaggagaatcaccggaa

SEQ ID NO: 8404744 - DNA, 22 bp, Homo sapiens
tgagctgagaacacttgggcta

SEQ ID NO: 8404745 - DNA, 22 bp, Homo sapiens
tgagctgataggctgtgagcct

SEQ ID NO: 8404746 - DNA, 23 bp, Homo sapiens
tgagcccagttttccctcttgcc

SEQ ID NO: 8404747 - DNA, 22 bp, Homo sapiens
tgagcccatgtagcacttccat

SEQ ID NO: 8404748 - DNA, 22 bp, Homo sapiens
tgagcccatgctctttctacga

SEQ ID NO: 8404749 - DNA, 22 bp, Homo sapiens
tgagcctctaccacaggtggaa

SEQ ID NO: 8404750 - DNA, 22 bp, Homo sapiens
tgagcagggagctgggctgagc

SEQ ID NO: 8404751 - DNA, 22 bp, Homo sapiens
tgagccagagaggttgaggcta

SEQ ID NO: 8404752 - DNA, 22 bp, Homo sapiens
tgagccacagtgagagctcctg

SEQ ID NO: 8404753 - DNA, 22 bp, Homo sapiens
tgagccagagtggagtgtgcct

SEQ ID NO: 8404754 - DNA, 22 bp, Homo sapiens
tgagccagaggaggctgtgtgg

SEQ ID NO: 8404755 - DNA, 22 bp, Homo sapiens
tgagccagataagggctcacgc

SEQ ID NO: 8404756 - DNA, 22 bp, Homo sapiens
tgagccaggagtttgaggctgt

SEQ ID NO: 8404757 - DNA, 22 bp, Homo sapiens
tgagccaggagtttgaggctgt

SEQ ID NO: 8404758 - DNA, 19 bp, Homo sapiens
tgagccagggaggccatgc

SEQ ID NO: 8404759 - DNA, 21 bp, Homo sapiens
tgagccaggctgacggctgtg

SEQ ID NO: 8404760 - DNA, 22 bp, Homo sapiens
tgagaagattgggcagagtgga

SEQ ID NO: 8404761 - DNA, 22 bp, Homo sapiens
tgactttaaaataacaagttta

SEQ ID NO: 8404762 - DNA, 22 bp, Homo sapiens
tgagagcagaggtgggcagcct

SEQ ID NO: 8404763 - DNA, 22 bp, Homo sapiens
tgagatcattgacttgttcctg

SEQ ID NO: 8404764 - DNA, 22 bp, Homo sapiens
tgagatcattgacttgttcctg

SEQ ID NO: 8404765 - DNA, 22 bp, Homo sapiens
tgagatctgtgcatgttagtta

SEQ ID NO: 8404766 - DNA, 22 bp, Homo sapiens
tgagatctctgcctatatggat

SEQ ID NO: 8404767 - DNA, 22 bp, Homo sapiens
tgagatgctgggaacaaggaag

SEQ ID NO: 8404768 - DNA, 22 bp, Homo sapiens
tgagatgctgctgtaacaaata

SEQ ID NO: 8404769 - DNA, 21 bp, Homo sapiens
tgagatgctagaaggcaggga

SEQ ID NO: 8404770 - DNA, 22 bp, Homo sapiens
tgagatgctaaagggctgctca

SEQ ID NO: 8404771 - DNA, 19 bp, Homo sapiens
tgagatgccttccagccct

SEQ ID NO: 8404772 - DNA, 22 bp, Homo sapiens
tgagatgcaggagatgggactg

SEQ ID NO: 8404773 - DNA, 22 bp, Homo sapiens
tgacagtaccaccaaatctgat

SEQ ID NO: 8404774 - DNA, 22 bp, Homo sapiens
tgacatttatcaaagaaatggt

SEQ ID NO: 8404775 - DNA, 22 bp, Homo sapiens
tgacatttaagcctctgatttc

SEQ ID NO: 8404776 - DNA, 22 bp, Homo sapiens
tgacatttcttgttgatataaa

SEQ ID NO: 8404777 - DNA, 22 bp, Homo sapiens
tgaaggagggaagaaggctctg

SEQ ID NO: 8404778 - DNA, 22 bp, Homo sapiens
tgaaggaggaatgtggcctcca

SEQ ID NO: 8404779 - DNA, 22 bp, Homo sapiens
tgaagccatccctcagatggcc

SEQ ID NO: 8404780 - DNA, 22 bp, Homo sapiens
tgaagccatcaggaagccagca

SEQ ID NO: 8404781 - DNA, 22 bp, Homo sapiens
tgaagccatctcagagtcaaga

SEQ ID NO: 8404782 - DNA, 22 bp, Homo sapiens
tgaagccaatctgccaggcaga

SEQ ID NO: 8404783 - DNA, 22 bp, Homo sapiens
tgaagccaccgaaccagaagag

SEQ ID NO: 8404784 - DNA, 22 bp, Homo sapiens
tgaagccataggacagaggata

SEQ ID NO: 8404785 - DNA, 22 bp, Homo sapiens
tgacaaaggtgttgccagaggg

SEQ ID NO: 8404786 - DNA, 19 bp, Homo sapiens
tgaatgacgggcatgagca

SEQ ID NO: 8404787 - DNA, 22 bp, Homo sapiens
tgaactcctgacctcatgatcc

SEQ ID NO: 8404788 - DNA, 22 bp, Homo sapiens
tgaactaatgaggaaatggtct

SEQ ID NO: 8404789 - DNA, 22 bp, Homo sapiens
tgaacatgctgttgatggcctg

SEQ ID NO: 8404790 - DNA, 22 bp, Homo sapiens
tgaagactcagaagctaagata

SEQ ID NO: 8404791 - DNA, 22 bp, Homo sapiens
tgaaaaactgaatagttgagta

SEQ ID NO: 8404792 - DNA, 22 bp, Homo sapiens
tggctgagtgttccaaggagca

SEQ ID NO: 8404793 - DNA, 20 bp, Homo sapiens
tggctgcacaccaggacagg

SEQ ID NO: 8404794 - DNA, 22 bp, Homo sapiens
tggctcagttaggtcagaaaca

SEQ ID NO: 8404795 - DNA, 22 bp, Homo sapiens
tggctcagtggcagccgcagct

SEQ ID NO: 8404796 - DNA, 22 bp, Homo sapiens
tggctcagttccatcatctgga

SEQ ID NO: 8404797 - DNA, 21 bp, Homo sapiens
tggctcagttgctgggcacag

SEQ ID NO: 8404798 - DNA, 21 bp, Homo sapiens
tggctcagttgctgggcacag

SEQ ID NO: 8404799 - DNA, 22 bp, Homo sapiens
tggctcaggcttgaaaatagat

SEQ ID NO: 8404800 - DNA, 22 bp, Homo sapiens
tggctcaggcctacgacgcctt

SEQ ID NO: 8404801 - DNA, 22 bp, Homo sapiens
tggctcaggcctacgacgcctt

SEQ ID NO: 8404802 - DNA, 22 bp, Homo sapiens
tggctcaggccacttcttttat

SEQ ID NO: 8404803 - DNA, 22 bp, Homo sapiens
tggctcaggatctaagcagaat

SEQ ID NO: 8404804 - DNA, 22 bp, Homo sapiens
tggctcaggagggatctttgct

SEQ ID NO: 8404805 - DNA, 22 bp, Homo sapiens
tggctcagctttccccatctgg

SEQ ID NO: 8404806 - DNA, 22 bp, Homo sapiens
tggctcaggataattttcccaa

SEQ ID NO: 8404807 - DNA, 22 bp, Homo sapiens
tggctcagccagccctaggaac

SEQ ID NO: 8404808 - DNA, 22 bp, Homo sapiens
tggctcagccagccctaggaac

SEQ ID NO: 8404809 - DNA, 22 bp, Homo sapiens
tggctcagccagccctaggaac

SEQ ID NO: 8404810 - DNA, 22 bp, Homo sapiens
tggctcagcttacttttgaggg

SEQ ID NO: 8404811 - DNA, 22 bp, Homo sapiens
tggctcagcaagacattgacct

SEQ ID NO: 8404812 - DNA, 22 bp, Homo sapiens
tggctcagcaggttagaaacta

SEQ ID NO: 8404813 - DNA, 22 bp, Homo sapiens
tggctcagcattcactggtctt

SEQ ID NO: 8404814 - DNA, 22 bp, Homo sapiens
tggctcagtggcagccgcagct

SEQ ID NO: 8404815 - DNA, 22 bp, Homo sapiens
tggctcagtgacattcctccca

SEQ ID NO: 8404816 - DNA, 22 bp, Homo sapiens
tggctcagtgcattcacagtaa

SEQ ID NO: 8404817 - DNA, 22 bp, Homo sapiens
tggctcagtctgggttgactga

SEQ ID NO: 8404818 - DNA, 22 bp, Homo sapiens
tggctcagtgaagagataactt

SEQ ID NO: 8404819 - DNA, 22 bp, Homo sapiens
tggctcagtcatggatgagtaa

SEQ ID NO: 8404820 - DNA, 22 bp, Homo sapiens
tggctcagtaatcgagtctcct

SEQ ID NO: 8404821 - DNA, 22 bp, Homo sapiens
tggctcagtagcagtgtggtca

SEQ ID NO: 8404822 - DNA, 22 bp, Homo sapiens
tggctcaggtgtgagctgaaga

SEQ ID NO: 8404823 - DNA, 23 bp, Homo sapiens
tggctcagggtctcttatgaagt

SEQ ID NO: 8404824 - DNA, 22 bp, Homo sapiens
tggctcagggtccccaaatggt

SEQ ID NO: 8404825 - DNA, 22 bp, Homo sapiens
tggctcaggggtctggctctgt

SEQ ID NO: 8404826 - DNA, 22 bp, Homo sapiens
tggctcagaagaaaaggtaaac

SEQ ID NO: 8404827 - DNA, 22 bp, Homo sapiens
tggctcagaactacttctagtt

SEQ ID NO: 8404828 - DNA, 22 bp, Homo sapiens
tggctcagaaggctgccttcac

SEQ ID NO: 8404829 - DNA, 22 bp, Homo sapiens
tggctcagagagggagtgtgga

SEQ ID NO: 8404830 - DNA, 22 bp, Homo sapiens
tggctcagagccttgagagctg

SEQ ID NO: 8404831 - DNA, 22 bp, Homo sapiens
tggctcagagcagggactctgg

SEQ ID NO: 8404832 - DNA, 22 bp, Homo sapiens
tggctcagatgctcttccagtg

SEQ ID NO: 8404833 - DNA, 22 bp, Homo sapiens
tggctcagatgctcttccagtg

SEQ ID NO: 8404834 - DNA, 22 bp, Homo sapiens
tggctcagatttttgtaggctt

SEQ ID NO: 8404835 - DNA, 18 bp, Homo sapiens
tggctcagatggctttaa

SEQ ID NO: 8404836 - DNA, 22 bp, Homo sapiens
tggctcagaggggaagtggttt

SEQ ID NO: 8404837 - DNA, 22 bp, Homo sapiens
tggctcagagttcatcttttag

SEQ ID NO: 8404838 - DNA, 22 bp, Homo sapiens
tggctcagataattcaaggggc

SEQ ID NO: 8404839 - DNA, 22 bp, Homo sapiens
tggcgaggccaggccagggcct

SEQ ID NO: 8404840 - DNA, 22 bp, Homo sapiens
tggcctggttgttgctgccgtt

SEQ ID NO: 8404841 - DNA, 22 bp, Homo sapiens
tgggaaggtacacgggaaagag

SEQ ID NO: 8404842 - DNA, 22 bp, Homo sapiens
tgggaaggggagctggaaagga

SEQ ID NO: 8404843 - DNA, 22 bp, Homo sapiens
tgggaagggtcaacagctggaa

SEQ ID NO: 8404844 - DNA, 22 bp, Homo sapiens
tgggaagggtcaacagctggaa

SEQ ID NO: 8404845 - DNA, 22 bp, Homo sapiens
tgggaagggccgatggagcctc

SEQ ID NO: 8404846 - DNA, 22 bp, Homo sapiens
tgggaaggcgtggaagtagaag

SEQ ID NO: 8404847 - DNA, 22 bp, Homo sapiens
tgggacaggttggagagaagca

SEQ ID NO: 8404848 - DNA, 22 bp, Homo sapiens
tgggacaggttggagagaagca

SEQ ID NO: 8404849 - DNA, 22 bp, Homo sapiens
tgggacagtgaccccagaggtc

SEQ ID NO: 8404850 - DNA, 22 bp, Homo sapiens
tgggacagtgtgccttgctcct

SEQ ID NO: 8404851 - DNA, 22 bp, Homo sapiens
tgggacagttgtcctccactct

SEQ ID NO: 8404852 - DNA, 22 bp, Homo sapiens
tgggacagtgtgccttgctcct

SEQ ID NO: 8404853 - DNA, 22 bp, Homo sapiens
tgggacagttgtcctccactct

SEQ ID NO: 8404854 - DNA, 21 bp, Homo sapiens
tgggacagtgatggctcctcc

SEQ ID NO: 8404855 - DNA, 21 bp, Homo sapiens
tgggacagtgatggctcctcc

SEQ ID NO: 8404856 - DNA, 22 bp, Homo sapiens
tgggactgtgacctccagggta

SEQ ID NO: 8404857 - DNA, 22 bp, Homo sapiens
tgggagagtttgtttagagtga

SEQ ID NO: 8404858 - DNA, 22 bp, Homo sapiens
tgggagagtctaaaaccgaggt

SEQ ID NO: 8404859 - DNA, 19 bp, Homo sapiens
tgggagaggcaacagagta

SEQ ID NO: 8404860 - DNA, 22 bp, Homo sapiens
tgggaggacttgtgggcttcat

SEQ ID NO: 8404861 - DNA, 22 bp, Homo sapiens
tgggaggatctcttgaggccag

SEQ ID NO: 8404862 - DNA, 22 bp, Homo sapiens
tgggaaagactcaggacaggag

SEQ ID NO: 8404863 - DNA, 20 bp, Homo sapiens
tgggaaagtctaagtgcctc

SEQ ID NO: 8404864 - DNA, 20 bp, Homo sapiens
tgggaaagtctaagtgcctc

SEQ ID NO: 8404865 - DNA, 22 bp, Homo sapiens
tggcttctggccaggcacagga

SEQ ID NO: 8404866 - DNA, 22 bp, Homo sapiens
tggcttctggctggtgagaaat

SEQ ID NO: 8404867 - DNA, 22 bp, Homo sapiens
tggctgtgtgccaggctgtctg

SEQ ID NO: 8404868 - DNA, 22 bp, Homo sapiens
tggctgtgcctctttccaggcc

SEQ ID NO: 8404869 - DNA, 22 bp, Homo sapiens
tggctgtgggatgagagcctca

SEQ ID NO: 8404870 - DNA, 20 bp, Homo sapiens
tggctgtgggcatctgtttc

SEQ ID NO: 8404871 - DNA, 19 bp, Homo sapiens
tggctgggtgccaatggcc

SEQ ID NO: 8404872 - DNA, 18 bp, Homo sapiens
tggctggcagtgggcagc

SEQ ID NO: 8404873 - DNA, 23 bp, Homo sapiens
tggctggcagaaactgaagcatg

SEQ ID NO: 8404874 - DNA, 22 bp, Homo sapiens
tggcagggagccaccggtcatg

SEQ ID NO: 8404875 - DNA, 22 bp, Homo sapiens
tggcagggagccaccggtcatg

SEQ ID NO: 8404876 - DNA, 18 bp, Homo sapiens
tggcagggaggaaatata

SEQ ID NO: 8404877 - DNA, 19 bp, Homo sapiens
tggcagggagtgatattag

SEQ ID NO: 8404878 - DNA, 21 bp, Homo sapiens
tggcaggggtagtagtacagc

SEQ ID NO: 8404879 - DNA, 18 bp, Homo sapiens
tggcaggggcagtacgcc

SEQ ID NO: 8404880 - DNA, 22 bp, Homo sapiens
tggcagggcctgaatcttatac

SEQ ID NO: 8404881 - DNA, 22 bp, Homo sapiens
tggcagggcctgctcatcatcc

SEQ ID NO: 8404882 - DNA, 22 bp, Homo sapiens
tggcagggagttgcaggatttc

SEQ ID NO: 8404883 - DNA, 22 bp, Homo sapiens
tggcagagttggaggtggaaga

SEQ ID NO: 8404884 - DNA, 22 bp, Homo sapiens
tggcagagtctgggcttgggca

SEQ ID NO: 8404885 - DNA, 22 bp, Homo sapiens
tggcagcagccatggaaggccc

SEQ ID NO: 8404886 - DNA, 22 bp, Homo sapiens
tggcacgacaattggcaccaat

SEQ ID NO: 8404887 - DNA, 22 bp, Homo sapiens
tggcacatagcaggtactcagt

SEQ ID NO: 8404888 - DNA, 22 bp, Homo sapiens
tggcactggaatcgtagccttg

SEQ ID NO: 8404889 - DNA, 22 bp, Homo sapiens
tggcactgccaacctgctaggt

SEQ ID NO: 8404890 - DNA, 22 bp, Homo sapiens
tggcactgtcaccaatgctgtc

SEQ ID NO: 8404891 - DNA, 22 bp, Homo sapiens
tggcagagactcctcctgggag

SEQ ID NO: 8404892 - DNA, 22 bp, Homo sapiens
tggcagagctggctgcggatga

SEQ ID NO: 8404893 - DNA, 22 bp, Homo sapiens
tggcacagaaaaatgctccatt

SEQ ID NO: 8404894 - DNA, 22 bp, Homo sapiens
tggcacagacagatcaggagtc

SEQ ID NO: 8404895 - DNA, 22 bp, Homo sapiens
tggcacagtgctggatggtgct

SEQ ID NO: 8404896 - DNA, 22 bp, Homo sapiens
tggcacagccatcttctcctgc

SEQ ID NO: 8404897 - DNA, 17 bp, Homo sapiens
tggcacagaggtgctat

SEQ ID NO: 8404898 - DNA, 22 bp, Homo sapiens
tggatggttctgggcggcagca

SEQ ID NO: 8404899 - DNA, 22 bp, Homo sapiens
tggatggttgaaaacgggcagt

SEQ ID NO: 8404900 - DNA, 22 bp, Homo sapiens
tggattgggtgctgaagcatag

SEQ ID NO: 8404901 - DNA, 22 bp, Homo sapiens
tggccctgacttggaggcctga

SEQ ID NO: 8404902 - DNA, 22 bp, Homo sapiens
tggccctgcacccagagcagtt

SEQ ID NO: 8404903 - DNA, 22 bp, Homo sapiens
tggcccaggtgcaagagacaga

SEQ ID NO: 8404904 - DNA, 22 bp, Homo sapiens
tggccctgaatcaaggccagca

SEQ ID NO: 8404905 - DNA, 22 bp, Homo sapiens
tggccatgggatagtgcagggg

SEQ ID NO: 8404906 - DNA, 22 bp, Homo sapiens
tggccatgacatggaggctttg

SEQ ID NO: 8404907 - DNA, 22 bp, Homo sapiens
tggccatgggatagtgcagggg

SEQ ID NO: 8404908 - DNA, 22 bp, Homo sapiens
tggccatgaaggaggcagcaga

SEQ ID NO: 8404909 - DNA, 22 bp, Homo sapiens
tggccagtttgctcaggcagtc

SEQ ID NO: 8404910 - DNA, 22 bp, Homo sapiens
tggccagtggggttgagcagga

SEQ ID NO: 8404911 - DNA, 22 bp, Homo sapiens
tggccagtgtcggaggccagga

SEQ ID NO: 8404912 - DNA, 22 bp, Homo sapiens
tggccagtgttggctagggaca

SEQ ID NO: 8404913 - DNA, 22 bp, Homo sapiens
tggcccaggtctctctgagccc

SEQ ID NO: 8404914 - DNA, 22 bp, Homo sapiens
tggcccaggccaaagccctgga

SEQ ID NO: 8404915 - DNA, 22 bp, Homo sapiens
tggcccagggagttcatggtgt

SEQ ID NO: 8404916 - DNA, 22 bp, Homo sapiens
tggccctgtgtgcaggctgcac

SEQ ID NO: 8404917 - DNA, 18 bp, Homo sapiens
tggcctggagacaactct

SEQ ID NO: 8404918 - DNA, 22 bp, Homo sapiens
tggcctgaggctcggcatgggt

SEQ ID NO: 8404919 - DNA, 22 bp, Homo sapiens
tggcctgagttgtctgcaggcc

SEQ ID NO: 8404920 - DNA, 23 bp, Homo sapiens
tggcagtgcccagggagatgatc

SEQ ID NO: 8404921 - DNA, 22 bp, Homo sapiens
tggcagtgatgcggcaggacat

SEQ ID NO: 8404922 - DNA, 18 bp, Homo sapiens
tggcagtgaggtaggcat

SEQ ID NO: 8404923 - DNA, 22 bp, Homo sapiens
tggcaggtttcctcctcatagt

SEQ ID NO: 8404924 - DNA, 22 bp, Homo sapiens
tggcaggtcatgagtggccacc

SEQ ID NO: 8404925 - DNA, 22 bp, Homo sapiens
tggcaggtccactcacagatct

SEQ ID NO: 8404926 - DNA, 22 bp, Homo sapiens
tggcaggtgaagttgttaggga

SEQ ID NO: 8404927 - DNA, 22 bp, Homo sapiens
tggcaggtgccatgggctcaga

SEQ ID NO: 8404928 - DNA, 22 bp, Homo sapiens
tggcaggtggagacagcagagc

SEQ ID NO: 8404929 - DNA, 22 bp, Homo sapiens
tggcaggtggcacagcctggga

SEQ ID NO: 8404930 - DNA, 22 bp, Homo sapiens
tggcaggttatgcgggccacat

SEQ ID NO: 8404931 - DNA, 22 bp, Homo sapiens
tggcagtggataggggagcggt

SEQ ID NO: 8404932 - DNA, 19 bp, Homo sapiens
tggcagtgtggggtatgaa

SEQ ID NO: 8404933 - DNA, 22 bp, Homo sapiens
tggcatggcaaccctgcaggga

SEQ ID NO: 8404934 - DNA, 22 bp, Homo sapiens
tggccaggccggggacagaact

SEQ ID NO: 8404935 - DNA, 22 bp, Homo sapiens
tggccaggccggggacagaact

SEQ ID NO: 8404936 - DNA, 21 bp, Homo sapiens
tggccagctggagtctccaca

SEQ ID NO: 8404937 - DNA, 22 bp, Homo sapiens
tggccagccttgtcatcgcttt

SEQ ID NO: 8404938 - DNA, 21 bp, Homo sapiens
tggccagctgctcgtctcctc

SEQ ID NO: 8404939 - DNA, 22 bp, Homo sapiens
tggccaggcattcagataagac

SEQ ID NO: 8404940 - DNA, 22 bp, Homo sapiens
tggccaggcattcagataagac

SEQ ID NO: 8404941 - DNA, 22 bp, Homo sapiens
tggccagcccttcagccatgcc

SEQ ID NO: 8404942 - DNA, 22 bp, Homo sapiens
tggccagcagagttcactctct

SEQ ID NO: 8404943 - DNA, 22 bp, Homo sapiens
tggccagtagataggcaggcaa

SEQ ID NO: 8404944 - DNA, 23 bp, Homo sapiens
tggccaggtagaggaggtagtga

SEQ ID NO: 8404945 - DNA, 23 bp, Homo sapiens
tggccaggtagaggaggtagtga

SEQ ID NO: 8404946 - DNA, 22 bp, Homo sapiens
tggccaggctggtctggaacgc

SEQ ID NO: 8404947 - DNA, 22 bp, Homo sapiens
tggccaggcctcttggtgccca

SEQ ID NO: 8404948 - DNA, 22 bp, Homo sapiens
tggcattggttgccaggctgtg

SEQ ID NO: 8404949 - DNA, 22 bp, Homo sapiens
tggccacatatgtgggacagct

SEQ ID NO: 8404950 - DNA, 22 bp, Homo sapiens
tggccacatctgaaatgagtgt

SEQ ID NO: 8404951 - DNA, 22 bp, Homo sapiens
tggccactcctccctgcaggct

SEQ ID NO: 8404952 - DNA, 22 bp, Homo sapiens
tggccagaactcagacatgtgg

SEQ ID NO: 8404953 - DNA, 19 bp, Homo sapiens
tgctgctgtccttgcaggg

SEQ ID NO: 8404954 - DNA, 22 bp, Homo sapiens
tgctgcttggcaccctcagagt

SEQ ID NO: 8404955 - DNA, 22 bp, Homo sapiens
tgctggccaacaaggctccaag

SEQ ID NO: 8404956 - DNA, 18 bp, Homo sapiens
tgctgtgcacagccctat

SEQ ID NO: 8404957 - DNA, 18 bp, Homo sapiens
tgctgtgcacagccctat

SEQ ID NO: 8404958 - DNA, 22 bp, Homo sapiens
tgctgtgcatcatagtgtttgg

SEQ ID NO: 8404959 - DNA, 23 bp, Homo sapiens
tgctgtgcctttgtctgcctcca

SEQ ID NO: 8404960 - DNA, 22 bp, Homo sapiens
tgctgtgcaaaggtgatgtgag

SEQ ID NO: 8404961 - DNA, 22 bp, Homo sapiens
tgctgggctagaagctgaggcc

SEQ ID NO: 8404962 - DNA, 22 bp, Homo sapiens
tgctgggctagggtggagctct

SEQ ID NO: 8404963 - DNA, 22 bp, Homo sapiens
tgctgggcttgaaagctgctaa

SEQ ID NO: 8404964 - DNA, 22 bp, Homo sapiens
tgctgggccaaagcagggtttt

SEQ ID NO: 8404965 - DNA, 22 bp, Homo sapiens
tgctgggcatttatgcagatgg

SEQ ID NO: 8404966 - DNA, 18 bp, Homo sapiens
tgctgggcattaggctta

SEQ ID NO: 8404967 - DNA, 20 bp, Homo sapiens
tgctgggcatgcagtggaaa

SEQ ID NO: 8404968 - DNA, 22 bp, Homo sapiens
tgctgggcatcgtaggaggtac

SEQ ID NO: 8404969 - DNA, 22 bp, Homo sapiens
tgctgtcagacagcagtggtaa

SEQ ID NO: 8404970 - DNA, 22 bp, Homo sapiens
tgctggggcagaagagccaaga

SEQ ID NO: 8404971 - DNA, 22 bp, Homo sapiens
tgctggggagtgattgaccatc

SEQ ID NO: 8404972 - DNA, 20 bp, Homo sapiens
tgctggggacatacagggtg

SEQ ID NO: 8404973 - DNA, 22 bp, Homo sapiens
tgctccaggagcaacctttgag

SEQ ID NO: 8404974 - DNA, 22 bp, Homo sapiens
tgctccagcccctggtgcacag

SEQ ID NO: 8404975 - DNA, 22 bp, Homo sapiens
tgctcgccccacatgccctcat

SEQ ID NO: 8404976 - DNA, 22 bp, Homo sapiens
tgctgagatctgccagtagatg

SEQ ID NO: 8404977 - DNA, 22 bp, Homo sapiens
tgctgagcgcatccggcggccg

SEQ ID NO: 8404978 - DNA, 22 bp, Homo sapiens
tgctgaggaaaaatgtgactct

SEQ ID NO: 8404979 - DNA, 19 bp, Homo sapiens
tgctgaggatgcaagatcc

SEQ ID NO: 8404980 - DNA, 22 bp, Homo sapiens
tgctgaggaggtggctgtgctt

SEQ ID NO: 8404981 - DNA, 22 bp, Homo sapiens
tgctgaggactaaaggagatga

SEQ ID NO: 8404982 - DNA, 22 bp, Homo sapiens
tgctgaggttgtggagtgcatt

SEQ ID NO: 8404983 - DNA, 22 bp, Homo sapiens
tgctgaggtttctgactatgga

SEQ ID NO: 8404984 - DNA, 20 bp, Homo sapiens
tgctgaggcctgaggcctgg

SEQ ID NO: 8404985 - DNA, 20 bp, Homo sapiens
tgctgaggcctgaggcctgg

SEQ ID NO: 8404986 - DNA, 22 bp, Homo sapiens
tgctgaggcagatgtctgtgac

SEQ ID NO: 8404987 - DNA, 22 bp, Homo sapiens
tgctgaggcagatgtctgtgac

SEQ ID NO: 8404988 - DNA, 22 bp, Homo sapiens
tgctgaggcagtcctaacagga

SEQ ID NO: 8404989 - DNA, 22 bp, Homo sapiens
tgctgaggcatttggacagagt

SEQ ID NO: 8404990 - DNA, 22 bp, Homo sapiens
tgcctggctaatttttgtatcc

SEQ ID NO: 8404991 - DNA, 22 bp, Homo sapiens
tgctcagctggtgccagggtcc

SEQ ID NO: 8404992 - DNA, 22 bp, Homo sapiens
tgctcattggcgatctgaggga

SEQ ID NO: 8404993 - DNA, 19 bp, Homo sapiens
tgctcagctcctgtgagtc

SEQ ID NO: 8404994 - DNA, 22 bp, Homo sapiens
tgctcagccgtgagcagagccg

SEQ ID NO: 8404995 - DNA, 22 bp, Homo sapiens
tgcggcagccaccgcgtggccc

SEQ ID NO: 8404996 - DNA, 22 bp, Homo sapiens
tggataaatgtgcagatgacat

SEQ ID NO: 8404997 - DNA, 22 bp, Homo sapiens
tggagtgggcaatgtaggcaag

SEQ ID NO: 8404998 - DNA, 22 bp, Homo sapiens
tggataaaatgacattacctga

SEQ ID NO: 8404999 - DNA, 20 bp, Homo sapiens
tggagttgttctgctaggtc

SEQ ID NO: 8405000 - DNA, 22 bp, Homo sapiens
tggaggtgtccaactcgtgggt

SEQ ID NO: 8405001 - DNA, 22 bp, Homo sapiens
tggaggtgtataaggtagcttc

SEQ ID NO: 8405002 - DNA, 22 bp, Homo sapiens
tggagtggacttcatgaggcca

SEQ ID NO: 8405003 - DNA, 22 bp, Homo sapiens
tggaggctggagtgcagtggcg

SEQ ID NO: 8405004 - DNA, 22 bp, Homo sapiens
tggagggcgcttagatggaggg

SEQ ID NO: 8405005 - DNA, 22 bp, Homo sapiens
tggagggcatgctgtccatggg

SEQ ID NO: 8405006 - DNA, 22 bp, Homo sapiens
tggaggtggtgcccagcaattt

SEQ ID NO: 8405007 - DNA, 22 bp, Homo sapiens
tggagggctaagctgagggata

SEQ ID NO: 8405008 - DNA, 22 bp, Homo sapiens
tggaggagaatttatggtcgaa

SEQ ID NO: 8405009 - DNA, 22 bp, Homo sapiens
tggaggagtagattttcagagg

SEQ ID NO: 8405010 - DNA, 22 bp, Homo sapiens
tggaggagtgtgattgtctgcc

SEQ ID NO: 8405011 - DNA, 22 bp, Homo sapiens
tggagcagaaatttgaagccat

SEQ ID NO: 8405012 - DNA, 22 bp, Homo sapiens
tggagaggagcaccatggccat

SEQ ID NO: 8405013 - DNA, 19 bp, Homo sapiens
tggagaggaaatgctgctc

SEQ ID NO: 8405014 - DNA, 22 bp, Homo sapiens
tggaagcactgaagagacaacc

SEQ ID NO: 8405015 - DNA, 23 bp, Homo sapiens
tggaagcaatcactgtagtgaat

SEQ ID NO: 8405016 - DNA, 22 bp, Homo sapiens
tggaagcacaggatcagtggaa

SEQ ID NO: 8405017 - DNA, 20 bp, Homo sapiens
tggaaggtcccagaggaatt

SEQ ID NO: 8405018 - DNA, 22 bp, Homo sapiens
tggaatcttgcgggcacatggc

SEQ ID NO: 8405019 - DNA, 22 bp, Homo sapiens
tggaatctgtatgtatgtataa

SEQ ID NO: 8405020 - DNA, 22 bp, Homo sapiens
tggaagtgatgctgaggtgacg

SEQ ID NO: 8405021 - DNA, 22 bp, Homo sapiens
tggaagtgtctacatgtggagt

SEQ ID NO: 8405022 - DNA, 23 bp, Homo sapiens
tggacagggtaactggtggtttt

SEQ ID NO: 8405023 - DNA, 22 bp, Homo sapiens
tggacaggctcctaggggttcc

SEQ ID NO: 8405024 - DNA, 20 bp, Homo sapiens
tggacaggggcataggttgc

SEQ ID NO: 8405025 - DNA, 23 bp, Homo sapiens
tggacaggacccccttcggaccc

SEQ ID NO: 8405026 - DNA, 22 bp, Homo sapiens
tggacagagaggaaggccattt

SEQ ID NO: 8405027 - DNA, 22 bp, Homo sapiens
tggacagagctgacagtatata

SEQ ID NO: 8405028 - DNA, 22 bp, Homo sapiens
tggaatgttttcctaaatcaga

SEQ ID NO: 8405029 - DNA, 22 bp, Homo sapiens
tggaatttagttaattccattt

SEQ ID NO: 8405030 - DNA, 22 bp, Homo sapiens
tggaatgttgcataagatctga

SEQ ID NO: 8405031 - DNA, 22 bp, Homo sapiens
tggaatgttgctctgccttgcg

SEQ ID NO: 8405032 - DNA, 22 bp, Homo sapiens
tggaatgttgataaacataggc

SEQ ID NO: 8405033 - DNA, 22 bp, Homo sapiens
tggaatgttatgatgatggtaa

SEQ ID NO: 8405034 - DNA, 19 bp, Homo sapiens
tggaatgttccaaggaggc

SEQ ID NO: 8405035 - DNA, 22 bp, Homo sapiens
tggaatgtttgacttattcagt

SEQ ID NO: 8405036 - DNA, 23 bp, Homo sapiens
tggaatgtttcttgtactgaatg

SEQ ID NO: 8405037 - DNA, 22 bp, Homo sapiens
tggaatgtttccccagcctgca

SEQ ID NO: 8405038 - DNA, 22 bp, Homo sapiens
tggaatgttgtgtataggtcag

SEQ ID NO: 8405039 - DNA, 22 bp, Homo sapiens
tggaatgttgggatttaagtgt

SEQ ID NO: 8405040 - DNA, 22 bp, Homo sapiens
tggaaaggaggcttgtggaata

SEQ ID NO: 8405041 - DNA, 23 bp, Homo sapiens
tggaaagcggacctggggcagag

SEQ ID NO: 8405042 - DNA, 22 bp, Homo sapiens
tggaaaggacagttgctgatag

SEQ ID NO: 8405043 - DNA, 22 bp, Homo sapiens
tggaaaatcaggggacattgat

SEQ ID NO: 8405044 - DNA, 22 bp, Homo sapiens
tggaaacaaagctggatgtagt

SEQ ID NO: 8405045 - DNA, 19 bp, Homo sapiens
tgcttgcctgcctttccca

SEQ ID NO: 8405046 - DNA, 22 bp, Homo sapiens
tggtggcaatgtcctggagaag

SEQ ID NO: 8405047 - DNA, 22 bp, Homo sapiens
tggtggcatcagtgaagtacac

SEQ ID NO: 8405048 - DNA, 22 bp, Homo sapiens
tggtggccaattcacagggctc

SEQ ID NO: 8405049 - DNA, 22 bp, Homo sapiens
tggtggccacgtgggcgcgagc

SEQ ID NO: 8405050 - DNA, 22 bp, Homo sapiens
tggtggcagctgagtgtcaggt

SEQ ID NO: 8405051 - DNA, 22 bp, Homo sapiens
tggtgggggaggctgtctagca

SEQ ID NO: 8405052 - DNA, 22 bp, Homo sapiens
tggtggggctttccttctgctt

SEQ ID NO: 8405053 - DNA, 22 bp, Homo sapiens
tggtggggccagacttcagctc

SEQ ID NO: 8405054 - DNA, 22 bp, Homo sapiens
tggtgggcacagtgcccaggct

SEQ ID NO: 8405055 - DNA, 22 bp, Homo sapiens
tggtgggagtgagggcatgcca

SEQ ID NO: 8405056 - DNA, 20 bp, Homo sapiens
tggtggccagtgctgcaggc

SEQ ID NO: 8405057 - DNA, 16 bp, Homo sapiens
tggtggggaggacagc

SEQ ID NO: 8405058 - DNA, 21 bp, Homo sapiens
tggtggagtgtgctgagcatg

SEQ ID NO: 8405059 - DNA, 22 bp, Homo sapiens
tggtggacaccgcagccatgaa

SEQ ID NO: 8405060 - DNA, 20 bp, Homo sapiens
tggtcctcacatgccatctt

SEQ ID NO: 8405061 - DNA, 22 bp, Homo sapiens
tggtcctcaccctacccagctg

SEQ ID NO: 8405062 - DNA, 20 bp, Homo sapiens
tggtcctcacatgccatctt

SEQ ID NO: 8405063 - DNA, 22 bp, Homo sapiens
tggtcaggtacctctggctgtc

SEQ ID NO: 8405064 - DNA, 22 bp, Homo sapiens
tggtccttcttgaagagtgagt

SEQ ID NO: 8405065 - DNA, 22 bp, Homo sapiens
tggtccttgctatagagtgata

SEQ ID NO: 8405066 - DNA, 22 bp, Homo sapiens
tggtgacagcatggaagaagtg

SEQ ID NO: 8405067 - DNA, 22 bp, Homo sapiens
tggtctctacggaggaaagctg

SEQ ID NO: 8405068 - DNA, 18 bp, Homo sapiens
tggtgaagggtggaggag

SEQ ID NO: 8405069 - DNA, 23 bp, Homo sapiens
tggtggggtcttggagacagcac

SEQ ID NO: 8405070 - DNA, 22 bp, Homo sapiens
tggttgtataatgtcactaagc

SEQ ID NO: 8405071 - DNA, 23 bp, Homo sapiens
tgtaaaatggggtagtgttacca

SEQ ID NO: 8405072 - DNA, 22 bp, Homo sapiens
tgtacagtatatttcaaagcca

SEQ ID NO: 8405073 - DNA, 22 bp, Homo sapiens
tgtacagtgccatgcagtttgc

SEQ ID NO: 8405074 - DNA, 22 bp, Homo sapiens
tgtacagagactaccattaata

SEQ ID NO: 8405075 - DNA, 22 bp, Homo sapiens
tgtacagaggtgtacatatgat

SEQ ID NO: 8405076 - DNA, 22 bp, Homo sapiens
tgtacacatttttatgttaaca

SEQ ID NO: 8405077 - DNA, 22 bp, Homo sapiens
tgtacacatggtgtacactccc

SEQ ID NO: 8405078 - DNA, 22 bp, Homo sapiens
tgtacacaacgtgcaggtttgt

SEQ ID NO: 8405079 - DNA, 22 bp, Homo sapiens
tgtacacaatgataaattatta

SEQ ID NO: 8405080 - DNA, 22 bp, Homo sapiens
tgtacaatgccgagactaactc

SEQ ID NO: 8405081 - DNA, 22 bp, Homo sapiens
tgtacaatgtggccagtgttaa

SEQ ID NO: 8405082 - DNA, 22 bp, Homo sapiens
tgtacaatggctataataccct

SEQ ID NO: 8405083 - DNA, 20 bp, Homo sapiens
tgtacacagtactttacaat

SEQ ID NO: 8405084 - DNA, 22 bp, Homo sapiens
tgtacacaatgtgcaggtttgt

SEQ ID NO: 8405085 - DNA, 22 bp, Homo sapiens
tgtacaaggccatctacatgct

SEQ ID NO: 8405086 - DNA, 22 bp, Homo sapiens
tgtacaagttgcctgctatctc

SEQ ID NO: 8405087 - DNA, 22 bp, Homo sapiens
tgtacaatagctattatctcca

SEQ ID NO: 8405088 - DNA, 22 bp, Homo sapiens
tgtacaatctgatgatgtatgg

SEQ ID NO: 8405089 - DNA, 17 bp, Homo sapiens
tgtacaacagtaccttc

SEQ ID NO: 8405090 - DNA, 22 bp, Homo sapiens
tgtacaagaataattttatata

SEQ ID NO: 8405091 - DNA, 22 bp, Homo sapiens
tgtacaagcaaatagaccttca

SEQ ID NO: 8405092 - DNA, 22 bp, Homo sapiens
tgtacaaagagtatagctttga

SEQ ID NO: 8405093 - DNA, 22 bp, Homo sapiens
tgtacaaagttaaacctatata

SEQ ID NO: 8405094 - DNA, 18 bp, Homo sapiens
tgtagctggaggccaggc

SEQ ID NO: 8405095 - DNA, 17 bp, Homo sapiens
tgtagcttctccttctc

SEQ ID NO: 8405096 - DNA, 22 bp, Homo sapiens
tgtagatatagaaaaagactga

SEQ ID NO: 8405097 - DNA, 22 bp, Homo sapiens
tgtagatagtgatttatgacca

SEQ ID NO: 8405098 - DNA, 22 bp, Homo sapiens
tgtactaatgcatttaactaac

SEQ ID NO: 8405099 - DNA, 22 bp, Homo sapiens
tgtactaaggctgtgtagatgt

SEQ ID NO: 8405100 - DNA, 22 bp, Homo sapiens
tgtcacaaacatacattataga

SEQ ID NO: 8405101 - DNA, 22 bp, Homo sapiens
tgtcctcagatatgtctactct

SEQ ID NO: 8405102 - DNA, 22 bp, Homo sapiens
tgtcctcacaggaatgaacttt

SEQ ID NO: 8405103 - DNA, 22 bp, Homo sapiens
tgtccagggggcttacctggag

SEQ ID NO: 8405104 - DNA, 22 bp, Homo sapiens
tgtcccaggtcctagatgacca

SEQ ID NO: 8405105 - DNA, 22 bp, Homo sapiens
tgtcccagttttgcaggttaga

SEQ ID NO: 8405106 - DNA, 22 bp, Homo sapiens
tgtcccaggcctcatgttgcca

SEQ ID NO: 8405107 - DNA, 22 bp, Homo sapiens
tgtcccaggctgaagtacagtg

SEQ ID NO: 8405108 - DNA, 22 bp, Homo sapiens
tgtcattttcatcctaaggagc

SEQ ID NO: 8405109 - DNA, 22 bp, Homo sapiens
tgtcattttatgtatgtggtct

SEQ ID NO: 8405110 - DNA, 22 bp, Homo sapiens
tgggcatgagtggacagagaag

SEQ ID NO: 8405111 - DNA, 22 bp, Homo sapiens
tgggcatggactgtggagccgc

SEQ ID NO: 8405112 - DNA, 22 bp, Homo sapiens
tgggcaggttgttatttgacat

SEQ ID NO: 8405113 - DNA, 22 bp, Homo sapiens
tgggcagggtctctgttatcag

SEQ ID NO: 8405114 - DNA, 22 bp, Homo sapiens
tgggcaggggccctgcttccgt

SEQ ID NO: 8405115 - DNA, 22 bp, Homo sapiens
tgggcaggtgctattttccatg

SEQ ID NO: 8405116 - DNA, 19 bp, Homo sapiens
tgggcaggttcagtaatgg

SEQ ID NO: 8405117 - DNA, 22 bp, Homo sapiens
tgggccagctccctgcccctgg

SEQ ID NO: 8405118 - DNA, 22 bp, Homo sapiens
tgggccagcactgggtgctcat

SEQ ID NO: 8405119 - DNA, 22 bp, Homo sapiens
tgggccagcactgggtgctcat

SEQ ID NO: 8405120 - DNA, 22 bp, Homo sapiens
tgggccagctgaagtgccgccc

SEQ ID NO: 8405121 - DNA, 22 bp, Homo sapiens
tgggccagcaattgctgctcag

SEQ ID NO: 8405122 - DNA, 22 bp, Homo sapiens
tgggccagcaattgctgctcag

SEQ ID NO: 8405123 - DNA, 23 bp, Homo sapiens
tgggcagcttctgcatgcccacc

SEQ ID NO: 8405124 - DNA, 22 bp, Homo sapiens
tgggcagccatcccagcctctc

SEQ ID NO: 8405125 - DNA, 22 bp, Homo sapiens
tgggcagggagctggaaccaca

SEQ ID NO: 8405126 - DNA, 22 bp, Homo sapiens
tgggcagggagctggaaccaca

SEQ ID NO: 8405127 - DNA, 22 bp, Homo sapiens
tgggcaggggccctgcttccgt

SEQ ID NO: 8405128 - DNA, 22 bp, Homo sapiens
tgggcagggatctcttttgcaa

SEQ ID NO: 8405129 - DNA, 20 bp, Homo sapiens
tgggcagcactgctggctgg

SEQ ID NO: 8405130 - DNA, 22 bp, Homo sapiens
tgggcagcagaaccaggccgac

SEQ ID NO: 8405131 - DNA, 22 bp, Homo sapiens
tgggcagcatcctccacagtca

SEQ ID NO: 8405132 - DNA, 22 bp, Homo sapiens
tgggcagcagcaaagccagact

SEQ ID NO: 8405133 - DNA, 22 bp, Homo sapiens
tgggagtgatacagtatggaat

SEQ ID NO: 8405134 - DNA, 22 bp, Homo sapiens
tgggcaagctctgggtggacac

SEQ ID NO: 8405135 - DNA, 22 bp, Homo sapiens
tgggcacaggggaatggatgaa

SEQ ID NO: 8405136 - DNA, 21 bp, Homo sapiens
tgggctctttaacccaggcac

SEQ ID NO: 8405137 - DNA, 18 bp, Homo sapiens
tgggctcaaaggatcctc

SEQ ID NO: 8405138 - DNA, 22 bp, Homo sapiens
tgggctcactggggcagggacc

SEQ ID NO: 8405139 - DNA, 22 bp, Homo sapiens
tgggctcactggggcagggacc

SEQ ID NO: 8405140 - DNA, 22 bp, Homo sapiens
tgggctcactggggcagggacc

SEQ ID NO: 8405141 - DNA, 22 bp, Homo sapiens
tgggctcagccttcatgtggcc

SEQ ID NO: 8405142 - DNA, 21 bp, Homo sapiens
tgggctcagccccagccctgc

SEQ ID NO: 8405143 - DNA, 22 bp, Homo sapiens
tgggctcaggaccccagaggcc

SEQ ID NO: 8405144 - DNA, 22 bp, Homo sapiens
tgggctcaggaccccagaggcc

SEQ ID NO: 8405145 - DNA, 22 bp, Homo sapiens
tgggctcaggaccccagaggcc

SEQ ID NO: 8405146 - DNA, 22 bp, Homo sapiens
tgggctcagctcccaagggaag

SEQ ID NO: 8405147 - DNA, 22 bp, Homo sapiens
tgggctcagggtcgaggacttt

SEQ ID NO: 8405148 - DNA, 22 bp, Homo sapiens
tgggccttacttggggctgact

SEQ ID NO: 8405149 - DNA, 22 bp, Homo sapiens
tgggccttctaatctggtccct

SEQ ID NO: 8405150 - DNA, 22 bp, Homo sapiens
tgggccaggtctgtgtcagctg

SEQ ID NO: 8405151 - DNA, 22 bp, Homo sapiens
tgggccaggtctgtgtcagctg

SEQ ID NO: 8405152 - DNA, 22 bp, Homo sapiens
tgggccaggggcctcttctgat

SEQ ID NO: 8405153 - DNA, 22 bp, Homo sapiens
tgggccagtagctactcgcaag

SEQ ID NO: 8405154 - DNA, 17 bp, Homo sapiens
tgggccagtagaaggga

SEQ ID NO: 8405155 - DNA, 17 bp, Homo sapiens
tgggccagtagaaggga

SEQ ID NO: 8405156 - DNA, 21 bp, Homo sapiens
tgggccagtagaaaggaaggc

SEQ ID NO: 8405157 - DNA, 22 bp, Homo sapiens
tgggccaggtgcagtgctttag

SEQ ID NO: 8405158 - DNA, 22 bp, Homo sapiens
tgggccagtcctgcctaaggtg

SEQ ID NO: 8405159 - DNA, 22 bp, Homo sapiens
tgggccagtcctgcctaaggtg

SEQ ID NO: 8405160 - DNA, 22 bp, Homo sapiens
tgggccagttatttcacctctg

SEQ ID NO: 8405161 - DNA, 22 bp, Homo sapiens
tgggccagttctttactcgtcc

SEQ ID NO: 8405162 - DNA, 22 bp, Homo sapiens
tgggccagttggtgactacaaa

SEQ ID NO: 8405163 - DNA, 22 bp, Homo sapiens
tgggccagttggtgactacaaa

SEQ ID NO: 8405164 - DNA, 22 bp, Homo sapiens
tgggccagttggaatggatact

SEQ ID NO: 8405165 - DNA, 22 bp, Homo sapiens
tgggccagttggaatggatact

SEQ ID NO: 8405166 - DNA, 22 bp, Homo sapiens
tgggcctcatcttcaatgagtc

SEQ ID NO: 8405167 - DNA, 21 bp, Homo sapiens
tgggcctgattcccagggtca

SEQ ID NO: 8405168 - DNA, 22 bp, Homo sapiens
tgggcctcggagcacaggagac

SEQ ID NO: 8405169 - DNA, 22 bp, Homo sapiens
tgggcctgagctcaccaggggc

SEQ ID NO: 8405170 - DNA, 23 bp, Homo sapiens
tggggctgatggagacggaccag

SEQ ID NO: 8405171 - DNA, 22 bp, Homo sapiens
tggggccacagcctcctagctt

SEQ ID NO: 8405172 - DNA, 22 bp, Homo sapiens
tgggggagccttcacagtagct

SEQ ID NO: 8405173 - DNA, 22 bp, Homo sapiens
tgggggagagtgcaagcatgaa

SEQ ID NO: 8405174 - DNA, 22 bp, Homo sapiens
tggggctggggatcttgagcct

SEQ ID NO: 8405175 - DNA, 22 bp, Homo sapiens
tggggcaaagtaggtatttagt

SEQ ID NO: 8405176 - DNA, 22 bp, Homo sapiens
tggggaagggcaccctggagac

SEQ ID NO: 8405177 - DNA, 22 bp, Homo sapiens
tggggaagggcaccctggagac

SEQ ID NO: 8405178 - DNA, 22 bp, Homo sapiens
tggggaagcactttgaacttaa

SEQ ID NO: 8405179 - DNA, 22 bp, Homo sapiens
tggggaagacagcagacactgt

SEQ ID NO: 8405180 - DNA, 22 bp, Homo sapiens
tgggcttggtttctaggtaggt

SEQ ID NO: 8405181 - DNA, 22 bp, Homo sapiens
tgggctggcgtggagagtttag

SEQ ID NO: 8405182 - DNA, 22 bp, Homo sapiens
tgggtaggggacgtggaagaaa

SEQ ID NO: 8405183 - DNA, 22 bp, Homo sapiens
tgggtactcctattagttcagt

SEQ ID NO: 8405184 - DNA, 22 bp, Homo sapiens
tggtattctttctgtagatcat

SEQ ID NO: 8405185 - DNA, 22 bp, Homo sapiens
tgggtgaggatgatgaggcagc

SEQ ID NO: 8405186 - DNA, 22 bp, Homo sapiens
tgttttagttctgtcttgcatg

SEQ ID NO: 8405187 - DNA, 22 bp, Homo sapiens
tgttagattcctgatgaattta

SEQ ID NO: 8405188 - DNA, 22 bp, Homo sapiens
tgttgactcaacactgtgggca

SEQ ID NO: 8405189 - DNA, 22 bp, Homo sapiens
tgtgggaagtttggagggaaag

SEQ ID NO: 8405190 - DNA, 22 bp, Homo sapiens
tgtgggaatcagccaggggggc

SEQ ID NO: 8405191 - DNA, 22 bp, Homo sapiens
tgtgggaagatgttgcaggaga

SEQ ID NO: 8405192 - DNA, 22 bp, Homo sapiens
tgtgggaagagcagtggcagca

SEQ ID NO: 8405193 - DNA, 22 bp, Homo sapiens
tgtgggaatgacgaggaagagg

SEQ ID NO: 8405194 - DNA, 22 bp, Homo sapiens
tgtgggaatgctgatgggatct

SEQ ID NO: 8405195 - DNA, 23 bp, Homo sapiens
tgtgggaatgttggagaggaaac

SEQ ID NO: 8405196 - DNA, 22 bp, Homo sapiens
tgtggctctgcctggcagtatt

SEQ ID NO: 8405197 - DNA, 22 bp, Homo sapiens
tgtggacaccactgggactgga

SEQ ID NO: 8405198 - DNA, 22 bp, Homo sapiens
tgtgggcctgggaaggtgacac

SEQ ID NO: 8405199 - DNA, 20 bp, Homo sapiens
tgtgggccttcggcgtgctc

SEQ ID NO: 8405200 - DNA, 20 bp, Homo sapiens
tgtgggcccttggctggcaa

SEQ ID NO: 8405201 - DNA, 22 bp, Homo sapiens
tgtgggattcatttggatcagc

SEQ ID NO: 8405202 - DNA, 22 bp, Homo sapiens
tgtgtgggagcacgggctgttg

SEQ ID NO: 8405203 - DNA, 22 bp, Homo sapiens
tgtgcatgtgtttcatggatct

SEQ ID NO: 8405204 - DNA, 20 bp, Homo sapiens
tgtgcaggagagtgaggctg

SEQ ID NO: 8405205 - DNA, 22 bp, Homo sapiens
tgtgcaggtgcaggaagggggc

SEQ ID NO: 8405206 - DNA, 19 bp, Homo sapiens
tgtgacatcactgggcagc

SEQ ID NO: 8405207 - DNA, 22 bp, Homo sapiens
tgtgattagctgaatacactgg

SEQ ID NO: 8405208 - DNA, 22 bp, Homo sapiens
tgtgactctggcacatggtgag

SEQ ID NO: 8405209 - DNA, 22 bp, Homo sapiens
tgtctgtgatttaggccagggc

SEQ ID NO: 8405210 - DNA, 22 bp, Homo sapiens
tgtctgcaaagtccagcacagg

SEQ ID NO: 8405211 - DNA, 22 bp, Homo sapiens
ttcattcagtgagactaggacg

SEQ ID NO: 8405212 - DNA, 22 bp, Homo sapiens
ttacagaatgtgccatttggtc

SEQ ID NO: 8405213 - DNA, 22 bp, Homo sapiens
ttacagaatctactcgtggtga

SEQ ID NO: 8405214 - DNA, 22 bp, Homo sapiens
ttacagaaaaggggttgtcctt

SEQ ID NO: 8405215 - DNA, 23 bp, Homo sapiens
ttacatgtgtgcacacattctgg

SEQ ID NO: 8405216 - DNA, 22 bp, Homo sapiens
ttacatgtttacggatacactt

SEQ ID NO: 8405217 - DNA, 22 bp, Homo sapiens
ttacatgtaatctaaaataatt

SEQ ID NO: 8405218 - DNA, 22 bp, Homo sapiens
ttacatgtactggtttgactta

SEQ ID NO: 8405219 - DNA, 22 bp, Homo sapiens
ttacatgtacaaacaattctta

SEQ ID NO: 8405220 - DNA, 22 bp, Homo sapiens
ttaataataatgagcccatttt

SEQ ID NO: 8405221 - DNA, 22 bp, Homo sapiens
ttaaagaggcaggttaaataat

SEQ ID NO: 8405222 - DNA, 22 bp, Homo sapiens
ttagataggactcatagattgg

SEQ ID NO: 8405223 - DNA, 22 bp, Homo sapiens
ttagatcattttagctaaatgg

SEQ ID NO: 8405224 - DNA, 22 bp, Homo sapiens
ttagatcattttgaactaattt

SEQ ID NO: 8405225 - DNA, 22 bp, Homo sapiens
ttagatcatagtgtatatactg

SEQ ID NO: 8405226 - DNA, 22 bp, Homo sapiens
ttagcagtcacagtgctaacat

SEQ ID NO: 8405227 - DNA, 21 bp, Homo sapiens
ttagatggtagtccttgcagg

SEQ ID NO: 8405228 - DNA, 22 bp, Homo sapiens
ttagtacatagatgatggttga

SEQ ID NO: 8405229 - DNA, 22 bp, Homo sapiens
ttatatgtttctgtttggaggc

SEQ ID NO: 8405230 - DNA, 22 bp, Homo sapiens
ttattctgagagttgaagtaat

SEQ ID NO: 8405231 - DNA, 22 bp, Homo sapiens
ttattctgttgcttttacagta

SEQ ID NO: 8405232 - DNA, 22 bp, Homo sapiens
actgagaactcaagagaaaagg

SEQ ID NO: 8405233 - DNA, 22 bp, Homo sapiens
aagtggcacgctttttggagtt

SEQ ID NO: 8405234 - DNA, 18 bp, Homo sapiens
aagtggcacaggagtgca

SEQ ID NO: 8405235 - DNA, 22 bp, Homo sapiens
aagtggcagaatagtggcagga

SEQ ID NO: 8405236 - DNA, 22 bp, Homo sapiens
aagtggcagttcaggaagcaga

SEQ ID NO: 8405237 - DNA, 23 bp, Homo sapiens
aagtaaacattagaagttgaggt

SEQ ID NO: 8405238 - DNA, 22 bp, Homo sapiens
aatactttgccaagttcgaaga

SEQ ID NO: 8405239 - DNA, 22 bp, Homo sapiens
aatcttgagtatcagaccaaga

SEQ ID NO: 8405240 - DNA, 22 bp, Homo sapiens
aatcttgagtgttactctcatt

SEQ ID NO: 8405241 - DNA, 22 bp, Homo sapiens
agaaacgcctgtgaaattatct

SEQ ID NO: 8405242 - DNA, 22 bp, Homo sapiens
acatgccaagatcctcgtcttt

SEQ ID NO: 8405243 - DNA, 22 bp, Homo sapiens
acaggaggagcagctgtgtgcc

SEQ ID NO: 8405244 - DNA, 22 bp, Homo sapiens
acaggagctctagggacagcac

SEQ ID NO: 8405245 - DNA, 22 bp, Homo sapiens
acaggaggagctgtttcaggga

SEQ ID NO: 8405246 - DNA, 22 bp, Homo sapiens
acaggtgattcaggctctggga

SEQ ID NO: 8405247 - DNA, 22 bp, Homo sapiens
acagtgcagtgtgatgagtatt

SEQ ID NO: 8405248 - DNA, 22 bp, Homo sapiens
acaggctgacttcctgccatgt

SEQ ID NO: 8405249 - DNA, 22 bp, Homo sapiens
acaggctgaggatgattgcatc

SEQ ID NO: 8405250 - DNA, 22 bp, Homo sapiens
acaggtagcatttttcctcttt

SEQ ID NO: 8405251 - DNA, 19 bp, Homo sapiens
agcaggccacagggccagc

SEQ ID NO: 8405252 - DNA, 19 bp, Homo sapiens
agcagccatcgaccatgga

SEQ ID NO: 8405253 - DNA, 22 bp, Homo sapiens
agcagctctgagaggccagcac

SEQ ID NO: 8405254 - DNA, 22 bp, Homo sapiens
agcagctcgggctacagagggg

SEQ ID NO: 8405255 - DNA, 22 bp, Homo sapiens
agcagctgaccagtgagtcctg

SEQ ID NO: 8405256 - DNA, 23 bp, Homo sapiens
agcagccagagatcctcggccct

SEQ ID NO: 8405257 - DNA, 23 bp, Homo sapiens
agcagcagcaattaagtggatat

SEQ ID NO: 8405258 - DNA, 22 bp, Homo sapiens
acacactcaattgcataagcac

SEQ ID NO: 8405259 - DNA, 22 bp, Homo sapiens
agcactttagaatttagagttg

SEQ ID NO: 8405260 - DNA, 22 bp, Homo sapiens
agcactttattcaggaactcca

SEQ ID NO: 8405261 - DNA, 22 bp, Homo sapiens
agatttcctcttttgtaaagtg

SEQ ID NO: 8405262 - DNA, 22 bp, Homo sapiens
acacacagaaggaagccccact

SEQ ID NO: 8405263 - DNA, 22 bp, Homo sapiens
agctcagggcaaagactcaaat

SEQ ID NO: 8405264 - DNA, 22 bp, Homo sapiens
agctccactccctgcctgtttc

SEQ ID NO: 8405265 - DNA, 22 bp, Homo sapiens
agctcaggtctcaggaggtgtc

SEQ ID NO: 8405266 - DNA, 22 bp, Homo sapiens
agcatttaagcttctgcaaagc

SEQ ID NO: 8405267 - DNA, 22 bp, Homo sapiens
agcatttaatcctacatagatc

SEQ ID NO: 8405268 - DNA, 22 bp, Homo sapiens
agccaggcgcagtggcttatgc

SEQ ID NO: 8405269 - DNA, 22 bp, Homo sapiens
agccaggctactccttgctgac

SEQ ID NO: 8405270 - DNA, 22 bp, Homo sapiens
agccaggcggggcaggtttcct

SEQ ID NO: 8405271 - DNA, 22 bp, Homo sapiens
agccaggctaaatgagccatga

SEQ ID NO: 8405272 - DNA, 22 bp, Homo sapiens
agcccagctttcacccctctgg

SEQ ID NO: 8405273 - DNA, 22 bp, Homo sapiens
agcccaggtggagtgtgtgggg

SEQ ID NO: 8405274 - DNA, 22 bp, Homo sapiens
agcccaggtgaggggttcgaaa

SEQ ID NO: 8405275 - DNA, 22 bp, Homo sapiens
agaatttaggatgcatgtgaat

SEQ ID NO: 8405276 - DNA, 22 bp, Homo sapiens
agaatttatgacaacgatagcc

SEQ ID NO: 8405277 - DNA, 22 bp, Homo sapiens
aatgtacactgaaagcctatca

SEQ ID NO: 8405278 - DNA, 22 bp, Homo sapiens
aatgtacaccgtgggtttttta

SEQ ID NO: 8405279 - DNA, 22 bp, Homo sapiens
aatgtacaggctggctatgggg

SEQ ID NO: 8405280 - DNA, 22 bp, Homo sapiens
aatgtacatctcagtgtagtac

SEQ ID NO: 8405281 - DNA, 22 bp, Homo sapiens
aatgtacagctgctgctgaagg

SEQ ID NO: 8405282 - DNA, 22 bp, Homo sapiens
aatgtacagctgtctttcctcc

SEQ ID NO: 8405283 - DNA, 22 bp, Homo sapiens
aatgcttttacgacatgtacct

SEQ ID NO: 8405284 - DNA, 22 bp, Homo sapiens
aatggaatgcctcacatgtatt

SEQ ID NO: 8405285 - DNA, 22 bp, Homo sapiens
aatggagaccctaaggaagagg

SEQ ID NO: 8405286 - DNA, 22 bp, Homo sapiens
aatggaattctccattagatgt

SEQ ID NO: 8405287 - DNA, 22 bp, Homo sapiens
agagagaggcagcagtgctcac

SEQ ID NO: 8405288 - DNA, 22 bp, Homo sapiens
agattaactctcagaaaagagg

SEQ ID NO: 8405289 - DNA, 22 bp, Homo sapiens
agaggtggccatgggcgctgga

SEQ ID NO: 8405290 - DNA, 22 bp, Homo sapiens
agaggttgggtctgaggtgaga

SEQ ID NO: 8405291 - DNA, 22 bp, Homo sapiens
agaggttgttagaatagtggag

SEQ ID NO: 8405292 - DNA, 22 bp, Homo sapiens
aatttcaagtcttgaagaagta

SEQ ID NO: 8405293 - DNA, 22 bp, Homo sapiens
agaggccaatagtaggtggcat

SEQ ID NO: 8405294 - DNA, 21 bp, Homo sapiens
agaggcaggcattaagtacac

SEQ ID NO: 8405295 - DNA, 22 bp, Homo sapiens
agaggcagtatacaatccgagc

SEQ ID NO: 8405296 - DNA, 19 bp, Homo sapiens
agaggcagtctccaacagg

SEQ ID NO: 8405297 - DNA, 22 bp, Homo sapiens
agagcaggcataaagctttgaa

SEQ ID NO: 8405298 - DNA, 22 bp, Homo sapiens
agagcaggggcaatgtgttgca

SEQ ID NO: 8405299 - DNA, 22 bp, Homo sapiens
aatgttacataacccattgtcc

SEQ ID NO: 8405300 - DNA, 22 bp, Homo sapiens
aactctatttaccctactaaac

SEQ ID NO: 8405301 - DNA, 22 bp, Homo sapiens
aagacaatttgatactagttgc

SEQ ID NO: 8405302 - DNA, 22 bp, Homo sapiens
aagaattttccagcatgtcagt

SEQ ID NO: 8405303 - DNA, 22 bp, Homo sapiens
acagaagagctggctctgtgct

SEQ ID NO: 8405304 - DNA, 22 bp, Homo sapiens
acagaagagcacatttagtatg

SEQ ID NO: 8405305 - DNA, 22 bp, Homo sapiens
acagaagataactgggaccaga

SEQ ID NO: 8405306 - DNA, 22 bp, Homo sapiens
acagaagaccagagagctaact

SEQ ID NO: 8405307 - DNA, 22 bp, Homo sapiens
acagaagaccaagaaagcttcc

SEQ ID NO: 8405308 - DNA, 22 bp, Homo sapiens
acagaagaagttcaaggtgaag

SEQ ID NO: 8405309 - DNA, 22 bp, Homo sapiens
aagacatttatgaaaagtgctg

SEQ ID NO: 8405310 - DNA, 22 bp, Homo sapiens
aagaggaggattgatgtgggag

SEQ ID NO: 8405311 - DNA, 21 bp, Homo sapiens
aagagtggctgaggaggtgat

SEQ ID NO: 8405312 - DNA, 22 bp, Homo sapiens
aagagtggagctggaaagtggg

SEQ ID NO: 8405313 - DNA, 22 bp, Homo sapiens
aaggccagacaggaccacatct

SEQ ID NO: 8405314 - DNA, 21 bp, Homo sapiens
aaggacgaggttttgattaca

SEQ ID NO: 8405315 - DNA, 22 bp, Homo sapiens
aagccagtgtttttgagagttg

SEQ ID NO: 8405316 - DNA, 22 bp, Homo sapiens
aagccagtgtggtctgcccatt

SEQ ID NO: 8405317 - DNA, 22 bp, Homo sapiens
aagccagtgtgacaggaaactt

SEQ ID NO: 8405318 - DNA, 16 bp, Homo sapiens
aagccagttcagcatt

SEQ ID NO: 8405319 - DNA, 22 bp, Homo sapiens
aagccagttagcacatcattgc

SEQ ID NO: 8405320 - DNA, 22 bp, Homo sapiens
aagccagtaagtttttgtcatt

SEQ ID NO: 8405321 - DNA, 22 bp, Homo sapiens
aagccagtattcaatggggcta

SEQ ID NO: 8405322 - DNA, 22 bp, Homo sapiens
aagccagtcctctactgggcac

SEQ ID NO: 8405323 - DNA, 22 bp, Homo sapiens
aagccagtggtgagaagatagc

SEQ ID NO: 8405324 - DNA, 22 bp, Homo sapiens
aagccagtgggcatagcagttg

SEQ ID NO: 8405325 - DNA, 22 bp, Homo sapiens
aagccagtggcttctccctgct

SEQ ID NO: 8405326 - DNA, 22 bp, Homo sapiens
aagccagtgtccagaatgggca

SEQ ID NO: 8405327 - DNA, 22 bp, Homo sapiens
aaccagtatgtttaggaggtga

SEQ ID NO: 8405328 - DNA, 20 bp, Homo sapiens
aaccagtacccaagtaggaa

SEQ ID NO: 8405329 - DNA, 22 bp, Homo sapiens
aaccatgatgcagggtgggatg

SEQ ID NO: 8405330 - DNA, 22 bp, Homo sapiens
aatcacttaatagctacactgg

SEQ ID NO: 8405331 - DNA, 22 bp, Homo sapiens
aacatttatgattgaggtaaat

SEQ ID NO: 8405332 - DNA, 22 bp, Homo sapiens
aacatttattctaattctggga

SEQ ID NO: 8405333 - DNA, 22 bp, Homo sapiens
aacatttacaaatccttctgca

SEQ ID NO: 8405334 - DNA, 22 bp, Homo sapiens
aaatactgttgaatgaagtaag

SEQ ID NO: 8405335 - DNA, 22 bp, Homo sapiens
aaatactgtccaccatggagca

SEQ ID NO: 8405336 - DNA, 22 bp, Homo sapiens
aaactactatgggaatgtactt

SEQ ID NO: 8405337 - DNA, 22 bp, Homo sapiens
aaaggccaccaacatgaagcat

SEQ ID NO: 8405338 - DNA, 22 bp, Homo sapiens
aaacacacagaaatgaatgagg

SEQ ID NO: 8405339 - DNA, 22 bp, Homo sapiens
aaacacacctttggaactgtga

SEQ ID NO: 8405340 - DNA, 22 bp, Homo sapiens
aaaaatgctgtggtagctgtgt

SEQ ID NO: 8405341 - DNA, 22 bp, Homo sapiens
aaaaatgtcattatggaactga

SEQ ID NO: 8405342 - DNA, 22 bp, Homo sapiens
aaaaatgtgaccacagggtgtt

SEQ ID NO: 8405343 - DNA, 22 bp, Homo sapiens
aaagatgatctacaagttcatt

SEQ ID NO: 8405344 - DNA, 22 bp, Homo sapiens
aagccactgagatttcactgca

SEQ ID NO: 8405345 - DNA, 18 bp, Homo sapiens
aagaggaggagcaggttg

SEQ ID NO: 8405346 - DNA, 22 bp, Homo sapiens
aagaatgtctctggtgaggcgc

SEQ ID NO: 8405347 - DNA, 22 bp, Homo sapiens
aagaggaagtctccatggagag

SEQ ID NO: 8405348 - DNA, 22 bp, Homo sapiens
aactcactttgtggcttctgaa

SEQ ID NO: 8405349 - DNA, 22 bp, Homo sapiens
aactcaaagatgcatgacgctt

SEQ ID NO: 8405350 - DNA, 21 bp, Homo sapiens
aacatttctgggagaactcac

SEQ ID NO: 8405351 - DNA, 22 bp, Homo sapiens
aacaatgtgattgaagctagaa

SEQ ID NO: 8405352 - DNA, 18 bp, Homo sapiens
cagatggtggagttttta

SEQ ID NO: 8405353 - DNA, 19 bp, Homo sapiens
agctaactcactaactatg

SEQ ID NO: 8405354 - DNA, 22 bp, Homo sapiens
agctaacatgactagaagcttc

SEQ ID NO: 8405355 - DNA, 20 bp, Homo sapiens
agctaaccctactttctttg

SEQ ID NO: 8405356 - DNA, 22 bp, Homo sapiens
agctaagctctcagatactaag

SEQ ID NO: 8405357 - DNA, 22 bp, Homo sapiens
agctacagtcggaaggacagac

SEQ ID NO: 8405358 - DNA, 22 bp, Homo sapiens
agccctggagcaaaggtgtctt

SEQ ID NO: 8405359 - DNA, 22 bp, Homo sapiens
agcccagggacagggcggatgt

SEQ ID NO: 8405360 - DNA, 22 bp, Homo sapiens
agccagttgatgggtttccaat

SEQ ID NO: 8405361 - DNA, 22 bp, Homo sapiens
agccagttggctatgaggagga

SEQ ID NO: 8405362 - DNA, 19 bp, Homo sapiens
agccagttctagacaatgg

SEQ ID NO: 8405363 - DNA, 22 bp, Homo sapiens
agccagttctctagtgatattt

SEQ ID NO: 8405364 - DNA, 22 bp, Homo sapiens
agccagtttaagcaggaggggt

SEQ ID NO: 8405365 - DNA, 23 bp, Homo sapiens
agccagttgtagccacagaactc

SEQ ID NO: 8405366 - DNA, 19 bp, Homo sapiens
agccagttggtaagaggct

SEQ ID NO: 8405367 - DNA, 22 bp, Homo sapiens
agccagtttgcttgtaataaca

SEQ ID NO: 8405368 - DNA, 22 bp, Homo sapiens
agccagtttccagatattaact

SEQ ID NO: 8405369 - DNA, 22 bp, Homo sapiens
agccagttgtggggctagccct

SEQ ID NO: 8405370 - DNA, 17 bp, Homo sapiens
agccagttcatagcact

SEQ ID NO: 8405371 - DNA, 22 bp, Homo sapiens
agccagttccagcacaccactg

SEQ ID NO: 8405372 - DNA, 22 bp, Homo sapiens
agccagttcaagttatggcgtt

SEQ ID NO: 8405373 - DNA, 22 bp, Homo sapiens
agccccacactctctctgagaa

SEQ ID NO: 8405374 - DNA, 20 bp, Homo sapiens
agccccacccttgtcctggc

SEQ ID NO: 8405375 - DNA, 22 bp, Homo sapiens
agcccaggttgaggctgcagtg

SEQ ID NO: 8405376 - DNA, 22 bp, Homo sapiens
agccccaggatgggccgcagga

SEQ ID NO: 8405377 - DNA, 22 bp, Homo sapiens
agccccacactctctctgagaa

SEQ ID NO: 8405378 - DNA, 22 bp, Homo sapiens
agccccagtccgctgcgggcgg

SEQ ID NO: 8405379 - DNA, 22 bp, Homo sapiens
agccccagtaagggagggcctg

SEQ ID NO: 8405380 - DNA, 17 bp, Homo sapiens
agccaggcatatgaagt

SEQ ID NO: 8405381 - DNA, 22 bp, Homo sapiens
agccaggccttagggagaggca

SEQ ID NO: 8405382 - DNA, 22 bp, Homo sapiens
agccagcagggcttagaggaca

SEQ ID NO: 8405383 - DNA, 19 bp, Homo sapiens
agccagcaggcctctgagc

SEQ ID NO: 8405384 - DNA, 22 bp, Homo sapiens
cactttatgggaagcaaaaatt

SEQ ID NO: 8405385 - DNA, 22 bp, Homo sapiens
cactttatattctaagacggcc

SEQ ID NO: 8405386 - DNA, 22 bp, Homo sapiens
cactttataaaattggtgtgag

SEQ ID NO: 8405387 - DNA, 22 bp, Homo sapiens
cactttatatgcattacctcat

SEQ ID NO: 8405388 - DNA, 19 bp, Homo sapiens
cactttatttctgttttgt

SEQ ID NO: 8405389 - DNA, 22 bp, Homo sapiens
cactttattataaatttgagag

SEQ ID NO: 8405390 - DNA, 22 bp, Homo sapiens
caaagggaaaagccatgtgggc

SEQ ID NO: 8405391 - DNA, 22 bp, Homo sapiens
agcagagtcttcaagggcaggc

SEQ ID NO: 8405392 - DNA, 22 bp, Homo sapiens
agcagctcatggagtaggcact

SEQ ID NO: 8405393 - DNA, 22 bp, Homo sapiens
agcagctcagaggcaccagggc

SEQ ID NO: 8405394 - DNA, 22 bp, Homo sapiens
agcagcagatcaaacaggcttg

SEQ ID NO: 8405395 - DNA, 23 bp, Homo sapiens
agcagtaacttcagaaacatcag

SEQ ID NO: 8405396 - DNA, 22 bp, Homo sapiens
agcatggacagtggcagcagtg

SEQ ID NO: 8405397 - DNA, 22 bp, Homo sapiens
cactgttattactactatacat

SEQ ID NO: 8405398 - DNA, 22 bp, Homo sapiens
caccagccagagtgacagctcc

SEQ ID NO: 8405399 - DNA, 22 bp, Homo sapiens
agcaggaaggggcctagcctgg

SEQ ID NO: 8405400 - DNA, 17 bp, Homo sapiens
agatggcaggaggcaga

SEQ ID NO: 8405401 - DNA, 22 bp, Homo sapiens
agatgcagaaaaactaagtgat

SEQ ID NO: 8405402 - DNA, 22 bp, Homo sapiens
agatgctgggaggctgagtgca

SEQ ID NO: 8405403 - DNA, 22 bp, Homo sapiens
agatgctgtgaggaagctagga

SEQ ID NO: 8405404 - DNA, 22 bp, Homo sapiens
agatgctgtcacacacactgtt

SEQ ID NO: 8405405 - DNA, 21 bp, Homo sapiens
attggcctgtttacagagtga

SEQ ID NO: 8405406 - DNA, 22 bp, Homo sapiens
attggcctgaaactggttcagc

SEQ ID NO: 8405407 - DNA, 22 bp, Homo sapiens
attggcctattttggaagactt

SEQ ID NO: 8405408 - DNA, 22 bp, Homo sapiens
attggcctaaagaaatgacaga

SEQ ID NO: 8405409 - DNA, 22 bp, Homo sapiens
attacagtaacagctacaatgc

SEQ ID NO: 8405410 - DNA, 22 bp, Homo sapiens
agaggctgcacttgctcatgat

SEQ ID NO: 8405411 - DNA, 22 bp, Homo sapiens
agaggctgatggagtagtgtct

SEQ ID NO: 8405412 - DNA, 23 bp, Homo sapiens
agaggctgcagggtattgagaat

SEQ ID NO: 8405413 - DNA, 22 bp, Homo sapiens
agaggctgcaggctggaaatca

SEQ ID NO: 8405414 - DNA, 18 bp, Homo sapiens
agaggctggacaggggat

SEQ ID NO: 8405415 - DNA, 22 bp, Homo sapiens
agaggctggattgagcatagac

SEQ ID NO: 8405416 - DNA, 22 bp, Homo sapiens
agaggccagcactgcagggaag

SEQ ID NO: 8405417 - DNA, 22 bp, Homo sapiens
agaggccagcaaccacagtaaa

SEQ ID NO: 8405418 - DNA, 23 bp, Homo sapiens
agaggccagcctttggagacacc

SEQ ID NO: 8405419 - DNA, 16 bp, Homo sapiens
agaggctgtaatggaa

SEQ ID NO: 8405420 - DNA, 22 bp, Homo sapiens
agaggctgtcccttgctattcc

SEQ ID NO: 8405421 - DNA, 22 bp, Homo sapiens
agaccccatacctcagcaggta

SEQ ID NO: 8405422 - DNA, 22 bp, Homo sapiens
atgcagggttctgggctagaga

SEQ ID NO: 8405423 - DNA, 22 bp, Homo sapiens
atgaggctgaaacacagaggct

SEQ ID NO: 8405424 - DNA, 22 bp, Homo sapiens
atgaggcttaaactgctgcaac

SEQ ID NO: 8405425 - DNA, 22 bp, Homo sapiens
agagcccctgggtcacacagcc

SEQ ID NO: 8405426 - DNA, 22 bp, Homo sapiens
agagcagatggccagggggcct

SEQ ID NO: 8405427 - DNA, 22 bp, Homo sapiens
agactttagggccatggtaggt

SEQ ID NO: 8405428 - DNA, 22 bp, Homo sapiens
agactttagaatcagatagcct

SEQ ID NO: 8405429 - DNA, 22 bp, Homo sapiens
agactttaatgtgcaaatgaaa

SEQ ID NO: 8405430 - DNA, 22 bp, Homo sapiens
agagaggctgggcgtagggctt

SEQ ID NO: 8405431 - DNA, 22 bp, Homo sapiens
aggaggctgtggagcactccat

SEQ ID NO: 8405432 - DNA, 22 bp, Homo sapiens
aggaggcttttgcaggtgccac

SEQ ID NO: 8405433 - DNA, 22 bp, Homo sapiens
aggaggggttctcgggtgctga

SEQ ID NO: 8405434 - DNA, 22 bp, Homo sapiens
acatacagacctgcagggcagc

SEQ ID NO: 8405435 - DNA, 18 bp, Homo sapiens
aggcacagagcatacata

SEQ ID NO: 8405436 - DNA, 22 bp, Homo sapiens
aggcacagagaatgccctccat

SEQ ID NO: 8405437 - DNA, 22 bp, Homo sapiens
aggagacataactatgatgaga

SEQ ID NO: 8405438 - DNA, 23 bp, Homo sapiens
aggaaggaggtcctaacagtatc

SEQ ID NO: 8405439 - DNA, 22 bp, Homo sapiens
aggaagggatacataggatagt

SEQ ID NO: 8405440 - DNA, 22 bp, Homo sapiens
aggagcctccttctcatgtgca

SEQ ID NO: 8405441 - DNA, 22 bp, Homo sapiens
aggagcctgagtcacagtgcct

SEQ ID NO: 8405442 - DNA, 22 bp, Homo sapiens
acagggtgactttgtgacagat

SEQ ID NO: 8405443 - DNA, 22 bp, Homo sapiens
aggagccatgagtgacatcaca

SEQ ID NO: 8405444 - DNA, 22 bp, Homo sapiens
acagggtggggatggtgagctt

SEQ ID NO: 8405445 - DNA, 22 bp, Homo sapiens
aggagccatggaggtgaggcgg

SEQ ID NO: 8405446 - DNA, 22 bp, Homo sapiens
agctgggagcagagccacagcc

SEQ ID NO: 8405447 - DNA, 22 bp, Homo sapiens
agctgggagcagagccacagcc

SEQ ID NO: 8405448 - DNA, 22 bp, Homo sapiens
agctgggaggtgggcagtgaga

SEQ ID NO: 8405449 - DNA, 22 bp, Homo sapiens
agctgggatgaggagcatcctt

SEQ ID NO: 8405450 - DNA, 22 bp, Homo sapiens
agctgggatgataacctcagtc

SEQ ID NO: 8405451 - DNA, 22 bp, Homo sapiens
agctgggcaaaatgtgaggttg

SEQ ID NO: 8405452 - DNA, 22 bp, Homo sapiens
agctgtgggagaatctctgggt

SEQ ID NO: 8405453 - DNA, 22 bp, Homo sapiens
agctgtggttagatagagtcct

SEQ ID NO: 8405454 - DNA, 22 bp, Homo sapiens
aggaagagcattcacatggtag

SEQ ID NO: 8405455 - DNA, 22 bp, Homo sapiens
acagccagtcatctcagcaggg

SEQ ID NO: 8405456 - DNA, 22 bp, Homo sapiens
acagccagtaatctacccctgt

SEQ ID NO: 8405457 - DNA, 22 bp, Homo sapiens
acagccagtgactgcagaccct

SEQ ID NO: 8405458 - DNA, 22 bp, Homo sapiens
acagccagtcctcccacagggt

SEQ ID NO: 8405459 - DNA, 22 bp, Homo sapiens
acagccagggtctcaggaggcg

SEQ ID NO: 8405460 - DNA, 22 bp, Homo sapiens
acagccaggtaaaggcatggca

SEQ ID NO: 8405461 - DNA, 22 bp, Homo sapiens
agctgcagctacagtgttggtt

SEQ ID NO: 8405462 - DNA, 22 bp, Homo sapiens
acagccagtgctccgtgaggac

SEQ ID NO: 8405463 - DNA, 22 bp, Homo sapiens
agctgcagccgcagctgtggcc

SEQ ID NO: 8405464 - DNA, 21 bp, Homo sapiens
acagcctccatctcctgggct

SEQ ID NO: 8405465 - DNA, 22 bp, Homo sapiens
agctgctggtttaagggatggg

SEQ ID NO: 8405466 - DNA, 22 bp, Homo sapiens
agctgctgtcctaggcactgta

SEQ ID NO: 8405467 - DNA, 22 bp, Homo sapiens
agggccatttgctggagctttg

SEQ ID NO: 8405468 - DNA, 22 bp, Homo sapiens
agggcctcctaatttcctcata

SEQ ID NO: 8405469 - DNA, 22 bp, Homo sapiens
agggcctctaccatccaaggtt

SEQ ID NO: 8405470 - DNA, 22 bp, Homo sapiens
agggcctcgaaggcagagggat

SEQ ID NO: 8405471 - DNA, 22 bp, Homo sapiens
agggcctcctagagaatctcca

SEQ ID NO: 8405472 - DNA, 22 bp, Homo sapiens
accaggagtctagcctagtcaa

SEQ ID NO: 8405473 - DNA, 19 bp, Homo sapiens
accaggagtatcagagctg

SEQ ID NO: 8405474 - DNA, 22 bp, Homo sapiens
accacagctttgcaccaggtgt

SEQ ID NO: 8405475 - DNA, 22 bp, Homo sapiens
accaaccagggacttggctccc

SEQ ID NO: 8405476 - DNA, 22 bp, Homo sapiens
acccaccctactagcagtgtcc

SEQ ID NO: 8405477 - DNA, 23 bp, Homo sapiens
agggcctctgtcccccagcactc

SEQ ID NO: 8405478 - DNA, 22 bp, Homo sapiens
agggcctctgacgcccccagcc

SEQ ID NO: 8405479 - DNA, 22 bp, Homo sapiens
acccagagatggacctggctgc

SEQ ID NO: 8405480 - DNA, 22 bp, Homo sapiens
acccagggtagagtgcagtggc

SEQ ID NO: 8405481 - DNA, 22 bp, Homo sapiens
acccagggtcaccccgtagggt

SEQ ID NO: 8405482 - DNA, 19 bp, Homo sapiens
acccagggttgatgtccag

SEQ ID NO: 8405483 - DNA, 18 bp, Homo sapiens
aggcatggtggtgcgcac

SEQ ID NO: 8405484 - DNA, 22 bp, Homo sapiens
aggccacaggtggaagccagag

SEQ ID NO: 8405485 - DNA, 22 bp, Homo sapiens
aggccacaggattgcacagcat

SEQ ID NO: 8405486 - DNA, 22 bp, Homo sapiens
aggcatggctttaggcaggcgt

SEQ ID NO: 8405487 - DNA, 20 bp, Homo sapiens
aggcatgggatgcccagatt

SEQ ID NO: 8405488 - DNA, 22 bp, Homo sapiens
aggcatggcattcctcaagcaa

SEQ ID NO: 8405489 - DNA, 22 bp, Homo sapiens
aggcttccgagtagctgggact

SEQ ID NO: 8405490 - DNA, 22 bp, Homo sapiens
aggtgaatgcctgaggcctctg

SEQ ID NO: 8405491 - DNA, 22 bp, Homo sapiens
aggtgacaggacaggagctggt

SEQ ID NO: 8405492 - DNA, 22 bp, Homo sapiens
aggtgacttaggctgtggctcg

SEQ ID NO: 8405493 - DNA, 22 bp, Homo sapiens
agtcactaggctgaaagtggag

SEQ ID NO: 8405494 - DNA, 22 bp, Homo sapiens
aggtggggaaaccagcgatccc

SEQ ID NO: 8405495 - DNA, 22 bp, Homo sapiens
agtagtggcttcctggagtgct

SEQ ID NO: 8405496 - DNA, 22 bp, Homo sapiens
actgccaatggtagtttgatgg

SEQ ID NO: 8405497 - DNA, 22 bp, Homo sapiens
actgagctctgatgagatttgg

SEQ ID NO: 8405498 - DNA, 22 bp, Homo sapiens
agaaggcactcacactggcacg

SEQ ID NO: 8405499 - DNA, 22 bp, Homo sapiens
agaaggagtgtacaggtcatgc

SEQ ID NO: 8405500 - DNA, 22 bp, Homo sapiens
agaagccaacagggcaggagag

SEQ ID NO: 8405501 - DNA, 22 bp, Homo sapiens
atccccacgatatagccaaagc

SEQ ID NO: 8405502 - DNA, 22 bp, Homo sapiens
atcaggtgtggtccaatcagca

SEQ ID NO: 8405503 - DNA, 20 bp, Homo sapiens
atcaggtgttcagccactgc

SEQ ID NO: 8405504 - DNA, 22 bp, Homo sapiens
atcaggtgcattagattaatta

SEQ ID NO: 8405505 - DNA, 20 bp, Homo sapiens
atcaggtgtattccttatct

SEQ ID NO: 8405506 - DNA, 22 bp, Homo sapiens
atcaggtgggttttgaagaaac

SEQ ID NO: 8405507 - DNA, 21 bp, Homo sapiens
actttacaatttacatagtga

SEQ ID NO: 8405508 - DNA, 22 bp, Homo sapiens
actttggaagatggctgtattt

SEQ ID NO: 8405509 - DNA, 22 bp, Homo sapiens
actttggacaatttattactgt

SEQ ID NO: 8405510 - DNA, 22 bp, Homo sapiens
ctcaccacaccgtcggcctcct

SEQ ID NO: 8405511 - DNA, 22 bp, Homo sapiens
agtgaggctaataggcaatggt

SEQ ID NO: 8405512 - DNA, 22 bp, Homo sapiens
agtgaggtcaggatctcaggga

SEQ ID NO: 8405513 - DNA, 22 bp, Homo sapiens
agtgatggggccctgcactgat

SEQ ID NO: 8405514 - DNA, 22 bp, Homo sapiens
agtgatggtttccagtcactga

SEQ ID NO: 8405515 - DNA, 22 bp, Homo sapiens
agtgaggctaataggcaatggt

SEQ ID NO: 8405516 - DNA, 22 bp, Homo sapiens
agtggccaacttatatgaaaaa

SEQ ID NO: 8405517 - DNA, 22 bp, Homo sapiens
agtggccaatatgtcatgctct

SEQ ID NO: 8405518 - DNA, 20 bp, Homo sapiens
agtggccactgcagagatgc

SEQ ID NO: 8405519 - DNA, 22 bp, Homo sapiens
agtggccactgacttggaaatc

SEQ ID NO: 8405520 - DNA, 22 bp, Homo sapiens
agtggccagcagcctagcctag

SEQ ID NO: 8405521 - DNA, 22 bp, Homo sapiens
agtggccaggaaaggtccagcc

SEQ ID NO: 8405522 - DNA, 22 bp, Homo sapiens
agtggccaccatgccagctctc

SEQ ID NO: 8405523 - DNA, 22 bp, Homo sapiens
agtggccactagaagctcagct

SEQ ID NO: 8405524 - DNA, 22 bp, Homo sapiens
agtggccacccactgagacagg

SEQ ID NO: 8405525 - DNA, 22 bp, Homo sapiens
agtggcaggcggagatgtagga

SEQ ID NO: 8405526 - DNA, 22 bp, Homo sapiens
agtggacaaccatgctgagatt

SEQ ID NO: 8405527 - DNA, 22 bp, Homo sapiens
agtggaaagaaccctggactca

SEQ ID NO: 8405528 - DNA, 22 bp, Homo sapiens
ctctggagtgtctggccagggt

SEQ ID NO: 8405529 - DNA, 22 bp, Homo sapiens
agtgggtgggtgtctgacagtt

SEQ ID NO: 8405530 - DNA, 22 bp, Homo sapiens
agtgggtgacagtgaacacgta

SEQ ID NO: 8405531 - DNA, 22 bp, Homo sapiens
agtggctagatcatgagtgagc

SEQ ID NO: 8405532 - DNA, 22 bp, Homo sapiens
agtggcggggattagcagtgtt

SEQ ID NO: 8405533 - DNA, 22 bp, Homo sapiens
agtggcccctgtgccaccacac

SEQ ID NO: 8405534 - DNA, 22 bp, Homo sapiens
agtggccatggcaggtgagcat

SEQ ID NO: 8405535 - DNA, 22 bp, Homo sapiens
agtggccatccctcaggtaggc

SEQ ID NO: 8405536 - DNA, 22 bp, Homo sapiens
agtggccagtgctgctctgggg

SEQ ID NO: 8405537 - DNA, 22 bp, Homo sapiens
agtggccagtgaaggcggcagc

SEQ ID NO: 8405538 - DNA, 22 bp, Homo sapiens
ctgagctgagccaaatctgtct

SEQ ID NO: 8405539 - DNA, 22 bp, Homo sapiens
agtgtggccaatgaggatgggc

SEQ ID NO: 8405540 - DNA, 22 bp, Homo sapiens
aggtggcagcagcctggtgaaa

SEQ ID NO: 8405541 - DNA, 22 bp, Homo sapiens
aggtggcagagtgacaggctga

SEQ ID NO: 8405542 - DNA, 22 bp, Homo sapiens
cctgggagggcaagtgctgatg

SEQ ID NO: 8405543 - DNA, 22 bp, Homo sapiens
cctgggaggtggaggttgcagt

SEQ ID NO: 8405544 - DNA, 22 bp, Homo sapiens
cctgggaggtggaggttgcagt

SEQ ID NO: 8405545 - DNA, 22 bp, Homo sapiens
cctgggaggtggaggttgcagc

SEQ ID NO: 8405546 - DNA, 22 bp, Homo sapiens
cctgggaggtggaggttgcagc

SEQ ID NO: 8405547 - DNA, 22 bp, Homo sapiens
cctgggaggctgaggctgcagt

SEQ ID NO: 8405548 - DNA, 22 bp, Homo sapiens
aggtcacaggctttgaaatcaa

SEQ ID NO: 8405549 - DNA, 23 bp, Homo sapiens
agggtggcttgctttgcttcctt

SEQ ID NO: 8405550 - DNA, 22 bp, Homo sapiens
aggtaaggctgtaagctaagcc

SEQ ID NO: 8405551 - DNA, 22 bp, Homo sapiens
ctaggaggcgggggctgcagta

SEQ ID NO: 8405552 - DNA, 22 bp, Homo sapiens
agtaaacatagaatgttcttcc

SEQ ID NO: 8405553 - DNA, 22 bp, Homo sapiens
agtagggaatacattggggtaa

SEQ ID NO: 8405554 - DNA, 22 bp, Homo sapiens
agtcaaggctattatgtgggaa

SEQ ID NO: 8405555 - DNA, 22 bp, Homo sapiens
agtagcagagttggactatgca

SEQ ID NO: 8405556 - DNA, 22 bp, Homo sapiens
agtagcagtgacagctgaggta

SEQ ID NO: 8405557 - DNA, 22 bp, Homo sapiens
agtagacaataattcaactccc

SEQ ID NO: 8405558 - DNA, 22 bp, Homo sapiens
agtagacattttgcaacatctg

SEQ ID NO: 8405559 - DNA, 22 bp, Homo sapiens
agtagacagccttgctcctgag

SEQ ID NO: 8405560 - DNA, 19 bp, Homo sapiens
agtagcagaaagtgcagtg

SEQ ID NO: 8405561 - DNA, 22 bp, Homo sapiens
cttaatctcacctgcaaagtcc

SEQ ID NO: 8405562 - DNA, 22 bp, Homo sapiens
cttctgtgttaaatgagtcttt

SEQ ID NO: 8405563 - DNA, 22 bp, Homo sapiens
ctgggtggctgtccagccagcc

SEQ ID NO: 8405564 - DNA, 22 bp, Homo sapiens
ctgggtggcgtctggggccagt

SEQ ID NO: 8405565 - DNA, 22 bp, Homo sapiens
ctgggtggcagagcctgcagtg

SEQ ID NO: 8405566 - DNA, 20 bp, Homo sapiens
ctgggtggcaagcaaggggg

SEQ ID NO: 8405567 - DNA, 22 bp, Homo sapiens
ctggggcatctgacagataaat

SEQ ID NO: 8405568 - DNA, 19 bp, Homo sapiens
ctgggaggtgttcagagaa

SEQ ID NO: 8405569 - DNA, 22 bp, Homo sapiens
ctgggggcaagcagacagctgt

SEQ ID NO: 8405570 - DNA, 22 bp, Homo sapiens
ctgggaggacaacttggagctc

SEQ ID NO: 8405571 - DNA, 22 bp, Homo sapiens
ctgggaggtggaggttgcattg

SEQ ID NO: 8405572 - DNA, 22 bp, Homo sapiens
atcaggtgaagtcactgagtgg

SEQ ID NO: 8405573 - DNA, 22 bp, Homo sapiens
atcaggtgatgctctggttccc

SEQ ID NO: 8405574 - DNA, 22 bp, Homo sapiens
ctgctactggccagctttgcag

SEQ ID NO: 8405575 - DNA, 22 bp, Homo sapiens
ctgctaccctagagctcactct

SEQ ID NO: 8405576 - DNA, 22 bp, Homo sapiens
ctgcctggaaggagcaagggga

SEQ ID NO: 8405577 - DNA, 22 bp, Homo sapiens
ctgcctggtctcaggcatgggg

SEQ ID NO: 8405578 - DNA, 22 bp, Homo sapiens
ctgcctgtgcatgcagtcagaa

SEQ ID NO: 8405579 - DNA, 20 bp, Homo sapiens
ctggccagaacgcctacaca

SEQ ID NO: 8405580 - DNA, 22 bp, Homo sapiens
ctggccagactacacatgtgtg

SEQ ID NO: 8405581 - DNA, 22 bp, Homo sapiens
ctggcaggtttggtgtctggtg

SEQ ID NO: 8405582 - DNA, 22 bp, Homo sapiens
ctggcaggtggatggggactcc

SEQ ID NO: 8405583 - DNA, 22 bp, Homo sapiens
ctggcaggtggaggttgcagtg

SEQ ID NO: 8405584 - DNA, 22 bp, Homo sapiens
ctggcaggtggaggttgcagtg

SEQ ID NO: 8405585 - DNA, 22 bp, Homo sapiens
ctggcaggttatagagctgccc

SEQ ID NO: 8405586 - DNA, 22 bp, Homo sapiens
atacatgtgggtctaaacatat

SEQ ID NO: 8405587 - DNA, 17 bp, Homo sapiens
atacatgtaaagtgctt

SEQ ID NO: 8405588 - DNA, 22 bp, Homo sapiens
atatacactccactgatacagg

SEQ ID NO: 8405589 - DNA, 22 bp, Homo sapiens
ctgggagctggaatgggagaag

SEQ ID NO: 8405590 - DNA, 22 bp, Homo sapiens
ctgggagctggatgccctgccc

SEQ ID NO: 8405591 - DNA, 22 bp, Homo sapiens
ctggcgagcaggaggcgacggc

SEQ ID NO: 8405592 - DNA, 22 bp, Homo sapiens
ctggcgagggtcgctggggact

SEQ ID NO: 8405593 - DNA, 22 bp, Homo sapiens
aggaaggtaatgaactgaggag

SEQ ID NO: 8405594 - DNA, 22 bp, Homo sapiens
aggaagggtgtcatgagccctt

SEQ ID NO: 8405595 - DNA, 22 bp, Homo sapiens
aggaatgtgtgtccaccgggga

SEQ ID NO: 8405596 - DNA, 21 bp, Homo sapiens
aggaatgtgtatatatacaat

SEQ ID NO: 8405597 - DNA, 16 bp, Homo sapiens
aggaatgtggcggaac

SEQ ID NO: 8405598 - DNA, 22 bp, Homo sapiens
aggaatgtgtttctaggctgtt

SEQ ID NO: 8405599 - DNA, 22 bp, Homo sapiens
aggaatgttaaagattaagagc

SEQ ID NO: 8405600 - DNA, 22 bp, Homo sapiens
aggaatgttagttctgtataca

SEQ ID NO: 8405601 - DNA, 22 bp, Homo sapiens
aggaatgttaggagatgagtct

SEQ ID NO: 8405602 - DNA, 22 bp, Homo sapiens
aggaatgttaagaaggtctacc

SEQ ID NO: 8405603 - DNA, 22 bp, Homo sapiens
aggaatgtttacacgacagaaa

SEQ ID NO: 8405604 - DNA, 22 bp, Homo sapiens
aggaatgtttagaatgtcagaa

SEQ ID NO: 8405605 - DNA, 22 bp, Homo sapiens
aggaatgtggcaatcttcaagt

SEQ ID NO: 8405606 - DNA, 22 bp, Homo sapiens
aggaatgtggcctagggaggag

SEQ ID NO: 8405607 - DNA, 23 bp, Homo sapiens
aggaatgtgcccacccatctcct

SEQ ID NO: 8405608 - DNA, 22 bp, Homo sapiens
aggaatgtgcctagcctccctg

SEQ ID NO: 8405609 - DNA, 22 bp, Homo sapiens
aggaatgtggaaggtggcggcg

SEQ ID NO: 8405610 - DNA, 22 bp, Homo sapiens
aggaatgtgactattttttcag

SEQ ID NO: 8405611 - DNA, 22 bp, Homo sapiens
aggaatgtgaccactagactct

SEQ ID NO: 8405612 - DNA, 22 bp, Homo sapiens
aggaatgtgaggcaagttgtga

SEQ ID NO: 8405613 - DNA, 22 bp, Homo sapiens
aggaatgtgaaacaggtggctg

SEQ ID NO: 8405614 - DNA, 22 bp, Homo sapiens
aggaatgtctgagaaagaggca

SEQ ID NO: 8405615 - DNA, 22 bp, Homo sapiens
aggaatgtcgtcataaacatga

SEQ ID NO: 8405616 - DNA, 14 bp, Homo sapiens
aggaatgtcctagg

SEQ ID NO: 8405617 - DNA, 22 bp, Homo sapiens
aggaagcaccggaatgatgact

SEQ ID NO: 8405618 - DNA, 22 bp, Homo sapiens
cagggtggtgaatagctatagt

SEQ ID NO: 8405619 - DNA, 22 bp, Homo sapiens
cagggtggtaccagcatctagt

SEQ ID NO: 8405620 - DNA, 22 bp, Homo sapiens
cagggtggtaccagcatctagt

SEQ ID NO: 8405621 - DNA, 22 bp, Homo sapiens
aggaaacagttggtaatgcata

SEQ ID NO: 8405622 - DNA, 22 bp, Homo sapiens
aggaaacagagtgaagcttggg

SEQ ID NO: 8405623 - DNA, 22 bp, Homo sapiens
aggaaacagagtgaagcttggg

SEQ ID NO: 8405624 - DNA, 22 bp, Homo sapiens
aggaaacaggcagcctttgaac

SEQ ID NO: 8405625 - DNA, 22 bp, Homo sapiens
aggaaacagtgaacttggcagg

SEQ ID NO: 8405626 - DNA, 22 bp, Homo sapiens
aggaaacatgaatctgccttga

SEQ ID NO: 8405627 - DNA, 22 bp, Homo sapiens
aggaaacattgatattgggaaa

SEQ ID NO: 8405628 - DNA, 22 bp, Homo sapiens
aggaaacatccttatctattct

SEQ ID NO: 8405629 - DNA, 22 bp, Homo sapiens
caggcttcgctctgtgggcagg

SEQ ID NO: 8405630 - DNA, 22 bp, Homo sapiens
agctggtgctcggggagctggc

SEQ ID NO: 8405631 - DNA, 22 bp, Homo sapiens
agctggtgctgaagctcttgag

SEQ ID NO: 8405632 - DNA, 22 bp, Homo sapiens
cagggacattggtggccaggtt

SEQ ID NO: 8405633 - DNA, 22 bp, Homo sapiens
cagggacattggtggccaggtt

SEQ ID NO: 8405634 - DNA, 22 bp, Homo sapiens
cagggactacagccagccctcc

SEQ ID NO: 8405635 - DNA, 22 bp, Homo sapiens
cagggacatgactggtctctgt

SEQ ID NO: 8405636 - DNA, 22 bp, Homo sapiens
aggaaacaacttggcatgagcc

SEQ ID NO: 8405637 - DNA, 22 bp, Homo sapiens
aggaaacagaggtgccacaata

SEQ ID NO: 8405638 - DNA, 22 bp, Homo sapiens
agctggtgaacctgaggcacag

SEQ ID NO: 8405639 - DNA, 22 bp, Homo sapiens
agctggtgaacctgaggcacag

SEQ ID NO: 8405640 - DNA, 22 bp, Homo sapiens
agctggtgagggttgaggggta

SEQ ID NO: 8405641 - DNA, 22 bp, Homo sapiens
agctggtgctcaggggcatgga

SEQ ID NO: 8405642 - DNA, 22 bp, Homo sapiens
agctggtgcctgcttttgtgtg

SEQ ID NO: 8405643 - DNA, 17 bp, Homo sapiens
agctgggttctcaggaa

SEQ ID NO: 8405644 - DNA, 22 bp, Homo sapiens
agctgggcaccccgctgcgtct

SEQ ID NO: 8405645 - DNA, 22 bp, Homo sapiens
agctgggcctgatttgcagggg

SEQ ID NO: 8405646 - DNA, 22 bp, Homo sapiens
agctgggcgcagtggctggtga

SEQ ID NO: 8405647 - DNA, 20 bp, Homo sapiens
agctggagaagggcccttcc

SEQ ID NO: 8405648 - DNA, 22 bp, Homo sapiens
agctggagccagtgtgaggctt

SEQ ID NO: 8405649 - DNA, 22 bp, Homo sapiens
agctggagcttcaagcaggtaa

SEQ ID NO: 8405650 - DNA, 22 bp, Homo sapiens
aggagctgggagaaggactaaa

SEQ ID NO: 8405651 - DNA, 22 bp, Homo sapiens
aggagctgggctgctgctggga

SEQ ID NO: 8405652 - DNA, 22 bp, Homo sapiens
aggagatggagctcagtgggca

SEQ ID NO: 8405653 - DNA, 22 bp, Homo sapiens
cagtgaggagtccagggcagag

SEQ ID NO: 8405654 - DNA, 22 bp, Homo sapiens
aggaatttttctagccggagtt

SEQ ID NO: 8405655 - DNA, 22 bp, Homo sapiens
aggaattgagatcctaggtttt

SEQ ID NO: 8405656 - DNA, 22 bp, Homo sapiens
aggaattgcctggggcctggga

SEQ ID NO: 8405657 - DNA, 22 bp, Homo sapiens
aggaattttacaagctggttgc

SEQ ID NO: 8405658 - DNA, 22 bp, Homo sapiens
aggaattttacatctcagagag

SEQ ID NO: 8405659 - DNA, 22 bp, Homo sapiens
aggaattttcacagttgggtat

SEQ ID NO: 8405660 - DNA, 22 bp, Homo sapiens
aggaattgtgttgtagtggaga

SEQ ID NO: 8405661 - DNA, 22 bp, Homo sapiens
aggaatttaagggctcagagag

SEQ ID NO: 8405662 - DNA, 19 bp, Homo sapiens
aggaatttctcagggaggc

SEQ ID NO: 8405663 - DNA, 22 bp, Homo sapiens
aggaatttgagtgctgtaggaa

SEQ ID NO: 8405664 - DNA, 22 bp, Homo sapiens
cagtgagggcattcagtgctgg

SEQ ID NO: 8405665 - DNA, 20 bp, Homo sapiens
aggagatgatccagagtcag

SEQ ID NO: 8405666 - DNA, 22 bp, Homo sapiens
cagtgcaggaagtgagatgcct

SEQ ID NO: 8405667 - DNA, 22 bp, Homo sapiens
cagtgcagccaaggacaggcac

SEQ ID NO: 8405668 - DNA, 22 bp, Homo sapiens
aggagggttgaggaggatactt

SEQ ID NO: 8405669 - DNA, 22 bp, Homo sapiens
aggagggtttcaatgggatgag

SEQ ID NO: 8405670 - DNA, 20 bp, Homo sapiens
aggaggtcaaatggaatctg

SEQ ID NO: 8405671 - DNA, 22 bp, Homo sapiens
aggaggtgagcggtcatgtggt

SEQ ID NO: 8405672 - DNA, 22 bp, Homo sapiens
aggaggtcagagccccatgctg

SEQ ID NO: 8405673 - DNA, 22 bp, Homo sapiens
aggagggtggcctcatgtgagt

SEQ ID NO: 8405674 - DNA, 22 bp, Homo sapiens
aggagggtggcctcatgtgagt

SEQ ID NO: 8405675 - DNA, 22 bp, Homo sapiens
aggaggttgccagtctgggggt

SEQ ID NO: 8405676 - DNA, 22 bp, Homo sapiens
aggagtgtgaagagcctagatc

SEQ ID NO: 8405677 - DNA, 22 bp, Homo sapiens
aggagtgtggccagggctctgg

SEQ ID NO: 8405678 - DNA, 22 bp, Homo sapiens
aggagtgttagagtagagctgg

SEQ ID NO: 8405679 - DNA, 22 bp, Homo sapiens
cagttctacttggatgtctgca

SEQ ID NO: 8405680 - DNA, 22 bp, Homo sapiens
cagttcatagtcttcatgtctc

SEQ ID NO: 8405681 - DNA, 19 bp, Homo sapiens
catcagagggcataggatg

SEQ ID NO: 8405682 - DNA, 22 bp, Homo sapiens
aggaggctgggcacagtggcct

SEQ ID NO: 8405683 - DNA, 22 bp, Homo sapiens
aggcagctttcagtgtctctca

SEQ ID NO: 8405684 - DNA, 22 bp, Homo sapiens
aggcacagtgcctggaatcaaa

SEQ ID NO: 8405685 - DNA, 22 bp, Homo sapiens
aggcactgaaaggtggccagag

SEQ ID NO: 8405686 - DNA, 22 bp, Homo sapiens
cccagtcatcctgcaggtgaaa

SEQ ID NO: 8405687 - DNA, 22 bp, Homo sapiens
cccaggcttttctcttgcccca

SEQ ID NO: 8405688 - DNA, 22 bp, Homo sapiens
cccaggcttttaagttagacag

SEQ ID NO: 8405689 - DNA, 22 bp, Homo sapiens
cccaggctggaattccaggcct

SEQ ID NO: 8405690 - DNA, 22 bp, Homo sapiens
cccaggctgtctgtcctttgct

SEQ ID NO: 8405691 - DNA, 23 bp, Homo sapiens
cccaggctacaaattatgctctg

SEQ ID NO: 8405692 - DNA, 22 bp, Homo sapiens
cccaggctgcatgagtccatgg

SEQ ID NO: 8405693 - DNA, 22 bp, Homo sapiens
cccaggctgcgtatccacaata

SEQ ID NO: 8405694 - DNA, 20 bp, Homo sapiens
cccaggagctgtgccccatc

SEQ ID NO: 8405695 - DNA, 22 bp, Homo sapiens
ccccagagaaagtcagcagcat

SEQ ID NO: 8405696 - DNA, 22 bp, Homo sapiens
ccccagagaaagtcagcagcat

SEQ ID NO: 8405697 - DNA, 22 bp, Homo sapiens
ccccagagtgagggattgagtg

SEQ ID NO: 8405698 - DNA, 22 bp, Homo sapiens
ccccagcacttggagtggggag

SEQ ID NO: 8405699 - DNA, 22 bp, Homo sapiens
ccccttccacagtgcttcctaa

SEQ ID NO: 8405700 - DNA, 21 bp, Homo sapiens
ccccagcaccttgccagcctg

SEQ ID NO: 8405701 - DNA, 22 bp, Homo sapiens
ccccagcactctgactcttacc

SEQ ID NO: 8405702 - DNA, 22 bp, Homo sapiens
agggtcaaaggaaaggcccaca

SEQ ID NO: 8405703 - DNA, 19 bp, Homo sapiens
aggggcactgtctctagag

SEQ ID NO: 8405704 - DNA, 22 bp, Homo sapiens
agggctggctaggtgcgttccc

SEQ ID NO: 8405705 - DNA, 22 bp, Homo sapiens
agggctggcatctctaatgctg

SEQ ID NO: 8405706 - DNA, 22 bp, Homo sapiens
cctcaggatacaggagccacag

SEQ ID NO: 8405707 - DNA, 22 bp, Homo sapiens
agggctggagccacagctggga

SEQ ID NO: 8405708 - DNA, 22 bp, Homo sapiens
agggctggagccacagctggga

SEQ ID NO: 8405709 - DNA, 22 bp, Homo sapiens
agggctggagccacagctggga

SEQ ID NO: 8405710 - DNA, 22 bp, Homo sapiens
agggcctcagtgttctcatctg

SEQ ID NO: 8405711 - DNA, 22 bp, Homo sapiens
agggcctcagtgttctcatctg

SEQ ID NO: 8405712 - DNA, 22 bp, Homo sapiens
agggcctccagggcagcagtgg

SEQ ID NO: 8405713 - DNA, 22 bp, Homo sapiens
aggccacagttgaggccagcaa

SEQ ID NO: 8405714 - DNA, 22 bp, Homo sapiens
aggccatgccaggcccaggaag

SEQ ID NO: 8405715 - DNA, 22 bp, Homo sapiens
ccagaaaatatggctaaggtga

SEQ ID NO: 8405716 - DNA, 22 bp, Homo sapiens
ccagaagaaaaagctggtatta

SEQ ID NO: 8405717 - DNA, 22 bp, Homo sapiens
ccagaagaacttaattcaaaac

SEQ ID NO: 8405718 - DNA, 22 bp, Homo sapiens
ccagagaaaaatgtgtccctgt

SEQ ID NO: 8405719 - DNA, 22 bp, Homo sapiens
ccagagaaagctcacaggcagt

SEQ ID NO: 8405720 - DNA, 22 bp, Homo sapiens
ccagagaaaagaggccaaggat

SEQ ID NO: 8405721 - DNA, 22 bp, Homo sapiens
ccagaccctttcttggcatgtg

SEQ ID NO: 8405722 - DNA, 22 bp, Homo sapiens
ccagctggcactgtggctgccc

SEQ ID NO: 8405723 - DNA, 22 bp, Homo sapiens
ccagctggcaggagagtcaggg

SEQ ID NO: 8405724 - DNA, 22 bp, Homo sapiens
ccagctggagctcgcagatagg

SEQ ID NO: 8405725 - DNA, 22 bp, Homo sapiens
ccagctggagccaaggtggact

SEQ ID NO: 8405726 - DNA, 22 bp, Homo sapiens
ccagctggaagagtgcagaact

SEQ ID NO: 8405727 - DNA, 22 bp, Homo sapiens
ccagctccggtgtgcttatttc

SEQ ID NO: 8405728 - DNA, 22 bp, Homo sapiens
ccagcaggagatgcctgtgtct

SEQ ID NO: 8405729 - DNA, 22 bp, Homo sapiens
ccaggaagtatgacccaacaga

SEQ ID NO: 8405730 - DNA, 22 bp, Homo sapiens
ccaggaaggtgtttaactagag

SEQ ID NO: 8405731 - DNA, 22 bp, Homo sapiens
aggcgtgggaggatctgaggcc

SEQ ID NO: 8405732 - DNA, 22 bp, Homo sapiens
aggcctggcatgagacctgaga

SEQ ID NO: 8405733 - DNA, 22 bp, Homo sapiens
aggcctggccccagttgctagg

SEQ ID NO: 8405734 - DNA, 22 bp, Homo sapiens
ccaggaaggcctggatgccccc

SEQ ID NO: 8405735 - DNA, 22 bp, Homo sapiens
ccaggaaggtatgggaagaaaa

SEQ ID NO: 8405736 - DNA, 22 bp, Homo sapiens
ccaggaaggcgttgttcctctc

SEQ ID NO: 8405737 - DNA, 22 bp, Homo sapiens
ccaggaagggctctttaaagac

SEQ ID NO: 8405738 - DNA, 22 bp, Homo sapiens
ccaggaaggcaggcctccccgc

SEQ ID NO: 8405739 - DNA, 22 bp, Homo sapiens
aggcctgggacgggagccgtga

SEQ ID NO: 8405740 - DNA, 22 bp, Homo sapiens
aggcctggctttggtttgctga

SEQ ID NO: 8405741 - DNA, 22 bp, Homo sapiens
aggctggcgacatctggcgggc

SEQ ID NO: 8405742 - DNA, 22 bp, Homo sapiens
aggctggcgtcaggggctgtac

SEQ ID NO: 8405743 - DNA, 22 bp, Homo sapiens
aggctgggaaggtaaagttgta

SEQ ID NO: 8405744 - DNA, 22 bp, Homo sapiens
ccaggtgactgtcagaggtttt

SEQ ID NO: 8405745 - DNA, 22 bp, Homo sapiens
ccaggtctggcactggccagtc

SEQ ID NO: 8405746 - DNA, 19 bp, Homo sapiens
aggctggagacaccaggcc

SEQ ID NO: 8405747 - DNA, 22 bp, Homo sapiens
ccagggctccattgctcatcct

SEQ ID NO: 8405748 - DNA, 22 bp, Homo sapiens
ccagggcctgccacttagcaag

SEQ ID NO: 8405749 - DNA, 22 bp, Homo sapiens
ccagggcctgccacttagcaag

SEQ ID NO: 8405750 - DNA, 22 bp, Homo sapiens
ccaggctgcttagccttatctt

SEQ ID NO: 8405751 - DNA, 22 bp, Homo sapiens
ccaggctggagtatagtggcgc

SEQ ID NO: 8405752 - DNA, 22 bp, Homo sapiens
gctcagggtcccttggtgctgg

SEQ ID NO: 8405753 - DNA, 22 bp, Homo sapiens
gcgcaggagccgcggagggccg

SEQ ID NO: 8405754 - DNA, 22 bp, Homo sapiens
gctaaggccttaactcatggag

SEQ ID NO: 8405755 - DNA, 22 bp, Homo sapiens
gcgtggggtaggtagacatgga

SEQ ID NO: 8405756 - DNA, 22 bp, Homo sapiens
gctatgggatgtgctgtggatg

SEQ ID NO: 8405757 - DNA, 22 bp, Homo sapiens
gctgaggaagtcaggtggccca

SEQ ID NO: 8405758 - DNA, 22 bp, Homo sapiens
gctgaggacatacacattgtgc

SEQ ID NO: 8405759 - DNA, 22 bp, Homo sapiens
gctgaggacatcatggaaggaa

SEQ ID NO: 8405760 - DNA, 22 bp, Homo sapiens
gctgaggaaaccaatgctcaga

SEQ ID NO: 8405761 - DNA, 22 bp, Homo sapiens
gctgaggaaaggctggaaggga

SEQ ID NO: 8405762 - DNA, 22 bp, Homo sapiens
gctctgggttctgatttatgag

SEQ ID NO: 8405763 - DNA, 15 bp, Homo sapiens
gctctgggtatttga

SEQ ID NO: 8405764 - DNA, 22 bp, Homo sapiens
gctctgggtgaatggcagattg

SEQ ID NO: 8405765 - DNA, 20 bp, Homo sapiens
gctctgggtggtaaatgact

SEQ ID NO: 8405766 - DNA, 22 bp, Homo sapiens
gctctgggtgaacttggagcaa

SEQ ID NO: 8405767 - DNA, 22 bp, Homo sapiens
gctctgggtgaagggtaccatt

SEQ ID NO: 8405768 - DNA, 20 bp, Homo sapiens
caaatccctgctctgtgctg

SEQ ID NO: 8405769 - DNA, 22 bp, Homo sapiens
caaatagacttaagcatctgta

SEQ ID NO: 8405770 - DNA, 22 bp, Homo sapiens
atttacataatagactttaggt

SEQ ID NO: 8405771 - DNA, 22 bp, Homo sapiens
atttacagtgtgcctactatat

SEQ ID NO: 8405772 - DNA, 22 bp, Homo sapiens
atttacagacgtggattagtgc

SEQ ID NO: 8405773 - DNA, 22 bp, Homo sapiens
atttacagtttagcatttcaag

SEQ ID NO: 8405774 - DNA, 22 bp, Homo sapiens
atttaccagtgctgacatttga

SEQ ID NO: 8405775 - DNA, 22 bp, Homo sapiens
atttacatttatttgagaaggt

SEQ ID NO: 8405776 - DNA, 22 bp, Homo sapiens
attgtacaaaaaagtagacctt

SEQ ID NO: 8405777 - DNA, 21 bp, Homo sapiens
gcagtgcagcttggagggtag

SEQ ID NO: 8405778 - DNA, 22 bp, Homo sapiens
attgtacaatgcctggaacatt

SEQ ID NO: 8405779 - DNA, 22 bp, Homo sapiens
gcagggctgggatttgagccca

SEQ ID NO: 8405780 - DNA, 22 bp, Homo sapiens
gcagggattgtgcagggggcta

SEQ ID NO: 8405781 - DNA, 22 bp, Homo sapiens
gcagggtcttgagaggcagcca

SEQ ID NO: 8405782 - DNA, 22 bp, Homo sapiens
gcagggtacattgggatgggat

SEQ ID NO: 8405783 - DNA, 22 bp, Homo sapiens
gcagggtaggtgacaggtagtc

SEQ ID NO: 8405784 - DNA, 22 bp, Homo sapiens
gcagggtacattgggatgggat

SEQ ID NO: 8405785 - DNA, 22 bp, Homo sapiens
gcagggtccatggaggcagccc

SEQ ID NO: 8405786 - DNA, 22 bp, Homo sapiens
attggcaggaaccgaggagggg

SEQ ID NO: 8405787 - DNA, 22 bp, Homo sapiens
attggcagggccagcatctccc

SEQ ID NO: 8405788 - DNA, 22 bp, Homo sapiens
gcaggatgggtgtagcccagca

SEQ ID NO: 8405789 - DNA, 22 bp, Homo sapiens
gcaggatgccagggcagcagcg

SEQ ID NO: 8405790 - DNA, 22 bp, Homo sapiens
gcaggagcagtcaggggcagct

SEQ ID NO: 8405791 - DNA, 22 bp, Homo sapiens
gcaggatgaactaacacctgca

SEQ ID NO: 8405792 - DNA, 22 bp, Homo sapiens
gcaggctgtggtatgttgggca

SEQ ID NO: 8405793 - DNA, 22 bp, Homo sapiens
gcacagaggaagcacagactct

SEQ ID NO: 8405794 - DNA, 22 bp, Homo sapiens
gcacaggctctcttggggacac

SEQ ID NO: 8405795 - DNA, 22 bp, Homo sapiens
gcacagggaggctggcctggcc

SEQ ID NO: 8405796 - DNA, 22 bp, Homo sapiens
gcactgggggcagcagtgaggg

SEQ ID NO: 8405797 - DNA, 22 bp, Homo sapiens
gcactgggtgtgaggcagcgtc

SEQ ID NO: 8405798 - DNA, 22 bp, Homo sapiens
gcaactgaacatgtgtgtggcc

SEQ ID NO: 8405799 - DNA, 22 bp, Homo sapiens
gcaaccatttggaatgtaaaaa

SEQ ID NO: 8405800 - DNA, 20 bp, Homo sapiens
gcaaatggatcccacaagcc

SEQ ID NO: 8405801 - DNA, 20 bp, Homo sapiens
gcaaatggacactcagggaa

SEQ ID NO: 8405802 - DNA, 19 bp, Homo sapiens
gcagatgatgaggctggtc

SEQ ID NO: 8405803 - DNA, 22 bp, Homo sapiens
gcagccaggctacagcgggctt

SEQ ID NO: 8405804 - DNA, 22 bp, Homo sapiens
gcagagtttgaagtcaagatgt

SEQ ID NO: 8405805 - DNA, 22 bp, Homo sapiens
gcagaggcctgaaggtggcggg

SEQ ID NO: 8405806 - DNA, 22 bp, Homo sapiens
gcagaggctgtagggaaggttg

SEQ ID NO: 8405807 - DNA, 22 bp, Homo sapiens
gcactgtgacccagagcaggtg

SEQ ID NO: 8405808 - DNA, 22 bp, Homo sapiens
gagcctttgaagccctcagaga

SEQ ID NO: 8405809 - DNA, 22 bp, Homo sapiens
gaggaaggagggaaagcgcgcg

SEQ ID NO: 8405810 - DNA, 22 bp, Homo sapiens
gaggaaggaatgcagtgtatgc

SEQ ID NO: 8405811 - DNA, 22 bp, Homo sapiens
gaggaaggatttagtttgaggg

SEQ ID NO: 8405812 - DNA, 22 bp, Homo sapiens
gaggaaggctaaggggcttaga

SEQ ID NO: 8405813 - DNA, 22 bp, Homo sapiens
atgtaacaggtgaagctctgag

SEQ ID NO: 8405814 - DNA, 22 bp, Homo sapiens
atgtacaaaatgccactgaatt

SEQ ID NO: 8405815 - DNA, 22 bp, Homo sapiens
atgtacaaaatgttttgaaatg

SEQ ID NO: 8405816 - DNA, 22 bp, Homo sapiens
atgtacaagctgttttactgca

SEQ ID NO: 8405817 - DNA, 22 bp, Homo sapiens
atgtacaatctagggtttgcat

SEQ ID NO: 8405818 - DNA, 22 bp, Homo sapiens
atgtacaatctatcacaagaag

SEQ ID NO: 8405819 - DNA, 22 bp, Homo sapiens
atgtacaacctgcatgacagtc

SEQ ID NO: 8405820 - DNA, 22 bp, Homo sapiens
atgtcacagtctgactcagtga

SEQ ID NO: 8405821 - DNA, 22 bp, Homo sapiens
gaggcttgcaccatgagcacca

SEQ ID NO: 8405822 - DNA, 22 bp, Homo sapiens
gaggccacagtcctgaggcatc

SEQ ID NO: 8405823 - DNA, 22 bp, Homo sapiens
gaggccacagtcagtgttcatc

SEQ ID NO: 8405824 - DNA, 22 bp, Homo sapiens
gaggccacagtgtctgggggcc

SEQ ID NO: 8405825 - DNA, 22 bp, Homo sapiens
gaggccacattacttggtgggt

SEQ ID NO: 8405826 - DNA, 22 bp, Homo sapiens
gaggggtcacatgggctggctt

SEQ ID NO: 8405827 - DNA, 22 bp, Homo sapiens
gatctggaatctgaaggctgag

SEQ ID NO: 8405828 - DNA, 21 bp, Homo sapiens
gagtgcaggtctgatgccatc

SEQ ID NO: 8405829 - DNA, 21 bp, Homo sapiens
gagtgcagcaaggtagagtct

SEQ ID NO: 8405830 - DNA, 22 bp, Homo sapiens
atgctttaaaacgtatgtgtaa

SEQ ID NO: 8405831 - DNA, 22 bp, Homo sapiens
atgcccagggctggtgaggtcc

SEQ ID NO: 8405832 - DNA, 22 bp, Homo sapiens
atgccctttaatttcactgtta

SEQ ID NO: 8405833 - DNA, 22 bp, Homo sapiens
gaatgtcagttgcgggcatttc

SEQ ID NO: 8405834 - DNA, 22 bp, Homo sapiens
gaatgttattgaactacgagct

SEQ ID NO: 8405835 - DNA, 22 bp, Homo sapiens
atgaggcatagcagggatcgga

SEQ ID NO: 8405836 - DNA, 22 bp, Homo sapiens
atgaggcagtctggcctgaggg

SEQ ID NO: 8405837 - DNA, 22 bp, Homo sapiens
gaaaaccacctcccatcaagca

SEQ ID NO: 8405838 - DNA, 22 bp, Homo sapiens
atgaatgagagaatagtggagc

SEQ ID NO: 8405839 - DNA, 22 bp, Homo sapiens
atgaatgatgcaaaagacactg

SEQ ID NO: 8405840 - DNA, 22 bp, Homo sapiens
atgaatgattaaagagtacagt

SEQ ID NO: 8405841 - DNA, 22 bp, Homo sapiens
atgaatgaaatacagagtactt

SEQ ID NO: 8405842 - DNA, 23 bp, Homo sapiens
ggctgggagctccgggtgcacgt

SEQ ID NO: 8405843 - DNA, 23 bp, Homo sapiens
ggctgggagctccgggtgcacgt

SEQ ID NO: 8405844 - DNA, 22 bp, Homo sapiens
ggctgggagccccacagagtca

SEQ ID NO: 8405845 - DNA, 22 bp, Homo sapiens
ggctgggacgatgaggattagt

SEQ ID NO: 8405846 - DNA, 22 bp, Homo sapiens
cagaagagtagctgaacaagtt

SEQ ID NO: 8405847 - DNA, 22 bp, Homo sapiens
cagaagaggactgggtagctca

SEQ ID NO: 8405848 - DNA, 23 bp, Homo sapiens
ggcttgagctggaacagcttggt

SEQ ID NO: 8405849 - DNA, 22 bp, Homo sapiens
ggcttggcagaggtgggtgctt

SEQ ID NO: 8405850 - DNA, 22 bp, Homo sapiens
ggctgccttgaccctggctccg

SEQ ID NO: 8405851 - DNA, 22 bp, Homo sapiens
ggctgaggctcatgccatcttg

SEQ ID NO: 8405852 - DNA, 22 bp, Homo sapiens
cactgaggtatctgtctctcct

SEQ ID NO: 8405853 - DNA, 22 bp, Homo sapiens
cactgagggcggagcccaggga

SEQ ID NO: 8405854 - DNA, 22 bp, Homo sapiens
cacatgccttcctcaggcctct

SEQ ID NO: 8405855 - DNA, 22 bp, Homo sapiens
ggagtgactcacagctgggaca

SEQ ID NO: 8405856 - DNA, 22 bp, Homo sapiens
ggagtgactctcggggccacta

SEQ ID NO: 8405857 - DNA, 22 bp, Homo sapiens
ggcaggaaaacaatgagccagg

SEQ ID NO: 8405858 - DNA, 22 bp, Homo sapiens
ggcagctgcaaatctgctctgt

SEQ ID NO: 8405859 - DNA, 22 bp, Homo sapiens
ggcaggaacacagatggtgccg

SEQ ID NO: 8405860 - DNA, 20 bp, Homo sapiens
ggatcagatggagcctctgc

SEQ ID NO: 8405861 - DNA, 22 bp, Homo sapiens
ggccagctacccatctgcgtca

SEQ ID NO: 8405862 - DNA, 22 bp, Homo sapiens
cacccaggaggttgggaagggc

SEQ ID NO: 8405863 - DNA, 22 bp, Homo sapiens
cacccaggcaggtggctgagaa

SEQ ID NO: 8405864 - DNA, 22 bp, Homo sapiens
cacccaggctagagtgcagtgg

SEQ ID NO: 8405865 - DNA, 22 bp, Homo sapiens
cacccaggcatgggttgagatg

SEQ ID NO: 8405866 - DNA, 21 bp, Homo sapiens
ggccagctcggaaggtcccat

SEQ ID NO: 8405867 - DNA, 22 bp, Homo sapiens
ggccagctcagggtccttgggc

SEQ ID NO: 8405868 - DNA, 18 bp, Homo sapiens
ggccagctcctgaggcag

SEQ ID NO: 8405869 - DNA, 22 bp, Homo sapiens
ggccccagggaagaaggtggtc

SEQ ID NO: 8405870 - DNA, 22 bp, Homo sapiens
ggccccagggattaggccaacc

SEQ ID NO: 8405871 - DNA, 22 bp, Homo sapiens
ggccccaggacctccacggtcc

SEQ ID NO: 8405872 - DNA, 22 bp, Homo sapiens
ggccccaggacctccacggtcc

SEQ ID NO: 8405873 - DNA, 22 bp, Homo sapiens
ggccccaggcctttggtctggc

SEQ ID NO: 8405874 - DNA, 22 bp, Homo sapiens
ggccccaggcctttggtctggc

SEQ ID NO: 8405875 - DNA, 22 bp, Homo sapiens
ggccccagcagaccctcctctg

SEQ ID NO: 8405876 - DNA, 22 bp, Homo sapiens
ggccccagcctcagtcccctga

SEQ ID NO: 8405877 - DNA, 22 bp, Homo sapiens
ggccccagcagaccctcctctg

SEQ ID NO: 8405878 - DNA, 22 bp, Homo sapiens
ggcccagcccgagtcagccttc

SEQ ID NO: 8405879 - DNA, 22 bp, Homo sapiens
ggccccagcagaccctcctctg

SEQ ID NO: 8405880 - DNA, 22 bp, Homo sapiens
cacaggagagctgggaggtgcc

SEQ ID NO: 8405881 - DNA, 22 bp, Homo sapiens
cacaggagagctgggaggtgcc

SEQ ID NO: 8405882 - DNA, 22 bp, Homo sapiens
ggaggggccggctgcctgccac

SEQ ID NO: 8405883 - DNA, 22 bp, Homo sapiens
ggaggggcatagttcaccatca

SEQ ID NO: 8405884 - DNA, 22 bp, Homo sapiens
ggaggggcagccatggaactcc

SEQ ID NO: 8405885 - DNA, 22 bp, Homo sapiens
ggaggggcaggtcccaagttgt

SEQ ID NO: 8405886 - DNA, 22 bp, Homo sapiens
ggaggagcacttctgagctcag

SEQ ID NO: 8405887 - DNA, 22 bp, Homo sapiens
ggaggagcacttctgagctcag

SEQ ID NO: 8405888 - DNA, 19 bp, Homo sapiens
cacagccacagccaacctc

SEQ ID NO: 8405889 - DNA, 22 bp, Homo sapiens
ggacagattgagctaggcgttt

SEQ ID NO: 8405890 - DNA, 19 bp, Homo sapiens
ggacacagaaagctgcatt

SEQ ID NO: 8405891 - DNA, 22 bp, Homo sapiens
ggaagagagatcccatagatgt

SEQ ID NO: 8405892 - DNA, 22 bp, Homo sapiens
ggaagagaaatgagtcaagact

SEQ ID NO: 8405893 - DNA, 22 bp, Homo sapiens
ggaagagaatgatggctatggg

SEQ ID NO: 8405894 - DNA, 18 bp, Homo sapiens
ggagagtgacagagtcgt

SEQ ID NO: 8405895 - DNA, 22 bp, Homo sapiens
gctggtcctcaagggcacagcc

SEQ ID NO: 8405896 - DNA, 22 bp, Homo sapiens
gctggtgagcaaaggagaagga

SEQ ID NO: 8405897 - DNA, 22 bp, Homo sapiens
caagttcaagtcctggctctgc

SEQ ID NO: 8405898 - DNA, 22 bp, Homo sapiens
caagttcacgttgctttttgag

SEQ ID NO: 8405899 - DNA, 22 bp, Homo sapiens
caagttcacatgcatccttgct

SEQ ID NO: 8405900 - DNA, 22 bp, Homo sapiens
caagttcattgtagcattattg

SEQ ID NO: 8405901 - DNA, 21 bp, Homo sapiens
caagttcagaaggttgggctg

SEQ ID NO: 8405902 - DNA, 21 bp, Homo sapiens
caatggcgagatcttggctca

SEQ ID NO: 8405903 - DNA, 22 bp, Homo sapiens
caatgtactacaaagattgtca

SEQ ID NO: 8405904 - DNA, 22 bp, Homo sapiens
caatgtacaaaataattacaca

SEQ ID NO: 8405905 - DNA, 18 bp, Homo sapiens
ggaaatgtttggtactag

SEQ ID NO: 8405906 - DNA, 20 bp, Homo sapiens
gctgaggtccctgtggtttt

SEQ ID NO: 8405907 - DNA, 22 bp, Homo sapiens
gctggcagagagctggtgagga

SEQ ID NO: 8405908 - DNA, 20 bp, Homo sapiens
gctgggctaccactggccct

SEQ ID NO: 8405909 - DNA, 22 bp, Homo sapiens
gctggccatggggagtgaggag

SEQ ID NO: 8405910 - DNA, 22 bp, Homo sapiens
cagaagatgctttgtaaaatga

SEQ ID NO: 8405911 - DNA, 22 bp, Homo sapiens
cagaagatgcagtgtctgagaa

SEQ ID NO: 8405912 - DNA, 22 bp, Homo sapiens
cagagagagtctgtccctgaag

SEQ ID NO: 8405913 - DNA, 22 bp, Homo sapiens
cagagcagcctccagggggagc

SEQ ID NO: 8405914 - DNA, 22 bp, Homo sapiens
cagagcaggaatagggtgttga

SEQ ID NO: 8405915 - DNA, 22 bp, Homo sapiens
cagaggaaggctctgggaatgt

SEQ ID NO: 8405916 - DNA, 22 bp, Homo sapiens
cagaggaagagatacaagccct

SEQ ID NO: 8405917 - DNA, 21 bp, Homo sapiens
gggctcagtggaaaagagtgt

SEQ ID NO: 8405918 - DNA, 22 bp, Homo sapiens
gggctcagtctggcgtggaatg

SEQ ID NO: 8405919 - DNA, 22 bp, Homo sapiens
gggctcagtctgcggcgcgcgg

SEQ ID NO: 8405920 - DNA, 22 bp, Homo sapiens
gggctcagtcggcaagcccctt

SEQ ID NO: 8405921 - DNA, 22 bp, Homo sapiens
gggctcagtcggcaagcccctt

SEQ ID NO: 8405922 - DNA, 22 bp, Homo sapiens
gggctcaggcctggcctctcac

SEQ ID NO: 8405923 - DNA, 22 bp, Homo sapiens
gggctcaggcctggcctctcac

SEQ ID NO: 8405924 - DNA, 22 bp, Homo sapiens
gggctcaggagtttgaggctgc

SEQ ID NO: 8405925 - DNA, 22 bp, Homo sapiens
gggctcaggtcagggcatcagc

SEQ ID NO: 8405926 - DNA, 22 bp, Homo sapiens
gggctcagtcctggttctaccc

SEQ ID NO: 8405927 - DNA, 22 bp, Homo sapiens
gggctcagggacacatgtgtgt

SEQ ID NO: 8405928 - DNA, 22 bp, Homo sapiens
gggctcagggacacatgtgtgt

SEQ ID NO: 8405929 - DNA, 20 bp, Homo sapiens
cagcagagacccatggggag

SEQ ID NO: 8405930 - DNA, 22 bp, Homo sapiens
ggggtctgctgcggagcagaga

SEQ ID NO: 8405931 - DNA, 22 bp, Homo sapiens
cagaggctgatgtgggatgggc

SEQ ID NO: 8405932 - DNA, 22 bp, Homo sapiens
cagaggctgctctgggtggcat

SEQ ID NO: 8405933 - DNA, 22 bp, Homo sapiens
cagatatattcatttgcagtgc

SEQ ID NO: 8405934 - DNA, 20 bp, Homo sapiens
gtgctgagggctgggcaatg

SEQ ID NO: 8405935 - DNA, 22 bp, Homo sapiens
gtgcctggtttggggaatgttc

SEQ ID NO: 8405936 - DNA, 22 bp, Homo sapiens
gtgctgaggatacagctgtgaa

SEQ ID NO: 8405937 - DNA, 22 bp, Homo sapiens
cagccctgtgcggagggccctg

SEQ ID NO: 8405938 - DNA, 22 bp, Homo sapiens
cagcagagctgggaataaaatt

SEQ ID NO: 8405939 - DNA, 22 bp, Homo sapiens
cagcagtggctgcaggcagctg

SEQ ID NO: 8405940 - DNA, 22 bp, Homo sapiens
cagcatgattggtgtctggtga

SEQ ID NO: 8405941 - DNA, 22 bp, Homo sapiens
gtcctgtgtaagccaggacaat

SEQ ID NO: 8405942 - DNA, 22 bp, Homo sapiens
cagcatgactcactgtggtcac

SEQ ID NO: 8405943 - DNA, 22 bp, Homo sapiens
gtgcagctactccttggtccta

SEQ ID NO: 8405944 - DNA, 22 bp, Homo sapiens
catgctgtcctgaaaagatatt

SEQ ID NO: 8405945 - DNA, 22 bp, Homo sapiens
catgctgtggtaaatcactgaa

SEQ ID NO: 8405946 - DNA, 22 bp, Homo sapiens
catgctgtgcatcttgatgacc

SEQ ID NO: 8405947 - DNA, 22 bp, Homo sapiens
catgctgtgtggttagaactgt

SEQ ID NO: 8405948 - DNA, 22 bp, Homo sapiens
catgggctctctgagctccagg

SEQ ID NO: 8405949 - DNA, 22 bp, Homo sapiens
catgtacaaaaggcaaatgcct

SEQ ID NO: 8405950 - DNA, 22 bp, Homo sapiens
catgtaaagcatccttctaggg

SEQ ID NO: 8405951 - DNA, 22 bp, Homo sapiens
catgtacatgcatgggcactgt

SEQ ID NO: 8405952 - DNA, 22 bp, Homo sapiens
catgtacagtttttctgtcctg

SEQ ID NO: 8405953 - DNA, 23 bp, Homo sapiens
catgtacagagtttgataaagtg

SEQ ID NO: 8405954 - DNA, 22 bp, Homo sapiens
catgtacagccagggttgagaa

SEQ ID NO: 8405955 - DNA, 22 bp, Homo sapiens
catgtacactcatgtaactata

SEQ ID NO: 8405956 - DNA, 23 bp, Homo sapiens
catgtacacacagctgtacagtg

SEQ ID NO: 8405957 - DNA, 22 bp, Homo sapiens
catgtacaaggatgctcagagt

SEQ ID NO: 8405958 - DNA, 22 bp, Homo sapiens
catgtacacacaaagggacaat

SEQ ID NO: 8405959 - DNA, 22 bp, Homo sapiens
catgtgggaagaggccagctgg

SEQ ID NO: 8405960 - DNA, 22 bp, Homo sapiens
catgtgggacaatctcaggtat

SEQ ID NO: 8405961 - DNA, 22 bp, Homo sapiens
tccaggtagggaataaatgtca

SEQ ID NO: 8405962 - DNA, 22 bp, Homo sapiens
tccaggtattactaagtgttaa

SEQ ID NO: 8405963 - DNA, 22 bp, Homo sapiens
catcagcctggaaggcagcctg

SEQ ID NO: 8405964 - DNA, 21 bp, Homo sapiens
tcaggaggctcagactcctgc

SEQ ID NO: 8405965 - DNA, 22 bp, Homo sapiens
tcaggaggcgtctcgctggggc

SEQ ID NO: 8405966 - DNA, 22 bp, Homo sapiens
tcaggaggcggtgctgcctttg

SEQ ID NO: 8405967 - DNA, 22 bp, Homo sapiens
tcaggaggcgtgctggggtaca

SEQ ID NO: 8405968 - DNA, 22 bp, Homo sapiens
tcaggaggctcaagacctggca

SEQ ID NO: 8405969 - DNA, 22 bp, Homo sapiens
tcaggaggccaccaggacctgt

SEQ ID NO: 8405970 - DNA, 22 bp, Homo sapiens
tcaggaagttttgaatcaactg

SEQ ID NO: 8405971 - DNA, 22 bp, Homo sapiens
tcaggaggccggcaggatttga

SEQ ID NO: 8405972 - DNA, 22 bp, Homo sapiens
tcaggaggcggaggttgcagtg

SEQ ID NO: 8405973 - DNA, 22 bp, Homo sapiens
tcaggaggcctgagtagctcta

SEQ ID NO: 8405974 - DNA, 22 bp, Homo sapiens
tcaggaggcctgagtagctcta

SEQ ID NO: 8405975 - DNA, 22 bp, Homo sapiens
tcaggaggccgtgtgctcagtg

SEQ ID NO: 8405976 - DNA, 22 bp, Homo sapiens
tcaggctgcagctgtcagcagc

SEQ ID NO: 8405977 - DNA, 22 bp, Homo sapiens
ccagagccagagaggtgcctgc

SEQ ID NO: 8405978 - DNA, 22 bp, Homo sapiens
ccagaggctgggttcacctcag

SEQ ID NO: 8405979 - DNA, 22 bp, Homo sapiens
ccagagcctcaacacaggtcct

SEQ ID NO: 8405980 - DNA, 22 bp, Homo sapiens
tctcagcttgagtggatgagct

SEQ ID NO: 8405981 - DNA, 22 bp, Homo sapiens
ccacagggcctttcctgctggc

SEQ ID NO: 8405982 - DNA, 22 bp, Homo sapiens
tcctgcccagagctctccactc

SEQ ID NO: 8405983 - DNA, 22 bp, Homo sapiens
ccaaccattggctaagaattgg

SEQ ID NO: 8405984 - DNA, 22 bp, Homo sapiens
taccctcacgagacttcaagtc

SEQ ID NO: 8405985 - DNA, 22 bp, Homo sapiens
caggctgcagcagcagtggccc

SEQ ID NO: 8405986 - DNA, 22 bp, Homo sapiens
tacctagtcacggggtggctgt

SEQ ID NO: 8405987 - DNA, 22 bp, Homo sapiens
tacctagttccctttggggcct

SEQ ID NO: 8405988 - DNA, 22 bp, Homo sapiens
tacctagacatgaacacagatg

SEQ ID NO: 8405989 - DNA, 22 bp, Homo sapiens
cagggacagccttggggtggcg

SEQ ID NO: 8405990 - DNA, 22 bp, Homo sapiens
cagggacagccttggggtggcg

SEQ ID NO: 8405991 - DNA, 22 bp, Homo sapiens
tagcagcacagaaagcctggag

SEQ ID NO: 8405992 - DNA, 22 bp, Homo sapiens
tagcagcaaagcaggatctgct

SEQ ID NO: 8405993 - DNA, 22 bp, Homo sapiens
cagggagctttgtcttctcatt

SEQ ID NO: 8405994 - DNA, 22 bp, Homo sapiens
cagggcagtaccgccctctggc

SEQ ID NO: 8405995 - DNA, 22 bp, Homo sapiens
cagggcagttttacttctctct

SEQ ID NO: 8405996 - DNA, 22 bp, Homo sapiens
cagggccaagctgcagcatctg

SEQ ID NO: 8405997 - DNA, 22 bp, Homo sapiens
cagggccaagcccctttggctg

SEQ ID NO: 8405998 - DNA, 23 bp, Homo sapiens
gtggagccacatcacaggctcct

SEQ ID NO: 8405999 - DNA, 22 bp, Homo sapiens
tacacagcctgtaatgatgact

SEQ ID NO: 8406000 - DNA, 22 bp, Homo sapiens
tacactgtgtaaaatgcacttt

SEQ ID NO: 8406001 - DNA, 22 bp, Homo sapiens
tacactgtttttggaaagaaga

SEQ ID NO: 8406002 - DNA, 22 bp, Homo sapiens
tacactgtggtaaactcaaagt

SEQ ID NO: 8406003 - DNA, 22 bp, Homo sapiens
caggccaccagatacatgcccc

SEQ ID NO: 8406004 - DNA, 22 bp, Homo sapiens
tacagcctcttccctggagtgg

SEQ ID NO: 8406005 - DNA, 22 bp, Homo sapiens
tacagcctggcactaccctggg

SEQ ID NO: 8406006 - DNA, 22 bp, Homo sapiens
tacagcctgatttggagccact

SEQ ID NO: 8406007 - DNA, 20 bp, Homo sapiens
tacagcctattcaccacata

SEQ ID NO: 8406008 - DNA, 22 bp, Homo sapiens
tacagcctcatcacgggagctg

SEQ ID NO: 8406009 - DNA, 22 bp, Homo sapiens
tacagcctccacaggccaagtg

SEQ ID NO: 8406010 - DNA, 17 bp, Homo sapiens
tacagttagaatctgga

SEQ ID NO: 8406011 - DNA, 22 bp, Homo sapiens
caggcctggagtgcaatggcac

SEQ ID NO: 8406012 - DNA, 22 bp, Homo sapiens
caggcctgtgacaccgtgtctg

SEQ ID NO: 8406013 - DNA, 20 bp, Homo sapiens
caggctccgcaggactaggg

SEQ ID NO: 8406014 - DNA, 22 bp, Homo sapiens
caggctcctcactcatgctccc

SEQ ID NO: 8406015 - DNA, 22 bp, Homo sapiens
caggctccctaagtcagcagcc

SEQ ID NO: 8406016 - DNA, 22 bp, Homo sapiens
caggctcccgctccactgggca

SEQ ID NO: 8406017 - DNA, 22 bp, Homo sapiens
caggctccctgggcagtggcag

SEQ ID NO: 8406018 - DNA, 22 bp, Homo sapiens
caggctccagcttcctgctcag

SEQ ID NO: 8406019 - DNA, 22 bp, Homo sapiens
caggctcccgaaatcacccatg

SEQ ID NO: 8406020 - DNA, 22 bp, Homo sapiens
cagtggcaatgggacagagcac

SEQ ID NO: 8406021 - DNA, 19 bp, Homo sapiens
cagtggagattggaggagg

SEQ ID NO: 8406022 - DNA, 22 bp, Homo sapiens
cagtggcaagtccggtattgaa

SEQ ID NO: 8406023 - DNA, 22 bp, Homo sapiens
cagtgcaggtttagggctgggg

SEQ ID NO: 8406024 - DNA, 22 bp, Homo sapiens
cagtgcaggtggcagaggacag

SEQ ID NO: 8406025 - DNA, 22 bp, Homo sapiens
tcaaatgggtatgctttataat

SEQ ID NO: 8406026 - DNA, 22 bp, Homo sapiens
tattccctgatgtacactggca

SEQ ID NO: 8406027 - DNA, 22 bp, Homo sapiens
tatgtacatcgttgaattcaaa

SEQ ID NO: 8406028 - DNA, 22 bp, Homo sapiens
caggtggcttattagggtcagt

SEQ ID NO: 8406029 - DNA, 22 bp, Homo sapiens
tatgcacacatgtatgcatgtg

SEQ ID NO: 8406030 - DNA, 22 bp, Homo sapiens
tatgtacatgatttcatttgct

SEQ ID NO: 8406031 - DNA, 22 bp, Homo sapiens
tatgtacatcttgagcaatgaa

SEQ ID NO: 8406032 - DNA, 22 bp, Homo sapiens
tatgtacatggagagcaattga

SEQ ID NO: 8406033 - DNA, 22 bp, Homo sapiens
tatgtacatgttaaagggcaaa

SEQ ID NO: 8406034 - DNA, 22 bp, Homo sapiens
tatgcacacatcgcagcaggaa

SEQ ID NO: 8406035 - DNA, 21 bp, Homo sapiens
cagggccaatcctgacctcta

SEQ ID NO: 8406036 - DNA, 22 bp, Homo sapiens
cagggccacacggaagggaaca

SEQ ID NO: 8406037 - DNA, 22 bp, Homo sapiens
cagggccaagttggtgcctttt

SEQ ID NO: 8406038 - DNA, 20 bp, Homo sapiens
cagggccacgctccaaggca

SEQ ID NO: 8406039 - DNA, 22 bp, Homo sapiens
cagggccaccgtgtttgctgct

SEQ ID NO: 8406040 - DNA, 22 bp, Homo sapiens
cagggccaccctctgctgggtg

SEQ ID NO: 8406041 - DNA, 22 bp, Homo sapiens
cagggccaccctctgctgggtg

SEQ ID NO: 8406042 - DNA, 22 bp, Homo sapiens
cagggctggatcctccagactc

SEQ ID NO: 8406043 - DNA, 22 bp, Homo sapiens
ccaggcaggcgatggtgcagtg

SEQ ID NO: 8406044 - DNA, 22 bp, Homo sapiens
ccaggcagagtgctccagaaag

SEQ ID NO: 8406045 - DNA, 22 bp, Homo sapiens
ccaggaggcggaggttgcagtg

SEQ ID NO: 8406046 - DNA, 22 bp, Homo sapiens
ccaggaggctctgactggaccc

SEQ ID NO: 8406047 - DNA, 22 bp, Homo sapiens
ccaggaggctctgcccatccca

SEQ ID NO: 8406048 - DNA, 22 bp, Homo sapiens
ccaggaggctcttgtccctggt

SEQ ID NO: 8406049 - DNA, 16 bp, Homo sapiens
ccaggaggctgacacc

SEQ ID NO: 8406050 - DNA, 22 bp, Homo sapiens
ccaggaggcttcgtccgtggag

SEQ ID NO: 8406051 - DNA, 22 bp, Homo sapiens
ccaggagcagccggcccacctg

SEQ ID NO: 8406052 - DNA, 22 bp, Homo sapiens
ccaggagcaggagctgcagctg

SEQ ID NO: 8406053 - DNA, 22 bp, Homo sapiens
ccaggagcaggagctggacaga

SEQ ID NO: 8406054 - DNA, 22 bp, Homo sapiens
ccaggagccactcaggcccaca

SEQ ID NO: 8406055 - DNA, 22 bp, Homo sapiens
ccaggagccactcaggcccaca

SEQ ID NO: 8406056 - DNA, 22 bp, Homo sapiens
ccaggagcattaagagaacata

SEQ ID NO: 8406057 - DNA, 22 bp, Homo sapiens
tctgggctctgcgaagcccttc

SEQ ID NO: 8406058 - DNA, 22 bp, Homo sapiens
tctgggctctgtcagcacctct

SEQ ID NO: 8406059 - DNA, 22 bp, Homo sapiens
ccagcactcgctgattttagga

SEQ ID NO: 8406060 - DNA, 22 bp, Homo sapiens
ccagggcagtgggagaaggtgc

SEQ ID NO: 8406061 - DNA, 22 bp, Homo sapiens
ccagggcaattatttggagggt

SEQ ID NO: 8406062 - DNA, 22 bp, Homo sapiens
ccagggcaataggaacactttt

SEQ ID NO: 8406063 - DNA, 22 bp, Homo sapiens
ccagggcaacgctgtctcagag

SEQ ID NO: 8406064 - DNA, 22 bp, Homo sapiens
ccagggcacgttgggacagtac

SEQ ID NO: 8406065 - DNA, 22 bp, Homo sapiens
ccagggagggtcctgtggcttc

SEQ ID NO: 8406066 - DNA, 22 bp, Homo sapiens
tcttgcaggcggctcagcaacc

SEQ ID NO: 8406067 - DNA, 22 bp, Homo sapiens
ccaggcttcccccatcctagga

SEQ ID NO: 8406068 - DNA, 22 bp, Homo sapiens
ccaggctgtaagagtgatgttg

SEQ ID NO: 8406069 - DNA, 21 bp, Homo sapiens
ccaggctgggagggcagttcc

SEQ ID NO: 8406070 - DNA, 22 bp, Homo sapiens
tgaaacactttcaattacatat

SEQ ID NO: 8406071 - DNA, 21 bp, Homo sapiens
tgaaacactctttccatgaga

SEQ ID NO: 8406072 - DNA, 22 bp, Homo sapiens
tgaggcagtgtgagataataaa

SEQ ID NO: 8406073 - DNA, 22 bp, Homo sapiens
ccagtgcattgccgtgtctagg

SEQ ID NO: 8406074 - DNA, 22 bp, Homo sapiens
tgagcccagagatctgagctat

SEQ ID NO: 8406075 - DNA, 22 bp, Homo sapiens
tgagcccagagcccttgtaggg

SEQ ID NO: 8406076 - DNA, 22 bp, Homo sapiens
tgaggctgaaactggcgataga

SEQ ID NO: 8406077 - DNA, 22 bp, Homo sapiens
tgaggctgacaaaagatgaggt

SEQ ID NO: 8406078 - DNA, 18 bp, Homo sapiens
tgaggctgaatatggggc

SEQ ID NO: 8406079 - DNA, 17 bp, Homo sapiens
tgaggccatggcaccat

SEQ ID NO: 8406080 - DNA, 22 bp, Homo sapiens
tgaggctgagatatcagggagg

SEQ ID NO: 8406081 - DNA, 22 bp, Homo sapiens
tgaggctgagatatcagggagg

SEQ ID NO: 8406082 - DNA, 19 bp, Homo sapiens
tgaggtctacatgggcatc

SEQ ID NO: 8406083 - DNA, 18 bp, Homo sapiens
cccagaggaatgcctgga

SEQ ID NO: 8406084 - DNA, 19 bp, Homo sapiens
cccagaggaatgcctggaa

SEQ ID NO: 8406085 - DNA, 22 bp, Homo sapiens
tgcactggtggtgagtgaggga

SEQ ID NO: 8406086 - DNA, 22 bp, Homo sapiens
tgcagctgcaggagggtgggag

SEQ ID NO: 8406087 - DNA, 22 bp, Homo sapiens
cccagaggaggatctcggcccg

SEQ ID NO: 8406088 - DNA, 20 bp, Homo sapiens
tgcagctgcaggagggtggg

SEQ ID NO: 8406089 - DNA, 22 bp, Homo sapiens
tgcagctgattaaagggcagac

SEQ ID NO: 8406090 - DNA, 22 bp, Homo sapiens
cccagcaggaggaggttgcagt

SEQ ID NO: 8406091 - DNA, 22 bp, Homo sapiens
cccagcagcctggatgttcttt

SEQ ID NO: 8406092 - DNA, 22 bp, Homo sapiens
tgggtggagaagtggacctgct

SEQ ID NO: 8406093 - DNA, 22 bp, Homo sapiens
tgggtggcaaaggcccattgtc

SEQ ID NO: 8406094 - DNA, 22 bp, Homo sapiens
tgggtggcggcctggttctgag

SEQ ID NO: 8406095 - DNA, 18 bp, Homo sapiens
tgggtggctagggagttt

SEQ ID NO: 8406096 - DNA, 22 bp, Homo sapiens
tgggtggcacttctggggtcca

SEQ ID NO: 8406097 - DNA, 22 bp, Homo sapiens
tgggtggcagcttcagcatgtt

SEQ ID NO: 8406098 - DNA, 22 bp, Homo sapiens
tggggagagattgaggagtttt

SEQ ID NO: 8406099 - DNA, 22 bp, Homo sapiens
tgggctcatggcccagcactgg

SEQ ID NO: 8406100 - DNA, 19 bp, Homo sapiens
tgggctcattcaggtggtt

SEQ ID NO: 8406101 - DNA, 22 bp, Homo sapiens
tgggcctggccctgtggaggag

SEQ ID NO: 8406102 - DNA, 22 bp, Homo sapiens
tgggcaggagagaagctaaaga

SEQ ID NO: 8406103 - DNA, 22 bp, Homo sapiens
tgggcaggataatatctcatgt

SEQ ID NO: 8406104 - DNA, 22 bp, Homo sapiens
tgggcaggcaagtgaatacctt

SEQ ID NO: 8406105 - DNA, 22 bp, Homo sapiens
tgggcaggatgcgttgattctt

SEQ ID NO: 8406106 - DNA, 22 bp, Homo sapiens
tgggagagataggcttctggac

SEQ ID NO: 8406107 - DNA, 22 bp, Homo sapiens
tgggacagggaatctgatcccc

SEQ ID NO: 8406108 - DNA, 22 bp, Homo sapiens
tgggacagggaatctgatcccc

SEQ ID NO: 8406109 - DNA, 22 bp, Homo sapiens
tgggagagaattctggtgactg

SEQ ID NO: 8406110 - DNA, 22 bp, Homo sapiens
tgggacaggaggcctctggaga

SEQ ID NO: 8406111 - DNA, 22 bp, Homo sapiens
tgggacaggatgaccagaaggt

SEQ ID NO: 8406112 - DNA, 22 bp, Homo sapiens
tgggacagagtgagctttggcc

SEQ ID NO: 8406113 - DNA, 22 bp, Homo sapiens
tgggacagattataagtctgca

SEQ ID NO: 8406114 - DNA, 21 bp, Homo sapiens
tgggagagcgttgctgtcctc

SEQ ID NO: 8406115 - DNA, 22 bp, Homo sapiens
tgggcagaaggaagagccacct

SEQ ID NO: 8406116 - DNA, 22 bp, Homo sapiens
tggcttggctaagatctaagct

SEQ ID NO: 8406117 - DNA, 22 bp, Homo sapiens
tggcttgggagattctcgaact

SEQ ID NO: 8406118 - DNA, 22 bp, Homo sapiens
tggcagtgggaagctggaagtc

SEQ ID NO: 8406119 - DNA, 19 bp, Homo sapiens
tggcaggtagtgagcagtc

SEQ ID NO: 8406120 - DNA, 22 bp, Homo sapiens
tggcagtgtcttatcaggagtg

SEQ ID NO: 8406121 - DNA, 22 bp, Homo sapiens
tggcagtgtcttgctggggcag

SEQ ID NO: 8406122 - DNA, 22 bp, Homo sapiens
tggcagtgtgggaggaaggtac

SEQ ID NO: 8406123 - DNA, 21 bp, Homo sapiens
tggccaaggaatagaagctct

SEQ ID NO: 8406124 - DNA, 22 bp, Homo sapiens
cctccagctgcctcagtctctt

SEQ ID NO: 8406125 - DNA, 22 bp, Homo sapiens
tggccaagccactgctgggtct

SEQ ID NO: 8406126 - DNA, 22 bp, Homo sapiens
tggcagggaatacagatgttta

SEQ ID NO: 8406127 - DNA, 19 bp, Homo sapiens
tggcagggagagtttgaag

SEQ ID NO: 8406128 - DNA, 19 bp, Homo sapiens
tggcaggcccaggatggac

SEQ ID NO: 8406129 - DNA, 22 bp, Homo sapiens
ccctggaggtggaggttgcagg

SEQ ID NO: 8406130 - DNA, 22 bp, Homo sapiens
ccctggaggttgaggctgcagt

SEQ ID NO: 8406131 - DNA, 22 bp, Homo sapiens
tggagatgaacatggtgatgtt

SEQ ID NO: 8406132 - DNA, 22 bp, Homo sapiens
tggagatgaatatgtgtacctg

SEQ ID NO: 8406133 - DNA, 22 bp, Homo sapiens
tggagatgcacgagcaggtgga

SEQ ID NO: 8406134 - DNA, 22 bp, Homo sapiens
tggagatgtaaagcaaggctta

SEQ ID NO: 8406135 - DNA, 22 bp, Homo sapiens
cccagttgttgccggctctgga

SEQ ID NO: 8406136 - DNA, 22 bp, Homo sapiens
ccccagctcagtgcagggacat

SEQ ID NO: 8406137 - DNA, 22 bp, Homo sapiens
ccccagctgagatttgaggaga

SEQ ID NO: 8406138 - DNA, 22 bp, Homo sapiens
ccccagctgcatacttgccaag

SEQ ID NO: 8406139 - DNA, 22 bp, Homo sapiens
ctgggaagaagtgggctacatt

SEQ ID NO: 8406140 - DNA, 22 bp, Homo sapiens
ctgggacagagcagcagtgggg

SEQ ID NO: 8406141 - DNA, 22 bp, Homo sapiens
ctgggacattataagaaacatt

SEQ ID NO: 8406142 - DNA, 22 bp, Homo sapiens
ctgggacatggtgctgtcttta

SEQ ID NO: 8406143 - DNA, 23 bp, Homo sapiens
ctgggacatggtaggggcacaac

SEQ ID NO: 8406144 - DNA, 22 bp, Homo sapiens
ctgggacctgtgtgcctgggcc

SEQ ID NO: 8406145 - DNA, 22 bp, Homo sapiens
ctgggagaggtggtgggaagta

SEQ ID NO: 8406146 - DNA, 22 bp, Homo sapiens
ctgggagattgaggccatggtg

SEQ ID NO: 8406147 - DNA, 22 bp, Homo sapiens
ctgggcagagtccggaagatgg

SEQ ID NO: 8406148 - DNA, 22 bp, Homo sapiens
ctgggcagctgtatcagggagt

SEQ ID NO: 8406149 - DNA, 22 bp, Homo sapiens
ctgggcagctgtatcagggagt

SEQ ID NO: 8406150 - DNA, 22 bp, Homo sapiens
ctgggccttggattgacactgt

SEQ ID NO: 8406151 - DNA, 22 bp, Homo sapiens
ctggtgacatttccggctgcca

SEQ ID NO: 8406152 - DNA, 20 bp, Homo sapiens
ctggggagcctcgcggtggc

SEQ ID NO: 8406153 - DNA, 22 bp, Homo sapiens
ctgtacaatgttacctatttat

SEQ ID NO: 8406154 - DNA, 22 bp, Homo sapiens
ctgtacaagtccttcatcaggg

SEQ ID NO: 8406155 - DNA, 22 bp, Homo sapiens
ctgtacaaagtagctgctggga

SEQ ID NO: 8406156 - DNA, 22 bp, Homo sapiens
ctgtacaaatggcagttgagtt

SEQ ID NO: 8406157 - DNA, 22 bp, Homo sapiens
ctgtacaaaagaaagttcctat

SEQ ID NO: 8406158 - DNA, 22 bp, Homo sapiens
ctggtgacttcatctcctcccc

SEQ ID NO: 8406159 - DNA, 22 bp, Homo sapiens
ctggtgaccggacctcagtttt

SEQ ID NO: 8406160 - DNA, 22 bp, Homo sapiens
ctgtgctgattcagcacaggcc

SEQ ID NO: 8406161 - DNA, 22 bp, Homo sapiens
ctgtcacttaaattcaggctga

SEQ ID NO: 8406162 - DNA, 22 bp, Homo sapiens
cttacccttcatcagattttgg

SEQ ID NO: 8406163 - DNA, 22 bp, Homo sapiens
cttctagagctggagcaaatgt

SEQ ID NO: 8406164 - DNA, 22 bp, Homo sapiens
cttccactctgagtccaccctg

SEQ ID NO: 8406165 - DNA, 22 bp, Homo sapiens
gaaaatttagaactgaacttct

SEQ ID NO: 8406166 - DNA, 22 bp, Homo sapiens
gaaaatttctgccacatgtgtg

SEQ ID NO: 8406167 - DNA, 22 bp, Homo sapiens
gaaaatacttcagtgttctggc

SEQ ID NO: 8406168 - DNA, 22 bp, Homo sapiens
gaggggctgccctggtgtcagg

SEQ ID NO: 8406169 - DNA, 22 bp, Homo sapiens
gaggggctggcacgatggctgc

SEQ ID NO: 8406170 - DNA, 22 bp, Homo sapiens
gagggagagtgatggaccattg

SEQ ID NO: 8406171 - DNA, 22 bp, Homo sapiens
gagggagccgccacagactggg

SEQ ID NO: 8406172 - DNA, 22 bp, Homo sapiens
gagggagccgccacagactggg

SEQ ID NO: 8406173 - DNA, 22 bp, Homo sapiens
gaggctgccaatgtgtgcatgt

SEQ ID NO: 8406174 - DNA, 22 bp, Homo sapiens
gaggctgattcggggaacagca

SEQ ID NO: 8406175 - DNA, 22 bp, Homo sapiens
gaggagaggggctcccaagagc

SEQ ID NO: 8406176 - DNA, 22 bp, Homo sapiens
gaggcaggcactgttatcagca

SEQ ID NO: 8406177 - DNA, 22 bp, Homo sapiens
gaggcaggcactgttatcagca

SEQ ID NO: 8406178 - DNA, 22 bp, Homo sapiens
gaggagcccccactgggctcac

SEQ ID NO: 8406179 - DNA, 22 bp, Homo sapiens
gaggcaggccctgaatgagtca

SEQ ID NO: 8406180 - DNA, 22 bp, Homo sapiens
gaggcagtgtcggtggcaggat

SEQ ID NO: 8406181 - DNA, 22 bp, Homo sapiens
gaggctcagagaagtcatggta

SEQ ID NO: 8406182 - DNA, 22 bp, Homo sapiens
gaggctcaacccacaggggttg

SEQ ID NO: 8406183 - DNA, 22 bp, Homo sapiens
gaggctgaagtgtacatgggtg

SEQ ID NO: 8406184 - DNA, 22 bp, Homo sapiens
gagcccagctctacctcagact

SEQ ID NO: 8406185 - DNA, 22 bp, Homo sapiens
gagcccagctgcggccctcagc

SEQ ID NO: 8406186 - DNA, 22 bp, Homo sapiens
gagcccagcccagagccatatg

SEQ ID NO: 8406187 - DNA, 22 bp, Homo sapiens
gagcccagcttgcacatggagc

SEQ ID NO: 8406188 - DNA, 22 bp, Homo sapiens
gagcccagctgtccttggcaaa

SEQ ID NO: 8406189 - DNA, 22 bp, Homo sapiens
gagcccagggcaggcaaggcag

SEQ ID NO: 8406190 - DNA, 21 bp, Homo sapiens
gagcccaggcatctcattaat

SEQ ID NO: 8406191 - DNA, 22 bp, Homo sapiens
gagcccaggttctgcttccagc

SEQ ID NO: 8406192 - DNA, 22 bp, Homo sapiens
gagcccagtaggcaaagctgca

SEQ ID NO: 8406193 - DNA, 21 bp, Homo sapiens
gagcatggcttacatcagcag

SEQ ID NO: 8406194 - DNA, 22 bp, Homo sapiens
gaggaagaaagcataggtgggg

SEQ ID NO: 8406195 - DNA, 22 bp, Homo sapiens
gaggaagaatcagggtggtgag

SEQ ID NO: 8406196 - DNA, 22 bp, Homo sapiens
gaggaaacattgtagaagcagt

SEQ ID NO: 8406197 - DNA, 18 bp, Homo sapiens
gaggaaacaaggcagagg

SEQ ID NO: 8406198 - DNA, 18 bp, Homo sapiens
gaggaaacaggctctgtg

SEQ ID NO: 8406199 - DNA, 22 bp, Homo sapiens
gactgaggtgacctaggactac

SEQ ID NO: 8406200 - DNA, 22 bp, Homo sapiens
gagaccaggaagtacagcagcc

SEQ ID NO: 8406201 - DNA, 22 bp, Homo sapiens
gagaccaggaagtacagcagcc

SEQ ID NO: 8406202 - DNA, 22 bp, Homo sapiens
gaccaggaaagagtgtgactaa

SEQ ID NO: 8406203 - DNA, 22 bp, Homo sapiens
gacatttaaggcagtcacttaa

SEQ ID NO: 8406204 - DNA, 22 bp, Homo sapiens
gacatttactgaatactgatta

SEQ ID NO: 8406205 - DNA, 22 bp, Homo sapiens
gaaggtagctgctgagatgaca

SEQ ID NO: 8406206 - DNA, 22 bp, Homo sapiens
gaagggtgtgtgtgagggacac

SEQ ID NO: 8406207 - DNA, 22 bp, Homo sapiens
gaagggcttggctgggaggcca

SEQ ID NO: 8406208 - DNA, 22 bp, Homo sapiens
gaagggcttggctgggaggcca

SEQ ID NO: 8406209 - DNA, 22 bp, Homo sapiens
gaagggctttctgggagaagag

SEQ ID NO: 8406210 - DNA, 22 bp, Homo sapiens
gaagggctttctgggagaagag

SEQ ID NO: 8406211 - DNA, 22 bp, Homo sapiens
gaaggccatttttaggtagaat

SEQ ID NO: 8406212 - DNA, 22 bp, Homo sapiens
gaaggcagggaatgtggtgcta

SEQ ID NO: 8406213 - DNA, 22 bp, Homo sapiens
gaaggagctaaagggagccctg

SEQ ID NO: 8406214 - DNA, 22 bp, Homo sapiens
gaaagctgaaccaggaaccatg

SEQ ID NO: 8406215 - DNA, 22 bp, Homo sapiens
gaagcatactttctatactgct

SEQ ID NO: 8406216 - DNA, 22 bp, Homo sapiens
ctcctcagctgggaggagtccc

SEQ ID NO: 8406217 - DNA, 19 bp, Homo sapiens
ctcctcagtcccagaggtc

SEQ ID NO: 8406218 - DNA, 22 bp, Homo sapiens
ctcaggctgtgatgtgatggca

SEQ ID NO: 8406219 - DNA, 22 bp, Homo sapiens
ctccccaccttcgcggtccctg

SEQ ID NO: 8406220 - DNA, 22 bp, Homo sapiens
ctccccacatttctccctgtct

SEQ ID NO: 8406221 - DNA, 22 bp, Homo sapiens
tttcaaataccataaacctaat

SEQ ID NO: 8406222 - DNA, 22 bp, Homo sapiens
ctctgaggctccatgcaggctt

SEQ ID NO: 8406223 - DNA, 20 bp, Homo sapiens
ctctgaggtatctgtaaagt

SEQ ID NO: 8406224 - DNA, 21 bp, Homo sapiens
ctctggaggcaagggagagtg

SEQ ID NO: 8406225 - DNA, 20 bp, Homo sapiens
ctgccctgccctgggtcctg

SEQ ID NO: 8406226 - DNA, 22 bp, Homo sapiens
ctgagctggttctcttgtgaaa

SEQ ID NO: 8406227 - DNA, 22 bp, Homo sapiens
ctgagctggtggaagcatgcag

SEQ ID NO: 8406228 - DNA, 22 bp, Homo sapiens
ctgagggagaagtcacgggcag

SEQ ID NO: 8406229 - DNA, 22 bp, Homo sapiens
ctgagggagagaatggggcaaa

SEQ ID NO: 8406230 - DNA, 22 bp, Homo sapiens
ctgagggagacagtgcggacta

SEQ ID NO: 8406231 - DNA, 22 bp, Homo sapiens
ctgagggcaccgacagagtgga

SEQ ID NO: 8406232 - DNA, 22 bp, Homo sapiens
ctgagggatgggctgggccgcc

SEQ ID NO: 8406233 - DNA, 22 bp, Homo sapiens
ctgagaggtaagcagcgcagtg

SEQ ID NO: 8406234 - DNA, 22 bp, Homo sapiens
ctgagctgggagcctggcacca

SEQ ID NO: 8406235 - DNA, 22 bp, Homo sapiens
ttttcctgcctttgctcaggga

SEQ ID NO: 8406236 - DNA, 22 bp, Homo sapiens
tttttctgagaatatgagagga

SEQ ID NO: 8406237 - DNA, 22 bp, Homo sapiens
tttttctgagcggtaatcatca

SEQ ID NO: 8406238 - DNA, 18 bp, Homo sapiens
tttttctgataaaacaag

SEQ ID NO: 8406239 - DNA, 22 bp, Homo sapiens
ctgaagggggtttcactgagct

SEQ ID NO: 8406240 - DNA, 22 bp, Homo sapiens
tttttctggataactgtatctc

SEQ ID NO: 8406241 - DNA, 22 bp, Homo sapiens
cggcttccagcaggtgctgcgc

SEQ ID NO: 8406242 - DNA, 22 bp, Homo sapiens
cggctgggttcggctgcaggcc

SEQ ID NO: 8406243 - DNA, 22 bp, Homo sapiens
cgtcccgggttcacgccattct

SEQ ID NO: 8406244 - DNA, 22 bp, Homo sapiens
ctaacctagttcaacaactgtc

SEQ ID NO: 8406245 - DNA, 22 bp, Homo sapiens
ctaaattatcatgagaattatg

SEQ ID NO: 8406246 - DNA, 22 bp, Homo sapiens
ctagttgaagaggctgtcatca

SEQ ID NO: 8406247 - DNA, 22 bp, Homo sapiens
ctcagccatgcaacatgctggg

SEQ ID NO: 8406248 - DNA, 22 bp, Homo sapiens
ttgatcaaatcagctactgagg

SEQ ID NO: 8406249 - DNA, 22 bp, Homo sapiens
ttgcaaaagcaattgcagtttt

SEQ ID NO: 8406250 - DNA, 22 bp, Homo sapiens
ttgctggcttgaagatagagga

SEQ ID NO: 8406251 - DNA, 22 bp, Homo sapiens
ttgaatcattacaatagataag

SEQ ID NO: 8406252 - DNA, 22 bp, Homo sapiens
ctcactgcaagctctgcctcca

SEQ ID NO: 8406253 - DNA, 22 bp, Homo sapiens
ctcactgcaagctctgcctccc

SEQ ID NO: 8406254 - DNA, 21 bp, Homo sapiens
ttactaaacaaaacatgcagg

SEQ ID NO: 8406255 - DNA, 22 bp, Homo sapiens
ccttgtcttgcacagatgcagc

SEQ ID NO: 8406256 - DNA, 20 bp, Homo sapiens
ttacagaaatgatgttattt

SEQ ID NO: 8406257 - DNA, 22 bp, Homo sapiens
ttacagaactgccctagttggc

SEQ ID NO: 8406258 - DNA, 22 bp, Homo sapiens
ttacagaaaggttgtgggatag

SEQ ID NO: 8406259 - DNA, 22 bp, Homo sapiens
cgatgctggaatgacagctgct

SEQ ID NO: 8406260 - DNA, 22 bp, Homo sapiens
cctgtggctggtcaggccagca

SEQ ID NO: 8406261 - DNA, 20 bp, Homo sapiens
cctgtggctcttgtaattca

SEQ ID NO: 8406262 - DNA, 22 bp, Homo sapiens
tggttccagttttcaatagagc

SEQ ID NO: 8406263 - DNA, 17 bp, Homo sapiens
tggttccaaccatacgc

SEQ ID NO: 8406264 - DNA, 20 bp, Homo sapiens
tgttgattggtgtcatctca

SEQ ID NO: 8406265 - DNA, 22 bp, Homo sapiens
cctggggctcaagatggcgccg

SEQ ID NO: 8406266 - DNA, 22 bp, Homo sapiens
gggctgggaatggctaagtatg

SEQ ID NO: 8406267 - DNA, 22 bp, Homo sapiens
gggtcagagccgtaacaggact

SEQ ID NO: 8406268 - DNA, 22 bp, Homo sapiens
ggggctgtttttggaatggctg

SEQ ID NO: 8406269 - DNA, 22 bp, Homo sapiens
ggggcaggagcccttcttcagc

SEQ ID NO: 8406270 - DNA, 20 bp, Homo sapiens
gggctggcgcatggggaaag

SEQ ID NO: 8406271 - DNA, 22 bp, Homo sapiens
gggctccagttgtccccaggat

SEQ ID NO: 8406272 - DNA, 23 bp, Homo sapiens
gggctccagtctctgctcagttg

SEQ ID NO: 8406273 - DNA, 22 bp, Homo sapiens
gggctccaggagccctaagaga

SEQ ID NO: 8406274 - DNA, 22 bp, Homo sapiens
gggctccatcacaggctccatc

SEQ ID NO: 8406275 - DNA, 18 bp, Homo sapiens
gggcatcattcacaaagt

SEQ ID NO: 8406276 - DNA, 22 bp, Homo sapiens
gggcctccggggtgagctgtgg

SEQ ID NO: 8406277 - DNA, 22 bp, Homo sapiens
gggcctcagctgccaacaggat

SEQ ID NO: 8406278 - DNA, 22 bp, Homo sapiens
gggcctcagctctgctctgcaa

SEQ ID NO: 8406279 - DNA, 22 bp, Homo sapiens
gggcctcagctggagtctgcct

SEQ ID NO: 8406280 - DNA, 22 bp, Homo sapiens
ggtgccagcctagtgcagtggt

SEQ ID NO: 8406281 - DNA, 22 bp, Homo sapiens
ggtgcccagcgaagtggctgtg

SEQ ID NO: 8406282 - DNA, 21 bp, Homo sapiens
ggtgggcacaggagagcagag

SEQ ID NO: 8406283 - DNA, 22 bp, Homo sapiens
ggtgggcaacatttggcctgag

SEQ ID NO: 8406284 - DNA, 22 bp, Homo sapiens
ggtgggagtggaacgtggaaga

SEQ ID NO: 8406285 - DNA, 20 bp, Homo sapiens
ggtgcaggtaacgctgtgct

SEQ ID NO: 8406286 - DNA, 17 bp, Homo sapiens
ggtctggggccattggc

SEQ ID NO: 8406287 - DNA, 22 bp, Homo sapiens
ggtcccagaattggttagcaca

SEQ ID NO: 8406288 - DNA, 17 bp, Homo sapiens
ggtacctacttctaacc

SEQ ID NO: 8406289 - DNA, 22 bp, Homo sapiens
gggtcaggctagcccagacttc

SEQ ID NO: 8406290 - DNA, 22 bp, Homo sapiens
gggtcagggctgcctgggctca

SEQ ID NO: 8406291 - DNA, 22 bp, Homo sapiens
gggtcaggctcagcagggcagc

SEQ ID NO: 8406292 - DNA, 22 bp, Homo sapiens
gggtcagggctgcctgggctca

SEQ ID NO: 8406293 - DNA, 23 bp, Homo sapiens
ggtccaggaaaggcagcagcacc

SEQ ID NO: 8406294 - DNA, 22 bp, Homo sapiens
ggtcagggggatctgtgaggta

SEQ ID NO: 8406295 - DNA, 22 bp, Homo sapiens
ggtcagggggatctgtgaggta

SEQ ID NO: 8406296 - DNA, 21 bp, Homo sapiens
ggtcagggggtgcctccaggt

SEQ ID NO: 8406297 - DNA, 22 bp, Homo sapiens
ggtcagggtataatcaagtgag

SEQ ID NO: 8406298 - DNA, 22 bp, Homo sapiens
ggtcaggggctgctctacagag

SEQ ID NO: 8406299 - DNA, 22 bp, Homo sapiens
ggtcaggggctgctctacagag

SEQ ID NO: 8406300 - DNA, 18 bp, Homo sapiens
ggtcaggggcggagagaa

SEQ ID NO: 8406301 - DNA, 22 bp, Homo sapiens
ggtcagggctgggtatgaagag

SEQ ID NO: 8406302 - DNA, 22 bp, Homo sapiens
ggtaggagtattttgcagcagt

SEQ ID NO: 8406303 - DNA, 22 bp, Homo sapiens
gtgctgggccctgagaccaggg

SEQ ID NO: 8406304 - DNA, 22 bp, Homo sapiens
gtgcacaatcttcatatggcgt

SEQ ID NO: 8406305 - DNA, 22 bp, Homo sapiens
gtcttgaaattctgttaaagga

SEQ ID NO: 8406306 - DNA, 22 bp, Homo sapiens
gtgaggcagggaaagaggataa

SEQ ID NO: 8406307 - DNA, 22 bp, Homo sapiens
gtgattaactgcagttagagct

SEQ ID NO: 8406308 - DNA, 22 bp, Homo sapiens
gtgatgtagccctaattctgca

SEQ ID NO: 8406309 - DNA, 22 bp, Homo sapiens
ggtgggcacccgagactggatc

SEQ ID NO: 8406310 - DNA, 22 bp, Homo sapiens
ggtgggcagctcttggcaggca

SEQ ID NO: 8406311 - DNA, 22 bp, Homo sapiens
ggtgggcagctcttggcaggca

SEQ ID NO: 8406312 - DNA, 22 bp, Homo sapiens
gtaaatcataaaatttgagctc

SEQ ID NO: 8406313 - DNA, 22 bp, Homo sapiens
gtagctgatattagcaatgagt

SEQ ID NO: 8406314 - DNA, 22 bp, Homo sapiens
gtagaggctcagagagccgcag

SEQ ID NO: 8406315 - DNA, 22 bp, Homo sapiens
gtcaatcagaaatcatgttaca

SEQ ID NO: 8406316 - DNA, 22 bp, Homo sapiens
gtcctctgcttcatgccctgat

SEQ ID NO: 8406317 - DNA, 22 bp, Homo sapiens
ggatgcaggaacacagcgacct

SEQ ID NO: 8406318 - DNA, 20 bp, Homo sapiens
ggatggccggaccagagcct

SEQ ID NO: 8406319 - DNA, 22 bp, Homo sapiens
ggatggccttcttgctcaggaa

SEQ ID NO: 8406320 - DNA, 22 bp, Homo sapiens
ggattgagagcactggtagctg

SEQ ID NO: 8406321 - DNA, 22 bp, Homo sapiens
ggagatgtagtgtcactggact

SEQ ID NO: 8406322 - DNA, 22 bp, Homo sapiens
ggagcagagctgggcttggctg

SEQ ID NO: 8406323 - DNA, 22 bp, Homo sapiens
ggcagcaggagccatctggtag

SEQ ID NO: 8406324 - DNA, 22 bp, Homo sapiens
ggcagcagcaaggttggagctg

SEQ ID NO: 8406325 - DNA, 22 bp, Homo sapiens
ggatttggaagaccgggtcaca

SEQ ID NO: 8406326 - DNA, 23 bp, Homo sapiens
ggattggccccaggagtatgggt

SEQ ID NO: 8406327 - DNA, 22 bp, Homo sapiens
ggattgagagcactggtagctg

SEQ ID NO: 8406328 - DNA, 22 bp, Homo sapiens
ggcagccagtagggccagcctg

SEQ ID NO: 8406329 - DNA, 22 bp, Homo sapiens
ggcagccatactcagacctggg

SEQ ID NO: 8406330 - DNA, 22 bp, Homo sapiens
ggcagcagtccatggcccaagg

SEQ ID NO: 8406331 - DNA, 22 bp, Homo sapiens
ggcagcagggtctagattgatg

SEQ ID NO: 8406332 - DNA, 17 bp, Homo sapiens
ggcagctgtgtgcatgc

SEQ ID NO: 8406333 - DNA, 17 bp, Homo sapiens
ggcagggtgctgggtat

SEQ ID NO: 8406334 - DNA, 17 bp, Homo sapiens
ggcagggtgctgggtat

SEQ ID NO: 8406335 - DNA, 22 bp, Homo sapiens
ggcagggtggccctccagtgag

SEQ ID NO: 8406336 - DNA, 19 bp, Homo sapiens
ggcaggtagagggccagtc

SEQ ID NO: 8406337 - DNA, 22 bp, Homo sapiens
ggcaggtactggggagtgaaga

SEQ ID NO: 8406338 - DNA, 22 bp, Homo sapiens
ggcaggtacagcaagaggacaa

SEQ ID NO: 8406339 - DNA, 22 bp, Homo sapiens
ggcagggtgtggagttgggaca

SEQ ID NO: 8406340 - DNA, 22 bp, Homo sapiens
ggcaggtgagagctctttgaaa

SEQ ID NO: 8406341 - DNA, 22 bp, Homo sapiens
ggcaggtagcctagaggaggtt

SEQ ID NO: 8406342 - DNA, 22 bp, Homo sapiens
ggcagggtccacacctgggaaa

SEQ ID NO: 8406343 - DNA, 22 bp, Homo sapiens
ggcagggtaaaccgaggtaagt

SEQ ID NO: 8406344 - DNA, 22 bp, Homo sapiens
ggccaggaacttttgggatggg

SEQ ID NO: 8406345 - DNA, 22 bp, Homo sapiens
ggccagctttgagctgcaggaa

SEQ ID NO: 8406346 - DNA, 22 bp, Homo sapiens
ggccagctttctgtcttctagg

SEQ ID NO: 8406347 - DNA, 22 bp, Homo sapiens
ggccagctgtggggccgagcct

SEQ ID NO: 8406348 - DNA, 19 bp, Homo sapiens
ggccagctgtctcctgcta

SEQ ID NO: 8406349 - DNA, 22 bp, Homo sapiens
ggccagcttattagctcagagg

SEQ ID NO: 8406350 - DNA, 22 bp, Homo sapiens
ggcatgagaggtcctggggatt

SEQ ID NO: 8406351 - DNA, 22 bp, Homo sapiens
ggcatcttgttgctcaaatcta

SEQ ID NO: 8406352 - DNA, 22 bp, Homo sapiens
ggcatcccttcttccagtgtca

SEQ ID NO: 8406353 - DNA, 22 bp, Homo sapiens
ggcatccctagaatagccaggt

SEQ ID NO: 8406354 - DNA, 21 bp, Homo sapiens
ggcatcccaggccagtgactg

SEQ ID NO: 8406355 - DNA, 19 bp, Homo sapiens
ggcgggtggactggagccc

SEQ ID NO: 8406356 - DNA, 22 bp, Homo sapiens
ggcctggcagagcgcgcggctg

SEQ ID NO: 8406357 - DNA, 22 bp, Homo sapiens
ggcctcagaccggagctggcca

SEQ ID NO: 8406358 - DNA, 22 bp, Homo sapiens
ggccaggagcagaatcgcctgc

SEQ ID NO: 8406359 - DNA, 22 bp, Homo sapiens
ggccaggagctgcacagggctc

SEQ ID NO: 8406360 - DNA, 22 bp, Homo sapiens
ggctgtgcctcaaggctactca

SEQ ID NO: 8406361 - DNA, 22 bp, Homo sapiens
ggctgtgcctctggcagcacat

SEQ ID NO: 8406362 - DNA, 22 bp, Homo sapiens
ggctgtgcgggcagccgtggga

SEQ ID NO: 8406363 - DNA, 22 bp, Homo sapiens
gggagctggagctggaagactc

SEQ ID NO: 8406364 - DNA, 22 bp, Homo sapiens
gggaatgtaagatatatactag

SEQ ID NO: 8406365 - DNA, 22 bp, Homo sapiens
gggaggtgattaggaccatgta

SEQ ID NO: 8406366 - DNA, 22 bp, Homo sapiens
gggaggtgttccagtgttggta

SEQ ID NO: 8406367 - DNA, 22 bp, Homo sapiens
gggaggtgaaaggttgctgcag

SEQ ID NO: 8406368 - DNA, 22 bp, Homo sapiens
gggagggccaggctcacccagg

SEQ ID NO: 8406369 - DNA, 22 bp, Homo sapiens
gggcagtgacaaaggggatgaa

SEQ ID NO: 8406370 - DNA, 22 bp, Homo sapiens
gggcagtgaatattggtgggaa

SEQ ID NO: 8406371 - DNA, 22 bp, Homo sapiens
gggcaggttattggagtaggga

SEQ ID NO: 8406372 - DNA, 23 bp, Homo sapiens
gggcaggtttttataggcttcag

SEQ ID NO: 8406373 - DNA, 23 bp, Homo sapiens
gggcaggtttttataggcttcag

SEQ ID NO: 8406374 - DNA, 22 bp, Homo sapiens
ggctggaatgtgtggatgtgat

SEQ ID NO: 8406375 - DNA, 22 bp, Homo sapiens
ggctgagggtatagctgtccca

SEQ ID NO: 8406376 - DNA, 22 bp, Homo sapiens
ggctgagggtcccagaccctaa

SEQ ID NO: 8406377 - DNA, 22 bp, Homo sapiens
ggctgagggccagggctagtct

SEQ ID NO: 8406378 - DNA, 22 bp, Homo sapiens
ggctgagggccagggctagtct

SEQ ID NO: 8406379 - DNA, 22 bp, Homo sapiens
ggctgagggccagggctagtct

SEQ ID NO: 8406380 - DNA, 22 bp, Homo sapiens
ggctgaggtgtggggaactata

SEQ ID NO: 8406381 - DNA, 22 bp, Homo sapiens
ggctgaggtgtggggaactata

SEQ ID NO: 8406382 - DNA, 18 bp, Homo sapiens
ggctgaggttgactagaa

SEQ ID NO: 8406383 - DNA, 18 bp, Homo sapiens
ggctgaggttgactagaa

SEQ ID NO: 8406384 - DNA, 19 bp, Homo sapiens
ggctggagaaaggaatcag

SEQ ID NO: 8406385 - DNA, 21 bp, Homo sapiens
ggctgggtcatgcagctggcc

SEQ ID NO: 8406386 - DNA, 22 bp, Homo sapiens
ggctgggtcccagctgggagga

SEQ ID NO: 8406387 - DNA, 23 bp, Homo sapiens
ggctggtgcccttggccagtcgg

SEQ ID NO: 8406388 - DNA, 23 bp, Homo sapiens
ggctggtgcccttggccagtcgg

SEQ ID NO: 8406389 - DNA, 23 bp, Homo sapiens
ggctgtgcagcctgcggcaaaag

SEQ ID NO: 8406390 - DNA, 22 bp, Homo sapiens
ggctgtgcagggcagagtctca

SEQ ID NO: 8406391 - DNA, 22 bp, Homo sapiens
ggctgtgcaccatccacctccc

SEQ ID NO: 8406392 - DNA, 17 bp, Homo sapiens
ggctgtgccaggtgaga

SEQ ID NO: 8406393 - DNA, 20 bp, Homo sapiens
ggctgtgcccttccgtggcc

SEQ ID NO: 8406394 - DNA, 22 bp, Homo sapiens
ggctgtgccctcacatggggca

SEQ ID NO: 8406395 - DNA, 22 bp, Homo sapiens
ggctccagtttgtgccttcagc

SEQ ID NO: 8406396 - DNA, 23 bp, Homo sapiens
ggctagagtggaggggaactgca

SEQ ID NO: 8406397 - DNA, 22 bp, Homo sapiens
ggctagaagtcagaggtcaaga

SEQ ID NO: 8406398 - DNA, 22 bp, Homo sapiens
ggctaagggttatacatgaacc

SEQ ID NO: 8406399 - DNA, 22 bp, Homo sapiens
ggctaaggaacgcaggcttctc

SEQ ID NO: 8406400 - DNA, 22 bp, Homo sapiens
gcagcagctcagttctgggagg

SEQ ID NO: 8406401 - DNA, 22 bp, Homo sapiens
gcagcagctgacagtgggtgcc

SEQ ID NO: 8406402 - DNA, 22 bp, Homo sapiens
gcagcagctctgaatgggcccc

SEQ ID NO: 8406403 - DNA, 22 bp, Homo sapiens
gcagcatgttgaaagggccaca

SEQ ID NO: 8406404 - DNA, 22 bp, Homo sapiens
gcagcatggagttgtggaatga

SEQ ID NO: 8406405 - DNA, 23 bp, Homo sapiens
gcagccaagagaccagggcaggc

SEQ ID NO: 8406406 - DNA, 22 bp, Homo sapiens
gcagctgatggaagtcctattg

SEQ ID NO: 8406407 - DNA, 22 bp, Homo sapiens
gcaggagtgacatggatgtgga

SEQ ID NO: 8406408 - DNA, 22 bp, Homo sapiens
gcaggagtatgcagctatggtt

SEQ ID NO: 8406409 - DNA, 22 bp, Homo sapiens
gcaggaggttgagccaggactg

SEQ ID NO: 8406410 - DNA, 22 bp, Homo sapiens
gcaggaggccaggtatgcttta

SEQ ID NO: 8406411 - DNA, 22 bp, Homo sapiens
gcagctggacccacacggctta

SEQ ID NO: 8406412 - DNA, 22 bp, Homo sapiens
gcagctggagcatcttctcatc

SEQ ID NO: 8406413 - DNA, 22 bp, Homo sapiens
gcaggagctggaaagtgatgtt

SEQ ID NO: 8406414 - DNA, 22 bp, Homo sapiens
gcaggaggatcacttgagccca

SEQ ID NO: 8406415 - DNA, 22 bp, Homo sapiens
gcaggaggagcattaactgagc

SEQ ID NO: 8406416 - DNA, 22 bp, Homo sapiens
gcaggctcactctgtttggctc

SEQ ID NO: 8406417 - DNA, 22 bp, Homo sapiens
gcaggctgagttgggaaaccaa

SEQ ID NO: 8406418 - DNA, 22 bp, Homo sapiens
gcaggctgagtattaccctagt

SEQ ID NO: 8406419 - DNA, 22 bp, Homo sapiens
gcaggctgagagtccaagaagg

SEQ ID NO: 8406420 - DNA, 22 bp, Homo sapiens
gcaggctgaaactcggggtcta

SEQ ID NO: 8406421 - DNA, 22 bp, Homo sapiens
gcaggctcgttggaagtcccct

SEQ ID NO: 8406422 - DNA, 22 bp, Homo sapiens
gcaggctgatgactggagttgg

SEQ ID NO: 8406423 - DNA, 22 bp, Homo sapiens
gcaggctgccaccttctgagtt

SEQ ID NO: 8406424 - DNA, 22 bp, Homo sapiens
gcagggctaatggggcaagtag

SEQ ID NO: 8406425 - DNA, 22 bp, Homo sapiens
gcactgagtctgtcatgctgca

SEQ ID NO: 8406426 - DNA, 22 bp, Homo sapiens
gcactgggaatgagggcagctt

SEQ ID NO: 8406427 - DNA, 21 bp, Homo sapiens
gcactgagcatctcctctgcc

SEQ ID NO: 8406428 - DNA, 22 bp, Homo sapiens
gcactctgccaggtctcctgat

SEQ ID NO: 8406429 - DNA, 22 bp, Homo sapiens
gcactgggctccaggaaggagg

SEQ ID NO: 8406430 - DNA, 22 bp, Homo sapiens
gcactgggaatgtgagcagctg

SEQ ID NO: 8406431 - DNA, 22 bp, Homo sapiens
gcactgggagtctgtgggggtt

SEQ ID NO: 8406432 - DNA, 22 bp, Homo sapiens
gcactgggaatgctgatgggct

SEQ ID NO: 8406433 - DNA, 22 bp, Homo sapiens
gcagagctgcagcgaggcctgg

SEQ ID NO: 8406434 - DNA, 22 bp, Homo sapiens
gcagaggacacaggagggcaag

SEQ ID NO: 8406435 - DNA, 22 bp, Homo sapiens
gaggggctgggtagggcaaccc

SEQ ID NO: 8406436 - DNA, 22 bp, Homo sapiens
gcaaatcctcctgcctgaagaa

SEQ ID NO: 8406437 - DNA, 20 bp, Homo sapiens
gcacagctgagttcagggtc

SEQ ID NO: 8406438 - DNA, 22 bp, Homo sapiens
gcacagctagacggtagccaaa

SEQ ID NO: 8406439 - DNA, 17 bp, Homo sapiens
gcagtgaaaagagatca

SEQ ID NO: 8406440 - DNA, 22 bp, Homo sapiens
gcagggctctgctgtagtccta

SEQ ID NO: 8406441 - DNA, 22 bp, Homo sapiens
gcagggctccactgtggccaag

SEQ ID NO: 8406442 - DNA, 22 bp, Homo sapiens
gcagggctcagccgctcccacc

SEQ ID NO: 8406443 - DNA, 22 bp, Homo sapiens
gccagagaggcaaatcctagca

SEQ ID NO: 8406444 - DNA, 22 bp, Homo sapiens
gccagagaggccgaggtaccca

SEQ ID NO: 8406445 - DNA, 22 bp, Homo sapiens
gccaagggtagtggaggcccct

SEQ ID NO: 8406446 - DNA, 22 bp, Homo sapiens
gccagagagagtccctgggcct

SEQ ID NO: 8406447 - DNA, 22 bp, Homo sapiens
gccagagcatgcactgcctgca

SEQ ID NO: 8406448 - DNA, 22 bp, Homo sapiens
gccagagccggcttcacaggat

SEQ ID NO: 8406449 - DNA, 22 bp, Homo sapiens
gccagagcagaatagagtggcc

SEQ ID NO: 8406450 - DNA, 22 bp, Homo sapiens
gccagcccagctccaggggaaa

SEQ ID NO: 8406451 - DNA, 22 bp, Homo sapiens
gccagcaggttgtcaaggagct

SEQ ID NO: 8406452 - DNA, 22 bp, Homo sapiens
gccagagcttcccccgagtgtg

SEQ ID NO: 8406453 - DNA, 22 bp, Homo sapiens
gccaggtggtctggctccagag

SEQ ID NO: 8406454 - DNA, 22 bp, Homo sapiens
gccaggtctgcaggcatcctga

SEQ ID NO: 8406455 - DNA, 22 bp, Homo sapiens
gccaggcacagttctaggtgct

SEQ ID NO: 8406456 - DNA, 22 bp, Homo sapiens
gccagtggcatgcggcagggac

SEQ ID NO: 8406457 - DNA, 22 bp, Homo sapiens
gccagtggaggacccatggaga

SEQ ID NO: 8406458 - DNA, 22 bp, Homo sapiens
gccagtggcttgccaggcagga

SEQ ID NO: 8406459 - DNA, 22 bp, Homo sapiens
gcccacaggtcctacctctttc

SEQ ID NO: 8406460 - DNA, 22 bp, Homo sapiens
gccaggttgctgacgacgatct

SEQ ID NO: 8406461 - DNA, 22 bp, Homo sapiens
gccagtggagactgaaacccat

SEQ ID NO: 8406462 - DNA, 22 bp, Homo sapiens
gccagtggagcacatggtgaag

SEQ ID NO: 8406463 - DNA, 22 bp, Homo sapiens
gccagtgcctgctgctcagggc

SEQ ID NO: 8406464 - DNA, 22 bp, Homo sapiens
gcccatctaatatgtactgtgt

SEQ ID NO: 8406465 - DNA, 22 bp, Homo sapiens
gcccatgcccctccttctggca

SEQ ID NO: 8406466 - DNA, 22 bp, Homo sapiens
gcccaggctggagttcagtggt

SEQ ID NO: 8406467 - DNA, 22 bp, Homo sapiens
gcccaggctggagtgcagtggt

SEQ ID NO: 8406468 - DNA, 22 bp, Homo sapiens
gcctcaggactggcatactcat

SEQ ID NO: 8406469 - DNA, 22 bp, Homo sapiens
gcctcagccggcggacgccagg

SEQ ID NO: 8406470 - DNA, 20 bp, Homo sapiens
gcctcagccaacccatgggg

SEQ ID NO: 8406471 - DNA, 22 bp, Homo sapiens
gcctcagaaagtggcaggtagg

SEQ ID NO: 8406472 - DNA, 22 bp, Homo sapiens
gcctcagaatcatttatcatct

SEQ ID NO: 8406473 - DNA, 23 bp, Homo sapiens
gcctcagagaaacagctgcacac

SEQ ID NO: 8406474 - DNA, 22 bp, Homo sapiens
gcctcagaaagcttttattcat

SEQ ID NO: 8406475 - DNA, 22 bp, Homo sapiens
gcctcaggcctatagctgctgt

SEQ ID NO: 8406476 - DNA, 22 bp, Homo sapiens
gcctcagggataggatgagcat

SEQ ID NO: 8406477 - DNA, 22 bp, Homo sapiens
gcctggggtcccttgttggcac

SEQ ID NO: 8406478 - DNA, 22 bp, Homo sapiens
gcggggcccccggccgagctct

SEQ ID NO: 8406479 - DNA, 22 bp, Homo sapiens
gctcagggaactttttgcaggc

SEQ ID NO: 8406480 - DNA, 21 bp, Homo sapiens
gctcaggctcttgacagagca

SEQ ID NO: 8406481 - DNA, 22 bp, Homo sapiens
gctcctgtccttagccccagag

SEQ ID NO: 8406482 - DNA, 22 bp, Homo sapiens
gctcctgtgaggacacagccgc

SEQ ID NO: 8406483 - DNA, 22 bp, Homo sapiens
gctgccagctgcggcccacgcg

SEQ ID NO: 8406484 - DNA, 22 bp, Homo sapiens
gctgattattacatgtctgtgg

SEQ ID NO: 8406485 - DNA, 22 bp, Homo sapiens
gctgattaacttcattgtagtt

SEQ ID NO: 8406486 - DNA, 22 bp, Homo sapiens
gctgatgcagggttgagaggag

SEQ ID NO: 8406487 - DNA, 22 bp, Homo sapiens
gctggctctgatgggctccagg

SEQ ID NO: 8406488 - DNA, 22 bp, Homo sapiens
gctgggaaccatgggaaggcag

SEQ ID NO: 8406489 - DNA, 22 bp, Homo sapiens
gctgggaagagatgcacatgat

SEQ ID NO: 8406490 - DNA, 22 bp, Homo sapiens
gctgggaagaacaggagagaat

SEQ ID NO: 8406491 - DNA, 22 bp, Homo sapiens
gctgggaagtggcagagctgga

SEQ ID NO: 8406492 - DNA, 22 bp, Homo sapiens
gctgggaatgattttggagagg

SEQ ID NO: 8406493 - DNA, 22 bp, Homo sapiens
gctgggactgagacagtgacct

SEQ ID NO: 8406494 - DNA, 22 bp, Homo sapiens
gctggcacatggctcagggcct

SEQ ID NO: 8406495 - DNA, 22 bp, Homo sapiens
gctggcactgggaaggactgag

SEQ ID NO: 8406496 - DNA, 22 bp, Homo sapiens
gctgggtgtcacggggctcgtg

SEQ ID NO: 8406497 - DNA, 22 bp, Homo sapiens
gctgggtggatcggaggctctg

SEQ ID NO: 8406498 - DNA, 18 bp, Homo sapiens
gctggggttgagctctcc

SEQ ID NO: 8406499 - DNA, 22 bp, Homo sapiens
gctggggtgtggtggataagct

SEQ ID NO: 8406500 - DNA, 22 bp, Homo sapiens
gctgtgcactacctatacatcc

SEQ ID NO: 8406501 - DNA, 22 bp, Homo sapiens
gctgtgcagagcacagggtccc

SEQ ID NO: 8406502 - DNA, 21 bp, Homo sapiens
gctgtgcagaggatggagtgg

SEQ ID NO: 8406503 - DNA, 22 bp, Homo sapiens
gctgtgcagatgtagggagtgg

SEQ ID NO: 8406504 - DNA, 22 bp, Homo sapiens
gctgtgcagaggtgagaatcca

SEQ ID NO: 8406505 - DNA, 22 bp, Homo sapiens
gctgtgcaaatcgatttgttgg

SEQ ID NO: 8406506 - DNA, 23 bp, Homo sapiens
gctgtgcacgagccactgcctgt

SEQ ID NO: 8406507 - DNA, 21 bp, Homo sapiens
gctgtgcacatagtagaagtg

SEQ ID NO: 8406508 - DNA, 22 bp, Homo sapiens
gctgtgcagtctttggtgtgcc

SEQ ID NO: 8406509 - DNA, 22 bp, Homo sapiens
gctgtgcagtgggagttcggtg

SEQ ID NO: 8406510 - DNA, 22 bp, Homo sapiens
gctgtgcataagtataataaac

SEQ ID NO: 8406511 - DNA, 22 bp, Homo sapiens
gctgtgcatcttcattctggac

SEQ ID NO: 8406512 - DNA, 22 bp, Homo sapiens
gctgtgcatggagggccgttca

SEQ ID NO: 8406513 - DNA, 22 bp, Homo sapiens
gctgtgcattgagcctgagagt

SEQ ID NO: 8406514 - DNA, 21 bp, Homo sapiens
gctgtgcaggattgaaagcag

SEQ ID NO: 8406515 - DNA, 22 bp, Homo sapiens
gctgtgcaggggatttggttat

SEQ ID NO: 8406516 - DNA, 22 bp, Homo sapiens
gctgtgcagccaagtgcctctg

SEQ ID NO: 8406517 - DNA, 21 bp, Homo sapiens
gctgtgcaggtgcccctgctc

SEQ ID NO: 8406518 - DNA, 22 bp, Homo sapiens
gctgtgcagtagtaggtacagt

SEQ ID NO: 8406519 - DNA, 22 bp, Homo sapiens
gctgtgcaggtccccactgcct

SEQ ID NO: 8406520 - DNA, 22 bp, Homo sapiens
ggacagagccctggtggcctaa

SEQ ID NO: 8406521 - DNA, 22 bp, Homo sapiens
ggacagagccctggtggcctaa

SEQ ID NO: 8406522 - DNA, 22 bp, Homo sapiens
ggactgaggacatgtgaggcat

SEQ ID NO: 8406523 - DNA, 22 bp, Homo sapiens
ggacgcagccgagggagcaggg

SEQ ID NO: 8406524 - DNA, 22 bp, Homo sapiens
ggacgcagccgagggagcaggg

SEQ ID NO: 8406525 - DNA, 22 bp, Homo sapiens
ggacgcagcgagggaagcagcc

SEQ ID NO: 8406526 - DNA, 22 bp, Homo sapiens
ggacgcagcgagggaagcagcc

SEQ ID NO: 8406527 - DNA, 19 bp, Homo sapiens
ggagaggctggagggatgc

SEQ ID NO: 8406528 - DNA, 22 bp, Homo sapiens
ggaagccaggcccagagatgct

SEQ ID NO: 8406529 - DNA, 22 bp, Homo sapiens
ggaaagctctacaaagccacag

SEQ ID NO: 8406530 - DNA, 22 bp, Homo sapiens
ggaaatcaagaagcagatgagt

SEQ ID NO: 8406531 - DNA, 22 bp, Homo sapiens
tagagatgaattctgcagtctt

SEQ ID NO: 8406532 - DNA, 23 bp, Homo sapiens
tagagcagccccgaggtgctgtc

SEQ ID NO: 8406533 - DNA, 22 bp, Homo sapiens
tagagcagttggcagctgtatt

SEQ ID NO: 8406534 - DNA, 22 bp, Homo sapiens
tactttcatgtctatacatatt

SEQ ID NO: 8406535 - DNA, 22 bp, Homo sapiens
tacttgtatctttaccaatttt

SEQ ID NO: 8406536 - DNA, 22 bp, Homo sapiens
tacttgttaggaatttctacta

SEQ ID NO: 8406537 - DNA, 22 bp, Homo sapiens
tacttgttaaaatattagctat

SEQ ID NO: 8406538 - DNA, 22 bp, Homo sapiens
tagccagttgcccagagtagaa

SEQ ID NO: 8406539 - DNA, 22 bp, Homo sapiens
tagccagtgagacccagaaata

SEQ ID NO: 8406540 - DNA, 22 bp, Homo sapiens
tagccagtgggacggtgctgca

SEQ ID NO: 8406541 - DNA, 22 bp, Homo sapiens
tagccagtgccatgggactgat

SEQ ID NO: 8406542 - DNA, 22 bp, Homo sapiens
tagccagtgaatgtttccagtg

SEQ ID NO: 8406543 - DNA, 23 bp, Homo sapiens
tagccagtcattccagcaaggcc

SEQ ID NO: 8406544 - DNA, 22 bp, Homo sapiens
tagcagtactgggcatgtgttt

SEQ ID NO: 8406545 - DNA, 22 bp, Homo sapiens
taggtttactgaattagtggaa

SEQ ID NO: 8406546 - DNA, 22 bp, Homo sapiens
taggtttaggagtgaaggtgaa

SEQ ID NO: 8406547 - DNA, 22 bp, Homo sapiens
tagtggcaaaagcattttgggt

SEQ ID NO: 8406548 - DNA, 17 bp, Homo sapiens
tagtggcaggaaatgaa

SEQ ID NO: 8406549 - DNA, 22 bp, Homo sapiens
tagtggcattgttgtgaggatt

SEQ ID NO: 8406550 - DNA, 22 bp, Homo sapiens
taggaatgtttttatcaactta

SEQ ID NO: 8406551 - DNA, 22 bp, Homo sapiens
taggaatgtctatgcagtgagg

SEQ ID NO: 8406552 - DNA, 22 bp, Homo sapiens
taggaatgtggcaggcagaaca

SEQ ID NO: 8406553 - DNA, 22 bp, Homo sapiens
taggaatggtgctcagcagaaa

SEQ ID NO: 8406554 - DNA, 22 bp, Homo sapiens
taggaatgggctatcccaagct

SEQ ID NO: 8406555 - DNA, 19 bp, Homo sapiens
taggaatgtagaatcctag

SEQ ID NO: 8406556 - DNA, 22 bp, Homo sapiens
taggaatgtaatctctgttatg

SEQ ID NO: 8406557 - DNA, 22 bp, Homo sapiens
taggaatgcagtgagacacaga

SEQ ID NO: 8406558 - DNA, 22 bp, Homo sapiens
taggaatgattggaattccagg

SEQ ID NO: 8406559 - DNA, 22 bp, Homo sapiens
taggaatgcagatgcataataa

SEQ ID NO: 8406560 - DNA, 22 bp, Homo sapiens
taggaatgcatgggggattctg

SEQ ID NO: 8406561 - DNA, 22 bp, Homo sapiens
taggaatggaacactttgattt

SEQ ID NO: 8406562 - DNA, 22 bp, Homo sapiens
taggaatggcagcagccggggg

SEQ ID NO: 8406563 - DNA, 22 bp, Homo sapiens
taggaatgggcaagacaaagaa

SEQ ID NO: 8406564 - DNA, 22 bp, Homo sapiens
taggaatgaaaatggccataga

SEQ ID NO: 8406565 - DNA, 22 bp, Homo sapiens
taggaatgaaagtgttttgaaa

SEQ ID NO: 8406566 - DNA, 22 bp, Homo sapiens
taggaatgaagaagtatgatat

SEQ ID NO: 8406567 - DNA, 22 bp, Homo sapiens
taggaatgaaggataaggtgtg

SEQ ID NO: 8406568 - DNA, 22 bp, Homo sapiens
taggaatgagaaagaattagat

SEQ ID NO: 8406569 - DNA, 22 bp, Homo sapiens
taggaatgagagggtgaggatt

SEQ ID NO: 8406570 - DNA, 22 bp, Homo sapiens
taggaatgataatagtaaagag

SEQ ID NO: 8406571 - DNA, 22 bp, Homo sapiens
taggaatgatgtatttttctct

SEQ ID NO: 8406572 - DNA, 22 bp, Homo sapiens
taggaaggtgtttttaaggagc

SEQ ID NO: 8406573 - DNA, 22 bp, Homo sapiens
taggaaggtccatgtcttatct

SEQ ID NO: 8406574 - DNA, 22 bp, Homo sapiens
taggaagggctcagggctcggt

SEQ ID NO: 8406575 - DNA, 22 bp, Homo sapiens
taggaaggaggccatcttggcg

SEQ ID NO: 8406576 - DNA, 22 bp, Homo sapiens
taggaaggaagagcctcagatt

SEQ ID NO: 8406577 - DNA, 22 bp, Homo sapiens
taggaaggcctgtcactacttg

SEQ ID NO: 8406578 - DNA, 22 bp, Homo sapiens
taggaagggaaaggcttcaact

SEQ ID NO: 8406579 - DNA, 22 bp, Homo sapiens
tatgcacattcacacaaaaatg

SEQ ID NO: 8406580 - DNA, 22 bp, Homo sapiens
taaagttataaattacctgtca

SEQ ID NO: 8406581 - DNA, 22 bp, Homo sapiens
taagatgggctaagtttgtcct

SEQ ID NO: 8406582 - DNA, 22 bp, Homo sapiens
taagatggcagatgagcttgtt

SEQ ID NO: 8406583 - DNA, 22 bp, Homo sapiens
taagatggttgtagatggactg

SEQ ID NO: 8406584 - DNA, 22 bp, Homo sapiens
taagttcataagcttattctta

SEQ ID NO: 8406585 - DNA, 22 bp, Homo sapiens
taagttcagagttctcatttgt

SEQ ID NO: 8406586 - DNA, 22 bp, Homo sapiens
taagttcaaatcatcccaactt

SEQ ID NO: 8406587 - DNA, 22 bp, Homo sapiens
taagttcaatgaactcagttct

SEQ ID NO: 8406588 - DNA, 22 bp, Homo sapiens
taatggattaacgtccctgtcg

SEQ ID NO: 8406589 - DNA, 22 bp, Homo sapiens
tacaatgttggtaaagtatcat

SEQ ID NO: 8406590 - DNA, 22 bp, Homo sapiens
tacctttaaggagatttgacaa

SEQ ID NO: 8406591 - DNA, 22 bp, Homo sapiens
tacgtttagctttatgagacat

SEQ ID NO: 8406592 - DNA, 22 bp, Homo sapiens
tactaaacatctggcattaaat

SEQ ID NO: 8406593 - DNA, 22 bp, Homo sapiens
tacatgtatgtttatcttgaga

SEQ ID NO: 8406594 - DNA, 22 bp, Homo sapiens
tacattacaggaaagataaaga

SEQ ID NO: 8406595 - DNA, 22 bp, Homo sapiens
tacagttactgcatttctaata

SEQ ID NO: 8406596 - DNA, 17 bp, Homo sapiens
tacaggagagcaggaac

SEQ ID NO: 8406597 - DNA, 20 bp, Homo sapiens
tacaggaatcaagactgcat

SEQ ID NO: 8406598 - DNA, 18 bp, Homo sapiens
tacaggaaaagtgttaca

SEQ ID NO: 8406599 - DNA, 22 bp, Homo sapiens
tacaggaaagaaatttgaactc

SEQ ID NO: 8406600 - DNA, 22 bp, Homo sapiens
tacaggaaggagcacatcggga

SEQ ID NO: 8406601 - DNA, 18 bp, Homo sapiens
tacaggaaggggttctcg

SEQ ID NO: 8406602 - DNA, 22 bp, Homo sapiens
tacaggaaggctctggaggtgc

SEQ ID NO: 8406603 - DNA, 22 bp, Homo sapiens
tacaggaagtctcagtacagta

SEQ ID NO: 8406604 - DNA, 22 bp, Homo sapiens
tacaggaagttacagactatga

SEQ ID NO: 8406605 - DNA, 22 bp, Homo sapiens
tcccagagtttcctgtgtccca

SEQ ID NO: 8406606 - DNA, 22 bp, Homo sapiens
tcccagctcacatatggtaact

SEQ ID NO: 8406607 - DNA, 21 bp, Homo sapiens
tcccagagtgcttgggactgc

SEQ ID NO: 8406608 - DNA, 22 bp, Homo sapiens
tccagtggcactggagactaga

SEQ ID NO: 8406609 - DNA, 22 bp, Homo sapiens
tccagtggcaggcggtgaggtc

SEQ ID NO: 8406610 - DNA, 21 bp, Homo sapiens
tccagtggtgtctagaatgtg

SEQ ID NO: 8406611 - DNA, 22 bp, Homo sapiens
tccagtggtggtttgaagggca

SEQ ID NO: 8406612 - DNA, 22 bp, Homo sapiens
tccagtgggttgctgagggagg

SEQ ID NO: 8406613 - DNA, 21 bp, Homo sapiens
tccagtggggatctctgatat

SEQ ID NO: 8406614 - DNA, 20 bp, Homo sapiens
tccagtggcctgaatctgga

SEQ ID NO: 8406615 - DNA, 22 bp, Homo sapiens
tcatggcttgcagatggccacc

SEQ ID NO: 8406616 - DNA, 22 bp, Homo sapiens
tccacagctgtcctgtaacagg

SEQ ID NO: 8406617 - DNA, 22 bp, Homo sapiens
tccacccagcacactgtggtag

SEQ ID NO: 8406618 - DNA, 22 bp, Homo sapiens
tcctccagtggtactggccaat

SEQ ID NO: 8406619 - DNA, 22 bp, Homo sapiens
tcctccagccctctaggaaaat

SEQ ID NO: 8406620 - DNA, 22 bp, Homo sapiens
tcctccagctgtatcctgcctg

SEQ ID NO: 8406621 - DNA, 22 bp, Homo sapiens
tcctccacgatggcacacctgg

SEQ ID NO: 8406622 - DNA, 22 bp, Homo sapiens
tccctgggcggacattctccca

SEQ ID NO: 8406623 - DNA, 22 bp, Homo sapiens
tcagggtgggaggacccttgag

SEQ ID NO: 8406624 - DNA, 22 bp, Homo sapiens
tcatctaagagtcttacattta

SEQ ID NO: 8406625 - DNA, 22 bp, Homo sapiens
tcagccagggctctggcctcag

SEQ ID NO: 8406626 - DNA, 22 bp, Homo sapiens
tcaggagcagccttggagagcg

SEQ ID NO: 8406627 - DNA, 22 bp, Homo sapiens
tcaggagcagcatgggtgagag

SEQ ID NO: 8406628 - DNA, 22 bp, Homo sapiens
tcaggagggtgacaggccctgg

SEQ ID NO: 8406629 - DNA, 22 bp, Homo sapiens
tcaggagggtctctattttcct

SEQ ID NO: 8406630 - DNA, 22 bp, Homo sapiens
tcaggagggctaagactgtagc

SEQ ID NO: 8406631 - DNA, 22 bp, Homo sapiens
tcaggagggattgttgcctatt

SEQ ID NO: 8406632 - DNA, 22 bp, Homo sapiens
tcaggagggagtgtggatagag

SEQ ID NO: 8406633 - DNA, 22 bp, Homo sapiens
tcaggaggcaagtaggtattga

SEQ ID NO: 8406634 - DNA, 22 bp, Homo sapiens
tcaggaggatgtcggcaaattt

SEQ ID NO: 8406635 - DNA, 22 bp, Homo sapiens
tcaggagcttggtagtgtgatt

SEQ ID NO: 8406636 - DNA, 22 bp, Homo sapiens
tcaggaggacagataaggatag

SEQ ID NO: 8406637 - DNA, 22 bp, Homo sapiens
tcaggaggagctcataagtttg

SEQ ID NO: 8406638 - DNA, 22 bp, Homo sapiens
tcaggagctgcattatcctgtg

SEQ ID NO: 8406639 - DNA, 22 bp, Homo sapiens
tcaggagctatggactgtcaaa

SEQ ID NO: 8406640 - DNA, 20 bp, Homo sapiens
tcaggagcctaggacatgat

SEQ ID NO: 8406641 - DNA, 22 bp, Homo sapiens
tcaggaggtccgcccgggaggg

SEQ ID NO: 8406642 - DNA, 22 bp, Homo sapiens
tcaggaggtaaggtaaaacaga

SEQ ID NO: 8406643 - DNA, 22 bp, Homo sapiens
tcaggaggtaggacatactggt

SEQ ID NO: 8406644 - DNA, 22 bp, Homo sapiens
tcaggaggtgtaacgaatacag

SEQ ID NO: 8406645 - DNA, 22 bp, Homo sapiens
tcaggaggtctgctgcggggtg

SEQ ID NO: 8406646 - DNA, 19 bp, Homo sapiens
tcaggaggtcgacctggca

SEQ ID NO: 8406647 - DNA, 22 bp, Homo sapiens
tcactgtaaactaggtcagtcc

SEQ ID NO: 8406648 - DNA, 22 bp, Homo sapiens
tcactgtaatttgtatctgtgg

SEQ ID NO: 8406649 - DNA, 22 bp, Homo sapiens
tcaccgaggctggagtgcagtg

SEQ ID NO: 8406650 - DNA, 21 bp, Homo sapiens
tcacgtggtcacatgagcttt

SEQ ID NO: 8406651 - DNA, 22 bp, Homo sapiens
tcagaggctacagtctgggagt

SEQ ID NO: 8406652 - DNA, 22 bp, Homo sapiens
tcagaggccaaactgagcaggg

SEQ ID NO: 8406653 - DNA, 22 bp, Homo sapiens
tcagagagcctcaggcactgcc

SEQ ID NO: 8406654 - DNA, 22 bp, Homo sapiens
tcacacagctgctctgttttat

SEQ ID NO: 8406655 - DNA, 22 bp, Homo sapiens
tcacacagcttggagttatggt

SEQ ID NO: 8406656 - DNA, 22 bp, Homo sapiens
tcacacagggttctggtctcat

SEQ ID NO: 8406657 - DNA, 22 bp, Homo sapiens
tcacagagcacacaagaattgc

SEQ ID NO: 8406658 - DNA, 22 bp, Homo sapiens
tcacagcctggacagttgcctg

SEQ ID NO: 8406659 - DNA, 22 bp, Homo sapiens
ttctaactaattggaaatggaa

SEQ ID NO: 8406660 - DNA, 22 bp, Homo sapiens
ttctcttccagccgggcttgca

SEQ ID NO: 8406661 - DNA, 22 bp, Homo sapiens
ttgaggctgcacagtacaggct

SEQ ID NO: 8406662 - DNA, 22 bp, Homo sapiens
ttctttgggcaattgctggccc

SEQ ID NO: 8406663 - DNA, 22 bp, Homo sapiens
ttcactgtcctgcaactctaga

SEQ ID NO: 8406664 - DNA, 22 bp, Homo sapiens
ttcaaaattgttctaagctctg

SEQ ID NO: 8406665 - DNA, 22 bp, Homo sapiens
ttgaggtccccagtacccactg

SEQ ID NO: 8406666 - DNA, 17 bp, Homo sapiens
ttgctactacgccaagt

SEQ ID NO: 8406667 - DNA, 22 bp, Homo sapiens
ttgggctcaggagtttgagacc

SEQ ID NO: 8406668 - DNA, 22 bp, Homo sapiens
ttggcctcatggacagctcatc

SEQ ID NO: 8406669 - DNA, 22 bp, Homo sapiens
tttagctagcctgtgtgtactt

SEQ ID NO: 8406670 - DNA, 22 bp, Homo sapiens
ttgttgtcattgtagaggattt

SEQ ID NO: 8406671 - DNA, 22 bp, Homo sapiens
ttgttgtcattgtagaggattt

SEQ ID NO: 8406672 - DNA, 19 bp, Homo sapiens
tttacaagttctttgtatg

SEQ ID NO: 8406673 - DNA, 22 bp, Homo sapiens
tttacactgccattctgaatac

SEQ ID NO: 8406674 - DNA, 22 bp, Homo sapiens
tttacacttgaggaaactgagg

SEQ ID NO: 8406675 - DNA, 22 bp, Homo sapiens
tttacacttattatgaagcttt

SEQ ID NO: 8406676 - DNA, 22 bp, Homo sapiens
tttcataatctgtcaagtgggg

SEQ ID NO: 8406677 - DNA, 17 bp, Homo sapiens
tttctagctgtgaaccc

SEQ ID NO: 8406678 - DNA, 21 bp, Homo sapiens
tttggcctagaggcttctctg

SEQ ID NO: 8406679 - DNA, 22 bp, Homo sapiens
tttggcctcgtttagaaatggc

SEQ ID NO: 8406680 - DNA, 22 bp, Homo sapiens
tttggcctctgggagaatattc

SEQ ID NO: 8406681 - DNA, 21 bp, Homo sapiens
tttggcctctgcctgagctcc

SEQ ID NO: 8406682 - DNA, 21 bp, Homo sapiens
tttggcctaggtcatgttttt

SEQ ID NO: 8406683 - DNA, 22 bp, Homo sapiens
tttggcctcatgaatttcttgc

SEQ ID NO: 8406684 - DNA, 22 bp, Homo sapiens
tttggcctgggccagcatatat

SEQ ID NO: 8406685 - DNA, 22 bp, Homo sapiens
tttggccttagtccagaagaag

SEQ ID NO: 8406686 - DNA, 22 bp, Homo sapiens
tttggccttgtgttctctccat

SEQ ID NO: 8406687 - DNA, 22 bp, Homo sapiens
aagatttattagatgcttacct

SEQ ID NO: 8406688 - DNA, 22 bp, Homo sapiens
aagatttactagcataatagct

SEQ ID NO: 8406689 - DNA, 22 bp, Homo sapiens
aagatttactttctttgtaata

SEQ ID NO: 8406690 - DNA, 22 bp, Homo sapiens
aagatttagggccagtttacat

SEQ ID NO: 8406691 - DNA, 21 bp, Homo sapiens
aagatttatgggacttgccaa

SEQ ID NO: 8406692 - DNA, 22 bp, Homo sapiens
aagatttaccactttattcaag

SEQ ID NO: 8406693 - DNA, 22 bp, Homo sapiens
acacaggggaaagtggagctga

SEQ ID NO: 8406694 - DNA, 22 bp, Homo sapiens
acacagggggcattctaggagt

SEQ ID NO: 8406695 - DNA, 22 bp, Homo sapiens
acagcagctgggttcccaccat

SEQ ID NO: 8406696 - DNA, 22 bp, Homo sapiens
acagcagcttcctgactgtact

SEQ ID NO: 8406697 - DNA, 22 bp, Homo sapiens
aagcagccactggccagttata

SEQ ID NO: 8406698 - DNA, 22 bp, Homo sapiens
aagacagtgacagtcacaattg

SEQ ID NO: 8406699 - DNA, 20 bp, Homo sapiens
aagacaccagtggcagcccc

SEQ ID NO: 8406700 - DNA, 22 bp, Homo sapiens
aagacaccatttgacagtggca

SEQ ID NO: 8406701 - DNA, 22 bp, Homo sapiens
aattgtacataaaccatttggc

SEQ ID NO: 8406702 - DNA, 22 bp, Homo sapiens
aagacattactggaatctgact

SEQ ID NO: 8406703 - DNA, 22 bp, Homo sapiens
aagagctggagctgctacagga

SEQ ID NO: 8406704 - DNA, 21 bp, Homo sapiens
aagagctgtcaggaaggctgc

SEQ ID NO: 8406705 - DNA, 22 bp, Homo sapiens
aagagctgcccaaggtgaacag

SEQ ID NO: 8406706 - DNA, 22 bp, Homo sapiens
aatgataccaaacatgtagata

SEQ ID NO: 8406707 - DNA, 22 bp, Homo sapiens
aactgctgacaagtgaccagtg

SEQ ID NO: 8406708 - DNA, 22 bp, Homo sapiens
aactgctgcatcttagaatgca

SEQ ID NO: 8406709 - DNA, 22 bp, Homo sapiens
aacatgcatataggtaaatgga

SEQ ID NO: 8406710 - DNA, 22 bp, Homo sapiens
aacaaagcaccactgagtcagt

SEQ ID NO: 8406711 - DNA, 22 bp, Homo sapiens
aaatgttcaccagatccatgac

SEQ ID NO: 8406712 - DNA, 22 bp, Homo sapiens
aaatgttcatttctcactcaca

SEQ ID NO: 8406713 - DNA, 22 bp, Homo sapiens
aacactctacgtgcagctccta

SEQ ID NO: 8406714 - DNA, 22 bp, Homo sapiens
aacagcctcagtgagattagga

SEQ ID NO: 8406715 - DNA, 22 bp, Homo sapiens
aaactctaagacactgtacaat

SEQ ID NO: 8406716 - DNA, 22 bp, Homo sapiens
aaaagtactattttaacaaagt

SEQ ID NO: 8406717 - DNA, 22 bp, Homo sapiens
aaactagattaccactgctaga

SEQ ID NO: 8406718 - DNA, 22 bp, Homo sapiens
aaaatgacattccagtgatatt

SEQ ID NO: 8406719 - DNA, 22 bp, Homo sapiens
aaactctgccatttttggcctg

SEQ ID NO: 8406720 - DNA, 22 bp, Homo sapiens
aaactctttccacgattacttt

SEQ ID NO: 8406721 - DNA, 22 bp, Homo sapiens
aaattgtctttaatcaggtcat

SEQ ID NO: 8406722 - DNA, 22 bp, Homo sapiens
aaagttcactgaccagcactgg

SEQ ID NO: 8406723 - DNA, 22 bp, Homo sapiens
aaagttcactatgtagcagcgt

SEQ ID NO: 8406724 - DNA, 22 bp, Homo sapiens
aaatagattgctgaggcattac

SEQ ID NO: 8406725 - DNA, 22 bp, Homo sapiens
aaatagatttcctagcattgga

SEQ ID NO: 8406726 - DNA, 22 bp, Homo sapiens
aaatcccttgctctctcagacc

SEQ ID NO: 8406727 - DNA, 22 bp, Homo sapiens
aaatgtacactttgcatcttga

SEQ ID NO: 8406728 - DNA, 22 bp, Homo sapiens
aaatgtacaacatccatatata

SEQ ID NO: 8406729 - DNA, 22 bp, Homo sapiens
aaatgtactgatacttatttta

SEQ ID NO: 8406730 - DNA, 22 bp, Homo sapiens
aaatgtacgggagtagaattag

SEQ ID NO: 8406731 - DNA, 18 bp, Homo sapiens
aaatgtactgtccatggc

SEQ ID NO: 8406732 - DNA, 22 bp, Homo sapiens
aagctgaagacacagctccagt

SEQ ID NO: 8406733 - DNA, 22 bp, Homo sapiens
aagctgaaaatgagactctaca

SEQ ID NO: 8406734 - DNA, 22 bp, Homo sapiens
aagctgaaacattagcctaaac

SEQ ID NO: 8406735 - DNA, 23 bp, Homo sapiens
aaagcttaactgggtaataaagc

SEQ ID NO: 8406736 - DNA, 22 bp, Homo sapiens
aaagcttagcattttcaaaatg

SEQ ID NO: 8406737 - DNA, 22 bp, Homo sapiens
agccacagggggtgagggacaa

SEQ ID NO: 8406738 - DNA, 22 bp, Homo sapiens
acactgtagatatagagttagt

SEQ ID NO: 8406739 - DNA, 22 bp, Homo sapiens
agcagggcatgaataagggttt

SEQ ID NO: 8406740 - DNA, 22 bp, Homo sapiens
acaatttctgatcagtgaattt

SEQ ID NO: 8406741 - DNA, 22 bp, Homo sapiens
agctagttaaactatgaataca

SEQ ID NO: 8406742 - DNA, 22 bp, Homo sapiens
agctaggggaccaaggtggccc

SEQ ID NO: 8406743 - DNA, 22 bp, Homo sapiens
acagcaagacccctagcatggt

SEQ ID NO: 8406744 - DNA, 22 bp, Homo sapiens
agcccctctgtagctaatagta

SEQ ID NO: 8406745 - DNA, 22 bp, Homo sapiens
acagagcatttgggacagagag

SEQ ID NO: 8406746 - DNA, 22 bp, Homo sapiens
agccacaggtgttggccagtgt

SEQ ID NO: 8406747 - DNA, 22 bp, Homo sapiens
agccagggtgggtgaatgctat

SEQ ID NO: 8406748 - DNA, 22 bp, Homo sapiens
agcccagctgcctgcctgctgt

SEQ ID NO: 8406749 - DNA, 22 bp, Homo sapiens
agcccagcggagcgggcccggg

SEQ ID NO: 8406750 - DNA, 22 bp, Homo sapiens
agcaagatttaaacccaggtca

SEQ ID NO: 8406751 - DNA, 22 bp, Homo sapiens
acaatgtttttgttcaaagagt

SEQ ID NO: 8406752 - DNA, 22 bp, Homo sapiens
agatggggctcagtgtggaggc

SEQ ID NO: 8406753 - DNA, 22 bp, Homo sapiens
acaaatggagaaactgaggccc

SEQ ID NO: 8406754 - DNA, 22 bp, Homo sapiens
acaaatggaaggtgttctcttc

SEQ ID NO: 8406755 - DNA, 19 bp, Homo sapiens
agatggggaagagtgtgag

SEQ ID NO: 8406756 - DNA, 22 bp, Homo sapiens
aattatcagatataaaactgca

SEQ ID NO: 8406757 - DNA, 22 bp, Homo sapiens
aatttacagttgctgatggtac

SEQ ID NO: 8406758 - DNA, 22 bp, Homo sapiens
aatttacacttcatttggaggg

SEQ ID NO: 8406759 - DNA, 22 bp, Homo sapiens
aatttacaggtgcactcgccat

SEQ ID NO: 8406760 - DNA, 22 bp, Homo sapiens
aattacctgtcatacatcaagc

SEQ ID NO: 8406761 - DNA, 22 bp, Homo sapiens
aattacctgtcatacatcaagc

SEQ ID NO: 8406762 - DNA, 22 bp, Homo sapiens
aatgttgcagagtgattgtcca

SEQ ID NO: 8406763 - DNA, 22 bp, Homo sapiens
aatgttcattgattaaatgaat

SEQ ID NO: 8406764 - DNA, 22 bp, Homo sapiens
aatgttcaaaagcatcagtgaa

SEQ ID NO: 8406765 - DNA, 22 bp, Homo sapiens
aatgtcatgggaatttattcat

SEQ ID NO: 8406766 - DNA, 22 bp, Homo sapiens
aatgtcatgagcctgctcttgt

SEQ ID NO: 8406767 - DNA, 22 bp, Homo sapiens
aatgtcatagcatttcttcaat

SEQ ID NO: 8406768 - DNA, 21 bp, Homo sapiens
agacagagtgcagtctacata

SEQ ID NO: 8406769 - DNA, 22 bp, Homo sapiens
aaggctgaggcagtgaggcaga

SEQ ID NO: 8406770 - DNA, 22 bp, Homo sapiens
aaggctgaggtagggcctaaaa

SEQ ID NO: 8406771 - DNA, 22 bp, Homo sapiens
aaggctgattagactgatagct

SEQ ID NO: 8406772 - DNA, 22 bp, Homo sapiens
aagggccaagctcttctcccat

SEQ ID NO: 8406773 - DNA, 22 bp, Homo sapiens
aagggccacatgccatttaaaa

SEQ ID NO: 8406774 - DNA, 22 bp, Homo sapiens
aagggccacttactcctgctgt

SEQ ID NO: 8406775 - DNA, 22 bp, Homo sapiens
aagggccacatttgggtccctg

SEQ ID NO: 8406776 - DNA, 22 bp, Homo sapiens
aagggccagggcagggttgtga

SEQ ID NO: 8406777 - DNA, 22 bp, Homo sapiens
aagggccagggctctagagata

SEQ ID NO: 8406778 - DNA, 22 bp, Homo sapiens
aagggccatgcctctactttct

SEQ ID NO: 8406779 - DNA, 22 bp, Homo sapiens
aagggccatcttggactcccca

SEQ ID NO: 8406780 - DNA, 22 bp, Homo sapiens
aagggccattgctgagagcagt

SEQ ID NO: 8406781 - DNA, 22 bp, Homo sapiens
aagggccagtagaattttagtg

SEQ ID NO: 8406782 - DNA, 22 bp, Homo sapiens
aagggccataacttgcagtgtt

SEQ ID NO: 8406783 - DNA, 22 bp, Homo sapiens
aagggccatcccagaacagaaa

SEQ ID NO: 8406784 - DNA, 22 bp, Homo sapiens
aagggcctttcaaaggtgatta

SEQ ID NO: 8406785 - DNA, 22 bp, Homo sapiens
accccaggagctgtgcctagtc

SEQ ID NO: 8406786 - DNA, 22 bp, Homo sapiens
accccaggtcatctgagagtcc

SEQ ID NO: 8406787 - DNA, 22 bp, Homo sapiens
accccaggtccaggttacagag

SEQ ID NO: 8406788 - DNA, 23 bp, Homo sapiens
accccaggcatcgcattcctctt

SEQ ID NO: 8406789 - DNA, 22 bp, Homo sapiens
accatgccagtggcagccagac

SEQ ID NO: 8406790 - DNA, 22 bp, Homo sapiens
aaggtggcatgtcccctggcca

SEQ ID NO: 8406791 - DNA, 22 bp, Homo sapiens
acagtacagctgaaactttagt

SEQ ID NO: 8406792 - DNA, 22 bp, Homo sapiens
acagggctcctaggtggtgtgc

SEQ ID NO: 8406793 - DNA, 22 bp, Homo sapiens
aaggcagatataaagactagag

SEQ ID NO: 8406794 - DNA, 22 bp, Homo sapiens
agaagggaactcagagatgatt

SEQ ID NO: 8406795 - DNA, 18 bp, Homo sapiens
agaaggagctatgggcag

SEQ ID NO: 8406796 - DNA, 22 bp, Homo sapiens
aatgactttgaaatatttgagt

SEQ ID NO: 8406797 - DNA, 22 bp, Homo sapiens
aatgactgtagtcatattaagg

SEQ ID NO: 8406798 - DNA, 19 bp, Homo sapiens
aatgactgagtacattgtc

SEQ ID NO: 8406799 - DNA, 22 bp, Homo sapiens
agaaaacagaaagtcattggtg

SEQ ID NO: 8406800 - DNA, 22 bp, Homo sapiens
agaaaacataggagacaggaaa

SEQ ID NO: 8406801 - DNA, 22 bp, Homo sapiens
aatgaacacagccctctacttt

SEQ ID NO: 8406802 - DNA, 18 bp, Homo sapiens
agaaataccagtattgga

SEQ ID NO: 8406803 - DNA, 22 bp, Homo sapiens
agaaatactaggaatattcata

SEQ ID NO: 8406804 - DNA, 22 bp, Homo sapiens
acttgttagatataaagtttgt

SEQ ID NO: 8406805 - DNA, 22 bp, Homo sapiens
acttgttagttttatctgcatg

SEQ ID NO: 8406806 - DNA, 22 bp, Homo sapiens
acttgtttacaagcagttctga

SEQ ID NO: 8406807 - DNA, 22 bp, Homo sapiens
aatccccatcaaattaatacgt

SEQ ID NO: 8406808 - DNA, 22 bp, Homo sapiens
acttgtttggtctcatgtttaa

SEQ ID NO: 8406809 - DNA, 22 bp, Homo sapiens
acttgaggaagcagcaagggat

SEQ ID NO: 8406810 - DNA, 22 bp, Homo sapiens
aagttactggcaagggctgcag

SEQ ID NO: 8406811 - DNA, 22 bp, Homo sapiens
aagtggactaatacaaggacta

SEQ ID NO: 8406812 - DNA, 22 bp, Homo sapiens
atctcaggaggaccctgatgct

SEQ ID NO: 8406813 - DNA, 22 bp, Homo sapiens
agaaggctggccctgggtggcc

SEQ ID NO: 8406814 - DNA, 22 bp, Homo sapiens
atgaacaataaaatagatcaca

SEQ ID NO: 8406815 - DNA, 22 bp, Homo sapiens
atgaacaatgactacatattga

SEQ ID NO: 8406816 - DNA, 22 bp, Homo sapiens
agagaaggaaagctgacatggg

SEQ ID NO: 8406817 - DNA, 20 bp, Homo sapiens
atggccttcctctctgtcca

SEQ ID NO: 8406818 - DNA, 22 bp, Homo sapiens
agaccagctgcctcccagggcc

SEQ ID NO: 8406819 - DNA, 22 bp, Homo sapiens
atggcagcctgtggacagtcaa

SEQ ID NO: 8406820 - DNA, 22 bp, Homo sapiens
atggccagctcagagcactcag

SEQ ID NO: 8406821 - DNA, 22 bp, Homo sapiens
agagaagagcaatgataaattt

SEQ ID NO: 8406822 - DNA, 22 bp, Homo sapiens
atggccagctcagagcactcag

SEQ ID NO: 8406823 - DNA, 22 bp, Homo sapiens
atggccagtcaagcctctggct

SEQ ID NO: 8406824 - DNA, 22 bp, Homo sapiens
agagccagcaactctagccctg

SEQ ID NO: 8406825 - DNA, 22 bp, Homo sapiens
agagccacagtggataggagcc

SEQ ID NO: 8406826 - DNA, 19 bp, Homo sapiens
agagccagacagcatagga

SEQ ID NO: 8406827 - DNA, 22 bp, Homo sapiens
agagccagaccattgccgtgca

SEQ ID NO: 8406828 - DNA, 22 bp, Homo sapiens
agagatgcattcagcatggatg

SEQ ID NO: 8406829 - DNA, 22 bp, Homo sapiens
agagatgcggttccatggttat

SEQ ID NO: 8406830 - DNA, 22 bp, Homo sapiens
agagatgcccttgaaaggatta

SEQ ID NO: 8406831 - DNA, 22 bp, Homo sapiens
agagatgccacctttttgctgt

SEQ ID NO: 8406832 - DNA, 19 bp, Homo sapiens
agagatgctaagagtcttt

SEQ ID NO: 8406833 - DNA, 22 bp, Homo sapiens
agagatgctgcccgcagacgtg

SEQ ID NO: 8406834 - DNA, 22 bp, Homo sapiens
agagatgctgacgtttacattt

SEQ ID NO: 8406835 - DNA, 22 bp, Homo sapiens
agagatgctgtgggtagaggca

SEQ ID NO: 8406836 - DNA, 22 bp, Homo sapiens
agagatgcatctcttaaaattg

SEQ ID NO: 8406837 - DNA, 22 bp, Homo sapiens
agagatgcagggtacatggaat

SEQ ID NO: 8406838 - DNA, 22 bp, Homo sapiens
agaggctgtgcagagggagtgc

SEQ ID NO: 8406839 - DNA, 22 bp, Homo sapiens
agaggcaggaagagctgatttt

SEQ ID NO: 8406840 - DNA, 22 bp, Homo sapiens
agaggcaggaggttgacttgag

SEQ ID NO: 8406841 - DNA, 22 bp, Homo sapiens
attattattgttgatgttaggg

SEQ ID NO: 8406842 - DNA, 22 bp, Homo sapiens
agaggcagaagtgttcaaaccc

SEQ ID NO: 8406843 - DNA, 22 bp, Homo sapiens
agaggaggctctgggatcgtcc

SEQ ID NO: 8406844 - DNA, 22 bp, Homo sapiens
agaggaggatttgtaaaggtct

SEQ ID NO: 8406845 - DNA, 22 bp, Homo sapiens
agaggaggatttgtaaaggtct

SEQ ID NO: 8406846 - DNA, 22 bp, Homo sapiens
atgtgtatacttgtgcttactc

SEQ ID NO: 8406847 - DNA, 22 bp, Homo sapiens
agagttgcttatgtcaggtgag

SEQ ID NO: 8406848 - DNA, 22 bp, Homo sapiens
agatacatatagaaaacatcaa

SEQ ID NO: 8406849 - DNA, 22 bp, Homo sapiens
agatacattgttctaagcattg

SEQ ID NO: 8406850 - DNA, 22 bp, Homo sapiens
agatactaagcatttccagcac

SEQ ID NO: 8406851 - DNA, 22 bp, Homo sapiens
atttcctgtacctatcaaggca

SEQ ID NO: 8406852 - DNA, 22 bp, Homo sapiens
cacccaggctggagtgcagtgg

SEQ ID NO: 8406853 - DNA, 22 bp, Homo sapiens
cacccaggctggagagcagtgg

SEQ ID NO: 8406854 - DNA, 22 bp, Homo sapiens
cacccaggctggagtgcagggg

SEQ ID NO: 8406855 - DNA, 22 bp, Homo sapiens
cacccaggctggagtgcagtga

SEQ ID NO: 8406856 - DNA, 22 bp, Homo sapiens
agcagggtcctgaggtgagtca

SEQ ID NO: 8406857 - DNA, 22 bp, Homo sapiens
agcagggttctcagttggtgct

SEQ ID NO: 8406858 - DNA, 22 bp, Homo sapiens
agcagggtttggggattggcac

SEQ ID NO: 8406859 - DNA, 22 bp, Homo sapiens
agcaggcaggaaggcagcactg

SEQ ID NO: 8406860 - DNA, 22 bp, Homo sapiens
agcacagttctttctctagctg

SEQ ID NO: 8406861 - DNA, 22 bp, Homo sapiens
caaatagattgttcaatcctga

SEQ ID NO: 8406862 - DNA, 22 bp, Homo sapiens
caaaataccacgacttgtttta

SEQ ID NO: 8406863 - DNA, 22 bp, Homo sapiens
agcagccaaggtaacctgtgct

SEQ ID NO: 8406864 - DNA, 22 bp, Homo sapiens
agcagccagaaatccagaggtg

SEQ ID NO: 8406865 - DNA, 22 bp, Homo sapiens
agcagccacccagctgctcatt

SEQ ID NO: 8406866 - DNA, 22 bp, Homo sapiens
cagagggagtttctgaggttgc

SEQ ID NO: 8406867 - DNA, 22 bp, Homo sapiens
cagagggagccctccaggagca

SEQ ID NO: 8406868 - DNA, 22 bp, Homo sapiens
cagcagctgactccaagagagc

SEQ ID NO: 8406869 - DNA, 22 bp, Homo sapiens
cagaaggagcgctaaggtccca

SEQ ID NO: 8406870 - DNA, 22 bp, Homo sapiens
cagaatgagataacccagattg

SEQ ID NO: 8406871 - DNA, 22 bp, Homo sapiens
cagagggacagtatgatgaaag

SEQ ID NO: 8406872 - DNA, 22 bp, Homo sapiens
agcccagggaaccaggaagtgg

SEQ ID NO: 8406873 - DNA, 22 bp, Homo sapiens
agcccaggctggagtgcagtgg

SEQ ID NO: 8406874 - DNA, 20 bp, Homo sapiens
agcccaggcctgtgtgagtc

SEQ ID NO: 8406875 - DNA, 22 bp, Homo sapiens
cagaggagttcagtacacagcc

SEQ ID NO: 8406876 - DNA, 22 bp, Homo sapiens
agcccagccggattcccagttc

SEQ ID NO: 8406877 - DNA, 21 bp, Homo sapiens
cagaggcaggtcctgggacgg

SEQ ID NO: 8406878 - DNA, 22 bp, Homo sapiens
cagaggcagtggggttgctcct

SEQ ID NO: 8406879 - DNA, 20 bp, Homo sapiens
cagaggcattttcagactct

SEQ ID NO: 8406880 - DNA, 23 bp, Homo sapiens
cagaggcatcggattcaacatca

SEQ ID NO: 8406881 - DNA, 22 bp, Homo sapiens
agcccagcccgggctgcgcttt

SEQ ID NO: 8406882 - DNA, 22 bp, Homo sapiens
agcccagcactgggggcccagc

SEQ ID NO: 8406883 - DNA, 22 bp, Homo sapiens
agcccagagacaatgctcagta

SEQ ID NO: 8406884 - DNA, 22 bp, Homo sapiens
aggtggagatcagggactaagg

SEQ ID NO: 8406885 - DNA, 22 bp, Homo sapiens
aggtggctatgaggatgcagtc

SEQ ID NO: 8406886 - DNA, 23 bp, Homo sapiens
aggtggcctttgcctctttctct

SEQ ID NO: 8406887 - DNA, 22 bp, Homo sapiens
aggtggccggtgccagccgggc

SEQ ID NO: 8406888 - DNA, 18 bp, Homo sapiens
aggtggcctgggagcttt

SEQ ID NO: 8406889 - DNA, 22 bp, Homo sapiens
aggtggcctaaggtggcactgg

SEQ ID NO: 8406890 - DNA, 22 bp, Homo sapiens
aggtggccaataaatgttggag

SEQ ID NO: 8406891 - DNA, 22 bp, Homo sapiens
aggtggccaagactgtttgaca

SEQ ID NO: 8406892 - DNA, 22 bp, Homo sapiens
aggtggcatgcctgagacataa

SEQ ID NO: 8406893 - DNA, 19 bp, Homo sapiens
aggtggccatgtccagcct

SEQ ID NO: 8406894 - DNA, 23 bp, Homo sapiens
aggtggccaccagaatgttaagg

SEQ ID NO: 8406895 - DNA, 21 bp, Homo sapiens
aggtggccacaaatctgtttc

SEQ ID NO: 8406896 - DNA, 22 bp, Homo sapiens
aggtggccccaggcctctgcca

SEQ ID NO: 8406897 - DNA, 22 bp, Homo sapiens
aggtggcccagctgacagatag

SEQ ID NO: 8406898 - DNA, 20 bp, Homo sapiens
aggtggcccattatagtgga

SEQ ID NO: 8406899 - DNA, 22 bp, Homo sapiens
acctgaccaggtggcttcccaa

SEQ ID NO: 8406900 - DNA, 20 bp, Homo sapiens
aggtggctcctgctgggggt

SEQ ID NO: 8406901 - DNA, 22 bp, Homo sapiens
aggtggctcctcccatggctgg

SEQ ID NO: 8406902 - DNA, 22 bp, Homo sapiens
agtaaacagaaagcaagatgat

SEQ ID NO: 8406903 - DNA, 22 bp, Homo sapiens
agtaaaattgtattggaaaaca

SEQ ID NO: 8406904 - DNA, 22 bp, Homo sapiens
agtaaacacgtggggtttcttt

SEQ ID NO: 8406905 - DNA, 22 bp, Homo sapiens
agtaaaattaatggatcagaag

SEQ ID NO: 8406906 - DNA, 22 bp, Homo sapiens
agtggcagggctggctgctgca

SEQ ID NO: 8406907 - DNA, 22 bp, Homo sapiens
agtggcagagccagggttggga

SEQ ID NO: 8406908 - DNA, 22 bp, Homo sapiens
agtggcaggtgtttcgtggtgc

SEQ ID NO: 8406909 - DNA, 22 bp, Homo sapiens
agtggcagtagatgagctggtt

SEQ ID NO: 8406910 - DNA, 22 bp, Homo sapiens
agtggcagtggctgggcagagc

SEQ ID NO: 8406911 - DNA, 22 bp, Homo sapiens
agtgtacatgtacacattagta

SEQ ID NO: 8406912 - DNA, 20 bp, Homo sapiens
agtgtacagacactagaaat

SEQ ID NO: 8406913 - DNA, 22 bp, Homo sapiens
agtgtacagttctatgaatttc

SEQ ID NO: 8406914 - DNA, 22 bp, Homo sapiens
agtgttggaccgaggtggagcc

SEQ ID NO: 8406915 - DNA, 22 bp, Homo sapiens
actgagctgtgacaatgcttaa

SEQ ID NO: 8406916 - DNA, 22 bp, Homo sapiens
agtcccaggcagccgagccggt

SEQ ID NO: 8406917 - DNA, 19 bp, Homo sapiens
atctcaaccctactctctg

SEQ ID NO: 8406918 - DNA, 22 bp, Homo sapiens
atctaaaatgtggttagttggt

SEQ ID NO: 8406919 - DNA, 23 bp, Homo sapiens
atctaaagtgttaaatagctggg

SEQ ID NO: 8406920 - DNA, 22 bp, Homo sapiens
agaaagtgaacgtgttcagttt

SEQ ID NO: 8406921 - DNA, 22 bp, Homo sapiens
agaaagggttctctgaggtgct

SEQ ID NO: 8406922 - DNA, 22 bp, Homo sapiens
actgtagagaatctgagaaaaa

SEQ ID NO: 8406923 - DNA, 22 bp, Homo sapiens
actgtagaggcctggattgagg

SEQ ID NO: 8406924 - DNA, 22 bp, Homo sapiens
actgtacatgtaaacattgtca

SEQ ID NO: 8406925 - DNA, 22 bp, Homo sapiens
actgtgcaaatgacaggcacac

SEQ ID NO: 8406926 - DNA, 22 bp, Homo sapiens
actgtgcacaattctaagtcct

SEQ ID NO: 8406927 - DNA, 22 bp, Homo sapiens
actgtgcaatgagtaataaact

SEQ ID NO: 8406928 - DNA, 22 bp, Homo sapiens
actgtgcaagtcaaagatgggc

SEQ ID NO: 8406929 - DNA, 22 bp, Homo sapiens
actgtgcatctattgccattta

SEQ ID NO: 8406930 - DNA, 22 bp, Homo sapiens
actgtgcatgaaccgaaacaaa

SEQ ID NO: 8406931 - DNA, 22 bp, Homo sapiens
actgtgcagtgttgtaacccga

SEQ ID NO: 8406932 - DNA, 22 bp, Homo sapiens
actgtgcaggtgaactgtttgc

SEQ ID NO: 8406933 - DNA, 22 bp, Homo sapiens
actgtgcagctgagtgctaatt

SEQ ID NO: 8406934 - DNA, 22 bp, Homo sapiens
actgtgcaggggaagagagaaa

SEQ ID NO: 8406935 - DNA, 22 bp, Homo sapiens
actgtgcaggtagatgcctggg

SEQ ID NO: 8406936 - DNA, 22 bp, Homo sapiens
actgtgcaccctggacagtgtc

SEQ ID NO: 8406937 - DNA, 22 bp, Homo sapiens
actgtgcacacaaaaatagatt

SEQ ID NO: 8406938 - DNA, 21 bp, Homo sapiens
actgtgcagcctgaggatgtg

SEQ ID NO: 8406939 - DNA, 22 bp, Homo sapiens
actgtgcatttgtcatggggtt

SEQ ID NO: 8406940 - DNA, 22 bp, Homo sapiens
actgtgcatttgaagggatcat

SEQ ID NO: 8406941 - DNA, 22 bp, Homo sapiens
actgtgcatggtatccttgatg

SEQ ID NO: 8406942 - DNA, 22 bp, Homo sapiens
actgtgcatttcatgtcttttc

SEQ ID NO: 8406943 - DNA, 22 bp, Homo sapiens
actgtgcattccccaacctgtg

SEQ ID NO: 8406944 - DNA, 22 bp, Homo sapiens
actttatttcctattgcatcca

SEQ ID NO: 8406945 - DNA, 22 bp, Homo sapiens
actttagtaaacttatgttact

SEQ ID NO: 8406946 - DNA, 22 bp, Homo sapiens
atactgtatatttcacatcttg

SEQ ID NO: 8406947 - DNA, 22 bp, Homo sapiens
atactgtagaggcatagctagt

SEQ ID NO: 8406948 - DNA, 22 bp, Homo sapiens
atacatgttgagaaaatatctg

SEQ ID NO: 8406949 - DNA, 22 bp, Homo sapiens
atacagtaaccacattctatag

SEQ ID NO: 8406950 - DNA, 22 bp, Homo sapiens
atacagggacatccagtttttc

SEQ ID NO: 8406951 - DNA, 22 bp, Homo sapiens
acccagctggatgcatggaggc

SEQ ID NO: 8406952 - DNA, 20 bp, Homo sapiens
acccagctctgtgccctggg

SEQ ID NO: 8406953 - DNA, 22 bp, Homo sapiens
agggctgacagtgaggagtcaa

SEQ ID NO: 8406954 - DNA, 22 bp, Homo sapiens
agggctgacagtgaggagtcaa

SEQ ID NO: 8406955 - DNA, 22 bp, Homo sapiens
acccaggctggcagaggctcct

SEQ ID NO: 8406956 - DNA, 22 bp, Homo sapiens
accagccaccaccaggagatcg

SEQ ID NO: 8406957 - DNA, 22 bp, Homo sapiens
accagccagccacagtggctcc

SEQ ID NO: 8406958 - DNA, 22 bp, Homo sapiens
agggcagcaatgcagctgctgc

SEQ ID NO: 8406959 - DNA, 22 bp, Homo sapiens
agggcagcaaagtttgacctca

SEQ ID NO: 8406960 - DNA, 22 bp, Homo sapiens
agggcagcacagctgtgctcct

SEQ ID NO: 8406961 - DNA, 22 bp, Homo sapiens
aggccagggtcccacactcgca

SEQ ID NO: 8406962 - DNA, 22 bp, Homo sapiens
aggccagggtcccacactcgca

SEQ ID NO: 8406963 - DNA, 22 bp, Homo sapiens
aggccaggcgagacacccggct

SEQ ID NO: 8406964 - DNA, 22 bp, Homo sapiens
acatgccagcactgcttttcag

SEQ ID NO: 8406965 - DNA, 22 bp, Homo sapiens
aggctgaggagggatgttgctt

SEQ ID NO: 8406966 - DNA, 22 bp, Homo sapiens
acatttgagcatctactaagtg

SEQ ID NO: 8406967 - DNA, 22 bp, Homo sapiens
aggctctggctactacagagct

SEQ ID NO: 8406968 - DNA, 22 bp, Homo sapiens
acattgtatacagacttagtca

SEQ ID NO: 8406969 - DNA, 22 bp, Homo sapiens
acaggctgttggggtccagggt

SEQ ID NO: 8406970 - DNA, 22 bp, Homo sapiens
aggacacacccagctcacgggg

SEQ ID NO: 8406971 - DNA, 22 bp, Homo sapiens
acaggggacctaggaccctcgg

SEQ ID NO: 8406972 - DNA, 22 bp, Homo sapiens
acagggcttttaatcagtagtt

SEQ ID NO: 8406973 - DNA, 18 bp, Homo sapiens
agctggtggggagacagc

SEQ ID NO: 8406974 - DNA, 22 bp, Homo sapiens
agctggtggggaagctgcaggt

SEQ ID NO: 8406975 - DNA, 22 bp, Homo sapiens
agctggtggattatgctgtaca

SEQ ID NO: 8406976 - DNA, 22 bp, Homo sapiens
agctggtggagcctttctgttt

SEQ ID NO: 8406977 - DNA, 21 bp, Homo sapiens
agctggtgtcagagctctggg

SEQ ID NO: 8406978 - DNA, 22 bp, Homo sapiens
agctggtgtgccagttccagtt

SEQ ID NO: 8406979 - DNA, 22 bp, Homo sapiens
agctggtgtgctctggaatcct

SEQ ID NO: 8406980 - DNA, 22 bp, Homo sapiens
acaggagggacaccttcctgct

SEQ ID NO: 8406981 - DNA, 22 bp, Homo sapiens
acaggagggacaccttcctgct

SEQ ID NO: 8406982 - DNA, 23 bp, Homo sapiens
acaggaggggacaggtggccgtg

SEQ ID NO: 8406983 - DNA, 22 bp, Homo sapiens
acaggaggggcatgaaagacgg

SEQ ID NO: 8406984 - DNA, 22 bp, Homo sapiens
acaggaggggcatgaaagacgg

SEQ ID NO: 8406985 - DNA, 22 bp, Homo sapiens
agctgagagcccctgccctgtg

SEQ ID NO: 8406986 - DNA, 22 bp, Homo sapiens
agctgaatctcaggcatccttt

SEQ ID NO: 8406987 - DNA, 22 bp, Homo sapiens
agctggatgaatttggaacact

SEQ ID NO: 8406988 - DNA, 22 bp, Homo sapiens
agctggaggggccagcaggtgt

SEQ ID NO: 8406989 - DNA, 22 bp, Homo sapiens
agctgagaggtggcaagctgta

SEQ ID NO: 8406990 - DNA, 22 bp, Homo sapiens
acagctgctcacctgtgagccc

SEQ ID NO: 8406991 - DNA, 22 bp, Homo sapiens
acagtaaataatgcatgttgat

SEQ ID NO: 8406992 - DNA, 21 bp, Homo sapiens
aggacacagagacacctattg

SEQ ID NO: 8406993 - DNA, 22 bp, Homo sapiens
aggatgagccgcgcaagctgac

SEQ ID NO: 8406994 - DNA, 22 bp, Homo sapiens
aggatgccttcattgcatggcc

SEQ ID NO: 8406995 - DNA, 22 bp, Homo sapiens
agtgttattgaggcaaaactgt

SEQ ID NO: 8406996 - DNA, 22 bp, Homo sapiens
atagtacacatcctacaatgtt

SEQ ID NO: 8406997 - DNA, 22 bp, Homo sapiens
ataggcagaaatgctccctatt

SEQ ID NO: 8406998 - DNA, 22 bp, Homo sapiens
ctggccagtgcctgtgggcccc

SEQ ID NO: 8406999 - DNA, 22 bp, Homo sapiens
ctggccaggctctcacgtggtc

SEQ ID NO: 8407000 - DNA, 22 bp, Homo sapiens
ctggccagtgactgctcacccg

SEQ ID NO: 8407001 - DNA, 22 bp, Homo sapiens
ctggccagggtgcgatcgtggt

SEQ ID NO: 8407002 - DNA, 22 bp, Homo sapiens
ctggccaggttttgaacagttg

SEQ ID NO: 8407003 - DNA, 21 bp, Homo sapiens
ctggaagaagcagcaggattc

SEQ ID NO: 8407004 - DNA, 22 bp, Homo sapiens
ctgggctgtggtgtggcccaaa

SEQ ID NO: 8407005 - DNA, 23 bp, Homo sapiens
ctgggctgtcctgaggtcacctc

SEQ ID NO: 8407006 - DNA, 22 bp, Homo sapiens
ctggggcatcatccattctttc

SEQ ID NO: 8407007 - DNA, 17 bp, Homo sapiens
ctggggatgtgggactc

SEQ ID NO: 8407008 - DNA, 22 bp, Homo sapiens
ctggggcagagcccagcaattt

SEQ ID NO: 8407009 - DNA, 22 bp, Homo sapiens
ctggtggcatcttgagatggtt

SEQ ID NO: 8407010 - DNA, 19 bp, Homo sapiens
atcaggaacaaggctgatc

SEQ ID NO: 8407011 - DNA, 22 bp, Homo sapiens
atcaggaatcttttgtcagaca

SEQ ID NO: 8407012 - DNA, 22 bp, Homo sapiens
atcaggaagatctagcgaatgt

SEQ ID NO: 8407013 - DNA, 22 bp, Homo sapiens
atctcccaattccctgataaat

SEQ ID NO: 8407014 - DNA, 22 bp, Homo sapiens
cttcatctttctgagcctcagt

SEQ ID NO: 8407015 - DNA, 17 bp, Homo sapiens
agtggcaggcagatggg

SEQ ID NO: 8407016 - DNA, 22 bp, Homo sapiens
agtggcagccgagcaggagatg

SEQ ID NO: 8407017 - DNA, 22 bp, Homo sapiens
ctcttagagagttgttgatcag

SEQ ID NO: 8407018 - DNA, 22 bp, Homo sapiens
agtctgtgaacttggcagggaa

SEQ ID NO: 8407019 - DNA, 22 bp, Homo sapiens
ctcaggcacgggtcagtgagcg

SEQ ID NO: 8407020 - DNA, 22 bp, Homo sapiens
ctcaggcacgggtcagtgagcg

SEQ ID NO: 8407021 - DNA, 22 bp, Homo sapiens
agtctgagttagtggaaatgta

SEQ ID NO: 8407022 - DNA, 21 bp, Homo sapiens
ctcaggcatttgaggagagtc

SEQ ID NO: 8407023 - DNA, 22 bp, Homo sapiens
agtgcacagcgtgatgtattgg

SEQ ID NO: 8407024 - DNA, 22 bp, Homo sapiens
agtgcagagacctggtcaggca

SEQ ID NO: 8407025 - DNA, 22 bp, Homo sapiens
agtgcagcaccatgttacagag

SEQ ID NO: 8407026 - DNA, 22 bp, Homo sapiens
ctcccagggtctaggctgctgg

SEQ ID NO: 8407027 - DNA, 22 bp, Homo sapiens
ctcccaggttccgacgcctctt

SEQ ID NO: 8407028 - DNA, 22 bp, Homo sapiens
agtgcagctgggactgtagggt

SEQ ID NO: 8407029 - DNA, 22 bp, Homo sapiens
agtgcaggagcctggccagagc

SEQ ID NO: 8407030 - DNA, 22 bp, Homo sapiens
agggtggctgagtagatggaag

SEQ ID NO: 8407031 - DNA, 21 bp, Homo sapiens
agggtggctctgggtcagaac

SEQ ID NO: 8407032 - DNA, 22 bp, Homo sapiens
agggtggctggaggaatcagaa

SEQ ID NO: 8407033 - DNA, 22 bp, Homo sapiens
cctggccagccagggctggggt

SEQ ID NO: 8407034 - DNA, 22 bp, Homo sapiens
agggtggcttaattccaaaggg

SEQ ID NO: 8407035 - DNA, 22 bp, Homo sapiens
agggtggctgtgaagtgcttgg

SEQ ID NO: 8407036 - DNA, 22 bp, Homo sapiens
agggtggccaccaagtatgtca

SEQ ID NO: 8407037 - DNA, 22 bp, Homo sapiens
agggtggccccactttggttgg

SEQ ID NO: 8407038 - DNA, 22 bp, Homo sapiens
agggtggccatgagggagagat

SEQ ID NO: 8407039 - DNA, 20 bp, Homo sapiens
agggtggcaagttagtgaca

SEQ ID NO: 8407040 - DNA, 19 bp, Homo sapiens
agggtggcaaaggagggtg

SEQ ID NO: 8407041 - DNA, 19 bp, Homo sapiens
agggtggcaaaggagggtg

SEQ ID NO: 8407042 - DNA, 22 bp, Homo sapiens
agggtggcaccacatatcatag

SEQ ID NO: 8407043 - DNA, 22 bp, Homo sapiens
agggtggcacctggaagggatg

SEQ ID NO: 8407044 - DNA, 22 bp, Homo sapiens
agggtggcagttactggagcaa

SEQ ID NO: 8407045 - DNA, 22 bp, Homo sapiens
agggtggcagttactggagcaa

SEQ ID NO: 8407046 - DNA, 22 bp, Homo sapiens
agggtggcactggtggctctat

SEQ ID NO: 8407047 - DNA, 22 bp, Homo sapiens
aggggctgtggaaaccaactct

SEQ ID NO: 8407048 - DNA, 21 bp, Homo sapiens
aggtatgttgagaactgagga

SEQ ID NO: 8407049 - DNA, 19 bp, Homo sapiens
aggtgaggggcaccatgtc

SEQ ID NO: 8407050 - DNA, 22 bp, Homo sapiens
agtcagttgcaaacatcaggca

SEQ ID NO: 8407051 - DNA, 20 bp, Homo sapiens
ctaaactctgcagatttagt

SEQ ID NO: 8407052 - DNA, 22 bp, Homo sapiens
cgtggccagcacaaggcagtga

SEQ ID NO: 8407053 - DNA, 22 bp, Homo sapiens
cgtggccacccagtggtgcgtg

SEQ ID NO: 8407054 - DNA, 22 bp, Homo sapiens
cgtggccagccatttcctggaa

SEQ ID NO: 8407055 - DNA, 22 bp, Homo sapiens
cgtggccagtttcaagctacca

SEQ ID NO: 8407056 - DNA, 22 bp, Homo sapiens
aggttggcctcagggaggctct

SEQ ID NO: 8407057 - DNA, 22 bp, Homo sapiens
aggtggggttcagtctcagccg

SEQ ID NO: 8407058 - DNA, 19 bp, Homo sapiens
aggtgtgggggctgcagac

SEQ ID NO: 8407059 - DNA, 22 bp, Homo sapiens
aggtgtggctggggcagaggcc

SEQ ID NO: 8407060 - DNA, 22 bp, Homo sapiens
aggtgtggctggggcagaggcc

SEQ ID NO: 8407061 - DNA, 23 bp, Homo sapiens
agggaagaaacatgaagggctgt

SEQ ID NO: 8407062 - DNA, 22 bp, Homo sapiens
agggaagaaaatccatcgctgc

SEQ ID NO: 8407063 - DNA, 22 bp, Homo sapiens
agggaagaagctggtagtaggt

SEQ ID NO: 8407064 - DNA, 22 bp, Homo sapiens
cccagggctgcagatggaggct

SEQ ID NO: 8407065 - DNA, 22 bp, Homo sapiens
aggctggctggcaggggacaca

SEQ ID NO: 8407066 - DNA, 22 bp, Homo sapiens
agggcagagagatgaatgggat

SEQ ID NO: 8407067 - DNA, 22 bp, Homo sapiens
agggcagagatctgagtgggca

SEQ ID NO: 8407068 - DNA, 22 bp, Homo sapiens
agggatggatcttggccctgga

SEQ ID NO: 8407069 - DNA, 22 bp, Homo sapiens
agggatgggaactcctccagca

SEQ ID NO: 8407070 - DNA, 22 bp, Homo sapiens
agggatgggaactcctccagca

SEQ ID NO: 8407071 - DNA, 22 bp, Homo sapiens
agggatggagtgcggcccggac

SEQ ID NO: 8407072 - DNA, 22 bp, Homo sapiens
agggagtgttatattccatcag

SEQ ID NO: 8407073 - DNA, 22 bp, Homo sapiens
agggagttagtgatgtggtctc

SEQ ID NO: 8407074 - DNA, 22 bp, Homo sapiens
agggagtgtaaatggtgctcag

SEQ ID NO: 8407075 - DNA, 22 bp, Homo sapiens
agggactcctctgctcggctgc

SEQ ID NO: 8407076 - DNA, 22 bp, Homo sapiens
ccctggaggcaaaggttgcagt

SEQ ID NO: 8407077 - DNA, 16 bp, Homo sapiens
agggccagaagcatca

SEQ ID NO: 8407078 - DNA, 22 bp, Homo sapiens
agggccagaatccctcagtcta

SEQ ID NO: 8407079 - DNA, 22 bp, Homo sapiens
agggccagaggcaccttgcagc

SEQ ID NO: 8407080 - DNA, 22 bp, Homo sapiens
agggccagagtacatcagggct

SEQ ID NO: 8407081 - DNA, 22 bp, Homo sapiens
agggccccatagtcactgcccg

SEQ ID NO: 8407082 - DNA, 22 bp, Homo sapiens
ccgaggctggagtgcagtggcg

SEQ ID NO: 8407083 - DNA, 22 bp, Homo sapiens
aggggctggcttatctgagagt

SEQ ID NO: 8407084 - DNA, 22 bp, Homo sapiens
aggggctgctgggtccgcccct

SEQ ID NO: 8407085 - DNA, 22 bp, Homo sapiens
agggctgagtgggagagagttg

SEQ ID NO: 8407086 - DNA, 22 bp, Homo sapiens
aggctcagttctgtggtgagcc

SEQ ID NO: 8407087 - DNA, 22 bp, Homo sapiens
aggctcagttcacgtcaacttt

SEQ ID NO: 8407088 - DNA, 22 bp, Homo sapiens
aggctcagtgcaaatcattctg

SEQ ID NO: 8407089 - DNA, 22 bp, Homo sapiens
aggctcagtttggtttccattg

SEQ ID NO: 8407090 - DNA, 22 bp, Homo sapiens
ccaggagctatgtacacactat

SEQ ID NO: 8407091 - DNA, 22 bp, Homo sapiens
ccaggaggaaagaccagcccat

SEQ ID NO: 8407092 - DNA, 22 bp, Homo sapiens
ccaggaggaaattctaaaggta

SEQ ID NO: 8407093 - DNA, 22 bp, Homo sapiens
aggctcagtatagctggcaagt

SEQ ID NO: 8407094 - DNA, 22 bp, Homo sapiens
aggctcaggtgcctcattcaca

SEQ ID NO: 8407095 - DNA, 22 bp, Homo sapiens
aggctcagtcccggcccgcgcc

SEQ ID NO: 8407096 - DNA, 22 bp, Homo sapiens
aggctcagtgatgtaaaatata

SEQ ID NO: 8407097 - DNA, 22 bp, Homo sapiens
aggctcagtctgttcatgcact

SEQ ID NO: 8407098 - DNA, 22 bp, Homo sapiens
ccagggtgaccagctggcctag

SEQ ID NO: 8407099 - DNA, 22 bp, Homo sapiens
ccagggtgagaaaaggctggat

SEQ ID NO: 8407100 - DNA, 22 bp, Homo sapiens
aggctccttgctcacaggctca

SEQ ID NO: 8407101 - DNA, 22 bp, Homo sapiens
aggctcctgagaggcagaggct

SEQ ID NO: 8407102 - DNA, 22 bp, Homo sapiens
aggctcctcggggctgacggcg

SEQ ID NO: 8407103 - DNA, 22 bp, Homo sapiens
aggctcctagcctgtggctggt

SEQ ID NO: 8407104 - DNA, 23 bp, Homo sapiens
cccagagcacagcctccagatgc

SEQ ID NO: 8407105 - DNA, 22 bp, Homo sapiens
ccatggcttttgagtctcaaga

SEQ ID NO: 8407106 - DNA, 22 bp, Homo sapiens
ccatgtgcttgctctggcacct

SEQ ID NO: 8407107 - DNA, 22 bp, Homo sapiens
aggctgcctcgtgagctcgctg

SEQ ID NO: 8407108 - DNA, 22 bp, Homo sapiens
ccagggtggaggctggatggag

SEQ ID NO: 8407109 - DNA, 22 bp, Homo sapiens
ccagggtgctctgtggcgtcgc

SEQ ID NO: 8407110 - DNA, 22 bp, Homo sapiens
ccatggcttctttctctgccag

SEQ ID NO: 8407111 - DNA, 22 bp, Homo sapiens
ccatggctgcaattcttctgga

SEQ ID NO: 8407112 - DNA, 22 bp, Homo sapiens
ccatggctctagagattgaaaa

SEQ ID NO: 8407113 - DNA, 22 bp, Homo sapiens
aggccagacagctagaaacagg

SEQ ID NO: 8407114 - DNA, 19 bp, Homo sapiens
ccagctggcctgggacctc

SEQ ID NO: 8407115 - DNA, 22 bp, Homo sapiens
ccaggagcaaagatcactggga

SEQ ID NO: 8407116 - DNA, 22 bp, Homo sapiens
ccaggagcaaagatcactggga

SEQ ID NO: 8407117 - DNA, 22 bp, Homo sapiens
aggccctggcccccagagattc

SEQ ID NO: 8407118 - DNA, 23 bp, Homo sapiens
aggcatggcatggatggtggctc

SEQ ID NO: 8407119 - DNA, 22 bp, Homo sapiens
aggcatggcactgagcagcttc

SEQ ID NO: 8407120 - DNA, 21 bp, Homo sapiens
aggcatggaaatggcacactg

SEQ ID NO: 8407121 - DNA, 22 bp, Homo sapiens
ccagagcagatgtggccttggt

SEQ ID NO: 8407122 - DNA, 22 bp, Homo sapiens
aggccagactttggccaaatcc

SEQ ID NO: 8407123 - DNA, 22 bp, Homo sapiens
aggcagggtgatgataatgatt

SEQ ID NO: 8407124 - DNA, 22 bp, Homo sapiens
aggcaggggagctggaagggta

SEQ ID NO: 8407125 - DNA, 22 bp, Homo sapiens
aggcaggggagctggaagggta

SEQ ID NO: 8407126 - DNA, 22 bp, Homo sapiens
agctgtgctgccaagttgctga

SEQ ID NO: 8407127 - DNA, 22 bp, Homo sapiens
agctgtgctgtggtcatctggg

SEQ ID NO: 8407128 - DNA, 22 bp, Homo sapiens
agctgtgcctattcgtggcaag

SEQ ID NO: 8407129 - DNA, 22 bp, Homo sapiens
agctgtgccttgctgcacggtg

SEQ ID NO: 8407130 - DNA, 22 bp, Homo sapiens
agctgtgctgccaagttgctga

SEQ ID NO: 8407131 - DNA, 19 bp, Homo sapiens
agctgtgcagacacttcgc

SEQ ID NO: 8407132 - DNA, 22 bp, Homo sapiens
agctgtgcacactgtgaagtag

SEQ ID NO: 8407133 - DNA, 22 bp, Homo sapiens
caggctcagcaggagcctgacc

SEQ ID NO: 8407134 - DNA, 22 bp, Homo sapiens
caggctccaagccctctgatgt

SEQ ID NO: 8407135 - DNA, 22 bp, Homo sapiens
caggctccactgtaggcagctc

SEQ ID NO: 8407136 - DNA, 22 bp, Homo sapiens
cagggagaaatctccaggaggt

SEQ ID NO: 8407137 - DNA, 22 bp, Homo sapiens
cagggagcggagtcccatgcct

SEQ ID NO: 8407138 - DNA, 22 bp, Homo sapiens
caggctggagtgcagttgtgca

SEQ ID NO: 8407139 - DNA, 22 bp, Homo sapiens
caggctggagtgcagtggtgcc

SEQ ID NO: 8407140 - DNA, 22 bp, Homo sapiens
cagggatgggatggagtcagtt

SEQ ID NO: 8407141 - DNA, 22 bp, Homo sapiens
cagggagctttcccaggaccct

SEQ ID NO: 8407142 - DNA, 22 bp, Homo sapiens
cagggagctggtgccagccgac

SEQ ID NO: 8407143 - DNA, 22 bp, Homo sapiens
cagggagctctgggccggactc

SEQ ID NO: 8407144 - DNA, 22 bp, Homo sapiens
cagggagctgacaaccaaggag

SEQ ID NO: 8407145 - DNA, 22 bp, Homo sapiens
cagggagctggctggctgtgcc

SEQ ID NO: 8407146 - DNA, 23 bp, Homo sapiens
cagggccaggcagcagctgtcac

SEQ ID NO: 8407147 - DNA, 22 bp, Homo sapiens
cagggctcgctcttgcccttcg

SEQ ID NO: 8407148 - DNA, 22 bp, Homo sapiens
cagggctcgctcgctcgctcgc

SEQ ID NO: 8407149 - DNA, 22 bp, Homo sapiens
caggggctctaatgcatgatca

SEQ ID NO: 8407150 - DNA, 22 bp, Homo sapiens
caggtgacatcaacaggaccac

SEQ ID NO: 8407151 - DNA, 22 bp, Homo sapiens
caggtccttgtttgtaaagcag

SEQ ID NO: 8407152 - DNA, 22 bp, Homo sapiens
caggtgaccctcagtgtggact

SEQ ID NO: 8407153 - DNA, 22 bp, Homo sapiens
caggtgaccctctcacctgctt

SEQ ID NO: 8407154 - DNA, 17 bp, Homo sapiens
caggtgacctggtgatg

SEQ ID NO: 8407155 - DNA, 22 bp, Homo sapiens
caggtgacctcagcgcctgcag

SEQ ID NO: 8407156 - DNA, 22 bp, Homo sapiens
agctgggctgggctgagctgag

SEQ ID NO: 8407157 - DNA, 19 bp, Homo sapiens
agctgggctgtcacagtga

SEQ ID NO: 8407158 - DNA, 22 bp, Homo sapiens
agctgggcttggccaggtcgct

SEQ ID NO: 8407159 - DNA, 22 bp, Homo sapiens
caggccagagtccaactccaga

SEQ ID NO: 8407160 - DNA, 22 bp, Homo sapiens
caggccagcagggcctccgtgg

SEQ ID NO: 8407161 - DNA, 22 bp, Homo sapiens
caggccagcgtccagaacaagc

SEQ ID NO: 8407162 - DNA, 22 bp, Homo sapiens
agctggccctcgagagccaatt

SEQ ID NO: 8407163 - DNA, 22 bp, Homo sapiens
agctggccattgtgagtggcct

SEQ ID NO: 8407164 - DNA, 20 bp, Homo sapiens
caggcacactcattcctgct

SEQ ID NO: 8407165 - DNA, 19 bp, Homo sapiens
agctgctggcccagggacc

SEQ ID NO: 8407166 - DNA, 22 bp, Homo sapiens
agctgctgcccataggtgacat

SEQ ID NO: 8407167 - DNA, 22 bp, Homo sapiens
caggcacactgtctacactgag

SEQ ID NO: 8407168 - DNA, 22 bp, Homo sapiens
caggaaggcgcggctgtgcctg

SEQ ID NO: 8407169 - DNA, 22 bp, Homo sapiens
caggaaggggctcactctggcc

SEQ ID NO: 8407170 - DNA, 22 bp, Homo sapiens
caggaaggggctcactctggcc

SEQ ID NO: 8407171 - DNA, 19 bp, Homo sapiens
caggaaggggcgaatctgg

SEQ ID NO: 8407172 - DNA, 22 bp, Homo sapiens
caggaaggcccacctgtcctgt

SEQ ID NO: 8407173 - DNA, 22 bp, Homo sapiens
agctgcagaggtttgtgcaaca

SEQ ID NO: 8407174 - DNA, 17 bp, Homo sapiens
agctgcagatgaagttg

SEQ ID NO: 8407175 - DNA, 22 bp, Homo sapiens
caggaaggaccgtccagatcag

SEQ ID NO: 8407176 - DNA, 22 bp, Homo sapiens
agctgagggcaggatggggtga

SEQ ID NO: 8407177 - DNA, 22 bp, Homo sapiens
agctgagggcaggatggggtga

SEQ ID NO: 8407178 - DNA, 22 bp, Homo sapiens
cagctgagaagtgatagctgca

SEQ ID NO: 8407179 - DNA, 22 bp, Homo sapiens
caggtggcttctccctaggcca

SEQ ID NO: 8407180 - DNA, 22 bp, Homo sapiens
aggacctggatcacagagatct

SEQ ID NO: 8407181 - DNA, 22 bp, Homo sapiens
cagtggccttgatgcctcattc

SEQ ID NO: 8407182 - DNA, 21 bp, Homo sapiens
cagtgcaggggttagcgtgta

SEQ ID NO: 8407183 - DNA, 22 bp, Homo sapiens
catggaggaccctcagggagct

SEQ ID NO: 8407184 - DNA, 22 bp, Homo sapiens
aggattgtgcctccagtcagaa

SEQ ID NO: 8407185 - DNA, 22 bp, Homo sapiens
aggattgtatacctaagtgtta

SEQ ID NO: 8407186 - DNA, 22 bp, Homo sapiens
aggatttctgtgcctggaaaat

SEQ ID NO: 8407187 - DNA, 22 bp, Homo sapiens
aggattgttgcagggcttcgtt

SEQ ID NO: 8407188 - DNA, 22 bp, Homo sapiens
catggggcccatgtgctccaag

SEQ ID NO: 8407189 - DNA, 18 bp, Homo sapiens
catgggtgacaggtggat

SEQ ID NO: 8407190 - DNA, 22 bp, Homo sapiens
catgggtaagactcttttgccc

SEQ ID NO: 8407191 - DNA, 22 bp, Homo sapiens
catgtacattctgtagatggag

SEQ ID NO: 8407192 - DNA, 21 bp, Homo sapiens
aggcagcaggatccagggaca

SEQ ID NO: 8407193 - DNA, 19 bp, Homo sapiens
aggcagcaggccagggatg

SEQ ID NO: 8407194 - DNA, 23 bp, Homo sapiens
aggcagcaggttgtccagggtga

SEQ ID NO: 8407195 - DNA, 22 bp, Homo sapiens
ccaagggctgctgaggtgtcca

SEQ ID NO: 8407196 - DNA, 22 bp, Homo sapiens
ccaagggctctgacttgcctgc

SEQ ID NO: 8407197 - DNA, 22 bp, Homo sapiens
ccaagctggatttagctgcaca

SEQ ID NO: 8407198 - DNA, 22 bp, Homo sapiens
gccagctgctggaacagcgcga

SEQ ID NO: 8407199 - DNA, 22 bp, Homo sapiens
attgtacagacatgggaaacaa

SEQ ID NO: 8407200 - DNA, 22 bp, Homo sapiens
attgtacatgcagtgagtcatc

SEQ ID NO: 8407201 - DNA, 22 bp, Homo sapiens
gccagctgccctctgctggtcc

SEQ ID NO: 8407202 - DNA, 22 bp, Homo sapiens
gccagctgcatctcctgggctg

SEQ ID NO: 8407203 - DNA, 19 bp, Homo sapiens
gcccaggggcccgatgctg

SEQ ID NO: 8407204 - DNA, 22 bp, Homo sapiens
gccatgcctgtgtctccaggcc

SEQ ID NO: 8407205 - DNA, 22 bp, Homo sapiens
gccatgcttggtatgctgtgag

SEQ ID NO: 8407206 - DNA, 19 bp, Homo sapiens
gcaggcagctggggtatcc

SEQ ID NO: 8407207 - DNA, 20 bp, Homo sapiens
gcaggcagggaatgggggtg

SEQ ID NO: 8407208 - DNA, 20 bp, Homo sapiens
gcatggaaacaaaggttgca

SEQ ID NO: 8407209 - DNA, 22 bp, Homo sapiens
gcagggcatagaggcacggagg

SEQ ID NO: 8407210 - DNA, 22 bp, Homo sapiens
gcagggcagtaagagctagagt

SEQ ID NO: 8407211 - DNA, 22 bp, Homo sapiens
gcagggcagtaagagctagagt

SEQ ID NO: 8407212 - DNA, 22 bp, Homo sapiens
gatgtgaggactcatgtggagg

SEQ ID NO: 8407213 - DNA, 22 bp, Homo sapiens
gatgtggggataatactggtac

SEQ ID NO: 8407214 - DNA, 18 bp, Homo sapiens
gatgtgggccctggatat

SEQ ID NO: 8407215 - DNA, 22 bp, Homo sapiens
gatgtggcatctgggtgacagc

SEQ ID NO: 8407216 - DNA, 22 bp, Homo sapiens
gatgtggggttgagggaccagc

SEQ ID NO: 8407217 - DNA, 22 bp, Homo sapiens
atgttatttattgaaacacttt

SEQ ID NO: 8407218 - DNA, 22 bp, Homo sapiens
gatggagtctgaagctgggaac

SEQ ID NO: 8407219 - DNA, 22 bp, Homo sapiens
gcagagaaggattgaaaccaga

SEQ ID NO: 8407220 - DNA, 22 bp, Homo sapiens
gcacccacttaggccagtcaat

SEQ ID NO: 8407221 - DNA, 22 bp, Homo sapiens
gaaggaggcgttagccctagga

SEQ ID NO: 8407222 - DNA, 22 bp, Homo sapiens
gaagctaaaccacagctaagaa

SEQ ID NO: 8407223 - DNA, 22 bp, Homo sapiens
gaagctaatgatttattttctg

SEQ ID NO: 8407224 - DNA, 22 bp, Homo sapiens
gaagctaatgagataaatgcca

SEQ ID NO: 8407225 - DNA, 22 bp, Homo sapiens
gaaggagggtgcggatctgagc

SEQ ID NO: 8407226 - DNA, 22 bp, Homo sapiens
atgcagtgtttggaagcttaag

SEQ ID NO: 8407227 - DNA, 22 bp, Homo sapiens
atgcagtggcttcagtgtcagt

SEQ ID NO: 8407228 - DNA, 22 bp, Homo sapiens
atgcagtggcagctcctggtgt

SEQ ID NO: 8407229 - DNA, 22 bp, Homo sapiens
gaagagagagccctggggtccg

SEQ ID NO: 8407230 - DNA, 22 bp, Homo sapiens
atgagcaggtttaagagaggcc

SEQ ID NO: 8407231 - DNA, 16 bp, Homo sapiens
atgctgctattagagg

SEQ ID NO: 8407232 - DNA, 22 bp, Homo sapiens
gacaggaaacaagaaggcagga

SEQ ID NO: 8407233 - DNA, 22 bp, Homo sapiens
atgctacattttggtttataaa

SEQ ID NO: 8407234 - DNA, 22 bp, Homo sapiens
atgctacaggaagacgtcaggc

SEQ ID NO: 8407235 - DNA, 22 bp, Homo sapiens
atgctacaggaagacgtcaggc

SEQ ID NO: 8407236 - DNA, 22 bp, Homo sapiens
gaatttcagatcagagaccatt

SEQ ID NO: 8407237 - DNA, 22 bp, Homo sapiens
gaatttcaagcagtgcaatgtt

SEQ ID NO: 8407238 - DNA, 22 bp, Homo sapiens
atgccactgcacttcagcctgg

SEQ ID NO: 8407239 - DNA, 22 bp, Homo sapiens
atgacatggtgcagacagtgtc

SEQ ID NO: 8407240 - DNA, 22 bp, Homo sapiens
gaggaggggcacttgtctccta

SEQ ID NO: 8407241 - DNA, 22 bp, Homo sapiens
atgtagctggggaggttgagtc

SEQ ID NO: 8407242 - DNA, 22 bp, Homo sapiens
atgtagcttcctaggagtgatt

SEQ ID NO: 8407243 - DNA, 22 bp, Homo sapiens
atgggcagcagctgtcattttc

SEQ ID NO: 8407244 - DNA, 22 bp, Homo sapiens
atgggcagctgcagcagtggtg

SEQ ID NO: 8407245 - DNA, 22 bp, Homo sapiens
atgggcagcagctgccattcat

SEQ ID NO: 8407246 - DNA, 22 bp, Homo sapiens
atgggcaggcactggctctcag

SEQ ID NO: 8407247 - DNA, 22 bp, Homo sapiens
gaggagctgggtcagggagaca

SEQ ID NO: 8407248 - DNA, 22 bp, Homo sapiens
atgggcagctgcagcagtggtg

SEQ ID NO: 8407249 - DNA, 22 bp, Homo sapiens
gaggagggcctggtgtcccttc

SEQ ID NO: 8407250 - DNA, 22 bp, Homo sapiens
atgtatcagataaagcatgtgg

SEQ ID NO: 8407251 - DNA, 18 bp, Homo sapiens
atgtggctagtgctactg

SEQ ID NO: 8407252 - DNA, 21 bp, Homo sapiens
atgtcaggcacttatgaggaa

SEQ ID NO: 8407253 - DNA, 21 bp, Homo sapiens
atgtggccattgtagtccacg

SEQ ID NO: 8407254 - DNA, 22 bp, Homo sapiens
atggcagacctgggctggagaa

SEQ ID NO: 8407255 - DNA, 22 bp, Homo sapiens
atgggcagacagggagctcacg

SEQ ID NO: 8407256 - DNA, 22 bp, Homo sapiens
atgggcagagctggtgggaggc

SEQ ID NO: 8407257 - DNA, 22 bp, Homo sapiens
gagccccaggacagctctagtt

SEQ ID NO: 8407258 - DNA, 22 bp, Homo sapiens
atggcagaaaggcatgtgggcc

SEQ ID NO: 8407259 - DNA, 22 bp, Homo sapiens
atggcagaatatctgcatcgca

SEQ ID NO: 8407260 - DNA, 22 bp, Homo sapiens
atggatagtggtgaaggctgta

SEQ ID NO: 8407261 - DNA, 22 bp, Homo sapiens
atgctgtggggagtgagggtag

SEQ ID NO: 8407262 - DNA, 22 bp, Homo sapiens
atgctgtgtcctagtgaaagaa

SEQ ID NO: 8407263 - DNA, 22 bp, Homo sapiens
caagccatactgggtgaaatca

SEQ ID NO: 8407264 - DNA, 22 bp, Homo sapiens
gctgggctcagacctagtgaac

SEQ ID NO: 8407265 - DNA, 22 bp, Homo sapiens
gctgggctcaccaggccactag

SEQ ID NO: 8407266 - DNA, 22 bp, Homo sapiens
gctgggcttgtggccagctggg

SEQ ID NO: 8407267 - DNA, 22 bp, Homo sapiens
gctggggagcaagagtagtgag

SEQ ID NO: 8407268 - DNA, 22 bp, Homo sapiens
gctggaaatgaatggagaggtg

SEQ ID NO: 8407269 - DNA, 22 bp, Homo sapiens
gctggaaatcaaagaagtggat

SEQ ID NO: 8407270 - DNA, 22 bp, Homo sapiens
gctgccctgtctgcagcaggac

SEQ ID NO: 8407271 - DNA, 17 bp, Homo sapiens
gctgcctgcaactgact

SEQ ID NO: 8407272 - DNA, 22 bp, Homo sapiens
gctgcctgatttacatagtgaa

SEQ ID NO: 8407273 - DNA, 22 bp, Homo sapiens
caatagtgtctgcttgtttcta

SEQ ID NO: 8407274 - DNA, 22 bp, Homo sapiens
caatagctatgtaacctgaaga

SEQ ID NO: 8407275 - DNA, 22 bp, Homo sapiens
caatttcaatacaaaatacatt

SEQ ID NO: 8407276 - DNA, 22 bp, Homo sapiens
caatttcaggtggataggtttt

SEQ ID NO: 8407277 - DNA, 22 bp, Homo sapiens
caatttcatggataaaagatgt

SEQ ID NO: 8407278 - DNA, 22 bp, Homo sapiens
caatttcatcttgtgcttcaat

SEQ ID NO: 8407279 - DNA, 22 bp, Homo sapiens
caatttcattaatagatataga

SEQ ID NO: 8407280 - DNA, 22 bp, Homo sapiens
ggagaagggacagactcagctt

SEQ ID NO: 8407281 - DNA, 22 bp, Homo sapiens
ggaccagctatcaatgccaggg

SEQ ID NO: 8407282 - DNA, 22 bp, Homo sapiens
ggaccagcaatcaagaacctac

SEQ ID NO: 8407283 - DNA, 22 bp, Homo sapiens
cacaactgccagccaggaaagg

SEQ ID NO: 8407284 - DNA, 22 bp, Homo sapiens
ggctggcaagtcagtgctgatg

SEQ ID NO: 8407285 - DNA, 22 bp, Homo sapiens
cacttctgttgccttgtgcaat

SEQ ID NO: 8407286 - DNA, 22 bp, Homo sapiens
ggccaggctgccctgggagcag

SEQ ID NO: 8407287 - DNA, 22 bp, Homo sapiens
ggccaggctggtctcagacttc

SEQ ID NO: 8407288 - DNA, 22 bp, Homo sapiens
cactccagccatttgtccccag

SEQ ID NO: 8407289 - DNA, 22 bp, Homo sapiens
cactcagggtacaatggagggc

SEQ ID NO: 8407290 - DNA, 17 bp, Homo sapiens
cactagtagtctctggc

SEQ ID NO: 8407291 - DNA, 22 bp, Homo sapiens
ggccagggaggagaggcccctg

SEQ ID NO: 8407292 - DNA, 22 bp, Homo sapiens
cacatgaagattcaactggatg

SEQ ID NO: 8407293 - DNA, 22 bp, Homo sapiens
ggcagagtgctctgggcagggg

SEQ ID NO: 8407294 - DNA, 22 bp, Homo sapiens
ggcagagtcagaggtggttctg

SEQ ID NO: 8407295 - DNA, 22 bp, Homo sapiens
ggcagagttggtggagtcagtt

SEQ ID NO: 8407296 - DNA, 22 bp, Homo sapiens
ggcagagtggagtgcggcctcc

SEQ ID NO: 8407297 - DNA, 22 bp, Homo sapiens
ggcagatggaagaggctgggtc

SEQ ID NO: 8407298 - DNA, 22 bp, Homo sapiens
ggcaaggggtcaggctgagaca

SEQ ID NO: 8407299 - DNA, 21 bp, Homo sapiens
cacaggtgggtcagtgaggcc

SEQ ID NO: 8407300 - DNA, 22 bp, Homo sapiens
cacaggtgttcttgcagtgaaa

SEQ ID NO: 8407301 - DNA, 22 bp, Homo sapiens
cacaggtgctcctcggggagct

SEQ ID NO: 8407302 - DNA, 22 bp, Homo sapiens
cacaggtgcaagaagttgcagt

SEQ ID NO: 8407303 - DNA, 22 bp, Homo sapiens
gtgagagggctgggctcatgat

SEQ ID NO: 8407304 - DNA, 19 bp, Homo sapiens
cagccctcttaccactgtg

SEQ ID NO: 8407305 - DNA, 23 bp, Homo sapiens
gtgagcagcccactaggaatgcc

SEQ ID NO: 8407306 - DNA, 22 bp, Homo sapiens
cagcagccactagagggctcac

SEQ ID NO: 8407307 - DNA, 22 bp, Homo sapiens
cagcagccgagagggggctctg

SEQ ID NO: 8407308 - DNA, 22 bp, Homo sapiens
cagcagccctttggctgaactg

SEQ ID NO: 8407309 - DNA, 22 bp, Homo sapiens
cagcagcctacaatgcacagaa

SEQ ID NO: 8407310 - DNA, 19 bp, Homo sapiens
cagcagccagggggcccct

SEQ ID NO: 8407311 - DNA, 22 bp, Homo sapiens
gtaggctgtgtgaggctagaga

SEQ ID NO: 8407312 - DNA, 22 bp, Homo sapiens
gtactttaaatcaatgtagatt

SEQ ID NO: 8407313 - DNA, 22 bp, Homo sapiens
cagcagcctagaagctctacca

SEQ ID NO: 8407314 - DNA, 22 bp, Homo sapiens
gtccagagggctgcaggatgct

SEQ ID NO: 8407315 - DNA, 22 bp, Homo sapiens
cagccagctgtcccaagtgcct

SEQ ID NO: 8407316 - DNA, 22 bp, Homo sapiens
cagagccactgtctgccaggca

SEQ ID NO: 8407317 - DNA, 22 bp, Homo sapiens
cagagccagcagtggggacagg

SEQ ID NO: 8407318 - DNA, 22 bp, Homo sapiens
gggctggaggaccggcctcgga

SEQ ID NO: 8407319 - DNA, 22 bp, Homo sapiens
gggctggaggagatccagaggc

SEQ ID NO: 8407320 - DNA, 22 bp, Homo sapiens
gggctgtggagccgcgagggct

SEQ ID NO: 8407321 - DNA, 22 bp, Homo sapiens
gggctgtgctgagtaggaggtg

SEQ ID NO: 8407322 - DNA, 18 bp, Homo sapiens
gggctgtgagatgggaag

SEQ ID NO: 8407323 - DNA, 22 bp, Homo sapiens
gggctgtgagagtggggctgct

SEQ ID NO: 8407324 - DNA, 20 bp, Homo sapiens
ggggttggctggcacaggga

SEQ ID NO: 8407325 - DNA, 22 bp, Homo sapiens
cagatgagagtggccagggttc

SEQ ID NO: 8407326 - DNA, 19 bp, Homo sapiens
cagatgagaaaagtgaggt

SEQ ID NO: 8407327 - DNA, 23 bp, Homo sapiens
cagatgaggttggcagcatggtc

SEQ ID NO: 8407328 - DNA, 22 bp, Homo sapiens
ggtcacacaccaggacctgcag

SEQ ID NO: 8407329 - DNA, 22 bp, Homo sapiens
gggtgggatctgtggagcctca

SEQ ID NO: 8407330 - DNA, 22 bp, Homo sapiens
gggttaggttctagaggcacaa

SEQ ID NO: 8407331 - DNA, 22 bp, Homo sapiens
gggtccagtagttggtggccgt

SEQ ID NO: 8407332 - DNA, 22 bp, Homo sapiens
gggtaggaaatccagaggtggc

SEQ ID NO: 8407333 - DNA, 22 bp, Homo sapiens
gggaggcacgaggcgcgcagtg

SEQ ID NO: 8407334 - DNA, 22 bp, Homo sapiens
ggctggcactgaggagagctct

SEQ ID NO: 8407335 - DNA, 22 bp, Homo sapiens
cagagcagaaacctgggtgatt

SEQ ID NO: 8407336 - DNA, 22 bp, Homo sapiens
cagagccaacgccacctgccca

SEQ ID NO: 8407337 - DNA, 22 bp, Homo sapiens
cagagcaggggtttcccaggtt

SEQ ID NO: 8407338 - DNA, 20 bp, Homo sapiens
cagagcagtgcccaggcggc

SEQ ID NO: 8407339 - DNA, 22 bp, Homo sapiens
gggcaggggtcagtggccccaa

SEQ ID NO: 8407340 - DNA, 22 bp, Homo sapiens
gggcaggggtcagtggccccaa

SEQ ID NO: 8407341 - DNA, 22 bp, Homo sapiens
gggcaggtacaagatgcttctt

SEQ ID NO: 8407342 - DNA, 22 bp, Homo sapiens
gggcaggtactgggtggtgagc

SEQ ID NO: 8407343 - DNA, 22 bp, Homo sapiens
cagagcagaaggtccaagcctg

SEQ ID NO: 8407344 - DNA, 22 bp, Homo sapiens
cagagcagaagcggtcctcaca

SEQ ID NO: 8407345 - DNA, 18 bp, Homo sapiens
cagagcagaggtggagcg

SEQ ID NO: 8407346 - DNA, 22 bp, Homo sapiens
ccagcagctgctatgtggtttt

SEQ ID NO: 8407347 - DNA, 22 bp, Homo sapiens
ccagcagctgcaaagcctgggt

SEQ ID NO: 8407348 - DNA, 22 bp, Homo sapiens
ccagcagctccctcagggtccg

SEQ ID NO: 8407349 - DNA, 21 bp, Homo sapiens
ccagcagctcaaggatctctt

SEQ ID NO: 8407350 - DNA, 22 bp, Homo sapiens
ccagcagctcagctactggtca

SEQ ID NO: 8407351 - DNA, 22 bp, Homo sapiens
ccagcagctttattggctctcc

SEQ ID NO: 8407352 - DNA, 22 bp, Homo sapiens
ccagcagcaggccaggccctcc

SEQ ID NO: 8407353 - DNA, 22 bp, Homo sapiens
ccagcagcatcctgcagcactt

SEQ ID NO: 8407354 - DNA, 22 bp, Homo sapiens
ccagcagccagagaaggacctc

SEQ ID NO: 8407355 - DNA, 22 bp, Homo sapiens
ccagcagcccacaggcgtccct

SEQ ID NO: 8407356 - DNA, 22 bp, Homo sapiens
ccagcagcgatagggtgagtgc

SEQ ID NO: 8407357 - DNA, 22 bp, Homo sapiens
ccagccacagcttccagctcct

SEQ ID NO: 8407358 - DNA, 20 bp, Homo sapiens
ccagcatgtacacatgtgga

SEQ ID NO: 8407359 - DNA, 18 bp, Homo sapiens
ccagcatgccagaggctg

SEQ ID NO: 8407360 - DNA, 22 bp, Homo sapiens
ccacagtgattcacttttgaag

SEQ ID NO: 8407361 - DNA, 22 bp, Homo sapiens
ccaccgccatggcgttgtacag

SEQ ID NO: 8407362 - DNA, 22 bp, Homo sapiens
ccaccagaccaccaagagcaac

SEQ ID NO: 8407363 - DNA, 22 bp, Homo sapiens
ccaccagcagtgtgcaaggatt

SEQ ID NO: 8407364 - DNA, 22 bp, Homo sapiens
ccagagaggccaaggtcgtggt

SEQ ID NO: 8407365 - DNA, 19 bp, Homo sapiens
ccagagagctaggtacaga

SEQ ID NO: 8407366 - DNA, 22 bp, Homo sapiens
ccagagagagtactgggctctg

SEQ ID NO: 8407367 - DNA, 22 bp, Homo sapiens
tctccaggaaagacactggact

SEQ ID NO: 8407368 - DNA, 22 bp, Homo sapiens
ccagaaaaatcctcccttgtcc

SEQ ID NO: 8407369 - DNA, 23 bp, Homo sapiens
tctcaagaggaagcagggctcat

SEQ ID NO: 8407370 - DNA, 19 bp, Homo sapiens
tccccagcacctctgagtc

SEQ ID NO: 8407371 - DNA, 18 bp, Homo sapiens
tcctcagcctcacctagc

SEQ ID NO: 8407372 - DNA, 22 bp, Homo sapiens
tcctcaggatctaggagtgctt

SEQ ID NO: 8407373 - DNA, 22 bp, Homo sapiens
tccagagaaatctagtcttaca

SEQ ID NO: 8407374 - DNA, 22 bp, Homo sapiens
tccagaccatgtgagaggcgca

SEQ ID NO: 8407375 - DNA, 21 bp, Homo sapiens
tccagctgcacaagcatgggg

SEQ ID NO: 8407376 - DNA, 22 bp, Homo sapiens
tccagctgctgacccagtagcc

SEQ ID NO: 8407377 - DNA, 22 bp, Homo sapiens
tccagctggcccggccatgaat

SEQ ID NO: 8407378 - DNA, 22 bp, Homo sapiens
tccagctggcctaacttcaggg

SEQ ID NO: 8407379 - DNA, 20 bp, Homo sapiens
tccaagccctccttccattc

SEQ ID NO: 8407380 - DNA, 22 bp, Homo sapiens
caggctgcctggaagaggactg

SEQ ID NO: 8407381 - DNA, 22 bp, Homo sapiens
caggctggagtgcaatggcaca

SEQ ID NO: 8407382 - DNA, 22 bp, Homo sapiens
caggctggagtgcaatggtgct

SEQ ID NO: 8407383 - DNA, 22 bp, Homo sapiens
caggctggagtgcagtggcgcc

SEQ ID NO: 8407384 - DNA, 22 bp, Homo sapiens
caggctggagtgcagtggcgcc

SEQ ID NO: 8407385 - DNA, 22 bp, Homo sapiens
caggctggagtgcagtggcgct

SEQ ID NO: 8407386 - DNA, 22 bp, Homo sapiens
caggctggagtgcagtggcgct

SEQ ID NO: 8407387 - DNA, 22 bp, Homo sapiens
tagaatactagtgaagtcatcg

SEQ ID NO: 8407388 - DNA, 22 bp, Homo sapiens
gtgaggggccaagagtagggca

SEQ ID NO: 8407389 - DNA, 22 bp, Homo sapiens
gtgagggcagcttggtcagtgt

SEQ ID NO: 8407390 - DNA, 17 bp, Homo sapiens
gtgagggcagaggatgg

SEQ ID NO: 8407391 - DNA, 22 bp, Homo sapiens
tagaggaactgcctttcttctg

SEQ ID NO: 8407392 - DNA, 22 bp, Homo sapiens
tagaggaaccaggcaggctgag

SEQ ID NO: 8407393 - DNA, 22 bp, Homo sapiens
tagaggaaatttccaaggtgag

SEQ ID NO: 8407394 - DNA, 22 bp, Homo sapiens
caggctggtcccagagcattgc

SEQ ID NO: 8407395 - DNA, 22 bp, Homo sapiens
caggctgggctccggagataaa

SEQ ID NO: 8407396 - DNA, 21 bp, Homo sapiens
cagggcacacagaggatggta

SEQ ID NO: 8407397 - DNA, 22 bp, Homo sapiens
cagggcacagttatggaggtgg

SEQ ID NO: 8407398 - DNA, 22 bp, Homo sapiens
tagggtggagactggaagcagg

SEQ ID NO: 8407399 - DNA, 22 bp, Homo sapiens
tagggtgggcagttcttgggga

SEQ ID NO: 8407400 - DNA, 22 bp, Homo sapiens
tagggtggttagaaggagtatg

SEQ ID NO: 8407401 - DNA, 22 bp, Homo sapiens
tagggccatgtctgtcttgttc

SEQ ID NO: 8407402 - DNA, 22 bp, Homo sapiens
tagggccagttagggaagcttt

SEQ ID NO: 8407403 - DNA, 22 bp, Homo sapiens
tagggccagataggcttcttga

SEQ ID NO: 8407404 - DNA, 18 bp, Homo sapiens
tagggccaaaatggaaaa

SEQ ID NO: 8407405 - DNA, 22 bp, Homo sapiens
taggggttacctttagcatctc

SEQ ID NO: 8407406 - DNA, 22 bp, Homo sapiens
cagggtggcactcagcgcatct

SEQ ID NO: 8407407 - DNA, 22 bp, Homo sapiens
cagggtggcactcagcgcatct

SEQ ID NO: 8407408 - DNA, 22 bp, Homo sapiens
cagggtggcaggcaccatggcc

SEQ ID NO: 8407409 - DNA, 22 bp, Homo sapiens
cagggtggccaggtagataata

SEQ ID NO: 8407410 - DNA, 22 bp, Homo sapiens
cagggtggcaggcaccatggcc

SEQ ID NO: 8407411 - DNA, 22 bp, Homo sapiens
tagtgaaagtcaaagacagcta

SEQ ID NO: 8407412 - DNA, 22 bp, Homo sapiens
cagggctagggagccctcctgg

SEQ ID NO: 8407413 - DNA, 22 bp, Homo sapiens
cagggccttgttcaggagtgaa

SEQ ID NO: 8407414 - DNA, 22 bp, Homo sapiens
cagggcagccaggccccgtggg

SEQ ID NO: 8407415 - DNA, 22 bp, Homo sapiens
tcagcagccgcagctgactcag

SEQ ID NO: 8407416 - DNA, 23 bp, Homo sapiens
tcagcagcagaagtgctgggatg

SEQ ID NO: 8407417 - DNA, 22 bp, Homo sapiens
cagttacagagccagttagaga

SEQ ID NO: 8407418 - DNA, 22 bp, Homo sapiens
cagtgccatgtctgagccccta

SEQ ID NO: 8407419 - DNA, 22 bp, Homo sapiens
cagtgccatgatgcagagcaat

SEQ ID NO: 8407420 - DNA, 22 bp, Homo sapiens
cagtgccacaggaatggccaat

SEQ ID NO: 8407421 - DNA, 22 bp, Homo sapiens
cagtgccacttaatgaggctgc

SEQ ID NO: 8407422 - DNA, 22 bp, Homo sapiens
cagtgccaggagacaagatcag

SEQ ID NO: 8407423 - DNA, 21 bp, Homo sapiens
cagtgccagccacaggacgcc

SEQ ID NO: 8407424 - DNA, 22 bp, Homo sapiens
cagggtggggaaatagcgccct

SEQ ID NO: 8407425 - DNA, 22 bp, Homo sapiens
cagggtgggcacccagcctcca

SEQ ID NO: 8407426 - DNA, 22 bp, Homo sapiens
caggtgttaatcacttttaagc

SEQ ID NO: 8407427 - DNA, 22 bp, Homo sapiens
caggtgttaattgttggagcaa

SEQ ID NO: 8407428 - DNA, 22 bp, Homo sapiens
caggtgttatacatgaaattta

SEQ ID NO: 8407429 - DNA, 22 bp, Homo sapiens
cagggtggccctgtggtctcat

SEQ ID NO: 8407430 - DNA, 22 bp, Homo sapiens
caggtgttttttattctgaaag

SEQ ID NO: 8407431 - DNA, 22 bp, Homo sapiens
caggtgtttgtcaattccatcc

SEQ ID NO: 8407432 - DNA, 22 bp, Homo sapiens
caggtgtttcaatcccaagtca

SEQ ID NO: 8407433 - DNA, 22 bp, Homo sapiens
caggtgtttcctgaagttgatg

SEQ ID NO: 8407434 - DNA, 23 bp, Homo sapiens
caggtgttttacatatggtagtt

SEQ ID NO: 8407435 - DNA, 22 bp, Homo sapiens
caggttcattctttcttgtatt

SEQ ID NO: 8407436 - DNA, 22 bp, Homo sapiens
caggtgtttcaaatgtgaaact

SEQ ID NO: 8407437 - DNA, 22 bp, Homo sapiens
caggtgttgtctaaagcttcag

SEQ ID NO: 8407438 - DNA, 22 bp, Homo sapiens
caggtgtttaggtttcatggat

SEQ ID NO: 8407439 - DNA, 22 bp, Homo sapiens
caggtgttgggagaagagataa

SEQ ID NO: 8407440 - DNA, 22 bp, Homo sapiens
caggtgttggaagggcagtggg

SEQ ID NO: 8407441 - DNA, 22 bp, Homo sapiens
caggtgttgatactaatcgtgg

SEQ ID NO: 8407442 - DNA, 22 bp, Homo sapiens
caggtgttctggaaatcagcag

SEQ ID NO: 8407443 - DNA, 17 bp, Homo sapiens
caggtgttctgtttttc

SEQ ID NO: 8407444 - DNA, 22 bp, Homo sapiens
caggtgttcaagctggaggcca

SEQ ID NO: 8407445 - DNA, 22 bp, Homo sapiens
caggtgttctaagccgggcagt

SEQ ID NO: 8407446 - DNA, 22 bp, Homo sapiens
caggtgttgatgtttattgagt

SEQ ID NO: 8407447 - DNA, 22 bp, Homo sapiens
caggtgttgcagttgaagactg

SEQ ID NO: 8407448 - DNA, 22 bp, Homo sapiens
caggtgttgcctaaattgacaa

SEQ ID NO: 8407449 - DNA, 22 bp, Homo sapiens
cagtgaagttctactgaatggt

SEQ ID NO: 8407450 - DNA, 22 bp, Homo sapiens
cagtgaagtttaaagtgtagat

SEQ ID NO: 8407451 - DNA, 22 bp, Homo sapiens
cagtgagcacggccagagggga

SEQ ID NO: 8407452 - DNA, 22 bp, Homo sapiens
cagtgagctcatggccaagtca

SEQ ID NO: 8407453 - DNA, 22 bp, Homo sapiens
cagtgaggaagctgtctggacc

SEQ ID NO: 8407454 - DNA, 20 bp, Homo sapiens
tcacaggagggaaggcaggt

SEQ ID NO: 8407455 - DNA, 22 bp, Homo sapiens
tgaaaggcagttagaggtgttt

SEQ ID NO: 8407456 - DNA, 22 bp, Homo sapiens
ccaggctcctcatgatcttgtt

SEQ ID NO: 8407457 - DNA, 22 bp, Homo sapiens
ccaggctccgcatagaccccac

SEQ ID NO: 8407458 - DNA, 22 bp, Homo sapiens
tcttgtctaggacagtgatgtg

SEQ ID NO: 8407459 - DNA, 22 bp, Homo sapiens
ccagcctcactggcatcaccta

SEQ ID NO: 8407460 - DNA, 17 bp, Homo sapiens
ccaggctataccaggct

SEQ ID NO: 8407461 - DNA, 22 bp, Homo sapiens
ccaggctagagtgcagtggcgt

SEQ ID NO: 8407462 - DNA, 22 bp, Homo sapiens
ccaggctagagtgcagtggcat

SEQ ID NO: 8407463 - DNA, 22 bp, Homo sapiens
ccaggctagagagcagtggcat

SEQ ID NO: 8407464 - DNA, 22 bp, Homo sapiens
ccaggctagagagcagtggcac

SEQ ID NO: 8407465 - DNA, 17 bp, Homo sapiens
ccaggctccatcactgt

SEQ ID NO: 8407466 - DNA, 22 bp, Homo sapiens
tctttatttaagtctgttgtaa

SEQ ID NO: 8407467 - DNA, 22 bp, Homo sapiens
tctttatttctgaatcccccat

SEQ ID NO: 8407468 - DNA, 22 bp, Homo sapiens
tctttattttatgcttgtgcaa

SEQ ID NO: 8407469 - DNA, 22 bp, Homo sapiens
ccaggctacacatcagatgagt

SEQ ID NO: 8407470 - DNA, 22 bp, Homo sapiens
ccaggctagaaactgaggcaca

SEQ ID NO: 8407471 - DNA, 22 bp, Homo sapiens
tgaggacattgagactggagac

SEQ ID NO: 8407472 - DNA, 22 bp, Homo sapiens
tgaggacatttatcttggcgca

SEQ ID NO: 8407473 - DNA, 23 bp, Homo sapiens
ccagtggcgtaaactagaggata

SEQ ID NO: 8407474 - DNA, 23 bp, Homo sapiens
tgagcacctaatgctgggcactg

SEQ ID NO: 8407475 - DNA, 22 bp, Homo sapiens
ccagggtggcgtagatgctggg

SEQ ID NO: 8407476 - DNA, 22 bp, Homo sapiens
ccagggtgtagggattccagat

SEQ ID NO: 8407477 - DNA, 22 bp, Homo sapiens
ccaggtaacttgagaacatgag

SEQ ID NO: 8407478 - DNA, 22 bp, Homo sapiens
ccagggccaagagacctcgagg

SEQ ID NO: 8407479 - DNA, 22 bp, Homo sapiens
tgacagagtcggggcaagctgt

SEQ ID NO: 8407480 - DNA, 23 bp, Homo sapiens
ccagggcccctacaccactgtcc

SEQ ID NO: 8407481 - DNA, 22 bp, Homo sapiens
tgaccatggtgtgccctgtgcg

SEQ ID NO: 8407482 - DNA, 22 bp, Homo sapiens
tgactttacagatatgtttcct

SEQ ID NO: 8407483 - DNA, 22 bp, Homo sapiens
cccaaccagaaattgacagaca

SEQ ID NO: 8407484 - DNA, 22 bp, Homo sapiens
cccaaccagaaattgacagaga

SEQ ID NO: 8407485 - DNA, 22 bp, Homo sapiens
tgattatattctaacttcataa

SEQ ID NO: 8407486 - DNA, 22 bp, Homo sapiens
tgattatattaactatgttcct

SEQ ID NO: 8407487 - DNA, 22 bp, Homo sapiens
ccatggccgccgctgctcagga

SEQ ID NO: 8407488 - DNA, 22 bp, Homo sapiens
ccatggccaggaaagccaaggt

SEQ ID NO: 8407489 - DNA, 22 bp, Homo sapiens
tgaggcagtattctccattcca

SEQ ID NO: 8407490 - DNA, 22 bp, Homo sapiens
tgaggcaggtggattacaaggt

SEQ ID NO: 8407491 - DNA, 22 bp, Homo sapiens
tgaggcaggtaagcaagttttg

SEQ ID NO: 8407492 - DNA, 22 bp, Homo sapiens
tgaggcagtcaccccctcctgc

SEQ ID NO: 8407493 - DNA, 22 bp, Homo sapiens
tgaggcagtattttagtgactt

SEQ ID NO: 8407494 - DNA, 22 bp, Homo sapiens
tgatgaccgccaacgtttaggt

SEQ ID NO: 8407495 - DNA, 22 bp, Homo sapiens
tgaggcagtgatgtttaagcac

SEQ ID NO: 8407496 - DNA, 18 bp, Homo sapiens
tgaggcagtcagtgatgg

SEQ ID NO: 8407497 - DNA, 22 bp, Homo sapiens
tgaggcagtgctgggaagcctg

SEQ ID NO: 8407498 - DNA, 22 bp, Homo sapiens
tgcagcaggttccaaagggtta

SEQ ID NO: 8407499 - DNA, 23 bp, Homo sapiens
cccagcagagatgaggaggggtc

SEQ ID NO: 8407500 - DNA, 22 bp, Homo sapiens
cccagcagaccgctgtgatggc

SEQ ID NO: 8407501 - DNA, 22 bp, Homo sapiens
cccagagagcatttggacaaag

SEQ ID NO: 8407502 - DNA, 22 bp, Homo sapiens
cccacccagcctggctgagggg

SEQ ID NO: 8407503 - DNA, 23 bp, Homo sapiens
cccacatgtctgagtcagtgcca

SEQ ID NO: 8407504 - DNA, 22 bp, Homo sapiens
cccaggagatctggatctcgtc

SEQ ID NO: 8407505 - DNA, 22 bp, Homo sapiens
tgccctcagtttcacatgagtg

SEQ ID NO: 8407506 - DNA, 22 bp, Homo sapiens
tgccctcattataagaggctca

SEQ ID NO: 8407507 - DNA, 22 bp, Homo sapiens
tgccctggttctgtgggtgagc

SEQ ID NO: 8407508 - DNA, 22 bp, Homo sapiens
tgcagtgctttggaacaaagtc

SEQ ID NO: 8407509 - DNA, 22 bp, Homo sapiens
tgcagtgcagctggaatatctt

SEQ ID NO: 8407510 - DNA, 22 bp, Homo sapiens
tgcagtgcagctggaagttggc

SEQ ID NO: 8407511 - DNA, 22 bp, Homo sapiens
tgcagtgcctcggcagtgcagc

SEQ ID NO: 8407512 - DNA, 22 bp, Homo sapiens
tgcagcagtttaatgcagggtt

SEQ ID NO: 8407513 - DNA, 22 bp, Homo sapiens
tgggagcctggcaggccagagg

SEQ ID NO: 8407514 - DNA, 21 bp, Homo sapiens
tgggccagatctgagtttcta

SEQ ID NO: 8407515 - DNA, 22 bp, Homo sapiens
tgggccagaggcatggagctat

SEQ ID NO: 8407516 - DNA, 22 bp, Homo sapiens
tgggccagagagtaagaaaggt

SEQ ID NO: 8407517 - DNA, 22 bp, Homo sapiens
tgggggagagaggcattctttc

SEQ ID NO: 8407518 - DNA, 22 bp, Homo sapiens
tggtctgaactaagacagtagt

SEQ ID NO: 8407519 - DNA, 22 bp, Homo sapiens
tggtctgaggaacaccagcact

SEQ ID NO: 8407520 - DNA, 22 bp, Homo sapiens
tgggtcagagctgtgctgccca

SEQ ID NO: 8407521 - DNA, 22 bp, Homo sapiens
tgggtcagaatcagagagttgc

SEQ ID NO: 8407522 - DNA, 22 bp, Homo sapiens
tgggtcagacagccagtgggcc

SEQ ID NO: 8407523 - DNA, 22 bp, Homo sapiens
tgggtcagacagccagtgggcc

SEQ ID NO: 8407524 - DNA, 22 bp, Homo sapiens
tgggtcagtttgggggccagcc

SEQ ID NO: 8407525 - DNA, 22 bp, Homo sapiens
tgggtcaggctgggagtcctga

SEQ ID NO: 8407526 - DNA, 22 bp, Homo sapiens
tgtacatacatagatatacaca

SEQ ID NO: 8407527 - DNA, 22 bp, Homo sapiens
tgtacatatatgtatgtacgca

SEQ ID NO: 8407528 - DNA, 22 bp, Homo sapiens
tgtcaagtctagttgctggctt

SEQ ID NO: 8407529 - DNA, 22 bp, Homo sapiens
cctggaggggaccaggaccagg

SEQ ID NO: 8407530 - DNA, 22 bp, Homo sapiens
tggctcagcggtggcagcagac

SEQ ID NO: 8407531 - DNA, 22 bp, Homo sapiens
tggctcagcggtggcagcagac

SEQ ID NO: 8407532 - DNA, 23 bp, Homo sapiens
tggctcagctagttttccatttc

SEQ ID NO: 8407533 - DNA, 22 bp, Homo sapiens
tggctcagcgcggcctggtctt

SEQ ID NO: 8407534 - DNA, 22 bp, Homo sapiens
tggctcagccattcgtgttgcc

SEQ ID NO: 8407535 - DNA, 22 bp, Homo sapiens
tggctcagcctggccctttcat

SEQ ID NO: 8407536 - DNA, 22 bp, Homo sapiens
tggcctcggcatccagcaagag

SEQ ID NO: 8407537 - DNA, 22 bp, Homo sapiens
tggcctcaagtctgagggcctt

SEQ ID NO: 8407538 - DNA, 22 bp, Homo sapiens
tggcctcaagtctgagggcctt

SEQ ID NO: 8407539 - DNA, 22 bp, Homo sapiens
tggcctcagatttcaggggtgg

SEQ ID NO: 8407540 - DNA, 22 bp, Homo sapiens
cctcagaagactttagggaaga

SEQ ID NO: 8407541 - DNA, 22 bp, Homo sapiens
cctcacccagtcacctaggtgg

SEQ ID NO: 8407542 - DNA, 22 bp, Homo sapiens
cctcacagccctcctctagcac

SEQ ID NO: 8407543 - DNA, 22 bp, Homo sapiens
ccctggagctgcttgcatgttg

SEQ ID NO: 8407544 - DNA, 22 bp, Homo sapiens
tggaggtgagtgtggtacagca

SEQ ID NO: 8407545 - DNA, 22 bp, Homo sapiens
tggaggtcttacccagggctat

SEQ ID NO: 8407546 - DNA, 22 bp, Homo sapiens
ccctgccttggggtccacaccg

SEQ ID NO: 8407547 - DNA, 22 bp, Homo sapiens
tggacaggttgagtaggaggag

SEQ ID NO: 8407548 - DNA, 22 bp, Homo sapiens
tggacaggttgagtaggaggag

SEQ ID NO: 8407549 - DNA, 22 bp, Homo sapiens
tggacaggtgcacacagcagcc

SEQ ID NO: 8407550 - DNA, 22 bp, Homo sapiens
tgcctcagtttctccatatgaa

SEQ ID NO: 8407551 - DNA, 22 bp, Homo sapiens
ctggaaggagaaggaggctgtg

SEQ ID NO: 8407552 - DNA, 22 bp, Homo sapiens
ctggaaagtgcatgtaatgagg

SEQ ID NO: 8407553 - DNA, 22 bp, Homo sapiens
ctggaaagtgcttttctgagag

SEQ ID NO: 8407554 - DNA, 22 bp, Homo sapiens
ctggaagggtcagagtgatgag

SEQ ID NO: 8407555 - DNA, 22 bp, Homo sapiens
ctggaagggtcagagtgatgag

SEQ ID NO: 8407556 - DNA, 22 bp, Homo sapiens
ctggaaggtaacaaggccatta

SEQ ID NO: 8407557 - DNA, 22 bp, Homo sapiens
ctggaagggggacagccacaca

SEQ ID NO: 8407558 - DNA, 22 bp, Homo sapiens
ctggagatgtccgggtgctgtt

SEQ ID NO: 8407559 - DNA, 22 bp, Homo sapiens
ctggagagttggaagatggact

SEQ ID NO: 8407560 - DNA, 22 bp, Homo sapiens
ctggagagggagccctggcagt

SEQ ID NO: 8407561 - DNA, 22 bp, Homo sapiens
ctgctgaacctttgctagataa

SEQ ID NO: 8407562 - DNA, 22 bp, Homo sapiens
ctgctgagagctgaaggctgta

SEQ ID NO: 8407563 - DNA, 22 bp, Homo sapiens
ctgctgagatgccaggagctct

SEQ ID NO: 8407564 - DNA, 22 bp, Homo sapiens
ctgcaggaatctgtgctaggtg

SEQ ID NO: 8407565 - DNA, 22 bp, Homo sapiens
ctgcaggactgaaagatgaggt

SEQ ID NO: 8407566 - DNA, 22 bp, Homo sapiens
ctgcaggaattcaaagtgagct

SEQ ID NO: 8407567 - DNA, 16 bp, Homo sapiens
ctgaggtttggccaca

SEQ ID NO: 8407568 - DNA, 22 bp, Homo sapiens
ctgcaggaggatcctgagagtg

SEQ ID NO: 8407569 - DNA, 22 bp, Homo sapiens
ctgcaggagggctggggaagcc

SEQ ID NO: 8407570 - DNA, 22 bp, Homo sapiens
ctgcaggagtgaaagcaggcct

SEQ ID NO: 8407571 - DNA, 22 bp, Homo sapiens
ctgcccatctgcagacatgcgt

SEQ ID NO: 8407572 - DNA, 22 bp, Homo sapiens
ctgaggctggagtgcagtggtg

SEQ ID NO: 8407573 - DNA, 22 bp, Homo sapiens
tttgcaaagtccattgaagtta

SEQ ID NO: 8407574 - DNA, 22 bp, Homo sapiens
tttgcaaagtgcttgcagagta

SEQ ID NO: 8407575 - DNA, 22 bp, Homo sapiens
tttgcaaactttcctctggacc

SEQ ID NO: 8407576 - DNA, 22 bp, Homo sapiens
ctctgtgggccagagaggcccc

SEQ ID NO: 8407577 - DNA, 17 bp, Homo sapiens
ctctgtggaggtgttta

SEQ ID NO: 8407578 - DNA, 22 bp, Homo sapiens
ctccttcctgcagatctgagat

SEQ ID NO: 8407579 - DNA, 22 bp, Homo sapiens
ctccttcccatgagtgtgggca

SEQ ID NO: 8407580 - DNA, 22 bp, Homo sapiens
ctcagggaagctatggtgaggg

SEQ ID NO: 8407581 - DNA, 19 bp, Homo sapiens
ctcagctgtagctcatgtg

SEQ ID NO: 8407582 - DNA, 22 bp, Homo sapiens
ctcaggagacagtgtccacatg

SEQ ID NO: 8407583 - DNA, 22 bp, Homo sapiens
ctcactgcaacctctgcctccc

SEQ ID NO: 8407584 - DNA, 22 bp, Homo sapiens
cgggcaaggcgagactaggccc

SEQ ID NO: 8407585 - DNA, 22 bp, Homo sapiens
cgggctggctgcagctgctgga

SEQ ID NO: 8407586 - DNA, 22 bp, Homo sapiens
cggggccctggggctgaaggtc

SEQ ID NO: 8407587 - DNA, 22 bp, Homo sapiens
cgtgagcaaaatggacactccc

SEQ ID NO: 8407588 - DNA, 22 bp, Homo sapiens
cgagagttagctaggagtcaca

SEQ ID NO: 8407589 - DNA, 22 bp, Homo sapiens
cgctccttgagcgtgtcggcct

SEQ ID NO: 8407590 - DNA, 22 bp, Homo sapiens
ttacagtttacataagaattgt

SEQ ID NO: 8407591 - DNA, 22 bp, Homo sapiens
ttacagtttctagtaatacttg

SEQ ID NO: 8407592 - DNA, 22 bp, Homo sapiens
ctgtgggtgaagacaagggaga

SEQ ID NO: 8407593 - DNA, 22 bp, Homo sapiens
ctgtgggtattaaaaatgaatt

SEQ ID NO: 8407594 - DNA, 22 bp, Homo sapiens
ctgtgggtggctgtgccccagg

SEQ ID NO: 8407595 - DNA, 19 bp, Homo sapiens
ctgtgggcggaggaggggc

SEQ ID NO: 8407596 - DNA, 22 bp, Homo sapiens
ctgtgaggcctttggccagata

SEQ ID NO: 8407597 - DNA, 22 bp, Homo sapiens
ctgtgaggcggaaaggactctc

SEQ ID NO: 8407598 - DNA, 22 bp, Homo sapiens
ctgggctcagtggctcatggct

SEQ ID NO: 8407599 - DNA, 22 bp, Homo sapiens
ctgggctcagcaggccaaggcc

SEQ ID NO: 8407600 - DNA, 22 bp, Homo sapiens
ctgggctctaagggagcaccgt

SEQ ID NO: 8407601 - DNA, 22 bp, Homo sapiens
ctgggctctagaaaggaaagaa

SEQ ID NO: 8407602 - DNA, 20 bp, Homo sapiens
ctgggctcggtggccctggc

SEQ ID NO: 8407603 - DNA, 22 bp, Homo sapiens
ctggggtggatgggtccaagtt

SEQ ID NO: 8407604 - DNA, 22 bp, Homo sapiens
ctggtagtgtctgccgaggtcc

SEQ ID NO: 8407605 - DNA, 22 bp, Homo sapiens
cttcccagcacctcagtctggc

SEQ ID NO: 8407606 - DNA, 22 bp, Homo sapiens
gaggctagagcaggggctcaat

SEQ ID NO: 8407607 - DNA, 22 bp, Homo sapiens
gaggcgagaagctggagatggt

SEQ ID NO: 8407608 - DNA, 22 bp, Homo sapiens
gaggctgtaacttgggcactgg

SEQ ID NO: 8407609 - DNA, 22 bp, Homo sapiens
gagggccagaaagttattgaga

SEQ ID NO: 8407610 - DNA, 22 bp, Homo sapiens
gagggccacttgaatgttttca

SEQ ID NO: 8407611 - DNA, 22 bp, Homo sapiens
gagggccacgttcagggctctc

SEQ ID NO: 8407612 - DNA, 22 bp, Homo sapiens
gagggccagatcccaggaggaa

SEQ ID NO: 8407613 - DNA, 22 bp, Homo sapiens
gagggccagagtcctggggtca

SEQ ID NO: 8407614 - DNA, 22 bp, Homo sapiens
gagggccagcagcctcagcatg

SEQ ID NO: 8407615 - DNA, 22 bp, Homo sapiens
gagggccagcctgccaagggcc

SEQ ID NO: 8407616 - DNA, 22 bp, Homo sapiens
gagggccaggcggagacaggcg

SEQ ID NO: 8407617 - DNA, 22 bp, Homo sapiens
gagggccaggtagatatcagga

SEQ ID NO: 8407618 - DNA, 22 bp, Homo sapiens
gagggccaggcagcaagaaggc

SEQ ID NO: 8407619 - DNA, 22 bp, Homo sapiens
gagggccattctgagggggtga

SEQ ID NO: 8407620 - DNA, 22 bp, Homo sapiens
gaggtggctggctcagagccag

SEQ ID NO: 8407621 - DNA, 22 bp, Homo sapiens
gaggtggctccttcagggaata

SEQ ID NO: 8407622 - DNA, 22 bp, Homo sapiens
gaggtgagaagggggtcagatg

SEQ ID NO: 8407623 - DNA, 22 bp, Homo sapiens
gaggtgctgctgtacttcttgc

SEQ ID NO: 8407624 - DNA, 19 bp, Homo sapiens
gaggtgtctttcctgagta

SEQ ID NO: 8407625 - DNA, 22 bp, Homo sapiens
gagggtggggaatagactgcta

SEQ ID NO: 8407626 - DNA, 22 bp, Homo sapiens
gagggtgggccagatatgaggg

SEQ ID NO: 8407627 - DNA, 22 bp, Homo sapiens
gagggtgggccagatatgaggg

SEQ ID NO: 8407628 - DNA, 22 bp, Homo sapiens
gagggtgggtttcttgcacgtc

SEQ ID NO: 8407629 - DNA, 22 bp, Homo sapiens
gagggtggtggcttaaggtgct

SEQ ID NO: 8407630 - DNA, 22 bp, Homo sapiens
gagggtggtggcttaaggtgct

SEQ ID NO: 8407631 - DNA, 22 bp, Homo sapiens
gagggtggtggcttaaggtgct

SEQ ID NO: 8407632 - DNA, 22 bp, Homo sapiens
gaggtctgccttcaggagagtt

SEQ ID NO: 8407633 - DNA, 22 bp, Homo sapiens
gagggtggaaagggtgtacctg

SEQ ID NO: 8407634 - DNA, 22 bp, Homo sapiens
gagggtgctgtgccaagatgac

SEQ ID NO: 8407635 - DNA, 22 bp, Homo sapiens
gagggtgctctgagcccttttg

SEQ ID NO: 8407636 - DNA, 22 bp, Homo sapiens
gagggtgcatgtgagattccta

SEQ ID NO: 8407637 - DNA, 22 bp, Homo sapiens
gagggtgcaggcaagagcaaaa

SEQ ID NO: 8407638 - DNA, 22 bp, Homo sapiens
gagggtgacagttctggtctct

SEQ ID NO: 8407639 - DNA, 22 bp, Homo sapiens
gagggtgcagctgggccccacg

SEQ ID NO: 8407640 - DNA, 22 bp, Homo sapiens
gagggtgcaggaggatggtagt

SEQ ID NO: 8407641 - DNA, 22 bp, Homo sapiens
gagggtggcctttagagcccat

SEQ ID NO: 8407642 - DNA, 22 bp, Homo sapiens
gagggtggcctttagagcccat

SEQ ID NO: 8407643 - DNA, 22 bp, Homo sapiens
gagggtggctcctccctgggcc

SEQ ID NO: 8407644 - DNA, 22 bp, Homo sapiens
gagggtggctcctccctgggcc

SEQ ID NO: 8407645 - DNA, 22 bp, Homo sapiens
gagggtggaagagctgctgaga

SEQ ID NO: 8407646 - DNA, 22 bp, Homo sapiens
gagggtggaagagctgctgaga

SEQ ID NO: 8407647 - DNA, 22 bp, Homo sapiens
gagggtggatcagcctgattgg

SEQ ID NO: 8407648 - DNA, 22 bp, Homo sapiens
gagggtggagctccagaatctg

SEQ ID NO: 8407649 - DNA, 22 bp, Homo sapiens
gaggccagaatgagtctctggg

SEQ ID NO: 8407650 - DNA, 22 bp, Homo sapiens
gaggccagatactctcttctgc

SEQ ID NO: 8407651 - DNA, 22 bp, Homo sapiens
gaggcctggaattccagcctgg

SEQ ID NO: 8407652 - DNA, 22 bp, Homo sapiens
gaggccagaagtgcctcgggct

SEQ ID NO: 8407653 - DNA, 22 bp, Homo sapiens
gaggccacttcctactggagga

SEQ ID NO: 8407654 - DNA, 22 bp, Homo sapiens
gaggccagaagtctgagatcag

SEQ ID NO: 8407655 - DNA, 22 bp, Homo sapiens
gaggatgtgtctggtctgggca

SEQ ID NO: 8407656 - DNA, 22 bp, Homo sapiens
gaggcatgcagagctggagcag

SEQ ID NO: 8407657 - DNA, 22 bp, Homo sapiens
gaggcatgcagagctggagcag

SEQ ID NO: 8407658 - DNA, 22 bp, Homo sapiens
gaggcatggcctgaggctagga

SEQ ID NO: 8407659 - DNA, 22 bp, Homo sapiens
gaggcatggcctgaggctagga

SEQ ID NO: 8407660 - DNA, 22 bp, Homo sapiens
gaggccacggttttccttgggg

SEQ ID NO: 8407661 - DNA, 22 bp, Homo sapiens
gaggacatagtggactagggtt

SEQ ID NO: 8407662 - DNA, 22 bp, Homo sapiens
gaggacatagtccagatggcaa

SEQ ID NO: 8407663 - DNA, 22 bp, Homo sapiens
gaggagagaagctaacggtgct

SEQ ID NO: 8407664 - DNA, 22 bp, Homo sapiens
gaggagtctttttagggcctga

SEQ ID NO: 8407665 - DNA, 22 bp, Homo sapiens
gaggagtctagtttatggcttc

SEQ ID NO: 8407666 - DNA, 22 bp, Homo sapiens
gaggagtgccagccgtggagtc

SEQ ID NO: 8407667 - DNA, 22 bp, Homo sapiens
gaggagtggagttgctgggttg

SEQ ID NO: 8407668 - DNA, 22 bp, Homo sapiens
gaggagtggagttgctgggttg

SEQ ID NO: 8407669 - DNA, 22 bp, Homo sapiens
gaggaggtggagtcatgcagag

SEQ ID NO: 8407670 - DNA, 22 bp, Homo sapiens
gaggagtgggttagtgcttatt

SEQ ID NO: 8407671 - DNA, 22 bp, Homo sapiens
gagctcagggcattgagcaaga

SEQ ID NO: 8407672 - DNA, 22 bp, Homo sapiens
gagctcagcaaaggtctgtgtg

SEQ ID NO: 8407673 - DNA, 22 bp, Homo sapiens
gagcaggcctggggtgaggcct

SEQ ID NO: 8407674 - DNA, 22 bp, Homo sapiens
gagctgggattcatctatgtct

SEQ ID NO: 8407675 - DNA, 22 bp, Homo sapiens
gagctgggatttgaacctggga

SEQ ID NO: 8407676 - DNA, 18 bp, Homo sapiens
gagaggagccagaatttt

SEQ ID NO: 8407677 - DNA, 22 bp, Homo sapiens
gagcagagcttctcaaagtaaa

SEQ ID NO: 8407678 - DNA, 18 bp, Homo sapiens
gagcagaggctcaactgg

SEQ ID NO: 8407679 - DNA, 22 bp, Homo sapiens
gagcagagaatccagctaagtg

SEQ ID NO: 8407680 - DNA, 22 bp, Homo sapiens
gagatttaggggggaagatacg

SEQ ID NO: 8407681 - DNA, 22 bp, Homo sapiens
gagaggcaggaatcctgggtga

SEQ ID NO: 8407682 - DNA, 22 bp, Homo sapiens
gagcaagattaaaaggctgggt

SEQ ID NO: 8407683 - DNA, 22 bp, Homo sapiens
gagcacagatcctggagccaca

SEQ ID NO: 8407684 - DNA, 22 bp, Homo sapiens
gacatgtacttcaatttctctt

SEQ ID NO: 8407685 - DNA, 22 bp, Homo sapiens
gactaggggcagcgtgggagct

SEQ ID NO: 8407686 - DNA, 17 bp, Homo sapiens
gacagctggttcctggc

SEQ ID NO: 8407687 - DNA, 22 bp, Homo sapiens
gaatgcagatggctggtgtatg

SEQ ID NO: 8407688 - DNA, 22 bp, Homo sapiens
gaagaaggtgccagaggcttac

SEQ ID NO: 8407689 - DNA, 22 bp, Homo sapiens
gaagaaggtggcccaggggtag

SEQ ID NO: 8407690 - DNA, 22 bp, Homo sapiens
tcccaggctggggccaggtgac

SEQ ID NO: 8407691 - DNA, 20 bp, Homo sapiens
tcccaggctccaccctagac

SEQ ID NO: 8407692 - DNA, 22 bp, Homo sapiens
tcccaggctcttcaaggaagac

SEQ ID NO: 8407693 - DNA, 22 bp, Homo sapiens
tcccaggcaggtgacaggggga

SEQ ID NO: 8407694 - DNA, 22 bp, Homo sapiens
tcccagcctcctgacagttttg

SEQ ID NO: 8407695 - DNA, 22 bp, Homo sapiens
tcccagcccaggtatgatgata

SEQ ID NO: 8407696 - DNA, 22 bp, Homo sapiens
tccaggctagaagtcacaggcc

SEQ ID NO: 8407697 - DNA, 18 bp, Homo sapiens
tccagggcttcctcctct

SEQ ID NO: 8407698 - DNA, 22 bp, Homo sapiens
tcctgcagccactgcaggcaga

SEQ ID NO: 8407699 - DNA, 22 bp, Homo sapiens
tccaaccaaaaatgacaatgtg

SEQ ID NO: 8407700 - DNA, 22 bp, Homo sapiens
tcatttaataatttttgagtag

SEQ ID NO: 8407701 - DNA, 22 bp, Homo sapiens
tcatttacaggtgaagcaacta

SEQ ID NO: 8407702 - DNA, 22 bp, Homo sapiens
tcagtaaataactcagatgctc

SEQ ID NO: 8407703 - DNA, 22 bp, Homo sapiens
tcagtaaacaggtttaagtcct

SEQ ID NO: 8407704 - DNA, 22 bp, Homo sapiens
tcagtaaaggctaggttatgct

SEQ ID NO: 8407705 - DNA, 22 bp, Homo sapiens
tcagtaaaggggaggtgatggg

SEQ ID NO: 8407706 - DNA, 22 bp, Homo sapiens
tcagtaaatgcttgcaggccga

SEQ ID NO: 8407707 - DNA, 22 bp, Homo sapiens
tcagggcaggcgagcagctgct

SEQ ID NO: 8407708 - DNA, 22 bp, Homo sapiens
tcagccagaggcttcttggttt

SEQ ID NO: 8407709 - DNA, 22 bp, Homo sapiens
tcagccagctgtgtgcttctgc

SEQ ID NO: 8407710 - DNA, 22 bp, Homo sapiens
tcagccagctcttggactctga

SEQ ID NO: 8407711 - DNA, 22 bp, Homo sapiens
tcagccaggcagccccctggtc

SEQ ID NO: 8407712 - DNA, 22 bp, Homo sapiens
tcaggaagtataatcagattca

SEQ ID NO: 8407713 - DNA, 22 bp, Homo sapiens
tcaggaagggtggtccacaggg

SEQ ID NO: 8407714 - DNA, 22 bp, Homo sapiens
tcagctggtgagtggatagaca

SEQ ID NO: 8407715 - DNA, 22 bp, Homo sapiens
tcagctggtgaatggactcatc

SEQ ID NO: 8407716 - DNA, 18 bp, Homo sapiens
tcagctggggctgcagcc

SEQ ID NO: 8407717 - DNA, 22 bp, Homo sapiens
tcagctggaagatggtgcagaa

SEQ ID NO: 8407718 - DNA, 22 bp, Homo sapiens
tcagctggagactgctcaatga

SEQ ID NO: 8407719 - DNA, 22 bp, Homo sapiens
tcagctggagatgagaaccgaa

SEQ ID NO: 8407720 - DNA, 19 bp, Homo sapiens
tcagctggcaggcctcctc

SEQ ID NO: 8407721 - DNA, 22 bp, Homo sapiens
tcagctggatgtggaagtgcta

SEQ ID NO: 8407722 - DNA, 22 bp, Homo sapiens
tcagctggcagttcagaggctg

SEQ ID NO: 8407723 - DNA, 22 bp, Homo sapiens
tcaggacagagatcagaacttc

SEQ ID NO: 8407724 - DNA, 22 bp, Homo sapiens
tcaggacaggttcgggtgggta

SEQ ID NO: 8407725 - DNA, 22 bp, Homo sapiens
tcaggacagccagggtgcagac

SEQ ID NO: 8407726 - DNA, 22 bp, Homo sapiens
tcaggagaatcagggctgtcct

SEQ ID NO: 8407727 - DNA, 22 bp, Homo sapiens
tcaggagactggcagtgcccac

SEQ ID NO: 8407728 - DNA, 22 bp, Homo sapiens
tcagagtgtgacttggtcatga

SEQ ID NO: 8407729 - DNA, 22 bp, Homo sapiens
tcagaacaggactggctgccat

SEQ ID NO: 8407730 - DNA, 22 bp, Homo sapiens
tcactgcaacctccacctcctg

SEQ ID NO: 8407731 - DNA, 22 bp, Homo sapiens
tcagaaaatgaaatggactctc

SEQ ID NO: 8407732 - DNA, 22 bp, Homo sapiens
tcactgcaacctccacctcccg

SEQ ID NO: 8407733 - DNA, 22 bp, Homo sapiens
tcaaccatccggcttatcctgc

SEQ ID NO: 8407734 - DNA, 22 bp, Homo sapiens
tcacatttctcagcactgatga

SEQ ID NO: 8407735 - DNA, 22 bp, Homo sapiens
tagagtaacacaaacgaattgg

SEQ ID NO: 8407736 - DNA, 22 bp, Homo sapiens
tagagagagctgtggtggctct

SEQ ID NO: 8407737 - DNA, 22 bp, Homo sapiens
tagatataaggtccttagaaca

SEQ ID NO: 8407738 - DNA, 22 bp, Homo sapiens
tagactagaggatcagcaaggg

SEQ ID NO: 8407739 - DNA, 22 bp, Homo sapiens
tagatgaaggctgagcacctgt

SEQ ID NO: 8407740 - DNA, 22 bp, Homo sapiens
tagatgaacagaaagccactgt

SEQ ID NO: 8407741 - DNA, 22 bp, Homo sapiens
tagctgagagctcacttgagga

SEQ ID NO: 8407742 - DNA, 22 bp, Homo sapiens
tagctgagaggccaattgaact

SEQ ID NO: 8407743 - DNA, 22 bp, Homo sapiens
tagcagggccaggctgggaacc

SEQ ID NO: 8407744 - DNA, 22 bp, Homo sapiens
tagggcagagtccaggatgggc

SEQ ID NO: 8407745 - DNA, 22 bp, Homo sapiens
tagggcagccacccaggctgct

SEQ ID NO: 8407746 - DNA, 22 bp, Homo sapiens
tagggcagattcggtggagttt

SEQ ID NO: 8407747 - DNA, 22 bp, Homo sapiens
tagggcagctgcatcaggcact

SEQ ID NO: 8407748 - DNA, 22 bp, Homo sapiens
tagggcagctgcatcaggcact

SEQ ID NO: 8407749 - DNA, 23 bp, Homo sapiens
tagggcagctgggagggacatgc

SEQ ID NO: 8407750 - DNA, 22 bp, Homo sapiens
tagggcttcaggtgtgaggcag

SEQ ID NO: 8407751 - DNA, 22 bp, Homo sapiens
taggcaggctgaatgtagattt

SEQ ID NO: 8407752 - DNA, 20 bp, Homo sapiens
taggcagagctgtgcagcct

SEQ ID NO: 8407753 - DNA, 22 bp, Homo sapiens
tagctggttctccaggagctag

SEQ ID NO: 8407754 - DNA, 22 bp, Homo sapiens
tagctggtctttaagcatgtaa

SEQ ID NO: 8407755 - DNA, 22 bp, Homo sapiens
tagtggaactgtgtcatacaaa

SEQ ID NO: 8407756 - DNA, 22 bp, Homo sapiens
tagtgccattgccaggaagggc

SEQ ID NO: 8407757 - DNA, 22 bp, Homo sapiens
tagtgcagaggaggagcctctg

SEQ ID NO: 8407758 - DNA, 22 bp, Homo sapiens
tcaaatcccagctcagcctctc

SEQ ID NO: 8407759 - DNA, 22 bp, Homo sapiens
tatgtacatatacacgtgtgtg

SEQ ID NO: 8407760 - DNA, 22 bp, Homo sapiens
tactgttacagggagtgttcaa

SEQ ID NO: 8407761 - DNA, 23 bp, Homo sapiens
tactatggttattatccctctcc

SEQ ID NO: 8407762 - DNA, 22 bp, Homo sapiens
tacagaggaggtggttgggagt

SEQ ID NO: 8407763 - DNA, 22 bp, Homo sapiens
tacagaggcacatgcaattttc

SEQ ID NO: 8407764 - DNA, 22 bp, Homo sapiens
tacagaggagaccaaggctcag

SEQ ID NO: 8407765 - DNA, 22 bp, Homo sapiens
tacagtagtatcttcatttgtt

SEQ ID NO: 8407766 - DNA, 22 bp, Homo sapiens
tacatgtatgtgtacgtgcatg

SEQ ID NO: 8407767 - DNA, 22 bp, Homo sapiens
tacatgtaggtgacattttaat

SEQ ID NO: 8407768 - DNA, 22 bp, Homo sapiens
tacatgtacattgggcattaat

SEQ ID NO: 8407769 - DNA, 22 bp, Homo sapiens
tacatgtaattttcatagtaag

SEQ ID NO: 8407770 - DNA, 22 bp, Homo sapiens
tacatgtaagacatgagactct

SEQ ID NO: 8407771 - DNA, 22 bp, Homo sapiens
tacagtgtctggatatcaaagg

SEQ ID NO: 8407772 - DNA, 22 bp, Homo sapiens
taaggaaaatggacatcaaaca

SEQ ID NO: 8407773 - DNA, 22 bp, Homo sapiens
taagcattaactctgctgcaag

SEQ ID NO: 8407774 - DNA, 22 bp, Homo sapiens
taaggaaggggaaagacatgtc

SEQ ID NO: 8407775 - DNA, 22 bp, Homo sapiens
gttgaaatcctaaccccctagt

SEQ ID NO: 8407776 - DNA, 22 bp, Homo sapiens
gtgctggctgccaggaggctgc

SEQ ID NO: 8407777 - DNA, 22 bp, Homo sapiens
gtgctggctgccaggaggctgc

SEQ ID NO: 8407778 - DNA, 22 bp, Homo sapiens
gtgctggctggacatggagcac

SEQ ID NO: 8407779 - DNA, 22 bp, Homo sapiens
gtgctggctgccaggaggctgc

SEQ ID NO: 8407780 - DNA, 17 bp, Homo sapiens
gtgctggcctggggctc

SEQ ID NO: 8407781 - DNA, 22 bp, Homo sapiens
gtgctggcctcagagggtcatg

SEQ ID NO: 8407782 - DNA, 21 bp, Homo sapiens
gtgctgggacacagccaggct

SEQ ID NO: 8407783 - DNA, 22 bp, Homo sapiens
gtgctggctggggcatcaggca

SEQ ID NO: 8407784 - DNA, 22 bp, Homo sapiens
gcccgcgccagcctctccatct

SEQ ID NO: 8407785 - DNA, 22 bp, Homo sapiens
gcccacagaggcaccaccaggc

SEQ ID NO: 8407786 - DNA, 22 bp, Homo sapiens
gcccacagctcgttcctctcct

SEQ ID NO: 8407787 - DNA, 22 bp, Homo sapiens
gcctcagggggagaggccagct

SEQ ID NO: 8407788 - DNA, 19 bp, Homo sapiens
gcctcatttccacctcccc

SEQ ID NO: 8407789 - DNA, 22 bp, Homo sapiens
gcctccctggcccacagcagcg

SEQ ID NO: 8407790 - DNA, 22 bp, Homo sapiens
gccaggctccccggatccctgg

SEQ ID NO: 8407791 - DNA, 23 bp, Homo sapiens
gccaggctccggtctgtggccac

SEQ ID NO: 8407792 - DNA, 22 bp, Homo sapiens
gccaggctcagcagtcaacctg

SEQ ID NO: 8407793 - DNA, 22 bp, Homo sapiens
gccagctggtaggcacctagcc

SEQ ID NO: 8407794 - DNA, 22 bp, Homo sapiens
gccagctgagaaatcattgata

SEQ ID NO: 8407795 - DNA, 17 bp, Homo sapiens
gccagcttgagggccat

SEQ ID NO: 8407796 - DNA, 22 bp, Homo sapiens
gccaggaatcactgctgagtaa

SEQ ID NO: 8407797 - DNA, 18 bp, Homo sapiens
gccaggaagaggaatgtg

SEQ ID NO: 8407798 - DNA, 22 bp, Homo sapiens
gccaggaagcagttagatgggt

SEQ ID NO: 8407799 - DNA, 22 bp, Homo sapiens
gccaggaacacaatgccaagct

SEQ ID NO: 8407800 - DNA, 22 bp, Homo sapiens
gcaggcatctctgtagccaggg

SEQ ID NO: 8407801 - DNA, 22 bp, Homo sapiens
gcagggcagctgaagctaggtg

SEQ ID NO: 8407802 - DNA, 22 bp, Homo sapiens
gcagggcagctgaagctaggtg

SEQ ID NO: 8407803 - DNA, 19 bp, Homo sapiens
gcaggtagagacagcagcc

SEQ ID NO: 8407804 - DNA, 22 bp, Homo sapiens
gcaggtgaaagtgagtagtgag

SEQ ID NO: 8407805 - DNA, 22 bp, Homo sapiens
gcaggtctggcatagagcctgc

SEQ ID NO: 8407806 - DNA, 22 bp, Homo sapiens
gcaggtgaatgatggactagga

SEQ ID NO: 8407807 - DNA, 22 bp, Homo sapiens
gcaggtgatgtgatgtgagcat

SEQ ID NO: 8407808 - DNA, 22 bp, Homo sapiens
gcaggtgatgtgatgtgagcat

SEQ ID NO: 8407809 - DNA, 22 bp, Homo sapiens
gcagggccagggctcaggctgt

SEQ ID NO: 8407810 - DNA, 22 bp, Homo sapiens
gcagggccagtgcagagaggaa

SEQ ID NO: 8407811 - DNA, 22 bp, Homo sapiens
gcagcagcagggagtctgactt

SEQ ID NO: 8407812 - DNA, 22 bp, Homo sapiens
gcagcagcaggcgctcggccgt

SEQ ID NO: 8407813 - DNA, 22 bp, Homo sapiens
gcagcactgtcttgtcttagga

SEQ ID NO: 8407814 - DNA, 19 bp, Homo sapiens
gcagccaccgcggcggccg

SEQ ID NO: 8407815 - DNA, 21 bp, Homo sapiens
gcagccacagccaccaagcta

SEQ ID NO: 8407816 - DNA, 21 bp, Homo sapiens
gcagccacagccaccaagcta

SEQ ID NO: 8407817 - DNA, 22 bp, Homo sapiens
gcagccaggaagcccaggacac

SEQ ID NO: 8407818 - DNA, 22 bp, Homo sapiens
gcagcccaatggactgagacag

SEQ ID NO: 8407819 - DNA, 22 bp, Homo sapiens
gcagcccacagctggaggccta

SEQ ID NO: 8407820 - DNA, 22 bp, Homo sapiens
gcagctgggacactgaggccag

SEQ ID NO: 8407821 - DNA, 22 bp, Homo sapiens
gcagctggctcagagaggtggg

SEQ ID NO: 8407822 - DNA, 22 bp, Homo sapiens
gcagctgggacactgaggccag

SEQ ID NO: 8407823 - DNA, 22 bp, Homo sapiens
gcagacagcatgttgggctatt

SEQ ID NO: 8407824 - DNA, 22 bp, Homo sapiens
gcagagtcccagcaggtggtgg

SEQ ID NO: 8407825 - DNA, 22 bp, Homo sapiens
gcagagtctggtaggtgctggt

SEQ ID NO: 8407826 - DNA, 22 bp, Homo sapiens
gcagaggttggattggtgactt

SEQ ID NO: 8407827 - DNA, 22 bp, Homo sapiens
gcagacagggctacagaggtac

SEQ ID NO: 8407828 - DNA, 22 bp, Homo sapiens
gcagaggtgctcagtggcagaa

SEQ ID NO: 8407829 - DNA, 22 bp, Homo sapiens
gcagatgttgtgaggctggtaa

SEQ ID NO: 8407830 - DNA, 19 bp, Homo sapiens
gcagagtggggtggagggt

SEQ ID NO: 8407831 - DNA, 22 bp, Homo sapiens
gcagagtgaagggagaggtgtg

SEQ ID NO: 8407832 - DNA, 22 bp, Homo sapiens
gcacatggcggccagcaggtga

SEQ ID NO: 8407833 - DNA, 21 bp, Homo sapiens
gcaaggcctatcatggcagct

SEQ ID NO: 8407834 - DNA, 22 bp, Homo sapiens
gagtagcattctagagtatgct

SEQ ID NO: 8407835 - DNA, 22 bp, Homo sapiens
ggagctggtcagccttgagcat

SEQ ID NO: 8407836 - DNA, 22 bp, Homo sapiens
ggaggaggggcgctttgtctat

SEQ ID NO: 8407837 - DNA, 22 bp, Homo sapiens
ggagccaggcatatcggggcac

SEQ ID NO: 8407838 - DNA, 17 bp, Homo sapiens
ggagccaggagcccacc

SEQ ID NO: 8407839 - DNA, 22 bp, Homo sapiens
ggagaagaggagctggaagcct

SEQ ID NO: 8407840 - DNA, 18 bp, Homo sapiens
ggagaagaacagatgtgg

SEQ ID NO: 8407841 - DNA, 22 bp, Homo sapiens
ggagccagtgccctctggtgga

SEQ ID NO: 8407842 - DNA, 22 bp, Homo sapiens
ggaaggctttgtagaagtgcca

SEQ ID NO: 8407843 - DNA, 22 bp, Homo sapiens
ggacagagggttgacagagtat

SEQ ID NO: 8407844 - DNA, 20 bp, Homo sapiens
ggaaggctgtttttccacca

SEQ ID NO: 8407845 - DNA, 22 bp, Homo sapiens
ggaaggctccacccaaggcgag

SEQ ID NO: 8407846 - DNA, 22 bp, Homo sapiens
ggacagggctcttggcactcct

SEQ ID NO: 8407847 - DNA, 22 bp, Homo sapiens
ggacaggggcgtggggattgtt

SEQ ID NO: 8407848 - DNA, 22 bp, Homo sapiens
ggactggccggcgctgaggccc

SEQ ID NO: 8407849 - DNA, 22 bp, Homo sapiens
gctgtgtgacctgggcaagtct

SEQ ID NO: 8407850 - DNA, 22 bp, Homo sapiens
gctgtcctgggaacaggcacta

SEQ ID NO: 8407851 - DNA, 22 bp, Homo sapiens
gctgtcctcttggactcagggc

SEQ ID NO: 8407852 - DNA, 22 bp, Homo sapiens
gctggtcagggtattggaggcc

SEQ ID NO: 8407853 - DNA, 22 bp, Homo sapiens
gctgtgtgctgggcatggcact

SEQ ID NO: 8407854 - DNA, 22 bp, Homo sapiens
gctgtgtgttcaataatgtgat

SEQ ID NO: 8407855 - DNA, 22 bp, Homo sapiens
gctttagatagatttagtcttt

SEQ ID NO: 8407856 - DNA, 22 bp, Homo sapiens
gctttagaaatgtaggagatac

SEQ ID NO: 8407857 - DNA, 22 bp, Homo sapiens
gctttagaaatgagtaaattag

SEQ ID NO: 8407858 - DNA, 22 bp, Homo sapiens
gctttagagaagaaaggttgct

SEQ ID NO: 8407859 - DNA, 22 bp, Homo sapiens
gctttagagcccagcttggtgg

SEQ ID NO: 8407860 - DNA, 19 bp, Homo sapiens
gctgctggctctggctgga

SEQ ID NO: 8407861 - DNA, 22 bp, Homo sapiens
gctggcagggtggttgagagag

SEQ ID NO: 8407862 - DNA, 22 bp, Homo sapiens
gctggcagtcccatcagctggg

SEQ ID NO: 8407863 - DNA, 22 bp, Homo sapiens
gctgagtgtaatgatggcagag

SEQ ID NO: 8407864 - DNA, 17 bp, Homo sapiens
gctgagtgcagggagtc

SEQ ID NO: 8407865 - DNA, 22 bp, Homo sapiens
gctgagtggagcagtcagcgct

SEQ ID NO: 8407866 - DNA, 22 bp, Homo sapiens
gctgagtgaggaaaaggttata

SEQ ID NO: 8407867 - DNA, 22 bp, Homo sapiens
gctgaggtgtcaccttgctggg

SEQ ID NO: 8407868 - DNA, 22 bp, Homo sapiens
gctgagggtaacacttcgggat

SEQ ID NO: 8407869 - DNA, 22 bp, Homo sapiens
gctctgtgtatgtggcaggtgc

SEQ ID NO: 8407870 - DNA, 22 bp, Homo sapiens
gctctgtggcattcatgggcag

SEQ ID NO: 8407871 - DNA, 22 bp, Homo sapiens
gctgcagggctctcacaggggg

SEQ ID NO: 8407872 - DNA, 22 bp, Homo sapiens
gctctggggttggaaagtgatc

SEQ ID NO: 8407873 - DNA, 22 bp, Homo sapiens
gctctgggtagccactgcctgg

SEQ ID NO: 8407874 - DNA, 20 bp, Homo sapiens
gctcccagcctgcagtcccc

SEQ ID NO: 8407875 - DNA, 22 bp, Homo sapiens
gctcagggagagagggcagccg

SEQ ID NO: 8407876 - DNA, 22 bp, Homo sapiens
gcctggcaggcctcatgagggg

SEQ ID NO: 8407877 - DNA, 22 bp, Homo sapiens
gcctggcaggaatctcagtgct

SEQ ID NO: 8407878 - DNA, 22 bp, Homo sapiens
gcctggcactcactgaagaggc

SEQ ID NO: 8407879 - DNA, 22 bp, Homo sapiens
gctaggaagaagggtgcttgaa

SEQ ID NO: 8407880 - DNA, 22 bp, Homo sapiens
gctaggaagctggggagaagtc

SEQ ID NO: 8407881 - DNA, 18 bp, Homo sapiens
gctagggcatgcatggtg

SEQ ID NO: 8407882 - DNA, 22 bp, Homo sapiens
gctagggtggctaataggagag

SEQ ID NO: 8407883 - DNA, 22 bp, Homo sapiens
ggaggatgagctacgaggagct

SEQ ID NO: 8407884 - DNA, 22 bp, Homo sapiens
ggaggatgagctacgaggagct

SEQ ID NO: 8407885 - DNA, 22 bp, Homo sapiens
ggaggaggggtgactgaatgct

SEQ ID NO: 8407886 - DNA, 22 bp, Homo sapiens
ggcagcagacccctaagtctac

SEQ ID NO: 8407887 - DNA, 22 bp, Homo sapiens
ggcagcagaactggccctgtat

SEQ ID NO: 8407888 - DNA, 23 bp, Homo sapiens
ggcactgaagctacaatggtgag

SEQ ID NO: 8407889 - DNA, 22 bp, Homo sapiens
ggcagtgcaaggcagcctggat

SEQ ID NO: 8407890 - DNA, 22 bp, Homo sapiens
ggcagtgagctggagggaagga

SEQ ID NO: 8407891 - DNA, 20 bp, Homo sapiens
ggcaggctttatatggaggg

SEQ ID NO: 8407892 - DNA, 22 bp, Homo sapiens
ggcaggctttcagcatcaagtc

SEQ ID NO: 8407893 - DNA, 22 bp, Homo sapiens
ggcagccatgtcccagggcttc

SEQ ID NO: 8407894 - DNA, 22 bp, Homo sapiens
ggcagccatgtgggcagcgagt

SEQ ID NO: 8407895 - DNA, 22 bp, Homo sapiens
ggccagagttgatggcatcttg

SEQ ID NO: 8407896 - DNA, 21 bp, Homo sapiens
ggccacagttagggctcagga

SEQ ID NO: 8407897 - DNA, 22 bp, Homo sapiens
ggcagtggcatgtgggtagtgg

SEQ ID NO: 8407898 - DNA, 22 bp, Homo sapiens
ggccagctctgcacagcagctg

SEQ ID NO: 8407899 - DNA, 22 bp, Homo sapiens
ggcccagcgaggccacctacag

SEQ ID NO: 8407900 - DNA, 22 bp, Homo sapiens
ggccagctgggccaccaggtgc

SEQ ID NO: 8407901 - DNA, 22 bp, Homo sapiens
ggccagctgctcagtgtctctg

SEQ ID NO: 8407902 - DNA, 20 bp, Homo sapiens
ggccagctggaggcgccggg

SEQ ID NO: 8407903 - DNA, 22 bp, Homo sapiens
ggccagctggagttccgggtgg

SEQ ID NO: 8407904 - DNA, 20 bp, Homo sapiens
ggccagctgatgcacgatgc

SEQ ID NO: 8407905 - DNA, 22 bp, Homo sapiens
ggccagctgagctgctgcacag

SEQ ID NO: 8407906 - DNA, 22 bp, Homo sapiens
ggctcagagacctgcgatctga

SEQ ID NO: 8407907 - DNA, 22 bp, Homo sapiens
ggctcagaggttgaggccggca

SEQ ID NO: 8407908 - DNA, 22 bp, Homo sapiens
ggctcagaggccagcaggtaga

SEQ ID NO: 8407909 - DNA, 22 bp, Homo sapiens
ggctcagactcccaggccctct

SEQ ID NO: 8407910 - DNA, 22 bp, Homo sapiens
ggctcagattccgagtggccct

SEQ ID NO: 8407911 - DNA, 22 bp, Homo sapiens
ggctcagattccgagtggccct

SEQ ID NO: 8407912 - DNA, 22 bp, Homo sapiens
ggctagggacacagctctgctc

SEQ ID NO: 8407913 - DNA, 22 bp, Homo sapiens
ggctagggacacagctctgctc

SEQ ID NO: 8407914 - DNA, 22 bp, Homo sapiens
ggcctctgccctcactcctgtc

SEQ ID NO: 8407915 - DNA, 22 bp, Homo sapiens
ggcctctgcctcatctgggcac

SEQ ID NO: 8407916 - DNA, 22 bp, Homo sapiens
ggctgcctgctcctcctgcacg

SEQ ID NO: 8407917 - DNA, 22 bp, Homo sapiens
ggctggagtgggctccagagtt

SEQ ID NO: 8407918 - DNA, 22 bp, Homo sapiens
ggctgcaggcttccctccagca

SEQ ID NO: 8407919 - DNA, 22 bp, Homo sapiens
ggctgccaggagggaggccagt

SEQ ID NO: 8407920 - DNA, 22 bp, Homo sapiens
ggctgccaggagaagctcagtg

SEQ ID NO: 8407921 - DNA, 22 bp, Homo sapiens
ggctgccacatgccatgtcctc

SEQ ID NO: 8407922 - DNA, 22 bp, Homo sapiens
ggctgtggcagctggaagtggt

SEQ ID NO: 8407923 - DNA, 22 bp, Homo sapiens
ggctgtggcattaggtgaggcc

SEQ ID NO: 8407924 - DNA, 22 bp, Homo sapiens
ggctgtggcattaggtgaggcc

SEQ ID NO: 8407925 - DNA, 22 bp, Homo sapiens
ggctgtgctttgttaggttgtc

SEQ ID NO: 8407926 - DNA, 22 bp, Homo sapiens
ggctgtgcttggtgtccttgga

SEQ ID NO: 8407927 - DNA, 22 bp, Homo sapiens
ggctgtgctttgcccaaagggc

SEQ ID NO: 8407928 - DNA, 22 bp, Homo sapiens
ggctgtgctgagggggaagccc

SEQ ID NO: 8407929 - DNA, 22 bp, Homo sapiens
ggctgtgcgtcatccggctgca

SEQ ID NO: 8407930 - DNA, 18 bp, Homo sapiens
ggctgtgcgtggaggctg

SEQ ID NO: 8407931 - DNA, 22 bp, Homo sapiens
gggaagagggagctggaatgat

SEQ ID NO: 8407932 - DNA, 22 bp, Homo sapiens
ggctgtgggtgtgacaggcctc

SEQ ID NO: 8407933 - DNA, 22 bp, Homo sapiens
ggctgtggtcattaggaggttg

SEQ ID NO: 8407934 - DNA, 22 bp, Homo sapiens
ggctgtggggaccaacaggact

SEQ ID NO: 8407935 - DNA, 22 bp, Homo sapiens
ggctgtggggccgggtacagtg

SEQ ID NO: 8407936 - DNA, 22 bp, Homo sapiens
gggagtggtcctttcctatctg

SEQ ID NO: 8407937 - DNA, 22 bp, Homo sapiens
gggagtgggtttggcctaggcc

SEQ ID NO: 8407938 - DNA, 22 bp, Homo sapiens
gggataggagattgggagtgtt

SEQ ID NO: 8407939 - DNA, 22 bp, Homo sapiens
gggagtggattatgtggaccca

SEQ ID NO: 8407940 - DNA, 22 bp, Homo sapiens
gggcagagactcagaaacagaa

SEQ ID NO: 8407941 - DNA, 20 bp, Homo sapiens
gggcagagccagccagtccc

SEQ ID NO: 8407942 - DNA, 22 bp, Homo sapiens
gggcagaggctctggcccatcc

SEQ ID NO: 8407943 - DNA, 22 bp, Homo sapiens
gggcagaggctctggcccatcc

SEQ ID NO: 8407944 - DNA, 17 bp, Homo sapiens
gggcagggactcctggg

SEQ ID NO: 8407945 - DNA, 22 bp, Homo sapiens
gggcaggtgattttggctccat

SEQ ID NO: 8407946 - DNA, 21 bp, Homo sapiens
gggcaggtctctgatgtcaac

SEQ ID NO: 8407947 - DNA, 22 bp, Homo sapiens
gggccccagtcctcccacgtgg

SEQ ID NO: 8407948 - DNA, 22 bp, Homo sapiens
gggccccactggggctgcctgc

SEQ ID NO: 8407949 - DNA, 22 bp, Homo sapiens
gggccccactggggctgcctgc

SEQ ID NO: 8407950 - DNA, 22 bp, Homo sapiens
gggccccaaaatgccaggctct

SEQ ID NO: 8407951 - DNA, 22 bp, Homo sapiens
gggcaggtgtgcagagctgttg

SEQ ID NO: 8407952 - DNA, 22 bp, Homo sapiens
gggcaggtggcagggtctctgg

SEQ ID NO: 8407953 - DNA, 22 bp, Homo sapiens
gggcaggtggcagggtctctgg

SEQ ID NO: 8407954 - DNA, 22 bp, Homo sapiens
gggcaggtggagggcccagcca

SEQ ID NO: 8407955 - DNA, 22 bp, Homo sapiens
gggcaggtggcaaagccagagg

SEQ ID NO: 8407956 - DNA, 22 bp, Homo sapiens
gggccggagctgggtcccgcgc

SEQ ID NO: 8407957 - DNA, 22 bp, Homo sapiens
gggctaggtctgatcagagaag

SEQ ID NO: 8407958 - DNA, 22 bp, Homo sapiens
gggctcagttctgcttcatgct

SEQ ID NO: 8407959 - DNA, 22 bp, Homo sapiens
gggctcagctgggcgtgctggt

SEQ ID NO: 8407960 - DNA, 22 bp, Homo sapiens
gggctcagctccttccttccta

SEQ ID NO: 8407961 - DNA, 21 bp, Homo sapiens
gggctcagcgctcggctcctc

SEQ ID NO: 8407962 - DNA, 21 bp, Homo sapiens
gggctcagcgctcggctcctc

SEQ ID NO: 8407963 - DNA, 22 bp, Homo sapiens
gggctcagaggagtggcctggg

SEQ ID NO: 8407964 - DNA, 22 bp, Homo sapiens
gggctcagaggagtggcctggg

SEQ ID NO: 8407965 - DNA, 22 bp, Homo sapiens
gggctcagagcatttgggttgg

SEQ ID NO: 8407966 - DNA, 22 bp, Homo sapiens
gggctcagacatccctcctgga

SEQ ID NO: 8407967 - DNA, 23 bp, Homo sapiens
gggctcagatttcattctgtgcc

SEQ ID NO: 8407968 - DNA, 16 bp, Homo sapiens
gggctcagatctttga

SEQ ID NO: 8407969 - DNA, 22 bp, Homo sapiens
gggctcagccccattgaaccag

SEQ ID NO: 8407970 - DNA, 22 bp, Homo sapiens
gggctcagcctcctcacttcga

SEQ ID NO: 8407971 - DNA, 22 bp, Homo sapiens
ggggcaggaggtgttctctttt

SEQ ID NO: 8407972 - DNA, 22 bp, Homo sapiens
ggggcagggaggttatcgccga

SEQ ID NO: 8407973 - DNA, 20 bp, Homo sapiens
ggggcaggtttttatggcta

SEQ ID NO: 8407974 - DNA, 22 bp, Homo sapiens
ggggaggctgatgtgggcaaag

SEQ ID NO: 8407975 - DNA, 22 bp, Homo sapiens
ggggccagatatcactaaggtt

SEQ ID NO: 8407976 - DNA, 22 bp, Homo sapiens
ggggcccctgtggcttgatgcc

SEQ ID NO: 8407977 - DNA, 22 bp, Homo sapiens
ggggtggctggcacctcctggt

SEQ ID NO: 8407978 - DNA, 19 bp, Homo sapiens
ggggtggctggggctccag

SEQ ID NO: 8407979 - DNA, 22 bp, Homo sapiens
ggggtggccctaccctctggaa

SEQ ID NO: 8407980 - DNA, 22 bp, Homo sapiens
ggggtggcctgtaggcagcatg

SEQ ID NO: 8407981 - DNA, 22 bp, Homo sapiens
ggggtggccaaggactctgacc

SEQ ID NO: 8407982 - DNA, 22 bp, Homo sapiens
gggtggtgtattagagctgcag

SEQ ID NO: 8407983 - DNA, 22 bp, Homo sapiens
gggtggtggcggaggctccagg

SEQ ID NO: 8407984 - DNA, 22 bp, Homo sapiens
gggtggtctggcaggctggaaa

SEQ ID NO: 8407985 - DNA, 22 bp, Homo sapiens
gggtggtggccagcagtgggca

SEQ ID NO: 8407986 - DNA, 22 bp, Homo sapiens
gggtggagaggctaagtccagt

SEQ ID NO: 8407987 - DNA, 22 bp, Homo sapiens
gggtggagccagttgactctgt

SEQ ID NO: 8407988 - DNA, 21 bp, Homo sapiens
gggtggggttccagccttttc

SEQ ID NO: 8407989 - DNA, 22 bp, Homo sapiens
gggtgaggcccatttgaggcca

SEQ ID NO: 8407990 - DNA, 22 bp, Homo sapiens
ggtcccagctggtcactgtcag

SEQ ID NO: 8407991 - DNA, 18 bp, Homo sapiens
gggtggtgtgctcttcgc

SEQ ID NO: 8407992 - DNA, 22 bp, Homo sapiens
gggttggattacttagggagaa

SEQ ID NO: 8407993 - DNA, 22 bp, Homo sapiens
gggttggatcctggtggctgcc

SEQ ID NO: 8407994 - DNA, 22 bp, Homo sapiens
gggttggcagcaccagaggagg

SEQ ID NO: 8407995 - DNA, 22 bp, Homo sapiens
ggtcccagttgcccaggtcagg

SEQ ID NO: 8407996 - DNA, 21 bp, Homo sapiens
ggtgctcgctgatgaggagtg

SEQ ID NO: 8407997 - DNA, 22 bp, Homo sapiens
ggtgctctggtcatggtggagt

SEQ ID NO: 8407998 - DNA, 18 bp, Homo sapiens
ggtgaggcggcggccagc

SEQ ID NO: 8407999 - DNA, 22 bp, Homo sapiens
ggtgaggcaggtggctgctgag

SEQ ID NO: 8408000 - DNA, 22 bp, Homo sapiens
ggtgaggctaagtgacacaggg

SEQ ID NO: 8408001 - DNA, 18 bp, Homo sapiens
ggtgagggagctggaagc

SEQ ID NO: 8408002 - DNA, 22 bp, Homo sapiens
ggtgagaggcctgagagctgga

SEQ ID NO: 8408003 - DNA, 22 bp, Homo sapiens
ggtgagaggcagtgctgtggaa

SEQ ID NO: 8408004 - DNA, 22 bp, Homo sapiens
ggtggcactcattatcaggtgc

SEQ ID NO: 8408005 - DNA, 22 bp, Homo sapiens
ggtgggcaggcgaggcccaggt

SEQ ID NO: 8408006 - DNA, 22 bp, Homo sapiens
ggtgggcaggcgaggcccaggt

SEQ ID NO: 8408007 - DNA, 22 bp, Homo sapiens
ggtggcaagggcagccagtaac

SEQ ID NO: 8408008 - DNA, 22 bp, Homo sapiens
ggtgggcaggtcactctgcctc

SEQ ID NO: 8408009 - DNA, 22 bp, Homo sapiens
ggtgggtgagccctgggagctg

SEQ ID NO: 8408010 - DNA, 22 bp, Homo sapiens
ggtgggtgagccctgggagctg

SEQ ID NO: 8408011 - DNA, 21 bp, Homo sapiens
ggttggtgtgtccagtggcca

SEQ ID NO: 8408012 - DNA, 22 bp, Homo sapiens
ggtggtgactgtcctagggatg

SEQ ID NO: 8408013 - DNA, 22 bp, Homo sapiens
ggtggtgaagacaagtggaagt

SEQ ID NO: 8408014 - DNA, 22 bp, Homo sapiens
ggtggtggagccagctgggagt

SEQ ID NO: 8408015 - DNA, 22 bp, Homo sapiens
ggtggtggagccagctgggagt

SEQ ID NO: 8408016 - DNA, 17 bp, Homo sapiens
gtgcagggatgaaggat

SEQ ID NO: 8408017 - DNA, 22 bp, Homo sapiens
gtgcagggcagccgaatgggct

SEQ ID NO: 8408018 - DNA, 22 bp, Homo sapiens
gtgcaggggatcaggttgcagc

SEQ ID NO: 8408019 - DNA, 22 bp, Homo sapiens
gtgcaggggatcaggttgcagc

SEQ ID NO: 8408020 - DNA, 22 bp, Homo sapiens
gtgcagcaaactagtgcgaggg

SEQ ID NO: 8408021 - DNA, 22 bp, Homo sapiens
gtgaggagctctttgactcacg

SEQ ID NO: 8408022 - DNA, 22 bp, Homo sapiens
gtgagcagggcaggactgggga

SEQ ID NO: 8408023 - DNA, 19 bp, Homo sapiens
gtcttggctctcaaccatc

SEQ ID NO: 8408024 - DNA, 22 bp, Homo sapiens
gtcttggcatattttcaccaag

SEQ ID NO: 8408025 - DNA, 22 bp, Homo sapiens
gtctccagttacagcagccagg

SEQ ID NO: 8408026 - DNA, 22 bp, Homo sapiens
gtctccagggacacactagccg

SEQ ID NO: 8408027 - DNA, 22 bp, Homo sapiens
gtctaagtgggtggcactgaca

SEQ ID NO: 8408028 - DNA, 22 bp, Homo sapiens
gtctagagaggaaggaagtgtg

SEQ ID NO: 8408029 - DNA, 22 bp, Homo sapiens
gtctccagaggttacatcctgt

SEQ ID NO: 8408030 - DNA, 22 bp, Homo sapiens
gtcactgtatccaggttccagc

SEQ ID NO: 8408031 - DNA, 22 bp, Homo sapiens
gtcagaagcatttgtggctgaa

SEQ ID NO: 8408032 - DNA, 22 bp, Homo sapiens
gtcagaagcatttgtggctgaa

SEQ ID NO: 8408033 - DNA, 22 bp, Homo sapiens
gtcactgtttcctattatattt

SEQ ID NO: 8408034 - DNA, 22 bp, Homo sapiens
gtccaggctgcccagggtcctg

SEQ ID NO: 8408035 - DNA, 22 bp, Homo sapiens
gtcctgggaactggacagctaa

SEQ ID NO: 8408036 - DNA, 22 bp, Homo sapiens
gtagtccatcttgagcagcgta

SEQ ID NO: 8408037 - DNA, 22 bp, Homo sapiens
gtacaagtgtgtgtttgagcag

SEQ ID NO: 8408038 - DNA, 22 bp, Homo sapiens
gtacaagttctactctataaat

SEQ ID NO: 8408039 - DNA, 22 bp, Homo sapiens
ttctggaatactaagttccttt

SEQ ID NO: 8408040 - DNA, 22 bp, Homo sapiens
ttctgtggctgggagcctggct

SEQ ID NO: 8408041 - DNA, 22 bp, Homo sapiens
ttcagagacatgttctagatca

SEQ ID NO: 8408042 - DNA, 22 bp, Homo sapiens
ttccagtaatgtgactttgagc

SEQ ID NO: 8408043 - DNA, 19 bp, Homo sapiens
ttcataagtttagtgaggg

SEQ ID NO: 8408044 - DNA, 22 bp, Homo sapiens
ttcatttaatcagaatctctaa

SEQ ID NO: 8408045 - DNA, 22 bp, Homo sapiens
ttggcagggccaggctctctct

SEQ ID NO: 8408046 - DNA, 22 bp, Homo sapiens
ttggcaggaatattgcagaggt

SEQ ID NO: 8408047 - DNA, 22 bp, Homo sapiens
ttggccatctaagcccagccac

SEQ ID NO: 8408048 - DNA, 22 bp, Homo sapiens
ttggccatctaagcccagccac

SEQ ID NO: 8408049 - DNA, 22 bp, Homo sapiens
ttgggcagggaaaggacaggca

SEQ ID NO: 8408050 - DNA, 22 bp, Homo sapiens
ttgggcagtctggctgcagagt

SEQ ID NO: 8408051 - DNA, 22 bp, Homo sapiens
ttgtacaagtattatgtgaaca

SEQ ID NO: 8408052 - DNA, 22 bp, Homo sapiens
ttgtacaagttttgagcttaag

SEQ ID NO: 8408053 - DNA, 22 bp, Homo sapiens
ttgtacagaaactgcatttgga

SEQ ID NO: 8408054 - DNA, 22 bp, Homo sapiens
ttgtacaatggatgccagatga

SEQ ID NO: 8408055 - DNA, 22 bp, Homo sapiens
ttgtacagggaagtaatacaag

SEQ ID NO: 8408056 - DNA, 22 bp, Homo sapiens
ttgctttcccaaggcagaacat

SEQ ID NO: 8408057 - DNA, 22 bp, Homo sapiens
ttgctgtgtcatttgtttaatc

SEQ ID NO: 8408058 - DNA, 22 bp, Homo sapiens
ttgacagggccaagaatggacc

SEQ ID NO: 8408059 - DNA, 22 bp, Homo sapiens
tttagaggggaaagtggctggt

SEQ ID NO: 8408060 - DNA, 22 bp, Homo sapiens
tttagaggtaggtagagtccaa

SEQ ID NO: 8408061 - DNA, 22 bp, Homo sapiens
tttagaggctgcctatcacaac

SEQ ID NO: 8408062 - DNA, 17 bp, Homo sapiens
tttagaggataagcccc

SEQ ID NO: 8408063 - DNA, 22 bp, Homo sapiens
tttagaggcatcttgcttttct

SEQ ID NO: 8408064 - DNA, 21 bp, Homo sapiens
tttagaggacacagggaggca

SEQ ID NO: 8408065 - DNA, 22 bp, Homo sapiens
tttagaggaggaagaaattttg

SEQ ID NO: 8408066 - DNA, 22 bp, Homo sapiens
tttagaggtctgtttcacatca

SEQ ID NO: 8408067 - DNA, 22 bp, Homo sapiens
tttagaggttagaggctgatag

SEQ ID NO: 8408068 - DNA, 22 bp, Homo sapiens
tttagaggttggggactttgca

SEQ ID NO: 8408069 - DNA, 22 bp, Homo sapiens
tttagaggaattgggagaacgt

SEQ ID NO: 8408070 - DNA, 22 bp, Homo sapiens
tttagaggaattgggagaacgt

SEQ ID NO: 8408071 - DNA, 21 bp, Homo sapiens
tttagaggacacagggaggca

SEQ ID NO: 8408072 - DNA, 22 bp, Homo sapiens
tttagatgctgtatgttatttc

SEQ ID NO: 8408073 - DNA, 22 bp, Homo sapiens
tttagagttgagtattcattgg

SEQ ID NO: 8408074 - DNA, 22 bp, Homo sapiens
tttaaactaacagtacacgttg

SEQ ID NO: 8408075 - DNA, 17 bp, Homo sapiens
tttaaactactacaagg

SEQ ID NO: 8408076 - DNA, 22 bp, Homo sapiens
tttgacagacatttactacatt

SEQ ID NO: 8408077 - DNA, 21 bp, Homo sapiens
ttttctggagtatgtctcctc

SEQ ID NO: 8408078 - DNA, 22 bp, Homo sapiens
actgtacatatggattctaaga

SEQ ID NO: 8408079 - DNA, 22 bp, Homo sapiens
actgtacacgtgtcatttacag

SEQ ID NO: 8408080 - DNA, 22 bp, Homo sapiens
agaaaggcagggatgaggattg

SEQ ID NO: 8408081 - DNA, 22 bp, Homo sapiens
agaagccagaatattcatggat

SEQ ID NO: 8408082 - DNA, 22 bp, Homo sapiens
acccagggtagaacctcagagc

SEQ ID NO: 8408083 - DNA, 22 bp, Homo sapiens
acccaggggcgaagctggccac

SEQ ID NO: 8408084 - DNA, 22 bp, Homo sapiens
acccagggagtgctcctgttct

SEQ ID NO: 8408085 - DNA, 22 bp, Homo sapiens
acccagggcttaaggcggtgca

SEQ ID NO: 8408086 - DNA, 22 bp, Homo sapiens
acccagggctcaagcgtaggca

SEQ ID NO: 8408087 - DNA, 22 bp, Homo sapiens
acccaggggcagccttgctgtg

SEQ ID NO: 8408088 - DNA, 22 bp, Homo sapiens
aagtccctttaatcagtgcctt

SEQ ID NO: 8408089 - DNA, 22 bp, Homo sapiens
aagggtggatttctgagctcta

SEQ ID NO: 8408090 - DNA, 22 bp, Homo sapiens
aagggtggatttctgagctcta

SEQ ID NO: 8408091 - DNA, 22 bp, Homo sapiens
aagggtgggccctggcagccat

SEQ ID NO: 8408092 - DNA, 22 bp, Homo sapiens
aagggtgggccctggcagccat

SEQ ID NO: 8408093 - DNA, 22 bp, Homo sapiens
aagggtggtgtaggagatcaaa

SEQ ID NO: 8408094 - DNA, 22 bp, Homo sapiens
aagggtgggcaccgccaggtca

SEQ ID NO: 8408095 - DNA, 22 bp, Homo sapiens
acatttcagtgagctattgaag

SEQ ID NO: 8408096 - DNA, 22 bp, Homo sapiens
acatttcagatgtaatgtgatg

SEQ ID NO: 8408097 - DNA, 22 bp, Homo sapiens
aagggatcataattgggttcaa

SEQ ID NO: 8408098 - DNA, 22 bp, Homo sapiens
aagcttcaatgagataattgtt

SEQ ID NO: 8408099 - DNA, 22 bp, Homo sapiens
aaggaagggaaatagtgatgtc

SEQ ID NO: 8408100 - DNA, 22 bp, Homo sapiens
aaggaaggaattgatcatgcgc

SEQ ID NO: 8408101 - DNA, 16 bp, Homo sapiens
aaggaatgtcattctg

SEQ ID NO: 8408102 - DNA, 22 bp, Homo sapiens
aaggaatgctctaggagggcag

SEQ ID NO: 8408103 - DNA, 21 bp, Homo sapiens
aaggaatgaatggatggatga

SEQ ID NO: 8408104 - DNA, 17 bp, Homo sapiens
aaggaatgtcagaagtt

SEQ ID NO: 8408105 - DNA, 19 bp, Homo sapiens
aaggaatggctttaagtag

SEQ ID NO: 8408106 - DNA, 22 bp, Homo sapiens
aaggaaggtactcagtgattct

SEQ ID NO: 8408107 - DNA, 22 bp, Homo sapiens
aaggaaggttcatagtcaaaga

SEQ ID NO: 8408108 - DNA, 22 bp, Homo sapiens
aaggacagagagccattccaga

SEQ ID NO: 8408109 - DNA, 22 bp, Homo sapiens
aaggccagcagtttgagaccag

SEQ ID NO: 8408110 - DNA, 22 bp, Homo sapiens
aaggcacacagttagatagagc

SEQ ID NO: 8408111 - DNA, 22 bp, Homo sapiens
aaggcacatattgcagatcttg

SEQ ID NO: 8408112 - DNA, 22 bp, Homo sapiens
aaggcacatattttagagtcac

SEQ ID NO: 8408113 - DNA, 17 bp, Homo sapiens
aaggcacagggcactgg

SEQ ID NO: 8408114 - DNA, 22 bp, Homo sapiens
aaggcacagccacttgatcatc

SEQ ID NO: 8408115 - DNA, 22 bp, Homo sapiens
aaggcacagaggcagggcactt

SEQ ID NO: 8408116 - DNA, 18 bp, Homo sapiens
aaggcacaggagaacatt

SEQ ID NO: 8408117 - DNA, 22 bp, Homo sapiens
aatgctcaaaatgtttcatcta

SEQ ID NO: 8408118 - DNA, 22 bp, Homo sapiens
agaggaatctgtctagacacaa

SEQ ID NO: 8408119 - DNA, 22 bp, Homo sapiens
agaggaatgtatttccctgcaa

SEQ ID NO: 8408120 - DNA, 22 bp, Homo sapiens
agaggaatatgggtgcactaga

SEQ ID NO: 8408121 - DNA, 22 bp, Homo sapiens
agaggaagtaatcaggacctgc

SEQ ID NO: 8408122 - DNA, 21 bp, Homo sapiens
agaggaagtgattggtctggc

SEQ ID NO: 8408123 - DNA, 22 bp, Homo sapiens
aatttcggttcaaggcccagtt

SEQ ID NO: 8408124 - DNA, 22 bp, Homo sapiens
agaggagtattttctaagggaa

SEQ ID NO: 8408125 - DNA, 21 bp, Homo sapiens
aattacagatggaattacaga

SEQ ID NO: 8408126 - DNA, 21 bp, Homo sapiens
agatgcagtgacccactgggg

SEQ ID NO: 8408127 - DNA, 22 bp, Homo sapiens
agatgcagagttgcttaagcat

SEQ ID NO: 8408128 - DNA, 22 bp, Homo sapiens
agatgcagatttggattcagga

SEQ ID NO: 8408129 - DNA, 22 bp, Homo sapiens
agatgcagagttgcttaagcat

SEQ ID NO: 8408130 - DNA, 22 bp, Homo sapiens
agatgcagacttggttcaggca

SEQ ID NO: 8408131 - DNA, 22 bp, Homo sapiens
agatgctatacattgtaagaca

SEQ ID NO: 8408132 - DNA, 21 bp, Homo sapiens
agatgcagtttgcaggtgggt

SEQ ID NO: 8408133 - DNA, 21 bp, Homo sapiens
agatgctgatgctgcaggtcc

SEQ ID NO: 8408134 - DNA, 22 bp, Homo sapiens
agatgctgattgaatagatttc

SEQ ID NO: 8408135 - DNA, 22 bp, Homo sapiens
agatgctggatggaaaatgatc

SEQ ID NO: 8408136 - DNA, 23 bp, Homo sapiens
acagaagccaggagccgctgggc

SEQ ID NO: 8408137 - DNA, 23 bp, Homo sapiens
acagaggcttaaatgagtggcag

SEQ ID NO: 8408138 - DNA, 22 bp, Homo sapiens
acagagggggccttggagtgca

SEQ ID NO: 8408139 - DNA, 22 bp, Homo sapiens
agcggtggtgtcggcagcggct

SEQ ID NO: 8408140 - DNA, 22 bp, Homo sapiens
acagcagcaatagcagtgacat

SEQ ID NO: 8408141 - DNA, 22 bp, Homo sapiens
acagcagccagccactgtgagc

SEQ ID NO: 8408142 - DNA, 20 bp, Homo sapiens
acagcagccttgctagaaac

SEQ ID NO: 8408143 - DNA, 21 bp, Homo sapiens
agctgaggtaaggcaagagag

SEQ ID NO: 8408144 - DNA, 22 bp, Homo sapiens
agctgatacatttcttgtagcc

SEQ ID NO: 8408145 - DNA, 22 bp, Homo sapiens
agctgagggttcggtgtccaca

SEQ ID NO: 8408146 - DNA, 22 bp, Homo sapiens
agccagctgttctggggcagca

SEQ ID NO: 8408147 - DNA, 22 bp, Homo sapiens
agccagctgtactgcctgctca

SEQ ID NO: 8408148 - DNA, 22 bp, Homo sapiens
acactgttccacactaagaagg

SEQ ID NO: 8408149 - DNA, 22 bp, Homo sapiens
acacccacctctttaggccatg

SEQ ID NO: 8408150 - DNA, 21 bp, Homo sapiens
acacccacttatgcccgcttg

SEQ ID NO: 8408151 - DNA, 22 bp, Homo sapiens
agccaagggtcagctgcacaga

SEQ ID NO: 8408152 - DNA, 22 bp, Homo sapiens
agccaaggcagctagagctctg

SEQ ID NO: 8408153 - DNA, 22 bp, Homo sapiens
agccaaggacacggagcctcct

SEQ ID NO: 8408154 - DNA, 22 bp, Homo sapiens
agcagggaatagcggaaagaat

SEQ ID NO: 8408155 - DNA, 19 bp, Homo sapiens
aaatgctgtggagggctcc

SEQ ID NO: 8408156 - DNA, 20 bp, Homo sapiens
aaatgcttttgacacatatt

SEQ ID NO: 8408157 - DNA, 22 bp, Homo sapiens
aaatgcacaggagaaccaattc

SEQ ID NO: 8408158 - DNA, 23 bp, Homo sapiens
aaatgatgtgtgttgtcccattc

SEQ ID NO: 8408159 - DNA, 22 bp, Homo sapiens
aaatacataaaggttgtaccag

SEQ ID NO: 8408160 - DNA, 22 bp, Homo sapiens
aaatacatacactgtacgtggc

SEQ ID NO: 8408161 - DNA, 22 bp, Homo sapiens
aaaggaggccacatggctagga

SEQ ID NO: 8408162 - DNA, 22 bp, Homo sapiens
aaattggattgggagaatgtga

SEQ ID NO: 8408163 - DNA, 22 bp, Homo sapiens
aaaggctggaaactgaagataa

SEQ ID NO: 8408164 - DNA, 22 bp, Homo sapiens
aaaggctgcctcagtgccatga

SEQ ID NO: 8408165 - DNA, 22 bp, Homo sapiens
aaagggaggggcgataagccgg

SEQ ID NO: 8408166 - DNA, 22 bp, Homo sapiens
aaaggctggattcagagaggtg

SEQ ID NO: 8408167 - DNA, 22 bp, Homo sapiens
aaaggctggggactgaggaagg

SEQ ID NO: 8408168 - DNA, 22 bp, Homo sapiens
aaaatactgtggagtgttgaaa

SEQ ID NO: 8408169 - DNA, 22 bp, Homo sapiens
aaaatgctgggaaagttggaat

SEQ ID NO: 8408170 - DNA, 23 bp, Homo sapiens
aaaacagcttcctccagtggctc

SEQ ID NO: 8408171 - DNA, 22 bp, Homo sapiens
aaaaatgttatctactgtccga

SEQ ID NO: 8408172 - DNA, 22 bp, Homo sapiens
aaagctctctgaacaccagacc

SEQ ID NO: 8408173 - DNA, 23 bp, Homo sapiens
aaacttcagtagtgtcatcagcc

SEQ ID NO: 8408174 - DNA, 22 bp, Homo sapiens
aaatgacaataaaagtccatgc

SEQ ID NO: 8408175 - DNA, 22 bp, Homo sapiens
aaatgacagagtaagctgttta

SEQ ID NO: 8408176 - DNA, 23 bp, Homo sapiens
aaggccagagagaggctagtgtc

SEQ ID NO: 8408177 - DNA, 22 bp, Homo sapiens
aaggccaggtccctgcagtgca

SEQ ID NO: 8408178 - DNA, 22 bp, Homo sapiens
aaggctgaattcaagggtaggc

SEQ ID NO: 8408179 - DNA, 22 bp, Homo sapiens
aaggaggttatcccagtggact

SEQ ID NO: 8408180 - DNA, 22 bp, Homo sapiens
aaggagtgcatgactcagagta

SEQ ID NO: 8408181 - DNA, 22 bp, Homo sapiens
aaggagtgatatatgggtgcta

SEQ ID NO: 8408182 - DNA, 22 bp, Homo sapiens
aaatggcaatcagcagaagcta

SEQ ID NO: 8408183 - DNA, 19 bp, Homo sapiens
aaatggagctaatcttgtc

SEQ ID NO: 8408184 - DNA, 22 bp, Homo sapiens
aaatggatctgtggaatacatt

SEQ ID NO: 8408185 - DNA, 22 bp, Homo sapiens
aatgtacaaaagtcagccaact

SEQ ID NO: 8408186 - DNA, 22 bp, Homo sapiens
aatgtacaaaccttctttgtag

SEQ ID NO: 8408187 - DNA, 22 bp, Homo sapiens
aatgcacataaatatggtctta

SEQ ID NO: 8408188 - DNA, 22 bp, Homo sapiens
aatgcacagctaaagtggttcc

SEQ ID NO: 8408189 - DNA, 22 bp, Homo sapiens
acaatgtaggagtatgacagta

SEQ ID NO: 8408190 - DNA, 17 bp, Homo sapiens
acacagccaggttctcc

SEQ ID NO: 8408191 - DNA, 22 bp, Homo sapiens
acacagccgtgaatctgcttct

SEQ ID NO: 8408192 - DNA, 22 bp, Homo sapiens
acacagccgtgaatctgcttct

SEQ ID NO: 8408193 - DNA, 22 bp, Homo sapiens
aagaactgtatcaagatgtagt

SEQ ID NO: 8408194 - DNA, 22 bp, Homo sapiens
aatgtacaagggttccagtttt

SEQ ID NO: 8408195 - DNA, 22 bp, Homo sapiens
aatgtacaataagacaaagagg

SEQ ID NO: 8408196 - DNA, 22 bp, Homo sapiens
acagccaggagccatgggcagg

SEQ ID NO: 8408197 - DNA, 22 bp, Homo sapiens
acagccaggcccagcacgcagg

SEQ ID NO: 8408198 - DNA, 22 bp, Homo sapiens
acagccaggacttggccctctt

SEQ ID NO: 8408199 - DNA, 22 bp, Homo sapiens
acacttgtaatggagaacacta

SEQ ID NO: 8408200 - DNA, 20 bp, Homo sapiens
agcaggccttggggagagga

SEQ ID NO: 8408201 - DNA, 22 bp, Homo sapiens
cacatgaagacctaattggatt

SEQ ID NO: 8408202 - DNA, 22 bp, Homo sapiens
cactgcaacctccacctcctgg

SEQ ID NO: 8408203 - DNA, 22 bp, Homo sapiens
agcatttatgactaatgtaaaa

SEQ ID NO: 8408204 - DNA, 22 bp, Homo sapiens
cacaggaagaggtatacaattc

SEQ ID NO: 8408205 - DNA, 22 bp, Homo sapiens
caagggcagcagcctcaagcgg

SEQ ID NO: 8408206 - DNA, 22 bp, Homo sapiens
caaggaaggagagatgatgggt

SEQ ID NO: 8408207 - DNA, 22 bp, Homo sapiens
cagagccatccaggtgcctgtt

SEQ ID NO: 8408208 - DNA, 22 bp, Homo sapiens
cagagccatggtatgggcttgt

SEQ ID NO: 8408209 - DNA, 22 bp, Homo sapiens
cagagccagggttgcacccctg

SEQ ID NO: 8408210 - DNA, 22 bp, Homo sapiens
cagagcagtaaatctggggcac

SEQ ID NO: 8408211 - DNA, 22 bp, Homo sapiens
agccagggaggtggaggttgca

SEQ ID NO: 8408212 - DNA, 22 bp, Homo sapiens
agccagggaggattacacccca

SEQ ID NO: 8408213 - DNA, 22 bp, Homo sapiens
agccagggctctccttcgcgtg

SEQ ID NO: 8408214 - DNA, 22 bp, Homo sapiens
agccagggatggcagtgcccag

SEQ ID NO: 8408215 - DNA, 22 bp, Homo sapiens
agccagggctgcaggttccttg

SEQ ID NO: 8408216 - DNA, 22 bp, Homo sapiens
agccagggaagaggcctacctc

SEQ ID NO: 8408217 - DNA, 22 bp, Homo sapiens
agccaggctgcagttggctggc

SEQ ID NO: 8408218 - DNA, 22 bp, Homo sapiens
agccaggccttttctcaaggtt

SEQ ID NO: 8408219 - DNA, 22 bp, Homo sapiens
agccaggctcaaggcctgctcc

SEQ ID NO: 8408220 - DNA, 22 bp, Homo sapiens
cagagtggcactctgctggatg

SEQ ID NO: 8408221 - DNA, 22 bp, Homo sapiens
cagaggaggccaccgcataggc

SEQ ID NO: 8408222 - DNA, 22 bp, Homo sapiens
agctgaggaggaatgatgggta

SEQ ID NO: 8408223 - DNA, 22 bp, Homo sapiens
cagctggcaagtggagcagggt

SEQ ID NO: 8408224 - DNA, 22 bp, Homo sapiens
cagctggcatacctgggcccgg

SEQ ID NO: 8408225 - DNA, 22 bp, Homo sapiens
cagctgggtggctcttctgctc

SEQ ID NO: 8408226 - DNA, 22 bp, Homo sapiens
cagctgctttcagcaggaggga

SEQ ID NO: 8408227 - DNA, 20 bp, Homo sapiens
agctgaggcacctgaggtta

SEQ ID NO: 8408228 - DNA, 22 bp, Homo sapiens
cagcccatccaaggcttggcat

SEQ ID NO: 8408229 - DNA, 19 bp, Homo sapiens
cagcccagggtgctaccaa

SEQ ID NO: 8408230 - DNA, 22 bp, Homo sapiens
cagcccagtaccaagcagttgg

SEQ ID NO: 8408231 - DNA, 22 bp, Homo sapiens
cagcccagaactcacgtctcca

SEQ ID NO: 8408232 - DNA, 22 bp, Homo sapiens
cagcccagagaaggggcccgtg

SEQ ID NO: 8408233 - DNA, 22 bp, Homo sapiens
atgctgaggtgtgtttaattta

SEQ ID NO: 8408234 - DNA, 22 bp, Homo sapiens
atgctgaggttgttgtcctatt

SEQ ID NO: 8408235 - DNA, 22 bp, Homo sapiens
atgctgagaaacagacgtgttg

SEQ ID NO: 8408236 - DNA, 22 bp, Homo sapiens
atgctgagataaggctttagtc

SEQ ID NO: 8408237 - DNA, 22 bp, Homo sapiens
atgctgagactggagcagctgg

SEQ ID NO: 8408238 - DNA, 22 bp, Homo sapiens
atgcggtgaattgactgtttct

SEQ ID NO: 8408239 - DNA, 22 bp, Homo sapiens
atgccagaccatccagttggga

SEQ ID NO: 8408240 - DNA, 22 bp, Homo sapiens
atcttacaattacaagacactc

SEQ ID NO: 8408241 - DNA, 22 bp, Homo sapiens
atgatttaaagtcattgtgaac

SEQ ID NO: 8408242 - DNA, 22 bp, Homo sapiens
atgaggcaaggctggccgtgtt

SEQ ID NO: 8408243 - DNA, 22 bp, Homo sapiens
atgttacagaaagcaaagatga

SEQ ID NO: 8408244 - DNA, 22 bp, Homo sapiens
agagccagcatttgggccctgc

SEQ ID NO: 8408245 - DNA, 22 bp, Homo sapiens
agagccagcatttgacactggc

SEQ ID NO: 8408246 - DNA, 22 bp, Homo sapiens
atgtgcagttggtggccaggag

SEQ ID NO: 8408247 - DNA, 22 bp, Homo sapiens
atgtgcagacctgggttagaac

SEQ ID NO: 8408248 - DNA, 23 bp, Homo sapiens
atgtgcaaagtgctacagtatag

SEQ ID NO: 8408249 - DNA, 16 bp, Homo sapiens
atgggcagtgaggaag

SEQ ID NO: 8408250 - DNA, 22 bp, Homo sapiens
atgggcagtgtattggaaggaa

SEQ ID NO: 8408251 - DNA, 22 bp, Homo sapiens
atgggcagtgtattggaaggaa

SEQ ID NO: 8408252 - DNA, 22 bp, Homo sapiens
atgggcctgttcctatgctggt

SEQ ID NO: 8408253 - DNA, 22 bp, Homo sapiens
atgggcagttaggaggccagga

SEQ ID NO: 8408254 - DNA, 22 bp, Homo sapiens
atgtatatacttacatgtgtgg

SEQ ID NO: 8408255 - DNA, 22 bp, Homo sapiens
attgttaaaaaggtggaaatgc

SEQ ID NO: 8408256 - DNA, 22 bp, Homo sapiens
attgttaactatagcatctggt

SEQ ID NO: 8408257 - DNA, 22 bp, Homo sapiens
attgtgctttgtatttggctag

SEQ ID NO: 8408258 - DNA, 22 bp, Homo sapiens
attgtgctcagaatctgtcgtg

SEQ ID NO: 8408259 - DNA, 22 bp, Homo sapiens
attgtgctcacagcttgtttct

SEQ ID NO: 8408260 - DNA, 22 bp, Homo sapiens
attgtgctttgcatcttgttcc

SEQ ID NO: 8408261 - DNA, 22 bp, Homo sapiens
attgtataagtctatttacaat

SEQ ID NO: 8408262 - DNA, 22 bp, Homo sapiens
agaggaaatggataaagggtga

SEQ ID NO: 8408263 - DNA, 22 bp, Homo sapiens
agaggaaacataggtttttaaa

SEQ ID NO: 8408264 - DNA, 22 bp, Homo sapiens
agaggaaaatgagttccagaat

SEQ ID NO: 8408265 - DNA, 22 bp, Homo sapiens
attctacaatcatgtagatcct

SEQ ID NO: 8408266 - DNA, 20 bp, Homo sapiens
attctacaagaataagcatg

SEQ ID NO: 8408267 - DNA, 22 bp, Homo sapiens
agcaatgtgacccctgacagca

SEQ ID NO: 8408268 - DNA, 22 bp, Homo sapiens
agcaatgtctttttggccatct

SEQ ID NO: 8408269 - DNA, 22 bp, Homo sapiens
agcaatgtaaaccctgaagttg

SEQ ID NO: 8408270 - DNA, 22 bp, Homo sapiens
agcaatgttggggttagaggac

SEQ ID NO: 8408271 - DNA, 22 bp, Homo sapiens
agcaatgtggaccagctcaggg

SEQ ID NO: 8408272 - DNA, 21 bp, Homo sapiens
agatgaggatactgaggccta

SEQ ID NO: 8408273 - DNA, 22 bp, Homo sapiens
atttacagccttgaaaacagca

SEQ ID NO: 8408274 - DNA, 23 bp, Homo sapiens
atttacagctgtgtgagcaagtt

SEQ ID NO: 8408275 - DNA, 22 bp, Homo sapiens
atttacaggtagaattttaagt

SEQ ID NO: 8408276 - DNA, 22 bp, Homo sapiens
atttacaggacagcttggcatt

SEQ ID NO: 8408277 - DNA, 22 bp, Homo sapiens
agatttatgtggtcacactcag

SEQ ID NO: 8408278 - DNA, 22 bp, Homo sapiens
agatttactcagctcctggaaa

SEQ ID NO: 8408279 - DNA, 20 bp, Homo sapiens
agatttacctttgagccttc

SEQ ID NO: 8408280 - DNA, 19 bp, Homo sapiens
agatttacctcatatagtt

SEQ ID NO: 8408281 - DNA, 22 bp, Homo sapiens
agatttacaaaggatttgcttt

SEQ ID NO: 8408282 - DNA, 22 bp, Homo sapiens
agatttactccctgcttccgcc

SEQ ID NO: 8408283 - DNA, 22 bp, Homo sapiens
agatttactgagaactgattac

SEQ ID NO: 8408284 - DNA, 22 bp, Homo sapiens
agatttatgtggtcacactcag

SEQ ID NO: 8408285 - DNA, 22 bp, Homo sapiens
aggtggagaagagatgggcagt

SEQ ID NO: 8408286 - DNA, 22 bp, Homo sapiens
aggtgaggataggtggccaagg

SEQ ID NO: 8408287 - DNA, 22 bp, Homo sapiens
aggtgcaggagctgtgcaggga

SEQ ID NO: 8408288 - DNA, 22 bp, Homo sapiens
agggtgagggtctggccttgag

SEQ ID NO: 8408289 - DNA, 22 bp, Homo sapiens
agggtccacttggacattgatc

SEQ ID NO: 8408290 - DNA, 18 bp, Homo sapiens
agggtcagtgtcactggc

SEQ ID NO: 8408291 - DNA, 18 bp, Homo sapiens
agggtcagtgtcactggc

SEQ ID NO: 8408292 - DNA, 22 bp, Homo sapiens
agtcctgggtgtgcaaggcaga

SEQ ID NO: 8408293 - DNA, 22 bp, Homo sapiens
agtaagcaatagagtgagaatt

SEQ ID NO: 8408294 - DNA, 22 bp, Homo sapiens
agttacctttctgaaacttcgt

SEQ ID NO: 8408295 - DNA, 21 bp, Homo sapiens
agttacaagtttattcagagg

SEQ ID NO: 8408296 - DNA, 22 bp, Homo sapiens
actggggattagggactcagtg

SEQ ID NO: 8408297 - DNA, 22 bp, Homo sapiens
agtggggccggtgaggccgagg

SEQ ID NO: 8408298 - DNA, 22 bp, Homo sapiens
agtggcagagcaggtgctggaa

SEQ ID NO: 8408299 - DNA, 22 bp, Homo sapiens
agtggcagacacaatgtgggca

SEQ ID NO: 8408300 - DNA, 22 bp, Homo sapiens
agtggcagaagtcactgggtag

SEQ ID NO: 8408301 - DNA, 22 bp, Homo sapiens
agtggcagagccaagatatgat

SEQ ID NO: 8408302 - DNA, 22 bp, Homo sapiens
agtggcagagccaagtagagcc

SEQ ID NO: 8408303 - DNA, 22 bp, Homo sapiens
agtgaatgtccccgcgggtcag

SEQ ID NO: 8408304 - DNA, 19 bp, Homo sapiens
agtgagcatccagagaggt

SEQ ID NO: 8408305 - DNA, 22 bp, Homo sapiens
agtgagcaacagaagcgtgggt

SEQ ID NO: 8408306 - DNA, 23 bp, Homo sapiens
agtgagcagctgtagggcaagga

SEQ ID NO: 8408307 - DNA, 22 bp, Homo sapiens
agtgaggcaaagtgagaggcag

SEQ ID NO: 8408308 - DNA, 20 bp, Homo sapiens
agtgaggcagttcagtgggc

SEQ ID NO: 8408309 - DNA, 22 bp, Homo sapiens
agtgagccataagggctgccac

SEQ ID NO: 8408310 - DNA, 22 bp, Homo sapiens
atacactgttcactagatcttc

SEQ ID NO: 8408311 - DNA, 22 bp, Homo sapiens
actttagaaaagcatccataga

SEQ ID NO: 8408312 - DNA, 22 bp, Homo sapiens
agttcacaccaaagttaggtag

SEQ ID NO: 8408313 - DNA, 21 bp, Homo sapiens
agaagccatgtggtggagaac

SEQ ID NO: 8408314 - DNA, 22 bp, Homo sapiens
agaagccatatttagggaggag

SEQ ID NO: 8408315 - DNA, 22 bp, Homo sapiens
agaagccatagtctgggaggca

SEQ ID NO: 8408316 - DNA, 22 bp, Homo sapiens
agaagccaccagctgaggaaga

SEQ ID NO: 8408317 - DNA, 22 bp, Homo sapiens
agaagccatagtatctcagggt

SEQ ID NO: 8408318 - DNA, 22 bp, Homo sapiens
agaagctgagaatgaattaaga

SEQ ID NO: 8408319 - DNA, 22 bp, Homo sapiens
agaagctaggctagacaagtga

SEQ ID NO: 8408320 - DNA, 22 bp, Homo sapiens
agaagccattccctgtaggctc

SEQ ID NO: 8408321 - DNA, 22 bp, Homo sapiens
agaagccatgtttagtaggatg

SEQ ID NO: 8408322 - DNA, 22 bp, Homo sapiens
agaagccaaatgccagtgacct

SEQ ID NO: 8408323 - DNA, 22 bp, Homo sapiens
agaaatgtttatggctgcctat

SEQ ID NO: 8408324 - DNA, 22 bp, Homo sapiens
agaaatgtccagggctaggatc

SEQ ID NO: 8408325 - DNA, 20 bp, Homo sapiens
agaaatgtgaaaggctgagt

SEQ ID NO: 8408326 - DNA, 22 bp, Homo sapiens
acctcagaacggcgttcttgaa

SEQ ID NO: 8408327 - DNA, 22 bp, Homo sapiens
acctcagaggaggctcctggct

SEQ ID NO: 8408328 - DNA, 22 bp, Homo sapiens
aggggccacctgtggcaccctg

SEQ ID NO: 8408329 - DNA, 23 bp, Homo sapiens
agggctgaatgcagagaagcaga

SEQ ID NO: 8408330 - DNA, 22 bp, Homo sapiens
accagagatggggcttctctgt

SEQ ID NO: 8408331 - DNA, 22 bp, Homo sapiens
accagagaatgtgcatctctaa

SEQ ID NO: 8408332 - DNA, 22 bp, Homo sapiens
agggcacaagactctgagcccc

SEQ ID NO: 8408333 - DNA, 22 bp, Homo sapiens
agggatgttagttgtgagctca

SEQ ID NO: 8408334 - DNA, 22 bp, Homo sapiens
agggatgttcattttgtggctg

SEQ ID NO: 8408335 - DNA, 22 bp, Homo sapiens
agggatgtgggaactgcaggtt

SEQ ID NO: 8408336 - DNA, 22 bp, Homo sapiens
agggaggtctttgaggggctta

SEQ ID NO: 8408337 - DNA, 18 bp, Homo sapiens
agggatgtatgctggtgg

SEQ ID NO: 8408338 - DNA, 22 bp, Homo sapiens
agggccagcactcctggcagga

SEQ ID NO: 8408339 - DNA, 22 bp, Homo sapiens
agggccagcccataatgccaaa

SEQ ID NO: 8408340 - DNA, 22 bp, Homo sapiens
agggccagccaggccctacaaa

SEQ ID NO: 8408341 - DNA, 21 bp, Homo sapiens
agggccagatcaccaaggagc

SEQ ID NO: 8408342 - DNA, 22 bp, Homo sapiens
agggccagatgaagccacaagc

SEQ ID NO: 8408343 - DNA, 22 bp, Homo sapiens
agggccagatgaagccacaagc

SEQ ID NO: 8408344 - DNA, 22 bp, Homo sapiens
agggccagttcagaggacatgg

SEQ ID NO: 8408345 - DNA, 22 bp, Homo sapiens
agggccagtcgtgtattactgt

SEQ ID NO: 8408346 - DNA, 22 bp, Homo sapiens
agggccagtcgtgtattactgt

SEQ ID NO: 8408347 - DNA, 22 bp, Homo sapiens
agggccagtgggttgaaaggca

SEQ ID NO: 8408348 - DNA, 22 bp, Homo sapiens
agggccagtaaatgtttcctca

SEQ ID NO: 8408349 - DNA, 22 bp, Homo sapiens
agggccagtaaatgtttcctca

SEQ ID NO: 8408350 - DNA, 22 bp, Homo sapiens
agggccagtattaaggtaatta

SEQ ID NO: 8408351 - DNA, 22 bp, Homo sapiens
agggccagtaccaggtgggtgg

SEQ ID NO: 8408352 - DNA, 22 bp, Homo sapiens
agggctcaatggtgggcatgta

SEQ ID NO: 8408353 - DNA, 22 bp, Homo sapiens
agggccagttctacctctgaat

SEQ ID NO: 8408354 - DNA, 17 bp, Homo sapiens
aggctgctgggccaggg

SEQ ID NO: 8408355 - DNA, 22 bp, Homo sapiens
aggctgcttcagctgcagggag

SEQ ID NO: 8408356 - DNA, 22 bp, Homo sapiens
aggctctggagttagccaggca

SEQ ID NO: 8408357 - DNA, 22 bp, Homo sapiens
accactgcccatggtgaaaact

SEQ ID NO: 8408358 - DNA, 22 bp, Homo sapiens
aggctcaggtctcaggtctggc

SEQ ID NO: 8408359 - DNA, 20 bp, Homo sapiens
aggctcagggtgtttaggaa

SEQ ID NO: 8408360 - DNA, 22 bp, Homo sapiens
aggctcagctggtggtgatcgc

SEQ ID NO: 8408361 - DNA, 20 bp, Homo sapiens
aggctcagctgagctcttgg

SEQ ID NO: 8408362 - DNA, 22 bp, Homo sapiens
aggctcagacaggaaaagtaac

SEQ ID NO: 8408363 - DNA, 22 bp, Homo sapiens
aggctcagggacggggcccctt

SEQ ID NO: 8408364 - DNA, 22 bp, Homo sapiens
aggctcagggactccctccctc

SEQ ID NO: 8408365 - DNA, 22 bp, Homo sapiens
aggctcaggcaggaatggcgga

SEQ ID NO: 8408366 - DNA, 22 bp, Homo sapiens
aggctcaggaggagctgccgga

SEQ ID NO: 8408367 - DNA, 20 bp, Homo sapiens
acatgtacagacaggtttct

SEQ ID NO: 8408368 - DNA, 21 bp, Homo sapiens
acatgtacacatgtatgcaca

SEQ ID NO: 8408369 - DNA, 22 bp, Homo sapiens
acagtgaaaagtagctaacaca

SEQ ID NO: 8408370 - DNA, 23 bp, Homo sapiens
acagtgaaacacgcagtaagagt

SEQ ID NO: 8408371 - DNA, 22 bp, Homo sapiens
acagtgaatgcccaagaaaagt

SEQ ID NO: 8408372 - DNA, 22 bp, Homo sapiens
acagtgagcggtagtgattgct

SEQ ID NO: 8408373 - DNA, 22 bp, Homo sapiens
aggcaggtgttacctctggttt

SEQ ID NO: 8408374 - DNA, 22 bp, Homo sapiens
aggcaggtgggtcacttgagtc

SEQ ID NO: 8408375 - DNA, 22 bp, Homo sapiens
aggcaggtgggtcacttgagtc

SEQ ID NO: 8408376 - DNA, 22 bp, Homo sapiens
aggcaggtgggagtgattcctt

SEQ ID NO: 8408377 - DNA, 22 bp, Homo sapiens
aggcagatgggagctggaagtt

SEQ ID NO: 8408378 - DNA, 22 bp, Homo sapiens
aggcagatgaacctgggttgag

SEQ ID NO: 8408379 - DNA, 22 bp, Homo sapiens
aggcagtgtattgctagcggct

SEQ ID NO: 8408380 - DNA, 22 bp, Homo sapiens
acagccagaggagccaggctgg

SEQ ID NO: 8408381 - DNA, 22 bp, Homo sapiens
acagccagaggagccaggctgg

SEQ ID NO: 8408382 - DNA, 22 bp, Homo sapiens
acaggaagtttggaaagcctca

SEQ ID NO: 8408383 - DNA, 22 bp, Homo sapiens
acaggacaactcagcagccagc

SEQ ID NO: 8408384 - DNA, 22 bp, Homo sapiens
acaggaagtttggaaagcctca

SEQ ID NO: 8408385 - DNA, 22 bp, Homo sapiens
acaggacaactcagcagccagc

SEQ ID NO: 8408386 - DNA, 22 bp, Homo sapiens
acaggaagaaagtgcagtagat

SEQ ID NO: 8408387 - DNA, 22 bp, Homo sapiens
acaggaagctggagacccttga

SEQ ID NO: 8408388 - DNA, 22 bp, Homo sapiens
acaggaagtgctggcacttaca

SEQ ID NO: 8408389 - DNA, 22 bp, Homo sapiens
acaggaagtgggaagaaacagg

SEQ ID NO: 8408390 - DNA, 20 bp, Homo sapiens
acagccagaggaggcagaca

SEQ ID NO: 8408391 - DNA, 22 bp, Homo sapiens
aggaaaggtgagagcggccgcg

SEQ ID NO: 8408392 - DNA, 22 bp, Homo sapiens
aggaaaggttcagtgattgaaa

SEQ ID NO: 8408393 - DNA, 22 bp, Homo sapiens
aggacaggtgtagtgggctctg

SEQ ID NO: 8408394 - DNA, 22 bp, Homo sapiens
aggacaggtgtagtgggctctg

SEQ ID NO: 8408395 - DNA, 22 bp, Homo sapiens
aggactggccctgaggggaggc

SEQ ID NO: 8408396 - DNA, 22 bp, Homo sapiens
aggactggtgtgtgatcagcat

SEQ ID NO: 8408397 - DNA, 22 bp, Homo sapiens
acagggcccttgccagcacaag

SEQ ID NO: 8408398 - DNA, 22 bp, Homo sapiens
acagggcctcagccagggcaga

SEQ ID NO: 8408399 - DNA, 23 bp, Homo sapiens
acagggctagctgacagtggtat

SEQ ID NO: 8408400 - DNA, 22 bp, Homo sapiens
ccagtgtagctcaggactgggc

SEQ ID NO: 8408401 - DNA, 22 bp, Homo sapiens
aggctgccctgccgccagtggg

SEQ ID NO: 8408402 - DNA, 22 bp, Homo sapiens
aggctgccgcagccaatggttg

SEQ ID NO: 8408403 - DNA, 20 bp, Homo sapiens
aggctgccaggtctcacatc

SEQ ID NO: 8408404 - DNA, 22 bp, Homo sapiens
cccacacacatttatgatagga

SEQ ID NO: 8408405 - DNA, 22 bp, Homo sapiens
cccactccctacgacacgctcc

SEQ ID NO: 8408406 - DNA, 22 bp, Homo sapiens
aggctgtggggttctgctttca

SEQ ID NO: 8408407 - DNA, 22 bp, Homo sapiens
aggctcagatccttgtgtcctg

SEQ ID NO: 8408408 - DNA, 22 bp, Homo sapiens
aggctcagattcacatttggtt

SEQ ID NO: 8408409 - DNA, 22 bp, Homo sapiens
aggctcagcccaaggtggagag

SEQ ID NO: 8408410 - DNA, 22 bp, Homo sapiens
aggctcagcatctgattcatat

SEQ ID NO: 8408411 - DNA, 21 bp, Homo sapiens
aggctcagcaggtgtataaag

SEQ ID NO: 8408412 - DNA, 22 bp, Homo sapiens
aggctcagcccctgggaggaga

SEQ ID NO: 8408413 - DNA, 22 bp, Homo sapiens
aggctcagcctgggcctagagc

SEQ ID NO: 8408414 - DNA, 22 bp, Homo sapiens
ccagtagttggacaaatagatt

SEQ ID NO: 8408415 - DNA, 20 bp, Homo sapiens
ccaggtggtgcctggagagg

SEQ ID NO: 8408416 - DNA, 22 bp, Homo sapiens
ccagggcagaaaaagagggaat

SEQ ID NO: 8408417 - DNA, 22 bp, Homo sapiens
ccagggcagcagaattggggca

SEQ ID NO: 8408418 - DNA, 22 bp, Homo sapiens
ccagggcagcgcccctccacgc

SEQ ID NO: 8408419 - DNA, 20 bp, Homo sapiens
aggctcagagcagtagtaca

SEQ ID NO: 8408420 - DNA, 16 bp, Homo sapiens
aggctcagaggctgga

SEQ ID NO: 8408421 - DNA, 22 bp, Homo sapiens
aggctcagaggtgagcatctgc

SEQ ID NO: 8408422 - DNA, 20 bp, Homo sapiens
aggctcagatacccagggaa

SEQ ID NO: 8408423 - DNA, 22 bp, Homo sapiens
ccaggcacaggtgggcctcaga

SEQ ID NO: 8408424 - DNA, 22 bp, Homo sapiens
aggcctggtgtgccggatgcag

SEQ ID NO: 8408425 - DNA, 22 bp, Homo sapiens
aggctcagagagctgtgtccat

SEQ ID NO: 8408426 - DNA, 21 bp, Homo sapiens
aggctcagagagaaactcttg

SEQ ID NO: 8408427 - DNA, 22 bp, Homo sapiens
aggctcagagatgagtaagcac

SEQ ID NO: 8408428 - DNA, 21 bp, Homo sapiens
aggctcagagatcaaacagta

SEQ ID NO: 8408429 - DNA, 22 bp, Homo sapiens
aggcctgggtctcgtgcctacc

SEQ ID NO: 8408430 - DNA, 22 bp, Homo sapiens
ccaggaggtgctggaagaaagc

SEQ ID NO: 8408431 - DNA, 22 bp, Homo sapiens
ccaggaggtggagattgcagtg

SEQ ID NO: 8408432 - DNA, 22 bp, Homo sapiens
ccaggaggtggaggttgcggtg

SEQ ID NO: 8408433 - DNA, 22 bp, Homo sapiens
ccaggaggtggcaggacttgcc

SEQ ID NO: 8408434 - DNA, 22 bp, Homo sapiens
ccaggaggtgaaacttcaccag

SEQ ID NO: 8408435 - DNA, 22 bp, Homo sapiens
ccaggaggtctgagtgtggaca

SEQ ID NO: 8408436 - DNA, 22 bp, Homo sapiens
ccaggagggtggttactcaatc

SEQ ID NO: 8408437 - DNA, 22 bp, Homo sapiens
ccaggaggggtctctgtctccc

SEQ ID NO: 8408438 - DNA, 22 bp, Homo sapiens
ccaggagggaggagttcctgag

SEQ ID NO: 8408439 - DNA, 22 bp, Homo sapiens
ccagctccctgaagcctggtct

SEQ ID NO: 8408440 - DNA, 22 bp, Homo sapiens
ccaggaggatgaggggcataga

SEQ ID NO: 8408441 - DNA, 22 bp, Homo sapiens
ccaggaggatcatcctgttttc

SEQ ID NO: 8408442 - DNA, 22 bp, Homo sapiens
aggcaggtctgtatctagtctc

SEQ ID NO: 8408443 - DNA, 22 bp, Homo sapiens
ccagccagctggttggacgcct

SEQ ID NO: 8408444 - DNA, 22 bp, Homo sapiens
ccagccagatgataagctctat

SEQ ID NO: 8408445 - DNA, 22 bp, Homo sapiens
cccaggaatgagcaggcagggg

SEQ ID NO: 8408446 - DNA, 22 bp, Homo sapiens
agggaatggatgatggcaggtt

SEQ ID NO: 8408447 - DNA, 22 bp, Homo sapiens
agggacagtctactgttcactg

SEQ ID NO: 8408448 - DNA, 22 bp, Homo sapiens
agggacagtctactgttcactg

SEQ ID NO: 8408449 - DNA, 22 bp, Homo sapiens
agggacagttacatcatcagac

SEQ ID NO: 8408450 - DNA, 22 bp, Homo sapiens
agggactccctgggccgacacg

SEQ ID NO: 8408451 - DNA, 23 bp, Homo sapiens
cccaggtgtggaggcggtggcag

SEQ ID NO: 8408452 - DNA, 22 bp, Homo sapiens
agggcagcttccatagtctggc

SEQ ID NO: 8408453 - DNA, 22 bp, Homo sapiens
aggggtcagtgaccattgagga

SEQ ID NO: 8408454 - DNA, 22 bp, Homo sapiens
aggggtcttgggagtcctggct

SEQ ID NO: 8408455 - DNA, 22 bp, Homo sapiens
aggggaaatctctcgccatctg

SEQ ID NO: 8408456 - DNA, 22 bp, Homo sapiens
agggctcttcctttgcctctca

SEQ ID NO: 8408457 - DNA, 22 bp, Homo sapiens
cctcaggtgtgggccagctgtc

SEQ ID NO: 8408458 - DNA, 22 bp, Homo sapiens
caggcccatctgctcccaggct

SEQ ID NO: 8408459 - DNA, 22 bp, Homo sapiens
agctgtcctggctcaggctgtg

SEQ ID NO: 8408460 - DNA, 22 bp, Homo sapiens
agctggtggaagggagcccaaa

SEQ ID NO: 8408461 - DNA, 22 bp, Homo sapiens
caggcagccttctcgtctcaca

SEQ ID NO: 8408462 - DNA, 22 bp, Homo sapiens
caggagcagagggtggtcagca

SEQ ID NO: 8408463 - DNA, 22 bp, Homo sapiens
caggatggagggagggctgtta

SEQ ID NO: 8408464 - DNA, 22 bp, Homo sapiens
caggatggagagtgaggggtca

SEQ ID NO: 8408465 - DNA, 22 bp, Homo sapiens
caggatggagagtgaggggtca

SEQ ID NO: 8408466 - DNA, 22 bp, Homo sapiens
caggcacacatccgtgagagat

SEQ ID NO: 8408467 - DNA, 22 bp, Homo sapiens
caggcacacccactggtgcaga

SEQ ID NO: 8408468 - DNA, 22 bp, Homo sapiens
caggcacacaggctccctgggc

SEQ ID NO: 8408469 - DNA, 22 bp, Homo sapiens
caggcacacagcacatggcctg

SEQ ID NO: 8408470 - DNA, 22 bp, Homo sapiens
caggcacaattatttccctttc

SEQ ID NO: 8408471 - DNA, 22 bp, Homo sapiens
caggatggccccggggctgtgc

SEQ ID NO: 8408472 - DNA, 22 bp, Homo sapiens
caggatgggatgtagtgggccc

SEQ ID NO: 8408473 - DNA, 22 bp, Homo sapiens
caggagcaaggagcagtgggat

SEQ ID NO: 8408474 - DNA, 22 bp, Homo sapiens
caggagaaggtttggagtgcag

SEQ ID NO: 8408475 - DNA, 22 bp, Homo sapiens
caggacgggcaaacaggatggt

SEQ ID NO: 8408476 - DNA, 22 bp, Homo sapiens
caggacgggcaaacaggatggt

SEQ ID NO: 8408477 - DNA, 22 bp, Homo sapiens
caggctcttccatcctgctgag

SEQ ID NO: 8408478 - DNA, 22 bp, Homo sapiens
cagggatgtgatgagctgagcc

SEQ ID NO: 8408479 - DNA, 19 bp, Homo sapiens
aggaaaggatcaaaatagc

SEQ ID NO: 8408480 - DNA, 18 bp, Homo sapiens
cagggctgtggggtcact

SEQ ID NO: 8408481 - DNA, 22 bp, Homo sapiens
aggaagagcccgggtgacataa

SEQ ID NO: 8408482 - DNA, 22 bp, Homo sapiens
aggaagagctggaccagaggac

SEQ ID NO: 8408483 - DNA, 22 bp, Homo sapiens
aggaagagctggaccagaggac

SEQ ID NO: 8408484 - DNA, 22 bp, Homo sapiens
cagtaaacactagcattcttgg

SEQ ID NO: 8408485 - DNA, 22 bp, Homo sapiens
cagtaaatataggaacgtggaa

SEQ ID NO: 8408486 - DNA, 22 bp, Homo sapiens
cagtaaatctctatctgccatt

SEQ ID NO: 8408487 - DNA, 22 bp, Homo sapiens
cagtaagaatatgaatcaggat

SEQ ID NO: 8408488 - DNA, 22 bp, Homo sapiens
aggaatatggatttgctcagct

SEQ ID NO: 8408489 - DNA, 18 bp, Homo sapiens
aggaatattcaaggtgct

SEQ ID NO: 8408490 - DNA, 22 bp, Homo sapiens
aggaatattctcaagtggtcgt

SEQ ID NO: 8408491 - DNA, 22 bp, Homo sapiens
aggaatctgggcccaactgtgc

SEQ ID NO: 8408492 - DNA, 22 bp, Homo sapiens
aggaatatgagctgctgcagtg

SEQ ID NO: 8408493 - DNA, 22 bp, Homo sapiens
aggaatagaccacttcactgag

SEQ ID NO: 8408494 - DNA, 22 bp, Homo sapiens
aggaagtgtcagggataacgat

SEQ ID NO: 8408495 - DNA, 22 bp, Homo sapiens
aggacacatgcacaccctgcgt

SEQ ID NO: 8408496 - DNA, 21 bp, Homo sapiens
aggaagtggccagattgggaa

SEQ ID NO: 8408497 - DNA, 22 bp, Homo sapiens
aggaagtggataaaatagcttt

SEQ ID NO: 8408498 - DNA, 22 bp, Homo sapiens
aggcaaggtgctacagacagtg

SEQ ID NO: 8408499 - DNA, 17 bp, Homo sapiens
aggcaatgactgtggtt

SEQ ID NO: 8408500 - DNA, 22 bp, Homo sapiens
catttacctttaattaaaacac

SEQ ID NO: 8408501 - DNA, 22 bp, Homo sapiens
catttcaaaagaattgccagaa

SEQ ID NO: 8408502 - DNA, 22 bp, Homo sapiens
catttcaagcattgacttctat

SEQ ID NO: 8408503 - DNA, 22 bp, Homo sapiens
catttcaagtaacagattgctt

SEQ ID NO: 8408504 - DNA, 22 bp, Homo sapiens
catttcaagtaacagattgctt

SEQ ID NO: 8408505 - DNA, 22 bp, Homo sapiens
catttcaatactatctgagaat

SEQ ID NO: 8408506 - DNA, 23 bp, Homo sapiens
ccactagcacctgttcaacttct

SEQ ID NO: 8408507 - DNA, 22 bp, Homo sapiens
ccacccacaaccagctggctgt

SEQ ID NO: 8408508 - DNA, 20 bp, Homo sapiens
ccacccacgcgggctctgcc

SEQ ID NO: 8408509 - DNA, 22 bp, Homo sapiens
aggcaggaggatcatggatgca

SEQ ID NO: 8408510 - DNA, 22 bp, Homo sapiens
aggcaggagtgaccctgacagg

SEQ ID NO: 8408511 - DNA, 17 bp, Homo sapiens
aggcaggagattggaga

SEQ ID NO: 8408512 - DNA, 21 bp, Homo sapiens
aggagccagcctgtcagtcta

SEQ ID NO: 8408513 - DNA, 22 bp, Homo sapiens
cagtgtggagggagagagcctg

SEQ ID NO: 8408514 - DNA, 22 bp, Homo sapiens
cagtgtggctgagacagaggct

SEQ ID NO: 8408515 - DNA, 22 bp, Homo sapiens
aggagctgtcagagtgccagag

SEQ ID NO: 8408516 - DNA, 22 bp, Homo sapiens
aggagctggtagtctcattggg

SEQ ID NO: 8408517 - DNA, 22 bp, Homo sapiens
aggaggctctcaggtcctcccc

SEQ ID NO: 8408518 - DNA, 22 bp, Homo sapiens
aggatggggtctgcagcctggt

SEQ ID NO: 8408519 - DNA, 22 bp, Homo sapiens
catcttgggtaagcagttgctt

SEQ ID NO: 8408520 - DNA, 22 bp, Homo sapiens
catcttggttcaatttcttcat

SEQ ID NO: 8408521 - DNA, 20 bp, Homo sapiens
catcttgaaggtcttccaca

SEQ ID NO: 8408522 - DNA, 22 bp, Homo sapiens
catcttgaaggtttctttagct

SEQ ID NO: 8408523 - DNA, 22 bp, Homo sapiens
catgaggtcagggggagccggt

SEQ ID NO: 8408524 - DNA, 22 bp, Homo sapiens
catgaggatgggcagctgggga

SEQ ID NO: 8408525 - DNA, 22 bp, Homo sapiens
catgagagacattctgtgtgaa

SEQ ID NO: 8408526 - DNA, 22 bp, Homo sapiens
aggatgtgccaccagctttgca

SEQ ID NO: 8408527 - DNA, 22 bp, Homo sapiens
aggatgtctctccagcctggag

SEQ ID NO: 8408528 - DNA, 23 bp, Homo sapiens
aggatgtcgaatgttagagtgag

SEQ ID NO: 8408529 - DNA, 22 bp, Homo sapiens
aggatgtctgctgctgtgggct

SEQ ID NO: 8408530 - DNA, 20 bp, Homo sapiens
aggatgtccccgagggcctg

SEQ ID NO: 8408531 - DNA, 22 bp, Homo sapiens
aggatgtcagcattggctagag

SEQ ID NO: 8408532 - DNA, 22 bp, Homo sapiens
ctgcacaatgcaccatcaagtt

SEQ ID NO: 8408533 - DNA, 22 bp, Homo sapiens
ctgaggagcagctggcccgcta

SEQ ID NO: 8408534 - DNA, 22 bp, Homo sapiens
ctggaatgggccatttgaggcc

SEQ ID NO: 8408535 - DNA, 22 bp, Homo sapiens
atacagtagacaatctcatgaa

SEQ ID NO: 8408536 - DNA, 22 bp, Homo sapiens
atacagtaatttgtaactcatc

SEQ ID NO: 8408537 - DNA, 22 bp, Homo sapiens
ctggagaattctatgaaatatt

SEQ ID NO: 8408538 - DNA, 22 bp, Homo sapiens
ctggagagaatgtggaatgatt

SEQ ID NO: 8408539 - DNA, 20 bp, Homo sapiens
atacagtaggtgctcaatat

SEQ ID NO: 8408540 - DNA, 22 bp, Homo sapiens
atacagtattacctgttcagga

SEQ ID NO: 8408541 - DNA, 22 bp, Homo sapiens
atacatgttcgtgtacatgttc

SEQ ID NO: 8408542 - DNA, 22 bp, Homo sapiens
atacatgtgtgtgcatacatgt

SEQ ID NO: 8408543 - DNA, 20 bp, Homo sapiens
atctgaggctgtcgctggaa

SEQ ID NO: 8408544 - DNA, 22 bp, Homo sapiens
atctgaggtatatgactggcta

SEQ ID NO: 8408545 - DNA, 22 bp, Homo sapiens
cttagacatggcagctccaagt

SEQ ID NO: 8408546 - DNA, 22 bp, Homo sapiens
ctgtggctaggaagctgtggga

SEQ ID NO: 8408547 - DNA, 23 bp, Homo sapiens
ctgtggccctgcttcatgcagcc

SEQ ID NO: 8408548 - DNA, 19 bp, Homo sapiens
ctgggctgaggtctgcctt

SEQ ID NO: 8408549 - DNA, 22 bp, Homo sapiens
ctggctggccggagcgaggcgg

SEQ ID NO: 8408550 - DNA, 22 bp, Homo sapiens
ctgggctcacctgtggctggca

SEQ ID NO: 8408551 - DNA, 22 bp, Homo sapiens
ctgggctcagatgagaggaagg

SEQ ID NO: 8408552 - DNA, 22 bp, Homo sapiens
ctccagctagggctggcttact

SEQ ID NO: 8408553 - DNA, 22 bp, Homo sapiens
ctcattgcaacctccgcctccc

SEQ ID NO: 8408554 - DNA, 22 bp, Homo sapiens
ctcattgcccagatccccacag

SEQ ID NO: 8408555 - DNA, 22 bp, Homo sapiens
ctccagctttttcccagttggc

SEQ ID NO: 8408556 - DNA, 22 bp, Homo sapiens
ctccagggaaaggggcgtccgc

SEQ ID NO: 8408557 - DNA, 22 bp, Homo sapiens
agtcctgggtccagcaggtcct

SEQ ID NO: 8408558 - DNA, 18 bp, Homo sapiens
ctccagggaactcagtca

SEQ ID NO: 8408559 - DNA, 20 bp, Homo sapiens
ctccagggaacagactggag

SEQ ID NO: 8408560 - DNA, 22 bp, Homo sapiens
agtggcagatctctggtctgga

SEQ ID NO: 8408561 - DNA, 22 bp, Homo sapiens
agtggcagagtgcactcaggca

SEQ ID NO: 8408562 - DNA, 22 bp, Homo sapiens
agtggcagaagccaagtctgca

SEQ ID NO: 8408563 - DNA, 22 bp, Homo sapiens
ctctggggtggaggaggctgac

SEQ ID NO: 8408564 - DNA, 22 bp, Homo sapiens
agttaagagtgtgaaaatgtta

SEQ ID NO: 8408565 - DNA, 22 bp, Homo sapiens
ctgaggagaacaatgagatcaa

SEQ ID NO: 8408566 - DNA, 22 bp, Homo sapiens
ctgaggagaggtggcctgtgtt

SEQ ID NO: 8408567 - DNA, 22 bp, Homo sapiens
ctgagcagcaacccagagcctc

SEQ ID NO: 8408568 - DNA, 22 bp, Homo sapiens
ctgagcagatgaccagccccag

SEQ ID NO: 8408569 - DNA, 22 bp, Homo sapiens
cctgtgcatgccagggtacacc

SEQ ID NO: 8408570 - DNA, 22 bp, Homo sapiens
cctgtgcattgagtttgcaccc

SEQ ID NO: 8408571 - DNA, 22 bp, Homo sapiens
cctgtgcattgaccacactctc

SEQ ID NO: 8408572 - DNA, 22 bp, Homo sapiens
cctgtgcattgcagggtgttca

SEQ ID NO: 8408573 - DNA, 22 bp, Homo sapiens
aggtggggaggagtgtctcttt

SEQ ID NO: 8408574 - DNA, 22 bp, Homo sapiens
aggtggggcccaccaatttgca

SEQ ID NO: 8408575 - DNA, 22 bp, Homo sapiens
aggtggggccaaatgctacagt

SEQ ID NO: 8408576 - DNA, 22 bp, Homo sapiens
cctgtgcatccggtggtcattg

SEQ ID NO: 8408577 - DNA, 22 bp, Homo sapiens
cctgtgcactatctgcattttt

SEQ ID NO: 8408578 - DNA, 22 bp, Homo sapiens
cctgtgcagcccttgccagttt

SEQ ID NO: 8408579 - DNA, 22 bp, Homo sapiens
cctgtgcaggctccataataga

SEQ ID NO: 8408580 - DNA, 22 bp, Homo sapiens
cctgtgcaatgttgaggtttca

SEQ ID NO: 8408581 - DNA, 19 bp, Homo sapiens
cctgtgcacatgtgtcctt

SEQ ID NO: 8408582 - DNA, 19 bp, Homo sapiens
aggtcctcaggatgaccct

SEQ ID NO: 8408583 - DNA, 22 bp, Homo sapiens
aggtcccagtgttagggtgaca

SEQ ID NO: 8408584 - DNA, 22 bp, Homo sapiens
cctggcacagagcggtggtcac

SEQ ID NO: 8408585 - DNA, 23 bp, Homo sapiens
cctggcacacagttgacatggaa

SEQ ID NO: 8408586 - DNA, 22 bp, Homo sapiens
cctggcaacatttcaaggtctt

SEQ ID NO: 8408587 - DNA, 22 bp, Homo sapiens
aggtagggaagaaggcatgaaa

SEQ ID NO: 8408588 - DNA, 22 bp, Homo sapiens
aggtagggctaggctgcgtctg

SEQ ID NO: 8408589 - DNA, 22 bp, Homo sapiens
aggtagggggtttgggaactgc

SEQ ID NO: 8408590 - DNA, 23 bp, Homo sapiens
cctgcagctgctggggctccacc

SEQ ID NO: 8408591 - DNA, 22 bp, Homo sapiens
cggctcagctagcttggcccca

SEQ ID NO: 8408592 - DNA, 22 bp, Homo sapiens
agtacactatggtaactggagt

SEQ ID NO: 8408593 - DNA, 20 bp, Homo sapiens
agtacaatgtatgattcaga

SEQ ID NO: 8408594 - DNA, 22 bp, Homo sapiens
ctacccagatccaggatggcta

SEQ ID NO: 8408595 - DNA, 22 bp, Homo sapiens
agtatttagagacacaagatgg

SEQ ID NO: 8408596 - DNA, 22 bp, Homo sapiens
agtatgtattttatacttacag

SEQ ID NO: 8408597 - DNA, 22 bp, Homo sapiens
ctaaggaagtgacagtgggatt

SEQ ID NO: 8408598 - DNA, 22 bp, Homo sapiens
cacagaggaaaggcagttggta

SEQ ID NO: 8408599 - DNA, 22 bp, Homo sapiens
cacagaggaaaggcagttggta

SEQ ID NO: 8408600 - DNA, 22 bp, Homo sapiens
cacagaggatgcccaagcgatc

SEQ ID NO: 8408601 - DNA, 22 bp, Homo sapiens
cacagaggatttttagggcagt

SEQ ID NO: 8408602 - DNA, 21 bp, Homo sapiens
cacagaggcgctgtatggctg

SEQ ID NO: 8408603 - DNA, 21 bp, Homo sapiens
ggaagggctctgaggacggct

SEQ ID NO: 8408604 - DNA, 22 bp, Homo sapiens
cacacaggagagtgctggaggt

SEQ ID NO: 8408605 - DNA, 21 bp, Homo sapiens
cacacagctgcccttaggtag

SEQ ID NO: 8408606 - DNA, 21 bp, Homo sapiens
cacacagctgcccttaggtag

SEQ ID NO: 8408607 - DNA, 22 bp, Homo sapiens
cacacagctcaggggcactgcc

SEQ ID NO: 8408608 - DNA, 22 bp, Homo sapiens
ggaggccaaggaggagcttgcc

SEQ ID NO: 8408609 - DNA, 22 bp, Homo sapiens
ggaggcaggaaagacaggttca

SEQ ID NO: 8408610 - DNA, 22 bp, Homo sapiens
cacaggaatcagcattaatggc

SEQ ID NO: 8408611 - DNA, 18 bp, Homo sapiens
cacaggaaggggaatatc

SEQ ID NO: 8408612 - DNA, 22 bp, Homo sapiens
cacaggaagtggtcagtgccag

SEQ ID NO: 8408613 - DNA, 22 bp, Homo sapiens
cacaggaatgaacagggaaaga

SEQ ID NO: 8408614 - DNA, 22 bp, Homo sapiens
cacaggaattagcagcctaaaa

SEQ ID NO: 8408615 - DNA, 22 bp, Homo sapiens
cacaggaccaattcacattcca

SEQ ID NO: 8408616 - DNA, 22 bp, Homo sapiens
gctggctgtatcacctggccag

SEQ ID NO: 8408617 - DNA, 22 bp, Homo sapiens
gctggctggctgtgcaaaggca

SEQ ID NO: 8408618 - DNA, 22 bp, Homo sapiens
caaggccagtttctcctagtca

SEQ ID NO: 8408619 - DNA, 22 bp, Homo sapiens
caaggccataagagatacaaaa

SEQ ID NO: 8408620 - DNA, 22 bp, Homo sapiens
caagccagcagtttaatgactc

SEQ ID NO: 8408621 - DNA, 22 bp, Homo sapiens
gctggaggatggactggaagaa

SEQ ID NO: 8408622 - DNA, 22 bp, Homo sapiens
ggctctggaatgtgtagtcagg

SEQ ID NO: 8408623 - DNA, 22 bp, Homo sapiens
ggctctggtcagtgaggggcct

SEQ ID NO: 8408624 - DNA, 18 bp, Homo sapiens
ggctccagtcttcagtgg

SEQ ID NO: 8408625 - DNA, 22 bp, Homo sapiens
ggctctggtgggaaggttagat

SEQ ID NO: 8408626 - DNA, 22 bp, Homo sapiens
ggctgaggcggcgatgcccttg

SEQ ID NO: 8408627 - DNA, 22 bp, Homo sapiens
ggctcagggaatgaggaagaat

SEQ ID NO: 8408628 - DNA, 22 bp, Homo sapiens
ggctcaggctggagtgcagtgg

SEQ ID NO: 8408629 - DNA, 22 bp, Homo sapiens
ggctcacacatgactgggctct

SEQ ID NO: 8408630 - DNA, 22 bp, Homo sapiens
ggctggtgttacagtcggcagc

SEQ ID NO: 8408631 - DNA, 21 bp, Homo sapiens
ggctggtgtttagctgtgata

SEQ ID NO: 8408632 - DNA, 22 bp, Homo sapiens
ggctgtgaagtagcaggggcag

SEQ ID NO: 8408633 - DNA, 22 bp, Homo sapiens
ggctgcctcaaagctcaagctc

SEQ ID NO: 8408634 - DNA, 22 bp, Homo sapiens
cagaaacatgtataaagttgta

SEQ ID NO: 8408635 - DNA, 21 bp, Homo sapiens
caccttggaaggtggagagtt

SEQ ID NO: 8408636 - DNA, 22 bp, Homo sapiens
ggccgtgctccaaagtcatcgt

SEQ ID NO: 8408637 - DNA, 22 bp, Homo sapiens
ggcagggcaggaaagtcaggaa

SEQ ID NO: 8408638 - DNA, 22 bp, Homo sapiens
ggcagggcaggaaagtcaggaa

SEQ ID NO: 8408639 - DNA, 22 bp, Homo sapiens
ggcaggtgccagttggcttggg

SEQ ID NO: 8408640 - DNA, 22 bp, Homo sapiens
ggccaaggatggtggctctggt

SEQ ID NO: 8408641 - DNA, 22 bp, Homo sapiens
ggaggtgcagagtagggttggt

SEQ ID NO: 8408642 - DNA, 22 bp, Homo sapiens
cacatttaggaggtggggaagc

SEQ ID NO: 8408643 - DNA, 22 bp, Homo sapiens
ggcaggcatcatcagttgatca

SEQ ID NO: 8408644 - DNA, 22 bp, Homo sapiens
ggcaggcatcatgtggtcatta

SEQ ID NO: 8408645 - DNA, 22 bp, Homo sapiens
ggcaggcatggggtctgccatt

SEQ ID NO: 8408646 - DNA, 22 bp, Homo sapiens
ggtgctgatgaagatgtagcct

SEQ ID NO: 8408647 - DNA, 22 bp, Homo sapiens
ggtgctgaggccttggcaggga

SEQ ID NO: 8408648 - DNA, 22 bp, Homo sapiens
cagcaaggactgggcatgtgaa

SEQ ID NO: 8408649 - DNA, 22 bp, Homo sapiens
ggtgaccagggtcagtagcttt

SEQ ID NO: 8408650 - DNA, 19 bp, Homo sapiens
ggtgaccacctggtcagtg

SEQ ID NO: 8408651 - DNA, 22 bp, Homo sapiens
ggtgagagaaaagaaacactgt

SEQ ID NO: 8408652 - DNA, 22 bp, Homo sapiens
ggtgactcatgtgtgttttcag

SEQ ID NO: 8408653 - DNA, 22 bp, Homo sapiens
ggtgacttgaaggcaactgaag

SEQ ID NO: 8408654 - DNA, 22 bp, Homo sapiens
cagcaagacagtttcctaagtg

SEQ ID NO: 8408655 - DNA, 22 bp, Homo sapiens
cagagtctctgggaggctgggt

SEQ ID NO: 8408656 - DNA, 22 bp, Homo sapiens
cagagtctgcgagcagaggggc

SEQ ID NO: 8408657 - DNA, 22 bp, Homo sapiens
ggtcatggatagctggagcctt

SEQ ID NO: 8408658 - DNA, 22 bp, Homo sapiens
cagagggctcagtcctgctgga

SEQ ID NO: 8408659 - DNA, 22 bp, Homo sapiens
cagagggctgccctgagttcgt

SEQ ID NO: 8408660 - DNA, 22 bp, Homo sapiens
cagactggctgaaggccgagtg

SEQ ID NO: 8408661 - DNA, 22 bp, Homo sapiens
cagaccagccatttgcctcttc

SEQ ID NO: 8408662 - DNA, 22 bp, Homo sapiens
cagaccccgagtttgcagagtt

SEQ ID NO: 8408663 - DNA, 22 bp, Homo sapiens
gggcagtggttacacagctgag

SEQ ID NO: 8408664 - DNA, 22 bp, Homo sapiens
gggcagcatgaggaccctcatc

SEQ ID NO: 8408665 - DNA, 22 bp, Homo sapiens
gggcagcatcaggaggggcttt

SEQ ID NO: 8408666 - DNA, 21 bp, Homo sapiens
gggcagcagcagcaacaaggg

SEQ ID NO: 8408667 - DNA, 22 bp, Homo sapiens
gggcagcagcaggaggtctctg

SEQ ID NO: 8408668 - DNA, 22 bp, Homo sapiens
gggccagagcttggcagctggg

SEQ ID NO: 8408669 - DNA, 22 bp, Homo sapiens
gggccagacccttggcgatctg

SEQ ID NO: 8408670 - DNA, 17 bp, Homo sapiens
gggctgacagtggcctc

SEQ ID NO: 8408671 - DNA, 22 bp, Homo sapiens
gggctgactctgcactgagcca

SEQ ID NO: 8408672 - DNA, 22 bp, Homo sapiens
cagagcccttggctggagccca

SEQ ID NO: 8408673 - DNA, 22 bp, Homo sapiens
cagaggcaaaagaggtggaggt

SEQ ID NO: 8408674 - DNA, 22 bp, Homo sapiens
cagaggattatggagatggtct

SEQ ID NO: 8408675 - DNA, 22 bp, Homo sapiens
cagaggatgatctggcctctct

SEQ ID NO: 8408676 - DNA, 22 bp, Homo sapiens
gggctgaggggtatctcatggg

SEQ ID NO: 8408677 - DNA, 22 bp, Homo sapiens
gggctgagtcatctggggcctc

SEQ ID NO: 8408678 - DNA, 22 bp, Homo sapiens
gggctgagtgacctcaggccaa

SEQ ID NO: 8408679 - DNA, 22 bp, Homo sapiens
gtccctggtttgcccaggacca

SEQ ID NO: 8408680 - DNA, 22 bp, Homo sapiens
gtcccaggctccatggcagcca

SEQ ID NO: 8408681 - DNA, 22 bp, Homo sapiens
cagccaggcctggtgaccaaag

SEQ ID NO: 8408682 - DNA, 22 bp, Homo sapiens
gtctgtgcttattcagcagggg

SEQ ID NO: 8408683 - DNA, 22 bp, Homo sapiens
cagccctcatcccgcctgcgtt

SEQ ID NO: 8408684 - DNA, 22 bp, Homo sapiens
cagcccccatggggaggtcaag

SEQ ID NO: 8408685 - DNA, 22 bp, Homo sapiens
cagcccctcacagagctgtcct

SEQ ID NO: 8408686 - DNA, 22 bp, Homo sapiens
cagcccgccctgaactttcggg

SEQ ID NO: 8408687 - DNA, 22 bp, Homo sapiens
cagccagggtcaggcagcttct

SEQ ID NO: 8408688 - DNA, 22 bp, Homo sapiens
cagccaggtatgggcgtgcggg

SEQ ID NO: 8408689 - DNA, 22 bp, Homo sapiens
cagcaggaaggtttcccctgca

SEQ ID NO: 8408690 - DNA, 22 bp, Homo sapiens
cagcaggaaagacatctgagca

SEQ ID NO: 8408691 - DNA, 22 bp, Homo sapiens
cagcagctggtgagacacagcc

SEQ ID NO: 8408692 - DNA, 22 bp, Homo sapiens
cagcaggctgcgattgctcatt

SEQ ID NO: 8408693 - DNA, 22 bp, Homo sapiens
gtcccaggcaggccactggcag

SEQ ID NO: 8408694 - DNA, 22 bp, Homo sapiens
gtcccaggagttgctgggcctt

SEQ ID NO: 8408695 - DNA, 20 bp, Homo sapiens
cagcctccactcactcagct

SEQ ID NO: 8408696 - DNA, 22 bp, Homo sapiens
cagccctgcagccatggcctgt

SEQ ID NO: 8408697 - DNA, 21 bp, Homo sapiens
cagcctgctgctccagggcca

SEQ ID NO: 8408698 - DNA, 20 bp, Homo sapiens
gtgcccagttggtgacagac

SEQ ID NO: 8408699 - DNA, 22 bp, Homo sapiens
gtgcccagttgaggccaggact

SEQ ID NO: 8408700 - DNA, 18 bp, Homo sapiens
gtgctgtgggcagtggcc

SEQ ID NO: 8408701 - DNA, 22 bp, Homo sapiens
gtgctgtgtctatcaggaataa

SEQ ID NO: 8408702 - DNA, 21 bp, Homo sapiens
atggagggaccagggaagcag

SEQ ID NO: 8408703 - DNA, 22 bp, Homo sapiens
atggagggaaaagtggagagcc

SEQ ID NO: 8408704 - DNA, 22 bp, Homo sapiens
atggagggtgtcagagagcgaa

SEQ ID NO: 8408705 - DNA, 22 bp, Homo sapiens
gactggggctctagccaggcct

SEQ ID NO: 8408706 - DNA, 22 bp, Homo sapiens
gagagaggcctccatgtactga

SEQ ID NO: 8408707 - DNA, 22 bp, Homo sapiens
atggccagagagagcacacctg

SEQ ID NO: 8408708 - DNA, 21 bp, Homo sapiens
atggccagatctattaggtgg

SEQ ID NO: 8408709 - DNA, 22 bp, Homo sapiens
atggccagagaggccagcctgg

SEQ ID NO: 8408710 - DNA, 22 bp, Homo sapiens
gagatggtagcctcagaagagt

SEQ ID NO: 8408711 - DNA, 22 bp, Homo sapiens
atggccagagaaggcagggtca

SEQ ID NO: 8408712 - DNA, 22 bp, Homo sapiens
atggccagagagagcacacctg

SEQ ID NO: 8408713 - DNA, 22 bp, Homo sapiens
atggggctagacaaccagtgcc

SEQ ID NO: 8408714 - DNA, 22 bp, Homo sapiens
atggtgctcctgcaggaagcag

SEQ ID NO: 8408715 - DNA, 22 bp, Homo sapiens
atggtgactcctaaatgtgaaa

SEQ ID NO: 8408716 - DNA, 22 bp, Homo sapiens
gaggcagcctcagtggacctcg

SEQ ID NO: 8408717 - DNA, 22 bp, Homo sapiens
atgggctggggaagctcactcc

SEQ ID NO: 8408718 - DNA, 22 bp, Homo sapiens
atgggctgaggaagctcctgag

SEQ ID NO: 8408719 - DNA, 18 bp, Homo sapiens
atgggcaggtaagatcca

SEQ ID NO: 8408720 - DNA, 22 bp, Homo sapiens
atgggacacagtccgccctcta

SEQ ID NO: 8408721 - DNA, 22 bp, Homo sapiens
atgggacatagatccttgaggt

SEQ ID NO: 8408722 - DNA, 22 bp, Homo sapiens
atgggacaggtactagaaaggg

SEQ ID NO: 8408723 - DNA, 22 bp, Homo sapiens
atgggacagggctggctggtcc

SEQ ID NO: 8408724 - DNA, 22 bp, Homo sapiens
gaggtggcactgtgaggagcac

SEQ ID NO: 8408725 - DNA, 22 bp, Homo sapiens
gaggtggccaagcgaggaaggg

SEQ ID NO: 8408726 - DNA, 22 bp, Homo sapiens
gaggtggccagagtcaagagcc

SEQ ID NO: 8408727 - DNA, 22 bp, Homo sapiens
gaggtggcctcaagcagtcttc

SEQ ID NO: 8408728 - DNA, 22 bp, Homo sapiens
atgttattttggaaaatacaaa

SEQ ID NO: 8408729 - DNA, 22 bp, Homo sapiens
atgtgagggaaatcagtcagaa

SEQ ID NO: 8408730 - DNA, 22 bp, Homo sapiens
gagggctgaagattgtggcccc

SEQ ID NO: 8408731 - DNA, 23 bp, Homo sapiens
gagggctctgagtgcttgggcca

SEQ ID NO: 8408732 - DNA, 22 bp, Homo sapiens
gagggctctgaaaggaggtcac

SEQ ID NO: 8408733 - DNA, 22 bp, Homo sapiens
atgtagctgcagatgataatgc

SEQ ID NO: 8408734 - DNA, 20 bp, Homo sapiens
atgtagcagtgtgctgggaa

SEQ ID NO: 8408735 - DNA, 22 bp, Homo sapiens
gaccttgtgatctgcctgcctt

SEQ ID NO: 8408736 - DNA, 22 bp, Homo sapiens
atgctcagggcacactctggac

SEQ ID NO: 8408737 - DNA, 22 bp, Homo sapiens
gacctttagtgtcatgttatat

SEQ ID NO: 8408738 - DNA, 22 bp, Homo sapiens
gacatttattagaaaactatca

SEQ ID NO: 8408739 - DNA, 22 bp, Homo sapiens
atgcacaggctgtgggctggtt

SEQ ID NO: 8408740 - DNA, 22 bp, Homo sapiens
atgcacagtaatgagctggttg

SEQ ID NO: 8408741 - DNA, 22 bp, Homo sapiens
atgcacaggaagtgtccccatt

SEQ ID NO: 8408742 - DNA, 22 bp, Homo sapiens
atgcacaggaccacacataatg

SEQ ID NO: 8408743 - DNA, 22 bp, Homo sapiens
atgcacagcagtgagttcagtg

SEQ ID NO: 8408744 - DNA, 22 bp, Homo sapiens
gaaggctgtcagagaggagggc

SEQ ID NO: 8408745 - DNA, 22 bp, Homo sapiens
gaaggctgtggctggtctcagt

SEQ ID NO: 8408746 - DNA, 22 bp, Homo sapiens
gaaggctgtaggcaaagtagga

SEQ ID NO: 8408747 - DNA, 22 bp, Homo sapiens
atgcacaaggtagattattatt

SEQ ID NO: 8408748 - DNA, 22 bp, Homo sapiens
gaaggctgtttctggtagtgat

SEQ ID NO: 8408749 - DNA, 22 bp, Homo sapiens
gaaggctgctgggaagtgtggt

SEQ ID NO: 8408750 - DNA, 22 bp, Homo sapiens
atgacatgacctggtagagaca

SEQ ID NO: 8408751 - DNA, 22 bp, Homo sapiens
gcctggcaatggcctcaggaag

SEQ ID NO: 8408752 - DNA, 22 bp, Homo sapiens
gcctggcacattgcagtggatt

SEQ ID NO: 8408753 - DNA, 22 bp, Homo sapiens
gcctaggagtacagaatggttt

SEQ ID NO: 8408754 - DNA, 23 bp, Homo sapiens
gcccaccctcagcgtcctcacgg

SEQ ID NO: 8408755 - DNA, 17 bp, Homo sapiens
gcccacccttaggagct

SEQ ID NO: 8408756 - DNA, 22 bp, Homo sapiens
gcccacagtctatcagtttgcg

SEQ ID NO: 8408757 - DNA, 21 bp, Homo sapiens
gcccacagtgaggaggatccc

SEQ ID NO: 8408758 - DNA, 22 bp, Homo sapiens
gccccaggttgcctgtcccagg

SEQ ID NO: 8408759 - DNA, 22 bp, Homo sapiens
gccaggtgagtgcgcgccgtcc

SEQ ID NO: 8408760 - DNA, 22 bp, Homo sapiens
gccaggctggtgcaaggatatt

SEQ ID NO: 8408761 - DNA, 22 bp, Homo sapiens
gccaggctggcaaaaggaaacc

SEQ ID NO: 8408762 - DNA, 22 bp, Homo sapiens
gccaggctggggggagatgtct

SEQ ID NO: 8408763 - DNA, 22 bp, Homo sapiens
gctgactgagctggcttttcgt

SEQ ID NO: 8408764 - DNA, 22 bp, Homo sapiens
caaatactgtactgaacactgt

SEQ ID NO: 8408765 - DNA, 20 bp, Homo sapiens
attcagaataggcatgtaaa

SEQ ID NO: 8408766 - DNA, 22 bp, Homo sapiens
gcacctttctatattcagtggc

SEQ ID NO: 8408767 - DNA, 22 bp, Homo sapiens
gcacggctaatttttgtatttt

SEQ ID NO: 8408768 - DNA, 21 bp, Homo sapiens
attcagaaagggaataaactc

SEQ ID NO: 8408769 - DNA, 22 bp, Homo sapiens
attacagtgggtaaacagaatt

SEQ ID NO: 8408770 - DNA, 22 bp, Homo sapiens
attacctatttcattttctgtc

SEQ ID NO: 8408771 - DNA, 23 bp, Homo sapiens
attacagttaattacaacatctt

SEQ ID NO: 8408772 - DNA, 22 bp, Homo sapiens
attacagttctacacatccttt

SEQ ID NO: 8408773 - DNA, 22 bp, Homo sapiens
attagaggtacaaaccttcact

SEQ ID NO: 8408774 - DNA, 22 bp, Homo sapiens
gcagggctgactcagccaccct

SEQ ID NO: 8408775 - DNA, 22 bp, Homo sapiens
gcagcgaggtgatgaaatagct

SEQ ID NO: 8408776 - DNA, 22 bp, Homo sapiens
gcagctgctggagggaggcagg

SEQ ID NO: 8408777 - DNA, 22 bp, Homo sapiens
gccaaccattggcttcttgtca

SEQ ID NO: 8408778 - DNA, 22 bp, Homo sapiens
gcatcagaatcatccggggaat

SEQ ID NO: 8408779 - DNA, 22 bp, Homo sapiens
ccaggaaggatcgtttgggagt

SEQ ID NO: 8408780 - DNA, 22 bp, Homo sapiens
ccagagagagaggtcaatggca

SEQ ID NO: 8408781 - DNA, 22 bp, Homo sapiens
ccagctgctgtgcagggaggct

SEQ ID NO: 8408782 - DNA, 22 bp, Homo sapiens
ccagctgcccaagaggcatcct

SEQ ID NO: 8408783 - DNA, 22 bp, Homo sapiens
ccaggaggttgaggctgcagtg

SEQ ID NO: 8408784 - DNA, 22 bp, Homo sapiens
ccaggagtcaataaaggaagct

SEQ ID NO: 8408785 - DNA, 22 bp, Homo sapiens
ccaggagggaccgcggcatccc

SEQ ID NO: 8408786 - DNA, 22 bp, Homo sapiens
tcttcccccgtgctccagtgca

SEQ ID NO: 8408787 - DNA, 22 bp, Homo sapiens
ccaggccagcctggagcatggc

SEQ ID NO: 8408788 - DNA, 22 bp, Homo sapiens
ccaggccagagtgcagtggcac

SEQ ID NO: 8408789 - DNA, 22 bp, Homo sapiens
ccaggccagagtgcagtggcac

SEQ ID NO: 8408790 - DNA, 22 bp, Homo sapiens
ccaggccagtgtttggtccagg

SEQ ID NO: 8408791 - DNA, 18 bp, Homo sapiens
ccaggccatgaacctctg

SEQ ID NO: 8408792 - DNA, 18 bp, Homo sapiens
ccaggccatgaacctctg

SEQ ID NO: 8408793 - DNA, 22 bp, Homo sapiens
ccaggcccaccttggccactta

SEQ ID NO: 8408794 - DNA, 22 bp, Homo sapiens
ccaggctggagtgcaatggcat

SEQ ID NO: 8408795 - DNA, 22 bp, Homo sapiens
ccaggctggagtgcaatggcgt

SEQ ID NO: 8408796 - DNA, 22 bp, Homo sapiens
tgagacgaagtcttgctctgtt

SEQ ID NO: 8408797 - DNA, 22 bp, Homo sapiens
tgaggcagatatttattgggtt

SEQ ID NO: 8408798 - DNA, 22 bp, Homo sapiens
tgaggcagcaattgattattca

SEQ ID NO: 8408799 - DNA, 22 bp, Homo sapiens
tgaggcagcaattgtattgtat

SEQ ID NO: 8408800 - DNA, 22 bp, Homo sapiens
tgaggcagagtaagatacatga

SEQ ID NO: 8408801 - DNA, 22 bp, Homo sapiens
tgaggcagaaattcctgttttc

SEQ ID NO: 8408802 - DNA, 22 bp, Homo sapiens
tgaggactacctggggtgggag

SEQ ID NO: 8408803 - DNA, 22 bp, Homo sapiens
ccaggggctggtgctgagctgg

SEQ ID NO: 8408804 - DNA, 22 bp, Homo sapiens
ccaggctggagtgcagtggcac

SEQ ID NO: 8408805 - DNA, 22 bp, Homo sapiens
ccaggggcctgtgaaggtgccc

SEQ ID NO: 8408806 - DNA, 22 bp, Homo sapiens
ccagggcttcccacgtgccctg

SEQ ID NO: 8408807 - DNA, 22 bp, Homo sapiens
tgagggctaaattgtggcaggt

SEQ ID NO: 8408808 - DNA, 22 bp, Homo sapiens
tgagggcagagcactggggagc

SEQ ID NO: 8408809 - DNA, 22 bp, Homo sapiens
tgaggcagcctgcattaaagag

SEQ ID NO: 8408810 - DNA, 22 bp, Homo sapiens
tgaggcagcccactttccttag

SEQ ID NO: 8408811 - DNA, 22 bp, Homo sapiens
tgaggcagcattcttcaagaca

SEQ ID NO: 8408812 - DNA, 20 bp, Homo sapiens
ccagtccctgagcaccaggg

SEQ ID NO: 8408813 - DNA, 22 bp, Homo sapiens
ccatgccccaatacaggacacc

SEQ ID NO: 8408814 - DNA, 22 bp, Homo sapiens
ccatgccccaccaggacgctgc

SEQ ID NO: 8408815 - DNA, 22 bp, Homo sapiens
ccatgctgaccctgtgcaggca

SEQ ID NO: 8408816 - DNA, 22 bp, Homo sapiens
ccatgctggagtccctagctgt

SEQ ID NO: 8408817 - DNA, 22 bp, Homo sapiens
ccatgccctaaaggactggcag

SEQ ID NO: 8408818 - DNA, 22 bp, Homo sapiens
tgaggtatacgttggttcagtc

SEQ ID NO: 8408819 - DNA, 22 bp, Homo sapiens
ccatggcctgaaggagtgcatc

SEQ ID NO: 8408820 - DNA, 22 bp, Homo sapiens
cccagacataacagcagagagg

SEQ ID NO: 8408821 - DNA, 22 bp, Homo sapiens
tgccagctcctgcagctcctgt

SEQ ID NO: 8408822 - DNA, 22 bp, Homo sapiens
tgccagcttcttacggctgcct

SEQ ID NO: 8408823 - DNA, 22 bp, Homo sapiens
cccaggagataacgttcccaag

SEQ ID NO: 8408824 - DNA, 22 bp, Homo sapiens
tgcccagccagtttatggtaat

SEQ ID NO: 8408825 - DNA, 22 bp, Homo sapiens
cccaggcagtgtgtgcatgcgt

SEQ ID NO: 8408826 - DNA, 22 bp, Homo sapiens
tgcccagcccctatccctggga

SEQ ID NO: 8408827 - DNA, 22 bp, Homo sapiens
cccaggctcagactggcttgtt

SEQ ID NO: 8408828 - DNA, 22 bp, Homo sapiens
cccaggctagtatgatatcagt

SEQ ID NO: 8408829 - DNA, 22 bp, Homo sapiens
cccaggctggggctcctccagc

SEQ ID NO: 8408830 - DNA, 22 bp, Homo sapiens
cccaggctggtcctgaactcct

SEQ ID NO: 8408831 - DNA, 22 bp, Homo sapiens
cccaggctggagtgcagtggcg

SEQ ID NO: 8408832 - DNA, 22 bp, Homo sapiens
cccaggctggagtgcaatggtg

SEQ ID NO: 8408833 - DNA, 22 bp, Homo sapiens
cccaggctggagtgcaatggca

SEQ ID NO: 8408834 - DNA, 20 bp, Homo sapiens
cccaggggttgtggtgagga

SEQ ID NO: 8408835 - DNA, 22 bp, Homo sapiens
cccagggtccctgctctctgtg

SEQ ID NO: 8408836 - DNA, 22 bp, Homo sapiens
cccgactagctgggattacagg

SEQ ID NO: 8408837 - DNA, 22 bp, Homo sapiens
ccccaccaccaaggctcagttt

SEQ ID NO: 8408838 - DNA, 22 bp, Homo sapiens
ccccaccctcgctccatttcgg

SEQ ID NO: 8408839 - DNA, 22 bp, Homo sapiens
ccccacccacctaagagaaact

SEQ ID NO: 8408840 - DNA, 18 bp, Homo sapiens
cccggctaatttttggta

SEQ ID NO: 8408841 - DNA, 22 bp, Homo sapiens
tgctgtgctccattgtcttcac

SEQ ID NO: 8408842 - DNA, 22 bp, Homo sapiens
tgctgtgctggcggcagaggcc

SEQ ID NO: 8408843 - DNA, 22 bp, Homo sapiens
tgctgtgctctttaaggtgctg

SEQ ID NO: 8408844 - DNA, 22 bp, Homo sapiens
tggaatgttaaacctcaatgat

SEQ ID NO: 8408845 - DNA, 22 bp, Homo sapiens
tggaatgtgttctattttacag

SEQ ID NO: 8408846 - DNA, 22 bp, Homo sapiens
tggaatgtaaacctcaggtggg

SEQ ID NO: 8408847 - DNA, 22 bp, Homo sapiens
tggaatgtaaactctgtgaggg

SEQ ID NO: 8408848 - DNA, 22 bp, Homo sapiens
tggaatggggactttgggacat

SEQ ID NO: 8408849 - DNA, 21 bp, Homo sapiens
tggaatgtacctccctctctt

SEQ ID NO: 8408850 - DNA, 22 bp, Homo sapiens
tggaatgtagcaagtgttgtca

SEQ ID NO: 8408851 - DNA, 20 bp, Homo sapiens
tggaatgtagtcggtgagag

SEQ ID NO: 8408852 - DNA, 22 bp, Homo sapiens
tggaatgtagtgtccatggaat

SEQ ID NO: 8408853 - DNA, 22 bp, Homo sapiens
tggaatgtaaagggtatgggat

SEQ ID NO: 8408854 - DNA, 22 bp, Homo sapiens
tggaatgtaatcagaatatgaa

SEQ ID NO: 8408855 - DNA, 22 bp, Homo sapiens
tggaatgtaatcatgtggtggt

SEQ ID NO: 8408856 - DNA, 22 bp, Homo sapiens
tggaatgtaaagcgtgtgataa

SEQ ID NO: 8408857 - DNA, 22 bp, Homo sapiens
tggaatgtcagctacaagaggg

SEQ ID NO: 8408858 - DNA, 23 bp, Homo sapiens
tggaatgtctgattctgctctag

SEQ ID NO: 8408859 - DNA, 22 bp, Homo sapiens
tggaatgtcataccataaaaga

SEQ ID NO: 8408860 - DNA, 22 bp, Homo sapiens
tggaatgtatagatgttatgta

SEQ ID NO: 8408861 - DNA, 22 bp, Homo sapiens
tggaatgtattaagtattgagt

SEQ ID NO: 8408862 - DNA, 22 bp, Homo sapiens
tggaatgtcaaaagtctgctat

SEQ ID NO: 8408863 - DNA, 22 bp, Homo sapiens
tggaatgtcaagaagcagtaag

SEQ ID NO: 8408864 - DNA, 22 bp, Homo sapiens
tggaatgtgctagggctgtggc

SEQ ID NO: 8408865 - DNA, 22 bp, Homo sapiens
tggaatgtggataagggtgtct

SEQ ID NO: 8408866 - DNA, 22 bp, Homo sapiens
tggaatgtggtatcagtagaaa

SEQ ID NO: 8408867 - DNA, 22 bp, Homo sapiens
tggaatgtgagaataccgtttt

SEQ ID NO: 8408868 - DNA, 22 bp, Homo sapiens
tggaatgtgctactgttgattt

SEQ ID NO: 8408869 - DNA, 22 bp, Homo sapiens
tggaatgtcttgatatagaggt

SEQ ID NO: 8408870 - DNA, 22 bp, Homo sapiens
tggaatgtgaacatacaaggta

SEQ ID NO: 8408871 - DNA, 20 bp, Homo sapiens
tggcccagcacgacgaggac

SEQ ID NO: 8408872 - DNA, 22 bp, Homo sapiens
cctcaggcttgtgagccttcag

SEQ ID NO: 8408873 - DNA, 22 bp, Homo sapiens
tggcagggttggccaccttacc

SEQ ID NO: 8408874 - DNA, 22 bp, Homo sapiens
tggcagggtgggcttcagcccc

SEQ ID NO: 8408875 - DNA, 22 bp, Homo sapiens
tggcaggtacccattggctgta

SEQ ID NO: 8408876 - DNA, 18 bp, Homo sapiens
tggagcaggtaggcatga

SEQ ID NO: 8408877 - DNA, 22 bp, Homo sapiens
tgggaaggacgtgtcagtggca

SEQ ID NO: 8408878 - DNA, 22 bp, Homo sapiens
tgggaaggacgtgtcagtggca

SEQ ID NO: 8408879 - DNA, 22 bp, Homo sapiens
tgggaaggacgtgtcagtggca

SEQ ID NO: 8408880 - DNA, 16 bp, Homo sapiens
tggctgagagagggtt

SEQ ID NO: 8408881 - DNA, 22 bp, Homo sapiens
tggctggctggaccacacctgc

SEQ ID NO: 8408882 - DNA, 22 bp, Homo sapiens
tggctggctagtgggcaggatt

SEQ ID NO: 8408883 - DNA, 22 bp, Homo sapiens
tggctggctgtcagtaggctgt

SEQ ID NO: 8408884 - DNA, 22 bp, Homo sapiens
tggctggctgtccagctgggca

SEQ ID NO: 8408885 - DNA, 22 bp, Homo sapiens
tggctggcttgttcactgactg

SEQ ID NO: 8408886 - DNA, 22 bp, Homo sapiens
catttacacttctaaccacaag

SEQ ID NO: 8408887 - DNA, 22 bp, Homo sapiens
catttacacacagaggtgtgct

SEQ ID NO: 8408888 - DNA, 22 bp, Homo sapiens
catttacaatgtacaggttgtg

SEQ ID NO: 8408889 - DNA, 22 bp, Homo sapiens
tcccaccccggtcaagggctga

SEQ ID NO: 8408890 - DNA, 22 bp, Homo sapiens
tcccaccccctccaaggaggaa

SEQ ID NO: 8408891 - DNA, 22 bp, Homo sapiens
tcccaccccttgactctttaag

SEQ ID NO: 8408892 - DNA, 22 bp, Homo sapiens
tcccacccatcctgcatctctt

SEQ ID NO: 8408893 - DNA, 23 bp, Homo sapiens
catgggagtgagaatgccagctc

SEQ ID NO: 8408894 - DNA, 22 bp, Homo sapiens
catgggctcaaccttgaccaca

SEQ ID NO: 8408895 - DNA, 22 bp, Homo sapiens
ccaaggctggagtgcagtggcg

SEQ ID NO: 8408896 - DNA, 22 bp, Homo sapiens
ccaaggccatcaggtaggtcct

SEQ ID NO: 8408897 - DNA, 22 bp, Homo sapiens
ccaaggcccctgtggtctagcc

SEQ ID NO: 8408898 - DNA, 22 bp, Homo sapiens
ccagagaaggtggagcttgtgt

SEQ ID NO: 8408899 - DNA, 22 bp, Homo sapiens
ccagagaagaaaagcacctttt

SEQ ID NO: 8408900 - DNA, 22 bp, Homo sapiens
ccagagaaccttgagctgtgag

SEQ ID NO: 8408901 - DNA, 22 bp, Homo sapiens
tcagaggagatggttaccaggg

SEQ ID NO: 8408902 - DNA, 22 bp, Homo sapiens
tcagagatgcagtgccacctac

SEQ ID NO: 8408903 - DNA, 22 bp, Homo sapiens
tcagagatcttcaggatgggac

SEQ ID NO: 8408904 - DNA, 22 bp, Homo sapiens
tcagagattcacgtcagtccca

SEQ ID NO: 8408905 - DNA, 22 bp, Homo sapiens
tcagagatctggagtacaactg

SEQ ID NO: 8408906 - DNA, 22 bp, Homo sapiens
tcagagagttttcactagggtg

SEQ ID NO: 8408907 - DNA, 22 bp, Homo sapiens
tcaggtgtatcatggagttgaa

SEQ ID NO: 8408908 - DNA, 22 bp, Homo sapiens
tcaggtgtaggttgttcagttt

SEQ ID NO: 8408909 - DNA, 22 bp, Homo sapiens
tcagggattgcaaaattcatcc

SEQ ID NO: 8408910 - DNA, 22 bp, Homo sapiens
catggaactgtataaaggcact

SEQ ID NO: 8408911 - DNA, 22 bp, Homo sapiens
catggcagagaaggggaactgg

SEQ ID NO: 8408912 - DNA, 23 bp, Homo sapiens
catggcagcaagagctcatggcc

SEQ ID NO: 8408913 - DNA, 22 bp, Homo sapiens
catggcaggaaaatgaacaggc

SEQ ID NO: 8408914 - DNA, 22 bp, Homo sapiens
catggcagctttgggaggagga

SEQ ID NO: 8408915 - DNA, 22 bp, Homo sapiens
catggcagctttgggaggagga

SEQ ID NO: 8408916 - DNA, 22 bp, Homo sapiens
catggccagcccccagttcctc

SEQ ID NO: 8408917 - DNA, 22 bp, Homo sapiens
catggcaggaaggacatgcact

SEQ ID NO: 8408918 - DNA, 22 bp, Homo sapiens
catggcagtgattcagcctttg

SEQ ID NO: 8408919 - DNA, 22 bp, Homo sapiens
catggcagggctgtgggcaggt

SEQ ID NO: 8408920 - DNA, 22 bp, Homo sapiens
catggcaggtgcagattctgtg

SEQ ID NO: 8408921 - DNA, 22 bp, Homo sapiens
catgaccagagaggacggccag

SEQ ID NO: 8408922 - DNA, 22 bp, Homo sapiens
catgcagtcaataaacatgtgt

SEQ ID NO: 8408923 - DNA, 22 bp, Homo sapiens
catgcagtattcaggacagttc

SEQ ID NO: 8408924 - DNA, 22 bp, Homo sapiens
catgcagtgactcagacacagg

SEQ ID NO: 8408925 - DNA, 22 bp, Homo sapiens
catgcagtgaaattgatatcca

SEQ ID NO: 8408926 - DNA, 22 bp, Homo sapiens
catgcagtctggagccttctgt

SEQ ID NO: 8408927 - DNA, 22 bp, Homo sapiens
catgcagtggtaaaaagtcagg

SEQ ID NO: 8408928 - DNA, 22 bp, Homo sapiens
catgcagtgtgtatctacttaa

SEQ ID NO: 8408929 - DNA, 22 bp, Homo sapiens
catgcagtgctttgcgccgggc

SEQ ID NO: 8408930 - DNA, 22 bp, Homo sapiens
catgcagtgcctctggattctt

SEQ ID NO: 8408931 - DNA, 22 bp, Homo sapiens
catgcagtgatgcactgcatca

SEQ ID NO: 8408932 - DNA, 22 bp, Homo sapiens
catgcagttgaagcacagagag

SEQ ID NO: 8408933 - DNA, 22 bp, Homo sapiens
catgcagtttctctatgcgtag

SEQ ID NO: 8408934 - DNA, 22 bp, Homo sapiens
taaggcagcctcagggtagggt

SEQ ID NO: 8408935 - DNA, 22 bp, Homo sapiens
caggcagcagaggagtgtggga

SEQ ID NO: 8408936 - DNA, 22 bp, Homo sapiens
caggcagcagaggagtgtggga

SEQ ID NO: 8408937 - DNA, 22 bp, Homo sapiens
caggccagtgtgcttcccaggc

SEQ ID NO: 8408938 - DNA, 22 bp, Homo sapiens
caggccaggtggcaggcaaaac

SEQ ID NO: 8408939 - DNA, 22 bp, Homo sapiens
tacaaaccaaggaacagtgatc

SEQ ID NO: 8408940 - DNA, 22 bp, Homo sapiens
caggctatgccttccatctgca

SEQ ID NO: 8408941 - DNA, 22 bp, Homo sapiens
tacttgttcatgaggtagtaaa

SEQ ID NO: 8408942 - DNA, 22 bp, Homo sapiens
tacttgttgatcagttgttaaa

SEQ ID NO: 8408943 - DNA, 22 bp, Homo sapiens
tacttgttgcttttgtgatcca

SEQ ID NO: 8408944 - DNA, 22 bp, Homo sapiens
tacttgttatcccttactcttg

SEQ ID NO: 8408945 - DNA, 22 bp, Homo sapiens
tacttgttctttcaagagatag

SEQ ID NO: 8408946 - DNA, 22 bp, Homo sapiens
tactttacagtattagataatt

SEQ ID NO: 8408947 - DNA, 22 bp, Homo sapiens
tactttagaaggaaataagttc

SEQ ID NO: 8408948 - DNA, 22 bp, Homo sapiens
tacattgtttgagatagtttgt

SEQ ID NO: 8408949 - DNA, 22 bp, Homo sapiens
tacattgtgttaaaacagaaga

SEQ ID NO: 8408950 - DNA, 22 bp, Homo sapiens
tacattgtgtctctatctagtc

SEQ ID NO: 8408951 - DNA, 22 bp, Homo sapiens
tacattgttcatgcatgagaaa

SEQ ID NO: 8408952 - DNA, 20 bp, Homo sapiens
tacattgtgagactaatgga

SEQ ID NO: 8408953 - DNA, 22 bp, Homo sapiens
tacattgtattatccgtgattg

SEQ ID NO: 8408954 - DNA, 22 bp, Homo sapiens
tacatgtttactccaagtcagg

SEQ ID NO: 8408955 - DNA, 20 bp, Homo sapiens
tacattgtagaaatattcaa

SEQ ID NO: 8408956 - DNA, 22 bp, Homo sapiens
tacattgtacttacaaatagtg

SEQ ID NO: 8408957 - DNA, 22 bp, Homo sapiens
caggcctgatacactgaactct

SEQ ID NO: 8408958 - DNA, 22 bp, Homo sapiens
caggcctgagtgtggaagtctt

SEQ ID NO: 8408959 - DNA, 22 bp, Homo sapiens
caggcctgaccctgagcttcac

SEQ ID NO: 8408960 - DNA, 22 bp, Homo sapiens
caggcctgagacatctgagata

SEQ ID NO: 8408961 - DNA, 22 bp, Homo sapiens
caggctggagttcagtggtgtg

SEQ ID NO: 8408962 - DNA, 22 bp, Homo sapiens
caggctgccgtggggtccaggc

SEQ ID NO: 8408963 - DNA, 22 bp, Homo sapiens
caggctggcaatgcgtcaagca

SEQ ID NO: 8408964 - DNA, 20 bp, Homo sapiens
cagggacagcagtgggtttt

SEQ ID NO: 8408965 - DNA, 22 bp, Homo sapiens
cagggacaaacaaggttgggga

SEQ ID NO: 8408966 - DNA, 22 bp, Homo sapiens
cagggaagagccgatgctgcag

SEQ ID NO: 8408967 - DNA, 22 bp, Homo sapiens
cagggctgtaaattagtgctga

SEQ ID NO: 8408968 - DNA, 22 bp, Homo sapiens
cagggctgtggctttgtgctgt

SEQ ID NO: 8408969 - DNA, 22 bp, Homo sapiens
cagggtcatggcacctgcacgg

SEQ ID NO: 8408970 - DNA, 22 bp, Homo sapiens
caggggtgtttttggccaggag

SEQ ID NO: 8408971 - DNA, 22 bp, Homo sapiens
cagggcccagtccctgctgtca

SEQ ID NO: 8408972 - DNA, 22 bp, Homo sapiens
taggcatgcaaataaatgtgca

SEQ ID NO: 8408973 - DNA, 22 bp, Homo sapiens
cagggagcactgcgagcggcag

SEQ ID NO: 8408974 - DNA, 22 bp, Homo sapiens
cagggagcaggctctgtccatc

SEQ ID NO: 8408975 - DNA, 22 bp, Homo sapiens
cagggagcagcgctggggcctc

SEQ ID NO: 8408976 - DNA, 22 bp, Homo sapiens
tagatttaagaccctgaatttg

SEQ ID NO: 8408977 - DNA, 22 bp, Homo sapiens
cagggccactgcatgaggttca

SEQ ID NO: 8408978 - DNA, 22 bp, Homo sapiens
cagggccagggctccatttcct

SEQ ID NO: 8408979 - DNA, 22 bp, Homo sapiens
cagggccagggctatggtgaag

SEQ ID NO: 8408980 - DNA, 22 bp, Homo sapiens
cagggccagggacacgctgtca

SEQ ID NO: 8408981 - DNA, 22 bp, Homo sapiens
cagggccaggctgatggcctgg

SEQ ID NO: 8408982 - DNA, 22 bp, Homo sapiens
cagggccattggcgtggctgtc

SEQ ID NO: 8408983 - DNA, 22 bp, Homo sapiens
cagggccatgaggcacagggtc

SEQ ID NO: 8408984 - DNA, 22 bp, Homo sapiens
cagggccattggaacaaagagg

SEQ ID NO: 8408985 - DNA, 22 bp, Homo sapiens
cagggccatatcttgtgcacca

SEQ ID NO: 8408986 - DNA, 22 bp, Homo sapiens
cagggccagttctcgcagcagt

SEQ ID NO: 8408987 - DNA, 22 bp, Homo sapiens
caggtggcattgtcccgccagc

SEQ ID NO: 8408988 - DNA, 22 bp, Homo sapiens
caggtggctaacggcctcatag

SEQ ID NO: 8408989 - DNA, 22 bp, Homo sapiens
caggtggctaacggcctcatag

SEQ ID NO: 8408990 - DNA, 19 bp, Homo sapiens
caggtggcgctctacaggg

SEQ ID NO: 8408991 - DNA, 22 bp, Homo sapiens
caggtgctgtcctgcacatgtc

SEQ ID NO: 8408992 - DNA, 22 bp, Homo sapiens
caggtgctctgctgcaggtaag

SEQ ID NO: 8408993 - DNA, 22 bp, Homo sapiens
caggtgacaagacaggtaatat

SEQ ID NO: 8408994 - DNA, 22 bp, Homo sapiens
caggtccaaggttcctgaatag

SEQ ID NO: 8408995 - DNA, 22 bp, Homo sapiens
caggtaggatggaagggctcaa

SEQ ID NO: 8408996 - DNA, 17 bp, Homo sapiens
caggtacattgctactg

SEQ ID NO: 8408997 - DNA, 22 bp, Homo sapiens
caggtaagagacggattggccc

SEQ ID NO: 8408998 - DNA, 22 bp, Homo sapiens
cagggtggggctggctatcaaa

SEQ ID NO: 8408999 - DNA, 22 bp, Homo sapiens
cagggtggggctggctatcaaa

SEQ ID NO: 8409000 - DNA, 22 bp, Homo sapiens
caggtcaaaggttagttatgtt

SEQ ID NO: 8409001 - DNA, 22 bp, Homo sapiens
caggtagggatatgatggtgat

SEQ ID NO: 8409002 - DNA, 22 bp, Homo sapiens
caggtaggggagagctccaaca

SEQ ID NO: 8409003 - DNA, 22 bp, Homo sapiens
caggtaggggagagctccaaca

SEQ ID NO: 8409004 - DNA, 22 bp, Homo sapiens
caggtaggtatggtgcagtctt

SEQ ID NO: 8409005 - DNA, 22 bp, Homo sapiens
ctcccagccttcgccagtctga

SEQ ID NO: 8409006 - DNA, 22 bp, Homo sapiens
ttgtacaacacatattctacag

SEQ ID NO: 8409007 - DNA, 22 bp, Homo sapiens
ttgtacaacgttttaaatttga

SEQ ID NO: 8409008 - DNA, 22 bp, Homo sapiens
ttgtacaaatgcatattcctgg

SEQ ID NO: 8409009 - DNA, 22 bp, Homo sapiens
ttgtacaaataggaacctctga

SEQ ID NO: 8409010 - DNA, 22 bp, Homo sapiens
ttgtacaaagatttcacagctc

SEQ ID NO: 8409011 - DNA, 22 bp, Homo sapiens
ttgtacaaaggatttggaagag

SEQ ID NO: 8409012 - DNA, 22 bp, Homo sapiens
ctctccaggctgggacaggacc

SEQ ID NO: 8409013 - DNA, 22 bp, Homo sapiens
ctctccagtcatattctcagtc

SEQ ID NO: 8409014 - DNA, 22 bp, Homo sapiens
ctctccaggggtagatgccttc

SEQ ID NO: 8409015 - DNA, 22 bp, Homo sapiens
tttcacatacagtgtatagtag

SEQ ID NO: 8409016 - DNA, 21 bp, Homo sapiens
tttcaatgtgttctttgtagt

SEQ ID NO: 8409017 - DNA, 17 bp, Homo sapiens
ctcctggcagcctcagg

SEQ ID NO: 8409018 - DNA, 22 bp, Homo sapiens
tttgcaaataaataagtgctcg

SEQ ID NO: 8409019 - DNA, 22 bp, Homo sapiens
ttttagtgcctgattaatgggt

SEQ ID NO: 8409020 - DNA, 18 bp, Homo sapiens
ctgcactgtgggtagctc

SEQ ID NO: 8409021 - DNA, 22 bp, Homo sapiens
ctgcactgaagaaaggagctct

SEQ ID NO: 8409022 - DNA, 22 bp, Homo sapiens
ctgaggccagctgcagagctct

SEQ ID NO: 8409023 - DNA, 22 bp, Homo sapiens
ctgaggccagagtgggcctctt

SEQ ID NO: 8409024 - DNA, 22 bp, Homo sapiens
ctgaggcagagggcagaccaga

SEQ ID NO: 8409025 - DNA, 22 bp, Homo sapiens
ctgagccctctgttttccctct

SEQ ID NO: 8409026 - DNA, 22 bp, Homo sapiens
ctgagccataagggaggctggg

SEQ ID NO: 8409027 - DNA, 22 bp, Homo sapiens
ccttcctggagcccatgcagat

SEQ ID NO: 8409028 - DNA, 22 bp, Homo sapiens
ttaaagtaatctgtgtgaattt

SEQ ID NO: 8409029 - DNA, 22 bp, Homo sapiens
tgttacaatattatcaactgag

SEQ ID NO: 8409030 - DNA, 22 bp, Homo sapiens
cctgggagtggcactcacagca

SEQ ID NO: 8409031 - DNA, 22 bp, Homo sapiens
tggggccaagaaggtctcatgt

SEQ ID NO: 8409032 - DNA, 22 bp, Homo sapiens
tggggctgtgagactacaggat

SEQ ID NO: 8409033 - DNA, 22 bp, Homo sapiens
ctacccttaagtttctgtgggg

SEQ ID NO: 8409034 - DNA, 22 bp, Homo sapiens
ctactgtatgtgttctctagtc

SEQ ID NO: 8409035 - DNA, 22 bp, Homo sapiens
cggtggccaacaagaggccggg

SEQ ID NO: 8409036 - DNA, 22 bp, Homo sapiens
cgcccaggctggagtgcagtgg

SEQ ID NO: 8409037 - DNA, 22 bp, Homo sapiens
cgcccaggctggagtgcagtga

SEQ ID NO: 8409038 - DNA, 22 bp, Homo sapiens
cgcccaggctggagagcagtgg

SEQ ID NO: 8409039 - DNA, 23 bp, Homo sapiens
cgcccagcctcagtgacctgggc

SEQ ID NO: 8409040 - DNA, 22 bp, Homo sapiens
ttaggctgttcttgtgttgtta

SEQ ID NO: 8409041 - DNA, 22 bp, Homo sapiens
ctggggccagtgaggaggcttt

SEQ ID NO: 8409042 - DNA, 22 bp, Homo sapiens
ctgggaagaaattgtgggaggc

SEQ ID NO: 8409043 - DNA, 22 bp, Homo sapiens
ctgggaagaaattgtgggaggc

SEQ ID NO: 8409044 - DNA, 22 bp, Homo sapiens
ctgggaggcccacgttgggaag

SEQ ID NO: 8409045 - DNA, 22 bp, Homo sapiens
ctgggcaggagggctctatgga

SEQ ID NO: 8409046 - DNA, 22 bp, Homo sapiens
ctgggcagtttattcagttctg

SEQ ID NO: 8409047 - DNA, 22 bp, Homo sapiens
ctgggcagttttacatcattgc

SEQ ID NO: 8409048 - DNA, 22 bp, Homo sapiens
ctggctcattttagcatcaggt

SEQ ID NO: 8409049 - DNA, 22 bp, Homo sapiens
ctggctcatagagcagctccaa

SEQ ID NO: 8409050 - DNA, 22 bp, Homo sapiens
ctggctggaacgccgaggcggc

SEQ ID NO: 8409051 - DNA, 20 bp, Homo sapiens
ctggctggaaacttagcctt

SEQ ID NO: 8409052 - DNA, 22 bp, Homo sapiens
ctggctcacctccgctccagca

SEQ ID NO: 8409053 - DNA, 19 bp, Homo sapiens
ctggccaggccaggggccc

SEQ ID NO: 8409054 - DNA, 22 bp, Homo sapiens
ctggcaggcggcagagcccagg

SEQ ID NO: 8409055 - DNA, 22 bp, Homo sapiens
ctggcagggcaggggtttgtgc

SEQ ID NO: 8409056 - DNA, 22 bp, Homo sapiens
ctggcaggcggaggttgcagtg

SEQ ID NO: 8409057 - DNA, 22 bp, Homo sapiens
ctggcaggcggaggttgcagtg

SEQ ID NO: 8409058 - DNA, 20 bp, Homo sapiens
ctggcaggagcgagtctacc

SEQ ID NO: 8409059 - DNA, 22 bp, Homo sapiens
ctggcaggagttgggattttga

SEQ ID NO: 8409060 - DNA, 22 bp, Homo sapiens
ctggcaggatctaaccagggaa

SEQ ID NO: 8409061 - DNA, 22 bp, Homo sapiens
ctggcaggcaaattggtgggag

SEQ ID NO: 8409062 - DNA, 22 bp, Homo sapiens
ctggccagcctcccaggtaccc

SEQ ID NO: 8409063 - DNA, 22 bp, Homo sapiens
ctggccagcctgtcgatgccct

SEQ ID NO: 8409064 - DNA, 22 bp, Homo sapiens
ctggccagctgacagcagggct

SEQ ID NO: 8409065 - DNA, 22 bp, Homo sapiens
ctggccagagttggagggtgtg

SEQ ID NO: 8409066 - DNA, 22 bp, Homo sapiens
ctggccagcatggctgaagtac

SEQ ID NO: 8409067 - DNA, 22 bp, Homo sapiens
ctgccagctcaccggctcagac

SEQ ID NO: 8409068 - DNA, 22 bp, Homo sapiens
ctggcaggaagaggaaaggtca

SEQ ID NO: 8409069 - DNA, 22 bp, Homo sapiens
ctggcaggaagttagatggtaa

SEQ ID NO: 8409070 - DNA, 22 bp, Homo sapiens
ctgtggctgtatttggccagag

SEQ ID NO: 8409071 - DNA, 22 bp, Homo sapiens
ctgtggctgtatttggccagag

SEQ ID NO: 8409072 - DNA, 22 bp, Homo sapiens
ctgtggctctcagaggctgctg

SEQ ID NO: 8409073 - DNA, 22 bp, Homo sapiens
ctgtggctgcgtaggtctggca

SEQ ID NO: 8409074 - DNA, 22 bp, Homo sapiens
ctgtcctggggaaagccagccc

SEQ ID NO: 8409075 - DNA, 22 bp, Homo sapiens
ctgtgagggtcacagccatgcc

SEQ ID NO: 8409076 - DNA, 22 bp, Homo sapiens
ctgtgagggccagagtcagggc

SEQ ID NO: 8409077 - DNA, 22 bp, Homo sapiens
cttgtacactcagtacttctag

SEQ ID NO: 8409078 - DNA, 20 bp, Homo sapiens
cttgtacatgataaagattt

SEQ ID NO: 8409079 - DNA, 22 bp, Homo sapiens
gagaatgtggagcctgtggttg

SEQ ID NO: 8409080 - DNA, 22 bp, Homo sapiens
gagaaggagctcaaatatggct

SEQ ID NO: 8409081 - DNA, 22 bp, Homo sapiens
gagaaggatgaggaaatggtat

SEQ ID NO: 8409082 - DNA, 22 bp, Homo sapiens
gacctcaggtttgtaatggaca

SEQ ID NO: 8409083 - DNA, 22 bp, Homo sapiens
gacctcatgatccacctgcctt

SEQ ID NO: 8409084 - DNA, 22 bp, Homo sapiens
gagaggctgggttggagatcga

SEQ ID NO: 8409085 - DNA, 22 bp, Homo sapiens
gagatgctgtcaggctatctgt

SEQ ID NO: 8409086 - DNA, 22 bp, Homo sapiens
gagatgctgaaatctgagtgta

SEQ ID NO: 8409087 - DNA, 22 bp, Homo sapiens
gagccagagatccaggatggct

SEQ ID NO: 8409088 - DNA, 22 bp, Homo sapiens
gagccaagattgtgtccctgca

SEQ ID NO: 8409089 - DNA, 22 bp, Homo sapiens
gagatttagagagacttaaaca

SEQ ID NO: 8409090 - DNA, 23 bp, Homo sapiens
gagatttagcagacaaagctctt

SEQ ID NO: 8409091 - DNA, 21 bp, Homo sapiens
gagatttagaaggatcaattt

SEQ ID NO: 8409092 - DNA, 22 bp, Homo sapiens
gagcttccatccttactgtgtg

SEQ ID NO: 8409093 - DNA, 22 bp, Homo sapiens
gagctgaacaaattgcgagtgg

SEQ ID NO: 8409094 - DNA, 22 bp, Homo sapiens
gagctgaagtttccatttgtac

SEQ ID NO: 8409095 - DNA, 22 bp, Homo sapiens
gaggccagctacccaagggtca

SEQ ID NO: 8409096 - DNA, 22 bp, Homo sapiens
gaggccagcccctcttgaaggc

SEQ ID NO: 8409097 - DNA, 22 bp, Homo sapiens
gaggccagcccctcttgaaggc

SEQ ID NO: 8409098 - DNA, 22 bp, Homo sapiens
gaggccagcgcgcagcactttt

SEQ ID NO: 8409099 - DNA, 22 bp, Homo sapiens
gaggcagaagttgcagtgagca

SEQ ID NO: 8409100 - DNA, 22 bp, Homo sapiens
gaggcagaagttgcagtgagca

SEQ ID NO: 8409101 - DNA, 22 bp, Homo sapiens
gaggcagaagttgcagtgagca

SEQ ID NO: 8409102 - DNA, 22 bp, Homo sapiens
gaggcagagaccttcaggacct

SEQ ID NO: 8409103 - DNA, 22 bp, Homo sapiens
gaggcacaatacatgtctcaag

SEQ ID NO: 8409104 - DNA, 22 bp, Homo sapiens
gaggcacatgactcaccaatgg

SEQ ID NO: 8409105 - DNA, 22 bp, Homo sapiens
gaggagcttgaggctaggagcc

SEQ ID NO: 8409106 - DNA, 19 bp, Homo sapiens
gaggagctatcggagacag

SEQ ID NO: 8409107 - DNA, 22 bp, Homo sapiens
gaggaggctaagtgggctctgg

SEQ ID NO: 8409108 - DNA, 22 bp, Homo sapiens
gacagtaactgagagatgtaat

SEQ ID NO: 8409109 - DNA, 22 bp, Homo sapiens
gacagtaagaccttaccagcct

SEQ ID NO: 8409110 - DNA, 22 bp, Homo sapiens
gacagggtggctgatagggctc

SEQ ID NO: 8409111 - DNA, 22 bp, Homo sapiens
gacaggtaaagatggtggcagg

SEQ ID NO: 8409112 - DNA, 22 bp, Homo sapiens
gacagggtccaaaggcagggga

SEQ ID NO: 8409113 - DNA, 22 bp, Homo sapiens
gacagggtccaaaggcagggga

SEQ ID NO: 8409114 - DNA, 21 bp, Homo sapiens
gacaggtgattcagagcaggg

SEQ ID NO: 8409115 - DNA, 22 bp, Homo sapiens
gacaggtgagatgaggaacacc

SEQ ID NO: 8409116 - DNA, 22 bp, Homo sapiens
gacaggtgaaacagcaaggtaa

SEQ ID NO: 8409117 - DNA, 22 bp, Homo sapiens
gacaggtgtgtgtatattaggg

SEQ ID NO: 8409118 - DNA, 22 bp, Homo sapiens
gacaggtgtgatgatttaggct

SEQ ID NO: 8409119 - DNA, 22 bp, Homo sapiens
gacaggtggggaaactaaggta

SEQ ID NO: 8409120 - DNA, 20 bp, Homo sapiens
gacaggtgctaaagaggggc

SEQ ID NO: 8409121 - DNA, 22 bp, Homo sapiens
gacaaggcgcccagcctgccaa

SEQ ID NO: 8409122 - DNA, 22 bp, Homo sapiens
gacaggctttgagtcccagaac

SEQ ID NO: 8409123 - DNA, 22 bp, Homo sapiens
gacaggcttcatcctcagagtt

SEQ ID NO: 8409124 - DNA, 17 bp, Homo sapiens
gacaggctcagtgacga

SEQ ID NO: 8409125 - DNA, 22 bp, Homo sapiens
gaaggaagactggtttaaatgt

SEQ ID NO: 8409126 - DNA, 22 bp, Homo sapiens
gaatacattggaaatcagaata

SEQ ID NO: 8409127 - DNA, 22 bp, Homo sapiens
gaagatgggaatgatgagtggg

SEQ ID NO: 8409128 - DNA, 22 bp, Homo sapiens
gaagattgaaggctgggaatta

SEQ ID NO: 8409129 - DNA, 22 bp, Homo sapiens
gaaatcacttttttcatagttg

SEQ ID NO: 8409130 - DNA, 22 bp, Homo sapiens
gggaggagctgagtgtgtgtgc

SEQ ID NO: 8409131 - DNA, 22 bp, Homo sapiens
gggatggggggaagcgtccatg

SEQ ID NO: 8409132 - DNA, 22 bp, Homo sapiens
gggcagctggcttataggtttg

SEQ ID NO: 8409133 - DNA, 22 bp, Homo sapiens
gggcagctgcagggatggtgac

SEQ ID NO: 8409134 - DNA, 22 bp, Homo sapiens
gggcaggaggctaattctgcat

SEQ ID NO: 8409135 - DNA, 19 bp, Homo sapiens
gggcatggatgagcttacc

SEQ ID NO: 8409136 - DNA, 22 bp, Homo sapiens
gggcaggaacaaatcaaatgat

SEQ ID NO: 8409137 - DNA, 16 bp, Homo sapiens
gggcaggaatcagggt

SEQ ID NO: 8409138 - DNA, 22 bp, Homo sapiens
gggcaggagaaggtggatgtcc

SEQ ID NO: 8409139 - DNA, 22 bp, Homo sapiens
gggcaggagagaacagtcatgg

SEQ ID NO: 8409140 - DNA, 22 bp, Homo sapiens
gggaccagaagaaggatggtga

SEQ ID NO: 8409141 - DNA, 22 bp, Homo sapiens
gggaatgtaatcatggaatgct

SEQ ID NO: 8409142 - DNA, 22 bp, Homo sapiens
gggaatgtgagtagggtgagtt

SEQ ID NO: 8409143 - DNA, 22 bp, Homo sapiens
gggaatgtgattgttgttttaa

SEQ ID NO: 8409144 - DNA, 22 bp, Homo sapiens
gggaatgtgcagccacagtgag

SEQ ID NO: 8409145 - DNA, 22 bp, Homo sapiens
gggaatgtgcaggatcgtgggc

SEQ ID NO: 8409146 - DNA, 20 bp, Homo sapiens
gggaatgtgccccttacccc

SEQ ID NO: 8409147 - DNA, 22 bp, Homo sapiens
gggaatgtgcctggagtgttca

SEQ ID NO: 8409148 - DNA, 22 bp, Homo sapiens
gggaatgtaattaatctccttc

SEQ ID NO: 8409149 - DNA, 22 bp, Homo sapiens
gggaatgtacagaggacacagg

SEQ ID NO: 8409150 - DNA, 22 bp, Homo sapiens
gggaatgtagcaaatctgcaat

SEQ ID NO: 8409151 - DNA, 22 bp, Homo sapiens
gggaatgtgaaacagtaaggga

SEQ ID NO: 8409152 - DNA, 22 bp, Homo sapiens
gggacagccatgtgcagatgcc

SEQ ID NO: 8409153 - DNA, 22 bp, Homo sapiens
gggagagcgggaggtgccacag

SEQ ID NO: 8409154 - DNA, 19 bp, Homo sapiens
gggagagccaggctcaccc

SEQ ID NO: 8409155 - DNA, 22 bp, Homo sapiens
gggagagcgcgctagggccgag

SEQ ID NO: 8409156 - DNA, 22 bp, Homo sapiens
ggctgagaaggagtgggtgagg

SEQ ID NO: 8409157 - DNA, 22 bp, Homo sapiens
ggctccagatgtcccctggcaa

SEQ ID NO: 8409158 - DNA, 22 bp, Homo sapiens
ggctccagaaacttcagtccat

SEQ ID NO: 8409159 - DNA, 22 bp, Homo sapiens
ggcgggaagttcttgcccactt

SEQ ID NO: 8409160 - DNA, 22 bp, Homo sapiens
ggctccagccctggctcttcac

SEQ ID NO: 8409161 - DNA, 22 bp, Homo sapiens
ggctccaggagggccttggcca

SEQ ID NO: 8409162 - DNA, 22 bp, Homo sapiens
ggctgagcaattttgatgacat

SEQ ID NO: 8409163 - DNA, 22 bp, Homo sapiens
ggctgctgagttggccaggaga

SEQ ID NO: 8409164 - DNA, 22 bp, Homo sapiens
ggctgggctgctgggtcagagc

SEQ ID NO: 8409165 - DNA, 22 bp, Homo sapiens
ggctgggctgcggctgtacctg

SEQ ID NO: 8409166 - DNA, 22 bp, Homo sapiens
ggctgggccagggcctgtggac

SEQ ID NO: 8409167 - DNA, 22 bp, Homo sapiens
ggctgggcatccatccatgaga

SEQ ID NO: 8409168 - DNA, 22 bp, Homo sapiens
ggctgggcaggtctgcacaggg

SEQ ID NO: 8409169 - DNA, 20 bp, Homo sapiens
ggcagagggcctgggagaag

SEQ ID NO: 8409170 - DNA, 22 bp, Homo sapiens
ggcaggcaccagctcagcaata

SEQ ID NO: 8409171 - DNA, 22 bp, Homo sapiens
ggcaggcaacggaccactagtc

SEQ ID NO: 8409172 - DNA, 20 bp, Homo sapiens
ggcagagggcctgggagaag

SEQ ID NO: 8409173 - DNA, 22 bp, Homo sapiens
ggcagaggagctggaaacatgg

SEQ ID NO: 8409174 - DNA, 22 bp, Homo sapiens
ggcacagcgactaccatcgaaa

SEQ ID NO: 8409175 - DNA, 22 bp, Homo sapiens
ggcaaaggaaccaggccacact

SEQ ID NO: 8409176 - DNA, 20 bp, Homo sapiens
ggcaagcaactgagggagga

SEQ ID NO: 8409177 - DNA, 22 bp, Homo sapiens
ggcaagaggtccaagaggtctc

SEQ ID NO: 8409178 - DNA, 22 bp, Homo sapiens
ggagtgcagtggtgggatctca

SEQ ID NO: 8409179 - DNA, 22 bp, Homo sapiens
ggagtcctgtgtcttccaggaa

SEQ ID NO: 8409180 - DNA, 19 bp, Homo sapiens
ggagccagctgtggaaggc

SEQ ID NO: 8409181 - DNA, 22 bp, Homo sapiens
ggagccagagcactggggagcc

SEQ ID NO: 8409182 - DNA, 22 bp, Homo sapiens
ggagccagagcactggggagcc

SEQ ID NO: 8409183 - DNA, 22 bp, Homo sapiens
ggagccagagtctgcagtgtaa

SEQ ID NO: 8409184 - DNA, 22 bp, Homo sapiens
ggcctcagagaaggctgtgcgg

SEQ ID NO: 8409185 - DNA, 22 bp, Homo sapiens
ggccatggaccccgagctgacc

SEQ ID NO: 8409186 - DNA, 22 bp, Homo sapiens
ggccatggaccccgagctgacc

SEQ ID NO: 8409187 - DNA, 23 bp, Homo sapiens
ggccatggagacttagaatgggc

SEQ ID NO: 8409188 - DNA, 22 bp, Homo sapiens
ggcctcagggtcactctgtaga

SEQ ID NO: 8409189 - DNA, 22 bp, Homo sapiens
ggcctcagtttctccatgggtt

SEQ ID NO: 8409190 - DNA, 22 bp, Homo sapiens
ggcctcagggttgggcccatta

SEQ ID NO: 8409191 - DNA, 22 bp, Homo sapiens
ggcctcagtgggccgctgcagg

SEQ ID NO: 8409192 - DNA, 22 bp, Homo sapiens
ggcgagcagagcactgccagga

SEQ ID NO: 8409193 - DNA, 22 bp, Homo sapiens
ggcgctggccacggtggctctg

SEQ ID NO: 8409194 - DNA, 22 bp, Homo sapiens
ggcaggtggaagttggcagagc

SEQ ID NO: 8409195 - DNA, 22 bp, Homo sapiens
ggccagggggcttcagactcca

SEQ ID NO: 8409196 - DNA, 23 bp, Homo sapiens
ggccaggtgcaccttagagagcc

SEQ ID NO: 8409197 - DNA, 22 bp, Homo sapiens
ggccaggtccagtggaaggccc

SEQ ID NO: 8409198 - DNA, 22 bp, Homo sapiens
ggccaggtgcggtggctcacac

SEQ ID NO: 8409199 - DNA, 22 bp, Homo sapiens
ggccaggtgcggtggctcacac

SEQ ID NO: 8409200 - DNA, 22 bp, Homo sapiens
ggccagggcctggggactgtcc

SEQ ID NO: 8409201 - DNA, 22 bp, Homo sapiens
ggccagtgtgggagtagttctt

SEQ ID NO: 8409202 - DNA, 22 bp, Homo sapiens
ggccatgagaatgtgcaggtcc

SEQ ID NO: 8409203 - DNA, 22 bp, Homo sapiens
ggccagtggctctgtgcttggg

SEQ ID NO: 8409204 - DNA, 22 bp, Homo sapiens
ggccagtgtgcaggtcagagat

SEQ ID NO: 8409205 - DNA, 22 bp, Homo sapiens
ggccaatgggaatggccagtag

SEQ ID NO: 8409206 - DNA, 22 bp, Homo sapiens
ggcatggtttaagtggtgggga

SEQ ID NO: 8409207 - DNA, 22 bp, Homo sapiens
ggccaaggtggagaaggcactg

SEQ ID NO: 8409208 - DNA, 22 bp, Homo sapiens
ggccaaggctcttgagggctga

SEQ ID NO: 8409209 - DNA, 22 bp, Homo sapiens
gggtaggctctgcaggctgggt

SEQ ID NO: 8409210 - DNA, 22 bp, Homo sapiens
gggtggaggtgggttttgagat

SEQ ID NO: 8409211 - DNA, 22 bp, Homo sapiens
gggtggaggagaacaggcccca

SEQ ID NO: 8409212 - DNA, 22 bp, Homo sapiens
gggtggagcctgagaatttgca

SEQ ID NO: 8409213 - DNA, 22 bp, Homo sapiens
ggggtgggcgtgcagggacacc

SEQ ID NO: 8409214 - DNA, 22 bp, Homo sapiens
ggggtgggcgtgcagggacacc

SEQ ID NO: 8409215 - DNA, 21 bp, Homo sapiens
ggggttggcaagagcagagac

SEQ ID NO: 8409216 - DNA, 21 bp, Homo sapiens
ggggttggcaagagcagagac

SEQ ID NO: 8409217 - DNA, 22 bp, Homo sapiens
ggggctgaacctggaggtggtc

SEQ ID NO: 8409218 - DNA, 22 bp, Homo sapiens
ggggctgacgggcatgtggctt

SEQ ID NO: 8409219 - DNA, 22 bp, Homo sapiens
ggggctcaggggaagtgtccag

SEQ ID NO: 8409220 - DNA, 22 bp, Homo sapiens
ggggctggctcactaagagact

SEQ ID NO: 8409221 - DNA, 22 bp, Homo sapiens
ggggaagatttttaattagtaa

SEQ ID NO: 8409222 - DNA, 22 bp, Homo sapiens
ggggccgaccgcggttcaggcc

SEQ ID NO: 8409223 - DNA, 22 bp, Homo sapiens
ggggaagaggcgtgatggatcc

SEQ ID NO: 8409224 - DNA, 22 bp, Homo sapiens
ggggaagatggccctccatgtg

SEQ ID NO: 8409225 - DNA, 22 bp, Homo sapiens
gggctgagagctggaatctgag

SEQ ID NO: 8409226 - DNA, 22 bp, Homo sapiens
gggccaaggggagctggaaggg

SEQ ID NO: 8409227 - DNA, 22 bp, Homo sapiens
gggcatggtggcaggcacctgt

SEQ ID NO: 8409228 - DNA, 22 bp, Homo sapiens
gggcatggtggtgcacacctgt

SEQ ID NO: 8409229 - DNA, 22 bp, Homo sapiens
gggcatggtgctggtgttcatg

SEQ ID NO: 8409230 - DNA, 18 bp, Homo sapiens
gggcatggatgcagcatc

SEQ ID NO: 8409231 - DNA, 22 bp, Homo sapiens
gggctgagtgtcccaggccgaa

SEQ ID NO: 8409232 - DNA, 22 bp, Homo sapiens
gggctgcatcagcaggacccgg

SEQ ID NO: 8409233 - DNA, 22 bp, Homo sapiens
gggcttggagtaggctgatgaa

SEQ ID NO: 8409234 - DNA, 22 bp, Homo sapiens
gggcttggcacatgggctcagc

SEQ ID NO: 8409235 - DNA, 22 bp, Homo sapiens
gggcttggcacatgggctcagc

SEQ ID NO: 8409236 - DNA, 22 bp, Homo sapiens
gggcttggagtaggctgatgaa

SEQ ID NO: 8409237 - DNA, 20 bp, Homo sapiens
gggcttggaggactcgaggg

SEQ ID NO: 8409238 - DNA, 19 bp, Homo sapiens
gggcttggggctgaagcct

SEQ ID NO: 8409239 - DNA, 22 bp, Homo sapiens
gggcttggctggggccaccaga

SEQ ID NO: 8409240 - DNA, 22 bp, Homo sapiens
gggcttgggtattgtgagaggt

SEQ ID NO: 8409241 - DNA, 22 bp, Homo sapiens
gggcttggctcataagtggatg

SEQ ID NO: 8409242 - DNA, 22 bp, Homo sapiens
gggcttgaggtgaaggtaggga

SEQ ID NO: 8409243 - DNA, 22 bp, Homo sapiens
ggtctcaggagactggagagca

SEQ ID NO: 8409244 - DNA, 22 bp, Homo sapiens
ggtctcagctggagtccttggt

SEQ ID NO: 8409245 - DNA, 22 bp, Homo sapiens
ggtctcagtgaaggagtgtgct

SEQ ID NO: 8409246 - DNA, 19 bp, Homo sapiens
ggtctcagtgcagctgcag

SEQ ID NO: 8409247 - DNA, 22 bp, Homo sapiens
ggtcgccagccctagtctgctg

SEQ ID NO: 8409248 - DNA, 22 bp, Homo sapiens
ggtcagaattaggtctagagta

SEQ ID NO: 8409249 - DNA, 22 bp, Homo sapiens
ggtcagaacaagcaaataatag

SEQ ID NO: 8409250 - DNA, 22 bp, Homo sapiens
ggtcagaacaagggtaaataaa

SEQ ID NO: 8409251 - DNA, 22 bp, Homo sapiens
ggtcagaaggattctgggaaat

SEQ ID NO: 8409252 - DNA, 22 bp, Homo sapiens
ggtcagaaggcagttaaacaaa

SEQ ID NO: 8409253 - DNA, 22 bp, Homo sapiens
ggtcagaaggcctcggcaggaa

SEQ ID NO: 8409254 - DNA, 22 bp, Homo sapiens
ggtcagaagtgcaaaatcagtt

SEQ ID NO: 8409255 - DNA, 22 bp, Homo sapiens
gggtggcaggattggcaggagt

SEQ ID NO: 8409256 - DNA, 22 bp, Homo sapiens
gggtggcagctgttgccaaggt

SEQ ID NO: 8409257 - DNA, 22 bp, Homo sapiens
gggtggcacaggtgcagagggt

SEQ ID NO: 8409258 - DNA, 20 bp, Homo sapiens
gggtggagttgcggtctgtg

SEQ ID NO: 8409259 - DNA, 22 bp, Homo sapiens
gggtggctcctatgggcatagc

SEQ ID NO: 8409260 - DNA, 22 bp, Homo sapiens
ggtagggcaaagtagggcacct

SEQ ID NO: 8409261 - DNA, 22 bp, Homo sapiens
gggtggcatagggtgatggctt

SEQ ID NO: 8409262 - DNA, 21 bp, Homo sapiens
gggtggccgcatgggtgcgtg

SEQ ID NO: 8409263 - DNA, 22 bp, Homo sapiens
gggtggccttaggcaagtcact

SEQ ID NO: 8409264 - DNA, 22 bp, Homo sapiens
gggtggccttcatagctcaggg

SEQ ID NO: 8409265 - DNA, 22 bp, Homo sapiens
ggtggctccgcttccatgggct

SEQ ID NO: 8409266 - DNA, 18 bp, Homo sapiens
ggtggcggggatggaggt

SEQ ID NO: 8409267 - DNA, 22 bp, Homo sapiens
ggtggctcaaagagagcacaga

SEQ ID NO: 8409268 - DNA, 21 bp, Homo sapiens
ggtggctcacctgattggata

SEQ ID NO: 8409269 - DNA, 19 bp, Homo sapiens
ggtggctcagggcccagcc

SEQ ID NO: 8409270 - DNA, 22 bp, Homo sapiens
ggtggcctctcatgcaaggtag

SEQ ID NO: 8409271 - DNA, 22 bp, Homo sapiens
ggtggcctcagcaaggctggca

SEQ ID NO: 8409272 - DNA, 22 bp, Homo sapiens
ggtggcctccagggcataggtg

SEQ ID NO: 8409273 - DNA, 22 bp, Homo sapiens
ggtggcctcggtggtgcacagg

SEQ ID NO: 8409274 - DNA, 22 bp, Homo sapiens
ggtggccttttatgagcagggt

SEQ ID NO: 8409275 - DNA, 22 bp, Homo sapiens
ggtggcctgaattagctcaggg

SEQ ID NO: 8409276 - DNA, 17 bp, Homo sapiens
ggtggcctgcagtggct

SEQ ID NO: 8409277 - DNA, 19 bp, Homo sapiens
ggtggctctccctcaggga

SEQ ID NO: 8409278 - DNA, 22 bp, Homo sapiens
ggtggctcggccagtgcaggcc

SEQ ID NO: 8409279 - DNA, 22 bp, Homo sapiens
ggtggctctcttaagggcagcg

SEQ ID NO: 8409280 - DNA, 22 bp, Homo sapiens
ggtggctctccctggactcagc

SEQ ID NO: 8409281 - DNA, 22 bp, Homo sapiens
gtgactctgcattttatggatc

SEQ ID NO: 8409282 - DNA, 22 bp, Homo sapiens
gtgagcagctcagggtggtctc

SEQ ID NO: 8409283 - DNA, 22 bp, Homo sapiens
gtgagcaggatttcatggtgta

SEQ ID NO: 8409284 - DNA, 22 bp, Homo sapiens
gtcctgggcctgctgaggctga

SEQ ID NO: 8409285 - DNA, 22 bp, Homo sapiens
gtgaagaaggcaatacaaagaa

SEQ ID NO: 8409286 - DNA, 22 bp, Homo sapiens
gtgaagagctgttgcagagatt

SEQ ID NO: 8409287 - DNA, 22 bp, Homo sapiens
gtcctgggcccaggggctgcct

SEQ ID NO: 8409288 - DNA, 22 bp, Homo sapiens
gtccccagaaaggtgaggcagg

SEQ ID NO: 8409289 - DNA, 22 bp, Homo sapiens
gtattcatttatttactcatcc

SEQ ID NO: 8409290 - DNA, 22 bp, Homo sapiens
gtattcatattaaacatatcaa

SEQ ID NO: 8409291 - DNA, 22 bp, Homo sapiens
gctactgattgaccttggagag

SEQ ID NO: 8409292 - DNA, 22 bp, Homo sapiens
gctcccaccttaaccttcacat

SEQ ID NO: 8409293 - DNA, 22 bp, Homo sapiens
gctgaggctcaagtcatgggtc

SEQ ID NO: 8409294 - DNA, 22 bp, Homo sapiens
gctgaggccagtttaatgagga

SEQ ID NO: 8409295 - DNA, 22 bp, Homo sapiens
gctgaggctgggagcagcctgt

SEQ ID NO: 8409296 - DNA, 22 bp, Homo sapiens
gctccgggggttccagatcatc

SEQ ID NO: 8409297 - DNA, 22 bp, Homo sapiens
gctctgggaagtcctttaccat

SEQ ID NO: 8409298 - DNA, 22 bp, Homo sapiens
gctctgggaaggatcgtagtga

SEQ ID NO: 8409299 - DNA, 22 bp, Homo sapiens
gctctgggaactgactgccttc

SEQ ID NO: 8409300 - DNA, 22 bp, Homo sapiens
gctctgggattaccagccttag

SEQ ID NO: 8409301 - DNA, 22 bp, Homo sapiens
gctctgggccatcctggccggg

SEQ ID NO: 8409302 - DNA, 22 bp, Homo sapiens
gctctgggaattcagaaagcct

SEQ ID NO: 8409303 - DNA, 22 bp, Homo sapiens
gctctgggattaccagccttag

SEQ ID NO: 8409304 - DNA, 20 bp, Homo sapiens
gctctgggagggatgtgatg

SEQ ID NO: 8409305 - DNA, 22 bp, Homo sapiens
gctctggggatgcttctgccgt

SEQ ID NO: 8409306 - DNA, 22 bp, Homo sapiens
gctctggggcccagggatcaca

SEQ ID NO: 8409307 - DNA, 22 bp, Homo sapiens
gctctgggctgccctctggaca

SEQ ID NO: 8409308 - DNA, 22 bp, Homo sapiens
gctctgggctgaatcatttatc

SEQ ID NO: 8409309 - DNA, 22 bp, Homo sapiens
gctctgggccgggcaccagcct

SEQ ID NO: 8409310 - DNA, 22 bp, Homo sapiens
gctgcctgtctgctgacccagg

SEQ ID NO: 8409311 - DNA, 19 bp, Homo sapiens
gctgcctgtcttagccagt

SEQ ID NO: 8409312 - DNA, 22 bp, Homo sapiens
gctgccctagaagtacagagag

SEQ ID NO: 8409313 - DNA, 22 bp, Homo sapiens
gctgcccattccactggatggt

SEQ ID NO: 8409314 - DNA, 22 bp, Homo sapiens
gctgcctgtcctgaggagtccg

SEQ ID NO: 8409315 - DNA, 22 bp, Homo sapiens
gctgagggccgcatagggtcat

SEQ ID NO: 8409316 - DNA, 22 bp, Homo sapiens
gctgagggcatgtgtggcgact

SEQ ID NO: 8409317 - DNA, 22 bp, Homo sapiens
ggagcagcactgccacacagag

SEQ ID NO: 8409318 - DNA, 22 bp, Homo sapiens
ggagccagaaatgctgtggttg

SEQ ID NO: 8409319 - DNA, 19 bp, Homo sapiens
ggaccagctttcaggaggc

SEQ ID NO: 8409320 - DNA, 20 bp, Homo sapiens
ggaccagctgtctgaggggc

SEQ ID NO: 8409321 - DNA, 20 bp, Homo sapiens
ggaccagctgtctgaggggc

SEQ ID NO: 8409322 - DNA, 22 bp, Homo sapiens
ggacatcttggttgcttccaag

SEQ ID NO: 8409323 - DNA, 22 bp, Homo sapiens
ggacaggtgtgaggctggcaca

SEQ ID NO: 8409324 - DNA, 22 bp, Homo sapiens
ggacaggtgcaaagggcacatg

SEQ ID NO: 8409325 - DNA, 22 bp, Homo sapiens
ggacaggtgactgcccagagtg

SEQ ID NO: 8409326 - DNA, 22 bp, Homo sapiens
ggaagaggctgagccaggtccc

SEQ ID NO: 8409327 - DNA, 22 bp, Homo sapiens
ggaagaggctctcattgagggc

SEQ ID NO: 8409328 - DNA, 22 bp, Homo sapiens
ggaagaggctggtagtgcccgt

SEQ ID NO: 8409329 - DNA, 22 bp, Homo sapiens
ggaagagtaacaggaggtggaa

SEQ ID NO: 8409330 - DNA, 22 bp, Homo sapiens
ggaatcttaatggcatggagtt

SEQ ID NO: 8409331 - DNA, 22 bp, Homo sapiens
ggaatctttgaaggattttaag

SEQ ID NO: 8409332 - DNA, 22 bp, Homo sapiens
ggaatcttcagccatgccaaga

SEQ ID NO: 8409333 - DNA, 22 bp, Homo sapiens
ggaatcgttaggtaagcaggga

SEQ ID NO: 8409334 - DNA, 22 bp, Homo sapiens
ggaatgtgttcttactgtattt

SEQ ID NO: 8409335 - DNA, 22 bp, Homo sapiens
ggaatgtgcgtactcagtgtca

SEQ ID NO: 8409336 - DNA, 22 bp, Homo sapiens
ggaatgtgctgacacgcgagag

SEQ ID NO: 8409337 - DNA, 22 bp, Homo sapiens
ggaatgtaaatttactgttgta

SEQ ID NO: 8409338 - DNA, 22 bp, Homo sapiens
ggaatgtagtttgtgcactgta

SEQ ID NO: 8409339 - DNA, 22 bp, Homo sapiens
ggaatctttttcataagcctca

SEQ ID NO: 8409340 - DNA, 22 bp, Homo sapiens
gctggagaacccaggaggaaga

SEQ ID NO: 8409341 - DNA, 21 bp, Homo sapiens
gctggctggctgaccggcctt

SEQ ID NO: 8409342 - DNA, 22 bp, Homo sapiens
gctgggcttcacctccagagtt

SEQ ID NO: 8409343 - DNA, 22 bp, Homo sapiens
gcttggaagtaggattgggaga

SEQ ID NO: 8409344 - DNA, 22 bp, Homo sapiens
gctgtggctccaatggtgagcc

SEQ ID NO: 8409345 - DNA, 22 bp, Homo sapiens
gctgtggctgaagatgcaggga

SEQ ID NO: 8409346 - DNA, 19 bp, Homo sapiens
gctggggcctgaccagaca

SEQ ID NO: 8409347 - DNA, 22 bp, Homo sapiens
gctggggctgggctgaggaaga

SEQ ID NO: 8409348 - DNA, 22 bp, Homo sapiens
gctgtggcggcagcagctggtg

SEQ ID NO: 8409349 - DNA, 22 bp, Homo sapiens
gctggggagggcgtcaaggcca

SEQ ID NO: 8409350 - DNA, 22 bp, Homo sapiens
gctggggcctgaacagtcagct

SEQ ID NO: 8409351 - DNA, 22 bp, Homo sapiens
gccccaccgagggtgcagtcct

SEQ ID NO: 8409352 - DNA, 22 bp, Homo sapiens
gccccacagcctgcggtctcag

SEQ ID NO: 8409353 - DNA, 22 bp, Homo sapiens
gccccaccttgagagcagaaac

SEQ ID NO: 8409354 - DNA, 22 bp, Homo sapiens
gccccacctgctaccttccagc

SEQ ID NO: 8409355 - DNA, 22 bp, Homo sapiens
gcccaggagcctggagatgtgt

SEQ ID NO: 8409356 - DNA, 22 bp, Homo sapiens
gcccagctttttgaggcaggca

SEQ ID NO: 8409357 - DNA, 22 bp, Homo sapiens
gcccaggaaagatagggcctca

SEQ ID NO: 8409358 - DNA, 22 bp, Homo sapiens
gccagggggtcagcaggcactt

SEQ ID NO: 8409359 - DNA, 22 bp, Homo sapiens
gccagggggtcagcaggcactt

SEQ ID NO: 8409360 - DNA, 22 bp, Homo sapiens
gccaggggacgcggagcgacga

SEQ ID NO: 8409361 - DNA, 22 bp, Homo sapiens
gcccagcacatctggccttgaa

SEQ ID NO: 8409362 - DNA, 22 bp, Homo sapiens
gcccagctccattcttggtgag

SEQ ID NO: 8409363 - DNA, 22 bp, Homo sapiens
gcccagctcctctgcagaccct

SEQ ID NO: 8409364 - DNA, 22 bp, Homo sapiens
gcccagctgagaagcgcggggc

SEQ ID NO: 8409365 - DNA, 22 bp, Homo sapiens
gcccagctgcaccctggtgggt

SEQ ID NO: 8409366 - DNA, 22 bp, Homo sapiens
gcccagcactcctctctgacat

SEQ ID NO: 8409367 - DNA, 22 bp, Homo sapiens
gcccagcacctctctcagggtt

SEQ ID NO: 8409368 - DNA, 22 bp, Homo sapiens
gcccagcagctccacttggctt

SEQ ID NO: 8409369 - DNA, 22 bp, Homo sapiens
gcccagcagatctcagtgtctc

SEQ ID NO: 8409370 - DNA, 22 bp, Homo sapiens
gcctcctggcctttgctcctca

SEQ ID NO: 8409371 - DNA, 22 bp, Homo sapiens
gccctgggattgggtggaggct

SEQ ID NO: 8409372 - DNA, 22 bp, Homo sapiens
gccccagccaaggtgacacgaa

SEQ ID NO: 8409373 - DNA, 22 bp, Homo sapiens
gccccagcctcccgagtagctg

SEQ ID NO: 8409374 - DNA, 22 bp, Homo sapiens
gccccagccctgtggaccatgg

SEQ ID NO: 8409375 - DNA, 18 bp, Homo sapiens
gccagccctccaacctcc

SEQ ID NO: 8409376 - DNA, 21 bp, Homo sapiens
gccagcggccgccctccagga

SEQ ID NO: 8409377 - DNA, 22 bp, Homo sapiens
gccagctgaatttccaactgtt

SEQ ID NO: 8409378 - DNA, 22 bp, Homo sapiens
gccaggcagatatgtgagctta

SEQ ID NO: 8409379 - DNA, 22 bp, Homo sapiens
gccaggcagcagcgaggatggt

SEQ ID NO: 8409380 - DNA, 18 bp, Homo sapiens
gccaggcagggtggggaa

SEQ ID NO: 8409381 - DNA, 22 bp, Homo sapiens
gccaggcagctgggagggtgcc

SEQ ID NO: 8409382 - DNA, 22 bp, Homo sapiens
gccaggcaggtgtcggagccct

SEQ ID NO: 8409383 - DNA, 22 bp, Homo sapiens
gccaggcaggccacgctgtgtt

SEQ ID NO: 8409384 - DNA, 22 bp, Homo sapiens
gccagggaggctgtagggtcct

SEQ ID NO: 8409385 - DNA, 21 bp, Homo sapiens
gccagggaagagagttggctg

SEQ ID NO: 8409386 - DNA, 22 bp, Homo sapiens
gccaggcatgggcttctgggcg

SEQ ID NO: 8409387 - DNA, 22 bp, Homo sapiens
gccagggaacccaagggcctca

SEQ ID NO: 8409388 - DNA, 21 bp, Homo sapiens
gccagggagttaaagagtctt

SEQ ID NO: 8409389 - DNA, 22 bp, Homo sapiens
gccagggcaggggagcatctgc

SEQ ID NO: 8409390 - DNA, 22 bp, Homo sapiens
gccagggctcgcggtccctcgt

SEQ ID NO: 8409391 - DNA, 22 bp, Homo sapiens
gcatgctgcagggaatgcttgt

SEQ ID NO: 8409392 - DNA, 22 bp, Homo sapiens
gcagtggcagctgagggggtat

SEQ ID NO: 8409393 - DNA, 22 bp, Homo sapiens
gcagtgggagcttaggcagtgc

SEQ ID NO: 8409394 - DNA, 22 bp, Homo sapiens
gcagtggccacatggaggagga

SEQ ID NO: 8409395 - DNA, 22 bp, Homo sapiens
gcagtggcccagcttgcaggct

SEQ ID NO: 8409396 - DNA, 22 bp, Homo sapiens
gcaggcagatcacctgtcagga

SEQ ID NO: 8409397 - DNA, 22 bp, Homo sapiens
gcaggcagaggtggaggagaca

SEQ ID NO: 8409398 - DNA, 22 bp, Homo sapiens
gcaggcagttatttagtagaat

SEQ ID NO: 8409399 - DNA, 22 bp, Homo sapiens
gcagggaagacccggagcagcg

SEQ ID NO: 8409400 - DNA, 21 bp, Homo sapiens
gcagggacaaagcttcaggag

SEQ ID NO: 8409401 - DNA, 22 bp, Homo sapiens
gcagggcttagaaatggtggct

SEQ ID NO: 8409402 - DNA, 22 bp, Homo sapiens
gcagggcttgcagcagctagac

SEQ ID NO: 8409403 - DNA, 22 bp, Homo sapiens
gcagggcttagaaatggtggct

SEQ ID NO: 8409404 - DNA, 22 bp, Homo sapiens
gcagggctgtaatttgagcctg

SEQ ID NO: 8409405 - DNA, 22 bp, Homo sapiens
gcagggctgggtgggagacaga

SEQ ID NO: 8409406 - DNA, 22 bp, Homo sapiens
gcagggctgggtgggagacaga

SEQ ID NO: 8409407 - DNA, 22 bp, Homo sapiens
gcagggaccaaaagaggcagta

SEQ ID NO: 8409408 - DNA, 22 bp, Homo sapiens
gcagggaccaaaagaggcagta

SEQ ID NO: 8409409 - DNA, 22 bp, Homo sapiens
gcagggacacctttgtgaagct

SEQ ID NO: 8409410 - DNA, 22 bp, Homo sapiens
gcaggaagggaaaggttgactc

SEQ ID NO: 8409411 - DNA, 22 bp, Homo sapiens
gcaggaagcatagaagaatgcc

SEQ ID NO: 8409412 - DNA, 22 bp, Homo sapiens
gcaggaagccttaccaagccca

SEQ ID NO: 8409413 - DNA, 22 bp, Homo sapiens
gcaggaagaggctcgaagcccc

SEQ ID NO: 8409414 - DNA, 22 bp, Homo sapiens
gcaggaagatgagctcaggtaa

SEQ ID NO: 8409415 - DNA, 22 bp, Homo sapiens
gcaggaacccggccgccctggc

SEQ ID NO: 8409416 - DNA, 22 bp, Homo sapiens
gcaggaaccccgggaggctggc

SEQ ID NO: 8409417 - DNA, 22 bp, Homo sapiens
gcaggaacccagacaaccaggg

SEQ ID NO: 8409418 - DNA, 22 bp, Homo sapiens
gcagcccagcagggcccggagc

SEQ ID NO: 8409419 - DNA, 22 bp, Homo sapiens
gcagcccagagcgcaggacccc

SEQ ID NO: 8409420 - DNA, 22 bp, Homo sapiens
gcacacagtactatatgctaca

SEQ ID NO: 8409421 - DNA, 20 bp, Homo sapiens
gcagagtgtgagagggtgaa

SEQ ID NO: 8409422 - DNA, 22 bp, Homo sapiens
gcagactgtatcaatgtcagta

SEQ ID NO: 8409423 - DNA, 22 bp, Homo sapiens
gcagagcaccaaagtgaaagat

SEQ ID NO: 8409424 - DNA, 22 bp, Homo sapiens
tcccacaggggctctgtgggtt

SEQ ID NO: 8409425 - DNA, 22 bp, Homo sapiens
tcccacagggcttctctgtaca

SEQ ID NO: 8409426 - DNA, 22 bp, Homo sapiens
tcccatctccaacatttttctt

SEQ ID NO: 8409427 - DNA, 22 bp, Homo sapiens
tccccacctacacactgctcct

SEQ ID NO: 8409428 - DNA, 22 bp, Homo sapiens
tccccacctaagatacccatct

SEQ ID NO: 8409429 - DNA, 22 bp, Homo sapiens
tccccaccccagaactactagg

SEQ ID NO: 8409430 - DNA, 22 bp, Homo sapiens
tccccaggggcatctctctgct

SEQ ID NO: 8409431 - DNA, 22 bp, Homo sapiens
tccccaggggcatctctctgct

SEQ ID NO: 8409432 - DNA, 22 bp, Homo sapiens
tccccaggggcctgggcacagt

SEQ ID NO: 8409433 - DNA, 20 bp, Homo sapiens
tccccagggcatcaggagca

SEQ ID NO: 8409434 - DNA, 22 bp, Homo sapiens
tccccagggtccctgcttccat

SEQ ID NO: 8409435 - DNA, 22 bp, Homo sapiens
tccagctcacagatagcgtggg

SEQ ID NO: 8409436 - DNA, 22 bp, Homo sapiens
tccagagcctgcgcactggctg

SEQ ID NO: 8409437 - DNA, 18 bp, Homo sapiens
tccagagctactgtggtg

SEQ ID NO: 8409438 - DNA, 22 bp, Homo sapiens
tccagagccccagtctagtggg

SEQ ID NO: 8409439 - DNA, 21 bp, Homo sapiens
tcccacagcgccagctcctgt

SEQ ID NO: 8409440 - DNA, 22 bp, Homo sapiens
tccaggctctcaggtgtcagca

SEQ ID NO: 8409441 - DNA, 22 bp, Homo sapiens
tccaggctaggtttacaggaca

SEQ ID NO: 8409442 - DNA, 22 bp, Homo sapiens
tccaggagtgtgtgctaatggg

SEQ ID NO: 8409443 - DNA, 22 bp, Homo sapiens
tcaggtgtttctggagaagtaa

SEQ ID NO: 8409444 - DNA, 18 bp, Homo sapiens
tcaggtgttttctgtata

SEQ ID NO: 8409445 - DNA, 22 bp, Homo sapiens
tcaggtgttctccactcagttt

SEQ ID NO: 8409446 - DNA, 22 bp, Homo sapiens
tcaggtgtttaaggatagtgat

SEQ ID NO: 8409447 - DNA, 22 bp, Homo sapiens
tcaggtgtgtggtggaaggcag

SEQ ID NO: 8409448 - DNA, 22 bp, Homo sapiens
tcaggtgttagaagaaatttca

SEQ ID NO: 8409449 - DNA, 22 bp, Homo sapiens
tcaggtgtgttgtattttacca

SEQ ID NO: 8409450 - DNA, 22 bp, Homo sapiens
tcaggtgtgggcagagaaacca

SEQ ID NO: 8409451 - DNA, 22 bp, Homo sapiens
tcaggtgtggaccgaggtcaga

SEQ ID NO: 8409452 - DNA, 22 bp, Homo sapiens
tcaggtgtggtcaccacagggt

SEQ ID NO: 8409453 - DNA, 22 bp, Homo sapiens
tcaggtgtgtggctctggacca

SEQ ID NO: 8409454 - DNA, 23 bp, Homo sapiens
tcaggtgtgcggactgctgagtc

SEQ ID NO: 8409455 - DNA, 16 bp, Homo sapiens
tcaggtgtgacttttt

SEQ ID NO: 8409456 - DNA, 22 bp, Homo sapiens
tcaggtgtcttgtgggatttta

SEQ ID NO: 8409457 - DNA, 22 bp, Homo sapiens
tcaggtgtgaactatttggaaa

SEQ ID NO: 8409458 - DNA, 22 bp, Homo sapiens
tcaggtgtctatctaacctggt

SEQ ID NO: 8409459 - DNA, 22 bp, Homo sapiens
tcaggtgtctgcctctttgagt

SEQ ID NO: 8409460 - DNA, 22 bp, Homo sapiens
tcaggtgtcaagcagggagctg

SEQ ID NO: 8409461 - DNA, 22 bp, Homo sapiens
tcaggtgtattgatgtctgtga

SEQ ID NO: 8409462 - DNA, 22 bp, Homo sapiens
tcaggaagaaagaagggagtgt

SEQ ID NO: 8409463 - DNA, 22 bp, Homo sapiens
tcaggaagaaattctgtatctt

SEQ ID NO: 8409464 - DNA, 22 bp, Homo sapiens
tcaggaagaagacggggcagga

SEQ ID NO: 8409465 - DNA, 22 bp, Homo sapiens
tcaggaagacaatctttggctc

SEQ ID NO: 8409466 - DNA, 22 bp, Homo sapiens
tcaggaagcatcctgaggtgtc

SEQ ID NO: 8409467 - DNA, 21 bp, Homo sapiens
tcaggaagagcttctcccact

SEQ ID NO: 8409468 - DNA, 22 bp, Homo sapiens
tcaggaagattagtttcctacc

SEQ ID NO: 8409469 - DNA, 21 bp, Homo sapiens
tcaggaagagccagttcatgc

SEQ ID NO: 8409470 - DNA, 22 bp, Homo sapiens
tcaggaagccactccacagaga

SEQ ID NO: 8409471 - DNA, 22 bp, Homo sapiens
tcaggaagctcttgctgattct

SEQ ID NO: 8409472 - DNA, 22 bp, Homo sapiens
tcaggaagctactgccagcagc

SEQ ID NO: 8409473 - DNA, 22 bp, Homo sapiens
tcaggaagccggttaaatagat

SEQ ID NO: 8409474 - DNA, 22 bp, Homo sapiens
tcaggaagctgctctgggtggt

SEQ ID NO: 8409475 - DNA, 22 bp, Homo sapiens
tcaggaaggagctggcctgcca

SEQ ID NO: 8409476 - DNA, 22 bp, Homo sapiens
tcaggaagctgaattacaaaaa

SEQ ID NO: 8409477 - DNA, 22 bp, Homo sapiens
tcaggaaggcgccccatcagga

SEQ ID NO: 8409478 - DNA, 22 bp, Homo sapiens
tcaggaaggcttcacacgagtg

SEQ ID NO: 8409479 - DNA, 22 bp, Homo sapiens
tcaggaaggcaaattgcatgat

SEQ ID NO: 8409480 - DNA, 22 bp, Homo sapiens
tcaggaagggctcagtctgtgc

SEQ ID NO: 8409481 - DNA, 22 bp, Homo sapiens
tcaggaaggcacttggtgtgtt

SEQ ID NO: 8409482 - DNA, 22 bp, Homo sapiens
tcaggaggtgtaggtcaagtga

SEQ ID NO: 8409483 - DNA, 22 bp, Homo sapiens
tcaggaggtttggattcagtta

SEQ ID NO: 8409484 - DNA, 17 bp, Homo sapiens
tcaggaggtgtttctag

SEQ ID NO: 8409485 - DNA, 22 bp, Homo sapiens
tcaggaggttgaccacggggca

SEQ ID NO: 8409486 - DNA, 22 bp, Homo sapiens
tcagcactttgaagcagaagga

SEQ ID NO: 8409487 - DNA, 22 bp, Homo sapiens
tcagcactttttaaagcagcat

SEQ ID NO: 8409488 - DNA, 21 bp, Homo sapiens
tcagcagcttttgcagtccct

SEQ ID NO: 8409489 - DNA, 22 bp, Homo sapiens
tcagcctggtgattcctctgtc

SEQ ID NO: 8409490 - DNA, 22 bp, Homo sapiens
tcaggccacttcacaggtgatt

SEQ ID NO: 8409491 - DNA, 22 bp, Homo sapiens
tcaggctgctggccagcaggct

SEQ ID NO: 8409492 - DNA, 22 bp, Homo sapiens
tcaaggcacttcatgtctcagt

SEQ ID NO: 8409493 - DNA, 23 bp, Homo sapiens
tcacagggcactggctggggttg

SEQ ID NO: 8409494 - DNA, 22 bp, Homo sapiens
tcacagggtatctgggatggat

SEQ ID NO: 8409495 - DNA, 20 bp, Homo sapiens
tcagacccagattagcaggt

SEQ ID NO: 8409496 - DNA, 22 bp, Homo sapiens
tcagaccccagaatgaagccag

SEQ ID NO: 8409497 - DNA, 22 bp, Homo sapiens
tcagacccaggtgccaagctgt

SEQ ID NO: 8409498 - DNA, 22 bp, Homo sapiens
tcagaaaagaccacattattct

SEQ ID NO: 8409499 - DNA, 22 bp, Homo sapiens
tcagcactcgctacctagtaaa

SEQ ID NO: 8409500 - DNA, 22 bp, Homo sapiens
tcagcaagtggaccatcctggg

SEQ ID NO: 8409501 - DNA, 22 bp, Homo sapiens
tcagcactgatagaagtcaata

SEQ ID NO: 8409502 - DNA, 22 bp, Homo sapiens
gtttccatgggagaagacagtg

SEQ ID NO: 8409503 - DNA, 23 bp, Homo sapiens
gtgtgccaagcactgtgccagga

SEQ ID NO: 8409504 - DNA, 22 bp, Homo sapiens
gtgtgccaccactgacaggatt

SEQ ID NO: 8409505 - DNA, 22 bp, Homo sapiens
gtgtgggacgggtgagtggcca

SEQ ID NO: 8409506 - DNA, 22 bp, Homo sapiens
gtgtggccttgggagaggtctg

SEQ ID NO: 8409507 - DNA, 23 bp, Homo sapiens
gttaataatgaacactttctccc

SEQ ID NO: 8409508 - DNA, 22 bp, Homo sapiens
gttcagtcacgtgcccaagttc

SEQ ID NO: 8409509 - DNA, 22 bp, Homo sapiens
taatggttttttggagactgct

SEQ ID NO: 8409510 - DNA, 22 bp, Homo sapiens
taatacattacctaacctctct

SEQ ID NO: 8409511 - DNA, 19 bp, Homo sapiens
taaggctgaaggaggaggg

SEQ ID NO: 8409512 - DNA, 22 bp, Homo sapiens
taaggctgtccaaaattttgac

SEQ ID NO: 8409513 - DNA, 22 bp, Homo sapiens
taaggctgttaggaggattaaa

SEQ ID NO: 8409514 - DNA, 17 bp, Homo sapiens
tacagaaggcaccacaa

SEQ ID NO: 8409515 - DNA, 22 bp, Homo sapiens
tacattgagaaccactgcttag

SEQ ID NO: 8409516 - DNA, 22 bp, Homo sapiens
tacaggaggattatcaaaggat

SEQ ID NO: 8409517 - DNA, 22 bp, Homo sapiens
tacaggagcatggggaagggat

SEQ ID NO: 8409518 - DNA, 22 bp, Homo sapiens
tacaggagcacaaaagagttga

SEQ ID NO: 8409519 - DNA, 22 bp, Homo sapiens
tacagtacagtctagactctgg

SEQ ID NO: 8409520 - DNA, 22 bp, Homo sapiens
tacagtagaatttttagtaact

SEQ ID NO: 8409521 - DNA, 22 bp, Homo sapiens
tagggactagtttcaaggctaa

SEQ ID NO: 8409522 - DNA, 22 bp, Homo sapiens
taggagtcatttggtccctctt

SEQ ID NO: 8409523 - DNA, 22 bp, Homo sapiens
taggaaacaaagtggatgaaat

SEQ ID NO: 8409524 - DNA, 22 bp, Homo sapiens
taggacagtagctggtgcacag

SEQ ID NO: 8409525 - DNA, 22 bp, Homo sapiens
tagagtaaatagtatgagaaag

SEQ ID NO: 8409526 - DNA, 23 bp, Homo sapiens
tagcagcatttttagcctctgtc

SEQ ID NO: 8409527 - DNA, 22 bp, Homo sapiens
tagcccaggctggagggcagtg

SEQ ID NO: 8409528 - DNA, 22 bp, Homo sapiens
tagctgaaggctacagcagaac

SEQ ID NO: 8409529 - DNA, 22 bp, Homo sapiens
tagaaacaatgacatgcttgta

SEQ ID NO: 8409530 - DNA, 22 bp, Homo sapiens
tagaaacagcatatattagccc

SEQ ID NO: 8409531 - DNA, 22 bp, Homo sapiens
tagaaacatcagctaaccaaaa

SEQ ID NO: 8409532 - DNA, 21 bp, Homo sapiens
tagaggcaggagggactgcag

SEQ ID NO: 8409533 - DNA, 22 bp, Homo sapiens
tatgtgcacatacaagtgtgct

SEQ ID NO: 8409534 - DNA, 22 bp, Homo sapiens
tatgtacaagcacacatgtgac

SEQ ID NO: 8409535 - DNA, 22 bp, Homo sapiens
tatgtacaatcagcagttcata

SEQ ID NO: 8409536 - DNA, 22 bp, Homo sapiens
tatgtacacacacatgcatgta

SEQ ID NO: 8409537 - DNA, 22 bp, Homo sapiens
tatgtacaatttgttgtatgtc

SEQ ID NO: 8409538 - DNA, 22 bp, Homo sapiens
tatgtacacatacacttgtaat

SEQ ID NO: 8409539 - DNA, 22 bp, Homo sapiens
tatgtacaccaaggattgaaaa

SEQ ID NO: 8409540 - DNA, 22 bp, Homo sapiens
tatgtacaccggggaaggtggg

SEQ ID NO: 8409541 - DNA, 22 bp, Homo sapiens
tatgtacacggtggctctgaag

SEQ ID NO: 8409542 - DNA, 22 bp, Homo sapiens
tatgtacagggatagaacttga

SEQ ID NO: 8409543 - DNA, 22 bp, Homo sapiens
tatgtacacttaagtttgagaa

SEQ ID NO: 8409544 - DNA, 22 bp, Homo sapiens
tatgtacagtccttaacttaaa

SEQ ID NO: 8409545 - DNA, 22 bp, Homo sapiens
tatgtacataacatgaaatgca

SEQ ID NO: 8409546 - DNA, 22 bp, Homo sapiens
tatgtacatacatgtgcatacg

SEQ ID NO: 8409547 - DNA, 22 bp, Homo sapiens
tatccccacctctgttaaggac

SEQ ID NO: 8409548 - DNA, 20 bp, Homo sapiens
tgtgtgaattagggcatgtt

SEQ ID NO: 8409549 - DNA, 22 bp, Homo sapiens
tgtgtcatctgtgttacataat

SEQ ID NO: 8409550 - DNA, 19 bp, Homo sapiens
tgtgtcctagcagccagtc

SEQ ID NO: 8409551 - DNA, 19 bp, Homo sapiens
tgtgtcctagcagccagtc

SEQ ID NO: 8409552 - DNA, 22 bp, Homo sapiens
tgtggcctggaaggggctgctc

SEQ ID NO: 8409553 - DNA, 22 bp, Homo sapiens
tgtggcagtataagagctagaa

SEQ ID NO: 8409554 - DNA, 22 bp, Homo sapiens
tgtggcagctgctgcaggagct

SEQ ID NO: 8409555 - DNA, 22 bp, Homo sapiens
tgtggcagtctcactggagggc

SEQ ID NO: 8409556 - DNA, 22 bp, Homo sapiens
tgtggccagaggtactatttta

SEQ ID NO: 8409557 - DNA, 22 bp, Homo sapiens
tgtggccagcaggtggctgtgt

SEQ ID NO: 8409558 - DNA, 22 bp, Homo sapiens
tgtggccactgtttcttttcct

SEQ ID NO: 8409559 - DNA, 22 bp, Homo sapiens
tgtggccaaaataaaatgaggt

SEQ ID NO: 8409560 - DNA, 22 bp, Homo sapiens
tgtggccaccagagctgctatt

SEQ ID NO: 8409561 - DNA, 19 bp, Homo sapiens
tgtggccatggttcagctg

SEQ ID NO: 8409562 - DNA, 22 bp, Homo sapiens
tgtggccataaagcttaaaatg

SEQ ID NO: 8409563 - DNA, 22 bp, Homo sapiens
tgtggccatatactttgttgtg

SEQ ID NO: 8409564 - DNA, 22 bp, Homo sapiens
tgtggccatggtcagaatattg

SEQ ID NO: 8409565 - DNA, 20 bp, Homo sapiens
tgtggccatgttccaactca

SEQ ID NO: 8409566 - DNA, 22 bp, Homo sapiens
tgtggccattcttgaggtcgac

SEQ ID NO: 8409567 - DNA, 22 bp, Homo sapiens
tgtggccaggaaaaggagatgg

SEQ ID NO: 8409568 - DNA, 22 bp, Homo sapiens
tgtggccagggggccatgtccc

SEQ ID NO: 8409569 - DNA, 22 bp, Homo sapiens
tgtggccaggcccctgatggtg

SEQ ID NO: 8409570 - DNA, 20 bp, Homo sapiens
tgtggccagctctctactgg

SEQ ID NO: 8409571 - DNA, 22 bp, Homo sapiens
tgtggccagccacaggcatggt

SEQ ID NO: 8409572 - DNA, 22 bp, Homo sapiens
tgtggcagaggaggcagcgtcc

SEQ ID NO: 8409573 - DNA, 22 bp, Homo sapiens
tgtggcacatacacaggagggc

SEQ ID NO: 8409574 - DNA, 22 bp, Homo sapiens
tgtggacgtcattaaagcagtg

SEQ ID NO: 8409575 - DNA, 22 bp, Homo sapiens
tcccccaggctggagtgcagtg

SEQ ID NO: 8409576 - DNA, 17 bp, Homo sapiens
tcccccagggctctctc

SEQ ID NO: 8409577 - DNA, 22 bp, Homo sapiens
tcccccagtctgggcgtggtca

SEQ ID NO: 8409578 - DNA, 23 bp, Homo sapiens
tgttattccaggttaatgtactt

SEQ ID NO: 8409579 - DNA, 22 bp, Homo sapiens
tgtgttgtgacattcttggatg

SEQ ID NO: 8409580 - DNA, 22 bp, Homo sapiens
ttactagttgcttcactttgct

SEQ ID NO: 8409581 - DNA, 20 bp, Homo sapiens
ttactgtagtactacatttt

SEQ ID NO: 8409582 - DNA, 22 bp, Homo sapiens
ttactgtagcttgacatatgtc

SEQ ID NO: 8409583 - DNA, 22 bp, Homo sapiens
ttactttaagggtgtcttatta

SEQ ID NO: 8409584 - DNA, 22 bp, Homo sapiens
ttactttagatcatactgtgtg

SEQ ID NO: 8409585 - DNA, 22 bp, Homo sapiens
ttagaggactgtaggtgggaat

SEQ ID NO: 8409586 - DNA, 22 bp, Homo sapiens
ttagaggaattattttctgctg

SEQ ID NO: 8409587 - DNA, 22 bp, Homo sapiens
ttagaggaaagtgactccgatg

SEQ ID NO: 8409588 - DNA, 22 bp, Homo sapiens
ttagaggacaagaggcctggct

SEQ ID NO: 8409589 - DNA, 22 bp, Homo sapiens
ttagaggatatcatcagcctac

SEQ ID NO: 8409590 - DNA, 22 bp, Homo sapiens
ttagaggaaagactgggactaa

SEQ ID NO: 8409591 - DNA, 22 bp, Homo sapiens
ttactttatgtgatggattagt

SEQ ID NO: 8409592 - DNA, 22 bp, Homo sapiens
ttacagtagctttatttggagt

SEQ ID NO: 8409593 - DNA, 22 bp, Homo sapiens
ttacatattatccaaaactgct

SEQ ID NO: 8409594 - DNA, 22 bp, Homo sapiens
ttacagtattgttaaactcttt

SEQ ID NO: 8409595 - DNA, 22 bp, Homo sapiens
ttacagtatgatcaacttttca

SEQ ID NO: 8409596 - DNA, 22 bp, Homo sapiens
ttcaggtgtcaaggataggctg

SEQ ID NO: 8409597 - DNA, 22 bp, Homo sapiens
ttcaggagaaagttcagtactt

SEQ ID NO: 8409598 - DNA, 22 bp, Homo sapiens
ttctgggctaccttcccggcag

SEQ ID NO: 8409599 - DNA, 22 bp, Homo sapiens
ttgagcccaggaggcctgggtg

SEQ ID NO: 8409600 - DNA, 22 bp, Homo sapiens
ttgaggagtgtgaggtctccca

SEQ ID NO: 8409601 - DNA, 22 bp, Homo sapiens
ttgagtggttcctcagttgact

SEQ ID NO: 8409602 - DNA, 22 bp, Homo sapiens
tttcaaaattttgcagtggtaa

SEQ ID NO: 8409603 - DNA, 22 bp, Homo sapiens
tttaaaatcagatgggagttgg

SEQ ID NO: 8409604 - DNA, 22 bp, Homo sapiens
tttacaaggcagaactgattaa

SEQ ID NO: 8409605 - DNA, 22 bp, Homo sapiens
tttctggaaagcaagatacatt

SEQ ID NO: 8409606 - DNA, 22 bp, Homo sapiens
tttctggacagcaagatcagtt

SEQ ID NO: 8409607 - DNA, 22 bp, Homo sapiens
tttctgtaagttcaggctttcc

SEQ ID NO: 8409608 - DNA, 22 bp, Homo sapiens
tttctttaggctgtgttgccaa

SEQ ID NO: 8409609 - DNA, 22 bp, Homo sapiens
tttgcaaatgctctgcagagct

SEQ ID NO: 8409610 - DNA, 22 bp, Homo sapiens
tttgcaaatgaagctctgagga

SEQ ID NO: 8409611 - DNA, 22 bp, Homo sapiens
attcaagagctggctttgaaat

SEQ ID NO: 8409612 - DNA, 22 bp, Homo sapiens
caaatgctggccctgctactta

SEQ ID NO: 8409613 - DNA, 22 bp, Homo sapiens
atttttctctcacacttaccag

SEQ ID NO: 8409614 - DNA, 22 bp, Homo sapiens
gccaggtggaggttgcagtgag

SEQ ID NO: 8409615 - DNA, 22 bp, Homo sapiens
gacgagagactccatccaccac

SEQ ID NO: 8409616 - DNA, 22 bp, Homo sapiens
gaggaaggctaaggggcttaga

SEQ ID NO: 8409617 - DNA, 22 bp, Homo sapiens
gtccctggggaatcagctggag

SEQ ID NO: 8409618 - DNA, 22 bp, Homo sapiens
gtccctggtctaccgtggcttc

SEQ ID NO: 8409619 - DNA, 22 bp, Homo sapiens
gtccctgggtagctcagtggct

SEQ ID NO: 8409620 - DNA, 22 bp, Homo sapiens
ggtcatagaatcacaggatctt

SEQ ID NO: 8409621 - DNA, 22 bp, Homo sapiens
ggcaggtgccagttggcttggg

SEQ ID NO: 8409622 - DNA, 22 bp, Homo sapiens
caatgtatcaagaagcatcagt

SEQ ID NO: 8409623 - DNA, 22 bp, Homo sapiens
cacaggaatcagcattaatggc

SEQ ID NO: 8409624 - DNA, 22 bp, Homo sapiens
ggaggcaggaaagacaggttca

SEQ ID NO: 8409625 - DNA, 22 bp, Homo sapiens
cacacaggagagtgctggaggt

SEQ ID NO: 8409626 - DNA, 22 bp, Homo sapiens
ggaaggggagctaaatctactg

SEQ ID NO: 8409627 - DNA, 22 bp, Homo sapiens
ggaaggggagctggaaagggta

SEQ ID NO: 8409628 - DNA, 22 bp, Homo sapiens
ggaaggggagctggaaagggta

SEQ ID NO: 8409629 - DNA, 20 bp, Homo sapiens
ggaaggggcaaagtgtgtga

SEQ ID NO: 8409630 - DNA, 20 bp, Homo sapiens
ggaaggggcaaagtgtgtga

SEQ ID NO: 8409631 - DNA, 22 bp, Homo sapiens
ggaaggggccttgagcaaactg

SEQ ID NO: 8409632 - DNA, 22 bp, Homo sapiens
aggtggggccaaatgctacagt

SEQ ID NO: 8409633 - DNA, 22 bp, Homo sapiens
aggtggggagtatatgtaattg

SEQ ID NO: 8409634 - DNA, 22 bp, Homo sapiens
aggtggggcccaccaatttgca

SEQ ID NO: 8409635 - DNA, 21 bp, Homo sapiens
aggtggggctgcacctctgct

SEQ ID NO: 8409636 - DNA, 22 bp, Homo sapiens
aggtggggaggagtgtctcttt

SEQ ID NO: 8409637 - DNA, 22 bp, Homo sapiens
ctcctgggaaaggctggacaca

SEQ ID NO: 8409638 - DNA, 22 bp, Homo sapiens
ataaatgtgaaatgagcagtta

SEQ ID NO: 8409639 - DNA, 22 bp, Homo sapiens
ataaatgtgaattagagctttg

SEQ ID NO: 8409640 - DNA, 22 bp, Homo sapiens
ataaatgtttgttgaatgaata

SEQ ID NO: 8409641 - DNA, 22 bp, Homo sapiens
aggatggggtctgcagcctggt

SEQ ID NO: 8409642 - DNA, 22 bp, Homo sapiens
aggatgggcctgggatatgctt

SEQ ID NO: 8409643 - DNA, 22 bp, Homo sapiens
ccaatcttatctttattttcta

SEQ ID NO: 8409644 - DNA, 22 bp, Homo sapiens
ccaatcttgctgtccacttggt

SEQ ID NO: 8409645 - DNA, 22 bp, Homo sapiens
ccaatcttgttttctacatcca

SEQ ID NO: 8409646 - DNA, 22 bp, Homo sapiens
ccacgtccagctaattttcgta

SEQ ID NO: 8409647 - DNA, 22 bp, Homo sapiens
ccacgagggaaccaggtggggt

SEQ ID NO: 8409648 - DNA, 22 bp, Homo sapiens
caggtgggattttgctgcttga

SEQ ID NO: 8409649 - DNA, 22 bp, Homo sapiens
agggcacctgttttagcttggt

SEQ ID NO: 8409650 - DNA, 22 bp, Homo sapiens
atagctttacagaagagtttag

SEQ ID NO: 8409651 - DNA, 22 bp, Homo sapiens
atagctttttgtcatagagtct

SEQ ID NO: 8409652 - DNA, 21 bp, Homo sapiens
agaggaagaagagtgtattat

SEQ ID NO: 8409653 - DNA, 22 bp, Homo sapiens
agaggaagattttattaaccag

SEQ ID NO: 8409654 - DNA, 22 bp, Homo sapiens
agaggaagccattgcttactga

SEQ ID NO: 8409655 - DNA, 22 bp, Homo sapiens
attattttatgtgcggcctgat

SEQ ID NO: 8409656 - DNA, 22 bp, Homo sapiens
attgtatttccagcttgaatgt

SEQ ID NO: 8409657 - DNA, 22 bp, Homo sapiens
agcgccgcccctgctggtgttg

SEQ ID NO: 8409658 - DNA, 22 bp, Homo sapiens
cagctggcagccctggccctgc

SEQ ID NO: 8409659 - DNA, 22 bp, Homo sapiens
agccggccatgtggtcttgtgc

SEQ ID NO: 8409660 - DNA, 22 bp, Homo sapiens
caaggaagttttaggagaggaa

SEQ ID NO: 8409661 - DNA, 22 bp, Homo sapiens
cacatgggtgtgcctggaggaa

SEQ ID NO: 8409662 - DNA, 22 bp, Homo sapiens
aatgctttcaaaaatgtgcagt

SEQ ID NO: 8409663 - DNA, 22 bp, Homo sapiens
aatgctttagaaaaccagcttt

SEQ ID NO: 8409664 - DNA, 22 bp, Homo sapiens
aatgctttagcagtgattagtg

SEQ ID NO: 8409665 - DNA, 22 bp, Homo sapiens
aatgctttaattgcatgtagtg

SEQ ID NO: 8409666 - DNA, 22 bp, Homo sapiens
aaaatgctgggaaagttggaat

SEQ ID NO: 8409667 - DNA, 22 bp, Homo sapiens
aaagcagggtccaaggagatgt

SEQ ID NO: 8409668 - DNA, 22 bp, Homo sapiens
aagagtttctgattcagtaggt

SEQ ID NO: 8409669 - DNA, 22 bp, Homo sapiens
aagagtttgggcaagtcataaa

SEQ ID NO: 8409670 - DNA, 22 bp, Homo sapiens
aaatataatttctgcctcaata

SEQ ID NO: 8409671 - DNA, 20 bp, Homo sapiens
aaatgcttttgacacatatt

SEQ ID NO: 8409672 - DNA, 21 bp, Homo sapiens
aaatgctttgtatatatctgt

SEQ ID NO: 8409673 - DNA, 22 bp, Homo sapiens
aaatgcttcacctcattaaact

SEQ ID NO: 8409674 - DNA, 22 bp, Homo sapiens
aaatgcttgctcttgattattt

SEQ ID NO: 8409675 - DNA, 22 bp, Homo sapiens
aaatgcttgtaaattttccatg

SEQ ID NO: 8409676 - DNA, 22 bp, Homo sapiens
aaatgcttgtatatttcttggt

SEQ ID NO: 8409677 - DNA, 22 bp, Homo sapiens
agcaggctttccacagaaggag

SEQ ID NO: 8409678 - DNA, 21 bp, Homo sapiens
agaggaagtgattggtctggc

SEQ ID NO: 8409679 - DNA, 22 bp, Homo sapiens
aatgtattatacataatttgtg

SEQ ID NO: 8409680 - DNA, 22 bp, Homo sapiens
aatgtattcctcatgcaagagt

SEQ ID NO: 8409681 - DNA, 22 bp, Homo sapiens
aaggcaatttgttgtgaggatt

SEQ ID NO: 8409682 - DNA, 22 bp, Homo sapiens
aaggaaggttcatagtcaaaga

SEQ ID NO: 8409683 - DNA, 22 bp, Homo sapiens
acctagctgaggagtgtgagtg

SEQ ID NO: 8409684 - DNA, 21 bp, Homo sapiens
aataaaacagttggtgtcaat

SEQ ID NO: 8409685 - DNA, 22 bp, Homo sapiens
tataaatgccaggactttagat

SEQ ID NO: 8409686 - DNA, 22 bp, Homo sapiens
tataaatgcacttttgaaatat

SEQ ID NO: 8409687 - DNA, 22 bp, Homo sapiens
gtttccatctccaggacataat

SEQ ID NO: 8409688 - DNA, 22 bp, Homo sapiens
tcagcaatgagaactggcattt

SEQ ID NO: 8409689 - DNA, 22 bp, Homo sapiens
tcacagaagagcattaagatga

SEQ ID NO: 8409690 - DNA, 22 bp, Homo sapiens
tcaataaaattgttttcctatc

SEQ ID NO: 8409691 - DNA, 22 bp, Homo sapiens
tcagcaggcacggacaggctgc

SEQ ID NO: 8409692 - DNA, 21 bp, Homo sapiens
tcagcaggcaccagaaggctg

SEQ ID NO: 8409693 - DNA, 19 bp, Homo sapiens
gcacacagtagggctggca

SEQ ID NO: 8409694 - DNA, 22 bp, Homo sapiens
gccctgggattgggtggaggct

SEQ ID NO: 8409695 - DNA, 22 bp, Homo sapiens
gcccatggtcagggaggcaggg

SEQ ID NO: 8409696 - DNA, 22 bp, Homo sapiens
ggaagaggctgagccaggtccc

SEQ ID NO: 8409697 - DNA, 22 bp, Homo sapiens
ggacacagggctcactctctct

SEQ ID NO: 8409698 - DNA, 22 bp, Homo sapiens
gctgcgccggatcccacgttcc

SEQ ID NO: 8409699 - DNA, 22 bp, Homo sapiens
gtaaaacatgttttaactagga

SEQ ID NO: 8409700 - DNA, 22 bp, Homo sapiens
gtcctgggaggggctggtcctg

SEQ ID NO: 8409701 - DNA, 22 bp, Homo sapiens
gtccctggaaaagagctggtga

SEQ ID NO: 8409702 - DNA, 22 bp, Homo sapiens
gggccaaggggagctggaaggg

SEQ ID NO: 8409703 - DNA, 22 bp, Homo sapiens
ggcaggtggattttctactcta

SEQ ID NO: 8409704 - DNA, 22 bp, Homo sapiens
ggcaggtggacgtgctaaagct

SEQ ID NO: 8409705 - DNA, 22 bp, Homo sapiens
ggcaggtggtaaggatttcata

SEQ ID NO: 8409706 - DNA, 21 bp, Homo sapiens
ggcaggtgggtctctgttgct

SEQ ID NO: 8409707 - DNA, 22 bp, Homo sapiens
ggcaggtggccaagtgtctaag

SEQ ID NO: 8409708 - DNA, 22 bp, Homo sapiens
ggcaggtggcactgctgctccc

SEQ ID NO: 8409709 - DNA, 22 bp, Homo sapiens
gggacaggcccctcgctagctt

SEQ ID NO: 8409710 - DNA, 18 bp, Homo sapiens
gagctgagaagaggatgc

SEQ ID NO: 8409711 - DNA, 22 bp, Homo sapiens
cttgtattaagcttagagaggc

SEQ ID NO: 8409712 - DNA, 22 bp, Homo sapiens
cttgatctacatagtgaaaccc

SEQ ID NO: 8409713 - DNA, 22 bp, Homo sapiens
cttattttgctgatgacccagg

SEQ ID NO: 8409714 - DNA, 22 bp, Homo sapiens
cttattttaagtcagtttgggt

SEQ ID NO: 8409715 - DNA, 22 bp, Homo sapiens
ctggccagctgacagcagggct

SEQ ID NO: 8409716 - DNA, 19 bp, Homo sapiens
ctggccaggccaggggccc

SEQ ID NO: 8409717 - DNA, 22 bp, Homo sapiens
ctggccaggcatcccctgatcc

SEQ ID NO: 8409718 - DNA, 22 bp, Homo sapiens
cgtcaggtccccagtgaagttg

SEQ ID NO: 8409719 - DNA, 22 bp, Homo sapiens
ttcctgggctttcccctctggt

SEQ ID NO: 8409720 - DNA, 21 bp, Homo sapiens
ttcctggggaaggagctgcct

SEQ ID NO: 8409721 - DNA, 22 bp, Homo sapiens
ttcctgggctctggctggccta

SEQ ID NO: 8409722 - DNA, 22 bp, Homo sapiens
ttcctgggactggagcagccca

SEQ ID NO: 8409723 - DNA, 22 bp, Homo sapiens
tttgccatgtaggttaatcatt

SEQ ID NO: 8409724 - DNA, 22 bp, Homo sapiens
tttcacaggtaagcaatacagg

SEQ ID NO: 8409725 - DNA, 22 bp, Homo sapiens
tttcacagtgctctgtaagtat

SEQ ID NO: 8409726 - DNA, 22 bp, Homo sapiens
tttcacagtagaaatcattatg

SEQ ID NO: 8409727 - DNA, 17 bp, Homo sapiens
cataaaacagttctatt

SEQ ID NO: 8409728 - DNA, 22 bp, Homo sapiens
tggaagggagctggaatttgga

SEQ ID NO: 8409729 - DNA, 22 bp, Homo sapiens
tgctggcccatgaagacgcagt

SEQ ID NO: 8409730 - DNA, 22 bp, Homo sapiens
tgccctggtagacacagactgt

SEQ ID NO: 8409731 - DNA, 22 bp, Homo sapiens
tgccctggtgaagtgctctcct

SEQ ID NO: 8409732 - DNA, 22 bp, Homo sapiens
tgccctggggagcccagccagg

SEQ ID NO: 8409733 - DNA, 22 bp, Homo sapiens
tgccctgggagttggagctgct

SEQ ID NO: 8409734 - DNA, 22 bp, Homo sapiens
tttcattttggttatgccataa

SEQ ID NO: 8409735 - DNA, 22 bp, Homo sapiens
tttatttcttagtttgccacag

SEQ ID NO: 8409736 - DNA, 22 bp, Homo sapiens
tttattatccagtgttgtcatg

SEQ ID NO: 8409737 - DNA, 22 bp, Homo sapiens
ttggtcatagcattcaaaatgg

SEQ ID NO: 8409738 - DNA, 22 bp, Homo sapiens
ttccctggaacatcatggtcta

SEQ ID NO: 8409739 - DNA, 22 bp, Homo sapiens
ttaagtctaggaggaactaggt

SEQ ID NO: 8409740 - DNA, 22 bp, Homo sapiens
tgttatctgagcaacgtcgacg

SEQ ID NO: 8409741 - DNA, 22 bp, Homo sapiens
cacctggcagctgttggccacg

SEQ ID NO: 8409742 - DNA, 22 bp, Homo sapiens
cacacagggagaaagaaagcct

SEQ ID NO: 8409743 - DNA, 22 bp, Homo sapiens
cacacaggatgaagcagcagaa

SEQ ID NO: 8409744 - DNA, 23 bp, Homo sapiens
atgtatttaaatttcagtgatga

SEQ ID NO: 8409745 - DNA, 22 bp, Homo sapiens
atgtatttactgagaaggaaac

SEQ ID NO: 8409746 - DNA, 22 bp, Homo sapiens
atgtatttctatgtagtgaaga

SEQ ID NO: 8409747 - DNA, 22 bp, Homo sapiens
atgctatgtaactggcagatag

SEQ ID NO: 8409748 - DNA, 22 bp, Homo sapiens
gcacacagattaggaaacagaa

SEQ ID NO: 8409749 - DNA, 16 bp, Homo sapiens
gcacacagccagcctt

SEQ ID NO: 8409750 - DNA, 23 bp, Homo sapiens
atgttattattagcagtcttgcc

SEQ ID NO: 8409751 - DNA, 22 bp, Homo sapiens
atttgtctctgcactttactca

SEQ ID NO: 8409752 - DNA, 22 bp, Homo sapiens
atttgtctagtggtattcacgt

SEQ ID NO: 8409753 - DNA, 22 bp, Homo sapiens
catgtattgaagtgtgcatctg

SEQ ID NO: 8409754 - DNA, 22 bp, Homo sapiens
aggaggggcaatgatagtctgg

SEQ ID NO: 8409755 - DNA, 22 bp, Homo sapiens
caggaaggcgcggctgtgcctg

SEQ ID NO: 8409756 - DNA, 22 bp, Homo sapiens
agctggccattgtgagtggcct

SEQ ID NO: 8409757 - DNA, 20 bp, Homo sapiens
agctggcccacaggtgtggg

SEQ ID NO: 8409758 - DNA, 20 bp, Homo sapiens
agctggcccccggtggcctg

SEQ ID NO: 8409759 - DNA, 22 bp, Homo sapiens
agctggcccactgtgtggtcca

SEQ ID NO: 8409760 - DNA, 22 bp, Homo sapiens
agctggccctcgagagccaatt

SEQ ID NO: 8409761 - DNA, 18 bp, Homo sapiens
agctggccctggctgccg

SEQ ID NO: 8409762 - DNA, 22 bp, Homo sapiens
agctggccggcctccaggtgga

SEQ ID NO: 8409763 - DNA, 22 bp, Homo sapiens
agctggcctcactgcagaatgc

SEQ ID NO: 8409764 - DNA, 22 bp, Homo sapiens
aggtggggttcagtctcagccg

SEQ ID NO: 8409765 - DNA, 22 bp, Homo sapiens
cctgggcaggccggacgctggg

SEQ ID NO: 8409766 - DNA, 22 bp, Homo sapiens
cctgggcagggagaccaggctc

SEQ ID NO: 8409767 - DNA, 22 bp, Homo sapiens
cctgggcaggatgggcccggtg

SEQ ID NO: 8409768 - DNA, 22 bp, Homo sapiens
cctggagcccctctggccagcc

SEQ ID NO: 8409769 - DNA, 22 bp, Homo sapiens
agtctgcaaatatgttcatgtg

SEQ ID NO: 8409770 - DNA, 20 bp, Homo sapiens
agtctgcagctgcatgaccc

SEQ ID NO: 8409771 - DNA, 23 bp, Homo sapiens
cttcatcaaaagttaacactagt

SEQ ID NO: 8409772 - DNA, 22 bp, Homo sapiens
cttcacagaataaactcattat

SEQ ID NO: 8409773 - DNA, 22 bp, Homo sapiens
ctggccagtgactgctcacccg

SEQ ID NO: 8409774 - DNA, 22 bp, Homo sapiens
ctggccaggctctcacgtggtc

SEQ ID NO: 8409775 - DNA, 22 bp, Homo sapiens
ctggccaggcttgggacagaca

SEQ ID NO: 8409776 - DNA, 22 bp, Homo sapiens
ctggccagtgcctgtgggcccc

SEQ ID NO: 8409777 - DNA, 22 bp, Homo sapiens
actgaggagaaatttgagtgaa

SEQ ID NO: 8409778 - DNA, 22 bp, Homo sapiens
actgaggatggataggtcatat

SEQ ID NO: 8409779 - DNA, 22 bp, Homo sapiens
actgaggacagtgaggagggct

SEQ ID NO: 8409780 - DNA, 22 bp, Homo sapiens
cacaagggagcttagaaaacat

SEQ ID NO: 8409781 - DNA, 17 bp, Homo sapiens
agcaggctgcagaggcc

SEQ ID NO: 8409782 - DNA, 22 bp, Homo sapiens
cacctagccttcttgtgcctct

SEQ ID NO: 8409783 - DNA, 22 bp, Homo sapiens
agaggtgacataggagaggctc

SEQ ID NO: 8409784 - DNA, 22 bp, Homo sapiens
agaggaagctgagatgcctctt

SEQ ID NO: 8409785 - DNA, 22 bp, Homo sapiens
atgtatttgcgaggttaggaaa

SEQ ID NO: 8409786 - DNA, 22 bp, Homo sapiens
atgtatttgcttgttatggatt

SEQ ID NO: 8409787 - DNA, 22 bp, Homo sapiens
atgtatttgcgtatggacatac

SEQ ID NO: 8409788 - DNA, 22 bp, Homo sapiens
atgtattttaagatttgcctca

SEQ ID NO: 8409789 - DNA, 22 bp, Homo sapiens
atgtattttgccagactgtctc

SEQ ID NO: 8409790 - DNA, 22 bp, Homo sapiens
aatgactttgaaatatttgagt

SEQ ID NO: 8409791 - DNA, 22 bp, Homo sapiens
aaggtggggtcctgtcatctga

SEQ ID NO: 8409792 - DNA, 22 bp, Homo sapiens
agaaggggcccaaggatgtcag

SEQ ID NO: 8409793 - DNA, 22 bp, Homo sapiens
agaaggggagaagctaccagga

SEQ ID NO: 8409794 - DNA, 22 bp, Homo sapiens
aatgtattctctttataagata

SEQ ID NO: 8409795 - DNA, 22 bp, Homo sapiens
aattttattaactggatgtagc

SEQ ID NO: 8409796 - DNA, 22 bp, Homo sapiens
aaagagtttccattgacatttc

SEQ ID NO: 8409797 - DNA, 22 bp, Homo sapiens
aaatgtattgcataggatattt

SEQ ID NO: 8409798 - DNA, 20 bp, Homo sapiens
aaatgtataggacccttcta

SEQ ID NO: 8409799 - DNA, 22 bp, Homo sapiens
aaatgtatcctacttcctgagt

SEQ ID NO: 8409800 - DNA, 22 bp, Homo sapiens
aatataaattcctgggcccagc

SEQ ID NO: 8409801 - DNA, 22 bp, Homo sapiens
acaaggcactttatgaagagga

SEQ ID NO: 8409802 - DNA, 22 bp, Homo sapiens
acaaggcgtgacggagagagga

SEQ ID NO: 8409803 - DNA, 21 bp, Homo sapiens
gggtggggttccagccttttc

SEQ ID NO: 8409804 - DNA, 22 bp, Homo sapiens
ggaggatgagctacgaggagct

SEQ ID NO: 8409805 - DNA, 22 bp, Homo sapiens
ggcacccttggggggccacagc

SEQ ID NO: 8409806 - DNA, 22 bp, Homo sapiens
gctggcaggtaaagccccgggg

SEQ ID NO: 8409807 - DNA, 22 bp, Homo sapiens
gctttatccgcttgacccttac

SEQ ID NO: 8409808 - DNA, 22 bp, Homo sapiens
gctggccacactgctgatggag

SEQ ID NO: 8409809 - DNA, 22 bp, Homo sapiens
gctggccacagatccccaggga

SEQ ID NO: 8409810 - DNA, 19 bp, Homo sapiens
gctggccacgccccagttg

SEQ ID NO: 8409811 - DNA, 22 bp, Homo sapiens
ggaaggaggggcaaagcagttc

SEQ ID NO: 8409812 - DNA, 22 bp, Homo sapiens
gcaataaagtagcagctcatca

SEQ ID NO: 8409813 - DNA, 22 bp, Homo sapiens
taaaagtatactttcaaaggag

SEQ ID NO: 8409814 - DNA, 22 bp, Homo sapiens
taacatgcatagatttgtatta

SEQ ID NO: 8409815 - DNA, 22 bp, Homo sapiens
taaggaagagcttggtaatagg

SEQ ID NO: 8409816 - DNA, 22 bp, Homo sapiens
tatggtcatggttgcacaattt

SEQ ID NO: 8409817 - DNA, 20 bp, Homo sapiens
tatgctttttataagattga

SEQ ID NO: 8409818 - DNA, 17 bp, Homo sapiens
tatgcttttcttctcca

SEQ ID NO: 8409819 - DNA, 22 bp, Homo sapiens
tatgctttggtagagagttgtg

SEQ ID NO: 8409820 - DNA, 22 bp, Homo sapiens
tatgctttacttttcattgtga

SEQ ID NO: 8409821 - DNA, 22 bp, Homo sapiens
tatgtattagagctccatgagg

SEQ ID NO: 8409822 - DNA, 22 bp, Homo sapiens
tatgtattatctgtgactgctt

SEQ ID NO: 8409823 - DNA, 22 bp, Homo sapiens
tataaaacagaaagcactacct

SEQ ID NO: 8409824 - DNA, 22 bp, Homo sapiens
tagctggcaaaggggaattagg

SEQ ID NO: 8409825 - DNA, 22 bp, Homo sapiens
tagctggcaaaacattatttct

SEQ ID NO: 8409826 - DNA, 22 bp, Homo sapiens
tagctggctaatagtatgaata

SEQ ID NO: 8409827 - DNA, 22 bp, Homo sapiens
tagctggccctgggactcccgg

SEQ ID NO: 8409828 - DNA, 17 bp, Homo sapiens
tagctggcactggggtt

SEQ ID NO: 8409829 - DNA, 22 bp, Homo sapiens
tagctggcatggccctgtggga

SEQ ID NO: 8409830 - DNA, 22 bp, Homo sapiens
tagctggcttatataaaagggc

SEQ ID NO: 8409831 - DNA, 22 bp, Homo sapiens
tccatgggtagccctggttgag

SEQ ID NO: 8409832 - DNA, 22 bp, Homo sapiens
tccctggcagctaagggtggtc

SEQ ID NO: 8409833 - DNA, 22 bp, Homo sapiens
gaatgctttgggaattcagaat

SEQ ID NO: 8409834 - DNA, 22 bp, Homo sapiens
gaggtgggagggcagtccctaa

SEQ ID NO: 8409835 - DNA, 22 bp, Homo sapiens
cttcaaagatttgataaagcca

SEQ ID NO: 8409836 - DNA, 22 bp, Homo sapiens
cttcacatctccctaaaacagc

SEQ ID NO: 8409837 - DNA, 22 bp, Homo sapiens
ccttcacaccatctttaccagg

SEQ ID NO: 8409838 - DNA, 22 bp, Homo sapiens
ccttcacacaggtagaagcaga

SEQ ID NO: 8409839 - DNA, 22 bp, Homo sapiens
ttctgcataacttcctgggtca

SEQ ID NO: 8409840 - DNA, 22 bp, Homo sapiens
ctgcaggagtgaaagcaggcct

SEQ ID NO: 8409841 - DNA, 22 bp, Homo sapiens
ctgcaggagggctggggaagcc

SEQ ID NO: 8409842 - DNA, 22 bp, Homo sapiens
ctggagcagcaggtggccaggg

SEQ ID NO: 8409843 - DNA, 22 bp, Homo sapiens
tgctttcaatgaattgtatact

SEQ ID NO: 8409844 - DNA, 22 bp, Homo sapiens
tgctttatttataaaatagcaa

SEQ ID NO: 8409845 - DNA, 22 bp, Homo sapiens
tgctttattttaaatatgccat

SEQ ID NO: 8409846 - DNA, 22 bp, Homo sapiens
tgctttattgcatcagtgtggg

SEQ ID NO: 8409847 - DNA, 22 bp, Homo sapiens
tgctttattggaacctcatcct

SEQ ID NO: 8409848 - DNA, 22 bp, Homo sapiens
ccggctcggcgaccaggctgaa

SEQ ID NO: 8409849 - DNA, 22 bp, Homo sapiens
tgtaagtcctcccggaagacca

SEQ ID NO: 8409850 - DNA, 22 bp, Homo sapiens
tgtaagtctcttggttgagttg

SEQ ID NO: 8409851 - DNA, 22 bp, Homo sapiens
tgtaagtctggcttatagcttt

SEQ ID NO: 8409852 - DNA, 22 bp, Homo sapiens
catctttgtaacttccacataa

SEQ ID NO: 8409853 - DNA, 22 bp, Homo sapiens
catctttgtttcatctgtccag

SEQ ID NO: 8409854 - DNA, 22 bp, Homo sapiens
ccacatggagcaggaggtgggg

SEQ ID NO: 8409855 - DNA, 22 bp, Homo sapiens
tttcacagcgtctttctcttgc

SEQ ID NO: 8409856 - DNA, 22 bp, Homo sapiens
tttcacagctgggaagagatat

SEQ ID NO: 8409857 - DNA, 22 bp, Homo sapiens
tttcacagcttccacttaagga

SEQ ID NO: 8409858 - DNA, 18 bp, Homo sapiens
tttcacagattcatgact

SEQ ID NO: 8409859 - DNA, 22 bp, Homo sapiens
tttcacagcagaatttctgagg

SEQ ID NO: 8409860 - DNA, 22 bp, Homo sapiens
tttcacagatcctacagcttgt

SEQ ID NO: 8409861 - DNA, 22 bp, Homo sapiens
tttcacagagaatattgccttg

SEQ ID NO: 8409862 - DNA, 22 bp, Homo sapiens
tttcacagagaaatataacagg

SEQ ID NO: 8409863 - DNA, 22 bp, Homo sapiens
tttcacagaaaggataacatta

SEQ ID NO: 8409864 - DNA, 22 bp, Homo sapiens
ttcctggggcttagcaatggag

SEQ ID NO: 8409865 - DNA, 22 bp, Homo sapiens
ttcctgggggcagcagtcttga

SEQ ID NO: 8409866 - DNA, 22 bp, Homo sapiens
ttcctggggctccagctaccag

SEQ ID NO: 8409867 - DNA, 22 bp, Homo sapiens
ttcctgggtggtcctggtagag

SEQ ID NO: 8409868 - DNA, 22 bp, Homo sapiens
gctggccatggggagtgaggag

SEQ ID NO: 8409869 - DNA, 22 bp, Homo sapiens
gctggccatagaagccaaagag

SEQ ID NO: 8409870 - DNA, 22 bp, Homo sapiens
gctggccatggcctgcgccatc

SEQ ID NO: 8409871 - DNA, 22 bp, Homo sapiens
gctggcagagctctgggctggg

SEQ ID NO: 8409872 - DNA, 19 bp, Homo sapiens
gctggcagatgtggccgtg

SEQ ID NO: 8409873 - DNA, 22 bp, Homo sapiens
gctggcagcattagaccctggg

SEQ ID NO: 8409874 - DNA, 22 bp, Homo sapiens
gctggccagtgtggtgaccacc

SEQ ID NO: 8409875 - DNA, 18 bp, Homo sapiens
ggaacaaggctctgactc

SEQ ID NO: 8409876 - DNA, 22 bp, Homo sapiens
caatgcttttagcttcagcttg

SEQ ID NO: 8409877 - DNA, 22 bp, Homo sapiens
caatgcttttgttctttactca

SEQ ID NO: 8409878 - DNA, 22 bp, Homo sapiens
ggaacagggatttggcctggtt

SEQ ID NO: 8409879 - DNA, 22 bp, Homo sapiens
ggaacaggaaaggagggatgct

SEQ ID NO: 8409880 - DNA, 22 bp, Homo sapiens
ggaaggggtcacctcctgatga

SEQ ID NO: 8409881 - DNA, 22 bp, Homo sapiens
ggcaggtgccttctgtgctagc

SEQ ID NO: 8409882 - DNA, 22 bp, Homo sapiens
ggcaggtgtttttatattaaag

SEQ ID NO: 8409883 - DNA, 22 bp, Homo sapiens
atgctttattgcttctgggcac

SEQ ID NO: 8409884 - DNA, 22 bp, Homo sapiens
atgctttattattttgcaggga

SEQ ID NO: 8409885 - DNA, 22 bp, Homo sapiens
atgtatttgaaatttgagacat

SEQ ID NO: 8409886 - DNA, 22 bp, Homo sapiens
gaggaaggatttagtttgaggg

SEQ ID NO: 8409887 - DNA, 22 bp, Homo sapiens
gaggaaggatttagtttgaggg

SEQ ID NO: 8409888 - DNA, 22 bp, Homo sapiens
gaggaaggaatgcagtgtatgc

SEQ ID NO: 8409889 - DNA, 22 bp, Homo sapiens
gaggaaggagggaaagcgcgcg

SEQ ID NO: 8409890 - DNA, 22 bp, Homo sapiens
gccactggacccagaaagggaa

SEQ ID NO: 8409891 - DNA, 22 bp, Homo sapiens
gccactggagacagtggggaag

SEQ ID NO: 8409892 - DNA, 22 bp, Homo sapiens
gctgaggaaggtttcttatcaa

SEQ ID NO: 8409893 - DNA, 22 bp, Homo sapiens
gctgaggaaaccaatgctcaga

SEQ ID NO: 8409894 - DNA, 22 bp, Homo sapiens
agctgccgatgcccagctgcat

SEQ ID NO: 8409895 - DNA, 22 bp, Homo sapiens
aggaagggtgtcatgagccctt

SEQ ID NO: 8409896 - DNA, 22 bp, Homo sapiens
aggaagggttctttctgtttat

SEQ ID NO: 8409897 - DNA, 22 bp, Homo sapiens
aggaaggggagaagttaaagct

SEQ ID NO: 8409898 - DNA, 22 bp, Homo sapiens
aggaagggtggatagtaacgtg

SEQ ID NO: 8409899 - DNA, 22 bp, Homo sapiens
aggaagggttctttgtgaaaga

SEQ ID NO: 8409900 - DNA, 22 bp, Homo sapiens
ctggccagactacacatgtgtg

SEQ ID NO: 8409901 - DNA, 20 bp, Homo sapiens
ctggccagaacgcctacaca

SEQ ID NO: 8409902 - DNA, 22 bp, Homo sapiens
ctggccagaagcacctttggcg

SEQ ID NO: 8409903 - DNA, 22 bp, Homo sapiens
ataaagaccagtatcttatgtt

SEQ ID NO: 8409904 - DNA, 22 bp, Homo sapiens
aggtggggaaaccagcgatccc

SEQ ID NO: 8409905 - DNA, 20 bp, Homo sapiens
agctggcctgtcctaggcct

SEQ ID NO: 8409906 - DNA, 22 bp, Homo sapiens
agctggccttcggtgtcactgg

SEQ ID NO: 8409907 - DNA, 22 bp, Homo sapiens
agctggccttagtgagcacctg

SEQ ID NO: 8409908 - DNA, 22 bp, Homo sapiens
agctggcctgttagagctgagt

SEQ ID NO: 8409909 - DNA, 22 bp, Homo sapiens
aggaagggatacataggatagt

SEQ ID NO: 8409910 - DNA, 22 bp, Homo sapiens
aggaagggagcagtttgttgtt

SEQ ID NO: 8409911 - DNA, 17 bp, Homo sapiens
aggaagggcaagtttct

SEQ ID NO: 8409912 - DNA, 22 bp, Homo sapiens
aggaggggttctcgggtgctga

SEQ ID NO: 8409913 - DNA, 20 bp, Homo sapiens
agctaggagaaagcatggag

SEQ ID NO: 8409914 - DNA, 22 bp, Homo sapiens
aactatgttaataagtttcatt

SEQ ID NO: 8409915 - DNA, 22 bp, Homo sapiens
aaatgctagaacattttaaagg

SEQ ID NO: 8409916 - DNA, 21 bp, Homo sapiens
aagggagataggaatcaggcc

SEQ ID NO: 8409917 - DNA, 22 bp, Homo sapiens
acacggcactttaggaaggggc

SEQ ID NO: 8409918 - DNA, 22 bp, Homo sapiens
aagatataataactgttgtcat

SEQ ID NO: 8409919 - DNA, 22 bp, Homo sapiens
aatgtattctgggaaaatgtta

SEQ ID NO: 8409920 - DNA, 22 bp, Homo sapiens
aatgtattttgggagtttcttt

SEQ ID NO: 8409921 - DNA, 22 bp, Homo sapiens
aatgtatttgatgtattagcct

SEQ ID NO: 8409922 - DNA, 20 bp, Homo sapiens
aatgtattgttttgtttcag

SEQ ID NO: 8409923 - DNA, 22 bp, Homo sapiens
aatgtattcttcaaccttgcta

SEQ ID NO: 8409924 - DNA, 22 bp, Homo sapiens
aatgctttgtctgctccagact

SEQ ID NO: 8409925 - DNA, 22 bp, Homo sapiens
aatgcttttgctgtcattgctt

SEQ ID NO: 8409926 - DNA, 22 bp, Homo sapiens
aatgcttttacgacatgtacct

SEQ ID NO: 8409927 - DNA, 22 bp, Homo sapiens
aatgctttgactatatctataa

SEQ ID NO: 8409928 - DNA, 22 bp, Homo sapiens
aatgctttgccaacagctattg

SEQ ID NO: 8409929 - DNA, 22 bp, Homo sapiens
aatgctttggggttggtactgt

SEQ ID NO: 8409930 - DNA, 22 bp, Homo sapiens
aatgctttgattgattaaaaca

SEQ ID NO: 8409931 - DNA, 22 bp, Homo sapiens
agcaggtgacccaagcaggctg

SEQ ID NO: 8409932 - DNA, 22 bp, Homo sapiens
aatactttcctatataaggtgc

SEQ ID NO: 8409933 - DNA, 22 bp, Homo sapiens
aataaatgttaagattgtctca

SEQ ID NO: 8409934 - DNA, 20 bp, Homo sapiens
tcacatcctctcccaacatg

SEQ ID NO: 8409935 - DNA, 22 bp, Homo sapiens
tccgccaggactgagggcccat

SEQ ID NO: 8409936 - DNA, 22 bp, Homo sapiens
taagagttactggtttagaacc

SEQ ID NO: 8409937 - DNA, 22 bp, Homo sapiens
gtgctttaataagatttcactt

SEQ ID NO: 8409938 - DNA, 22 bp, Homo sapiens
tatctttggtagctttcctaag

SEQ ID NO: 8409939 - DNA, 22 bp, Homo sapiens
tatctttgtatcaatctccatt

SEQ ID NO: 8409940 - DNA, 22 bp, Homo sapiens
tatctttgcaaatatctctaag

SEQ ID NO: 8409941 - DNA, 18 bp, Homo sapiens
tatctttgagtcctctgc

SEQ ID NO: 8409942 - DNA, 23 bp, Homo sapiens
tatttgtctcttaccactgctgt

SEQ ID NO: 8409943 - DNA, 22 bp, Homo sapiens
gcttccgcgatgtcctaggtgg

SEQ ID NO: 8409944 - DNA, 22 bp, Homo sapiens
ggagagcttggagtgcgatttt

SEQ ID NO: 8409945 - DNA, 22 bp, Homo sapiens
gctggcagctggaagttgggct

SEQ ID NO: 8409946 - DNA, 22 bp, Homo sapiens
gcgggccaccttggagagcgct

SEQ ID NO: 8409947 - DNA, 22 bp, Homo sapiens
gcggcggagacagcaggaagcc

SEQ ID NO: 8409948 - DNA, 22 bp, Homo sapiens
gcggcccgagcaggacgggtgg

SEQ ID NO: 8409949 - DNA, 22 bp, Homo sapiens
gcccatggacacccaagtgcca

SEQ ID NO: 8409950 - DNA, 22 bp, Homo sapiens
gggcaccttgggtctcaggcaa

SEQ ID NO: 8409951 - DNA, 22 bp, Homo sapiens
gggaagggctccttttattgca

SEQ ID NO: 8409952 - DNA, 22 bp, Homo sapiens
gggaagggtgttgtcttatctt

SEQ ID NO: 8409953 - DNA, 22 bp, Homo sapiens
gggaagggagctgggtatttag

SEQ ID NO: 8409954 - DNA, 22 bp, Homo sapiens
ggccctggtcctaggggtggaa

SEQ ID NO: 8409955 - DNA, 22 bp, Homo sapiens
ggcaggtgacctggcctcccag

SEQ ID NO: 8409956 - DNA, 22 bp, Homo sapiens
ggatggaggttctcagatgctc

SEQ ID NO: 8409957 - DNA, 22 bp, Homo sapiens
gtccctggagctgagcagtgct

SEQ ID NO: 8409958 - DNA, 22 bp, Homo sapiens
gtcattgtaatattctcattta

SEQ ID NO: 8409959 - DNA, 22 bp, Homo sapiens
gtaaatgcgattgactgatgga

SEQ ID NO: 8409960 - DNA, 22 bp, Homo sapiens
gtaagtctagggcaaggcctga

SEQ ID NO: 8409961 - DNA, 22 bp, Homo sapiens
gtaagtctctcaagagggtcag

SEQ ID NO: 8409962 - DNA, 22 bp, Homo sapiens
gtaagtctctgtgtaagctaat

SEQ ID NO: 8409963 - DNA, 22 bp, Homo sapiens
gtaagtctgagtgtaattcaca

SEQ ID NO: 8409964 - DNA, 22 bp, Homo sapiens
ttacaatgagacgttcttatct

SEQ ID NO: 8409965 - DNA, 22 bp, Homo sapiens
ctaaatgtgactcaccatctca

SEQ ID NO: 8409966 - DNA, 22 bp, Homo sapiens
tttttctgagcggtaatcatca

SEQ ID NO: 8409967 - DNA, 22 bp, Homo sapiens
ctgcatcacagcaggaggcaca

SEQ ID NO: 8409968 - DNA, 20 bp, Homo sapiens
gaatctttccccatgcaatg

SEQ ID NO: 8409969 - DNA, 22 bp, Homo sapiens
gagctgagtatcccactgaagt

SEQ ID NO: 8409970 - DNA, 18 bp, Homo sapiens
cttcatttgtagagttcc

SEQ ID NO: 8409971 - DNA, 22 bp, Homo sapiens
ctgggcacttgctcacagctct

SEQ ID NO: 8409972 - DNA, 22 bp, Homo sapiens
ctgggcacctttgcagcaggct

SEQ ID NO: 8409973 - DNA, 22 bp, Homo sapiens
ctgggcactgcagcaggcatca

SEQ ID NO: 8409974 - DNA, 22 bp, Homo sapiens
ctgggacagagcagcagtgggg

SEQ ID NO: 8409975 - DNA, 22 bp, Homo sapiens
ctgggacacccagagctgcaga

SEQ ID NO: 8409976 - DNA, 22 bp, Homo sapiens
cccagttgttgccggctctgga

SEQ ID NO: 8409977 - DNA, 22 bp, Homo sapiens
tagaaacaagtttctctttggg

SEQ ID NO: 8409978 - DNA, 22 bp, Homo sapiens
catgctttaccaaagcagtgat

SEQ ID NO: 8409979 - DNA, 22 bp, Homo sapiens
tccaagatctacagcagtttag

SEQ ID NO: 8409980 - DNA, 22 bp, Homo sapiens
tttgtctgttattgttctcatg

SEQ ID NO: 8409981 - DNA, 22 bp, Homo sapiens
ttttagaaggaatgctatggtg

SEQ ID NO: 8409982 - DNA, 22 bp, Homo sapiens
tttcacaggattctgatgtagt

SEQ ID NO: 8409983 - DNA, 23 bp, Homo sapiens
tttcacagcttttattctgcatc

SEQ ID NO: 8409984 - DNA, 22 bp, Homo sapiens
tttcacaggagtcctttctata

SEQ ID NO: 8409985 - DNA, 22 bp, Homo sapiens
ttgccattggcaggcctcttgt

SEQ ID NO: 8409986 - DNA, 22 bp, Homo sapiens
ttgctttatctcttatgcctca

SEQ ID NO: 8409987 - DNA, 22 bp, Homo sapiens
ttattttaccttcctctgagct

SEQ ID NO: 8409988 - DNA, 22 bp, Homo sapiens
ttataagagtatatagtgtact

SEQ ID NO: 8409989 - DNA, 22 bp, Homo sapiens
ttctcttcacagggatcatcct

SEQ ID NO: 8409990 - DNA, 22 bp, Homo sapiens
attaaatgatggcatgtcttat

SEQ ID NO: 8409991 - DNA, 22 bp, Homo sapiens
atggaaggtcctacagagcgca

SEQ ID NO: 8409992 - DNA, 22 bp, Homo sapiens
gtattttactgctcaaagctct

SEQ ID NO: 8409993 - DNA, 22 bp, Homo sapiens
ctgggcacaagtggccctggat

SEQ ID NO: 8409994 - DNA, 22 bp, Homo sapiens
ctgggcacaggggagcagagtc

SEQ ID NO: 8409995 - DNA, 22 bp, Homo sapiens
ctgggcacagcgttgggctctt

SEQ ID NO: 8409996 - DNA, 22 bp, Homo sapiens
ctgggcacagtggctcacgcct

SEQ ID NO: 8409997 - DNA, 23 bp, Homo sapiens
ctgggcacccagtacctaggccc

SEQ ID NO: 8409998 - DNA, 22 bp, Homo sapiens
ataaaagtttccaatcatgcct

SEQ ID NO: 8409999 - DNA, 22 bp, Homo sapiens
ataaaagtctgcttatttgggc

SEQ ID NO: 8410000 - DNA, 19 bp, Homo sapiens
cctgggacttaggctgggt

SEQ ID NO: 8410001 - DNA, 22 bp, Homo sapiens
aggtggggctgggaaagattcc

SEQ ID NO: 8410002 - DNA, 22 bp, Homo sapiens
aggtggggtgagctgcagacta

SEQ ID NO: 8410003 - DNA, 22 bp, Homo sapiens
aggtggggtgttggatgtttat

SEQ ID NO: 8410004 - DNA, 22 bp, Homo sapiens
aggtgggggctgtgtccttgac

SEQ ID NO: 8410005 - DNA, 22 bp, Homo sapiens
ctcgggcaccctggttctggtg

SEQ ID NO: 8410006 - DNA, 22 bp, Homo sapiens
ctctcgccagcggggctgcgct

SEQ ID NO: 8410007 - DNA, 22 bp, Homo sapiens
ccctgggatggattggcaggaa

SEQ ID NO: 8410008 - DNA, 22 bp, Homo sapiens
ccagttggtttcaatgggacag

SEQ ID NO: 8410009 - DNA, 22 bp, Homo sapiens
aggaacaggcctcgttttctat

SEQ ID NO: 8410010 - DNA, 22 bp, Homo sapiens
aggaacagaagagcaatgcagg

SEQ ID NO: 8410011 - DNA, 22 bp, Homo sapiens
agctgaggctctgagagggaag

SEQ ID NO: 8410012 - DNA, 22 bp, Homo sapiens
agctggcctccgggtgcctggg

SEQ ID NO: 8410013 - DNA, 21 bp, Homo sapiens
agctggcctggtttgagctcc

SEQ ID NO: 8410014 - DNA, 22 bp, Homo sapiens
agctggccagatgtcccaaaga

SEQ ID NO: 8410015 - DNA, 22 bp, Homo sapiens
agctggccagcacctccaggtc

SEQ ID NO: 8410016 - DNA, 20 bp, Homo sapiens
agctggccaattctattact

SEQ ID NO: 8410017 - DNA, 22 bp, Homo sapiens
atttagtcatcactcatgtgtt

SEQ ID NO: 8410018 - DNA, 22 bp, Homo sapiens
agcataagttggtacagccact

SEQ ID NO: 8410019 - DNA, 22 bp, Homo sapiens
acttcacaggttttcataaaac

SEQ ID NO: 8410020 - DNA, 22 bp, Homo sapiens
acttcacagatatttatttggt

SEQ ID NO: 8410021 - DNA, 22 bp, Homo sapiens
acttcacatttgcaagtcttgg

SEQ ID NO: 8410022 - DNA, 22 bp, Homo sapiens
acttcacaaagagatcatctaa

SEQ ID NO: 8410023 - DNA, 22 bp, Homo sapiens
acttcacacagcaaatttatct

SEQ ID NO: 8410024 - DNA, 22 bp, Homo sapiens
acttcacagaaattttatgagg

SEQ ID NO: 8410025 - DNA, 22 bp, Homo sapiens
acagggagtctgaggggatagt

SEQ ID NO: 8410026 - DNA, 19 bp, Homo sapiens
aggaatggaattaattctg

SEQ ID NO: 8410027 - DNA, 22 bp, Homo sapiens
aggaagggctgtttctccaaga

SEQ ID NO: 8410028 - DNA, 22 bp, Homo sapiens
aatgctttctcagagtccttca

SEQ ID NO: 8410029 - DNA, 22 bp, Homo sapiens
aatgctttcttataaccactgc

SEQ ID NO: 8410030 - DNA, 22 bp, Homo sapiens
aatggctttgagtattttctgg

SEQ ID NO: 8410031 - DNA, 22 bp, Homo sapiens
aagatatattttggtgatttca

SEQ ID NO: 8410032 - DNA, 22 bp, Homo sapiens
aaatctttccctttactatcca

SEQ ID NO: 8410033 - DNA, 22 bp, Homo sapiens
actttatttcctattgcatcca

SEQ ID NO: 8410034 - DNA, 19 bp, Homo sapiens
acctagctcagtggagtag

SEQ ID NO: 8410035 - DNA, 22 bp, Homo sapiens
accgggctaatttttgtatctt

SEQ ID NO: 8410036 - DNA, 22 bp, Homo sapiens
aagtcgtcgaagatggaggttg

SEQ ID NO: 8410037 - DNA, 22 bp, Homo sapiens
aaggaggaattctgagttcatg

SEQ ID NO: 8410038 - DNA, 22 bp, Homo sapiens
aaggaggaatgtagccagctcc

SEQ ID NO: 8410039 - DNA, 22 bp, Homo sapiens
ggtgtaagatgtcagctgagca

SEQ ID NO: 8410040 - DNA, 22 bp, Homo sapiens
gtctgcattggagacaagagtc

SEQ ID NO: 8410041 - DNA, 22 bp, Homo sapiens
gtctgcattgaccctactagtc

SEQ ID NO: 8410042 - DNA, 22 bp, Homo sapiens
gtctgcatacaggacatgcaca

SEQ ID NO: 8410043 - DNA, 22 bp, Homo sapiens
gtctgcatattagatttgtttt

SEQ ID NO: 8410044 - DNA, 22 bp, Homo sapiens
gtggaaggtgctagaacaagga

SEQ ID NO: 8410045 - DNA, 20 bp, Homo sapiens
gtgaagggagtcaggtgtgc

SEQ ID NO: 8410046 - DNA, 22 bp, Homo sapiens
gtggtcatcaactgagaatggt

SEQ ID NO: 8410047 - DNA, 22 bp, Homo sapiens
gtggtcatcacggaaggaagat

SEQ ID NO: 8410048 - DNA, 21 bp, Homo sapiens
gttattttaagtgagctttgc

SEQ ID NO: 8410049 - DNA, 22 bp, Homo sapiens
gttattttaacttctcagtaat

SEQ ID NO: 8410050 - DNA, 22 bp, Homo sapiens
gttattttcattggctcagact

SEQ ID NO: 8410051 - DNA, 22 bp, Homo sapiens
gttattttatctctgagaggtt

SEQ ID NO: 8410052 - DNA, 21 bp, Homo sapiens
ggaaggggtcctcccaacagt

SEQ ID NO: 8410053 - DNA, 22 bp, Homo sapiens
ggaaggggtgggtgagcctcag

SEQ ID NO: 8410054 - DNA, 22 bp, Homo sapiens
ggaagggtttaagcaggagagt

SEQ ID NO: 8410055 - DNA, 22 bp, Homo sapiens
ggaaggggttaggggtccctga

SEQ ID NO: 8410056 - DNA, 22 bp, Homo sapiens
ggaaggggtgtcgcccatggat

SEQ ID NO: 8410057 - DNA, 22 bp, Homo sapiens
ggaaggtgaggtaaggtcttgt

SEQ ID NO: 8410058 - DNA, 22 bp, Homo sapiens
ggaggaagggtagcataatgta

SEQ ID NO: 8410059 - DNA, 22 bp, Homo sapiens
ggaggaagcacacggcttgtat

SEQ ID NO: 8410060 - DNA, 22 bp, Homo sapiens
ggaggaagaggttgttctctca

SEQ ID NO: 8410061 - DNA, 22 bp, Homo sapiens
ggagctgagtgggtttattgat

SEQ ID NO: 8410062 - DNA, 22 bp, Homo sapiens
ggagctgaggacactacatttt

SEQ ID NO: 8410063 - DNA, 22 bp, Homo sapiens
ggaggcagaatagagtgtgggt

SEQ ID NO: 8410064 - DNA, 20 bp, Homo sapiens
ggcaggtgctcgcttggtct

SEQ ID NO: 8410065 - DNA, 22 bp, Homo sapiens
ggcaggtgaggcatgtgcctgg

SEQ ID NO: 8410066 - DNA, 22 bp, Homo sapiens
ggagtagctgcattccgagcac

SEQ ID NO: 8410067 - DNA, 22 bp, Homo sapiens
gggaacagcttgggctctgcca

SEQ ID NO: 8410068 - DNA, 22 bp, Homo sapiens
ggcaggtgctgggagcatctca

SEQ ID NO: 8410069 - DNA, 22 bp, Homo sapiens
ggcaggtggaaggtctccattc

SEQ ID NO: 8410070 - DNA, 22 bp, Homo sapiens
gaggtgggatgtgtgtgctact

SEQ ID NO: 8410071 - DNA, 22 bp, Homo sapiens
gaggtgggcggatcacaaggtc

SEQ ID NO: 8410072 - DNA, 22 bp, Homo sapiens
gaggtgggtgtatcacaggtca

SEQ ID NO: 8410073 - DNA, 19 bp, Homo sapiens
gaggtgggtccccgcagcc

SEQ ID NO: 8410074 - DNA, 22 bp, Homo sapiens
gaggtggggttttgttcttgaa

SEQ ID NO: 8410075 - DNA, 22 bp, Homo sapiens
gaggaagggactttattatctg

SEQ ID NO: 8410076 - DNA, 22 bp, Homo sapiens
gaggaagggctgcctgccgggc

SEQ ID NO: 8410077 - DNA, 22 bp, Homo sapiens
gaggaaggtcccatcagaattt

SEQ ID NO: 8410078 - DNA, 22 bp, Homo sapiens
gaggagggttggccttaggtag

SEQ ID NO: 8410079 - DNA, 22 bp, Homo sapiens
gaaggcggacgccagggggtcg

SEQ ID NO: 8410080 - DNA, 18 bp, Homo sapiens
gacacaggagagagtccc

SEQ ID NO: 8410081 - DNA, 22 bp, Homo sapiens
gacacaggaaaagctccagccc

SEQ ID NO: 8410082 - DNA, 22 bp, Homo sapiens
gacacagggacgtgctctgcct

SEQ ID NO: 8410083 - DNA, 22 bp, Homo sapiens
gatgctttggccccatcatgag

SEQ ID NO: 8410084 - DNA, 22 bp, Homo sapiens
gatgctttctcctttctccacc

SEQ ID NO: 8410085 - DNA, 22 bp, Homo sapiens
gattttatatggcatactgtgg

SEQ ID NO: 8410086 - DNA, 22 bp, Homo sapiens
gccagtggtcactgaggaagaa

SEQ ID NO: 8410087 - DNA, 22 bp, Homo sapiens
gctggccagggctgctcgcgga

SEQ ID NO: 8410088 - DNA, 19 bp, Homo sapiens
ctaagtctgtcaaggaatt

SEQ ID NO: 8410089 - DNA, 22 bp, Homo sapiens
ttcctggggacttaccgtcatt

SEQ ID NO: 8410090 - DNA, 22 bp, Homo sapiens
ctcatagttagagacacagaga

SEQ ID NO: 8410091 - DNA, 22 bp, Homo sapiens
ctggcctgcagatcccagggtc

SEQ ID NO: 8410092 - DNA, 23 bp, Homo sapiens
cctgggcattggctgcagcttct

SEQ ID NO: 8410093 - DNA, 22 bp, Homo sapiens
taaggcagaaatatgagcaggg

SEQ ID NO: 8410094 - DNA, 22 bp, Homo sapiens
taaggcagccgctcagagaggt

SEQ ID NO: 8410095 - DNA, 22 bp, Homo sapiens
caggaagggggatccttggaag

SEQ ID NO: 8410096 - DNA, 22 bp, Homo sapiens
taaatgtataggcactaaacct

SEQ ID NO: 8410097 - DNA, 22 bp, Homo sapiens
taaatgtagtcaaaggagcctc

SEQ ID NO: 8410098 - DNA, 22 bp, Homo sapiens
taaatgtactgaggcaacagga

SEQ ID NO: 8410099 - DNA, 22 bp, Homo sapiens
taaatgtaaatggcgtcttgcg

SEQ ID NO: 8410100 - DNA, 22 bp, Homo sapiens
taaatgtaccttctgccttact

SEQ ID NO: 8410101 - DNA, 22 bp, Homo sapiens
caggagatgacagggaagaacc

SEQ ID NO: 8410102 - DNA, 22 bp, Homo sapiens
gttggccattaattggaggaca

SEQ ID NO: 8410103 - DNA, 22 bp, Homo sapiens
gttcctggcattgtcagcggcc

SEQ ID NO: 8410104 - DNA, 22 bp, Homo sapiens
tctgcgttgctcacgctgggag

SEQ ID NO: 8410105 - DNA, 22 bp, Homo sapiens
catctttgccatatgatgtaat

SEQ ID NO: 8410106 - DNA, 22 bp, Homo sapiens
catctttgaactctgtataaac

SEQ ID NO: 8410107 - DNA, 22 bp, Homo sapiens
tattaaatatatctgttagttg

SEQ ID NO: 8410108 - DNA, 22 bp, Homo sapiens
tatctatgtgctctgacctctc

SEQ ID NO: 8410109 - DNA, 22 bp, Homo sapiens
ttattcttcttctcttgccagg

SEQ ID NO: 8410110 - DNA, 22 bp, Homo sapiens
ttaaaaatatgtagggcccgat

SEQ ID NO: 8410111 - DNA, 22 bp, Homo sapiens
ttaaaacagcgtgaatctggca

SEQ ID NO: 8410112 - DNA, 22 bp, Homo sapiens
tgggcacctagcaacccttctc

SEQ ID NO: 8410113 - DNA, 20 bp, Homo sapiens
tgggcaccagatgggatgcc

SEQ ID NO: 8410114 - DNA, 21 bp, Homo sapiens
tgggcaccaaaacctaggagt

SEQ ID NO: 8410115 - DNA, 22 bp, Homo sapiens
tgggcacctgaggcctggcagg

SEQ ID NO: 8410116 - DNA, 18 bp, Homo sapiens
tgtccctgcaaataacat

SEQ ID NO: 8410117 - DNA, 17 bp, Homo sapiens
tgtatttgtaccacagc

SEQ ID NO: 8410118 - DNA, 22 bp, Homo sapiens
tgtatttgaaacagtgcatggg

SEQ ID NO: 8410119 - DNA, 22 bp, Homo sapiens
tggtcataaggatttggaagct

SEQ ID NO: 8410120 - DNA, 22 bp, Homo sapiens
tgctttataaccatttctgtgg

SEQ ID NO: 8410121 - DNA, 22 bp, Homo sapiens
tgctttattaagagagaaattt

SEQ ID NO: 8410122 - DNA, 18 bp, Homo sapiens
tgctttatgcttatataa

SEQ ID NO: 8410123 - DNA, 20 bp, Homo sapiens
tgctttatgctatactttgt

SEQ ID NO: 8410124 - DNA, 22 bp, Homo sapiens
tgctttatctgtgagaacctga

SEQ ID NO: 8410125 - DNA, 21 bp, Homo sapiens
tgctttatgggaaaaatgtca

SEQ ID NO: 8410126 - DNA, 22 bp, Homo sapiens
tgctttatgtggctgatactca

SEQ ID NO: 8410127 - DNA, 22 bp, Homo sapiens
tgctttatgttatcagaagggt

SEQ ID NO: 8410128 - DNA, 22 bp, Homo sapiens
tgctttatcaaagctatagtga

SEQ ID NO: 8410129 - DNA, 22 bp, Homo sapiens
tgctttatagacaaggaagtag

SEQ ID NO: 8410130 - DNA, 22 bp, Homo sapiens
tgctttataggggattgcaggc

SEQ ID NO: 8410131 - DNA, 22 bp, Homo sapiens
tggaaggggccaggcgcggagt

SEQ ID NO: 8410132 - DNA, 22 bp, Homo sapiens
tggaaggggagttgttccacgt

SEQ ID NO: 8410133 - DNA, 22 bp, Homo sapiens
tggaaggggagctggaaagggg

SEQ ID NO: 8410134 - DNA, 23 bp, Homo sapiens
tggagctgacagtcagagggagg

SEQ ID NO: 8410135 - DNA, 22 bp, Homo sapiens
tgctgaggcatttggacagagt

SEQ ID NO: 8410136 - DNA, 22 bp, Homo sapiens
tgctgaggcagtcctaacagga

SEQ ID NO: 8410137 - DNA, 22 bp, Homo sapiens
tgctgaggcccaggagcacttt

SEQ ID NO: 8410138 - DNA, 22 bp, Homo sapiens
tgctgagggagcatcaaagaaa

SEQ ID NO: 8410139 - DNA, 22 bp, Homo sapiens
tgctgaggaaagaggataaaag

SEQ ID NO: 8410140 - DNA, 22 bp, Homo sapiens
tgggacacagaaaaggcaggtt

SEQ ID NO: 8410141 - DNA, 22 bp, Homo sapiens
tggcctgggtcacaccagggtc

SEQ ID NO: 8410142 - DNA, 21 bp, Homo sapiens
tgaaggggccatcacaaaggc

SEQ ID NO: 8410143 - DNA, 22 bp, Homo sapiens
tgaagggggagatatatgtgtg

SEQ ID NO: 8410144 - DNA, 21 bp, Homo sapiens
tgaaggggtggcagtgtgctt

SEQ ID NO: 8410145 - DNA, 22 bp, Homo sapiens
tgaaggggttcagcatgggggt

SEQ ID NO: 8410146 - DNA, 22 bp, Homo sapiens
tgagatgtaaggtatgcttact

SEQ ID NO: 8410147 - DNA, 22 bp, Homo sapiens
tgagcaggcgcagcaggaggtc

SEQ ID NO: 8410148 - DNA, 22 bp, Homo sapiens
tgaggaagggtgtgacggcacc

SEQ ID NO: 8410149 - DNA, 22 bp, Homo sapiens
tgatctcctgaccttgtaatcc

SEQ ID NO: 8410150 - DNA, 22 bp, Homo sapiens
tgcatcatataatgtctatgga

SEQ ID NO: 8410151 - DNA, 22 bp, Homo sapiens
tgccctgggaacacagatgcca

SEQ ID NO: 8410152 - DNA, 22 bp, Homo sapiens
tgccctggcttcagctttggct

SEQ ID NO: 8410153 - DNA, 22 bp, Homo sapiens
tgccctgggacatgcagcggag

SEQ ID NO: 8410154 - DNA, 22 bp, Homo sapiens
tgccctggatgctgcaggtgtg

SEQ ID NO: 8410155 - DNA, 22 bp, Homo sapiens
tgccctggcacacacacagctg

SEQ ID NO: 8410156 - DNA, 22 bp, Homo sapiens
tgccctggcgctgtctctatgg

SEQ ID NO: 8410157 - DNA, 22 bp, Homo sapiens
tgccctggctcctcccacgctg

SEQ ID NO: 8410158 - DNA, 22 bp, Homo sapiens
tgccctggctctccactagttt

SEQ ID NO: 8410159 - DNA, 22 bp, Homo sapiens
tcctttgcttctgtcattctcc

SEQ ID NO: 8410160 - DNA, 22 bp, Homo sapiens
tcttcacatcatgttttttaat

SEQ ID NO: 8410161 - DNA, 22 bp, Homo sapiens
tctgcatcttctgcacatgcca

SEQ ID NO: 8410162 - DNA, 22 bp, Homo sapiens
tctgcatctcaggattcccttc

SEQ ID NO: 8410163 - DNA, 22 bp, Homo sapiens
acatagaacctggcacatagta

SEQ ID NO: 8410164 - DNA, 22 bp, Homo sapiens
aaggaggaataaagaggtggtg

SEQ ID NO: 8410165 - DNA, 22 bp, Homo sapiens
acagtcttcatgctagaatggc

SEQ ID NO: 8410166 - DNA, 22 bp, Homo sapiens
acagtcttgagcatcagccaga

SEQ ID NO: 8410167 - DNA, 22 bp, Homo sapiens
acagtcttgagcatcagccaga

SEQ ID NO: 8410168 - DNA, 22 bp, Homo sapiens
aagcgccatggttcctgcgcag

SEQ ID NO: 8410169 - DNA, 22 bp, Homo sapiens
aagccttttccacctaatagag

SEQ ID NO: 8410170 - DNA, 22 bp, Homo sapiens
aaggctgcttttaacatgcata

SEQ ID NO: 8410171 - DNA, 22 bp, Homo sapiens
acatttctcttgatgtctctat

SEQ ID NO: 8410172 - DNA, 22 bp, Homo sapiens
acatttctgctagaataggtga

SEQ ID NO: 8410173 - DNA, 22 bp, Homo sapiens
aaggctccctcttctcgagtgt

SEQ ID NO: 8410174 - DNA, 22 bp, Homo sapiens
acattcttgaagtgaagtttat

SEQ ID NO: 8410175 - DNA, 22 bp, Homo sapiens
acattcttcttgtgaatttact

SEQ ID NO: 8410176 - DNA, 22 bp, Homo sapiens
acattcttccagctggctgttg

SEQ ID NO: 8410177 - DNA, 22 bp, Homo sapiens
aaggctctctgatggcagcagt

SEQ ID NO: 8410178 - DNA, 22 bp, Homo sapiens
aaggcctcttctctctggagat

SEQ ID NO: 8410179 - DNA, 22 bp, Homo sapiens
aaggcctccgccaatggcagag

SEQ ID NO: 8410180 - DNA, 22 bp, Homo sapiens
aaggcctccctgtgtgcaggtg

SEQ ID NO: 8410181 - DNA, 22 bp, Homo sapiens
aaggcctcaggtgaggctgccc

SEQ ID NO: 8410182 - DNA, 22 bp, Homo sapiens
aaggcctgaacatgaggagatg

SEQ ID NO: 8410183 - DNA, 22 bp, Homo sapiens
aaggccttgccgaaggatgcca

SEQ ID NO: 8410184 - DNA, 22 bp, Homo sapiens
acattttacaccaagacttctt

SEQ ID NO: 8410185 - DNA, 22 bp, Homo sapiens
acattttaatatgcttagtgtg

SEQ ID NO: 8410186 - DNA, 22 bp, Homo sapiens
acattttacaccaagacttctt

SEQ ID NO: 8410187 - DNA, 21 bp, Homo sapiens
acattttctgttttaggaagt

SEQ ID NO: 8410188 - DNA, 22 bp, Homo sapiens
acattttacagttgtctggcta

SEQ ID NO: 8410189 - DNA, 22 bp, Homo sapiens
acattttaatatgcttagtgtg

SEQ ID NO: 8410190 - DNA, 22 bp, Homo sapiens
aagtctctctgtgtgggataag

SEQ ID NO: 8410191 - DNA, 22 bp, Homo sapiens
aagtctctcatggctgacagca

SEQ ID NO: 8410192 - DNA, 22 bp, Homo sapiens
aagtctctaagactgtgccatc

SEQ ID NO: 8410193 - DNA, 22 bp, Homo sapiens
aagtctctcacatatctggtcc

SEQ ID NO: 8410194 - DNA, 22 bp, Homo sapiens
aagtctctgatgtgtgttaggt

SEQ ID NO: 8410195 - DNA, 22 bp, Homo sapiens
aagtctctggcaaatgatcttg

SEQ ID NO: 8410196 - DNA, 18 bp, Homo sapiens
aagtctctgaaagctttt

SEQ ID NO: 8410197 - DNA, 22 bp, Homo sapiens
aagtctctgactcacacaatgt

SEQ ID NO: 8410198 - DNA, 22 bp, Homo sapiens
aagtctctttacctctccaggc

SEQ ID NO: 8410199 - DNA, 22 bp, Homo sapiens
aagtctctggttgcttgcatgg

SEQ ID NO: 8410200 - DNA, 22 bp, Homo sapiens
aagtctctggtgatgcaggaaa

SEQ ID NO: 8410201 - DNA, 22 bp, Homo sapiens
aagtctcttcctctgccaaaga

SEQ ID NO: 8410202 - DNA, 22 bp, Homo sapiens
aagtctcttagtaatatccaac

SEQ ID NO: 8410203 - DNA, 22 bp, Homo sapiens
acctacatagttaagtaacaaa

SEQ ID NO: 8410204 - DNA, 22 bp, Homo sapiens
acctacatacggaaatatttac

SEQ ID NO: 8410205 - DNA, 23 bp, Homo sapiens
acctacattatagggatatgggt

SEQ ID NO: 8410206 - DNA, 22 bp, Homo sapiens
acctacatgttccacatagttg

SEQ ID NO: 8410207 - DNA, 20 bp, Homo sapiens
acctacatgtatagtgaggg

SEQ ID NO: 8410208 - DNA, 22 bp, Homo sapiens
acctacatggctttaagtaagt

SEQ ID NO: 8410209 - DNA, 22 bp, Homo sapiens
acctacatcaagggagtggtag

SEQ ID NO: 8410210 - DNA, 22 bp, Homo sapiens
acgtgcaggatctggttggcga

SEQ ID NO: 8410211 - DNA, 22 bp, Homo sapiens
acgtcttcgttggcagagattt

SEQ ID NO: 8410212 - DNA, 22 bp, Homo sapiens
actctataaagatacctcaatt

SEQ ID NO: 8410213 - DNA, 22 bp, Homo sapiens
actcagagaacattcccagtct

SEQ ID NO: 8410214 - DNA, 22 bp, Homo sapiens
actcactttccattcaagcacc

SEQ ID NO: 8410215 - DNA, 22 bp, Homo sapiens
actgaggtttacttgaaggaga

SEQ ID NO: 8410216 - DNA, 22 bp, Homo sapiens
actgcactccagcctgggtaac

SEQ ID NO: 8410217 - DNA, 22 bp, Homo sapiens
actgcactccagcctcggggtc

SEQ ID NO: 8410218 - DNA, 22 bp, Homo sapiens
actgcactccaacctgggtgac

SEQ ID NO: 8410219 - DNA, 22 bp, Homo sapiens
actggaggattcctggaaggcg

SEQ ID NO: 8410220 - DNA, 22 bp, Homo sapiens
actggaggcccctcccagtgaa

SEQ ID NO: 8410221 - DNA, 22 bp, Homo sapiens
actggaggggaaaatggtagta

SEQ ID NO: 8410222 - DNA, 22 bp, Homo sapiens
actgcactccagcctgggtgac

SEQ ID NO: 8410223 - DNA, 22 bp, Homo sapiens
aatacagaggcttccagtaaaa

SEQ ID NO: 8410224 - DNA, 22 bp, Homo sapiens
actttatttcctattgcatcca

SEQ ID NO: 8410225 - DNA, 22 bp, Homo sapiens
actttatttcctattgcatcca

SEQ ID NO: 8410226 - DNA, 23 bp, Homo sapiens
actttattgaccccaggtcagtt

SEQ ID NO: 8410227 - DNA, 23 bp, Homo sapiens
actttattgaccccaggtcagtt

SEQ ID NO: 8410228 - DNA, 19 bp, Homo sapiens
actgttctaacttgcagct

SEQ ID NO: 8410229 - DNA, 18 bp, Homo sapiens
actgttctctcctgccct

SEQ ID NO: 8410230 - DNA, 22 bp, Homo sapiens
aatataattttattcctagagt

SEQ ID NO: 8410231 - DNA, 22 bp, Homo sapiens
agaacaaaattagaggagtgca

SEQ ID NO: 8410232 - DNA, 22 bp, Homo sapiens
agaaatgacacacatgagacat

SEQ ID NO: 8410233 - DNA, 22 bp, Homo sapiens
agaaatgacacacatgagacat

SEQ ID NO: 8410234 - DNA, 22 bp, Homo sapiens
aatgattggcactagatacaca

SEQ ID NO: 8410235 - DNA, 22 bp, Homo sapiens
aatgattgcaaacattgagaac

SEQ ID NO: 8410236 - DNA, 22 bp, Homo sapiens
aatgatggtcatggcaactttt

SEQ ID NO: 8410237 - DNA, 22 bp, Homo sapiens
aatgatttggcaaaggaatcca

SEQ ID NO: 8410238 - DNA, 22 bp, Homo sapiens
agaaatgaaaccaaagcctaga

SEQ ID NO: 8410239 - DNA, 22 bp, Homo sapiens
agaaatgaagagagtcaaggtt

SEQ ID NO: 8410240 - DNA, 22 bp, Homo sapiens
agaaatgaagcaggagttatta

SEQ ID NO: 8410241 - DNA, 22 bp, Homo sapiens
agaaatgaatatgtagtggtta

SEQ ID NO: 8410242 - DNA, 22 bp, Homo sapiens
agaaatgacaagactgatcagg

SEQ ID NO: 8410243 - DNA, 22 bp, Homo sapiens
aatgtggccacttttttctggg

SEQ ID NO: 8410244 - DNA, 22 bp, Homo sapiens
aatgtggcattgtcattattgg

SEQ ID NO: 8410245 - DNA, 22 bp, Homo sapiens
aatgtcttccctggcaggccaa

SEQ ID NO: 8410246 - DNA, 23 bp, Homo sapiens
aatggtcttcctccacccctctg

SEQ ID NO: 8410247 - DNA, 22 bp, Homo sapiens
aatggcaagctgaactcagaag

SEQ ID NO: 8410248 - DNA, 22 bp, Homo sapiens
aatggcaaaaggataacaagga

SEQ ID NO: 8410249 - DNA, 22 bp, Homo sapiens
aatggcaagagccacagaggcg

SEQ ID NO: 8410250 - DNA, 22 bp, Homo sapiens
aatggcaacatggtatagtgag

SEQ ID NO: 8410251 - DNA, 19 bp, Homo sapiens
agacaatggggttggcagt

SEQ ID NO: 8410252 - DNA, 22 bp, Homo sapiens
agacaatggagggaaatacttc

SEQ ID NO: 8410253 - DNA, 22 bp, Homo sapiens
agacaatggagagcagagtact

SEQ ID NO: 8410254 - DNA, 22 bp, Homo sapiens
agacaatggaccaagcaccttc

SEQ ID NO: 8410255 - DNA, 22 bp, Homo sapiens
agagccaggtgctgctgtttga

SEQ ID NO: 8410256 - DNA, 22 bp, Homo sapiens
agaccctgtcagtgttaggaaa

SEQ ID NO: 8410257 - DNA, 20 bp, Homo sapiens
agaccctgtgtcctgtggcc

SEQ ID NO: 8410258 - DNA, 22 bp, Homo sapiens
agaccctctccatgcccactgc

SEQ ID NO: 8410259 - DNA, 18 bp, Homo sapiens
agaccctctaagggcagt

SEQ ID NO: 8410260 - DNA, 22 bp, Homo sapiens
agaccctgcacctctcgtgggc

SEQ ID NO: 8410261 - DNA, 20 bp, Homo sapiens
agaccctctggactgggccc

SEQ ID NO: 8410262 - DNA, 22 bp, Homo sapiens
aattaaaagataacccatgagt

SEQ ID NO: 8410263 - DNA, 22 bp, Homo sapiens
aattaaattggtttagagagga

SEQ ID NO: 8410264 - DNA, 23 bp, Homo sapiens
aattaaattgctagatccagggc

SEQ ID NO: 8410265 - DNA, 22 bp, Homo sapiens
aattaaatgacaggggaagatg

SEQ ID NO: 8410266 - DNA, 22 bp, Homo sapiens
aattaacagagggcttattact

SEQ ID NO: 8410267 - DNA, 22 bp, Homo sapiens
acaagagccctttcagattgac

SEQ ID NO: 8410268 - DNA, 22 bp, Homo sapiens
acaagagcattgcaggtgtgtt

SEQ ID NO: 8410269 - DNA, 22 bp, Homo sapiens
acaagactgtgctctaagagtg

SEQ ID NO: 8410270 - DNA, 22 bp, Homo sapiens
acaagactgtgctctaagagtg

SEQ ID NO: 8410271 - DNA, 22 bp, Homo sapiens
acaacacagcaaaaccccatct

SEQ ID NO: 8410272 - DNA, 23 bp, Homo sapiens
acaagatagggataaaaagataa

SEQ ID NO: 8410273 - DNA, 22 bp, Homo sapiens
acaagattcaatgaattgattg

SEQ ID NO: 8410274 - DNA, 22 bp, Homo sapiens
acaagattttgtctggtagggt

SEQ ID NO: 8410275 - DNA, 22 bp, Homo sapiens
acaagattttatgactcttttt

SEQ ID NO: 8410276 - DNA, 22 bp, Homo sapiens
acaagattgataagtctgccct

SEQ ID NO: 8410277 - DNA, 22 bp, Homo sapiens
acaagatttaatgcaacccaag

SEQ ID NO: 8410278 - DNA, 22 bp, Homo sapiens
acaagatttagcttaaagggct

SEQ ID NO: 8410279 - DNA, 22 bp, Homo sapiens
acaagatttaatgcaacccaag

SEQ ID NO: 8410280 - DNA, 22 bp, Homo sapiens
acaagatttggctgaaactcca

SEQ ID NO: 8410281 - DNA, 22 bp, Homo sapiens
acaagcataagtgagatgaata

SEQ ID NO: 8410282 - DNA, 22 bp, Homo sapiens
acaatcacacatgcaattatac

SEQ ID NO: 8410283 - DNA, 22 bp, Homo sapiens
agaggctctgccgcctcaggta

SEQ ID NO: 8410284 - DNA, 22 bp, Homo sapiens
acaaagggggactgcagagggt

SEQ ID NO: 8410285 - DNA, 22 bp, Homo sapiens
agaggctgttacactcccagat

SEQ ID NO: 8410286 - DNA, 23 bp, Homo sapiens
acagacattccataatgtacacc

SEQ ID NO: 8410287 - DNA, 22 bp, Homo sapiens
acagagagaggcccgaggctgc

SEQ ID NO: 8410288 - DNA, 22 bp, Homo sapiens
acagagagctgtgattgagtta

SEQ ID NO: 8410289 - DNA, 22 bp, Homo sapiens
acagagagaattgggtttacag

SEQ ID NO: 8410290 - DNA, 22 bp, Homo sapiens
acagagagaaacaatcagcagc

SEQ ID NO: 8410291 - DNA, 22 bp, Homo sapiens
acagagagaaacaatcagcagc

SEQ ID NO: 8410292 - DNA, 22 bp, Homo sapiens
acactttatcaatattcaaaaa

SEQ ID NO: 8410293 - DNA, 22 bp, Homo sapiens
acagacagacagattgcatatg

SEQ ID NO: 8410294 - DNA, 22 bp, Homo sapiens
acagaaagataggcacaaggtc

SEQ ID NO: 8410295 - DNA, 22 bp, Homo sapiens
acagatggttattgtcatttct

SEQ ID NO: 8410296 - DNA, 21 bp, Homo sapiens
acagatgggatgagcacactg

SEQ ID NO: 8410297 - DNA, 22 bp, Homo sapiens
acagatggccatattactatat

SEQ ID NO: 8410298 - DNA, 22 bp, Homo sapiens
acagatggagctactaggtaaa

SEQ ID NO: 8410299 - DNA, 17 bp, Homo sapiens
agctcctgcccatggct

SEQ ID NO: 8410300 - DNA, 22 bp, Homo sapiens
agcctctgatggctcccaagga

SEQ ID NO: 8410301 - DNA, 22 bp, Homo sapiens
acagatgaggcccatcagtctg

SEQ ID NO: 8410302 - DNA, 22 bp, Homo sapiens
acagatgagttaaagcagagtg

SEQ ID NO: 8410303 - DNA, 22 bp, Homo sapiens
acagatggaatgtgttatggga

SEQ ID NO: 8410304 - DNA, 22 bp, Homo sapiens
acagagctaatgttgcataggc

SEQ ID NO: 8410305 - DNA, 17 bp, Homo sapiens
acacagggagagggagc

SEQ ID NO: 8410306 - DNA, 22 bp, Homo sapiens
acacattatagagagtataata

SEQ ID NO: 8410307 - DNA, 22 bp, Homo sapiens
acactctacagagcaatctacc

SEQ ID NO: 8410308 - DNA, 22 bp, Homo sapiens
acactttactcttacaccattg

SEQ ID NO: 8410309 - DNA, 23 bp, Homo sapiens
agcagcaaaaatttatctttctg

SEQ ID NO: 8410310 - DNA, 22 bp, Homo sapiens
acaatgcacctattttaaaact

SEQ ID NO: 8410311 - DNA, 17 bp, Homo sapiens
acaatgcagtctctagt

SEQ ID NO: 8410312 - DNA, 23 bp, Homo sapiens
acaatgcactttaaatggttccc

SEQ ID NO: 8410313 - DNA, 22 bp, Homo sapiens
acaatgcacctattttaaaact

SEQ ID NO: 8410314 - DNA, 22 bp, Homo sapiens
acacagataatgctcatatagg

SEQ ID NO: 8410315 - DNA, 22 bp, Homo sapiens
acacagagtatttagaaggggt

SEQ ID NO: 8410316 - DNA, 22 bp, Homo sapiens
acacagagtatcttttgcctag

SEQ ID NO: 8410317 - DNA, 22 bp, Homo sapiens
aaatgcatgtagaataatagag

SEQ ID NO: 8410318 - DNA, 22 bp, Homo sapiens
aagatattcaaagatttattag

SEQ ID NO: 8410319 - DNA, 22 bp, Homo sapiens
aagatattcaaagatttattag

SEQ ID NO: 8410320 - DNA, 20 bp, Homo sapiens
aagattcattgtaattaggg

SEQ ID NO: 8410321 - DNA, 22 bp, Homo sapiens
aagattcacagagtgaatgaaa

SEQ ID NO: 8410322 - DNA, 22 bp, Homo sapiens
aaatactctcaataaagaaagt

SEQ ID NO: 8410323 - DNA, 22 bp, Homo sapiens
aagataaactcttgatttctga

SEQ ID NO: 8410324 - DNA, 22 bp, Homo sapiens
aaagtgaggacttgagtactgt

SEQ ID NO: 8410325 - DNA, 22 bp, Homo sapiens
aagaacatgctataattatctt

SEQ ID NO: 8410326 - DNA, 22 bp, Homo sapiens
aagaacatgggtgtgggcattc

SEQ ID NO: 8410327 - DNA, 22 bp, Homo sapiens
aagaacatgagttatgatgatt

SEQ ID NO: 8410328 - DNA, 22 bp, Homo sapiens
aagaacatgatggccatgtgca

SEQ ID NO: 8410329 - DNA, 22 bp, Homo sapiens
aaagtgcacctgcttcttcttg

SEQ ID NO: 8410330 - DNA, 20 bp, Homo sapiens
aaagtgcacagatacagctc

SEQ ID NO: 8410331 - DNA, 22 bp, Homo sapiens
aaagtgcagaactgttctcact

SEQ ID NO: 8410332 - DNA, 22 bp, Homo sapiens
aaaggcatctagccaagttgag

SEQ ID NO: 8410333 - DNA, 22 bp, Homo sapiens
aaccccgctcaggctgggtgag

SEQ ID NO: 8410334 - DNA, 22 bp, Homo sapiens
aacccgggaggcagaggttgtg

SEQ ID NO: 8410335 - DNA, 22 bp, Homo sapiens
aacccgggaggcagaggttgtg

SEQ ID NO: 8410336 - DNA, 22 bp, Homo sapiens
aaagcctcccaggttatgagta

SEQ ID NO: 8410337 - DNA, 22 bp, Homo sapiens
aacccagccgtgtagctgccgc

SEQ ID NO: 8410338 - DNA, 22 bp, Homo sapiens
aactgtctgaaactggggtttc

SEQ ID NO: 8410339 - DNA, 22 bp, Homo sapiens
aactgtctaaggagaatatgaa

SEQ ID NO: 8410340 - DNA, 22 bp, Homo sapiens
aactgtggacttgagactgatg

SEQ ID NO: 8410341 - DNA, 22 bp, Homo sapiens
aactgtcttgcctactcagcat

SEQ ID NO: 8410342 - DNA, 23 bp, Homo sapiens
aactgtcttgcaagtgtgatacc

SEQ ID NO: 8410343 - DNA, 22 bp, Homo sapiens
aactgtcttatttatatttctg

SEQ ID NO: 8410344 - DNA, 22 bp, Homo sapiens
aactgtcttaataacaaaagct

SEQ ID NO: 8410345 - DNA, 22 bp, Homo sapiens
aactgtgggatgcattaattca

SEQ ID NO: 8410346 - DNA, 22 bp, Homo sapiens
aagaacatgaacacaatgttta

SEQ ID NO: 8410347 - DNA, 22 bp, Homo sapiens
aagaacatgaagtcacaaatgc

SEQ ID NO: 8410348 - DNA, 23 bp, Homo sapiens
aacatactgtttaatattcacag

SEQ ID NO: 8410349 - DNA, 22 bp, Homo sapiens
aacataatgtggccaaagtcac

SEQ ID NO: 8410350 - DNA, 22 bp, Homo sapiens
aacataatgtggccaaagtcac

SEQ ID NO: 8410351 - DNA, 22 bp, Homo sapiens
aacacttaaggagagatcaaat

SEQ ID NO: 8410352 - DNA, 22 bp, Homo sapiens
aacacttagatttttaaggttt

SEQ ID NO: 8410353 - DNA, 22 bp, Homo sapiens
aaagattcgagcgatgtataaa

SEQ ID NO: 8410354 - DNA, 22 bp, Homo sapiens
aaagacttggcttatgatttgc

SEQ ID NO: 8410355 - DNA, 22 bp, Homo sapiens
aaagagaaacttagaagcctga

SEQ ID NO: 8410356 - DNA, 20 bp, Homo sapiens
aaagagaagcctcaccttgt

SEQ ID NO: 8410357 - DNA, 22 bp, Homo sapiens
aaagagaaaatgatctgtacat

SEQ ID NO: 8410358 - DNA, 22 bp, Homo sapiens
aaagagaaaaagatcccggctc

SEQ ID NO: 8410359 - DNA, 22 bp, Homo sapiens
aaagaaatacctttctcagctt

SEQ ID NO: 8410360 - DNA, 21 bp, Homo sapiens
aaagaaatctcccattggtag

SEQ ID NO: 8410361 - DNA, 22 bp, Homo sapiens
aaagaaatagatggcatttaaa

SEQ ID NO: 8410362 - DNA, 22 bp, Homo sapiens
aaactgtgaagcaagtacaagg

SEQ ID NO: 8410363 - DNA, 23 bp, Homo sapiens
aaacatgcagcacatgaatgcta

SEQ ID NO: 8410364 - DNA, 22 bp, Homo sapiens
aaacatgcattcaagaaaatct

SEQ ID NO: 8410365 - DNA, 22 bp, Homo sapiens
aaacattagacaccatatgctc

SEQ ID NO: 8410366 - DNA, 22 bp, Homo sapiens
aaacattgtaattttagcatgg

SEQ ID NO: 8410367 - DNA, 22 bp, Homo sapiens
aaacagatgagttataatagcc

SEQ ID NO: 8410368 - DNA, 22 bp, Homo sapiens
aaacagataagggacaatttca

SEQ ID NO: 8410369 - DNA, 22 bp, Homo sapiens
aaacagataatgctataaatgg

SEQ ID NO: 8410370 - DNA, 22 bp, Homo sapiens
aaagccagcaaggtgagtttca

SEQ ID NO: 8410371 - DNA, 22 bp, Homo sapiens
aaaaggcattttgtcaaccata

SEQ ID NO: 8410372 - DNA, 22 bp, Homo sapiens
aaaaagtattggccatggttga

SEQ ID NO: 8410373 - DNA, 21 bp, Homo sapiens
aaaaagctggggcatgcatgc

SEQ ID NO: 8410374 - DNA, 22 bp, Homo sapiens
aaaattcatagaactgtacgct

SEQ ID NO: 8410375 - DNA, 22 bp, Homo sapiens
aaaattcatggcttgggaaaag

SEQ ID NO: 8410376 - DNA, 22 bp, Homo sapiens
aaaaggttttgagtacaaatat

SEQ ID NO: 8410377 - DNA, 22 bp, Homo sapiens
aaacaccagtcccagtatacac

SEQ ID NO: 8410378 - DNA, 22 bp, Homo sapiens
aaactgcagagccatggttcaa

SEQ ID NO: 8410379 - DNA, 22 bp, Homo sapiens
aagaaaacgttttgaggagttt

SEQ ID NO: 8410380 - DNA, 22 bp, Homo sapiens
aatttacacttcatttggaggg

SEQ ID NO: 8410381 - DNA, 22 bp, Homo sapiens
aagaacaactgctttaaaagca

SEQ ID NO: 8410382 - DNA, 22 bp, Homo sapiens
aagaaatgtgaatattgaatag

SEQ ID NO: 8410383 - DNA, 22 bp, Homo sapiens
aagaaatgtagagcctagtaaa

SEQ ID NO: 8410384 - DNA, 22 bp, Homo sapiens
aattctatgttcttgagtaaga

SEQ ID NO: 8410385 - DNA, 22 bp, Homo sapiens
aattctataggcaagctatttt

SEQ ID NO: 8410386 - DNA, 22 bp, Homo sapiens
aattctacattggttcacattt

SEQ ID NO: 8410387 - DNA, 22 bp, Homo sapiens
aagagaaggtgaggaagccggt

SEQ ID NO: 8410388 - DNA, 22 bp, Homo sapiens
aagagaatatcgatagcactct

SEQ ID NO: 8410389 - DNA, 21 bp, Homo sapiens
acacaaacctcctcagcctgg

SEQ ID NO: 8410390 - DNA, 22 bp, Homo sapiens
aagactttccctcatcagaacg

SEQ ID NO: 8410391 - DNA, 22 bp, Homo sapiens
aagacttgaccaggttgaaggc

SEQ ID NO: 8410392 - DNA, 20 bp, Homo sapiens
aattttatctccatcctttg

SEQ ID NO: 8410393 - DNA, 22 bp, Homo sapiens
aattttacttccctcagtgtag

SEQ ID NO: 8410394 - DNA, 20 bp, Homo sapiens
aattttactgtcctatagag

SEQ ID NO: 8410395 - DNA, 22 bp, Homo sapiens
aattttacttccctcagtgtag

SEQ ID NO: 8410396 - DNA, 22 bp, Homo sapiens
aatttgttacacagcaatataa

SEQ ID NO: 8410397 - DNA, 22 bp, Homo sapiens
aattttacaagaaggcctcgta

SEQ ID NO: 8410398 - DNA, 22 bp, Homo sapiens
aattttacaagaaggcctcgta

SEQ ID NO: 8410399 - DNA, 22 bp, Homo sapiens
aattttacaaaatacctccgat

SEQ ID NO: 8410400 - DNA, 22 bp, Homo sapiens
aattttacaaaatacctccgat

SEQ ID NO: 8410401 - DNA, 20 bp, Homo sapiens
aattttactgtcctatagag

SEQ ID NO: 8410402 - DNA, 22 bp, Homo sapiens
aattttactaatctgagtgtga

SEQ ID NO: 8410403 - DNA, 22 bp, Homo sapiens
aattttacataggggatatggg

SEQ ID NO: 8410404 - DNA, 22 bp, Homo sapiens
aattttacataggggatatggg

SEQ ID NO: 8410405 - DNA, 22 bp, Homo sapiens
aattttactaatctgagtgtga

SEQ ID NO: 8410406 - DNA, 22 bp, Homo sapiens
aagatgcagctttacaataagg

SEQ ID NO: 8410407 - DNA, 22 bp, Homo sapiens
aagatgatagatctgtcaatgt

SEQ ID NO: 8410408 - DNA, 22 bp, Homo sapiens
aagatgaatcagtatgtgtcct

SEQ ID NO: 8410409 - DNA, 22 bp, Homo sapiens
acacatttattacatgcatgtg

SEQ ID NO: 8410410 - DNA, 22 bp, Homo sapiens
acacattatctcattaaatact

SEQ ID NO: 8410411 - DNA, 22 bp, Homo sapiens
acacattcatgagtgcatgcac

SEQ ID NO: 8410412 - DNA, 22 bp, Homo sapiens
acacatgaaagacattaaggtg

SEQ ID NO: 8410413 - DNA, 22 bp, Homo sapiens
acacatgaaataatattatgca

SEQ ID NO: 8410414 - DNA, 22 bp, Homo sapiens
acacatgaatcactggtggaag

SEQ ID NO: 8410415 - DNA, 22 bp, Homo sapiens
acacatgagaaacatcagttgt

SEQ ID NO: 8410416 - DNA, 22 bp, Homo sapiens
acacatgacctccgcagcagca

SEQ ID NO: 8410417 - DNA, 22 bp, Homo sapiens
acacatgataagaaagtttaaa

SEQ ID NO: 8410418 - DNA, 19 bp, Homo sapiens
acacatgaggagggacccc

SEQ ID NO: 8410419 - DNA, 22 bp, Homo sapiens
acacatgaggaaggcctcaccc

SEQ ID NO: 8410420 - DNA, 22 bp, Homo sapiens
acacatgagttctcatcttgtg

SEQ ID NO: 8410421 - DNA, 22 bp, Homo sapiens
acacatgaggatgaggggatca

SEQ ID NO: 8410422 - DNA, 22 bp, Homo sapiens
acacatgattaatgccaagcat

SEQ ID NO: 8410423 - DNA, 22 bp, Homo sapiens
aagcacaatttcaccttcttgt

SEQ ID NO: 8410424 - DNA, 22 bp, Homo sapiens
aactagaaccacttgtatttcc

SEQ ID NO: 8410425 - DNA, 22 bp, Homo sapiens
aactagaaagaacatatttcca

SEQ ID NO: 8410426 - DNA, 23 bp, Homo sapiens
aatgacagtgtgtgattgaagaa

SEQ ID NO: 8410427 - DNA, 22 bp, Homo sapiens
aatgacaatattaatttggagg

SEQ ID NO: 8410428 - DNA, 22 bp, Homo sapiens
aatgacaagacatagtctctga

SEQ ID NO: 8410429 - DNA, 22 bp, Homo sapiens
aatgacaataatcattaacttt

SEQ ID NO: 8410430 - DNA, 22 bp, Homo sapiens
aacctgcatgtttctaaaagca

SEQ ID NO: 8410431 - DNA, 22 bp, Homo sapiens
aacctgcagtttttattctgag

SEQ ID NO: 8410432 - DNA, 22 bp, Homo sapiens
aacccgggaggcggaggttgtg

SEQ ID NO: 8410433 - DNA, 22 bp, Homo sapiens
aacccgggaggcggaggttgtg

SEQ ID NO: 8410434 - DNA, 22 bp, Homo sapiens
aacctctacatccaggaaagga

SEQ ID NO: 8410435 - DNA, 22 bp, Homo sapiens
aacatctcatggactacattct

SEQ ID NO: 8410436 - DNA, 22 bp, Homo sapiens
aacatctagttcctatataata

SEQ ID NO: 8410437 - DNA, 22 bp, Homo sapiens
aacatctctgtattttatagac

SEQ ID NO: 8410438 - DNA, 22 bp, Homo sapiens
aacatgaaaactacctgtgatt

SEQ ID NO: 8410439 - DNA, 22 bp, Homo sapiens
aacatgaaaagcccagagaggt

SEQ ID NO: 8410440 - DNA, 22 bp, Homo sapiens
aacagcgtctttccagctgttc

SEQ ID NO: 8410441 - DNA, 22 bp, Homo sapiens
aagtgtatttttgtactaacat

SEQ ID NO: 8410442 - DNA, 22 bp, Homo sapiens
aagtgtattaagcaacgttatt

SEQ ID NO: 8410443 - DNA, 22 bp, Homo sapiens
aagtgtatatatgacttataaa

SEQ ID NO: 8410444 - DNA, 22 bp, Homo sapiens
aacagctattagaacttcatgg

SEQ ID NO: 8410445 - DNA, 22 bp, Homo sapiens
aacagcttcatcacatggcata

SEQ ID NO: 8410446 - DNA, 22 bp, Homo sapiens
aacatctacagtgagatgttag

SEQ ID NO: 8410447 - DNA, 22 bp, Homo sapiens
aacatcatcatgaacaactaat

SEQ ID NO: 8410448 - DNA, 22 bp, Homo sapiens
aacatcagaatatccatgttgg

SEQ ID NO: 8410449 - DNA, 22 bp, Homo sapiens
aacacagctaatttctgtcaat

SEQ ID NO: 8410450 - DNA, 20 bp, Homo sapiens
aacacagataccaaaggttg

SEQ ID NO: 8410451 - DNA, 22 bp, Homo sapiens
aaatttctaagtcaagaagaac

SEQ ID NO: 8410452 - DNA, 21 bp, Homo sapiens
aaatttctgcaagcctcaact

SEQ ID NO: 8410453 - DNA, 22 bp, Homo sapiens
aaattttaaggctggaacttaa

SEQ ID NO: 8410454 - DNA, 22 bp, Homo sapiens
aaatttcttgaggctctctagc

SEQ ID NO: 8410455 - DNA, 22 bp, Homo sapiens
aaatttgataagccattgttac

SEQ ID NO: 8410456 - DNA, 22 bp, Homo sapiens
aaatttctgttgttttgagcca

SEQ ID NO: 8410457 - DNA, 22 bp, Homo sapiens
aaatttctggaagtgtcagagt

SEQ ID NO: 8410458 - DNA, 22 bp, Homo sapiens
aacagaatcttgggttcttttc

SEQ ID NO: 8410459 - DNA, 22 bp, Homo sapiens
aaattattttcagaatggagaa

SEQ ID NO: 8410460 - DNA, 22 bp, Homo sapiens
aaattcaatgatcactggctca

SEQ ID NO: 8410461 - DNA, 22 bp, Homo sapiens
aaattcaattaactttcatgct

SEQ ID NO: 8410462 - DNA, 23 bp, Homo sapiens
aaattattgctcttcaattgcct

SEQ ID NO: 8410463 - DNA, 22 bp, Homo sapiens
aaggaagacacagatgaagtga

SEQ ID NO: 8410464 - DNA, 22 bp, Homo sapiens
aaatgcatgtatgtaatatgct

SEQ ID NO: 8410465 - DNA, 22 bp, Homo sapiens
aaatgcattaagtcagaacaat

SEQ ID NO: 8410466 - DNA, 22 bp, Homo sapiens
aaatgcattggtttctacttgt

SEQ ID NO: 8410467 - DNA, 22 bp, Homo sapiens
aaggaagatatatcaagcttaa

SEQ ID NO: 8410468 - DNA, 22 bp, Homo sapiens
aaggaagaggcaggttttgctg

SEQ ID NO: 8410469 - DNA, 22 bp, Homo sapiens
aaatgtcagaagctttacttct

SEQ ID NO: 8410470 - DNA, 19 bp, Homo sapiens
aggaatggaattaattctg

SEQ ID NO: 8410471 - DNA, 22 bp, Homo sapiens
aggaatgtaaatctagatttta

SEQ ID NO: 8410472 - DNA, 22 bp, Homo sapiens
aggaatgtaacaggagtaaaaa

SEQ ID NO: 8410473 - DNA, 22 bp, Homo sapiens
aggaatgtaatagtgtggctca

SEQ ID NO: 8410474 - DNA, 22 bp, Homo sapiens
aggaatgtagtttgagtagaaa

SEQ ID NO: 8410475 - DNA, 22 bp, Homo sapiens
aggaatgtattattccttctgg

SEQ ID NO: 8410476 - DNA, 22 bp, Homo sapiens
aggaatgtattgacctgttgca

SEQ ID NO: 8410477 - DNA, 22 bp, Homo sapiens
aggaatgtcaagtagatgtgcg

SEQ ID NO: 8410478 - DNA, 22 bp, Homo sapiens
aggaatgtcatagaataatcat

SEQ ID NO: 8410479 - DNA, 14 bp, Homo sapiens
aggaatgtcctagg

SEQ ID NO: 8410480 - DNA, 22 bp, Homo sapiens
agctttatgggagcttagataa

SEQ ID NO: 8410481 - DNA, 22 bp, Homo sapiens
agctttatcacaatattggcta

SEQ ID NO: 8410482 - DNA, 22 bp, Homo sapiens
agctttatcagaggagtctcta

SEQ ID NO: 8410483 - DNA, 22 bp, Homo sapiens
agctttatcttcacctgggaat

SEQ ID NO: 8410484 - DNA, 22 bp, Homo sapiens
agctttatcccttgcccatcga

SEQ ID NO: 8410485 - DNA, 22 bp, Homo sapiens
agctttatgaggagaccttagt

SEQ ID NO: 8410486 - DNA, 22 bp, Homo sapiens
agctttatgcttcctacaagct

SEQ ID NO: 8410487 - DNA, 17 bp, Homo sapiens
acaggcctgcttgcact

SEQ ID NO: 8410488 - DNA, 22 bp, Homo sapiens
acaggcctgagattttgcattt

SEQ ID NO: 8410489 - DNA, 22 bp, Homo sapiens
acagctctggtcctttagagag

SEQ ID NO: 8410490 - DNA, 20 bp, Homo sapiens
aggaggaaaaaatgacgagc

SEQ ID NO: 8410491 - DNA, 22 bp, Homo sapiens
acagtaaatcaacagaatatct

SEQ ID NO: 8410492 - DNA, 22 bp, Homo sapiens
aggaggaactcagaaagaaggt

SEQ ID NO: 8410493 - DNA, 21 bp, Homo sapiens
aggaggaacccgtggctgggc

SEQ ID NO: 8410494 - DNA, 22 bp, Homo sapiens
aggaggaaagaaggcccccagc

SEQ ID NO: 8410495 - DNA, 22 bp, Homo sapiens
aggaggaaaaaggccacagcaa

SEQ ID NO: 8410496 - DNA, 20 bp, Homo sapiens
aggaggaagaaagcacactg

SEQ ID NO: 8410497 - DNA, 22 bp, Homo sapiens
acagtttgccctgacattctcc

SEQ ID NO: 8410498 - DNA, 22 bp, Homo sapiens
aggcagcaattgaaatcattgt

SEQ ID NO: 8410499 - DNA, 22 bp, Homo sapiens
aggcagctggaggcagagacta

SEQ ID NO: 8410500 - DNA, 22 bp, Homo sapiens
acagttcaagacatcagtatga

SEQ ID NO: 8410501 - DNA, 22 bp, Homo sapiens
acagttcaagtcttagacaaca

SEQ ID NO: 8410502 - DNA, 22 bp, Homo sapiens
acagtgcacatcctgagtgatt

SEQ ID NO: 8410503 - DNA, 22 bp, Homo sapiens
acagtgcaaataggactgtctt

SEQ ID NO: 8410504 - DNA, 22 bp, Homo sapiens
acagtgcaaacttttgtctcct

SEQ ID NO: 8410505 - DNA, 22 bp, Homo sapiens
acagtgttttagaaaagcttga

SEQ ID NO: 8410506 - DNA, 22 bp, Homo sapiens
acagtgcaaaccctcgggaaag

SEQ ID NO: 8410507 - DNA, 22 bp, Homo sapiens
acatgagaagctgcaacatgac

SEQ ID NO: 8410508 - DNA, 22 bp, Homo sapiens
acatgattcttgataggcattg

SEQ ID NO: 8410509 - DNA, 22 bp, Homo sapiens
acatgattaaaagattttaaag

SEQ ID NO: 8410510 - DNA, 22 bp, Homo sapiens
acatgatattaatgtcttattt

SEQ ID NO: 8410511 - DNA, 22 bp, Homo sapiens
acatgagatcacaaagataaat

SEQ ID NO: 8410512 - DNA, 22 bp, Homo sapiens
acatgcacacgattcagtctgg

SEQ ID NO: 8410513 - DNA, 22 bp, Homo sapiens
acatgattttagtatcataata

SEQ ID NO: 8410514 - DNA, 22 bp, Homo sapiens
acatgatttttaaagagataat

SEQ ID NO: 8410515 - DNA, 20 bp, Homo sapiens
acatgcacgtgtgtatatat

SEQ ID NO: 8410516 - DNA, 22 bp, Homo sapiens
acatgcataaactacttcttat

SEQ ID NO: 8410517 - DNA, 22 bp, Homo sapiens
aggcctttgtggagctcatggc

SEQ ID NO: 8410518 - DNA, 22 bp, Homo sapiens
aggccttaccatagctgtagca

SEQ ID NO: 8410519 - DNA, 22 bp, Homo sapiens
acatttaagttaaaacctcagt

SEQ ID NO: 8410520 - DNA, 22 bp, Homo sapiens
acccggagtcggaggttgcagt

SEQ ID NO: 8410521 - DNA, 22 bp, Homo sapiens
acccaggcctgagagacaggag

SEQ ID NO: 8410522 - DNA, 22 bp, Homo sapiens
acccaggctgcttctcagtggc

SEQ ID NO: 8410523 - DNA, 22 bp, Homo sapiens
agggcctgggccagcacccttt

SEQ ID NO: 8410524 - DNA, 22 bp, Homo sapiens
accatttgactctctaaggata

SEQ ID NO: 8410525 - DNA, 20 bp, Homo sapiens
agggcagcttgaggagccgg

SEQ ID NO: 8410526 - DNA, 22 bp, Homo sapiens
accattctttacacttatttct

SEQ ID NO: 8410527 - DNA, 22 bp, Homo sapiens
accattctgtctctttacaaat

SEQ ID NO: 8410528 - DNA, 22 bp, Homo sapiens
acatttttattcatcaaagcag

SEQ ID NO: 8410529 - DNA, 22 bp, Homo sapiens
agggaatgtagcaagatgccaa

SEQ ID NO: 8410530 - DNA, 22 bp, Homo sapiens
acttcaaattttcagaagaaat

SEQ ID NO: 8410531 - DNA, 22 bp, Homo sapiens
actgtgttgccttcccccagcc

SEQ ID NO: 8410532 - DNA, 22 bp, Homo sapiens
actgtgtggaccactctgaggc

SEQ ID NO: 8410533 - DNA, 22 bp, Homo sapiens
acttggcaagtatctataaagt

SEQ ID NO: 8410534 - DNA, 22 bp, Homo sapiens
acttgcatcttagagactcacc

SEQ ID NO: 8410535 - DNA, 22 bp, Homo sapiens
acttgatttttataataaatgg

SEQ ID NO: 8410536 - DNA, 22 bp, Homo sapiens
acttcatattgtttccactaga

SEQ ID NO: 8410537 - DNA, 22 bp, Homo sapiens
acttcattcattttcacgaatg

SEQ ID NO: 8410538 - DNA, 22 bp, Homo sapiens
acttcattgctaagaacaaggt

SEQ ID NO: 8410539 - DNA, 22 bp, Homo sapiens
agtttacacttttgattcttat

SEQ ID NO: 8410540 - DNA, 22 bp, Homo sapiens
agtttacagatgctacaggagc

SEQ ID NO: 8410541 - DNA, 22 bp, Homo sapiens
agtttatgtaaaattagtaatg

SEQ ID NO: 8410542 - DNA, 22 bp, Homo sapiens
agtttacataaaaaggcagagg

SEQ ID NO: 8410543 - DNA, 22 bp, Homo sapiens
agtttacatatttgtcggagtc

SEQ ID NO: 8410544 - DNA, 22 bp, Homo sapiens
agtttacatgacgtgtatttca

SEQ ID NO: 8410545 - DNA, 17 bp, Homo sapiens
actgtcttttacaccct

SEQ ID NO: 8410546 - DNA, 22 bp, Homo sapiens
actgtctttattagaatcttat

SEQ ID NO: 8410547 - DNA, 22 bp, Homo sapiens
actgtctttgagctggaggagg

SEQ ID NO: 8410548 - DNA, 22 bp, Homo sapiens
actgtcttgttccaagactaaa

SEQ ID NO: 8410549 - DNA, 22 bp, Homo sapiens
actgtcttgtgttaaagaacca

SEQ ID NO: 8410550 - DNA, 22 bp, Homo sapiens
actgtcttccaggtctggaggt

SEQ ID NO: 8410551 - DNA, 22 bp, Homo sapiens
actgtcttcatatctgtgtctc

SEQ ID NO: 8410552 - DNA, 22 bp, Homo sapiens
actgtcttgctatgagctccca

SEQ ID NO: 8410553 - DNA, 22 bp, Homo sapiens
actgtctgctggcccctggtta

SEQ ID NO: 8410554 - DNA, 22 bp, Homo sapiens
actgtcttcaaatgaatatatt

SEQ ID NO: 8410555 - DNA, 22 bp, Homo sapiens
actgtgccttcttattgggtcc

SEQ ID NO: 8410556 - DNA, 22 bp, Homo sapiens
actgtgcctttcacttgcactt

SEQ ID NO: 8410557 - DNA, 22 bp, Homo sapiens
agaagaaatgaggccgttctgc

SEQ ID NO: 8410558 - DNA, 19 bp, Homo sapiens
atcagcaaggtaggatgtg

SEQ ID NO: 8410559 - DNA, 22 bp, Homo sapiens
agaaacatcattggaacacaag

SEQ ID NO: 8410560 - DNA, 22 bp, Homo sapiens
atataattctcaggtttgacta

SEQ ID NO: 8410561 - DNA, 22 bp, Homo sapiens
acttggtgtattagctctcact

SEQ ID NO: 8410562 - DNA, 22 bp, Homo sapiens
acttggtgaagtcaggtgatta

SEQ ID NO: 8410563 - DNA, 22 bp, Homo sapiens
atatatttgagaatattcatga

SEQ ID NO: 8410564 - DNA, 22 bp, Homo sapiens
atatatttactctcctgttgca

SEQ ID NO: 8410565 - DNA, 22 bp, Homo sapiens
atatatttgagaatattcatga

SEQ ID NO: 8410566 - DNA, 22 bp, Homo sapiens
agaaaattagattttactgtgt

SEQ ID NO: 8410567 - DNA, 22 bp, Homo sapiens
atatctttcaaagccaaaagta

SEQ ID NO: 8410568 - DNA, 22 bp, Homo sapiens
actccaggcatctgcttctgct

SEQ ID NO: 8410569 - DNA, 22 bp, Homo sapiens
agtctctcttgggtgtggtttg

SEQ ID NO: 8410570 - DNA, 22 bp, Homo sapiens
agtcggaagctgtgcgtaaatc

SEQ ID NO: 8410571 - DNA, 22 bp, Homo sapiens
actggcaatagcaaatgcttgg

SEQ ID NO: 8410572 - DNA, 22 bp, Homo sapiens
actgctgagagcaatcccaaac

SEQ ID NO: 8410573 - DNA, 22 bp, Homo sapiens
actaaagaagccaaagttttct

SEQ ID NO: 8410574 - DNA, 22 bp, Homo sapiens
acgggccttctcttcaggcgag

SEQ ID NO: 8410575 - DNA, 22 bp, Homo sapiens
actaaaaactactgccaatagc

SEQ ID NO: 8410576 - DNA, 19 bp, Homo sapiens
actaaaaatgatgtttgag

SEQ ID NO: 8410577 - DNA, 23 bp, Homo sapiens
actcaaaatttggcatttgagga

SEQ ID NO: 8410578 - DNA, 22 bp, Homo sapiens
actattagcatatcatgaatgg

SEQ ID NO: 8410579 - DNA, 22 bp, Homo sapiens
actattcacagattcagtgttc

SEQ ID NO: 8410580 - DNA, 22 bp, Homo sapiens
actattcaagtgctcattcaga

SEQ ID NO: 8410581 - DNA, 22 bp, Homo sapiens
actattcacctttcatgcagga

SEQ ID NO: 8410582 - DNA, 22 bp, Homo sapiens
acctggttcctcctcactgctg

SEQ ID NO: 8410583 - DNA, 23 bp, Homo sapiens
acctgtctgcctcccaccatcaa

SEQ ID NO: 8410584 - DNA, 22 bp, Homo sapiens
cacatcaggtagacctacagag

SEQ ID NO: 8410585 - DNA, 19 bp, Homo sapiens
cacatcagcagggctgtgg

SEQ ID NO: 8410586 - DNA, 22 bp, Homo sapiens
cacatcagggctgcttgggggt

SEQ ID NO: 8410587 - DNA, 22 bp, Homo sapiens
agcagctgtttgttgaattggt

SEQ ID NO: 8410588 - DNA, 22 bp, Homo sapiens
caatgacatctccctgctctaa

SEQ ID NO: 8410589 - DNA, 22 bp, Homo sapiens
caatgacaggttcatgactcct

SEQ ID NO: 8410590 - DNA, 22 bp, Homo sapiens
cacaggctgcccgcagctggga

SEQ ID NO: 8410591 - DNA, 22 bp, Homo sapiens
cacaggaggcaatggtaagatt

SEQ ID NO: 8410592 - DNA, 22 bp, Homo sapiens
caactgagcagtagcgtctgga

SEQ ID NO: 8410593 - DNA, 22 bp, Homo sapiens
agcagcaagtgtaactgaatat

SEQ ID NO: 8410594 - DNA, 22 bp, Homo sapiens
agcagcaataataaagtaatac

SEQ ID NO: 8410595 - DNA, 22 bp, Homo sapiens
caaatgcagtccctttgttgct

SEQ ID NO: 8410596 - DNA, 22 bp, Homo sapiens
caaatgcagattcaggagttct

SEQ ID NO: 8410597 - DNA, 22 bp, Homo sapiens
caaattaatgtgtctcaaaata

SEQ ID NO: 8410598 - DNA, 22 bp, Homo sapiens
agcacttaactgacagtactat

SEQ ID NO: 8410599 - DNA, 22 bp, Homo sapiens
agcaaacattcagcagattggc

SEQ ID NO: 8410600 - DNA, 22 bp, Homo sapiens
cagaagaaagtggggagacaag

SEQ ID NO: 8410601 - DNA, 22 bp, Homo sapiens
cagaagaatggtgtctgagctc

SEQ ID NO: 8410602 - DNA, 22 bp, Homo sapiens
cagaagagatgaaatagtatta

SEQ ID NO: 8410603 - DNA, 22 bp, Homo sapiens
cactctgtgattgcagcattcc

SEQ ID NO: 8410604 - DNA, 22 bp, Homo sapiens
agccacagcaacaagtgcaatt

SEQ ID NO: 8410605 - DNA, 22 bp, Homo sapiens
cagagagggcggccctggcttc

SEQ ID NO: 8410606 - DNA, 22 bp, Homo sapiens
cagagcacagagcttgggacaa

SEQ ID NO: 8410607 - DNA, 22 bp, Homo sapiens
cagacagcaggcctggatgtgt

SEQ ID NO: 8410608 - DNA, 22 bp, Homo sapiens
agccctaaattatctttatttt

SEQ ID NO: 8410609 - DNA, 22 bp, Homo sapiens
agcccggcttccccggttgcta

SEQ ID NO: 8410610 - DNA, 22 bp, Homo sapiens
cagaggctcagatggccctggc

SEQ ID NO: 8410611 - DNA, 22 bp, Homo sapiens
cagcaggacgtccaagtgctat

SEQ ID NO: 8410612 - DNA, 22 bp, Homo sapiens
agctcccaggcagtcatgagga

SEQ ID NO: 8410613 - DNA, 22 bp, Homo sapiens
agctcccagcagagctggccac

SEQ ID NO: 8410614 - DNA, 22 bp, Homo sapiens
agctcccattatcttctgaaac

SEQ ID NO: 8410615 - DNA, 22 bp, Homo sapiens
cagccagatcagggcaggggtt

SEQ ID NO: 8410616 - DNA, 22 bp, Homo sapiens
cagccagatcaaactcagatgt

SEQ ID NO: 8410617 - DNA, 22 bp, Homo sapiens
cagccagagaaagggcactgcc

SEQ ID NO: 8410618 - DNA, 22 bp, Homo sapiens
cagccagagaggaaggaatgca

SEQ ID NO: 8410619 - DNA, 22 bp, Homo sapiens
agctcctactctatgccagaca

SEQ ID NO: 8410620 - DNA, 22 bp, Homo sapiens
atttagcacctccatctcaaca

SEQ ID NO: 8410621 - DNA, 22 bp, Homo sapiens
atttattatgggatttggctca

SEQ ID NO: 8410622 - DNA, 22 bp, Homo sapiens
atttattattgtggttacttct

SEQ ID NO: 8410623 - DNA, 22 bp, Homo sapiens
atttagcaaaaaatgatgaagc

SEQ ID NO: 8410624 - DNA, 22 bp, Homo sapiens
atttagcaagcaggcaaattca

SEQ ID NO: 8410625 - DNA, 22 bp, Homo sapiens
atttagcaagagtacaaaataa

SEQ ID NO: 8410626 - DNA, 23 bp, Homo sapiens
atttaatgctgagttgaatgtta

SEQ ID NO: 8410627 - DNA, 22 bp, Homo sapiens
atttaagaggctgctagagtat

SEQ ID NO: 8410628 - DNA, 22 bp, Homo sapiens
atttaacaagacagagaactgg

SEQ ID NO: 8410629 - DNA, 22 bp, Homo sapiens
atttaacaagacagagaactgg

SEQ ID NO: 8410630 - DNA, 22 bp, Homo sapiens
attcttcatacctactgaggtt

SEQ ID NO: 8410631 - DNA, 22 bp, Homo sapiens
attcttcatgttgaagctgtca

SEQ ID NO: 8410632 - DNA, 23 bp, Homo sapiens
attcttcattatcttctagaaaa

SEQ ID NO: 8410633 - DNA, 22 bp, Homo sapiens
attcttcatttactgttacttg

SEQ ID NO: 8410634 - DNA, 22 bp, Homo sapiens
agatggttttgtctttatgatt

SEQ ID NO: 8410635 - DNA, 22 bp, Homo sapiens
agatgaagatatctgcaggggc

SEQ ID NO: 8410636 - DNA, 22 bp, Homo sapiens
atttcattgaagttaattcttc

SEQ ID NO: 8410637 - DNA, 22 bp, Homo sapiens
atttgctggtgaatgtatagct

SEQ ID NO: 8410638 - DNA, 22 bp, Homo sapiens
atttgctgtgtgctttagagac

SEQ ID NO: 8410639 - DNA, 22 bp, Homo sapiens
atttgctgatggcatttgagct

SEQ ID NO: 8410640 - DNA, 22 bp, Homo sapiens
agcaaacagtttctggggatct

SEQ ID NO: 8410641 - DNA, 22 bp, Homo sapiens
agcaaaataaggtaatttattg

SEQ ID NO: 8410642 - DNA, 20 bp, Homo sapiens
agcaaaatgcaagattttca

SEQ ID NO: 8410643 - DNA, 22 bp, Homo sapiens
atgttaaataatcccttaaagc

SEQ ID NO: 8410644 - DNA, 22 bp, Homo sapiens
atgttaaagatggtgggaaatt

SEQ ID NO: 8410645 - DNA, 22 bp, Homo sapiens
atgttaaatggtttattattaa

SEQ ID NO: 8410646 - DNA, 22 bp, Homo sapiens
atgttacaaccctgaggagccg

SEQ ID NO: 8410647 - DNA, 22 bp, Homo sapiens
atgttacaaatcctacaggtag

SEQ ID NO: 8410648 - DNA, 22 bp, Homo sapiens
atgttaaatggtttattattaa

SEQ ID NO: 8410649 - DNA, 22 bp, Homo sapiens
atgttaaatggtttattattaa

SEQ ID NO: 8410650 - DNA, 20 bp, Homo sapiens
atgttaaatagcatttagag

SEQ ID NO: 8410651 - DNA, 22 bp, Homo sapiens
atgttaaatagccatttgtttg

SEQ ID NO: 8410652 - DNA, 20 bp, Homo sapiens
attagctcaggtgaggtcat

SEQ ID NO: 8410653 - DNA, 22 bp, Homo sapiens
attagcaatcacgcagtcattt

SEQ ID NO: 8410654 - DNA, 22 bp, Homo sapiens
attagcaagttttccagctaat

SEQ ID NO: 8410655 - DNA, 22 bp, Homo sapiens
attagcaattgtgcatctagta

SEQ ID NO: 8410656 - DNA, 22 bp, Homo sapiens
attagcaattgccctgtgcaat

SEQ ID NO: 8410657 - DNA, 22 bp, Homo sapiens
attaaagaaacccagcatgtga

SEQ ID NO: 8410658 - DNA, 22 bp, Homo sapiens
attaaactgagcaaattaacat

SEQ ID NO: 8410659 - DNA, 22 bp, Homo sapiens
atgttttaaatatgtgtgtaaa

SEQ ID NO: 8410660 - DNA, 22 bp, Homo sapiens
attatacattttgtgtagagat

SEQ ID NO: 8410661 - DNA, 22 bp, Homo sapiens
attataaagaacatgtgtgtgg

SEQ ID NO: 8410662 - DNA, 22 bp, Homo sapiens
attataaacctttgagggtggg

SEQ ID NO: 8410663 - DNA, 22 bp, Homo sapiens
attcacactttacttctttcca

SEQ ID NO: 8410664 - DNA, 22 bp, Homo sapiens
attcacacatactcatgtgtga

SEQ ID NO: 8410665 - DNA, 22 bp, Homo sapiens
attcacacacatttagagcaga

SEQ ID NO: 8410666 - DNA, 22 bp, Homo sapiens
attcacactgtatacacaggat

SEQ ID NO: 8410667 - DNA, 22 bp, Homo sapiens
attcaaagcccagtaaacattg

SEQ ID NO: 8410668 - DNA, 22 bp, Homo sapiens
attcagcataatcagtagcttg

SEQ ID NO: 8410669 - DNA, 22 bp, Homo sapiens
attcagcatgcaattaggtaat

SEQ ID NO: 8410670 - DNA, 22 bp, Homo sapiens
attcagcaatgagcttggattt

SEQ ID NO: 8410671 - DNA, 22 bp, Homo sapiens
attcagcaatgagcttggattt

SEQ ID NO: 8410672 - DNA, 22 bp, Homo sapiens
attcagcaaacatttattgtgt

SEQ ID NO: 8410673 - DNA, 22 bp, Homo sapiens
attcagcaaacatttattatct

SEQ ID NO: 8410674 - DNA, 22 bp, Homo sapiens
agagggatcaccctgtttctgg

SEQ ID NO: 8410675 - DNA, 22 bp, Homo sapiens
agagggatcaccctgtttctgg

SEQ ID NO: 8410676 - DNA, 22 bp, Homo sapiens
agagggatcaccctgtttctgg

SEQ ID NO: 8410677 - DNA, 22 bp, Homo sapiens
attctgggaactttgtctctca

SEQ ID NO: 8410678 - DNA, 22 bp, Homo sapiens
attctggggctggttattttga

SEQ ID NO: 8410679 - DNA, 22 bp, Homo sapiens
attctgggttcatgagtgagct

SEQ ID NO: 8410680 - DNA, 22 bp, Homo sapiens
atgcttgcccatgtttctgaag

SEQ ID NO: 8410681 - DNA, 22 bp, Homo sapiens
atgcagggtctccgtgtgacga

SEQ ID NO: 8410682 - DNA, 22 bp, Homo sapiens
atgtccagccaaccactggatt

SEQ ID NO: 8410683 - DNA, 22 bp, Homo sapiens
atgtccagagtaaagcacattc

SEQ ID NO: 8410684 - DNA, 22 bp, Homo sapiens
atgtccagagtgtcctggaaag

SEQ ID NO: 8410685 - DNA, 22 bp, Homo sapiens
atgtccagagccggcctgctga

SEQ ID NO: 8410686 - DNA, 20 bp, Homo sapiens
atgtccagtgactggaccat

SEQ ID NO: 8410687 - DNA, 22 bp, Homo sapiens
atgtccagtttctacacacata

SEQ ID NO: 8410688 - DNA, 22 bp, Homo sapiens
atgtccagggcacacagcagtg

SEQ ID NO: 8410689 - DNA, 22 bp, Homo sapiens
atgtccaggatctatccccaga

SEQ ID NO: 8410690 - DNA, 22 bp, Homo sapiens
agaatacagtatgcaaaaagat

SEQ ID NO: 8410691 - DNA, 21 bp, Homo sapiens
agaataatggtatcatttgct

SEQ ID NO: 8410692 - DNA, 22 bp, Homo sapiens
atctttatatatctcctctgaa

SEQ ID NO: 8410693 - DNA, 22 bp, Homo sapiens
agaatacagttcagtaatggat

SEQ ID NO: 8410694 - DNA, 22 bp, Homo sapiens
agaagaaatgtgaaggccactg

SEQ ID NO: 8410695 - DNA, 22 bp, Homo sapiens
atcttattgctgttgccagata

SEQ ID NO: 8410696 - DNA, 22 bp, Homo sapiens
atctttacagtgtaagtgcaga

SEQ ID NO: 8410697 - DNA, 21 bp, Homo sapiens
agacaggtcagggagaggtga

SEQ ID NO: 8410698 - DNA, 21 bp, Homo sapiens
agacagtaactcttctactcc

SEQ ID NO: 8410699 - DNA, 22 bp, Homo sapiens
agacagtgatgtaagcaggagt

SEQ ID NO: 8410700 - DNA, 22 bp, Homo sapiens
agacagtgcaagaagagcaggc

SEQ ID NO: 8410701 - DNA, 22 bp, Homo sapiens
atgcaggattagaaagttgcct

SEQ ID NO: 8410702 - DNA, 22 bp, Homo sapiens
agacaggcagaggctgcagagg

SEQ ID NO: 8410703 - DNA, 22 bp, Homo sapiens
agacaggcagggcatggaaaaa

SEQ ID NO: 8410704 - DNA, 22 bp, Homo sapiens
agacaatatataattttagttg

SEQ ID NO: 8410705 - DNA, 21 bp, Homo sapiens
agaattcttaagtattctaat

SEQ ID NO: 8410706 - DNA, 22 bp, Homo sapiens
agaatgcagtttgaaataaggt

SEQ ID NO: 8410707 - DNA, 22 bp, Homo sapiens
agaatgcaagataaactttatt

SEQ ID NO: 8410708 - DNA, 22 bp, Homo sapiens
caggagtctctcttgagcccag

SEQ ID NO: 8410709 - DNA, 22 bp, Homo sapiens
caggagtccatctggcctggtg

SEQ ID NO: 8410710 - DNA, 22 bp, Homo sapiens
caggagtccctctggccagcat

SEQ ID NO: 8410711 - DNA, 22 bp, Homo sapiens
cagcttgaaatattaggagatg

SEQ ID NO: 8410712 - DNA, 22 bp, Homo sapiens
cagctttgccaagtaaggtctt

SEQ ID NO: 8410713 - DNA, 22 bp, Homo sapiens
cagctttgcaggctggtcagtg

SEQ ID NO: 8410714 - DNA, 22 bp, Homo sapiens
cagctttggcccagtcgggagg

SEQ ID NO: 8410715 - DNA, 22 bp, Homo sapiens
cagctttttagaatctagggca

SEQ ID NO: 8410716 - DNA, 22 bp, Homo sapiens
cagctttgtgcaatgcagtctc

SEQ ID NO: 8410717 - DNA, 22 bp, Homo sapiens
cagctttgtggccttgacctcg

SEQ ID NO: 8410718 - DNA, 22 bp, Homo sapiens
cagcttctggcgtggagcctga

SEQ ID NO: 8410719 - DNA, 21 bp, Homo sapiens
cagcttcttctgtgacctggt

SEQ ID NO: 8410720 - DNA, 22 bp, Homo sapiens
cagcttcttcagtcctggagct

SEQ ID NO: 8410721 - DNA, 22 bp, Homo sapiens
cagctcctgggccatctcctag

SEQ ID NO: 8410722 - DNA, 23 bp, Homo sapiens
agctctgaaatagggaaagagga

SEQ ID NO: 8410723 - DNA, 22 bp, Homo sapiens
agctctgacattgattctcagc

SEQ ID NO: 8410724 - DNA, 22 bp, Homo sapiens
aggaacagaagagcaatgcagg

SEQ ID NO: 8410725 - DNA, 22 bp, Homo sapiens
cagggccagcgcccaggcccag

SEQ ID NO: 8410726 - DNA, 22 bp, Homo sapiens
aggaaatgcaggcaaatactct

SEQ ID NO: 8410727 - DNA, 22 bp, Homo sapiens
aggaaatgggaatagatggtat

SEQ ID NO: 8410728 - DNA, 22 bp, Homo sapiens
aggaaatgcaggcaaatactct

SEQ ID NO: 8410729 - DNA, 22 bp, Homo sapiens
aggaaatgtacaaatgaagatg

SEQ ID NO: 8410730 - DNA, 22 bp, Homo sapiens
aggaaatgtagtcctcatctcc

SEQ ID NO: 8410731 - DNA, 22 bp, Homo sapiens
cagggccagagagggctggctg

SEQ ID NO: 8410732 - DNA, 22 bp, Homo sapiens
aggaaactaaagcccagagagg

SEQ ID NO: 8410733 - DNA, 22 bp, Homo sapiens
agctttatatgttgtttctcca

SEQ ID NO: 8410734 - DNA, 22 bp, Homo sapiens
agctttatagaaaggatcagtg

SEQ ID NO: 8410735 - DNA, 22 bp, Homo sapiens
agctttatataaaagagtacat

SEQ ID NO: 8410736 - DNA, 22 bp, Homo sapiens
agctttacctgccttggggcac

SEQ ID NO: 8410737 - DNA, 22 bp, Homo sapiens
agctgtgtgtgcttgggattat

SEQ ID NO: 8410738 - DNA, 22 bp, Homo sapiens
agctgtgtgcccatggtggagg

SEQ ID NO: 8410739 - DNA, 22 bp, Homo sapiens
agctgtgtttccagatggtagc

SEQ ID NO: 8410740 - DNA, 22 bp, Homo sapiens
agcttgatttctctgcagtgtg

SEQ ID NO: 8410741 - DNA, 22 bp, Homo sapiens
agctgtggccagatgtgagcgg

SEQ ID NO: 8410742 - DNA, 22 bp, Homo sapiens
caggcctccactccacgcagac

SEQ ID NO: 8410743 - DNA, 21 bp, Homo sapiens
catttacatgacagattggtt

SEQ ID NO: 8410744 - DNA, 22 bp, Homo sapiens
cattcccttggggagttcatgc

SEQ ID NO: 8410745 - DNA, 22 bp, Homo sapiens
cattccctgtctcttcaatcct

SEQ ID NO: 8410746 - DNA, 22 bp, Homo sapiens
cattccaaggccaagtctaaga

SEQ ID NO: 8410747 - DNA, 22 bp, Homo sapiens
cattcaaacattaatttattca

SEQ ID NO: 8410748 - DNA, 22 bp, Homo sapiens
cattcaaagcaggaaaggcctt

SEQ ID NO: 8410749 - DNA, 22 bp, Homo sapiens
cattcaaaagctccatgtttgt

SEQ ID NO: 8410750 - DNA, 22 bp, Homo sapiens
cattcaaaatgggctgacctgt

SEQ ID NO: 8410751 - DNA, 22 bp, Homo sapiens
catggcctgcctcctcctggtg

SEQ ID NO: 8410752 - DNA, 22 bp, Homo sapiens
cattaagatttttttctactgg

SEQ ID NO: 8410753 - DNA, 22 bp, Homo sapiens
catggcggtcaggatgtaggtg

SEQ ID NO: 8410754 - DNA, 22 bp, Homo sapiens
catgcaggaggaaaaagcagct

SEQ ID NO: 8410755 - DNA, 20 bp, Homo sapiens
aggaggcaatgtagataagc

SEQ ID NO: 8410756 - DNA, 20 bp, Homo sapiens
aggaggcaatgtagataagc

SEQ ID NO: 8410757 - DNA, 22 bp, Homo sapiens
aggaggaattgacacagaagcc

SEQ ID NO: 8410758 - DNA, 22 bp, Homo sapiens
aggaggaatacaatccagcagc

SEQ ID NO: 8410759 - DNA, 22 bp, Homo sapiens
aggaggaagggaagacaagtaa

SEQ ID NO: 8410760 - DNA, 22 bp, Homo sapiens
aggaggaaggcttcattaggtt

SEQ ID NO: 8410761 - DNA, 22 bp, Homo sapiens
aggagaggcatcaagaaaatcg

SEQ ID NO: 8410762 - DNA, 18 bp, Homo sapiens
aggagaaagggaccaggg

SEQ ID NO: 8410763 - DNA, 19 bp, Homo sapiens
aggaaggaacctgagtctg

SEQ ID NO: 8410764 - DNA, 19 bp, Homo sapiens
aggaaggaacctgagtctg

SEQ ID NO: 8410765 - DNA, 22 bp, Homo sapiens
cagtcctgggcacagccctggg

SEQ ID NO: 8410766 - DNA, 22 bp, Homo sapiens
cagtcctgaggaagagctgctg

SEQ ID NO: 8410767 - DNA, 22 bp, Homo sapiens
ccagttcttcttgacacgaaag

SEQ ID NO: 8410768 - DNA, 22 bp, Homo sapiens
ccagtttaggtactaggctcta

SEQ ID NO: 8410769 - DNA, 22 bp, Homo sapiens
ccagtttaggtactaggctcta

SEQ ID NO: 8410770 - DNA, 22 bp, Homo sapiens
aggctctgaggcagattttcgt

SEQ ID NO: 8410771 - DNA, 22 bp, Homo sapiens
aggctctgatcaggtggctgtg

SEQ ID NO: 8410772 - DNA, 22 bp, Homo sapiens
aggctctgcatccaggctttat

SEQ ID NO: 8410773 - DNA, 22 bp, Homo sapiens
ccaggcagggctcaaggaacct

SEQ ID NO: 8410774 - DNA, 22 bp, Homo sapiens
aggcctcctggctccaggcctt

SEQ ID NO: 8410775 - DNA, 22 bp, Homo sapiens
aggcctcctggctccaggcctt

SEQ ID NO: 8410776 - DNA, 17 bp, Homo sapiens
aggcctccctccaggcc

SEQ ID NO: 8410777 - DNA, 22 bp, Homo sapiens
aggcctccagccacatgccagt

SEQ ID NO: 8410778 - DNA, 21 bp, Homo sapiens
aggctcccagaaatgggcatc

SEQ ID NO: 8410779 - DNA, 22 bp, Homo sapiens
aggctcccaagcactgacccca

SEQ ID NO: 8410780 - DNA, 22 bp, Homo sapiens
ccaggcctcacctgcccaccta

SEQ ID NO: 8410781 - DNA, 22 bp, Homo sapiens
ccaggcctagcccctgagggta

SEQ ID NO: 8410782 - DNA, 22 bp, Homo sapiens
aggcagtgctcaagacagcagc

SEQ ID NO: 8410783 - DNA, 22 bp, Homo sapiens
aggcatgactttggctgaagaa

SEQ ID NO: 8410784 - DNA, 22 bp, Homo sapiens
aggccaagtagccgctgtccta

SEQ ID NO: 8410785 - DNA, 22 bp, Homo sapiens
aggccaagattttggatcagct

SEQ ID NO: 8410786 - DNA, 22 bp, Homo sapiens
agggcagctctcacctctggcc

SEQ ID NO: 8410787 - DNA, 22 bp, Homo sapiens
agggcagctggaaggtggcttc

SEQ ID NO: 8410788 - DNA, 22 bp, Homo sapiens
agggcagcctctcagcctaggt

SEQ ID NO: 8410789 - DNA, 22 bp, Homo sapiens
agggcagctaaggtgctgactg

SEQ ID NO: 8410790 - DNA, 22 bp, Homo sapiens
agggaggagtcctcaaagtcat

SEQ ID NO: 8410791 - DNA, 22 bp, Homo sapiens
agggcagcagctcctcctagct

SEQ ID NO: 8410792 - DNA, 22 bp, Homo sapiens
agggcagcccttctgggagggc

SEQ ID NO: 8410793 - DNA, 22 bp, Homo sapiens
agggcagccatgagccttcagg

SEQ ID NO: 8410794 - DNA, 22 bp, Homo sapiens
cctagacattaagcttgggttt

SEQ ID NO: 8410795 - DNA, 22 bp, Homo sapiens
cctcccatccctgcaagagagc

SEQ ID NO: 8410796 - DNA, 22 bp, Homo sapiens
cctccccacagcccaggagact

SEQ ID NO: 8410797 - DNA, 22 bp, Homo sapiens
cctccccacaggccaaataggc

SEQ ID NO: 8410798 - DNA, 21 bp, Homo sapiens
cctccaggagcagagccctga

SEQ ID NO: 8410799 - DNA, 22 bp, Homo sapiens
ccatgacattttaattttcact

SEQ ID NO: 8410800 - DNA, 22 bp, Homo sapiens
ccataatctggctttgagagag

SEQ ID NO: 8410801 - DNA, 21 bp, Homo sapiens
ccataatcttaggatcaaaat

SEQ ID NO: 8410802 - DNA, 22 bp, Homo sapiens
ccataatcatgtaagtaaattc

SEQ ID NO: 8410803 - DNA, 23 bp, Homo sapiens
ccataatcagggttgtggggtcc

SEQ ID NO: 8410804 - DNA, 22 bp, Homo sapiens
ccataatctggctttgagagag

SEQ ID NO: 8410805 - DNA, 22 bp, Homo sapiens
ccataatcgtgtgttaaataat

SEQ ID NO: 8410806 - DNA, 22 bp, Homo sapiens
cccagctctgccatctacccac

SEQ ID NO: 8410807 - DNA, 22 bp, Homo sapiens
cccagctctgcagacctgccct

SEQ ID NO: 8410808 - DNA, 22 bp, Homo sapiens
cccagctctgcagacctgccct

SEQ ID NO: 8410809 - DNA, 22 bp, Homo sapiens
aggctgtgtttaagtggtaatg

SEQ ID NO: 8410810 - DNA, 22 bp, Homo sapiens
aggctgtgttctggttcttagc

SEQ ID NO: 8410811 - DNA, 22 bp, Homo sapiens
aggctgtgtggtcatggtggct

SEQ ID NO: 8410812 - DNA, 22 bp, Homo sapiens
agggaatgctccgtataaatct

SEQ ID NO: 8410813 - DNA, 22 bp, Homo sapiens
agggagagtagatatcaggtgt

SEQ ID NO: 8410814 - DNA, 22 bp, Homo sapiens
agggaagggcagggtctatgca

SEQ ID NO: 8410815 - DNA, 22 bp, Homo sapiens
agggaaggaggccatgtgtccc

SEQ ID NO: 8410816 - DNA, 22 bp, Homo sapiens
aggcttagactacctggtctgt

SEQ ID NO: 8410817 - DNA, 22 bp, Homo sapiens
aggcttagaaattcagctgagt

SEQ ID NO: 8410818 - DNA, 22 bp, Homo sapiens
aggcttagaaagggtaagtgac

SEQ ID NO: 8410819 - DNA, 22 bp, Homo sapiens
ctcggcaggtggaggttgtagt

SEQ ID NO: 8410820 - DNA, 19 bp, Homo sapiens
ctctccacctaacaggtat

SEQ ID NO: 8410821 - DNA, 23 bp, Homo sapiens
ctctccaccttcccacccaggga

SEQ ID NO: 8410822 - DNA, 19 bp, Homo sapiens
ctctggagaacaatagtgc

SEQ ID NO: 8410823 - DNA, 22 bp, Homo sapiens
agtggcttgctctgcctcagcc

SEQ ID NO: 8410824 - DNA, 22 bp, Homo sapiens
agtggcttatctgggacagcta

SEQ ID NO: 8410825 - DNA, 23 bp, Homo sapiens
agtgacaatgggccagaggtggc

SEQ ID NO: 8410826 - DNA, 22 bp, Homo sapiens
agtctcagagtacctgagggac

SEQ ID NO: 8410827 - DNA, 22 bp, Homo sapiens
agtcccaacagcttacaaggaa

SEQ ID NO: 8410828 - DNA, 21 bp, Homo sapiens
ctcaaaattctttctgttgga

SEQ ID NO: 8410829 - DNA, 22 bp, Homo sapiens
ctcaaaatggttaattttaata

SEQ ID NO: 8410830 - DNA, 22 bp, Homo sapiens
cggggtccctgcccacccatac

SEQ ID NO: 8410831 - DNA, 22 bp, Homo sapiens
cggggtccgggcagtaggctgc

SEQ ID NO: 8410832 - DNA, 22 bp, Homo sapiens
ctcagatgtgttggatggaaaa

SEQ ID NO: 8410833 - DNA, 22 bp, Homo sapiens
ctcagatgtagaaagattgtga

SEQ ID NO: 8410834 - DNA, 22 bp, Homo sapiens
ctcagcaacagcgacttaaggg

SEQ ID NO: 8410835 - DNA, 22 bp, Homo sapiens
ctcagcaagattaagcagcttg

SEQ ID NO: 8410836 - DNA, 22 bp, Homo sapiens
ctcagcaacccacacacggtct

SEQ ID NO: 8410837 - DNA, 22 bp, Homo sapiens
ctcagcaagacccccaccgtgt

SEQ ID NO: 8410838 - DNA, 22 bp, Homo sapiens
cctttattcaattagtcctaat

SEQ ID NO: 8410839 - DNA, 22 bp, Homo sapiens
cgaggcagggaagctgcaaaag

SEQ ID NO: 8410840 - DNA, 22 bp, Homo sapiens
cgagcatgatgacggctgtggc

SEQ ID NO: 8410841 - DNA, 22 bp, Homo sapiens
cggctcactgcagctccgcctc

SEQ ID NO: 8410842 - DNA, 22 bp, Homo sapiens
cggccgcagcagtgtcggccca

SEQ ID NO: 8410843 - DNA, 22 bp, Homo sapiens
agtatatggggaattgcataat

SEQ ID NO: 8410844 - DNA, 22 bp, Homo sapiens
agggtctgttgtttgttctgga

SEQ ID NO: 8410845 - DNA, 21 bp, Homo sapiens
agggtcaggaaccagggtacc

SEQ ID NO: 8410846 - DNA, 22 bp, Homo sapiens
ataaaggcaacaccagggtatg

SEQ ID NO: 8410847 - DNA, 17 bp, Homo sapiens
ataaaggcaagtattat

SEQ ID NO: 8410848 - DNA, 22 bp, Homo sapiens
ataaaggctggctgctgtgagc

SEQ ID NO: 8410849 - DNA, 22 bp, Homo sapiens
ataaaggccaaaatttgcattt

SEQ ID NO: 8410850 - DNA, 22 bp, Homo sapiens
ataaaggcagattttggacctc

SEQ ID NO: 8410851 - DNA, 22 bp, Homo sapiens
ataaaggcagagtagggaggaa

SEQ ID NO: 8410852 - DNA, 22 bp, Homo sapiens
ctgcagctaaggaatgtggttg

SEQ ID NO: 8410853 - DNA, 22 bp, Homo sapiens
ctgcagagcagccagtccccca

SEQ ID NO: 8410854 - DNA, 22 bp, Homo sapiens
agtttaactttgtaaacgtgag

SEQ ID NO: 8410855 - DNA, 22 bp, Homo sapiens
agtttaactttggaaaactata

SEQ ID NO: 8410856 - DNA, 22 bp, Homo sapiens
ctgcagagcaagttctctgttg

SEQ ID NO: 8410857 - DNA, 21 bp, Homo sapiens
agtttgatgcaatttctgaga

SEQ ID NO: 8410858 - DNA, 22 bp, Homo sapiens
ctgaggcatcatggagaacagt

SEQ ID NO: 8410859 - DNA, 22 bp, Homo sapiens
ctgaggcttgtcctctcagctt

SEQ ID NO: 8410860 - DNA, 22 bp, Homo sapiens
ctgaggctggggaagggaagtg

SEQ ID NO: 8410861 - DNA, 22 bp, Homo sapiens
ctgagggtgctattcttgcctt

SEQ ID NO: 8410862 - DNA, 22 bp, Homo sapiens
ctgaggtagccatggcccaagt

SEQ ID NO: 8410863 - DNA, 22 bp, Homo sapiens
ctggaggaaaacaactgcagac

SEQ ID NO: 8410864 - DNA, 22 bp, Homo sapiens
ctggaggaataatctcctaccc

SEQ ID NO: 8410865 - DNA, 22 bp, Homo sapiens
ctggagagaccgaaagaggctg

SEQ ID NO: 8410866 - DNA, 22 bp, Homo sapiens
atacttatgataaataattgct

SEQ ID NO: 8410867 - DNA, 22 bp, Homo sapiens
atacttatactaagaatgtact

SEQ ID NO: 8410868 - DNA, 22 bp, Homo sapiens
ctggcagctctactcagagcct

SEQ ID NO: 8410869 - DNA, 22 bp, Homo sapiens
ataatataatcctacttcccat

SEQ ID NO: 8410870 - DNA, 22 bp, Homo sapiens
ataatatttggataggacagta

SEQ ID NO: 8410871 - DNA, 22 bp, Homo sapiens
ataatatttggataggacagta

SEQ ID NO: 8410872 - DNA, 22 bp, Homo sapiens
ataatcaaagtcctatgacatc

SEQ ID NO: 8410873 - DNA, 18 bp, Homo sapiens
atacaagctctgttactt

SEQ ID NO: 8410874 - DNA, 22 bp, Homo sapiens
ataatacatggttaacctcttt

SEQ ID NO: 8410875 - DNA, 22 bp, Homo sapiens
ctggcagcttagcactctggtt

SEQ ID NO: 8410876 - DNA, 22 bp, Homo sapiens
atataacatacatacagaaaag

SEQ ID NO: 8410877 - DNA, 23 bp, Homo sapiens
atatggctgttgtgtgttaacat

SEQ ID NO: 8410878 - DNA, 22 bp, Homo sapiens
atatgtattgagtgccaactgt

SEQ ID NO: 8410879 - DNA, 22 bp, Homo sapiens
atatttctctcagacatggaag

SEQ ID NO: 8410880 - DNA, 22 bp, Homo sapiens
atatgcaagcacatagaatact

SEQ ID NO: 8410881 - DNA, 22 bp, Homo sapiens
atatgattccactattgtatgg

SEQ ID NO: 8410882 - DNA, 22 bp, Homo sapiens
atatgacagcggattcacatat

SEQ ID NO: 8410883 - DNA, 22 bp, Homo sapiens
atatgacataaaatcatttttg

SEQ ID NO: 8410884 - DNA, 22 bp, Homo sapiens
atatgaagtcagacaaactggg

SEQ ID NO: 8410885 - DNA, 18 bp, Homo sapiens
atatccaataatgaacac

SEQ ID NO: 8410886 - DNA, 22 bp, Homo sapiens
atatccaagaaacaattaattc

SEQ ID NO: 8410887 - DNA, 22 bp, Homo sapiens
atccaaaaccagtgcattttcc

SEQ ID NO: 8410888 - DNA, 18 bp, Homo sapiens
atccaaaaagatggaagt

SEQ ID NO: 8410889 - DNA, 22 bp, Homo sapiens
atccaaaatttactgtagcatt

SEQ ID NO: 8410890 - DNA, 22 bp, Homo sapiens
atccacagtcttagccatcaaa

SEQ ID NO: 8410891 - DNA, 22 bp, Homo sapiens
atctaattttcactcatttgct

SEQ ID NO: 8410892 - DNA, 22 bp, Homo sapiens
atcctttagtcctacaactcga

SEQ ID NO: 8410893 - DNA, 22 bp, Homo sapiens
atcctttataagacttgtattc

SEQ ID NO: 8410894 - DNA, 22 bp, Homo sapiens
atcctagaatcagcccttgctg

SEQ ID NO: 8410895 - DNA, 22 bp, Homo sapiens
atcctacaaagcagggctatgg

SEQ ID NO: 8410896 - DNA, 22 bp, Homo sapiens
atatttgtcaattcactgttca

SEQ ID NO: 8410897 - DNA, 22 bp, Homo sapiens
ctgtccagtctttagcaagctg

SEQ ID NO: 8410898 - DNA, 22 bp, Homo sapiens
ctgtcttcccgaggccctggag

SEQ ID NO: 8410899 - DNA, 22 bp, Homo sapiens
atcatgtacttgacaaatatgt

SEQ ID NO: 8410900 - DNA, 22 bp, Homo sapiens
gtattttaagtgactactaggt

SEQ ID NO: 8410901 - DNA, 22 bp, Homo sapiens
cagccactacaattggttccat

SEQ ID NO: 8410902 - DNA, 22 bp, Homo sapiens
cagccactctcagacagtccca

SEQ ID NO: 8410903 - DNA, 22 bp, Homo sapiens
cagccactgaactcctggctat

SEQ ID NO: 8410904 - DNA, 22 bp, Homo sapiens
cagcattttcttaatgtaggtg

SEQ ID NO: 8410905 - DNA, 22 bp, Homo sapiens
cagccacttgtgatgctgggga

SEQ ID NO: 8410906 - DNA, 22 bp, Homo sapiens
cagccactgtggtctagctgca

SEQ ID NO: 8410907 - DNA, 22 bp, Homo sapiens
cagccacttcgagcttcctgat

SEQ ID NO: 8410908 - DNA, 22 bp, Homo sapiens
cagccactggtgccaggctgtt

SEQ ID NO: 8410909 - DNA, 22 bp, Homo sapiens
gtatgcatcgactcaagtctga

SEQ ID NO: 8410910 - DNA, 22 bp, Homo sapiens
gtatgaaagcatcattcctgct

SEQ ID NO: 8410911 - DNA, 22 bp, Homo sapiens
gtaaaattctagcatctgaaag

SEQ ID NO: 8410912 - DNA, 22 bp, Homo sapiens
gtaaaattgcaattacttttgc

SEQ ID NO: 8410913 - DNA, 22 bp, Homo sapiens
ggttccccaggcggcccttgga

SEQ ID NO: 8410914 - DNA, 22 bp, Homo sapiens
ggttcctgtgcctctagctggc

SEQ ID NO: 8410915 - DNA, 22 bp, Homo sapiens
cagcaatcgggtgatatgcaat

SEQ ID NO: 8410916 - DNA, 22 bp, Homo sapiens
cagagtcagctagtcttgggat

SEQ ID NO: 8410917 - DNA, 22 bp, Homo sapiens
cagagtcagagcacctgggatt

SEQ ID NO: 8410918 - DNA, 22 bp, Homo sapiens
gggaaagaccttcctggggtgt

SEQ ID NO: 8410919 - DNA, 22 bp, Homo sapiens
gggaaagaagaagagccatttt

SEQ ID NO: 8410920 - DNA, 22 bp, Homo sapiens
cagaagtcaccctcagaataac

SEQ ID NO: 8410921 - DNA, 22 bp, Homo sapiens
cagaagggcagcactgggaagg

SEQ ID NO: 8410922 - DNA, 22 bp, Homo sapiens
cagacaggaattctggcgtggt

SEQ ID NO: 8410923 - DNA, 22 bp, Homo sapiens
cagacaggaattctggcgtggt

SEQ ID NO: 8410924 - DNA, 22 bp, Homo sapiens
cagacaggcaggtgctgctttg

SEQ ID NO: 8410925 - DNA, 22 bp, Homo sapiens
cagacagggacctcgctccaga

SEQ ID NO: 8410926 - DNA, 17 bp, Homo sapiens
cagacaggctgtcaccc

SEQ ID NO: 8410927 - DNA, 22 bp, Homo sapiens
gggcaagtccggtgcccagagc

SEQ ID NO: 8410928 - DNA, 22 bp, Homo sapiens
gggagggtctgagagctgcacc

SEQ ID NO: 8410929 - DNA, 22 bp, Homo sapiens
gggtctccatgttaacatcact

SEQ ID NO: 8410930 - DNA, 22 bp, Homo sapiens
gggcgagggcgaaagcgagagc

SEQ ID NO: 8410931 - DNA, 20 bp, Homo sapiens
ggggaagaaaaggatgtgat

SEQ ID NO: 8410932 - DNA, 22 bp, Homo sapiens
caaggaggaagatgcaggggac

SEQ ID NO: 8410933 - DNA, 22 bp, Homo sapiens
caagataatttattctgagttt

SEQ ID NO: 8410934 - DNA, 22 bp, Homo sapiens
caagatatcaatgacatagtat

SEQ ID NO: 8410935 - DNA, 22 bp, Homo sapiens
caagatcttcctcaatagacct

SEQ ID NO: 8410936 - DNA, 22 bp, Homo sapiens
caagatcttcctcaatagacct

SEQ ID NO: 8410937 - DNA, 22 bp, Homo sapiens
caagataagatcatttacacta

SEQ ID NO: 8410938 - DNA, 22 bp, Homo sapiens
gctgcagtgagccaagatcgtg

SEQ ID NO: 8410939 - DNA, 22 bp, Homo sapiens
caacagtctctatagctccttg

SEQ ID NO: 8410940 - DNA, 22 bp, Homo sapiens
caacagtcagaatgaagctgag

SEQ ID NO: 8410941 - DNA, 22 bp, Homo sapiens
gctgccacattttcaggactaa

SEQ ID NO: 8410942 - DNA, 22 bp, Homo sapiens
caacatttgagtaaagaaatgg

SEQ ID NO: 8410943 - DNA, 22 bp, Homo sapiens
caacattcaaccaacatttatg

SEQ ID NO: 8410944 - DNA, 22 bp, Homo sapiens
caacattcttatcactataagc

SEQ ID NO: 8410945 - DNA, 22 bp, Homo sapiens
caacatcagtcctcatgagaca

SEQ ID NO: 8410946 - DNA, 22 bp, Homo sapiens
caacagtgttgcaatctgaaaa

SEQ ID NO: 8410947 - DNA, 19 bp, Homo sapiens
gctcctggatgacctgtgg

SEQ ID NO: 8410948 - DNA, 22 bp, Homo sapiens
gctcctggagagattgagaaag

SEQ ID NO: 8410949 - DNA, 22 bp, Homo sapiens
cacaccagaggttacctgcaaa

SEQ ID NO: 8410950 - DNA, 23 bp, Homo sapiens
cacacccatcactaagagctcct

SEQ ID NO: 8410951 - DNA, 23 bp, Homo sapiens
cacacccatcactaagagctcct

SEQ ID NO: 8410952 - DNA, 19 bp, Homo sapiens
cacacccatgcttgccaag

SEQ ID NO: 8410953 - DNA, 22 bp, Homo sapiens
cacaattagcagctctttattt

SEQ ID NO: 8410954 - DNA, 19 bp, Homo sapiens
cacaattatgagacactta

SEQ ID NO: 8410955 - DNA, 22 bp, Homo sapiens
cacacagtgggaaaacctgaag

SEQ ID NO: 8410956 - DNA, 22 bp, Homo sapiens
cacaagggctttgtaggctttg

SEQ ID NO: 8410957 - DNA, 22 bp, Homo sapiens
cacaactttaggaaccacattc

SEQ ID NO: 8410958 - DNA, 18 bp, Homo sapiens
cacaatagacaccgataa

SEQ ID NO: 8410959 - DNA, 22 bp, Homo sapiens
cacaagtctgtggtctccaaca

SEQ ID NO: 8410960 - DNA, 22 bp, Homo sapiens
cacaatgtgttgggttaagttt

SEQ ID NO: 8410961 - DNA, 22 bp, Homo sapiens
cacaatgcgtacatatatcaaa

SEQ ID NO: 8410962 - DNA, 22 bp, Homo sapiens
cacaaagtgttagatgccactc

SEQ ID NO: 8410963 - DNA, 22 bp, Homo sapiens
gcttggctgtgttcaagggcgg

SEQ ID NO: 8410964 - DNA, 22 bp, Homo sapiens
gcttggcttgggctcagaggcc

SEQ ID NO: 8410965 - DNA, 22 bp, Homo sapiens
gcttggctttactagggggaca

SEQ ID NO: 8410966 - DNA, 22 bp, Homo sapiens
gcttgggaaacgtagttcctag

SEQ ID NO: 8410967 - DNA, 22 bp, Homo sapiens
caatttctcgaactctaatcca

SEQ ID NO: 8410968 - DNA, 22 bp, Homo sapiens
caatttctcgaactctaatcca

SEQ ID NO: 8410969 - DNA, 22 bp, Homo sapiens
gcttggctcctggctcacaggt

SEQ ID NO: 8410970 - DNA, 22 bp, Homo sapiens
gcttggccagcagccgggatgc

SEQ ID NO: 8410971 - DNA, 22 bp, Homo sapiens
gcttggctggaaataggttgag

SEQ ID NO: 8410972 - DNA, 22 bp, Homo sapiens
gctgtggcctggcgcagagctg

SEQ ID NO: 8410973 - DNA, 22 bp, Homo sapiens
gctgtggccgtcagggaaatgg

SEQ ID NO: 8410974 - DNA, 22 bp, Homo sapiens
gctgtggccgggcccaggccgc

SEQ ID NO: 8410975 - DNA, 22 bp, Homo sapiens
gctgtggcccttggcatctgcg

SEQ ID NO: 8410976 - DNA, 20 bp, Homo sapiens
gctgtggccgtgccagactc

SEQ ID NO: 8410977 - DNA, 22 bp, Homo sapiens
gctgtggcctagtttgttatat

SEQ ID NO: 8410978 - DNA, 22 bp, Homo sapiens
gctgtggcctccagcactcccc

SEQ ID NO: 8410979 - DNA, 20 bp, Homo sapiens
caaggcagaccagagtgagt

SEQ ID NO: 8410980 - DNA, 22 bp, Homo sapiens
caaggaggcagtgggacttgaa

SEQ ID NO: 8410981 - DNA, 22 bp, Homo sapiens
gctgtggccaacaaaccacttt

SEQ ID NO: 8410982 - DNA, 20 bp, Homo sapiens
gctgtggcaagtgctcactg

SEQ ID NO: 8410983 - DNA, 22 bp, Homo sapiens
gctgtggcaatgtttataatta

SEQ ID NO: 8410984 - DNA, 20 bp, Homo sapiens
gctgtggcaaagctttgtgt

SEQ ID NO: 8410985 - DNA, 22 bp, Homo sapiens
cacccagcagcacttaagacta

SEQ ID NO: 8410986 - DNA, 22 bp, Homo sapiens
cacccagcacagagggaggcga

SEQ ID NO: 8410987 - DNA, 22 bp, Homo sapiens
cacccacatggaaattcacagt

SEQ ID NO: 8410988 - DNA, 22 bp, Homo sapiens
caccatcagcagcaggtgtcaa

SEQ ID NO: 8410989 - DNA, 22 bp, Homo sapiens
ggcctcgcggcttctggtggct

SEQ ID NO: 8410990 - DNA, 22 bp, Homo sapiens
ggcctctcatgcccagagccaa

SEQ ID NO: 8410991 - DNA, 22 bp, Homo sapiens
ggcctctcatgtcctgggcttc

SEQ ID NO: 8410992 - DNA, 22 bp, Homo sapiens
ggcactggaaggatcatgtgag

SEQ ID NO: 8410993 - DNA, 22 bp, Homo sapiens
ggcactggaagtcccattgtct

SEQ ID NO: 8410994 - DNA, 22 bp, Homo sapiens
ggcactgggaatgcagtgatga

SEQ ID NO: 8410995 - DNA, 22 bp, Homo sapiens
ggcactgggaatgcagtgatga

SEQ ID NO: 8410996 - DNA, 22 bp, Homo sapiens
ggcactgggagaggtgagacgg

SEQ ID NO: 8410997 - DNA, 22 bp, Homo sapiens
ggatgttctggggttctcttgt

SEQ ID NO: 8410998 - DNA, 22 bp, Homo sapiens
cacagcttcccaaagtggacct

SEQ ID NO: 8410999 - DNA, 20 bp, Homo sapiens
atggaggaagggcaagagaa

SEQ ID NO: 8411000 - DNA, 20 bp, Homo sapiens
atggaggaagggcaagagaa

SEQ ID NO: 8411001 - DNA, 22 bp, Homo sapiens
gagaaatgcatgcatgtcatca

SEQ ID NO: 8411002 - DNA, 22 bp, Homo sapiens
gagaaatgctagcttaggaatc

SEQ ID NO: 8411003 - DNA, 22 bp, Homo sapiens
atgccactgcgctccagcctgg

SEQ ID NO: 8411004 - DNA, 22 bp, Homo sapiens
atgccactgcacttcagcttgg

SEQ ID NO: 8411005 - DNA, 23 bp, Homo sapiens
gacagagtgagaccttgtcttac

SEQ ID NO: 8411006 - DNA, 23 bp, Homo sapiens
gacagagtgagaccttgtcttac

SEQ ID NO: 8411007 - DNA, 22 bp, Homo sapiens
gagaggaactcccagtgcctgg

SEQ ID NO: 8411008 - DNA, 22 bp, Homo sapiens
gagagctgtttatcttcttcaa

SEQ ID NO: 8411009 - DNA, 22 bp, Homo sapiens
gaggctgctttgatgacaggag

SEQ ID NO: 8411010 - DNA, 22 bp, Homo sapiens
gaggctgctttcctcctatcct

SEQ ID NO: 8411011 - DNA, 22 bp, Homo sapiens
gaggggagacagggaaatcagt

SEQ ID NO: 8411012 - DNA, 22 bp, Homo sapiens
atgtcttttatggagatgtcat

SEQ ID NO: 8411013 - DNA, 22 bp, Homo sapiens
atgtctttctcatacaagccca

SEQ ID NO: 8411014 - DNA, 22 bp, Homo sapiens
atgtctttcttgtgtcccaaga

SEQ ID NO: 8411015 - DNA, 22 bp, Homo sapiens
atgtctttgccatagttcatat

SEQ ID NO: 8411016 - DNA, 22 bp, Homo sapiens
gaggctgcggggaggagcctgc

SEQ ID NO: 8411017 - DNA, 20 bp, Homo sapiens
gaggctgcggactgctggac

SEQ ID NO: 8411018 - DNA, 23 bp, Homo sapiens
gaggcctggccctgccacatctc

SEQ ID NO: 8411019 - DNA, 22 bp, Homo sapiens
atggtcagttgcagctaatgtt

SEQ ID NO: 8411020 - DNA, 22 bp, Homo sapiens
atggtaaaagatatactgtgca

SEQ ID NO: 8411021 - DNA, 22 bp, Homo sapiens
atggtaaacatttaacaactag

SEQ ID NO: 8411022 - DNA, 22 bp, Homo sapiens
atggtaaattttaccttatgta

SEQ ID NO: 8411023 - DNA, 22 bp, Homo sapiens
atggctggatttgatccatggg

SEQ ID NO: 8411024 - DNA, 22 bp, Homo sapiens
atcttctactttgccaatcagg

SEQ ID NO: 8411025 - DNA, 22 bp, Homo sapiens
cttgcctttgtcttcaaaggct

SEQ ID NO: 8411026 - DNA, 18 bp, Homo sapiens
cttgttcttctcttggcg

SEQ ID NO: 8411027 - DNA, 22 bp, Homo sapiens
atcttttttgtcttggtcactg

SEQ ID NO: 8411028 - DNA, 22 bp, Homo sapiens
atctttttgacatggtgatggt

SEQ ID NO: 8411029 - DNA, 22 bp, Homo sapiens
atctttttactaacactgctta

SEQ ID NO: 8411030 - DNA, 22 bp, Homo sapiens
atctttttatctgtttggaaca

SEQ ID NO: 8411031 - DNA, 22 bp, Homo sapiens
atcttttacattactgcccaga

SEQ ID NO: 8411032 - DNA, 22 bp, Homo sapiens
atcttttatgagcgttctgaca

SEQ ID NO: 8411033 - DNA, 22 bp, Homo sapiens
atcttttactacaaatcaggtg

SEQ ID NO: 8411034 - DNA, 19 bp, Homo sapiens
cttttcatcaacagccaat

SEQ ID NO: 8411035 - DNA, 22 bp, Homo sapiens
cttttcatgccagcccatcaca

SEQ ID NO: 8411036 - DNA, 23 bp, Homo sapiens
cttttcattgccttagcgcagag

SEQ ID NO: 8411037 - DNA, 22 bp, Homo sapiens
cttttcatgagtctgttatggg

SEQ ID NO: 8411038 - DNA, 22 bp, Homo sapiens
atgaggcagcccttcccttctc

SEQ ID NO: 8411039 - DNA, 22 bp, Homo sapiens
atgaagcaacagccctcctatt

SEQ ID NO: 8411040 - DNA, 22 bp, Homo sapiens
atgaagcagaatttcccactct

SEQ ID NO: 8411041 - DNA, 22 bp, Homo sapiens
atgaggcagctggctttctccc

SEQ ID NO: 8411042 - DNA, 22 bp, Homo sapiens
atgatttttcagcagaggatct

SEQ ID NO: 8411043 - DNA, 20 bp, Homo sapiens
atgattttgcactaacttca

SEQ ID NO: 8411044 - DNA, 22 bp, Homo sapiens
atgattcagcccaatttttcta

SEQ ID NO: 8411045 - DNA, 22 bp, Homo sapiens
atgagttgaagctacaagaggc

SEQ ID NO: 8411046 - DNA, 22 bp, Homo sapiens
atgatacaagcaaaactaatca

SEQ ID NO: 8411047 - DNA, 22 bp, Homo sapiens
atgcactttctagagattctga

SEQ ID NO: 8411048 - DNA, 22 bp, Homo sapiens
atgcacttcaagcatctctctg

SEQ ID NO: 8411049 - DNA, 22 bp, Homo sapiens
atgcacttcaagcatctctctg

SEQ ID NO: 8411050 - DNA, 22 bp, Homo sapiens
atgcactttgtaatctgttcaa

SEQ ID NO: 8411051 - DNA, 22 bp, Homo sapiens
atgcagaagcagaacttacaca

SEQ ID NO: 8411052 - DNA, 22 bp, Homo sapiens
atgcagaagactgaaaagctga

SEQ ID NO: 8411053 - DNA, 22 bp, Homo sapiens
atgcagcagccccttgaggtgc

SEQ ID NO: 8411054 - DNA, 22 bp, Homo sapiens
atgcattgtctggtttcatttt

SEQ ID NO: 8411055 - DNA, 22 bp, Homo sapiens
atgcattgtcaggcaatttcat

SEQ ID NO: 8411056 - DNA, 22 bp, Homo sapiens
atgcattgctgctttcaaaaca

SEQ ID NO: 8411057 - DNA, 22 bp, Homo sapiens
atgcattcattcattctttcta

SEQ ID NO: 8411058 - DNA, 22 bp, Homo sapiens
atgcatgtgcatggctctatct

SEQ ID NO: 8411059 - DNA, 22 bp, Homo sapiens
atgcattcagcggaatgcttag

SEQ ID NO: 8411060 - DNA, 23 bp, Homo sapiens
atgcaggacttataaggtaaggt

SEQ ID NO: 8411061 - DNA, 22 bp, Homo sapiens
atgcagcttcaggattatgatg

SEQ ID NO: 8411062 - DNA, 22 bp, Homo sapiens
atgcagctgtgggcaagaaatg

SEQ ID NO: 8411063 - DNA, 22 bp, Homo sapiens
atgcagcagtttacaaagcaat

SEQ ID NO: 8411064 - DNA, 22 bp, Homo sapiens
atgcagctatttgagcatgtca

SEQ ID NO: 8411065 - DNA, 22 bp, Homo sapiens
atgcagctgacattttcatgtt

SEQ ID NO: 8411066 - DNA, 22 bp, Homo sapiens
attaaatggtggtcattcattt

SEQ ID NO: 8411067 - DNA, 22 bp, Homo sapiens
attaaattagcaaactgtgaaa

SEQ ID NO: 8411068 - DNA, 22 bp, Homo sapiens
attaaattaagtggctaattta

SEQ ID NO: 8411069 - DNA, 22 bp, Homo sapiens
attaaatgttccttaaattata

SEQ ID NO: 8411070 - DNA, 22 bp, Homo sapiens
atgttttatgttccactcaagg

SEQ ID NO: 8411071 - DNA, 23 bp, Homo sapiens
atgttttatgtctctagctgcca

SEQ ID NO: 8411072 - DNA, 22 bp, Homo sapiens
atgttaaaaaccagtacagttg

SEQ ID NO: 8411073 - DNA, 22 bp, Homo sapiens
atgtgtttgtacctttaaatat

SEQ ID NO: 8411074 - DNA, 22 bp, Homo sapiens
attacaaaagaagggagaaggt

SEQ ID NO: 8411075 - DNA, 22 bp, Homo sapiens
attaatttttctgacagccaca

SEQ ID NO: 8411076 - DNA, 22 bp, Homo sapiens
attacaataaggtttatttgta

SEQ ID NO: 8411077 - DNA, 22 bp, Homo sapiens
attacaataatacatgctcatt

SEQ ID NO: 8411078 - DNA, 22 bp, Homo sapiens
attaatatacactgttagcatg

SEQ ID NO: 8411079 - DNA, 22 bp, Homo sapiens
attaagatcattgtagaagatt

SEQ ID NO: 8411080 - DNA, 22 bp, Homo sapiens
attaatttccaggcactgtgct

SEQ ID NO: 8411081 - DNA, 22 bp, Homo sapiens
attaattttacctttgtaaaca

SEQ ID NO: 8411082 - DNA, 22 bp, Homo sapiens
attaatattggttcattagctg

SEQ ID NO: 8411083 - DNA, 22 bp, Homo sapiens
gcaagtacaaacgcatcggctg

SEQ ID NO: 8411084 - DNA, 21 bp, Homo sapiens
gcaagtactatcatcattatc

SEQ ID NO: 8411085 - DNA, 22 bp, Homo sapiens
gcaagtttagctaactggccca

SEQ ID NO: 8411086 - DNA, 22 bp, Homo sapiens
attagaatgaagtataggattt

SEQ ID NO: 8411087 - DNA, 22 bp, Homo sapiens
attagaatgacagaaatgaggc

SEQ ID NO: 8411088 - DNA, 22 bp, Homo sapiens
attattcttatgtcatcatggc

SEQ ID NO: 8411089 - DNA, 22 bp, Homo sapiens
attagacatcatatgattcagc

SEQ ID NO: 8411090 - DNA, 22 bp, Homo sapiens
attctacacctctctcatttag

SEQ ID NO: 8411091 - DNA, 22 bp, Homo sapiens
attctacatgatagaagggaga

SEQ ID NO: 8411092 - DNA, 22 bp, Homo sapiens
attctacatttggagtgatgtc

SEQ ID NO: 8411093 - DNA, 22 bp, Homo sapiens
attctacacaaagcaagaagac

SEQ ID NO: 8411094 - DNA, 19 bp, Homo sapiens
attcctcaaggacagaaat

SEQ ID NO: 8411095 - DNA, 22 bp, Homo sapiens
attcctcaaaggtagcccatta

SEQ ID NO: 8411096 - DNA, 22 bp, Homo sapiens
attcagtgtgaggttttcaagt

SEQ ID NO: 8411097 - DNA, 22 bp, Homo sapiens
attatttagaaatcgattgaaa

SEQ ID NO: 8411098 - DNA, 22 bp, Homo sapiens
attcagactgtctaaatggttt

SEQ ID NO: 8411099 - DNA, 22 bp, Homo sapiens
attatttacagtgtgctcgaag

SEQ ID NO: 8411100 - DNA, 22 bp, Homo sapiens
attctcagctttcaaatagaca

SEQ ID NO: 8411101 - DNA, 22 bp, Homo sapiens
attcttaattgccatgctgtat

SEQ ID NO: 8411102 - DNA, 22 bp, Homo sapiens
attcttcaaagagtgtcaaagt

SEQ ID NO: 8411103 - DNA, 22 bp, Homo sapiens
attcttcactgtttcagaatga

SEQ ID NO: 8411104 - DNA, 22 bp, Homo sapiens
attcttcaccatggataatttg

SEQ ID NO: 8411105 - DNA, 22 bp, Homo sapiens
attgcacttcagcctgggtgac

SEQ ID NO: 8411106 - DNA, 22 bp, Homo sapiens
attgaagagaagctaaatagag

SEQ ID NO: 8411107 - DNA, 22 bp, Homo sapiens
attgaagatcagggaaagattc

SEQ ID NO: 8411108 - DNA, 22 bp, Homo sapiens
attgaagaaacccaaataatgg

SEQ ID NO: 8411109 - DNA, 22 bp, Homo sapiens
attgaatagctgcttgttgtat

SEQ ID NO: 8411110 - DNA, 22 bp, Homo sapiens
attgaatagatgcattatacta

SEQ ID NO: 8411111 - DNA, 22 bp, Homo sapiens
attgaatgcttgctaacacttt

SEQ ID NO: 8411112 - DNA, 22 bp, Homo sapiens
attgaaattgatgaaattcttg

SEQ ID NO: 8411113 - DNA, 22 bp, Homo sapiens
attcttcagcaggggacactat

SEQ ID NO: 8411114 - DNA, 20 bp, Homo sapiens
attgaaatttttctgagatt

SEQ ID NO: 8411115 - DNA, 22 bp, Homo sapiens
attgaacagaaaaactcagaga

SEQ ID NO: 8411116 - DNA, 22 bp, Homo sapiens
attgaacatacatatccacacc

SEQ ID NO: 8411117 - DNA, 23 bp, Homo sapiens
attgaacagagagaaaaacatcc

SEQ ID NO: 8411118 - DNA, 22 bp, Homo sapiens
gccaggcatttgttaggtgctg

SEQ ID NO: 8411119 - DNA, 22 bp, Homo sapiens
gccaggcatttattgattgaat

SEQ ID NO: 8411120 - DNA, 22 bp, Homo sapiens
gccaggcattctagaagtagtg

SEQ ID NO: 8411121 - DNA, 22 bp, Homo sapiens
atttctacagtacacatgcatt

SEQ ID NO: 8411122 - DNA, 18 bp, Homo sapiens
atttctactactataaag

SEQ ID NO: 8411123 - DNA, 22 bp, Homo sapiens
atttctacattgagttttagca

SEQ ID NO: 8411124 - DNA, 22 bp, Homo sapiens
atttctataggaggacagtatt

SEQ ID NO: 8411125 - DNA, 22 bp, Homo sapiens
atttcatatgtatcacctagcc

SEQ ID NO: 8411126 - DNA, 22 bp, Homo sapiens
atttacagaagcatgtaatagc

SEQ ID NO: 8411127 - DNA, 22 bp, Homo sapiens
attggagaagaacatgaattag

SEQ ID NO: 8411128 - DNA, 22 bp, Homo sapiens
atttaatgtcgagctattgtag

SEQ ID NO: 8411129 - DNA, 22 bp, Homo sapiens
caaacttactgtgtttaaagag

SEQ ID NO: 8411130 - DNA, 22 bp, Homo sapiens
gctcaggagctgacagcctcaa

SEQ ID NO: 8411131 - DNA, 19 bp, Homo sapiens
gcgaggaagtcactgtggt

SEQ ID NO: 8411132 - DNA, 22 bp, Homo sapiens
gcgcactgggcgcacgcgtagg

SEQ ID NO: 8411133 - DNA, 22 bp, Homo sapiens
gcgcaccacctccaggtggccg

SEQ ID NO: 8411134 - DNA, 22 bp, Homo sapiens
caaactattgttcacaagacaa

SEQ ID NO: 8411135 - DNA, 22 bp, Homo sapiens
gcctgtgatgcccccataagta

SEQ ID NO: 8411136 - DNA, 19 bp, Homo sapiens
gcgaggaagtcactgtggc

SEQ ID NO: 8411137 - DNA, 22 bp, Homo sapiens
gcctctctgggctgccgaggct

SEQ ID NO: 8411138 - DNA, 22 bp, Homo sapiens
atttctcagcacttcctatctc

SEQ ID NO: 8411139 - DNA, 22 bp, Homo sapiens
atttctcagcacttcctatctc

SEQ ID NO: 8411140 - DNA, 22 bp, Homo sapiens
atttctcactcacagtccatgt

SEQ ID NO: 8411141 - DNA, 22 bp, Homo sapiens
atttctcagtgaaatgacaggc

SEQ ID NO: 8411142 - DNA, 22 bp, Homo sapiens
atttctcagtgaaatgacaggc

SEQ ID NO: 8411143 - DNA, 22 bp, Homo sapiens
atttctcagtgtacattatgtt

SEQ ID NO: 8411144 - DNA, 22 bp, Homo sapiens
tatacagttaagtttcttcagt

SEQ ID NO: 8411145 - DNA, 22 bp, Homo sapiens
caggtctccattttgatgagtt

SEQ ID NO: 8411146 - DNA, 22 bp, Homo sapiens
tatacagctatggcaagacaaa

SEQ ID NO: 8411147 - DNA, 22 bp, Homo sapiens
cagggtggaagctgtagagtgg

SEQ ID NO: 8411148 - DNA, 22 bp, Homo sapiens
tattaaatatatctgttagttg

SEQ ID NO: 8411149 - DNA, 22 bp, Homo sapiens
tatgtgcatgctgacttgagga

SEQ ID NO: 8411150 - DNA, 22 bp, Homo sapiens
tatgtgcattatctagttcatt

SEQ ID NO: 8411151 - DNA, 23 bp, Homo sapiens
tatgtgcatatgtgtaagaatac

SEQ ID NO: 8411152 - DNA, 22 bp, Homo sapiens
tatgtgcatatgcatacacaca

SEQ ID NO: 8411153 - DNA, 22 bp, Homo sapiens
tatctctagcgcacagaagaaa

SEQ ID NO: 8411154 - DNA, 23 bp, Homo sapiens
tatctcagaggaatgtagttact

SEQ ID NO: 8411155 - DNA, 22 bp, Homo sapiens
tcaccagggctccagccagcct

SEQ ID NO: 8411156 - DNA, 22 bp, Homo sapiens
tcacattctttatttgccatcc

SEQ ID NO: 8411157 - DNA, 22 bp, Homo sapiens
tcagaaatagtctttaaaatga

SEQ ID NO: 8411158 - DNA, 22 bp, Homo sapiens
tcactccatctttgctactggt

SEQ ID NO: 8411159 - DNA, 22 bp, Homo sapiens
tcactcctcaggctagcatcat

SEQ ID NO: 8411160 - DNA, 22 bp, Homo sapiens
cagtcctctcactcaggccttt

SEQ ID NO: 8411161 - DNA, 22 bp, Homo sapiens
cagtgcagacgtggagggggca

SEQ ID NO: 8411162 - DNA, 22 bp, Homo sapiens
cagtgcagaacacatggaaaat

SEQ ID NO: 8411163 - DNA, 22 bp, Homo sapiens
cagtgcagaggccagggaggat

SEQ ID NO: 8411164 - DNA, 17 bp, Homo sapiens
cagtgcagagccctttc

SEQ ID NO: 8411165 - DNA, 22 bp, Homo sapiens
cagtgaggtggatggatggcct

SEQ ID NO: 8411166 - DNA, 22 bp, Homo sapiens
cagtgaggtggatggatggcct

SEQ ID NO: 8411167 - DNA, 22 bp, Homo sapiens
cagtgaggtagacagctttttc

SEQ ID NO: 8411168 - DNA, 21 bp, Homo sapiens
cagtgaggtccccagcctagg

SEQ ID NO: 8411169 - DNA, 21 bp, Homo sapiens
cagtgaggtccccagcctagg

SEQ ID NO: 8411170 - DNA, 22 bp, Homo sapiens
cagtgaggtgcccagcctgccc

SEQ ID NO: 8411171 - DNA, 22 bp, Homo sapiens
cagtgaggtgcccagcctgccc

SEQ ID NO: 8411172 - DNA, 22 bp, Homo sapiens
cagtgaggtggagtagttccca

SEQ ID NO: 8411173 - DNA, 22 bp, Homo sapiens
cagtctaagactcacgccaaga

SEQ ID NO: 8411174 - DNA, 22 bp, Homo sapiens
cagtctaagttaatttccacaa

SEQ ID NO: 8411175 - DNA, 22 bp, Homo sapiens
cagtctaatctgttactcatta

SEQ ID NO: 8411176 - DNA, 18 bp, Homo sapiens
tcatttgttttgcatgaa

SEQ ID NO: 8411177 - DNA, 22 bp, Homo sapiens
tcatttgttgctgttacctgag

SEQ ID NO: 8411178 - DNA, 22 bp, Homo sapiens
tcatttgttgaactttagtgcg

SEQ ID NO: 8411179 - DNA, 22 bp, Homo sapiens
catgatgttatctaaatctggt

SEQ ID NO: 8411180 - DNA, 22 bp, Homo sapiens
catgataattgttaacaaagta

SEQ ID NO: 8411181 - DNA, 22 bp, Homo sapiens
catgagttcatctgcttctctt

SEQ ID NO: 8411182 - DNA, 22 bp, Homo sapiens
catgcacaaaggtaagatgcgt

SEQ ID NO: 8411183 - DNA, 22 bp, Homo sapiens
catggctgaggcagaggactga

SEQ ID NO: 8411184 - DNA, 22 bp, Homo sapiens
tccaggcaaggataataaacat

SEQ ID NO: 8411185 - DNA, 22 bp, Homo sapiens
tccaggcaagggaggagcatgg

SEQ ID NO: 8411186 - DNA, 22 bp, Homo sapiens
tccaggcaaagtgctgggctgc

SEQ ID NO: 8411187 - DNA, 22 bp, Homo sapiens
tccaggcaaaaaccaactacag

SEQ ID NO: 8411188 - DNA, 22 bp, Homo sapiens
tccaggcaaaaggaactgcttg

SEQ ID NO: 8411189 - DNA, 22 bp, Homo sapiens
tccaggcaaagccttgtagacg

SEQ ID NO: 8411190 - DNA, 22 bp, Homo sapiens
tccaggcaaagggactagcagg

SEQ ID NO: 8411191 - DNA, 22 bp, Homo sapiens
catccagggcagccatggcctg

SEQ ID NO: 8411192 - DNA, 22 bp, Homo sapiens
catccagggcagccatggcctg

SEQ ID NO: 8411193 - DNA, 22 bp, Homo sapiens
catccaggcaccacaaccagct

SEQ ID NO: 8411194 - DNA, 22 bp, Homo sapiens
catccaggcaccacaaccagct

SEQ ID NO: 8411195 - DNA, 22 bp, Homo sapiens
catcacagggggctagaagtct

SEQ ID NO: 8411196 - DNA, 22 bp, Homo sapiens
catagaatgtaataaagagtag

SEQ ID NO: 8411197 - DNA, 20 bp, Homo sapiens
catatatacctagaagtgga

SEQ ID NO: 8411198 - DNA, 22 bp, Homo sapiens
cataatttttttaagtcagaac

SEQ ID NO: 8411199 - DNA, 22 bp, Homo sapiens
catacttttgccctgacattct

SEQ ID NO: 8411200 - DNA, 22 bp, Homo sapiens
catactttctttttcacgcata

SEQ ID NO: 8411201 - DNA, 22 bp, Homo sapiens
cagtttatatgtcagagctgta

SEQ ID NO: 8411202 - DNA, 22 bp, Homo sapiens
tctgcgccaccttgtgcttgtg

SEQ ID NO: 8411203 - DNA, 22 bp, Homo sapiens
tctggaggcaggctgccaggat

SEQ ID NO: 8411204 - DNA, 22 bp, Homo sapiens
tctggaggcaactaacctagtt

SEQ ID NO: 8411205 - DNA, 22 bp, Homo sapiens
tctgtcttcatcagcatgtgat

SEQ ID NO: 8411206 - DNA, 22 bp, Homo sapiens
tctgtcttagccatctcaggct

SEQ ID NO: 8411207 - DNA, 22 bp, Homo sapiens
tctgtcttagcatctttgctca

SEQ ID NO: 8411208 - DNA, 21 bp, Homo sapiens
tctgtcttcctcagcctaagg

SEQ ID NO: 8411209 - DNA, 22 bp, Homo sapiens
tctgtcttctgtagctaataat

SEQ ID NO: 8411210 - DNA, 22 bp, Homo sapiens
tctgtcttcttcattgcctata

SEQ ID NO: 8411211 - DNA, 22 bp, Homo sapiens
tctgtcttggccagccatctgg

SEQ ID NO: 8411212 - DNA, 23 bp, Homo sapiens
tctgtcttgtttaggccactgtt

SEQ ID NO: 8411213 - DNA, 17 bp, Homo sapiens
tctgtcttgactgtcac

SEQ ID NO: 8411214 - DNA, 18 bp, Homo sapiens
tctgtggcagcagtgcac

SEQ ID NO: 8411215 - DNA, 21 bp, Homo sapiens
tctgtggcagcatgatgaggt

SEQ ID NO: 8411216 - DNA, 20 bp, Homo sapiens
tctgtggcaggtggcgcttg

SEQ ID NO: 8411217 - DNA, 22 bp, Homo sapiens
tctgtggcacgattgcactgca

SEQ ID NO: 8411218 - DNA, 19 bp, Homo sapiens
tctgtggcacctgggaggg

SEQ ID NO: 8411219 - DNA, 22 bp, Homo sapiens
tctgtctttagaggcctgtgct

SEQ ID NO: 8411220 - DNA, 22 bp, Homo sapiens
tctgtggcaaacacagtgacca

SEQ ID NO: 8411221 - DNA, 22 bp, Homo sapiens
ccagctctaaacggctctgtgg

SEQ ID NO: 8411222 - DNA, 22 bp, Homo sapiens
ccagctctagccccatgtggct

SEQ ID NO: 8411223 - DNA, 22 bp, Homo sapiens
ccagccttactgcccttcagtg

SEQ ID NO: 8411224 - DNA, 22 bp, Homo sapiens
ccagccactgggccactgccag

SEQ ID NO: 8411225 - DNA, 22 bp, Homo sapiens
tctcttaataagtaaatactga

SEQ ID NO: 8411226 - DNA, 22 bp, Homo sapiens
tctgaggaccatcggggagctg

SEQ ID NO: 8411227 - DNA, 22 bp, Homo sapiens
tctgaggcagcttgccactcta

SEQ ID NO: 8411228 - DNA, 17 bp, Homo sapiens
tccaggcagcaactgag

SEQ ID NO: 8411229 - DNA, 22 bp, Homo sapiens
tccaggcagagcaacaaaatat

SEQ ID NO: 8411230 - DNA, 22 bp, Homo sapiens
tccaggcactatatatactttt

SEQ ID NO: 8411231 - DNA, 20 bp, Homo sapiens
tccaggcagacagctatggg

SEQ ID NO: 8411232 - DNA, 22 bp, Homo sapiens
tccaggcacagagttggtcagt

SEQ ID NO: 8411233 - DNA, 22 bp, Homo sapiens
tccaggcacgaggccctgtgca

SEQ ID NO: 8411234 - DNA, 23 bp, Homo sapiens
tccaggcacgcatttcttctagc

SEQ ID NO: 8411235 - DNA, 19 bp, Homo sapiens
catttagaagtacatatta

SEQ ID NO: 8411236 - DNA, 22 bp, Homo sapiens
tcccagggcactcaccctccct

SEQ ID NO: 8411237 - DNA, 22 bp, Homo sapiens
catttgcagagggtgacactct

SEQ ID NO: 8411238 - DNA, 20 bp, Homo sapiens
tcctgcagttcctaggaggg

SEQ ID NO: 8411239 - DNA, 20 bp, Homo sapiens
tcctgcagttcctaggaggg

SEQ ID NO: 8411240 - DNA, 22 bp, Homo sapiens
ccaattcatcctctggggcttc

SEQ ID NO: 8411241 - DNA, 22 bp, Homo sapiens
ccaattcacctcctatgcacat

SEQ ID NO: 8411242 - DNA, 23 bp, Homo sapiens
ccaattcagatattggcttgtgc

SEQ ID NO: 8411243 - DNA, 22 bp, Homo sapiens
tcctgcagtgtgtctcctgcac

SEQ ID NO: 8411244 - DNA, 22 bp, Homo sapiens
tcctgcagtgtgtctcctgcac

SEQ ID NO: 8411245 - DNA, 22 bp, Homo sapiens
tcctgcagttacatcccagcca

SEQ ID NO: 8411246 - DNA, 22 bp, Homo sapiens
ccacaagatgcaaactctaaca

SEQ ID NO: 8411247 - DNA, 22 bp, Homo sapiens
tcctcccaacttttccatctca

SEQ ID NO: 8411248 - DNA, 22 bp, Homo sapiens
tcctcccacataggacaatggg

SEQ ID NO: 8411249 - DNA, 23 bp, Homo sapiens
tcctcccaaatttcagcctcatt

SEQ ID NO: 8411250 - DNA, 22 bp, Homo sapiens
tctctaggggagccccgtttgt

SEQ ID NO: 8411251 - DNA, 22 bp, Homo sapiens
tctctagggatctgttttaatt

SEQ ID NO: 8411252 - DNA, 22 bp, Homo sapiens
tctctaaagatatttatggcaa

SEQ ID NO: 8411253 - DNA, 22 bp, Homo sapiens
tctctaaagcactttaaccaca

SEQ ID NO: 8411254 - DNA, 22 bp, Homo sapiens
tctctaaagtagaaaagacccc

SEQ ID NO: 8411255 - DNA, 22 bp, Homo sapiens
tctctaaagcctggaagaggag

SEQ ID NO: 8411256 - DNA, 22 bp, Homo sapiens
ccagacaggaacacacatctcc

SEQ ID NO: 8411257 - DNA, 22 bp, Homo sapiens
ccactgcctatttgcagggccc

SEQ ID NO: 8411258 - DNA, 22 bp, Homo sapiens
ccactgccagccgcccggaggc

SEQ ID NO: 8411259 - DNA, 18 bp, Homo sapiens
tcctggtggagaagtggt

SEQ ID NO: 8411260 - DNA, 22 bp, Homo sapiens
tcctggtgctgacacccatagc

SEQ ID NO: 8411261 - DNA, 22 bp, Homo sapiens
tcctggtgaggctagaagtgtc

SEQ ID NO: 8411262 - DNA, 22 bp, Homo sapiens
ccactctgctgtgctccatgat

SEQ ID NO: 8411263 - DNA, 22 bp, Homo sapiens
gttcttcagattccatttcagt

SEQ ID NO: 8411264 - DNA, 22 bp, Homo sapiens
gttcttcagccctcaggtccta

SEQ ID NO: 8411265 - DNA, 22 bp, Homo sapiens
gttcttaagaccacaataaaaa

SEQ ID NO: 8411266 - DNA, 22 bp, Homo sapiens
gttggctatgagagctttagtg

SEQ ID NO: 8411267 - DNA, 22 bp, Homo sapiens
gttggcaagtgttccttcctct

SEQ ID NO: 8411268 - DNA, 22 bp, Homo sapiens
caggaacaatgtaagtctcatt

SEQ ID NO: 8411269 - DNA, 22 bp, Homo sapiens
caggaacacaatgagtctcaaa

SEQ ID NO: 8411270 - DNA, 22 bp, Homo sapiens
gtttcctgcgtgtgccactcat

SEQ ID NO: 8411271 - DNA, 22 bp, Homo sapiens
gtttattattcaacttcatgtt

SEQ ID NO: 8411272 - DNA, 22 bp, Homo sapiens
gttcacaagagttacagacaga

SEQ ID NO: 8411273 - DNA, 22 bp, Homo sapiens
gttcacaatggctttacctaag

SEQ ID NO: 8411274 - DNA, 22 bp, Homo sapiens
gttcacaatttttactgattgg

SEQ ID NO: 8411275 - DNA, 22 bp, Homo sapiens
cagctttccagagacctgcccc

SEQ ID NO: 8411276 - DNA, 22 bp, Homo sapiens
cagctttatttcacgtgtttgt

SEQ ID NO: 8411277 - DNA, 23 bp, Homo sapiens
cagctttcagggctttagggaag

SEQ ID NO: 8411278 - DNA, 22 bp, Homo sapiens
cagctttaccaatatttggaaa

SEQ ID NO: 8411279 - DNA, 22 bp, Homo sapiens
cagcttgttttatttggggacc

SEQ ID NO: 8411280 - DNA, 22 bp, Homo sapiens
cagctttacctttaggagtaac

SEQ ID NO: 8411281 - DNA, 22 bp, Homo sapiens
cagctttagagaaaacatattt

SEQ ID NO: 8411282 - DNA, 22 bp, Homo sapiens
cagcttgttaccgagggagggt

SEQ ID NO: 8411283 - DNA, 22 bp, Homo sapiens
cagcttgtgcaaaggtcctggg

SEQ ID NO: 8411284 - DNA, 20 bp, Homo sapiens
cagctttagatctttgatta

SEQ ID NO: 8411285 - DNA, 22 bp, Homo sapiens
cagctttaggactcataataaa

SEQ ID NO: 8411286 - DNA, 22 bp, Homo sapiens
cagctttagtaacccactgctc

SEQ ID NO: 8411287 - DNA, 16 bp, Homo sapiens
cagctttatgtcagtg

SEQ ID NO: 8411288 - DNA, 17 bp, Homo sapiens
cagctttatgctactgt

SEQ ID NO: 8411289 - DNA, 22 bp, Homo sapiens
cagctttattgaggtataattg

SEQ ID NO: 8411290 - DNA, 22 bp, Homo sapiens
cagctttattaatgattgtctt

SEQ ID NO: 8411291 - DNA, 22 bp, Homo sapiens
gttattagaagtgaaggattgt

SEQ ID NO: 8411292 - DNA, 22 bp, Homo sapiens
gttattagtaagactcgcacat

SEQ ID NO: 8411293 - DNA, 22 bp, Homo sapiens
gttattgacatgtattaagcac

SEQ ID NO: 8411294 - DNA, 22 bp, Homo sapiens
gttattgactctcttgtggctt

SEQ ID NO: 8411295 - DNA, 22 bp, Homo sapiens
cagcttattcagtaagcacata

SEQ ID NO: 8411296 - DNA, 22 bp, Homo sapiens
cagcttcaccagggccatggtt

SEQ ID NO: 8411297 - DNA, 22 bp, Homo sapiens
cagctgtggctgccactgctcc

SEQ ID NO: 8411298 - DNA, 20 bp, Homo sapiens
gttaaaagagtaatttgagg

SEQ ID NO: 8411299 - DNA, 22 bp, Homo sapiens
gttaaataacctcatgtccgtt

SEQ ID NO: 8411300 - DNA, 22 bp, Homo sapiens
gtgttttatcagacaaagtata

SEQ ID NO: 8411301 - DNA, 22 bp, Homo sapiens
cagctgtgaattgtcttatcta

SEQ ID NO: 8411302 - DNA, 22 bp, Homo sapiens
gtgtacagtaagtgaatctagg

SEQ ID NO: 8411303 - DNA, 22 bp, Homo sapiens
gtggtaaagctgattgaattga

SEQ ID NO: 8411304 - DNA, 22 bp, Homo sapiens
gtggtaaaatgtgaaatggatt

SEQ ID NO: 8411305 - DNA, 22 bp, Homo sapiens
gtgtgagagaagctgccatgga

SEQ ID NO: 8411306 - DNA, 22 bp, Homo sapiens
cagctgcagttcaatgcttgct

SEQ ID NO: 8411307 - DNA, 22 bp, Homo sapiens
gtggcagagatagaactggaat

SEQ ID NO: 8411308 - DNA, 22 bp, Homo sapiens
gtggcttgagcaggggcagagg

SEQ ID NO: 8411309 - DNA, 22 bp, Homo sapiens
cagctctgttcatagatggtgc

SEQ ID NO: 8411310 - DNA, 22 bp, Homo sapiens
caggagcaaggagcagtgggat

SEQ ID NO: 8411311 - DNA, 22 bp, Homo sapiens
taaatgcttagattcatagaaa

SEQ ID NO: 8411312 - DNA, 22 bp, Homo sapiens
taaagtcaaggtactgtttcac

SEQ ID NO: 8411313 - DNA, 22 bp, Homo sapiens
taaagccacttcattctagtct

SEQ ID NO: 8411314 - DNA, 17 bp, Homo sapiens
taaagccagtcaagtca

SEQ ID NO: 8411315 - DNA, 22 bp, Homo sapiens
taaagccctctgatcacactgg

SEQ ID NO: 8411316 - DNA, 22 bp, Homo sapiens
taaagccaacactttactgctc

SEQ ID NO: 8411317 - DNA, 22 bp, Homo sapiens
taaatggcaacccctagagctg

SEQ ID NO: 8411318 - DNA, 22 bp, Homo sapiens
caggaggcagtgggtgttgtct

SEQ ID NO: 8411319 - DNA, 23 bp, Homo sapiens
caggagggaatgaagttagacaa

SEQ ID NO: 8411320 - DNA, 20 bp, Homo sapiens
caggagggacatttcagcat

SEQ ID NO: 8411321 - DNA, 22 bp, Homo sapiens
caggagggcccgagactcttcc

SEQ ID NO: 8411322 - DNA, 22 bp, Homo sapiens
caggagggggtggagtttcgcc

SEQ ID NO: 8411323 - DNA, 22 bp, Homo sapiens
caggagggtgtggaaaactggg

SEQ ID NO: 8411324 - DNA, 22 bp, Homo sapiens
caggagttttaaatctagcatg

SEQ ID NO: 8411325 - DNA, 22 bp, Homo sapiens
caggaatccagagtgagcctcc

SEQ ID NO: 8411326 - DNA, 22 bp, Homo sapiens
caggacaatctcgtcgggtcct

SEQ ID NO: 8411327 - DNA, 22 bp, Homo sapiens
caggacaatggtcatactggat

SEQ ID NO: 8411328 - DNA, 18 bp, Homo sapiens
caggaatggatgggattt

SEQ ID NO: 8411329 - DNA, 19 bp, Homo sapiens
caggaatgaggtaatggct

SEQ ID NO: 8411330 - DNA, 22 bp, Homo sapiens
caggacattgatccattggcac

SEQ ID NO: 8411331 - DNA, 23 bp, Homo sapiens
caggacatgggaggaagtatggc

SEQ ID NO: 8411332 - DNA, 22 bp, Homo sapiens
taaaaaacattactctgtcctg

SEQ ID NO: 8411333 - DNA, 22 bp, Homo sapiens
taaaatagcatgtgcagtgaaa

SEQ ID NO: 8411334 - DNA, 22 bp, Homo sapiens
taaaaatcttatgaatggcaag

SEQ ID NO: 8411335 - DNA, 22 bp, Homo sapiens
caggcacatgggagctcatcat

SEQ ID NO: 8411336 - DNA, 22 bp, Homo sapiens
caggatcttttaatgtctccag

SEQ ID NO: 8411337 - DNA, 22 bp, Homo sapiens
caggatctgttaagttgttcca

SEQ ID NO: 8411338 - DNA, 22 bp, Homo sapiens
caggatctgcccaggcctttgg

SEQ ID NO: 8411339 - DNA, 22 bp, Homo sapiens
taacatttaaatttttcacata

SEQ ID NO: 8411340 - DNA, 16 bp, Homo sapiens
taacatttttaaaagg

SEQ ID NO: 8411341 - DNA, 22 bp, Homo sapiens
taactttagtgtatgaggtaag

SEQ ID NO: 8411342 - DNA, 22 bp, Homo sapiens
taacactttggattaaaattct

SEQ ID NO: 8411343 - DNA, 22 bp, Homo sapiens
caggcagccctgcaccaagtgt

SEQ ID NO: 8411344 - DNA, 22 bp, Homo sapiens
caggcagctgactgtcagatat

SEQ ID NO: 8411345 - DNA, 22 bp, Homo sapiens
caggcagctgctgggttcagcc

SEQ ID NO: 8411346 - DNA, 22 bp, Homo sapiens
caggcagctgcgacaagagagc

SEQ ID NO: 8411347 - DNA, 22 bp, Homo sapiens
caggcagaaattttgtttcatt

SEQ ID NO: 8411348 - DNA, 20 bp, Homo sapiens
tacaatacacatgcatatga

SEQ ID NO: 8411349 - DNA, 20 bp, Homo sapiens
tacaatacacatgcatatga

SEQ ID NO: 8411350 - DNA, 22 bp, Homo sapiens
tacaaggcttcagctcagctat

SEQ ID NO: 8411351 - DNA, 22 bp, Homo sapiens
tacaagtatgttttaaaatgtt

SEQ ID NO: 8411352 - DNA, 22 bp, Homo sapiens
tacaagtccgtaaagggcagat

SEQ ID NO: 8411353 - DNA, 22 bp, Homo sapiens
tacaaattaatgggcatgttta

SEQ ID NO: 8411354 - DNA, 20 bp, Homo sapiens
tacaaattttccatgtttcc

SEQ ID NO: 8411355 - DNA, 20 bp, Homo sapiens
tacaaattttccatgtttcc

SEQ ID NO: 8411356 - DNA, 22 bp, Homo sapiens
tacaaatgagttgtatgaacca

SEQ ID NO: 8411357 - DNA, 22 bp, Homo sapiens
tgtggcttttgctagctttgca

SEQ ID NO: 8411358 - DNA, 22 bp, Homo sapiens
tgtggctgctcaggtgcagacc

SEQ ID NO: 8411359 - DNA, 20 bp, Homo sapiens
cctgggctcaaagcatcctc

SEQ ID NO: 8411360 - DNA, 22 bp, Homo sapiens
tgtgcccatccctctggagtgt

SEQ ID NO: 8411361 - DNA, 20 bp, Homo sapiens
tgtgcccagcagaggctgcc

SEQ ID NO: 8411362 - DNA, 22 bp, Homo sapiens
tgtgccagcctctggctgtgtc

SEQ ID NO: 8411363 - DNA, 22 bp, Homo sapiens
tgtgaggtaacgctgctctgtt

SEQ ID NO: 8411364 - DNA, 22 bp, Homo sapiens
tgtgagcttaggacagggctat

SEQ ID NO: 8411365 - DNA, 22 bp, Homo sapiens
tgtctttatatatttggaaaat

SEQ ID NO: 8411366 - DNA, 22 bp, Homo sapiens
tgtctttctgacccaaggtagt

SEQ ID NO: 8411367 - DNA, 22 bp, Homo sapiens
tgtctttagccagcagtcttct

SEQ ID NO: 8411368 - DNA, 22 bp, Homo sapiens
tgtctttagagtcacaaaacca

SEQ ID NO: 8411369 - DNA, 22 bp, Homo sapiens
tgtctttagaaagaagcagaca

SEQ ID NO: 8411370 - DNA, 22 bp, Homo sapiens
tgtctgtctgcacagctcatgg

SEQ ID NO: 8411371 - DNA, 22 bp, Homo sapiens
cctggaggtggaggttgcagtg

SEQ ID NO: 8411372 - DNA, 22 bp, Homo sapiens
tggtggctaccaggtcctgggg

SEQ ID NO: 8411373 - DNA, 22 bp, Homo sapiens
tggtggcttctgaggatggcga

SEQ ID NO: 8411374 - DNA, 22 bp, Homo sapiens
tgtcccagcactttgggagtct

SEQ ID NO: 8411375 - DNA, 19 bp, Homo sapiens
tgtcccagactccgtgtct

SEQ ID NO: 8411376 - DNA, 22 bp, Homo sapiens
cctggcaggctggggacagtgc

SEQ ID NO: 8411377 - DNA, 22 bp, Homo sapiens
cctggcctgtgaatctgagagc

SEQ ID NO: 8411378 - DNA, 22 bp, Homo sapiens
cctggctccagctgcctgtcct

SEQ ID NO: 8411379 - DNA, 19 bp, Homo sapiens
cctggccctgctgcgcggg

SEQ ID NO: 8411380 - DNA, 22 bp, Homo sapiens
tgtctctgtctcccaggttgtg

SEQ ID NO: 8411381 - DNA, 23 bp, Homo sapiens
cccagctgcagacaagggagggt

SEQ ID NO: 8411382 - DNA, 22 bp, Homo sapiens
cccagctggccaggtggctttg

SEQ ID NO: 8411383 - DNA, 22 bp, Homo sapiens
cccagctgatttttgcagagat

SEQ ID NO: 8411384 - DNA, 22 bp, Homo sapiens
cccagctgatttttgcagagat

SEQ ID NO: 8411385 - DNA, 22 bp, Homo sapiens
cccagcttgtctgattcagcct

SEQ ID NO: 8411386 - DNA, 22 bp, Homo sapiens
cccagcttgcgggcggcaggag

SEQ ID NO: 8411387 - DNA, 22 bp, Homo sapiens
cccagcttgcccaggactgagg

SEQ ID NO: 8411388 - DNA, 22 bp, Homo sapiens
cccagcttgcaaatgggttgct

SEQ ID NO: 8411389 - DNA, 19 bp, Homo sapiens
cccagcttgaccacctgct

SEQ ID NO: 8411390 - DNA, 22 bp, Homo sapiens
cccagcttctgagggggccttg

SEQ ID NO: 8411391 - DNA, 18 bp, Homo sapiens
cccagcttagcgcccctc

SEQ ID NO: 8411392 - DNA, 21 bp, Homo sapiens
tctgtggcggactctaggccc

SEQ ID NO: 8411393 - DNA, 22 bp, Homo sapiens
tctgtggcgcatagttgtctct

SEQ ID NO: 8411394 - DNA, 22 bp, Homo sapiens
tctgtggcctgcctcctcattt

SEQ ID NO: 8411395 - DNA, 19 bp, Homo sapiens
tctgtggccttccctgatg

SEQ ID NO: 8411396 - DNA, 22 bp, Homo sapiens
tctgtggcctgtgtccaagtgc

SEQ ID NO: 8411397 - DNA, 22 bp, Homo sapiens
tctgtggcagttctggttcatc

SEQ ID NO: 8411398 - DNA, 22 bp, Homo sapiens
tctgtggcatagtgcttgggaa

SEQ ID NO: 8411399 - DNA, 22 bp, Homo sapiens
tctgtggcatgaggaaataggc

SEQ ID NO: 8411400 - DNA, 22 bp, Homo sapiens
tctgtggcatggtatctggagg

SEQ ID NO: 8411401 - DNA, 22 bp, Homo sapiens
tctgtggcctccttccacttac

SEQ ID NO: 8411402 - DNA, 23 bp, Homo sapiens
tctgtggccccttcgccccactc

SEQ ID NO: 8411403 - DNA, 22 bp, Homo sapiens
tctgtggcatgttgcacttgta

SEQ ID NO: 8411404 - DNA, 22 bp, Homo sapiens
tctgtggcccaagtgatggctg

SEQ ID NO: 8411405 - DNA, 22 bp, Homo sapiens
cccagctcaagcagagagctaa

SEQ ID NO: 8411406 - DNA, 22 bp, Homo sapiens
tgcagggaatctgtggctggac

SEQ ID NO: 8411407 - DNA, 22 bp, Homo sapiens
tgcagggaatgcttgcagcatg

SEQ ID NO: 8411408 - DNA, 22 bp, Homo sapiens
tgcagggaatgcttgcagcatg

SEQ ID NO: 8411409 - DNA, 22 bp, Homo sapiens
tgcagggagctctggggtgcag

SEQ ID NO: 8411410 - DNA, 22 bp, Homo sapiens
tgcagggacaggctctggggat

SEQ ID NO: 8411411 - DNA, 22 bp, Homo sapiens
tgcagggagggcccagcaatct

SEQ ID NO: 8411412 - DNA, 22 bp, Homo sapiens
tgcagggaggccccgcagccct

SEQ ID NO: 8411413 - DNA, 22 bp, Homo sapiens
cccaggcagtagaaagaagagg

SEQ ID NO: 8411414 - DNA, 22 bp, Homo sapiens
cccaggcagggacgtgctctgg

SEQ ID NO: 8411415 - DNA, 22 bp, Homo sapiens
cccaggcaggagtgtggtggct

SEQ ID NO: 8411416 - DNA, 22 bp, Homo sapiens
cccaggcagtgctgatccctca

SEQ ID NO: 8411417 - DNA, 22 bp, Homo sapiens
cccaggcagtctggctctaaag

SEQ ID NO: 8411418 - DNA, 22 bp, Homo sapiens
cccaggcagtgtgtgcatgcgt

SEQ ID NO: 8411419 - DNA, 22 bp, Homo sapiens
cccaggcagcccttctgacgca

SEQ ID NO: 8411420 - DNA, 22 bp, Homo sapiens
cccaggcagccccagaagcttg

SEQ ID NO: 8411421 - DNA, 20 bp, Homo sapiens
cccaggcagagctagcggca

SEQ ID NO: 8411422 - DNA, 22 bp, Homo sapiens
cccaggcagcctgcagggaagg

SEQ ID NO: 8411423 - DNA, 22 bp, Homo sapiens
cccaggcagcggggtctccttg

SEQ ID NO: 8411424 - DNA, 22 bp, Homo sapiens
cccaggcacactgaagtgacat

SEQ ID NO: 8411425 - DNA, 22 bp, Homo sapiens
cccaggcacaccccgaacggaa

SEQ ID NO: 8411426 - DNA, 22 bp, Homo sapiens
cccaggcacagattatcccaat

SEQ ID NO: 8411427 - DNA, 22 bp, Homo sapiens
cccaggcacatccactctgtga

SEQ ID NO: 8411428 - DNA, 22 bp, Homo sapiens
cccaggcagaattagtgtttca

SEQ ID NO: 8411429 - DNA, 22 bp, Homo sapiens
cccaggcactcttggtcatttt

SEQ ID NO: 8411430 - DNA, 22 bp, Homo sapiens
cccaggcagagagctggtgagc

SEQ ID NO: 8411431 - DNA, 22 bp, Homo sapiens
tgcattcaaatcctgatcctgc

SEQ ID NO: 8411432 - DNA, 22 bp, Homo sapiens
tgctccagtgagctggccatcc

SEQ ID NO: 8411433 - DNA, 22 bp, Homo sapiens
cccaggctcctgctgtgttgac

SEQ ID NO: 8411434 - DNA, 22 bp, Homo sapiens
ccccaccttgcaattgttccct

SEQ ID NO: 8411435 - DNA, 22 bp, Homo sapiens
tgctggagcccaggcggccttt

SEQ ID NO: 8411436 - DNA, 22 bp, Homo sapiens
tgctggagcaacattattgtgc

SEQ ID NO: 8411437 - DNA, 22 bp, Homo sapiens
tgctggagagccttggccaagg

SEQ ID NO: 8411438 - DNA, 22 bp, Homo sapiens
tgctggagatcattaatgttca

SEQ ID NO: 8411439 - DNA, 22 bp, Homo sapiens
tgctggagatgaaagggccctg

SEQ ID NO: 8411440 - DNA, 22 bp, Homo sapiens
tgctggagacctgcttgcacca

SEQ ID NO: 8411441 - DNA, 22 bp, Homo sapiens
ccctcagcttctccctgcagct

SEQ ID NO: 8411442 - DNA, 22 bp, Homo sapiens
cctctccagcggcctcagggcc

SEQ ID NO: 8411443 - DNA, 23 bp, Homo sapiens
cctctccagacactgggccttgt

SEQ ID NO: 8411444 - DNA, 22 bp, Homo sapiens
cctctcagccggactgtcaggc

SEQ ID NO: 8411445 - DNA, 22 bp, Homo sapiens
tggcccagtgcttatgctctga

SEQ ID NO: 8411446 - DNA, 22 bp, Homo sapiens
tggcaagagggatgcaaggttt

SEQ ID NO: 8411447 - DNA, 22 bp, Homo sapiens
tggatctggttccctgagcctt

SEQ ID NO: 8411448 - DNA, 22 bp, Homo sapiens
tggagctgactcacaccagcta

SEQ ID NO: 8411449 - DNA, 22 bp, Homo sapiens
tggagctgagagccaggctggc

SEQ ID NO: 8411450 - DNA, 22 bp, Homo sapiens
tggcagatgtggcatagagcat

SEQ ID NO: 8411451 - DNA, 22 bp, Homo sapiens
tggcagatgtatatcacagctt

SEQ ID NO: 8411452 - DNA, 22 bp, Homo sapiens
tggcagattctggttgatactt

SEQ ID NO: 8411453 - DNA, 22 bp, Homo sapiens
tggcagatgtggtttgagacag

SEQ ID NO: 8411454 - DNA, 22 bp, Homo sapiens
tggcagattgtaggcagttagg

SEQ ID NO: 8411455 - DNA, 22 bp, Homo sapiens
tggcagattttctctggaggag

SEQ ID NO: 8411456 - DNA, 22 bp, Homo sapiens
tggcagattttgaagacagaga

SEQ ID NO: 8411457 - DNA, 22 bp, Homo sapiens
ctggcagcattaacagagagca

SEQ ID NO: 8411458 - DNA, 22 bp, Homo sapiens
ctggatttaattaactgttgct

SEQ ID NO: 8411459 - DNA, 22 bp, Homo sapiens
ctggattttgatgagcagtttt

SEQ ID NO: 8411460 - DNA, 22 bp, Homo sapiens
ctgctttagacaactgctggga

SEQ ID NO: 8411461 - DNA, 22 bp, Homo sapiens
ctggaggtgggggcaagagtgt

SEQ ID NO: 8411462 - DNA, 22 bp, Homo sapiens
ctggaggaggaagtctacaatg

SEQ ID NO: 8411463 - DNA, 22 bp, Homo sapiens
ctggaggagcatggactggagt

SEQ ID NO: 8411464 - DNA, 22 bp, Homo sapiens
ctggaggagcaatatggttagg

SEQ ID NO: 8411465 - DNA, 22 bp, Homo sapiens
ctggaggacccctgcctggaag

SEQ ID NO: 8411466 - DNA, 22 bp, Homo sapiens
ctggaggagaacttgaggaagg

SEQ ID NO: 8411467 - DNA, 22 bp, Homo sapiens
ctggaggagagtctgaatgaca

SEQ ID NO: 8411468 - DNA, 22 bp, Homo sapiens
ctggaggccactgtacagattg

SEQ ID NO: 8411469 - DNA, 22 bp, Homo sapiens
ctggaggaataatggcatcttg

SEQ ID NO: 8411470 - DNA, 22 bp, Homo sapiens
ctggaggaatcacagaaggctt

SEQ ID NO: 8411471 - DNA, 22 bp, Homo sapiens
ctggaggaccacagaagctggt

SEQ ID NO: 8411472 - DNA, 22 bp, Homo sapiens
ctggaggacagaggccatgtct

SEQ ID NO: 8411473 - DNA, 22 bp, Homo sapiens
ctgaggagtgggtgggcagtga

SEQ ID NO: 8411474 - DNA, 22 bp, Homo sapiens
ctgaggagtcagttccactcag

SEQ ID NO: 8411475 - DNA, 22 bp, Homo sapiens
ctgaggaggggcctgagtgaga

SEQ ID NO: 8411476 - DNA, 22 bp, Homo sapiens
ctgaggagtcagcttactcact

SEQ ID NO: 8411477 - DNA, 22 bp, Homo sapiens
ctgaggagttggtgaataagcc

SEQ ID NO: 8411478 - DNA, 22 bp, Homo sapiens
ctgaggagtttgggttgttcaa

SEQ ID NO: 8411479 - DNA, 22 bp, Homo sapiens
ctgaggagtttcttatatgtgt

SEQ ID NO: 8411480 - DNA, 22 bp, Homo sapiens
ctgaggagaaagatggtccaag

SEQ ID NO: 8411481 - DNA, 22 bp, Homo sapiens
ctgaggagaaatgggatggttc

SEQ ID NO: 8411482 - DNA, 22 bp, Homo sapiens
ctgaggaggctaatttgaggat

SEQ ID NO: 8411483 - DNA, 22 bp, Homo sapiens
ctgaggagggaagtccccaaag

SEQ ID NO: 8411484 - DNA, 22 bp, Homo sapiens
ctgatcttaagtaacattattt

SEQ ID NO: 8411485 - DNA, 22 bp, Homo sapiens
ctgatgcccctggacctgtgac

SEQ ID NO: 8411486 - DNA, 21 bp, Homo sapiens
ctgcagagcatgcaaaatgtt

SEQ ID NO: 8411487 - DNA, 22 bp, Homo sapiens
ctgattgagaaggaaggggatc

SEQ ID NO: 8411488 - DNA, 20 bp, Homo sapiens
ctgaacacagaataagcaca

SEQ ID NO: 8411489 - DNA, 22 bp, Homo sapiens
ctgaagagcaaaccaactggac

SEQ ID NO: 8411490 - DNA, 19 bp, Homo sapiens
ctgaaaaacattctcagga

SEQ ID NO: 8411491 - DNA, 22 bp, Homo sapiens
ctcttttaattgtcataacaac

SEQ ID NO: 8411492 - DNA, 22 bp, Homo sapiens
ctcttttacaccaaaaggccta

SEQ ID NO: 8411493 - DNA, 22 bp, Homo sapiens
ctcttttatgtgacgtgtgtga

SEQ ID NO: 8411494 - DNA, 22 bp, Homo sapiens
ctcttttagagatgaaaattgg

SEQ ID NO: 8411495 - DNA, 22 bp, Homo sapiens
ctctgggcaaagatgcctcatc

SEQ ID NO: 8411496 - DNA, 19 bp, Homo sapiens
tttgtgaagaaaatgatgc

SEQ ID NO: 8411497 - DNA, 22 bp, Homo sapiens
ttgggatctacatagctatgta

SEQ ID NO: 8411498 - DNA, 21 bp, Homo sapiens
ttgggatctgagaagtgaaaa

SEQ ID NO: 8411499 - DNA, 22 bp, Homo sapiens
ttgggatctcaaatccagctat

SEQ ID NO: 8411500 - DNA, 22 bp, Homo sapiens
ttgatatctctgctgtgttagg

SEQ ID NO: 8411501 - DNA, 22 bp, Homo sapiens
ttgatacaggctctatttcatc

SEQ ID NO: 8411502 - DNA, 22 bp, Homo sapiens
ttggatgaggttgagaatcatt

SEQ ID NO: 8411503 - DNA, 22 bp, Homo sapiens
ttgctttggtagcagctataga

SEQ ID NO: 8411504 - DNA, 22 bp, Homo sapiens
ctccagtgagtgagcaggcgac

SEQ ID NO: 8411505 - DNA, 22 bp, Homo sapiens
ctccagtgagcgcggggcatgg

SEQ ID NO: 8411506 - DNA, 22 bp, Homo sapiens
ttgtttcatggggatgtttatt

SEQ ID NO: 8411507 - DNA, 22 bp, Homo sapiens
ttgtttcaggatggtttgttac

SEQ ID NO: 8411508 - DNA, 22 bp, Homo sapiens
ctccagtgcacccagaggattt

SEQ ID NO: 8411509 - DNA, 22 bp, Homo sapiens
ttgttacagcagcaatagaaaa

SEQ ID NO: 8411510 - DNA, 21 bp, Homo sapiens
ttgttacaatgcaagagtatg

SEQ ID NO: 8411511 - DNA, 22 bp, Homo sapiens
ctccagggaggagcacgggttc

SEQ ID NO: 8411512 - DNA, 22 bp, Homo sapiens
ctccagggatgagacagagtag

SEQ ID NO: 8411513 - DNA, 22 bp, Homo sapiens
ttgtatttgattgtcatatcgt

SEQ ID NO: 8411514 - DNA, 22 bp, Homo sapiens
ttggtaaattatttcttccaat

SEQ ID NO: 8411515 - DNA, 22 bp, Homo sapiens
ttggtaaaatcatagtggtaac

SEQ ID NO: 8411516 - DNA, 22 bp, Homo sapiens
ttggtaaatgttgattgtggct

SEQ ID NO: 8411517 - DNA, 22 bp, Homo sapiens
ttggtaaatccccttacacaaa

SEQ ID NO: 8411518 - DNA, 22 bp, Homo sapiens
ttggtaaatactctttggagac

SEQ ID NO: 8411519 - DNA, 22 bp, Homo sapiens
ttggtaaatactataatcaaat

SEQ ID NO: 8411520 - DNA, 22 bp, Homo sapiens
ttggtaaacttgacagagaatc

SEQ ID NO: 8411521 - DNA, 22 bp, Homo sapiens
ttggtaaataacaatcacagtg

SEQ ID NO: 8411522 - DNA, 22 bp, Homo sapiens
tttagacactagggatgcagtg

SEQ ID NO: 8411523 - DNA, 22 bp, Homo sapiens
tttagacagcatctggtgactt

SEQ ID NO: 8411524 - DNA, 22 bp, Homo sapiens
tttagacatagctgaaatcatt

SEQ ID NO: 8411525 - DNA, 22 bp, Homo sapiens
tttagacacactttgtatattt

SEQ ID NO: 8411526 - DNA, 22 bp, Homo sapiens
tttagacaagatccttctgaat

SEQ ID NO: 8411527 - DNA, 22 bp, Homo sapiens
ctcctgagctctgaggaagctt

SEQ ID NO: 8411528 - DNA, 22 bp, Homo sapiens
tttaaaaaactagtctgagtct

SEQ ID NO: 8411529 - DNA, 22 bp, Homo sapiens
tttaaatttgtgtttagagggt

SEQ ID NO: 8411530 - DNA, 22 bp, Homo sapiens
tttaacactagtttctttaact

SEQ ID NO: 8411531 - DNA, 22 bp, Homo sapiens
tttaacagatagtttcttctgt

SEQ ID NO: 8411532 - DNA, 22 bp, Homo sapiens
tttaaattctgtctgccgctta

SEQ ID NO: 8411533 - DNA, 22 bp, Homo sapiens
tttaaatttagaagaaacactg

SEQ ID NO: 8411534 - DNA, 22 bp, Homo sapiens
tttacacatacctctttaaagt

SEQ ID NO: 8411535 - DNA, 22 bp, Homo sapiens
tttacagttaagaaatgttacc

SEQ ID NO: 8411536 - DNA, 22 bp, Homo sapiens
tttacagttccatgtgataggc

SEQ ID NO: 8411537 - DNA, 17 bp, Homo sapiens
tttacattgctcgcagt

SEQ ID NO: 8411538 - DNA, 22 bp, Homo sapiens
tttacattgcattaggtattat

SEQ ID NO: 8411539 - DNA, 22 bp, Homo sapiens
tttacattgcattaggtattat

SEQ ID NO: 8411540 - DNA, 22 bp, Homo sapiens
tttacatttccctctgtcagtt

SEQ ID NO: 8411541 - DNA, 22 bp, Homo sapiens
tttacatgtaatgttatacaaa

SEQ ID NO: 8411542 - DNA, 22 bp, Homo sapiens
ctctccaggactttggcccaat

SEQ ID NO: 8411543 - DNA, 22 bp, Homo sapiens
ctcctggctcgcccccagctga

SEQ ID NO: 8411544 - DNA, 22 bp, Homo sapiens
ctctccactgtcctttgctggt

SEQ ID NO: 8411545 - DNA, 22 bp, Homo sapiens
ctctccactgtcctttgctggt

SEQ ID NO: 8411546 - DNA, 19 bp, Homo sapiens
ctctcactcgccacatcct

SEQ ID NO: 8411547 - DNA, 22 bp, Homo sapiens
ctctccactcagcgtcatgtcc

SEQ ID NO: 8411548 - DNA, 22 bp, Homo sapiens
ctaatgaagctgctttctatga

SEQ ID NO: 8411549 - DNA, 22 bp, Homo sapiens
ttcccttaaattatggcatcta

SEQ ID NO: 8411550 - DNA, 22 bp, Homo sapiens
ttcccttaaattatggcatcta

SEQ ID NO: 8411551 - DNA, 22 bp, Homo sapiens
ttcccttaaattatggcatcta

SEQ ID NO: 8411552 - DNA, 22 bp, Homo sapiens
ttcacattaagcctcctcctac

SEQ ID NO: 8411553 - DNA, 22 bp, Homo sapiens
ttcacattacaaggccatattt

SEQ ID NO: 8411554 - DNA, 22 bp, Homo sapiens
ttcacataatgatacaaagctt

SEQ ID NO: 8411555 - DNA, 23 bp, Homo sapiens
ttcatgagattatctgcatgtgt

SEQ ID NO: 8411556 - DNA, 22 bp, Homo sapiens
ttcatgaggtacctgtgatcat

SEQ ID NO: 8411557 - DNA, 19 bp, Homo sapiens
ttcattctcttattgttgt

SEQ ID NO: 8411558 - DNA, 22 bp, Homo sapiens
ttcacttatagggatgttattg

SEQ ID NO: 8411559 - DNA, 22 bp, Homo sapiens
ttcacttaacatcatatcatga

SEQ ID NO: 8411560 - DNA, 22 bp, Homo sapiens
ctagggactgggaccttagtta

SEQ ID NO: 8411561 - DNA, 22 bp, Homo sapiens
ctagggacctcagctcctggag

SEQ ID NO: 8411562 - DNA, 22 bp, Homo sapiens
ctagggacagaaagagggtaga

SEQ ID NO: 8411563 - DNA, 22 bp, Homo sapiens
ctattcaggtgtccattaatcc

SEQ ID NO: 8411564 - DNA, 22 bp, Homo sapiens
ctattcagtaagccaaaaccat

SEQ ID NO: 8411565 - DNA, 22 bp, Homo sapiens
ctattcagttgtgggcaacaat

SEQ ID NO: 8411566 - DNA, 22 bp, Homo sapiens
ctattcagcctctaagacaagt

SEQ ID NO: 8411567 - DNA, 22 bp, Homo sapiens
ctattcaacttgactgtttcac

SEQ ID NO: 8411568 - DNA, 22 bp, Homo sapiens
ttctgtcatgctcatgtaattg

SEQ ID NO: 8411569 - DNA, 22 bp, Homo sapiens
ctattttcattcttacattgtc

SEQ ID NO: 8411570 - DNA, 22 bp, Homo sapiens
ctattttccgcagcaggaagta

SEQ ID NO: 8411571 - DNA, 22 bp, Homo sapiens
ctattttcccatatggttgaca

SEQ ID NO: 8411572 - DNA, 22 bp, Homo sapiens
ctattttcattcttacattgtc

SEQ ID NO: 8411573 - DNA, 22 bp, Homo sapiens
ctattttccgcagcaggaagta

SEQ ID NO: 8411574 - DNA, 22 bp, Homo sapiens
ctattttcccatatggttgaca

SEQ ID NO: 8411575 - DNA, 22 bp, Homo sapiens
ctattttctgtctctatagagt

SEQ ID NO: 8411576 - DNA, 22 bp, Homo sapiens
ctattttctgtctctatagagt

SEQ ID NO: 8411577 - DNA, 22 bp, Homo sapiens
ttgaggaggtcctgggtttact

SEQ ID NO: 8411578 - DNA, 22 bp, Homo sapiens
ttgaggaggtatgactaggtac

SEQ ID NO: 8411579 - DNA, 22 bp, Homo sapiens
ttgaggaggtagtacagagtat

SEQ ID NO: 8411580 - DNA, 22 bp, Homo sapiens
ttgaggagtcaggggcacggaa

SEQ ID NO: 8411581 - DNA, 22 bp, Homo sapiens
ttgaggagtacaaagcatgctt

SEQ ID NO: 8411582 - DNA, 22 bp, Homo sapiens
ttgaggagtagaagctttgaat

SEQ ID NO: 8411583 - DNA, 22 bp, Homo sapiens
ttgaggaggacagaaacattta

SEQ ID NO: 8411584 - DNA, 22 bp, Homo sapiens
ttgaggaggaactgtgaggcaa

SEQ ID NO: 8411585 - DNA, 22 bp, Homo sapiens
ttgaggaggcctttcagggctt

SEQ ID NO: 8411586 - DNA, 23 bp, Homo sapiens
ttgaggagcagcgctttttaccg

SEQ ID NO: 8411587 - DNA, 22 bp, Homo sapiens
ttgaggagcaggatgggaggct

SEQ ID NO: 8411588 - DNA, 22 bp, Homo sapiens
ttgaggaggaaaagggggtacc

SEQ ID NO: 8411589 - DNA, 22 bp, Homo sapiens
ttgaggagcactagtcaggtat

SEQ ID NO: 8411590 - DNA, 20 bp, Homo sapiens
ttgaggagatattgaatact

SEQ ID NO: 8411591 - DNA, 22 bp, Homo sapiens
ttgaggagaagactttgcttcc

SEQ ID NO: 8411592 - DNA, 23 bp, Homo sapiens
ttgaggagtgctttttctatcca

SEQ ID NO: 8411593 - DNA, 21 bp, Homo sapiens
ttgaggagtgagagtgggttt

SEQ ID NO: 8411594 - DNA, 22 bp, Homo sapiens
ttgaggagtggcgctggactta

SEQ ID NO: 8411595 - DNA, 22 bp, Homo sapiens
ttgataaaatgatatcttcttt

SEQ ID NO: 8411596 - DNA, 22 bp, Homo sapiens
ttgatacaggccttctagatga

SEQ ID NO: 8411597 - DNA, 22 bp, Homo sapiens
ttgacccagctttccccacaat

SEQ ID NO: 8411598 - DNA, 22 bp, Homo sapiens
gctgctctcatagatggcttca

SEQ ID NO: 8411599 - DNA, 22 bp, Homo sapiens
gctgaggattgaagagttgcca

SEQ ID NO: 8411600 - DNA, 22 bp, Homo sapiens
gctgaaattcagattcctaggc

SEQ ID NO: 8411601 - DNA, 22 bp, Homo sapiens
gctcctgggtgtggctgcccct

SEQ ID NO: 8411602 - DNA, 19 bp, Homo sapiens
gctcctgggcctcactcat

SEQ ID NO: 8411603 - DNA, 22 bp, Homo sapiens
gctctgagtgatcagctgggaa

SEQ ID NO: 8411604 - DNA, 22 bp, Homo sapiens
gctctgaggagccaagaatgtg

SEQ ID NO: 8411605 - DNA, 22 bp, Homo sapiens
gctcctggcaggcagtgtgtgt

SEQ ID NO: 8411606 - DNA, 22 bp, Homo sapiens
gctcatgactgtaatcccagca

SEQ ID NO: 8411607 - DNA, 22 bp, Homo sapiens
gcctgtttggcatcattggttg

SEQ ID NO: 8411608 - DNA, 22 bp, Homo sapiens
gcctgtttgttatgtcatggta

SEQ ID NO: 8411609 - DNA, 22 bp, Homo sapiens
gcctgtttatctatcatgaact

SEQ ID NO: 8411610 - DNA, 22 bp, Homo sapiens
gcctgtttactttgccgcagga

SEQ ID NO: 8411611 - DNA, 22 bp, Homo sapiens
gcctgtttctcctccttggccc

SEQ ID NO: 8411612 - DNA, 22 bp, Homo sapiens
gcctgtttgagaatagtcaggg

SEQ ID NO: 8411613 - DNA, 22 bp, Homo sapiens
gcctgtttgactggtctctgct

SEQ ID NO: 8411614 - DNA, 22 bp, Homo sapiens
gccagggaaactgcagaccagc

SEQ ID NO: 8411615 - DNA, 22 bp, Homo sapiens
gccatgtcctgggcatctgcca

SEQ ID NO: 8411616 - DNA, 22 bp, Homo sapiens
gcccaggataatgctgtccctg

SEQ ID NO: 8411617 - DNA, 22 bp, Homo sapiens
gcccaggattctttcttcctta

SEQ ID NO: 8411618 - DNA, 22 bp, Homo sapiens
gcccaggctggagtgcagtagc

SEQ ID NO: 8411619 - DNA, 22 bp, Homo sapiens
gcctggagggatagaatgcaag

SEQ ID NO: 8411620 - DNA, 22 bp, Homo sapiens
gcctgttctccagcatccaggt

SEQ ID NO: 8411621 - DNA, 22 bp, Homo sapiens
gcctgttctgccctgagagcct

SEQ ID NO: 8411622 - DNA, 22 bp, Homo sapiens
gattttactgtctgtgtatctc

SEQ ID NO: 8411623 - DNA, 22 bp, Homo sapiens
gattttactgtctgtgtatctc

SEQ ID NO: 8411624 - DNA, 22 bp, Homo sapiens
gattttacaaactgcaggaccc

SEQ ID NO: 8411625 - DNA, 22 bp, Homo sapiens
gattttacaaactgcaggaccc

SEQ ID NO: 8411626 - DNA, 22 bp, Homo sapiens
gattttacatgtcatatctatt

SEQ ID NO: 8411627 - DNA, 22 bp, Homo sapiens
gattttacatgtcatatctatt

SEQ ID NO: 8411628 - DNA, 21 bp, Homo sapiens
gattttaaagagactgccaca

SEQ ID NO: 8411629 - DNA, 22 bp, Homo sapiens
gattttattagcccaaactttg

SEQ ID NO: 8411630 - DNA, 22 bp, Homo sapiens
gattttatatggcatactgtgg

SEQ ID NO: 8411631 - DNA, 22 bp, Homo sapiens
gattttatcgtcatccttctgg

SEQ ID NO: 8411632 - DNA, 22 bp, Homo sapiens
gattttcatgataaacttgtga

SEQ ID NO: 8411633 - DNA, 22 bp, Homo sapiens
gattttcattatagctagtttc

SEQ ID NO: 8411634 - DNA, 22 bp, Homo sapiens
gattttcatgataaacttgtga

SEQ ID NO: 8411635 - DNA, 22 bp, Homo sapiens
gattttcatgataaacttgtga

SEQ ID NO: 8411636 - DNA, 22 bp, Homo sapiens
gattttcattatagctagtttc

SEQ ID NO: 8411637 - DNA, 22 bp, Homo sapiens
gattttcatttgcactctagaa

SEQ ID NO: 8411638 - DNA, 22 bp, Homo sapiens
gattttcatttgcactctagaa

SEQ ID NO: 8411639 - DNA, 22 bp, Homo sapiens
gcaattattatgtgacttttac

SEQ ID NO: 8411640 - DNA, 22 bp, Homo sapiens
gcacaagaataaccatatttaa

SEQ ID NO: 8411641 - DNA, 22 bp, Homo sapiens
gcaaacattcaggagtacagga

SEQ ID NO: 8411642 - DNA, 22 bp, Homo sapiens
gatttttcagtataaaatatat

SEQ ID NO: 8411643 - DNA, 22 bp, Homo sapiens
gattttctgagccttcaaattt

SEQ ID NO: 8411644 - DNA, 22 bp, Homo sapiens
gcagagcagtgcttgcccagcg

SEQ ID NO: 8411645 - DNA, 22 bp, Homo sapiens
gcacttgtcaaatattatagta

SEQ ID NO: 8411646 - DNA, 22 bp, Homo sapiens
gcaccgccttggaccgcccgct

SEQ ID NO: 8411647 - DNA, 22 bp, Homo sapiens
gcacccaggcttgggcagcaac

SEQ ID NO: 8411648 - DNA, 22 bp, Homo sapiens
gcacccagggacttggctggcc

SEQ ID NO: 8411649 - DNA, 22 bp, Homo sapiens
gcacccagtttgtctcagggtt

SEQ ID NO: 8411650 - DNA, 22 bp, Homo sapiens
gcacaataattcttgttttgct

SEQ ID NO: 8411651 - DNA, 22 bp, Homo sapiens
gcacaagtttcttcattgttca

SEQ ID NO: 8411652 - DNA, 22 bp, Homo sapiens
gcacaataacagccaaggttat

SEQ ID NO: 8411653 - DNA, 22 bp, Homo sapiens
gcacaatggaccgtgtgctctg

SEQ ID NO: 8411654 - DNA, 22 bp, Homo sapiens
gcacccaggccggcgactgcag

SEQ ID NO: 8411655 - DNA, 22 bp, Homo sapiens
gcacccaggccggcgactgcag

SEQ ID NO: 8411656 - DNA, 22 bp, Homo sapiens
gatgcattgcatcgagtagctt

SEQ ID NO: 8411657 - DNA, 22 bp, Homo sapiens
gatgcattacaaaagtgattat

SEQ ID NO: 8411658 - DNA, 22 bp, Homo sapiens
gatgcattacaaaagtgattat

SEQ ID NO: 8411659 - DNA, 22 bp, Homo sapiens
gatgcgggcccgctccactgcc

SEQ ID NO: 8411660 - DNA, 22 bp, Homo sapiens
gatgcgggcccgctccactgcc

SEQ ID NO: 8411661 - DNA, 22 bp, Homo sapiens
gatggctggctatatcagggga

SEQ ID NO: 8411662 - DNA, 22 bp, Homo sapiens
gatggcttaagagtaaaaggca

SEQ ID NO: 8411663 - DNA, 22 bp, Homo sapiens
gatgggcgtggcgcgtttggtg

SEQ ID NO: 8411664 - DNA, 22 bp, Homo sapiens
gatggtgcaggtgaagtgctgg

SEQ ID NO: 8411665 - DNA, 22 bp, Homo sapiens
gatggtctttgtctctgataag

SEQ ID NO: 8411666 - DNA, 22 bp, Homo sapiens
gatggtctgtattaaacagatg

SEQ ID NO: 8411667 - DNA, 22 bp, Homo sapiens
gatgtagacacttggaggctta

SEQ ID NO: 8411668 - DNA, 22 bp, Homo sapiens
gatttattgtccctgtcctgct

SEQ ID NO: 8411669 - DNA, 22 bp, Homo sapiens
gatttatttttaatcagcaggg

SEQ ID NO: 8411670 - DNA, 22 bp, Homo sapiens
gattgagtctgaggatgctgca

SEQ ID NO: 8411671 - DNA, 22 bp, Homo sapiens
gatttacagatctaagggtcac

SEQ ID NO: 8411672 - DNA, 22 bp, Homo sapiens
gatttacaaagctctctagtgt

SEQ ID NO: 8411673 - DNA, 22 bp, Homo sapiens
gattctttacatctctgctgac

SEQ ID NO: 8411674 - DNA, 22 bp, Homo sapiens
gattctttgacagggtgttggg

SEQ ID NO: 8411675 - DNA, 22 bp, Homo sapiens
gattctttggcctttattgaca

SEQ ID NO: 8411676 - DNA, 22 bp, Homo sapiens
gattctttactcagattttgtt

SEQ ID NO: 8411677 - DNA, 22 bp, Homo sapiens
gattctttagcccagaaagtta

SEQ ID NO: 8411678 - DNA, 22 bp, Homo sapiens
gattcaaaaataagctcctatt

SEQ ID NO: 8411679 - DNA, 22 bp, Homo sapiens
gattcaaagttaatgaagatgc

SEQ ID NO: 8411680 - DNA, 22 bp, Homo sapiens
gattcaaaagtttgagctccaa

SEQ ID NO: 8411681 - DNA, 22 bp, Homo sapiens
gattcaaagacagactcatttc

SEQ ID NO: 8411682 - DNA, 22 bp, Homo sapiens
gatgtttcatgctagcatgtgt

SEQ ID NO: 8411683 - DNA, 22 bp, Homo sapiens
gatgttaagaaggaattgaagt

SEQ ID NO: 8411684 - DNA, 21 bp, Homo sapiens
gattaaatttaagctacatgc

SEQ ID NO: 8411685 - DNA, 20 bp, Homo sapiens
gattacaaaatgaaatgcat

SEQ ID NO: 8411686 - DNA, 22 bp, Homo sapiens
gcatggtggccttagggtagcc

SEQ ID NO: 8411687 - DNA, 22 bp, Homo sapiens
gcatgttttgcaacaagtgacc

SEQ ID NO: 8411688 - DNA, 19 bp, Homo sapiens
gccagcagaatgatgaggc

SEQ ID NO: 8411689 - DNA, 22 bp, Homo sapiens
gcagtgttaggaataaaaatga

SEQ ID NO: 8411690 - DNA, 22 bp, Homo sapiens
gcagtagtgtcagtacagcaaa

SEQ ID NO: 8411691 - DNA, 22 bp, Homo sapiens
gcagctattgtctcctgggccc

SEQ ID NO: 8411692 - DNA, 22 bp, Homo sapiens
gcaggagctgctctcctgacga

SEQ ID NO: 8411693 - DNA, 22 bp, Homo sapiens
gcaggcaccgggttgctcccct

SEQ ID NO: 8411694 - DNA, 22 bp, Homo sapiens
gcagggaccttgcccaccctcc

SEQ ID NO: 8411695 - DNA, 22 bp, Homo sapiens
gcagggacgcagcactctccgt

SEQ ID NO: 8411696 - DNA, 21 bp, Homo sapiens
gcaggggatagaaatggtctg

SEQ ID NO: 8411697 - DNA, 22 bp, Homo sapiens
gcaggggctaaggacacagaga

SEQ ID NO: 8411698 - DNA, 21 bp, Homo sapiens
gacaggactagaccagagctc

SEQ ID NO: 8411699 - DNA, 22 bp, Homo sapiens
gaaggcctcactctgcagcata

SEQ ID NO: 8411700 - DNA, 22 bp, Homo sapiens
gaactgtagttaatactacaca

SEQ ID NO: 8411701 - DNA, 22 bp, Homo sapiens
gaactgtgtacattgtagataa

SEQ ID NO: 8411702 - DNA, 22 bp, Homo sapiens
gaactgtgggtaatatattaga

SEQ ID NO: 8411703 - DNA, 22 bp, Homo sapiens
gaaggaagtcattagtgcagac

SEQ ID NO: 8411704 - DNA, 22 bp, Homo sapiens
gaagtgaaggttactctagatt

SEQ ID NO: 8411705 - DNA, 22 bp, Homo sapiens
gaagtgaagagattagaaatca

SEQ ID NO: 8411706 - DNA, 22 bp, Homo sapiens
gaagtgtagtcttgagccccca

SEQ ID NO: 8411707 - DNA, 22 bp, Homo sapiens
gactgtctctgtgaatggtagg

SEQ ID NO: 8411708 - DNA, 22 bp, Homo sapiens
gactgtctcctgtcatgaggga

SEQ ID NO: 8411709 - DNA, 22 bp, Homo sapiens
gactgtcttgtttctaagatga

SEQ ID NO: 8411710 - DNA, 22 bp, Homo sapiens
gactgtcttttgaataaaaatg

SEQ ID NO: 8411711 - DNA, 22 bp, Homo sapiens
gactgtggcaggctcagcactg

SEQ ID NO: 8411712 - DNA, 22 bp, Homo sapiens
gactgtggccttggaccatggg

SEQ ID NO: 8411713 - DNA, 22 bp, Homo sapiens
gactgtgggaagactgtaggtt

SEQ ID NO: 8411714 - DNA, 22 bp, Homo sapiens
gactgtgggctccttgagggca

SEQ ID NO: 8411715 - DNA, 22 bp, Homo sapiens
gactgtggtctgttctccaggt

SEQ ID NO: 8411716 - DNA, 22 bp, Homo sapiens
gacccagggtatccagagctgc

SEQ ID NO: 8411717 - DNA, 22 bp, Homo sapiens
gacccagggtggtcacctgaaa

SEQ ID NO: 8411718 - DNA, 22 bp, Homo sapiens
gacccaggcccaaggctgccag

SEQ ID NO: 8411719 - DNA, 22 bp, Homo sapiens
gacccagcttaagtcacatgtt

SEQ ID NO: 8411720 - DNA, 22 bp, Homo sapiens
gacccagcttaagtcacatgtt

SEQ ID NO: 8411721 - DNA, 22 bp, Homo sapiens
gacccagcctggtttttatagg

SEQ ID NO: 8411722 - DNA, 22 bp, Homo sapiens
gacccagctaaccaggtgggga

SEQ ID NO: 8411723 - DNA, 18 bp, Homo sapiens
gacccagcagatgggctt

SEQ ID NO: 8411724 - DNA, 22 bp, Homo sapiens
gacccagaaggagtgccctaga

SEQ ID NO: 8411725 - DNA, 22 bp, Homo sapiens
gagagctggattctggataggt

SEQ ID NO: 8411726 - DNA, 22 bp, Homo sapiens
gagagctgggctttgggtgaag

SEQ ID NO: 8411727 - DNA, 22 bp, Homo sapiens
gagagctgggggactgtggatg

SEQ ID NO: 8411728 - DNA, 22 bp, Homo sapiens
gagagtctaggaacctcatata

SEQ ID NO: 8411729 - DNA, 22 bp, Homo sapiens
gagaaaagcgaaggacctggag

SEQ ID NO: 8411730 - DNA, 22 bp, Homo sapiens
gagaaaatcttgggtcaagaat

SEQ ID NO: 8411731 - DNA, 22 bp, Homo sapiens
gactttatttccttatttgtga

SEQ ID NO: 8411732 - DNA, 22 bp, Homo sapiens
gagacacagcagatattcaatc

SEQ ID NO: 8411733 - DNA, 22 bp, Homo sapiens
gagacacaggcacagaagaggc

SEQ ID NO: 8411734 - DNA, 22 bp, Homo sapiens
gagacacaagacgcaactctgt

SEQ ID NO: 8411735 - DNA, 22 bp, Homo sapiens
gagacacaatctcatttacatt

SEQ ID NO: 8411736 - DNA, 22 bp, Homo sapiens
gagacacacccaaggttatgag

SEQ ID NO: 8411737 - DNA, 22 bp, Homo sapiens
gagacacacattctggagagaa

SEQ ID NO: 8411738 - DNA, 22 bp, Homo sapiens
cttctcagttgcaagtgtcaga

SEQ ID NO: 8411739 - DNA, 22 bp, Homo sapiens
ctggctggtcatgtcatgagcc

SEQ ID NO: 8411740 - DNA, 22 bp, Homo sapiens
cttctttcaagaatggattagg

SEQ ID NO: 8411741 - DNA, 22 bp, Homo sapiens
cttctttagggatctcttgctg

SEQ ID NO: 8411742 - DNA, 22 bp, Homo sapiens
cttctttcccaggcatgtttta

SEQ ID NO: 8411743 - DNA, 22 bp, Homo sapiens
cttctttccttcctccagtggc

SEQ ID NO: 8411744 - DNA, 22 bp, Homo sapiens
cttctttcttttgatcacaggt

SEQ ID NO: 8411745 - DNA, 22 bp, Homo sapiens
ctttatgaaggaacaatgctcc

SEQ ID NO: 8411746 - DNA, 21 bp, Homo sapiens
cttggctgcagtgacaggcat

SEQ ID NO: 8411747 - DNA, 21 bp, Homo sapiens
cttggctgcagtgacaggcat

SEQ ID NO: 8411748 - DNA, 22 bp, Homo sapiens
cttggctgtcataaggtcctgg

SEQ ID NO: 8411749 - DNA, 22 bp, Homo sapiens
cttggctgtcataaggtcctgg

SEQ ID NO: 8411750 - DNA, 22 bp, Homo sapiens
cttggctgtaaaatcagaggct

SEQ ID NO: 8411751 - DNA, 22 bp, Homo sapiens
cttggctgttgggcattgagaa

SEQ ID NO: 8411752 - DNA, 22 bp, Homo sapiens
cttggctgtctataggaaagag

SEQ ID NO: 8411753 - DNA, 22 bp, Homo sapiens
cttggggatgcaaagccagtgt

SEQ ID NO: 8411754 - DNA, 22 bp, Homo sapiens
cttgggatgtaacctttgttcc

SEQ ID NO: 8411755 - DNA, 22 bp, Homo sapiens
gaaaggccacgtgccaagatta

SEQ ID NO: 8411756 - DNA, 22 bp, Homo sapiens
gaaaacactttgatctgaaagt

SEQ ID NO: 8411757 - DNA, 22 bp, Homo sapiens
cttttacactcatctgggaggg

SEQ ID NO: 8411758 - DNA, 21 bp, Homo sapiens
gaaaagcaagggagtagaaca

SEQ ID NO: 8411759 - DNA, 22 bp, Homo sapiens
gaaatacaaagccagccatttt

SEQ ID NO: 8411760 - DNA, 22 bp, Homo sapiens
gaggagggttggccttaggtag

SEQ ID NO: 8411761 - DNA, 22 bp, Homo sapiens
gaggagggagaattaggcttaa

SEQ ID NO: 8411762 - DNA, 23 bp, Homo sapiens
gaggagggtctgacaagtgtagc

SEQ ID NO: 8411763 - DNA, 22 bp, Homo sapiens
gaggagggagctggaagctctt

SEQ ID NO: 8411764 - DNA, 22 bp, Homo sapiens
gaggagggagctggaagctctt

SEQ ID NO: 8411765 - DNA, 23 bp, Homo sapiens
gaggcagctcctgcagtgccctg

SEQ ID NO: 8411766 - DNA, 22 bp, Homo sapiens
gaggcagctgggatacaaggga

SEQ ID NO: 8411767 - DNA, 20 bp, Homo sapiens
gaggcctcagcctcagctcc

SEQ ID NO: 8411768 - DNA, 20 bp, Homo sapiens
gaggcctcagcctcagctcc

SEQ ID NO: 8411769 - DNA, 22 bp, Homo sapiens
gaggaatgggtgtctcgtgatt

SEQ ID NO: 8411770 - DNA, 21 bp, Homo sapiens
gaggaatggtttgcaaagcac

SEQ ID NO: 8411771 - DNA, 22 bp, Homo sapiens
gaggaatgttattaaaggagct

SEQ ID NO: 8411772 - DNA, 22 bp, Homo sapiens
gaggaatgtcagcacaggcctc

SEQ ID NO: 8411773 - DNA, 22 bp, Homo sapiens
gaggacaaggccttgcaattct

SEQ ID NO: 8411774 - DNA, 22 bp, Homo sapiens
gaggacaagctgtgagtggggt

SEQ ID NO: 8411775 - DNA, 22 bp, Homo sapiens
gaggacaaagcccaggtgctgg

SEQ ID NO: 8411776 - DNA, 22 bp, Homo sapiens
gaggaagatggttgagtggtcc

SEQ ID NO: 8411777 - DNA, 22 bp, Homo sapiens
gagagtctagtgcacctagttt

SEQ ID NO: 8411778 - DNA, 22 bp, Homo sapiens
gagagtctaggaacctcatata

SEQ ID NO: 8411779 - DNA, 22 bp, Homo sapiens
gaggggcacagtaaagggtccc

SEQ ID NO: 8411780 - DNA, 22 bp, Homo sapiens
gaggggcaatgagggaaagagt

SEQ ID NO: 8411781 - DNA, 22 bp, Homo sapiens
gagggccaaagagcaagagcct

SEQ ID NO: 8411782 - DNA, 22 bp, Homo sapiens
gaggctgcccacacctgcgccg

SEQ ID NO: 8411783 - DNA, 22 bp, Homo sapiens
gaggctgcccaactggagtgga

SEQ ID NO: 8411784 - DNA, 22 bp, Homo sapiens
gagtctctgctatgttttctct

SEQ ID NO: 8411785 - DNA, 22 bp, Homo sapiens
gagtgagggcagcaggggctgc

SEQ ID NO: 8411786 - DNA, 22 bp, Homo sapiens
gataaagggggaccaaatgact

SEQ ID NO: 8411787 - DNA, 22 bp, Homo sapiens
gatacagctctggccagatgtg

SEQ ID NO: 8411788 - DNA, 22 bp, Homo sapiens
gatcaatactattaagatcata

SEQ ID NO: 8411789 - DNA, 22 bp, Homo sapiens
gatcatgtgatttgaagtaatg

SEQ ID NO: 8411790 - DNA, 22 bp, Homo sapiens
gatatttacattaagcacattg

SEQ ID NO: 8411791 - DNA, 22 bp, Homo sapiens
gatctttactactgccttctct

SEQ ID NO: 8411792 - DNA, 21 bp, Homo sapiens
gatctttactttcctacttac

SEQ ID NO: 8411793 - DNA, 22 bp, Homo sapiens
gatctttagccaagacacacca

SEQ ID NO: 8411794 - DNA, 22 bp, Homo sapiens
gatcttttcagtcttggtagtt

SEQ ID NO: 8411795 - DNA, 22 bp, Homo sapiens
gatcttttcagtcttggtagtt

SEQ ID NO: 8411796 - DNA, 22 bp, Homo sapiens
gatcttttcaggtttctctagt

SEQ ID NO: 8411797 - DNA, 22 bp, Homo sapiens
gatcttttcaggtttctctagt

SEQ ID NO: 8411798 - DNA, 22 bp, Homo sapiens
gatcttttcagaatttatcagt

SEQ ID NO: 8411799 - DNA, 22 bp, Homo sapiens
gatcttttcagaatttatcagt

SEQ ID NO: 8411800 - DNA, 17 bp, Homo sapiens
gatgaaatgatgcacac

SEQ ID NO: 8411801 - DNA, 20 bp, Homo sapiens
gatgaaatcactgggcagcc

SEQ ID NO: 8411802 - DNA, 22 bp, Homo sapiens
gatgaaggggctggtgccctct

SEQ ID NO: 8411803 - DNA, 22 bp, Homo sapiens
ggccagaagttggaaaagagcc

SEQ ID NO: 8411804 - DNA, 22 bp, Homo sapiens
ggccccagttcactcctggccg

SEQ ID NO: 8411805 - DNA, 22 bp, Homo sapiens
ggctcctgctgtcctttgaagc

SEQ ID NO: 8411806 - DNA, 21 bp, Homo sapiens
ggctcctgctttgtgaggggc

SEQ ID NO: 8411807 - DNA, 22 bp, Homo sapiens
ggctccaagtctcagagtgaag

SEQ ID NO: 8411808 - DNA, 22 bp, Homo sapiens
ggccttcctgctgctccgggcc

SEQ ID NO: 8411809 - DNA, 21 bp, Homo sapiens
ggccttcccctgcagtctccg

SEQ ID NO: 8411810 - DNA, 22 bp, Homo sapiens
ggccttcctggcggctcagggt

SEQ ID NO: 8411811 - DNA, 22 bp, Homo sapiens
ggctttgctttggctgtttcag

SEQ ID NO: 8411812 - DNA, 22 bp, Homo sapiens
ggctttgcttctccagatgctt

SEQ ID NO: 8411813 - DNA, 22 bp, Homo sapiens
ggctttgggccctcaagtctcc

SEQ ID NO: 8411814 - DNA, 22 bp, Homo sapiens
gggaacactccagggcttggaa

SEQ ID NO: 8411815 - DNA, 19 bp, Homo sapiens
ggctgtggtggtgccttgc

SEQ ID NO: 8411816 - DNA, 22 bp, Homo sapiens
ggctgagttgagaggattactt

SEQ ID NO: 8411817 - DNA, 22 bp, Homo sapiens
ggctgatcaggtgcaaatgcat

SEQ ID NO: 8411818 - DNA, 22 bp, Homo sapiens
ggctcctgggatgggactgagc

SEQ ID NO: 8411819 - DNA, 22 bp, Homo sapiens
ggctcctgggagatagaggtca

SEQ ID NO: 8411820 - DNA, 22 bp, Homo sapiens
ggctcctgttatttaatgagga

SEQ ID NO: 8411821 - DNA, 22 bp, Homo sapiens
gggccatgagaggttcatcaac

SEQ ID NO: 8411822 - DNA, 22 bp, Homo sapiens
gggcggatcatttgaggtcagg

SEQ ID NO: 8411823 - DNA, 22 bp, Homo sapiens
gggcggatcatttgaggtcagg

SEQ ID NO: 8411824 - DNA, 22 bp, Homo sapiens
gggcggatcatttgaggtcagg

SEQ ID NO: 8411825 - DNA, 22 bp, Homo sapiens
gggcggatcacctgaggtcagg

SEQ ID NO: 8411826 - DNA, 22 bp, Homo sapiens
gggcggatcacctgaggtcagg

SEQ ID NO: 8411827 - DNA, 22 bp, Homo sapiens
gggcggatcacctgaggtcagg

SEQ ID NO: 8411828 - DNA, 20 bp, Homo sapiens
gggagaagggctgatgagag

SEQ ID NO: 8411829 - DNA, 22 bp, Homo sapiens
gggagaaggagctagttcttga

SEQ ID NO: 8411830 - DNA, 22 bp, Homo sapiens
gggagaaggaggactgtgctgt

SEQ ID NO: 8411831 - DNA, 22 bp, Homo sapiens
gggagaagaatgtgtcaattgt

SEQ ID NO: 8411832 - DNA, 22 bp, Homo sapiens
gggacctggtctagcactgagc

SEQ ID NO: 8411833 - DNA, 23 bp, Homo sapiens
gggacctggtaggaggtgattgg

SEQ ID NO: 8411834 - DNA, 22 bp, Homo sapiens
gggacctggggactccttgttc

SEQ ID NO: 8411835 - DNA, 22 bp, Homo sapiens
gggacctggcacctttgctctg

SEQ ID NO: 8411836 - DNA, 22 bp, Homo sapiens
gggacctggcgagggtcacaca

SEQ ID NO: 8411837 - DNA, 22 bp, Homo sapiens
gggacctgggccagaggacagt

SEQ ID NO: 8411838 - DNA, 22 bp, Homo sapiens
gggacctgccaaggccacccag

SEQ ID NO: 8411839 - DNA, 22 bp, Homo sapiens
gggacctgccattgctcacagg

SEQ ID NO: 8411840 - DNA, 22 bp, Homo sapiens
gggacctgaggccctgctccac

SEQ ID NO: 8411841 - DNA, 22 bp, Homo sapiens
gggacctgcgccactcactgtc

SEQ ID NO: 8411842 - DNA, 22 bp, Homo sapiens
gggacctggacatgtgtgtgct

SEQ ID NO: 8411843 - DNA, 22 bp, Homo sapiens
gggaccctgggaggctggcgca

SEQ ID NO: 8411844 - DNA, 22 bp, Homo sapiens
gggacctgaggaggggtttcag

SEQ ID NO: 8411845 - DNA, 19 bp, Homo sapiens
gggacctgactaattggca

SEQ ID NO: 8411846 - DNA, 22 bp, Homo sapiens
gggatggggagctggaaagggg

SEQ ID NO: 8411847 - DNA, 22 bp, Homo sapiens
gggagggaaagcttgatctgtc

SEQ ID NO: 8411848 - DNA, 22 bp, Homo sapiens
gggagggaaggtacctgtgtga

SEQ ID NO: 8411849 - DNA, 22 bp, Homo sapiens
gggagggaaggaggcgccgtgt

SEQ ID NO: 8411850 - DNA, 22 bp, Homo sapiens
gggagggaaggaccttatgaat

SEQ ID NO: 8411851 - DNA, 22 bp, Homo sapiens
ggggtactggctggagccccac

SEQ ID NO: 8411852 - DNA, 22 bp, Homo sapiens
gggggtcccaagctgggctgct

SEQ ID NO: 8411853 - DNA, 22 bp, Homo sapiens
gggggctctgactccctcagct

SEQ ID NO: 8411854 - DNA, 19 bp, Homo sapiens
ggggagaactagagacagc

SEQ ID NO: 8411855 - DNA, 19 bp, Homo sapiens
ggggagaactagagacagc

SEQ ID NO: 8411856 - DNA, 22 bp, Homo sapiens
ggggacctaggctctgtctctt

SEQ ID NO: 8411857 - DNA, 22 bp, Homo sapiens
ggggacctgggcttcaagggtt

SEQ ID NO: 8411858 - DNA, 22 bp, Homo sapiens
ggggaccttcccagagcagttg

SEQ ID NO: 8411859 - DNA, 22 bp, Homo sapiens
ggggacctggccacccatcctt

SEQ ID NO: 8411860 - DNA, 22 bp, Homo sapiens
ggggacctttccatttctgaga

SEQ ID NO: 8411861 - DNA, 22 bp, Homo sapiens
ggaggtgggagcctccagtggt

SEQ ID NO: 8411862 - DNA, 22 bp, Homo sapiens
ggaggtcaaatggagggctggg

SEQ ID NO: 8411863 - DNA, 22 bp, Homo sapiens
ggagggaaccttggctggattg

SEQ ID NO: 8411864 - DNA, 22 bp, Homo sapiens
ggagggaagtgagttctcagct

SEQ ID NO: 8411865 - DNA, 22 bp, Homo sapiens
ggagggaatgtctagcattctt

SEQ ID NO: 8411866 - DNA, 22 bp, Homo sapiens
ggcaggctgggagtcatcagag

SEQ ID NO: 8411867 - DNA, 22 bp, Homo sapiens
ggcaggctccagagccctctcc

SEQ ID NO: 8411868 - DNA, 22 bp, Homo sapiens
ggagttgattttggatatatta

SEQ ID NO: 8411869 - DNA, 22 bp, Homo sapiens
ggcagacctctccagccccaca

SEQ ID NO: 8411870 - DNA, 22 bp, Homo sapiens
ggaggccagggacccagtcagc

SEQ ID NO: 8411871 - DNA, 22 bp, Homo sapiens
ggagctgaggacactacatttt

SEQ ID NO: 8411872 - DNA, 22 bp, Homo sapiens
ggagctgaggctgaggcctcac

SEQ ID NO: 8411873 - DNA, 22 bp, Homo sapiens
ggagctgagcagcgatggcgga

SEQ ID NO: 8411874 - DNA, 22 bp, Homo sapiens
ggagctgagagtagtccctttt

SEQ ID NO: 8411875 - DNA, 22 bp, Homo sapiens
ggagctgaggaatagctttgat

SEQ ID NO: 8411876 - DNA, 22 bp, Homo sapiens
ggagctgagttcttcagccggg

SEQ ID NO: 8411877 - DNA, 22 bp, Homo sapiens
ggagctgatgacgtcaccatgg

SEQ ID NO: 8411878 - DNA, 22 bp, Homo sapiens
ggagctgaggtaacagtgagtg

SEQ ID NO: 8411879 - DNA, 22 bp, Homo sapiens
ggagctgagtgggtttattgat

SEQ ID NO: 8411880 - DNA, 22 bp, Homo sapiens
ggaggaaatccttagtaaggca

SEQ ID NO: 8411881 - DNA, 22 bp, Homo sapiens
ggagctgatggtagaagaatga

SEQ ID NO: 8411882 - DNA, 22 bp, Homo sapiens
ggagctgaaccccatcgtgctg

SEQ ID NO: 8411883 - DNA, 22 bp, Homo sapiens
ggagctgaaggggtgggctcag

SEQ ID NO: 8411884 - DNA, 22 bp, Homo sapiens
ggagctgagacccagtggctga

SEQ ID NO: 8411885 - DNA, 22 bp, Homo sapiens
ggaggaaatgaaaggagggttt

SEQ ID NO: 8411886 - DNA, 22 bp, Homo sapiens
ggaggacactggctctgccttc

SEQ ID NO: 8411887 - DNA, 22 bp, Homo sapiens
ggagatcttgcttgaaggcatg

SEQ ID NO: 8411888 - DNA, 22 bp, Homo sapiens
ggaataaagaatctggttcccc

SEQ ID NO: 8411889 - DNA, 22 bp, Homo sapiens
ggaataaaaattgtttactgta

SEQ ID NO: 8411890 - DNA, 22 bp, Homo sapiens
ggagaaggaagaaagctactat

SEQ ID NO: 8411891 - DNA, 21 bp, Homo sapiens
ggagaaggacaatgttgagta

SEQ ID NO: 8411892 - DNA, 22 bp, Homo sapiens
ggagaaggcacacccacctctg

SEQ ID NO: 8411893 - DNA, 22 bp, Homo sapiens
ggagaaggaatattggagtagg

SEQ ID NO: 8411894 - DNA, 22 bp, Homo sapiens
ggagaaggaagaaagctactat

SEQ ID NO: 8411895 - DNA, 17 bp, Homo sapiens
ggagacagggtctttaa

SEQ ID NO: 8411896 - DNA, 22 bp, Homo sapiens
ggagacaatggaggccaaaaga

SEQ ID NO: 8411897 - DNA, 23 bp, Homo sapiens
ggagacaaggtaccacgttaaca

SEQ ID NO: 8411898 - DNA, 17 bp, Homo sapiens
ggaaggtcaaggggagg

SEQ ID NO: 8411899 - DNA, 22 bp, Homo sapiens
ggaagaaatgctcttctatgcg

SEQ ID NO: 8411900 - DNA, 22 bp, Homo sapiens
ggaagaaatctggttaagagat

SEQ ID NO: 8411901 - DNA, 22 bp, Homo sapiens
ggaactgattaagtcatgagaa

SEQ ID NO: 8411902 - DNA, 22 bp, Homo sapiens
ggaactgaggaacgaactggga

SEQ ID NO: 8411903 - DNA, 22 bp, Homo sapiens
ggaagaaagcacacaaacttga

SEQ ID NO: 8411904 - DNA, 20 bp, Homo sapiens
ggaaaaatgcatgctcaaga

SEQ ID NO: 8411905 - DNA, 22 bp, Homo sapiens
gcttagcaaacatctgtagtcc

SEQ ID NO: 8411906 - DNA, 22 bp, Homo sapiens
gcttagcaatgtgacaagatgc

SEQ ID NO: 8411907 - DNA, 22 bp, Homo sapiens
gcttagcacagaatgagagttc

SEQ ID NO: 8411908 - DNA, 20 bp, Homo sapiens
gcttagcaggcatagtagct

SEQ ID NO: 8411909 - DNA, 22 bp, Homo sapiens
gcttagcatcttacaatgctga

SEQ ID NO: 8411910 - DNA, 22 bp, Homo sapiens
gcttagcagtcacacattgttc

SEQ ID NO: 8411911 - DNA, 22 bp, Homo sapiens
gcttagcagtgtgtgcttttga

SEQ ID NO: 8411912 - DNA, 22 bp, Homo sapiens
gcttatgatgtttacataaaag

SEQ ID NO: 8411913 - DNA, 22 bp, Homo sapiens
gcttcctgtccctcagccatga

SEQ ID NO: 8411914 - DNA, 22 bp, Homo sapiens
gcttctattatttggagctgag

SEQ ID NO: 8411915 - DNA, 22 bp, Homo sapiens
gcttctatccctccactgcact

SEQ ID NO: 8411916 - DNA, 22 bp, Homo sapiens
gttattttatctctgagaggtt

SEQ ID NO: 8411917 - DNA, 22 bp, Homo sapiens
gttattttatctctgagaggtt

SEQ ID NO: 8411918 - DNA, 21 bp, Homo sapiens
gttattttaagtgagctttgc

SEQ ID NO: 8411919 - DNA, 22 bp, Homo sapiens
gttattttcattggctcagact

SEQ ID NO: 8411920 - DNA, 19 bp, Homo sapiens
gttcaaacactgattcagc

SEQ ID NO: 8411921 - DNA, 22 bp, Homo sapiens
gttcaaaattcaaatggtatac

SEQ ID NO: 8411922 - DNA, 21 bp, Homo sapiens
gttattttaagtgagctttgc

SEQ ID NO: 8411923 - DNA, 22 bp, Homo sapiens
gttattttaacttctcagtaat

SEQ ID NO: 8411924 - DNA, 22 bp, Homo sapiens
gttcaaattttggctgtactgc

SEQ ID NO: 8411925 - DNA, 22 bp, Homo sapiens
gttcaaattttctaggtgggtg

SEQ ID NO: 8411926 - DNA, 22 bp, Homo sapiens
gttcaaattgattttggtaaag

SEQ ID NO: 8411927 - DNA, 22 bp, Homo sapiens
gttcaaattgagatggtataaa

SEQ ID NO: 8411928 - DNA, 22 bp, Homo sapiens
gttcaagaccagcctggccaac

SEQ ID NO: 8411929 - DNA, 22 bp, Homo sapiens
gttcaagaccagcctggccaac

SEQ ID NO: 8411930 - DNA, 22 bp, Homo sapiens
gttcaagaccagcctggccaac

SEQ ID NO: 8411931 - DNA, 21 bp, Homo sapiens
gttcaaatcctgacactacac

SEQ ID NO: 8411932 - DNA, 22 bp, Homo sapiens
gttcaaatctcaggacttcaga

SEQ ID NO: 8411933 - DNA, 22 bp, Homo sapiens
gttcaaatggctgcagttacca

SEQ ID NO: 8411934 - DNA, 21 bp, Homo sapiens
gttcaaatgggtagattcaca

SEQ ID NO: 8411935 - DNA, 22 bp, Homo sapiens
gttcaaattctatgaaatatgt

SEQ ID NO: 8411936 - DNA, 22 bp, Homo sapiens
gttctacagttcctattactta

SEQ ID NO: 8411937 - DNA, 22 bp, Homo sapiens
gttctacatgacactcaacatt

SEQ ID NO: 8411938 - DNA, 21 bp, Homo sapiens
gttctacagttttagaattcc

SEQ ID NO: 8411939 - DNA, 22 bp, Homo sapiens
gttctctcagcgatagtgatgg

SEQ ID NO: 8411940 - DNA, 22 bp, Homo sapiens
gtgtaagtatctttgtatcttt

SEQ ID NO: 8411941 - DNA, 22 bp, Homo sapiens
gtggtggatgtctgtaatctca

SEQ ID NO: 8411942 - DNA, 22 bp, Homo sapiens
taaaggattttgtataatataa

SEQ ID NO: 8411943 - DNA, 22 bp, Homo sapiens
taaaggcaaactctccaaggat

SEQ ID NO: 8411944 - DNA, 22 bp, Homo sapiens
taaaggcttctgcagggactga

SEQ ID NO: 8411945 - DNA, 21 bp, Homo sapiens
taaaggctttagaatggcaaa

SEQ ID NO: 8411946 - DNA, 22 bp, Homo sapiens
taaaggctttattttccagtca

SEQ ID NO: 8411947 - DNA, 22 bp, Homo sapiens
taaaggcctagtaagttgagac

SEQ ID NO: 8411948 - DNA, 22 bp, Homo sapiens
taaaggcagccactgagctcaa

SEQ ID NO: 8411949 - DNA, 22 bp, Homo sapiens
taaaggcactgcgtccctcaaa

SEQ ID NO: 8411950 - DNA, 22 bp, Homo sapiens
taaaggcagtaattcctgagtt

SEQ ID NO: 8411951 - DNA, 22 bp, Homo sapiens
taaagctgttagagtagtaaga

SEQ ID NO: 8411952 - DNA, 22 bp, Homo sapiens
taaagctgttcagtgcagaaag

SEQ ID NO: 8411953 - DNA, 22 bp, Homo sapiens
taaagctgaaatgattatgaca

SEQ ID NO: 8411954 - DNA, 22 bp, Homo sapiens
taaaaaacattactctgtcctg

SEQ ID NO: 8411955 - DNA, 22 bp, Homo sapiens
gtttaacattgtaccaacacct

SEQ ID NO: 8411956 - DNA, 22 bp, Homo sapiens
gtttaacatctgtgaagctgct

SEQ ID NO: 8411957 - DNA, 22 bp, Homo sapiens
taagaaatttagttatagaatg

SEQ ID NO: 8411958 - DNA, 22 bp, Homo sapiens
taacagagtaacaggtatgtaa

SEQ ID NO: 8411959 - DNA, 22 bp, Homo sapiens
taacactaagaatctaaattta

SEQ ID NO: 8411960 - DNA, 22 bp, Homo sapiens
taacactatccagatatgataa

SEQ ID NO: 8411961 - DNA, 21 bp, Homo sapiens
taaatctctgtattcttcagt

SEQ ID NO: 8411962 - DNA, 22 bp, Homo sapiens
taaatctcctgtttttcatcta

SEQ ID NO: 8411963 - DNA, 22 bp, Homo sapiens
taaaggcttttacaggagtgca

SEQ ID NO: 8411964 - DNA, 22 bp, Homo sapiens
gtgaccagccagtgctgtctgt

SEQ ID NO: 8411965 - DNA, 23 bp, Homo sapiens
gtgcgccaggacaacctgacgga

SEQ ID NO: 8411966 - DNA, 22 bp, Homo sapiens
gtgcgggcctgggggtttctct

SEQ ID NO: 8411967 - DNA, 22 bp, Homo sapiens
gtggcagagttgctgactagaa

SEQ ID NO: 8411968 - DNA, 22 bp, Homo sapiens
gtggcacaaggcttacacagca

SEQ ID NO: 8411969 - DNA, 22 bp, Homo sapiens
gtggattacaagacagttgaga

SEQ ID NO: 8411970 - DNA, 22 bp, Homo sapiens
gtggaggagaggcgccttgcgg

SEQ ID NO: 8411971 - DNA, 22 bp, Homo sapiens
gtggaggaaaagaagttgggtg

SEQ ID NO: 8411972 - DNA, 22 bp, Homo sapiens
gtggaggaagggattcagacca

SEQ ID NO: 8411973 - DNA, 22 bp, Homo sapiens
gtggaggacaaaagaagccttt

SEQ ID NO: 8411974 - DNA, 22 bp, Homo sapiens
gtggaggacaaaagaagccttt

SEQ ID NO: 8411975 - DNA, 22 bp, Homo sapiens
gtggacagcttctaggtgccag

SEQ ID NO: 8411976 - DNA, 22 bp, Homo sapiens
gtctggctgttcctgcctgtga

SEQ ID NO: 8411977 - DNA, 22 bp, Homo sapiens
gtccttccccagccagctctgg

SEQ ID NO: 8411978 - DNA, 22 bp, Homo sapiens
gtccttcctgcagggatggatg

SEQ ID NO: 8411979 - DNA, 22 bp, Homo sapiens
gtccaggtctggaccctgagcc

SEQ ID NO: 8411980 - DNA, 22 bp, Homo sapiens
gtccagtgacaagtagctggcc

SEQ ID NO: 8411981 - DNA, 19 bp, Homo sapiens
gtccagtgttttccagtca

SEQ ID NO: 8411982 - DNA, 22 bp, Homo sapiens
gtccagtgtgtttatcttggat

SEQ ID NO: 8411983 - DNA, 22 bp, Homo sapiens
gtcctgtgtgacttcccaaatg

SEQ ID NO: 8411984 - DNA, 22 bp, Homo sapiens
gtcccagggcaaggctgtttct

SEQ ID NO: 8411985 - DNA, 22 bp, Homo sapiens
ggtggttcacgcctataatccc

SEQ ID NO: 8411986 - DNA, 22 bp, Homo sapiens
gtataggtttggctctctccag

SEQ ID NO: 8411987 - DNA, 22 bp, Homo sapiens
gtatatgagaaccatggaggtg

SEQ ID NO: 8411988 - DNA, 22 bp, Homo sapiens
gtatatcttcagaaattatagg

SEQ ID NO: 8411989 - DNA, 22 bp, Homo sapiens
gtatatctcttacatacacaca

SEQ ID NO: 8411990 - DNA, 23 bp, Homo sapiens
gtaaaatacgcagtgcagtgtga

SEQ ID NO: 8411991 - DNA, 22 bp, Homo sapiens
ggtgtcctcggattcagggcag

SEQ ID NO: 8411992 - DNA, 22 bp, Homo sapiens
gtaaaggctctgataagtactg

SEQ ID NO: 8411993 - DNA, 22 bp, Homo sapiens
gtaaaggcccattcaaacagct

SEQ ID NO: 8411994 - DNA, 16 bp, Homo sapiens
gtaaaggcagggaatt

SEQ ID NO: 8411995 - DNA, 22 bp, Homo sapiens
tctgcaggctctagatgaggtt

SEQ ID NO: 8411996 - DNA, 22 bp, Homo sapiens
tctgcaggaggctggctgcagg

SEQ ID NO: 8411997 - DNA, 22 bp, Homo sapiens
tctgcccctgctgggcacagag

SEQ ID NO: 8411998 - DNA, 18 bp, Homo sapiens
tctgccccagccgcactg

SEQ ID NO: 8411999 - DNA, 22 bp, Homo sapiens
tctgcccagtttgtgctcaggt

SEQ ID NO: 8412000 - DNA, 22 bp, Homo sapiens
tctgccctcattgctgcctgga

SEQ ID NO: 8412001 - DNA, 21 bp, Homo sapiens
tctgatgttcacaccctgtat

SEQ ID NO: 8412002 - DNA, 22 bp, Homo sapiens
tctgatgtggagacactgtttt

SEQ ID NO: 8412003 - DNA, 22 bp, Homo sapiens
tctgatttctcttgtggatgct

SEQ ID NO: 8412004 - DNA, 17 bp, Homo sapiens
tctgaggcctctaggag

SEQ ID NO: 8412005 - DNA, 22 bp, Homo sapiens
tctgaggctgaatggactccgt

SEQ ID NO: 8412006 - DNA, 22 bp, Homo sapiens
tctgacttccttttctgatcca

SEQ ID NO: 8412007 - DNA, 20 bp, Homo sapiens
tctgagacttgtagtgtgga

SEQ ID NO: 8412008 - DNA, 22 bp, Homo sapiens
tctgagacaggaagtggagggt

SEQ ID NO: 8412009 - DNA, 22 bp, Homo sapiens
tctgagacactcttgtgatggg

SEQ ID NO: 8412010 - DNA, 22 bp, Homo sapiens
tctggagagcagatgcctctgg

SEQ ID NO: 8412011 - DNA, 22 bp, Homo sapiens
tctggcccagcccctgaggtca

SEQ ID NO: 8412012 - DNA, 22 bp, Homo sapiens
tctggaggctctgagggtgagt

SEQ ID NO: 8412013 - DNA, 23 bp, Homo sapiens
tctggaggggacactgcagatgc

SEQ ID NO: 8412014 - DNA, 22 bp, Homo sapiens
tctggagggggatgcctcatcc

SEQ ID NO: 8412015 - DNA, 22 bp, Homo sapiens
tctggaggggtttagagggaca

SEQ ID NO: 8412016 - DNA, 18 bp, Homo sapiens
tctggagggaagctttga

SEQ ID NO: 8412017 - DNA, 22 bp, Homo sapiens
tctggagggcccacatccacaa

SEQ ID NO: 8412018 - DNA, 21 bp, Homo sapiens
tctgggctgctgctgcccatc

SEQ ID NO: 8412019 - DNA, 21 bp, Homo sapiens
tctgggcccatgctgcctcac

SEQ ID NO: 8412020 - DNA, 23 bp, Homo sapiens
tctgggccacttgtctgcacttc

SEQ ID NO: 8412021 - DNA, 22 bp, Homo sapiens
tctggcccatgatcctgctaac

SEQ ID NO: 8412022 - DNA, 22 bp, Homo sapiens
tctggcccctggtctctggtgt

SEQ ID NO: 8412023 - DNA, 22 bp, Homo sapiens
tcttcacatgaccttcatgtct

SEQ ID NO: 8412024 - DNA, 22 bp, Homo sapiens
tcttcaaatcctacagtgtctg

SEQ ID NO: 8412025 - DNA, 22 bp, Homo sapiens
tcttcaaagaattttagtaatt

SEQ ID NO: 8412026 - DNA, 22 bp, Homo sapiens
tcttcaaactgaaaatttagaa

SEQ ID NO: 8412027 - DNA, 22 bp, Homo sapiens
tcttcctccctacagagctcag

SEQ ID NO: 8412028 - DNA, 22 bp, Homo sapiens
tcttctcctttgccatgtgttt

SEQ ID NO: 8412029 - DNA, 22 bp, Homo sapiens
tcttctccagtgcttctgcaca

SEQ ID NO: 8412030 - DNA, 22 bp, Homo sapiens
tctttattgctactggtttgtc

SEQ ID NO: 8412031 - DNA, 22 bp, Homo sapiens
tctttattgctactggtttgtc

SEQ ID NO: 8412032 - DNA, 22 bp, Homo sapiens
tctttcattctagtctgaggtt

SEQ ID NO: 8412033 - DNA, 22 bp, Homo sapiens
tctttcccgccagagcatgagt

SEQ ID NO: 8412034 - DNA, 22 bp, Homo sapiens
tctttctacatcatttgcttct

SEQ ID NO: 8412035 - DNA, 22 bp, Homo sapiens
tctttccctgtgttagcctgta

SEQ ID NO: 8412036 - DNA, 21 bp, Homo sapiens
tctttctgaaatctcagtctg

SEQ ID NO: 8412037 - DNA, 22 bp, Homo sapiens
tcttgctaaagaccaacacatt

SEQ ID NO: 8412038 - DNA, 22 bp, Homo sapiens
tctttacaatctaagcatagtt

SEQ ID NO: 8412039 - DNA, 22 bp, Homo sapiens
tctgtgatagtttttcagctat

SEQ ID NO: 8412040 - DNA, 22 bp, Homo sapiens
tctgtctttgtcaggaccagag

SEQ ID NO: 8412041 - DNA, 22 bp, Homo sapiens
tctgtctttgagatctcagcct

SEQ ID NO: 8412042 - DNA, 22 bp, Homo sapiens
tctgtgcaggaagtcattatga

SEQ ID NO: 8412043 - DNA, 22 bp, Homo sapiens
tctgtgccctcggtgctgggcc

SEQ ID NO: 8412044 - DNA, 22 bp, Homo sapiens
tctgtgccacctctccagtgtc

SEQ ID NO: 8412045 - DNA, 22 bp, Homo sapiens
tctgtgcctgcttccccaccca

SEQ ID NO: 8412046 - DNA, 22 bp, Homo sapiens
tctgtgtctgcagaagttcagc

SEQ ID NO: 8412047 - DNA, 22 bp, Homo sapiens
tctgtgtcccttctaatttcag

SEQ ID NO: 8412048 - DNA, 22 bp, Homo sapiens
tctgtggctttcgtgtaagatg

SEQ ID NO: 8412049 - DNA, 22 bp, Homo sapiens
tctgtggcttgggcctgcctgt

SEQ ID NO: 8412050 - DNA, 22 bp, Homo sapiens
tctgtggcttctatttaacttt

SEQ ID NO: 8412051 - DNA, 22 bp, Homo sapiens
tctgtggcttcctatttcttgg

SEQ ID NO: 8412052 - DNA, 22 bp, Homo sapiens
tctgtggctttcttatgttgta

SEQ ID NO: 8412053 - DNA, 22 bp, Homo sapiens
tctgtggctgtctttccagagg

SEQ ID NO: 8412054 - DNA, 22 bp, Homo sapiens
tctgtggctgtgctgggccaga

SEQ ID NO: 8412055 - DNA, 19 bp, Homo sapiens
tctgtggctgtggggagga

SEQ ID NO: 8412056 - DNA, 22 bp, Homo sapiens
tctgtggctgttatctttatat

SEQ ID NO: 8412057 - DNA, 22 bp, Homo sapiens
tctgtggctggagaacttgtct

SEQ ID NO: 8412058 - DNA, 22 bp, Homo sapiens
tctgtggctggagaacttgtct

SEQ ID NO: 8412059 - DNA, 22 bp, Homo sapiens
tctgtggctggtaattgcatgt

SEQ ID NO: 8412060 - DNA, 22 bp, Homo sapiens
tctgtgctcaagttctgcctct

SEQ ID NO: 8412061 - DNA, 22 bp, Homo sapiens
tcttaagaaagtgacaaatagg

SEQ ID NO: 8412062 - DNA, 22 bp, Homo sapiens
tcttagatggcagctagagctc

SEQ ID NO: 8412063 - DNA, 20 bp, Homo sapiens
tcttatacagaaaacatttt

SEQ ID NO: 8412064 - DNA, 22 bp, Homo sapiens
tcttatacagaagatgtttaat

SEQ ID NO: 8412065 - DNA, 21 bp, Homo sapiens
tcttatacagcaatagatctg

SEQ ID NO: 8412066 - DNA, 22 bp, Homo sapiens
tcttagcatttgttaataccca

SEQ ID NO: 8412067 - DNA, 22 bp, Homo sapiens
tcttagcatttcataacaactg

SEQ ID NO: 8412068 - DNA, 22 bp, Homo sapiens
tcttagcagacttggctactgt

SEQ ID NO: 8412069 - DNA, 22 bp, Homo sapiens
tcttagcacagctatataagtt

SEQ ID NO: 8412070 - DNA, 22 bp, Homo sapiens
tcttagcagtgctgagaagaat

SEQ ID NO: 8412071 - DNA, 22 bp, Homo sapiens
tcttagcaaatactacttagaa

SEQ ID NO: 8412072 - DNA, 22 bp, Homo sapiens
tcttagatgttagctctgtgtg

SEQ ID NO: 8412073 - DNA, 22 bp, Homo sapiens
tcttagcaaattttctttgcct

SEQ ID NO: 8412074 - DNA, 22 bp, Homo sapiens
tcttaaaccacaaaattcagag

SEQ ID NO: 8412075 - DNA, 22 bp, Homo sapiens
tctgtgtgccctaaagcctgct

SEQ ID NO: 8412076 - DNA, 22 bp, Homo sapiens
tctgtgtgcccacctgacacct

SEQ ID NO: 8412077 - DNA, 20 bp, Homo sapiens
tctgggcttcccccagctcc

SEQ ID NO: 8412078 - DNA, 22 bp, Homo sapiens
tctgggctttaagaactctgtt

SEQ ID NO: 8412079 - DNA, 23 bp, Homo sapiens
tctgtacaattgagaagagaaca

SEQ ID NO: 8412080 - DNA, 22 bp, Homo sapiens
tctgtaatcaagatatttgaga

SEQ ID NO: 8412081 - DNA, 20 bp, Homo sapiens
tctgtctctgagctagactt

SEQ ID NO: 8412082 - DNA, 22 bp, Homo sapiens
tcctttgcttctgtcattctcc

SEQ ID NO: 8412083 - DNA, 22 bp, Homo sapiens
tcgcaccattgcactccagcca

SEQ ID NO: 8412084 - DNA, 22 bp, Homo sapiens
tcgcaccattgcactccagcca

SEQ ID NO: 8412085 - DNA, 22 bp, Homo sapiens
tcgcaccattgcactccagcca

SEQ ID NO: 8412086 - DNA, 22 bp, Homo sapiens
tcctttccctttccatcctggc

SEQ ID NO: 8412087 - DNA, 22 bp, Homo sapiens
tctaaactagggttaaaggaaa

SEQ ID NO: 8412088 - DNA, 22 bp, Homo sapiens
tctaaacttcactttaagtgct

SEQ ID NO: 8412089 - DNA, 22 bp, Homo sapiens
tctaaagatgtttattgacata

SEQ ID NO: 8412090 - DNA, 22 bp, Homo sapiens
tctaaagagaaccttttctcat

SEQ ID NO: 8412091 - DNA, 22 bp, Homo sapiens
tctaaagacactttttacaggg

SEQ ID NO: 8412092 - DNA, 22 bp, Homo sapiens
tctaaagatttggattcatttg

SEQ ID NO: 8412093 - DNA, 22 bp, Homo sapiens
tcgcccaggctggaagtgcagt

SEQ ID NO: 8412094 - DNA, 22 bp, Homo sapiens
tcgccatcgtcggacacagtga

SEQ ID NO: 8412095 - DNA, 21 bp, Homo sapiens
tcgtgcagcagctgaggcttg

SEQ ID NO: 8412096 - DNA, 21 bp, Homo sapiens
tcgtgcagcagctgaggcttg

SEQ ID NO: 8412097 - DNA, 22 bp, Homo sapiens
tcgttaaatgctaaaactgaca

SEQ ID NO: 8412098 - DNA, 22 bp, Homo sapiens
tccttagacaaagagtgggctt

SEQ ID NO: 8412099 - DNA, 22 bp, Homo sapiens
tctaggtggatgaggaacatag

SEQ ID NO: 8412100 - DNA, 22 bp, Homo sapiens
tctagggaacatgggtcaagct

SEQ ID NO: 8412101 - DNA, 22 bp, Homo sapiens
tctagttctagatccctgagga

SEQ ID NO: 8412102 - DNA, 22 bp, Homo sapiens
tctatgaaaagtctattcattc

SEQ ID NO: 8412103 - DNA, 22 bp, Homo sapiens
tctatcagagtagaaggcaacg

SEQ ID NO: 8412104 - DNA, 22 bp, Homo sapiens
tctatgtagtgccagctagtat

SEQ ID NO: 8412105 - DNA, 22 bp, Homo sapiens
tctcacaagctcaaggattagt

SEQ ID NO: 8412106 - DNA, 19 bp, Homo sapiens
tctcacaagcaacattgtt

SEQ ID NO: 8412107 - DNA, 22 bp, Homo sapiens
tctcaaggaaaagtgatggcat

SEQ ID NO: 8412108 - DNA, 22 bp, Homo sapiens
tctattttatactcaaatcttc

SEQ ID NO: 8412109 - DNA, 22 bp, Homo sapiens
tctattttcttgccaaaactgc

SEQ ID NO: 8412110 - DNA, 22 bp, Homo sapiens
tctatttcgcatataagttttg

SEQ ID NO: 8412111 - DNA, 22 bp, Homo sapiens
tctattttgtttccagctctac

SEQ ID NO: 8412112 - DNA, 22 bp, Homo sapiens
tctaaatgtggtagtcataaga

SEQ ID NO: 8412113 - DNA, 22 bp, Homo sapiens
tctaacattgaatggctgatta

SEQ ID NO: 8412114 - DNA, 22 bp, Homo sapiens
tctaacttgtgagtatagatga

SEQ ID NO: 8412115 - DNA, 20 bp, Homo sapiens
tctaattaaaattgtctagt

SEQ ID NO: 8412116 - DNA, 22 bp, Homo sapiens
tctacaaagaagaattaatgtc

SEQ ID NO: 8412117 - DNA, 22 bp, Homo sapiens
tctacattccttttataatatc

SEQ ID NO: 8412118 - DNA, 22 bp, Homo sapiens
tctacattttctttatgtacat

SEQ ID NO: 8412119 - DNA, 22 bp, Homo sapiens
tctacattttcacaaggtctcc

SEQ ID NO: 8412120 - DNA, 22 bp, Homo sapiens
tctacattttaacaagatgccc

SEQ ID NO: 8412121 - DNA, 22 bp, Homo sapiens
tctacactgtagaattataagg

SEQ ID NO: 8412122 - DNA, 22 bp, Homo sapiens
tctacagactcctatgtaacac

SEQ ID NO: 8412123 - DNA, 22 bp, Homo sapiens
tctagacctggcactgccctgt

SEQ ID NO: 8412124 - DNA, 19 bp, Homo sapiens
tctagcaacccactgcatg

SEQ ID NO: 8412125 - DNA, 22 bp, Homo sapiens
tcctggccaagtagatgtggcg

SEQ ID NO: 8412126 - DNA, 22 bp, Homo sapiens
tcctggcccactatgccagcat

SEQ ID NO: 8412127 - DNA, 22 bp, Homo sapiens
tcctggccctgtggcctgcagt

SEQ ID NO: 8412128 - DNA, 22 bp, Homo sapiens
taagaattatctcatggataat

SEQ ID NO: 8412129 - DNA, 22 bp, Homo sapiens
tcctgtctaaagacctgcaggc

SEQ ID NO: 8412130 - DNA, 22 bp, Homo sapiens
tcctgtgatattgtttgttata

SEQ ID NO: 8412131 - DNA, 22 bp, Homo sapiens
tcctgtgagtagatagtattgt

SEQ ID NO: 8412132 - DNA, 22 bp, Homo sapiens
tcctgtgatggcttgcgatgtg

SEQ ID NO: 8412133 - DNA, 22 bp, Homo sapiens
tcctgtgaccagcttccatgct

SEQ ID NO: 8412134 - DNA, 23 bp, Homo sapiens
tcctgtgaagccatgtttgttgt

SEQ ID NO: 8412135 - DNA, 22 bp, Homo sapiens
tcctgtgaagaatagcactcaa

SEQ ID NO: 8412136 - DNA, 22 bp, Homo sapiens
tcctgtcttaatgatctcgtgc

SEQ ID NO: 8412137 - DNA, 21 bp, Homo sapiens
tcctgtgaggacctgtcagtg

SEQ ID NO: 8412138 - DNA, 22 bp, Homo sapiens
tcctgtgagcagcacagagaca

SEQ ID NO: 8412139 - DNA, 22 bp, Homo sapiens
tcctgtgacggagcgccagagg

SEQ ID NO: 8412140 - DNA, 22 bp, Homo sapiens
tcctgtgagacttgtccattat

SEQ ID NO: 8412141 - DNA, 22 bp, Homo sapiens
tctgaagattaccagctaaatg

SEQ ID NO: 8412142 - DNA, 22 bp, Homo sapiens
tctgaagaactgagtaaacatg

SEQ ID NO: 8412143 - DNA, 22 bp, Homo sapiens
tctgaagaataggatgttgtgt

SEQ ID NO: 8412144 - DNA, 22 bp, Homo sapiens
tctgaacatccagcaatgcaca

SEQ ID NO: 8412145 - DNA, 22 bp, Homo sapiens
tctgaacagaaaagatgcacaa

SEQ ID NO: 8412146 - DNA, 22 bp, Homo sapiens
tctgaaatgcaaatttgactga

SEQ ID NO: 8412147 - DNA, 22 bp, Homo sapiens
tctgaaatgcaggcaatttgct

SEQ ID NO: 8412148 - DNA, 22 bp, Homo sapiens
tctgaaatgttctcttgttttg

SEQ ID NO: 8412149 - DNA, 22 bp, Homo sapiens
tctgaaatactgcaggttctct

SEQ ID NO: 8412150 - DNA, 18 bp, Homo sapiens
tctgaaagcaccggtgaa

SEQ ID NO: 8412151 - DNA, 22 bp, Homo sapiens
tctcttccctttatggtatgtg

SEQ ID NO: 8412152 - DNA, 22 bp, Homo sapiens
tctcttaattttggaatagtgt

SEQ ID NO: 8412153 - DNA, 22 bp, Homo sapiens
tctcttcacattcctggcaaac

SEQ ID NO: 8412154 - DNA, 21 bp, Homo sapiens
tctctgtggtccaatcccagc

SEQ ID NO: 8412155 - DNA, 22 bp, Homo sapiens
tctctgtgggtttcaccagcgc

SEQ ID NO: 8412156 - DNA, 22 bp, Homo sapiens
tctctgtgtctcatgttcctat

SEQ ID NO: 8412157 - DNA, 21 bp, Homo sapiens
tctctgtgtacagtctcaccc

SEQ ID NO: 8412158 - DNA, 22 bp, Homo sapiens
tctctgtgcccagtagttctct

SEQ ID NO: 8412159 - DNA, 22 bp, Homo sapiens
tctctgtggagcagtgtgttca

SEQ ID NO: 8412160 - DNA, 22 bp, Homo sapiens
tctctgtggcaagcatgctgct

SEQ ID NO: 8412161 - DNA, 22 bp, Homo sapiens
tctctgtgacagctgggtatgt

SEQ ID NO: 8412162 - DNA, 22 bp, Homo sapiens
tctctgtgcaggatgctgagtt

SEQ ID NO: 8412163 - DNA, 22 bp, Homo sapiens
tctctggcagggatatctggct

SEQ ID NO: 8412164 - DNA, 22 bp, Homo sapiens
tctctgagcccaatgtagcaat

SEQ ID NO: 8412165 - DNA, 22 bp, Homo sapiens
tctctgaacttcctggaaaggc

SEQ ID NO: 8412166 - DNA, 22 bp, Homo sapiens
tctctgaagagctcagactagt

SEQ ID NO: 8412167 - DNA, 18 bp, Homo sapiens
tctctgaatattttatgt

SEQ ID NO: 8412168 - DNA, 22 bp, Homo sapiens
tctctgaaggggagctgtttaa

SEQ ID NO: 8412169 - DNA, 22 bp, Homo sapiens
tctctgaagatatttattatta

SEQ ID NO: 8412170 - DNA, 22 bp, Homo sapiens
tctctcccaaatctgcagatag

SEQ ID NO: 8412171 - DNA, 22 bp, Homo sapiens
tctccagggaggtagcccagtg

SEQ ID NO: 8412172 - DNA, 22 bp, Homo sapiens
tctcgctctgtcgcccaggctg

SEQ ID NO: 8412173 - DNA, 20 bp, Homo sapiens
tctcgcactcggagcagccg

SEQ ID NO: 8412174 - DNA, 22 bp, Homo sapiens
tctccacaagctttctcctttt

SEQ ID NO: 8412175 - DNA, 22 bp, Homo sapiens
tctccacaagctgatgctagga

SEQ ID NO: 8412176 - DNA, 23 bp, Homo sapiens
tctccaggccttactccaggcct

SEQ ID NO: 8412177 - DNA, 22 bp, Homo sapiens
tctccaaatcaatcaatatgaa

SEQ ID NO: 8412178 - DNA, 22 bp, Homo sapiens
tctcagggtgaggaaagaattt

SEQ ID NO: 8412179 - DNA, 20 bp, Homo sapiens
tctcagggttcagcaaagta

SEQ ID NO: 8412180 - DNA, 19 bp, Homo sapiens
tctcacagtttccttgcct

SEQ ID NO: 8412181 - DNA, 22 bp, Homo sapiens
tctcacagtgcaggtctgtctc

SEQ ID NO: 8412182 - DNA, 22 bp, Homo sapiens
tctcactgatttgagaccaagg

SEQ ID NO: 8412183 - DNA, 22 bp, Homo sapiens
tctcactgggtcacagcagagg

SEQ ID NO: 8412184 - DNA, 23 bp, Homo sapiens
tctcagaaaggagaagtaatttg

SEQ ID NO: 8412185 - DNA, 22 bp, Homo sapiens
tctcagagtgacaatgagaatt

SEQ ID NO: 8412186 - DNA, 22 bp, Homo sapiens
tgcctacattccttgcttatgg

SEQ ID NO: 8412187 - DNA, 22 bp, Homo sapiens
tgcctagtagggttgttgtagg

SEQ ID NO: 8412188 - DNA, 22 bp, Homo sapiens
tgcctgatgcaggagtatcaga

SEQ ID NO: 8412189 - DNA, 22 bp, Homo sapiens
tgcctccctctctgccactgga

SEQ ID NO: 8412190 - DNA, 22 bp, Homo sapiens
tgcctcagtctaaagtctctca

SEQ ID NO: 8412191 - DNA, 22 bp, Homo sapiens
tgccatccttgaggaagggcaa

SEQ ID NO: 8412192 - DNA, 18 bp, Homo sapiens
tgccatccccagtcaagt

SEQ ID NO: 8412193 - DNA, 22 bp, Homo sapiens
tgcccaggtttgagtgcccaag

SEQ ID NO: 8412194 - DNA, 22 bp, Homo sapiens
tgccccagactctgctcacctc

SEQ ID NO: 8412195 - DNA, 20 bp, Homo sapiens
tgccccaggcctgcacctgc

SEQ ID NO: 8412196 - DNA, 22 bp, Homo sapiens
tgcccaggctggagtgcagagg

SEQ ID NO: 8412197 - DNA, 22 bp, Homo sapiens
tgcccaggcttcaccctcagag

SEQ ID NO: 8412198 - DNA, 23 bp, Homo sapiens
tgccattttccatctcatgcaga

SEQ ID NO: 8412199 - DNA, 22 bp, Homo sapiens
tgcccagcacccagcatgatgc

SEQ ID NO: 8412200 - DNA, 20 bp, Homo sapiens
tgcccagcaagagtgcagtt

SEQ ID NO: 8412201 - DNA, 22 bp, Homo sapiens
tgcatatacccgcatttacata

SEQ ID NO: 8412202 - DNA, 19 bp, Homo sapiens
tgcataaattatatacttt

SEQ ID NO: 8412203 - DNA, 22 bp, Homo sapiens
tgcatacacaagcatacatgta

SEQ ID NO: 8412204 - DNA, 22 bp, Homo sapiens
tgcatacacatgtgcacatacg

SEQ ID NO: 8412205 - DNA, 21 bp, Homo sapiens
tgcagttcaagtcaatctact

SEQ ID NO: 8412206 - DNA, 22 bp, Homo sapiens
tgcataaagtgccatagtatta

SEQ ID NO: 8412207 - DNA, 22 bp, Homo sapiens
tgcataaacagatacttcatgt

SEQ ID NO: 8412208 - DNA, 22 bp, Homo sapiens
tgcataaacttctctggtgtga

SEQ ID NO: 8412209 - DNA, 21 bp, Homo sapiens
tgcataaagaaatacaaatac

SEQ ID NO: 8412210 - DNA, 22 bp, Homo sapiens
tgcatgtggacccctggtgcct

SEQ ID NO: 8412211 - DNA, 22 bp, Homo sapiens
tgcatgtgcccactctggctta

SEQ ID NO: 8412212 - DNA, 22 bp, Homo sapiens
tgcatgttaagaaaatattgag

SEQ ID NO: 8412213 - DNA, 22 bp, Homo sapiens
tgcatgctgcacacatgcgtag

SEQ ID NO: 8412214 - DNA, 22 bp, Homo sapiens
tgcatgcaacaattcttctata

SEQ ID NO: 8412215 - DNA, 22 bp, Homo sapiens
tgcatgcaaagtgtctgctttg

SEQ ID NO: 8412216 - DNA, 22 bp, Homo sapiens
tgccaaattgccctataaatga

SEQ ID NO: 8412217 - DNA, 19 bp, Homo sapiens
tgcattgagggctgtctca

SEQ ID NO: 8412218 - DNA, 22 bp, Homo sapiens
tgcattgagattttaaaattca

SEQ ID NO: 8412219 - DNA, 22 bp, Homo sapiens
tgcattgaggggctctcttcct

SEQ ID NO: 8412220 - DNA, 22 bp, Homo sapiens
tgcattgagtcatttcagtatg

SEQ ID NO: 8412221 - DNA, 22 bp, Homo sapiens
tgcattgatcatatccttcctg

SEQ ID NO: 8412222 - DNA, 22 bp, Homo sapiens
tgcatttttaacaaggctaatt

SEQ ID NO: 8412223 - DNA, 20 bp, Homo sapiens
tgcagggctgcctcccagct

SEQ ID NO: 8412224 - DNA, 23 bp, Homo sapiens
tgcaggggaggcttaaagcaggt

SEQ ID NO: 8412225 - DNA, 22 bp, Homo sapiens
tgcagggcttcctcttggagtt

SEQ ID NO: 8412226 - DNA, 22 bp, Homo sapiens
tgcaggggcttgtctgggcctg

SEQ ID NO: 8412227 - DNA, 22 bp, Homo sapiens
tgcagtggttgagagcccagac

SEQ ID NO: 8412228 - DNA, 22 bp, Homo sapiens
tgcaggctggggaggcagactt

SEQ ID NO: 8412229 - DNA, 22 bp, Homo sapiens
tgcaggctgctggcagtagctt

SEQ ID NO: 8412230 - DNA, 22 bp, Homo sapiens
tgcaggctgcagtctcaggtgg

SEQ ID NO: 8412231 - DNA, 22 bp, Homo sapiens
tgcaggctccatgaggacaggc

SEQ ID NO: 8412232 - DNA, 22 bp, Homo sapiens
tgcagggaaaacccaggatgct

SEQ ID NO: 8412233 - DNA, 22 bp, Homo sapiens
tgcagggaatccagtctagggt

SEQ ID NO: 8412234 - DNA, 22 bp, Homo sapiens
tgcagggaagcaagggtggctc

SEQ ID NO: 8412235 - DNA, 22 bp, Homo sapiens
tgcagggaaagtgttggcagca

SEQ ID NO: 8412236 - DNA, 22 bp, Homo sapiens
tgcagggaaagggcactgggct

SEQ ID NO: 8412237 - DNA, 22 bp, Homo sapiens
tgcagggcccttggggttgaac

SEQ ID NO: 8412238 - DNA, 22 bp, Homo sapiens
tgcagggctacaggactacaac

SEQ ID NO: 8412239 - DNA, 22 bp, Homo sapiens
tgcagggccatggtggcggctg

SEQ ID NO: 8412240 - DNA, 22 bp, Homo sapiens
tgcagggccagactgggttgga

SEQ ID NO: 8412241 - DNA, 22 bp, Homo sapiens
tgcagggcagtttgtttcggca

SEQ ID NO: 8412242 - DNA, 22 bp, Homo sapiens
tgcagggcagtggaggttgagt

SEQ ID NO: 8412243 - DNA, 22 bp, Homo sapiens
tgcagggcacacgcacgggtgt

SEQ ID NO: 8412244 - DNA, 22 bp, Homo sapiens
tgcagggatgctagaggtaaga

SEQ ID NO: 8412245 - DNA, 22 bp, Homo sapiens
tgcagggattatgtaggggttg

SEQ ID NO: 8412246 - DNA, 22 bp, Homo sapiens
tgcagggattatgtaggggttg

SEQ ID NO: 8412247 - DNA, 22 bp, Homo sapiens
tgcagggattagaggccgggga

SEQ ID NO: 8412248 - DNA, 22 bp, Homo sapiens
tgcagggattgttggcatccat

SEQ ID NO: 8412249 - DNA, 23 bp, Homo sapiens
tgcagggcaagttagagacccca

SEQ ID NO: 8412250 - DNA, 22 bp, Homo sapiens
tgatccctggacttgagtaagt

SEQ ID NO: 8412251 - DNA, 22 bp, Homo sapiens
tgatctttactgctgtttataa

SEQ ID NO: 8412252 - DNA, 22 bp, Homo sapiens
tgatagaagcagaagcatacca

SEQ ID NO: 8412253 - DNA, 22 bp, Homo sapiens
tgatagaaaggaaattaattgg

SEQ ID NO: 8412254 - DNA, 22 bp, Homo sapiens
tgagtgaggctgggcagtccct

SEQ ID NO: 8412255 - DNA, 22 bp, Homo sapiens
tgattctatggaaggcataagg

SEQ ID NO: 8412256 - DNA, 22 bp, Homo sapiens
tgattgactttagaatagcact

SEQ ID NO: 8412257 - DNA, 22 bp, Homo sapiens
tgattgatacaactcaatccaa

SEQ ID NO: 8412258 - DNA, 22 bp, Homo sapiens
tgatgttctgtatatcatatag

SEQ ID NO: 8412259 - DNA, 22 bp, Homo sapiens
tgatgtctagtacatacaagag

SEQ ID NO: 8412260 - DNA, 22 bp, Homo sapiens
tgatggtcaggatgcatggaga

SEQ ID NO: 8412261 - DNA, 22 bp, Homo sapiens
tgattcacagacttcacaaggc

SEQ ID NO: 8412262 - DNA, 22 bp, Homo sapiens
tgattcaattatctgatgcttt

SEQ ID NO: 8412263 - DNA, 22 bp, Homo sapiens
tgattcaagctactgttactgg

SEQ ID NO: 8412264 - DNA, 22 bp, Homo sapiens
tgatggctatccctggaagggc

SEQ ID NO: 8412265 - DNA, 22 bp, Homo sapiens
tgatggctcatgtttggggatg

SEQ ID NO: 8412266 - DNA, 22 bp, Homo sapiens
tgatggctcccatgggcatatg

SEQ ID NO: 8412267 - DNA, 22 bp, Homo sapiens
tgatggcttagtggcagggcga

SEQ ID NO: 8412268 - DNA, 22 bp, Homo sapiens
tgatggcttatggagagagcaa

SEQ ID NO: 8412269 - DNA, 22 bp, Homo sapiens
tgatggaaataaaagcatagct

SEQ ID NO: 8412270 - DNA, 22 bp, Homo sapiens
tgatctttgggccattaataaa

SEQ ID NO: 8412271 - DNA, 18 bp, Homo sapiens
tgatctttgagtataatg

SEQ ID NO: 8412272 - DNA, 22 bp, Homo sapiens
tgatcttttcaaagacaagctt

SEQ ID NO: 8412273 - DNA, 20 bp, Homo sapiens
tgattttctgaaacagcaca

SEQ ID NO: 8412274 - DNA, 22 bp, Homo sapiens
tgcaaaataatgaacgattttt

SEQ ID NO: 8412275 - DNA, 22 bp, Homo sapiens
tgcaaaagaatatagatattgt

SEQ ID NO: 8412276 - DNA, 22 bp, Homo sapiens
tgcaacaggagagttcagggca

SEQ ID NO: 8412277 - DNA, 22 bp, Homo sapiens
tgcaacaggctgtgacatggaa

SEQ ID NO: 8412278 - DNA, 22 bp, Homo sapiens
tgcaacagactttattaactct

SEQ ID NO: 8412279 - DNA, 22 bp, Homo sapiens
tgcaacagtggggcatgctgaa

SEQ ID NO: 8412280 - DNA, 21 bp, Homo sapiens
tgcaatccagcctgggcgaca

SEQ ID NO: 8412281 - DNA, 21 bp, Homo sapiens
tgcaatccagcctgggcgaca

SEQ ID NO: 8412282 - DNA, 22 bp, Homo sapiens
tgcaatttcaggcatatattgt

SEQ ID NO: 8412283 - DNA, 22 bp, Homo sapiens
tgcaatttcaaatatcagaaag

SEQ ID NO: 8412284 - DNA, 21 bp, Homo sapiens
tgcaatttagacttgaacatt

SEQ ID NO: 8412285 - DNA, 22 bp, Homo sapiens
tgcacaagtcagagtaacattt

SEQ ID NO: 8412286 - DNA, 22 bp, Homo sapiens
tgcaattttcagaaattccaaa

SEQ ID NO: 8412287 - DNA, 22 bp, Homo sapiens
tgcaatttttatcaattcagca

SEQ ID NO: 8412288 - DNA, 22 bp, Homo sapiens
tgcaattttaatacattagagg

SEQ ID NO: 8412289 - DNA, 22 bp, Homo sapiens
tgcacccatagcacacactcct

SEQ ID NO: 8412290 - DNA, 22 bp, Homo sapiens
tgcagaaacaagccatcattca

SEQ ID NO: 8412291 - DNA, 22 bp, Homo sapiens
tgcactactgtgatacacagcc

SEQ ID NO: 8412292 - DNA, 22 bp, Homo sapiens
tgcagaaacagtcattaatgta

SEQ ID NO: 8412293 - DNA, 22 bp, Homo sapiens
tgcagaaataactcatattgca

SEQ ID NO: 8412294 - DNA, 22 bp, Homo sapiens
tgcagattcaaatgaaatgcaa

SEQ ID NO: 8412295 - DNA, 20 bp, Homo sapiens
tgcagcacgggccctttcca

SEQ ID NO: 8412296 - DNA, 22 bp, Homo sapiens
tgcagatagcgtcattcttgct

SEQ ID NO: 8412297 - DNA, 22 bp, Homo sapiens
tgcagatacagtatgtggaagc

SEQ ID NO: 8412298 - DNA, 22 bp, Homo sapiens
tgcaggctcatctcaagagtag

SEQ ID NO: 8412299 - DNA, 22 bp, Homo sapiens
tgcaggctcacctgccagggcc

SEQ ID NO: 8412300 - DNA, 22 bp, Homo sapiens
tgaggagaaatgctcagagcca

SEQ ID NO: 8412301 - DNA, 22 bp, Homo sapiens
tgaggaaagaaaggcatgcatg

SEQ ID NO: 8412302 - DNA, 22 bp, Homo sapiens
tgaggcaggactgagcgggatg

SEQ ID NO: 8412303 - DNA, 22 bp, Homo sapiens
tgaggcaggacatggacaactg

SEQ ID NO: 8412304 - DNA, 22 bp, Homo sapiens
tgaggcaggaatggggaaaagt

SEQ ID NO: 8412305 - DNA, 22 bp, Homo sapiens
tgaggatttaatgggactcatt

SEQ ID NO: 8412306 - DNA, 22 bp, Homo sapiens
tgaggcaaagttcaagctgaaa

SEQ ID NO: 8412307 - DNA, 22 bp, Homo sapiens
tgaggcaatccctagggtaagg

SEQ ID NO: 8412308 - DNA, 19 bp, Homo sapiens
tgaggcaagatggctctgg

SEQ ID NO: 8412309 - DNA, 22 bp, Homo sapiens
tgaggcaaggctgaatgaaggc

SEQ ID NO: 8412310 - DNA, 22 bp, Homo sapiens
tgaggcaggagaatggcgggaa

SEQ ID NO: 8412311 - DNA, 22 bp, Homo sapiens
tgaggcaggaggttgagaactg

SEQ ID NO: 8412312 - DNA, 22 bp, Homo sapiens
tgaggcaggaggattgcaggat

SEQ ID NO: 8412313 - DNA, 22 bp, Homo sapiens
tgaggcaggagttcaggctgcg

SEQ ID NO: 8412314 - DNA, 23 bp, Homo sapiens
tgaggcaggcggatcacgaggtc

SEQ ID NO: 8412315 - DNA, 22 bp, Homo sapiens
tgaggcagggagagtggatatg

SEQ ID NO: 8412316 - DNA, 22 bp, Homo sapiens
tgaggtggccgaggagcaggac

SEQ ID NO: 8412317 - DNA, 22 bp, Homo sapiens
tgaggtggaaggatcctttgaa

SEQ ID NO: 8412318 - DNA, 22 bp, Homo sapiens
tgaggtggcacacacttcctgc

SEQ ID NO: 8412319 - DNA, 22 bp, Homo sapiens
tgaggtgggtggcttctgttat

SEQ ID NO: 8412320 - DNA, 22 bp, Homo sapiens
tgaggtgggcttgtggatttgc

SEQ ID NO: 8412321 - DNA, 22 bp, Homo sapiens
tgaggtggtgctaatctctgct

SEQ ID NO: 8412322 - DNA, 22 bp, Homo sapiens
tgaggtggttcaagagccttgt

SEQ ID NO: 8412323 - DNA, 22 bp, Homo sapiens
tgaggtggtttgtatcactggg

SEQ ID NO: 8412324 - DNA, 22 bp, Homo sapiens
tgagtactcggagtgctttgga

SEQ ID NO: 8412325 - DNA, 22 bp, Homo sapiens
tgaggctccagccaggccagca

SEQ ID NO: 8412326 - DNA, 22 bp, Homo sapiens
tgaggctcagaaatgtaagttt

SEQ ID NO: 8412327 - DNA, 22 bp, Homo sapiens
tgaggctcaagaatagacagta

SEQ ID NO: 8412328 - DNA, 22 bp, Homo sapiens
tgagggaatcctcacatcaatc

SEQ ID NO: 8412329 - DNA, 22 bp, Homo sapiens
tgagggaatattgatagatccg

SEQ ID NO: 8412330 - DNA, 22 bp, Homo sapiens
tgagggagtgtggatacagtag

SEQ ID NO: 8412331 - DNA, 22 bp, Homo sapiens
tgagcaatatgtgaattttctt

SEQ ID NO: 8412332 - DNA, 22 bp, Homo sapiens
tgagcaattaacagagtctaaa

SEQ ID NO: 8412333 - DNA, 22 bp, Homo sapiens
tgagcagagtcgctccagagtg

SEQ ID NO: 8412334 - DNA, 22 bp, Homo sapiens
tgagcatctttttacaggttta

SEQ ID NO: 8412335 - DNA, 23 bp, Homo sapiens
tgagcatcacaggagaaccaggc

SEQ ID NO: 8412336 - DNA, 22 bp, Homo sapiens
tgagctctgttagggctggaac

SEQ ID NO: 8412337 - DNA, 22 bp, Homo sapiens
tgagctggtcttgagtgtagct

SEQ ID NO: 8412338 - DNA, 22 bp, Homo sapiens
tgagatgtaaggtatgcttact

SEQ ID NO: 8412339 - DNA, 22 bp, Homo sapiens
tgagatgaataactcctgctaa

SEQ ID NO: 8412340 - DNA, 22 bp, Homo sapiens
tgagataattaaatcaaaacct

SEQ ID NO: 8412341 - DNA, 22 bp, Homo sapiens
tgagagcacacagaaatatttt

SEQ ID NO: 8412342 - DNA, 18 bp, Homo sapiens
tgagaggctattttttgc

SEQ ID NO: 8412343 - DNA, 22 bp, Homo sapiens
tgagaagcccacactctttcct

SEQ ID NO: 8412344 - DNA, 22 bp, Homo sapiens
tgagaacatttgcagggagagt

SEQ ID NO: 8412345 - DNA, 22 bp, Homo sapiens
tgagaacattgggaaagctatg

SEQ ID NO: 8412346 - DNA, 22 bp, Homo sapiens
tgagacagcagtcagggaaata

SEQ ID NO: 8412347 - DNA, 22 bp, Homo sapiens
tgagacagcagtcagggaaata

SEQ ID NO: 8412348 - DNA, 19 bp, Homo sapiens
tgagacagaagatgagcct

SEQ ID NO: 8412349 - DNA, 22 bp, Homo sapiens
tgaagggggagatatatgtgtg

SEQ ID NO: 8412350 - DNA, 22 bp, Homo sapiens
tgaataatcttgggtattaata

SEQ ID NO: 8412351 - DNA, 22 bp, Homo sapiens
tgaagcagttctcagaagtggg

SEQ ID NO: 8412352 - DNA, 22 bp, Homo sapiens
tgaatccagagctatttcgtcc

SEQ ID NO: 8412353 - DNA, 22 bp, Homo sapiens
tgaatcatgccactgagctccc

SEQ ID NO: 8412354 - DNA, 22 bp, Homo sapiens
tgaatcatggataaatagctta

SEQ ID NO: 8412355 - DNA, 22 bp, Homo sapiens
tgaatatggcaactcttgtaac

SEQ ID NO: 8412356 - DNA, 22 bp, Homo sapiens
tgaatatgtatttcttatttac

SEQ ID NO: 8412357 - DNA, 22 bp, Homo sapiens
tgaatatgtgactttgatttca

SEQ ID NO: 8412358 - DNA, 20 bp, Homo sapiens
tgaatatgaccttatttgga

SEQ ID NO: 8412359 - DNA, 22 bp, Homo sapiens
tgaatatgctttgcaatcctaa

SEQ ID NO: 8412360 - DNA, 22 bp, Homo sapiens
tgaatatgattgcaaatttggc

SEQ ID NO: 8412361 - DNA, 22 bp, Homo sapiens
tgaatacaggaaaatatactga

SEQ ID NO: 8412362 - DNA, 20 bp, Homo sapiens
tgaatagagagcacatatgc

SEQ ID NO: 8412363 - DNA, 22 bp, Homo sapiens
tgaatactatttcataatgtgg

SEQ ID NO: 8412364 - DNA, 22 bp, Homo sapiens
tgaatagatggtgacagtatga

SEQ ID NO: 8412365 - DNA, 22 bp, Homo sapiens
tgaatagatttttaacatataa

SEQ ID NO: 8412366 - DNA, 22 bp, Homo sapiens
tgacaaaccagtagcaataaag

SEQ ID NO: 8412367 - DNA, 22 bp, Homo sapiens
tgacaaagacaaagatatgtcc

SEQ ID NO: 8412368 - DNA, 22 bp, Homo sapiens
tgacaaattcatatttcagagg

SEQ ID NO: 8412369 - DNA, 20 bp, Homo sapiens
tgacacaaattgctttctca

SEQ ID NO: 8412370 - DNA, 22 bp, Homo sapiens
tgacatttgagagagatataca

SEQ ID NO: 8412371 - DNA, 22 bp, Homo sapiens
tgacattctgttaagtctcata

SEQ ID NO: 8412372 - DNA, 21 bp, Homo sapiens
tgacatttccaatataaagcc

SEQ ID NO: 8412373 - DNA, 21 bp, Homo sapiens
tgactgaggcttcttcacaca

SEQ ID NO: 8412374 - DNA, 22 bp, Homo sapiens
tgacttgtctctttgggagaca

SEQ ID NO: 8412375 - DNA, 22 bp, Homo sapiens
tgacttcctgcactcaggtgat

SEQ ID NO: 8412376 - DNA, 22 bp, Homo sapiens
tgactaaaataggacattaact

SEQ ID NO: 8412377 - DNA, 22 bp, Homo sapiens
tgacctgcagtcaagaggggaa

SEQ ID NO: 8412378 - DNA, 22 bp, Homo sapiens
tgacctgcgtaggtggtttctg

SEQ ID NO: 8412379 - DNA, 18 bp, Homo sapiens
tgacctgcgcttcacggt

SEQ ID NO: 8412380 - DNA, 22 bp, Homo sapiens
tgacacatgcaccagtctttaa

SEQ ID NO: 8412381 - DNA, 22 bp, Homo sapiens
tgacacataccgaaaatatttg

SEQ ID NO: 8412382 - DNA, 22 bp, Homo sapiens
tgaaaaacctcagtccgcttta

SEQ ID NO: 8412383 - DNA, 22 bp, Homo sapiens
tctttttatattgacaaaaggt

SEQ ID NO: 8412384 - DNA, 22 bp, Homo sapiens
tctttttttcctgtgcagagct

SEQ ID NO: 8412385 - DNA, 22 bp, Homo sapiens
tgaaaattgttgtacttgataa

SEQ ID NO: 8412386 - DNA, 17 bp, Homo sapiens
tgaaagaatcagggaga

SEQ ID NO: 8412387 - DNA, 21 bp, Homo sapiens
tcttttcctttctgtgtgcaa

SEQ ID NO: 8412388 - DNA, 22 bp, Homo sapiens
tgaagaaacgcagagaggtagg

SEQ ID NO: 8412389 - DNA, 22 bp, Homo sapiens
tgaagaaacagaccaagaggat

SEQ ID NO: 8412390 - DNA, 22 bp, Homo sapiens
tgaacattagttgagtaaagtc

SEQ ID NO: 8412391 - DNA, 22 bp, Homo sapiens
tgaacatgctgttgatggcctg

SEQ ID NO: 8412392 - DNA, 21 bp, Homo sapiens
tgaacaaagttcttatcgtga

SEQ ID NO: 8412393 - DNA, 22 bp, Homo sapiens
tgaacaaatggaaataaccagt

SEQ ID NO: 8412394 - DNA, 22 bp, Homo sapiens
tgaacaaactgcattcttcact

SEQ ID NO: 8412395 - DNA, 22 bp, Homo sapiens
tgaaatacacaaatttagtaag

SEQ ID NO: 8412396 - DNA, 23 bp, Homo sapiens
tgaaatattcttttgcatgagct

SEQ ID NO: 8412397 - DNA, 22 bp, Homo sapiens
tgaaagattgtgattcaatatg

SEQ ID NO: 8412398 - DNA, 22 bp, Homo sapiens
tgaaagataagttattatgtac

SEQ ID NO: 8412399 - DNA, 22 bp, Homo sapiens
tgaaatgttaatcacacaaagg

SEQ ID NO: 8412400 - DNA, 23 bp, Homo sapiens
tggctaaacagtggagaaagctt

SEQ ID NO: 8412401 - DNA, 21 bp, Homo sapiens
tggctaaaccctagtaaatta

SEQ ID NO: 8412402 - DNA, 22 bp, Homo sapiens
tggctgctgcagacagacagga

SEQ ID NO: 8412403 - DNA, 22 bp, Homo sapiens
tggctgctgagaaggcagctgt

SEQ ID NO: 8412404 - DNA, 21 bp, Homo sapiens
tggctgagccaggtgtgtgga

SEQ ID NO: 8412405 - DNA, 21 bp, Homo sapiens
tggctgactcttcctatcatt

SEQ ID NO: 8412406 - DNA, 22 bp, Homo sapiens
tggctgacaatgtagcagtaac

SEQ ID NO: 8412407 - DNA, 22 bp, Homo sapiens
tggctgaatctgcagcaggaag

SEQ ID NO: 8412408 - DNA, 22 bp, Homo sapiens
tggctctcaatggctgtactat

SEQ ID NO: 8412409 - DNA, 21 bp, Homo sapiens
tgggacctagctttgcacagg

SEQ ID NO: 8412410 - DNA, 21 bp, Homo sapiens
tgggacctatttcaactggat

SEQ ID NO: 8412411 - DNA, 22 bp, Homo sapiens
tgggacctctcttgagagagca

SEQ ID NO: 8412412 - DNA, 22 bp, Homo sapiens
tgggacctgaagcaggttggca

SEQ ID NO: 8412413 - DNA, 22 bp, Homo sapiens
tgggacctgccctggccccatc

SEQ ID NO: 8412414 - DNA, 22 bp, Homo sapiens
tgggacctgctcctggaatgag

SEQ ID NO: 8412415 - DNA, 22 bp, Homo sapiens
tgggacctgctcttggaatgag

SEQ ID NO: 8412416 - DNA, 16 bp, Homo sapiens
tgggacctgtggccaa

SEQ ID NO: 8412417 - DNA, 23 bp, Homo sapiens
tgggacctgtttgcccacagatg

SEQ ID NO: 8412418 - DNA, 22 bp, Homo sapiens
tgggacctgttacattgagtta

SEQ ID NO: 8412419 - DNA, 22 bp, Homo sapiens
tggctggagggttagtgagata

SEQ ID NO: 8412420 - DNA, 22 bp, Homo sapiens
tggctggagtataggagtagga

SEQ ID NO: 8412421 - DNA, 22 bp, Homo sapiens
tggctgtagaatcagagacttg

SEQ ID NO: 8412422 - DNA, 22 bp, Homo sapiens
tggctgtagaacagtggatatt

SEQ ID NO: 8412423 - DNA, 22 bp, Homo sapiens
tggctgtgcctctttccaggcc

SEQ ID NO: 8412424 - DNA, 22 bp, Homo sapiens
tggctgtgaacaaagagaataa

SEQ ID NO: 8412425 - DNA, 22 bp, Homo sapiens
tggctgtgatttgcacgagatg

SEQ ID NO: 8412426 - DNA, 22 bp, Homo sapiens
tggctgtgtccctgtccagagt

SEQ ID NO: 8412427 - DNA, 22 bp, Homo sapiens
tggcctctgaggcacctttgcc

SEQ ID NO: 8412428 - DNA, 22 bp, Homo sapiens
tggcctctgcactgggctcccc

SEQ ID NO: 8412429 - DNA, 22 bp, Homo sapiens
tggcaacatgtcgaagtgctgt

SEQ ID NO: 8412430 - DNA, 22 bp, Homo sapiens
tggcaaatattttgttttgtaa

SEQ ID NO: 8412431 - DNA, 23 bp, Homo sapiens
tggcagatacaggcatgacttct

SEQ ID NO: 8412432 - DNA, 22 bp, Homo sapiens
tggcagataaaataatagggaa

SEQ ID NO: 8412433 - DNA, 22 bp, Homo sapiens
tggcagataaacatgtgataaa

SEQ ID NO: 8412434 - DNA, 18 bp, Homo sapiens
tggcaggaaatgcacttt

SEQ ID NO: 8412435 - DNA, 22 bp, Homo sapiens
tgctgagcgcatccggcggccg

SEQ ID NO: 8412436 - DNA, 22 bp, Homo sapiens
tgctgaaaactcaaccattgtg

SEQ ID NO: 8412437 - DNA, 22 bp, Homo sapiens
tgctgaaacaataacatactgg

SEQ ID NO: 8412438 - DNA, 22 bp, Homo sapiens
tgctgaaattagaacattgagg

SEQ ID NO: 8412439 - DNA, 22 bp, Homo sapiens
tgctgaaagtcccaaatctcat

SEQ ID NO: 8412440 - DNA, 22 bp, Homo sapiens
tgctcttcggggccactgcttg

SEQ ID NO: 8412441 - DNA, 22 bp, Homo sapiens
tgctgaggtcatttccaagtga

SEQ ID NO: 8412442 - DNA, 22 bp, Homo sapiens
tgctgaggtttcgtctgcttgc

SEQ ID NO: 8412443 - DNA, 22 bp, Homo sapiens
tgctcccaggcattctctgttg

SEQ ID NO: 8412444 - DNA, 22 bp, Homo sapiens
tgctcccagggactctggctgg

SEQ ID NO: 8412445 - DNA, 22 bp, Homo sapiens
tgcgccatgtgctctcggccct

SEQ ID NO: 8412446 - DNA, 22 bp, Homo sapiens
tgctatcaccaactctgctaag

SEQ ID NO: 8412447 - DNA, 22 bp, Homo sapiens
tgctcagagctccagctctcct

SEQ ID NO: 8412448 - DNA, 22 bp, Homo sapiens
tgcgaccctagccccctcactt

SEQ ID NO: 8412449 - DNA, 22 bp, Homo sapiens
tgctggggatccgtaccaaccc

SEQ ID NO: 8412450 - DNA, 22 bp, Homo sapiens
tgctgtaatacttaaggttaag

SEQ ID NO: 8412451 - DNA, 20 bp, Homo sapiens
tgctgggcatgcagtggaaa

SEQ ID NO: 8412452 - DNA, 22 bp, Homo sapiens
tgctgggccaaagcagggtttt

SEQ ID NO: 8412453 - DNA, 21 bp, Homo sapiens
tgctgggctgcaggggatgca

SEQ ID NO: 8412454 - DNA, 22 bp, Homo sapiens
tgctgggctagaagctgaggcc

SEQ ID NO: 8412455 - DNA, 22 bp, Homo sapiens
tgcttaaaatgatgattatttt

SEQ ID NO: 8412456 - DNA, 22 bp, Homo sapiens
tgcttaaaatagttcatttttg

SEQ ID NO: 8412457 - DNA, 22 bp, Homo sapiens
tgctgtcttttcccaatcctgg

SEQ ID NO: 8412458 - DNA, 22 bp, Homo sapiens
tgcttaaacatactatttatat

SEQ ID NO: 8412459 - DNA, 22 bp, Homo sapiens
tgcttaaaccctgatcatgtgt

SEQ ID NO: 8412460 - DNA, 22 bp, Homo sapiens
tgctggagttcgacattgcaaa

SEQ ID NO: 8412461 - DNA, 22 bp, Homo sapiens
tgctggagtgcagtggcttaac

SEQ ID NO: 8412462 - DNA, 22 bp, Homo sapiens
tgctggaggagtttactgtggc

SEQ ID NO: 8412463 - DNA, 22 bp, Homo sapiens
tgctggaggccagaagtctgag

SEQ ID NO: 8412464 - DNA, 22 bp, Homo sapiens
tgctggagtctcttgaccctgg

SEQ ID NO: 8412465 - DNA, 22 bp, Homo sapiens
tgctggaggggatgccttcact

SEQ ID NO: 8412466 - DNA, 21 bp, Homo sapiens
tgctggaaaaagtggttctag

SEQ ID NO: 8412467 - DNA, 22 bp, Homo sapiens
tggagctgcctggcacctacag

SEQ ID NO: 8412468 - DNA, 22 bp, Homo sapiens
tggagagatgtctgttcaaggt

SEQ ID NO: 8412469 - DNA, 22 bp, Homo sapiens
tggagaaggggcagggtctcca

SEQ ID NO: 8412470 - DNA, 22 bp, Homo sapiens
tggaggcaactgaagatgtagt

SEQ ID NO: 8412471 - DNA, 22 bp, Homo sapiens
tggaggaaaattactggggtct

SEQ ID NO: 8412472 - DNA, 18 bp, Homo sapiens
tggaggaaaaatctcatg

SEQ ID NO: 8412473 - DNA, 22 bp, Homo sapiens
tggaggaaaaaaccaggcagag

SEQ ID NO: 8412474 - DNA, 23 bp, Homo sapiens
tggagctgggctcagaccctggg

SEQ ID NO: 8412475 - DNA, 22 bp, Homo sapiens
tggagctggtaaacagtgacat

SEQ ID NO: 8412476 - DNA, 23 bp, Homo sapiens
tggaggcaggatgctaaggagtc

SEQ ID NO: 8412477 - DNA, 22 bp, Homo sapiens
tggaggcaggggatacaggtca

SEQ ID NO: 8412478 - DNA, 20 bp, Homo sapiens
tggagggattgttggcaaat

SEQ ID NO: 8412479 - DNA, 22 bp, Homo sapiens
tggagggatacaaagatgaaaa

SEQ ID NO: 8412480 - DNA, 22 bp, Homo sapiens
tggagggaacccaggctgctct

SEQ ID NO: 8412481 - DNA, 22 bp, Homo sapiens
tggagggaacaaaggagtccca

SEQ ID NO: 8412482 - DNA, 23 bp, Homo sapiens
tggataaaatacttacattcaac

SEQ ID NO: 8412483 - DNA, 23 bp, Homo sapiens
tggataaaatacttacattcaac

SEQ ID NO: 8412484 - DNA, 22 bp, Homo sapiens
tggataaaacgttctgaaaaac

SEQ ID NO: 8412485 - DNA, 22 bp, Homo sapiens
tggataaaatgacattacctga

SEQ ID NO: 8412486 - DNA, 22 bp, Homo sapiens
tggataaatgtgcagatgacat

SEQ ID NO: 8412487 - DNA, 22 bp, Homo sapiens
tggataaatggtgctatcaccc

SEQ ID NO: 8412488 - DNA, 22 bp, Homo sapiens
tggaaggggccaggcgcggagt

SEQ ID NO: 8412489 - DNA, 22 bp, Homo sapiens
tggaatatgcaattgcatttca

SEQ ID NO: 8412490 - DNA, 22 bp, Homo sapiens
tggacaacatagtgagacctca

SEQ ID NO: 8412491 - DNA, 22 bp, Homo sapiens
tggaatggaaacaaactgagga

SEQ ID NO: 8412492 - DNA, 22 bp, Homo sapiens
tggacctgcgtaggtgctgggc

SEQ ID NO: 8412493 - DNA, 22 bp, Homo sapiens
tggacctgctggatgggcaggt

SEQ ID NO: 8412494 - DNA, 23 bp, Homo sapiens
tggacctgaaccagtgcctctgt

SEQ ID NO: 8412495 - DNA, 22 bp, Homo sapiens
tggacctgagcctggccctgcc

SEQ ID NO: 8412496 - DNA, 22 bp, Homo sapiens
tggacctgaagaataggaagta

SEQ ID NO: 8412497 - DNA, 19 bp, Homo sapiens
tggacctgtgcccatggct

SEQ ID NO: 8412498 - DNA, 20 bp, Homo sapiens
tggacctgtctctttaggga

SEQ ID NO: 8412499 - DNA, 21 bp, Homo sapiens
tggacctgtccttctcgctgt

SEQ ID NO: 8412500 - DNA, 22 bp, Homo sapiens
tggacctggggtggcctcctct

SEQ ID NO: 8412501 - DNA, 22 bp, Homo sapiens
tgctttataggggattgcaggc

SEQ ID NO: 8412502 - DNA, 22 bp, Homo sapiens
tgctttatagacaaggaagtag

SEQ ID NO: 8412503 - DNA, 22 bp, Homo sapiens
tgctttataacttagtttatgg

SEQ ID NO: 8412504 - DNA, 22 bp, Homo sapiens
tgctttatcaaagctatagtga

SEQ ID NO: 8412505 - DNA, 22 bp, Homo sapiens
tgctttatatctctcttcttag

SEQ ID NO: 8412506 - DNA, 22 bp, Homo sapiens
tgctttatctgacttggcgctg

SEQ ID NO: 8412507 - DNA, 22 bp, Homo sapiens
tgctttatctgtgagaacctga

SEQ ID NO: 8412508 - DNA, 22 bp, Homo sapiens
tgctttatgttatcagaagggt

SEQ ID NO: 8412509 - DNA, 22 bp, Homo sapiens
tgctttatgtggctgatactca

SEQ ID NO: 8412510 - DNA, 21 bp, Homo sapiens
tgctttatgggaaaaatgtca

SEQ ID NO: 8412511 - DNA, 20 bp, Homo sapiens
tgctttatgctatactttgt

SEQ ID NO: 8412512 - DNA, 18 bp, Homo sapiens
tgctttatgcttatataa

SEQ ID NO: 8412513 - DNA, 22 bp, Homo sapiens
tgctttatggagcccatctcat

SEQ ID NO: 8412514 - DNA, 22 bp, Homo sapiens
tgctttatggatttgtgtcctg

SEQ ID NO: 8412515 - DNA, 22 bp, Homo sapiens
tgctttattaagagagaaattt

SEQ ID NO: 8412516 - DNA, 22 bp, Homo sapiens
tgctttattcagtctctgccat

SEQ ID NO: 8412517 - DNA, 22 bp, Homo sapiens
tgctttattcagggtttacccc

SEQ ID NO: 8412518 - DNA, 22 bp, Homo sapiens
tgctttattcccttctgatgtg

SEQ ID NO: 8412519 - DNA, 22 bp, Homo sapiens
tgctttattcgacatctggtag

SEQ ID NO: 8412520 - DNA, 22 bp, Homo sapiens
tgctttctttagctcctgagtc

SEQ ID NO: 8412521 - DNA, 22 bp, Homo sapiens
tgctttgctctgtctctagcta

SEQ ID NO: 8412522 - DNA, 22 bp, Homo sapiens
tgctttgctctcactgtaaggt

SEQ ID NO: 8412523 - DNA, 19 bp, Homo sapiens
tgctttgccttgattagct

SEQ ID NO: 8412524 - DNA, 22 bp, Homo sapiens
tgctttgcagtgtctaacagaa

SEQ ID NO: 8412525 - DNA, 21 bp, Homo sapiens
tgctttgcaggtggatttagt

SEQ ID NO: 8412526 - DNA, 22 bp, Homo sapiens
tgctttataaccatttctgtgg

SEQ ID NO: 8412527 - DNA, 22 bp, Homo sapiens
tgcttgaacccaggaagtggag

SEQ ID NO: 8412528 - DNA, 22 bp, Homo sapiens
tgcttctttatgatgtatgatt

SEQ ID NO: 8412529 - DNA, 20 bp, Homo sapiens
tgcttttatacctataatga

SEQ ID NO: 8412530 - DNA, 22 bp, Homo sapiens
tggtcaggtacctctggctgtc

SEQ ID NO: 8412531 - DNA, 22 bp, Homo sapiens
tggtcagcgtttgtcagagcag

SEQ ID NO: 8412532 - DNA, 22 bp, Homo sapiens
tggtcaggggcttctgagctgt

SEQ ID NO: 8412533 - DNA, 22 bp, Homo sapiens
tggtgaggccaaagccatgaca

SEQ ID NO: 8412534 - DNA, 22 bp, Homo sapiens
tggtgaggtcatagagaactgt

SEQ ID NO: 8412535 - DNA, 22 bp, Homo sapiens
tggtgcagagagggatctaggg

SEQ ID NO: 8412536 - DNA, 22 bp, Homo sapiens
tggtgcagacaggagccccgct

SEQ ID NO: 8412537 - DNA, 23 bp, Homo sapiens
tggtctcacttggtaagatgaag

SEQ ID NO: 8412538 - DNA, 23 bp, Homo sapiens
tggtctcagcctgtgagagctga

SEQ ID NO: 8412539 - DNA, 22 bp, Homo sapiens
tggtggacatcccagggtgaaa

SEQ ID NO: 8412540 - DNA, 22 bp, Homo sapiens
tggtggacattctggatgtgct

SEQ ID NO: 8412541 - DNA, 21 bp, Homo sapiens
tggtggaccagtgctgggaga

SEQ ID NO: 8412542 - DNA, 22 bp, Homo sapiens
tggtggagcctaggctaagtct

SEQ ID NO: 8412543 - DNA, 19 bp, Homo sapiens
tggtggaggccccatgttc

SEQ ID NO: 8412544 - DNA, 19 bp, Homo sapiens
tggtggaggtgcacctgac

SEQ ID NO: 8412545 - DNA, 22 bp, Homo sapiens
tggtgcagatgcaggtcactgg

SEQ ID NO: 8412546 - DNA, 22 bp, Homo sapiens
tggtgcaggtgttgatgcagga

SEQ ID NO: 8412547 - DNA, 22 bp, Homo sapiens
tggtgcagtagagctgtctggg

SEQ ID NO: 8412548 - DNA, 22 bp, Homo sapiens
tggtgcagtcattggcccaggg

SEQ ID NO: 8412549 - DNA, 22 bp, Homo sapiens
tgtaagaaaagtaaatagtgac

SEQ ID NO: 8412550 - DNA, 22 bp, Homo sapiens
tgtacaatagctattatctcca

SEQ ID NO: 8412551 - DNA, 22 bp, Homo sapiens
tgtacacaattcttaacataca

SEQ ID NO: 8412552 - DNA, 22 bp, Homo sapiens
tgtaaaaccaaatcaatctagt

SEQ ID NO: 8412553 - DNA, 22 bp, Homo sapiens
tgtaaagttacttttgaaagga

SEQ ID NO: 8412554 - DNA, 22 bp, Homo sapiens
tggttaaatgggaagagcaaca

SEQ ID NO: 8412555 - DNA, 22 bp, Homo sapiens
tggtttacccctgtcctatatc

SEQ ID NO: 8412556 - DNA, 22 bp, Homo sapiens
tgtattttgtgaggatcactct

SEQ ID NO: 8412557 - DNA, 22 bp, Homo sapiens
tgtattgaattgtgttatatct

SEQ ID NO: 8412558 - DNA, 22 bp, Homo sapiens
tgtatgcacatatataggtaca

SEQ ID NO: 8412559 - DNA, 22 bp, Homo sapiens
tgtcacaaaaatcagtaattgc

SEQ ID NO: 8412560 - DNA, 22 bp, Homo sapiens
tgtatttttaggaatgcgctat

SEQ ID NO: 8412561 - DNA, 22 bp, Homo sapiens
tgtatttttagacctttagacc

SEQ ID NO: 8412562 - DNA, 22 bp, Homo sapiens
tgtagaaattagtaagatcaac

SEQ ID NO: 8412563 - DNA, 22 bp, Homo sapiens
tgtagaaattagtaagatcaac

SEQ ID NO: 8412564 - DNA, 22 bp, Homo sapiens
tgtagaaagctcttctgaaatc

SEQ ID NO: 8412565 - DNA, 22 bp, Homo sapiens
tgtagaaagaatatgtttcata

SEQ ID NO: 8412566 - DNA, 20 bp, Homo sapiens
tgtaggaaggaccctgtctg

SEQ ID NO: 8412567 - DNA, 22 bp, Homo sapiens
tgtatacaggattactcatagc

SEQ ID NO: 8412568 - DNA, 22 bp, Homo sapiens
tgtatcaaaccaaattaattct

SEQ ID NO: 8412569 - DNA, 22 bp, Homo sapiens
tgtatcaagggtttatgtaagc

SEQ ID NO: 8412570 - DNA, 22 bp, Homo sapiens
tgtccccagagcctgttcctgc

SEQ ID NO: 8412571 - DNA, 22 bp, Homo sapiens
tgtcccagctgtctctgttttt

SEQ ID NO: 8412572 - DNA, 22 bp, Homo sapiens
tgtcccagtcaaggctgtcatc

SEQ ID NO: 8412573 - DNA, 22 bp, Homo sapiens
tgtccaggtcagcagcagggac

SEQ ID NO: 8412574 - DNA, 22 bp, Homo sapiens
tgtcccagcagctgggttctct

SEQ ID NO: 8412575 - DNA, 22 bp, Homo sapiens
tgtcattttaatcacctttcca

SEQ ID NO: 8412576 - DNA, 22 bp, Homo sapiens
tgtcattttagtgcatcactca

SEQ ID NO: 8412577 - DNA, 22 bp, Homo sapiens
tgtcatttcacaatatcactca

SEQ ID NO: 8412578 - DNA, 22 bp, Homo sapiens
tgtcagttaaatgaggtacaag

SEQ ID NO: 8412579 - DNA, 22 bp, Homo sapiens
tgtcagttcagtgattacaaaa

SEQ ID NO: 8412580 - DNA, 22 bp, Homo sapiens
tgtcagttcaattatagtaatt

SEQ ID NO: 8412581 - DNA, 22 bp, Homo sapiens
tgggatgtctttaggggaagag

SEQ ID NO: 8412582 - DNA, 22 bp, Homo sapiens
tgggatcttttgagatactgtg

SEQ ID NO: 8412583 - DNA, 22 bp, Homo sapiens
tgggatctgcagtttaacaaaa

SEQ ID NO: 8412584 - DNA, 22 bp, Homo sapiens
tgggagtccaaggtttttatag

SEQ ID NO: 8412585 - DNA, 22 bp, Homo sapiens
tgggcagggatctcttttgcaa

SEQ ID NO: 8412586 - DNA, 22 bp, Homo sapiens
tgggcctcctttccattcagag

SEQ ID NO: 8412587 - DNA, 22 bp, Homo sapiens
tgggcctctgtttcctcatctg

SEQ ID NO: 8412588 - DNA, 22 bp, Homo sapiens
tgggcctcatcttcaatgagtc

SEQ ID NO: 8412589 - DNA, 22 bp, Homo sapiens
tgggcctcccatgtcttaggga

SEQ ID NO: 8412590 - DNA, 22 bp, Homo sapiens
tgggcctcaccttcttggcagc

SEQ ID NO: 8412591 - DNA, 22 bp, Homo sapiens
tgggcgacagagcaagactccg

SEQ ID NO: 8412592 - DNA, 22 bp, Homo sapiens
tgggcgacagagcaagactccg

SEQ ID NO: 8412593 - DNA, 22 bp, Homo sapiens
tgggcgacagagcaagactccg

SEQ ID NO: 8412594 - DNA, 22 bp, Homo sapiens
tgggctgaaatgctgtggacta

SEQ ID NO: 8412595 - DNA, 22 bp, Homo sapiens
tgggtgaggagaggctgtctaa

SEQ ID NO: 8412596 - DNA, 22 bp, Homo sapiens
tggtcaagggacagagctgaac

SEQ ID NO: 8412597 - DNA, 22 bp, Homo sapiens
tggtcaaggcttggagatagta

SEQ ID NO: 8412598 - DNA, 22 bp, Homo sapiens
tggtcaaagaccaggaaatgct

SEQ ID NO: 8412599 - DNA, 22 bp, Homo sapiens
tggtatcagagccatctgtatt

SEQ ID NO: 8412600 - DNA, 22 bp, Homo sapiens
tggtaaaaaccgcaattacatt

SEQ ID NO: 8412601 - DNA, 22 bp, Homo sapiens
tggtaaaaactgcaattacttt

SEQ ID NO: 8412602 - DNA, 22 bp, Homo sapiens
tggtaaaatattacaaggcact

SEQ ID NO: 8412603 - DNA, 22 bp, Homo sapiens
tggtaagaacccatcagagaag

SEQ ID NO: 8412604 - DNA, 22 bp, Homo sapiens
tgggtactcctattagttcagt

SEQ ID NO: 8412605 - DNA, 22 bp, Homo sapiens
ttaaacatttatggaggcagca

SEQ ID NO: 8412606 - DNA, 22 bp, Homo sapiens
tgttttagctgacacatggagc

SEQ ID NO: 8412607 - DNA, 18 bp, Homo sapiens
tgtttatttttctcttac

SEQ ID NO: 8412608 - DNA, 22 bp, Homo sapiens
tgttgattagtgtttagactta

SEQ ID NO: 8412609 - DNA, 22 bp, Homo sapiens
tgtttaaccaccattctattct

SEQ ID NO: 8412610 - DNA, 22 bp, Homo sapiens
tgtttaactagttttcacactt

SEQ ID NO: 8412611 - DNA, 22 bp, Homo sapiens
tgtttactcctgatatattttt

SEQ ID NO: 8412612 - DNA, 22 bp, Homo sapiens
tgtttattgagtgcctactata

SEQ ID NO: 8412613 - DNA, 22 bp, Homo sapiens
tgtttattcatggctaatgaaa

SEQ ID NO: 8412614 - DNA, 22 bp, Homo sapiens
tgttagggtcctgtgcaggggc

SEQ ID NO: 8412615 - DNA, 18 bp, Homo sapiens
tgttaaatgaagatttgc

SEQ ID NO: 8412616 - DNA, 22 bp, Homo sapiens
tgtgtcaattttcattcctact

SEQ ID NO: 8412617 - DNA, 22 bp, Homo sapiens
tgttaaaaccacaggtgaggac

SEQ ID NO: 8412618 - DNA, 22 bp, Homo sapiens
tgttaaaaattcagctctagat

SEQ ID NO: 8412619 - DNA, 22 bp, Homo sapiens
tgtggctgcaaaggaaggctgc

SEQ ID NO: 8412620 - DNA, 22 bp, Homo sapiens
tgtctcctgggtcccttccacc

SEQ ID NO: 8412621 - DNA, 22 bp, Homo sapiens
tgtctctccacacagccagtgc

SEQ ID NO: 8412622 - DNA, 22 bp, Homo sapiens
tgtcttcagcagtcatctgggg

SEQ ID NO: 8412623 - DNA, 22 bp, Homo sapiens
tgtctttaaaattaaacacatc

SEQ ID NO: 8412624 - DNA, 20 bp, Homo sapiens
tgtcttcattatggtgccct

SEQ ID NO: 8412625 - DNA, 23 bp, Homo sapiens
tgtcttcgactcctgcgtgcttc

SEQ ID NO: 8412626 - DNA, 23 bp, Homo sapiens
tgtgacccctaggagtggggacc

SEQ ID NO: 8412627 - DNA, 22 bp, Homo sapiens
tgtgaccctctccgatgggcag

SEQ ID NO: 8412628 - DNA, 19 bp, Homo sapiens
tgtgaccccagacaagctg

SEQ ID NO: 8412629 - DNA, 22 bp, Homo sapiens
tgtgacccagactcatcttctt

SEQ ID NO: 8412630 - DNA, 22 bp, Homo sapiens
tgtgacccccgtcacggctgct

SEQ ID NO: 8412631 - DNA, 22 bp, Homo sapiens
tgtgagacaattgcatcagggc

SEQ ID NO: 8412632 - DNA, 20 bp, Homo sapiens
tgtgacaaaggcatatttta

SEQ ID NO: 8412633 - DNA, 22 bp, Homo sapiens
tgtgacaagcattgtatattgg

SEQ ID NO: 8412634 - DNA, 22 bp, Homo sapiens
tgtgaataatgccgcaataaac

SEQ ID NO: 8412635 - DNA, 22 bp, Homo sapiens
tgtgaataccttgaattcatca

SEQ ID NO: 8412636 - DNA, 22 bp, Homo sapiens
tgtgaatagtcagcattttgtt

SEQ ID NO: 8412637 - DNA, 22 bp, Homo sapiens
tgtgaatagattgaagctttgg

SEQ ID NO: 8412638 - DNA, 22 bp, Homo sapiens
tgtgaatagtgccgcaataaac

SEQ ID NO: 8412639 - DNA, 22 bp, Homo sapiens
tgtgaatatacttaatgccact

SEQ ID NO: 8412640 - DNA, 22 bp, Homo sapiens
tgtgaatatccatttgtttcag

SEQ ID NO: 8412641 - DNA, 22 bp, Homo sapiens
tgtgcaggtgcaggaagggggc

SEQ ID NO: 8412642 - DNA, 22 bp, Homo sapiens
tgtgcaatcttgagcaatttat

SEQ ID NO: 8412643 - DNA, 22 bp, Homo sapiens
tgtgcatgtattgatttgtacc

SEQ ID NO: 8412644 - DNA, 22 bp, Homo sapiens
tgtgcctactgatagagccaag

SEQ ID NO: 8412645 - DNA, 19 bp, Homo sapiens
tgtgcctctatagcatgtg

SEQ ID NO: 8412646 - DNA, 22 bp, Homo sapiens
tgtgctatttgactgtttgcta

SEQ ID NO: 8412647 - DNA, 22 bp, Homo sapiens
tgtgctattacacatttattta

SEQ ID NO: 8412648 - DNA, 22 bp, Homo sapiens
tgtgctatttttgcatatgtgt

SEQ ID NO: 8412649 - DNA, 22 bp, Homo sapiens
tgtgctcttctgttacttgtag

SEQ ID NO: 8412650 - DNA, 22 bp, Homo sapiens
ttattcttcttctcttgccagg

SEQ ID NO: 8412651 - DNA, 22 bp, Homo sapiens
ttattctgcacttttaaaatat

SEQ ID NO: 8412652 - DNA, 22 bp, Homo sapiens
ttattcagtctgtctagggagt

SEQ ID NO: 8412653 - DNA, 22 bp, Homo sapiens
ttatatgtttctgtttggaggc

SEQ ID NO: 8412654 - DNA, 22 bp, Homo sapiens
ttagtctccagcttagggtttg

SEQ ID NO: 8412655 - DNA, 22 bp, Homo sapiens
ttatgcaacaggtgagcagaca

SEQ ID NO: 8412656 - DNA, 22 bp, Homo sapiens
ttatgcaaaggggcctcttcct

SEQ ID NO: 8412657 - DNA, 22 bp, Homo sapiens
ttatgatttagaaagattcact

SEQ ID NO: 8412658 - DNA, 22 bp, Homo sapiens
ttatgacatatgagtacaagta

SEQ ID NO: 8412659 - DNA, 22 bp, Homo sapiens
ttatgacagaaatgaaaagctg

SEQ ID NO: 8412660 - DNA, 22 bp, Homo sapiens
ttatgacaggaaaatcacagaa

SEQ ID NO: 8412661 - DNA, 22 bp, Homo sapiens
ttagtacatagatgatggttga

SEQ ID NO: 8412662 - DNA, 22 bp, Homo sapiens
ttagtacaagagattaattact

SEQ ID NO: 8412663 - DNA, 22 bp, Homo sapiens
ttagtacattgattcattatgt

SEQ ID NO: 8412664 - DNA, 22 bp, Homo sapiens
ttagtacaagagattaattact

SEQ ID NO: 8412665 - DNA, 22 bp, Homo sapiens
ttagtacagaatcaaaagcaat

SEQ ID NO: 8412666 - DNA, 22 bp, Homo sapiens
ttagtaatgtgttaatatgaat

SEQ ID NO: 8412667 - DNA, 22 bp, Homo sapiens
ttaggtaagtaggatcaaaaaa

SEQ ID NO: 8412668 - DNA, 22 bp, Homo sapiens
ttagcatttcatttcaagagga

SEQ ID NO: 8412669 - DNA, 22 bp, Homo sapiens
ttagcatttctggaatcacaag

SEQ ID NO: 8412670 - DNA, 19 bp, Homo sapiens
ttagggacatgaattctag

SEQ ID NO: 8412671 - DNA, 22 bp, Homo sapiens
ttagggacagctctgtaggtga

SEQ ID NO: 8412672 - DNA, 22 bp, Homo sapiens
ttagggaaggctgctgtcagct

SEQ ID NO: 8412673 - DNA, 22 bp, Homo sapiens
ttagggacaaatttgcagaacc

SEQ ID NO: 8412674 - DNA, 22 bp, Homo sapiens
ttagcattctcatttgcataaa

SEQ ID NO: 8412675 - DNA, 22 bp, Homo sapiens
ttagcattctgcctcctatatc

SEQ ID NO: 8412676 - DNA, 22 bp, Homo sapiens
ttagataatgtagagatatgag

SEQ ID NO: 8412677 - DNA, 22 bp, Homo sapiens
ttagataacagtagaatatcaa

SEQ ID NO: 8412678 - DNA, 22 bp, Homo sapiens
ttaaagatgcagctttagagaa

SEQ ID NO: 8412679 - DNA, 22 bp, Homo sapiens
ttaatacaactgttgtcactgg

SEQ ID NO: 8412680 - DNA, 22 bp, Homo sapiens
ttaatacaagcatatgcacaca

SEQ ID NO: 8412681 - DNA, 22 bp, Homo sapiens
ttaatacagtctccagaagtaa

SEQ ID NO: 8412682 - DNA, 22 bp, Homo sapiens
ttaattaagagatactgcagta

SEQ ID NO: 8412683 - DNA, 22 bp, Homo sapiens
ttaattaaattcatgagcattg

SEQ ID NO: 8412684 - DNA, 22 bp, Homo sapiens
ttaattaactagccaaccacta

SEQ ID NO: 8412685 - DNA, 22 bp, Homo sapiens
ttacatgtggtgtgaagaagag

SEQ ID NO: 8412686 - DNA, 22 bp, Homo sapiens
ttacattcaaggaactcattct

SEQ ID NO: 8412687 - DNA, 22 bp, Homo sapiens
ttacattcaatttctagaggta

SEQ ID NO: 8412688 - DNA, 21 bp, Homo sapiens
ttacattcagaggagtggaag

SEQ ID NO: 8412689 - DNA, 22 bp, Homo sapiens
ttacattcagaaagatttgagt

SEQ ID NO: 8412690 - DNA, 22 bp, Homo sapiens
ttacattcttatctcagttatt

SEQ ID NO: 8412691 - DNA, 22 bp, Homo sapiens
ttacattcttggaatcttgttt

SEQ ID NO: 8412692 - DNA, 22 bp, Homo sapiens
ttacattcccagtgtgcagcat

SEQ ID NO: 8412693 - DNA, 22 bp, Homo sapiens
ttacattcattgaagtgattca

SEQ ID NO: 8412694 - DNA, 22 bp, Homo sapiens
ttacagatcatcaaggtataat

SEQ ID NO: 8412695 - DNA, 22 bp, Homo sapiens
ttacagcaaagtgcgcagacct

SEQ ID NO: 8412696 - DNA, 22 bp, Homo sapiens
ttacagcacagtgcttttactg

SEQ ID NO: 8412697 - DNA, 17 bp, Homo sapiens
ttacagcagcaatagag

SEQ ID NO: 8412698 - DNA, 22 bp, Homo sapiens
ttacagcagcagggacagacta

SEQ ID NO: 8412699 - DNA, 22 bp, Homo sapiens
ttacatgcagagggaagggaga

SEQ ID NO: 8412700 - DNA, 22 bp, Homo sapiens
ttacacaaaaataagatatggc

SEQ ID NO: 8412701 - DNA, 22 bp, Homo sapiens
ttacagacaaactgtgttaagt

SEQ ID NO: 8412702 - DNA, 22 bp, Homo sapiens
ttacaagataacctgatgctgt

SEQ ID NO: 8412703 - DNA, 22 bp, Homo sapiens
ttcattcacccaggaaacatct

SEQ ID NO: 8412704 - DNA, 22 bp, Homo sapiens
ttcattaagtataaaatgtggt

SEQ ID NO: 8412705 - DNA, 22 bp, Homo sapiens
ttcattaattcattcagtgact

SEQ ID NO: 8412706 - DNA, 22 bp, Homo sapiens
ttcattcattcatgaatgttaa

SEQ ID NO: 8412707 - DNA, 22 bp, Homo sapiens
ttcattcatgtattgtctatgg

SEQ ID NO: 8412708 - DNA, 22 bp, Homo sapiens
ttcattcattcatgaatgttaa

SEQ ID NO: 8412709 - DNA, 22 bp, Homo sapiens
ttccagctaactcacatccctt

SEQ ID NO: 8412710 - DNA, 22 bp, Homo sapiens
ttcactgccaactaacatggaa

SEQ ID NO: 8412711 - DNA, 22 bp, Homo sapiens
ttcagcagtttctgagaagcaa

SEQ ID NO: 8412712 - DNA, 19 bp, Homo sapiens
ttcagcagtgtctgctctt

SEQ ID NO: 8412713 - DNA, 21 bp, Homo sapiens
ttcagcagtcctctagagata

SEQ ID NO: 8412714 - DNA, 22 bp, Homo sapiens
ttcactgctacatccaggtgcc

SEQ ID NO: 8412715 - DNA, 22 bp, Homo sapiens
ttatttgcccatgtttagcaga

SEQ ID NO: 8412716 - DNA, 22 bp, Homo sapiens
ttcacattgtgcagattatggt

SEQ ID NO: 8412717 - DNA, 22 bp, Homo sapiens
ttcacattggtgatatgtttct

SEQ ID NO: 8412718 - DNA, 22 bp, Homo sapiens
ttcacattggttcttgatagct

SEQ ID NO: 8412719 - DNA, 22 bp, Homo sapiens
ttcacattggtgatatgtttct

SEQ ID NO: 8412720 - DNA, 22 bp, Homo sapiens
ttcacattgtggttcatgtgaa

SEQ ID NO: 8412721 - DNA, 22 bp, Homo sapiens
ttcacattgttttaatgtgaat

SEQ ID NO: 8412722 - DNA, 22 bp, Homo sapiens
ttcacatttctctgctgtttga

SEQ ID NO: 8412723 - DNA, 22 bp, Homo sapiens
ttcacatttcataccacagctt

SEQ ID NO: 8412724 - DNA, 22 bp, Homo sapiens
ttcacatttactggtttgtccg

SEQ ID NO: 8412725 - DNA, 22 bp, Homo sapiens
ttcacatttgcccttatgtgtg

SEQ ID NO: 8412726 - DNA, 22 bp, Homo sapiens
ttcacatttgaaaggaaagata

SEQ ID NO: 8412727 - DNA, 20 bp, Homo sapiens
ttcacatttctgtagtgatt

SEQ ID NO: 8412728 - DNA, 22 bp, Homo sapiens
ttcacatttcataccacagctt

SEQ ID NO: 8412729 - DNA, 19 bp, Homo sapiens
ttcacatttttgtggcact

SEQ ID NO: 8412730 - DNA, 19 bp, Homo sapiens
ttcacattttgctctgagg

SEQ ID NO: 8412731 - DNA, 22 bp, Homo sapiens
aataaatgttaagattgtctca

SEQ ID NO: 8412732 - DNA, 22 bp, Homo sapiens
aataaagactcagaggcccagg

SEQ ID NO: 8412733 - DNA, 22 bp, Homo sapiens
actgagaactcaagagaaaagg

SEQ ID NO: 8412734 - DNA, 21 bp, Homo sapiens
aagtaaatcagagaaataacc

SEQ ID NO: 8412735 - DNA, 22 bp, Homo sapiens
aagtaaatatctgtttatagca

SEQ ID NO: 8412736 - DNA, 22 bp, Homo sapiens
aagtgaggcctaggcactgggt

SEQ ID NO: 8412737 - DNA, 22 bp, Homo sapiens
aagtgatacatctagtctataa

SEQ ID NO: 8412738 - DNA, 22 bp, Homo sapiens
aagtgaggtttctgctttcaga

SEQ ID NO: 8412739 - DNA, 22 bp, Homo sapiens
aagtgatgctacgactttgaca

SEQ ID NO: 8412740 - DNA, 22 bp, Homo sapiens
aagtgatacgtgtttatttcca

SEQ ID NO: 8412741 - DNA, 22 bp, Homo sapiens
aagtgcaatttgaaattctgca

SEQ ID NO: 8412742 - DNA, 22 bp, Homo sapiens
aagtgcaggagtggggaaagta

SEQ ID NO: 8412743 - DNA, 22 bp, Homo sapiens
aagtgatttctgcctgcatgtt

SEQ ID NO: 8412744 - DNA, 22 bp, Homo sapiens
aagtctcttttcttcctgtatt

SEQ ID NO: 8412745 - DNA, 22 bp, Homo sapiens
aagtctctttgggtactttatt

SEQ ID NO: 8412746 - DNA, 22 bp, Homo sapiens
aagtgaatctcctttctttatt

SEQ ID NO: 8412747 - DNA, 22 bp, Homo sapiens
aagtgaatttcattccaattct

SEQ ID NO: 8412748 - DNA, 22 bp, Homo sapiens
aagtgacataccttacatatgt

SEQ ID NO: 8412749 - DNA, 22 bp, Homo sapiens
aatacttgtcagatgaataaga

SEQ ID NO: 8412750 - DNA, 22 bp, Homo sapiens
actgtgctgctctccgcagccc

SEQ ID NO: 8412751 - DNA, 22 bp, Homo sapiens
actgtggcaaagaagcaggctc

SEQ ID NO: 8412752 - DNA, 22 bp, Homo sapiens
actgtggccaaagcctctggga

SEQ ID NO: 8412753 - DNA, 22 bp, Homo sapiens
actgtggcactaggcaccttac

SEQ ID NO: 8412754 - DNA, 22 bp, Homo sapiens
actgtggcaaaagaacattgga

SEQ ID NO: 8412755 - DNA, 22 bp, Homo sapiens
actgtggctcatcaggctggtg

SEQ ID NO: 8412756 - DNA, 22 bp, Homo sapiens
actgtggctcagggaatgcatg

SEQ ID NO: 8412757 - DNA, 18 bp, Homo sapiens
actgtggctcagagttgc

SEQ ID NO: 8412758 - DNA, 22 bp, Homo sapiens
actgtggctaattcatttggtc

SEQ ID NO: 8412759 - DNA, 22 bp, Homo sapiens
actgtggccggaacagtgggac

SEQ ID NO: 8412760 - DNA, 22 bp, Homo sapiens
actgtggccttgtgggttcagg

SEQ ID NO: 8412761 - DNA, 22 bp, Homo sapiens
actgtggcgtcaggaagaaatt

SEQ ID NO: 8412762 - DNA, 22 bp, Homo sapiens
actgtggcctgctgtatgggct

SEQ ID NO: 8412763 - DNA, 22 bp, Homo sapiens
aatatcttctaaggatagaact

SEQ ID NO: 8412764 - DNA, 22 bp, Homo sapiens
aatatgaattattgttacaagt

SEQ ID NO: 8412765 - DNA, 22 bp, Homo sapiens
aatatcttggcccaactccaga

SEQ ID NO: 8412766 - DNA, 22 bp, Homo sapiens
acttattagacatcttcattgt

SEQ ID NO: 8412767 - DNA, 22 bp, Homo sapiens
acttagcaaatcttttggattc

SEQ ID NO: 8412768 - DNA, 22 bp, Homo sapiens
acttagataacaaacctgtggt

SEQ ID NO: 8412769 - DNA, 22 bp, Homo sapiens
acttagattcctggtacctccg

SEQ ID NO: 8412770 - DNA, 22 bp, Homo sapiens
acttagatttccttactgggtg

SEQ ID NO: 8412771 - DNA, 22 bp, Homo sapiens
acttagcagagttgaatgtact

SEQ ID NO: 8412772 - DNA, 22 bp, Homo sapiens
acttagcaggtactttcatatt

SEQ ID NO: 8412773 - DNA, 22 bp, Homo sapiens
acttagcacctatggcattttt

SEQ ID NO: 8412774 - DNA, 22 bp, Homo sapiens
acttagcaatttgattaaaaga

SEQ ID NO: 8412775 - DNA, 22 bp, Homo sapiens
acttagcacgaacatttacttt

SEQ ID NO: 8412776 - DNA, 22 bp, Homo sapiens
acttagcattatgtaattacta

SEQ ID NO: 8412777 - DNA, 22 bp, Homo sapiens
acttagcagtttagaatatgtc

SEQ ID NO: 8412778 - DNA, 22 bp, Homo sapiens
acttagcaggtggtgactcgaa

SEQ ID NO: 8412779 - DNA, 22 bp, Homo sapiens
aatctatatgcttttcacatac

SEQ ID NO: 8412780 - DNA, 22 bp, Homo sapiens
aatctttttcacaagaaagcac

SEQ ID NO: 8412781 - DNA, 22 bp, Homo sapiens
aatcttttaggggatcctgagg

SEQ ID NO: 8412782 - DNA, 22 bp, Homo sapiens
aatcttttgattctagggctgt

SEQ ID NO: 8412783 - DNA, 22 bp, Homo sapiens
aatatgttccacttaaagctgg

SEQ ID NO: 8412784 - DNA, 22 bp, Homo sapiens
aatattatacagtcaacctctt

SEQ ID NO: 8412785 - DNA, 22 bp, Homo sapiens
aatatgcaaagcgtgttatctg

SEQ ID NO: 8412786 - DNA, 22 bp, Homo sapiens
aatatgcactctgatttagcag

SEQ ID NO: 8412787 - DNA, 22 bp, Homo sapiens
aatatggctccattcctttagg

SEQ ID NO: 8412788 - DNA, 22 bp, Homo sapiens
aatatgcagcttatcttctagg

SEQ ID NO: 8412789 - DNA, 22 bp, Homo sapiens
aatatgcatgtatacatgtgta

SEQ ID NO: 8412790 - DNA, 22 bp, Homo sapiens
agaaaatattcattgagaggct

SEQ ID NO: 8412791 - DNA, 22 bp, Homo sapiens
aatattcatttgcagaagaagt

SEQ ID NO: 8412792 - DNA, 21 bp, Homo sapiens
agaaaatggcgttttagattt

SEQ ID NO: 8412793 - DNA, 22 bp, Homo sapiens
acagtgcagtgtgatgagtatt

SEQ ID NO: 8412794 - DNA, 22 bp, Homo sapiens
acagtgcataaaaacaactttt

SEQ ID NO: 8412795 - DNA, 22 bp, Homo sapiens
acagtgcaggtctcaacaatta

SEQ ID NO: 8412796 - DNA, 22 bp, Homo sapiens
acagtctttgcaaagtcctggt

SEQ ID NO: 8412797 - DNA, 20 bp, Homo sapiens
acagtgcatggggggacagc

SEQ ID NO: 8412798 - DNA, 19 bp, Homo sapiens
acagtgcatgggacctggt

SEQ ID NO: 8412799 - DNA, 22 bp, Homo sapiens
acagtgcattattgctgaatgc

SEQ ID NO: 8412800 - DNA, 22 bp, Homo sapiens
acagtgcattattgctgaatgc

SEQ ID NO: 8412801 - DNA, 22 bp, Homo sapiens
acagtgtccccagctctgtgag

SEQ ID NO: 8412802 - DNA, 22 bp, Homo sapiens
acagtgtagaatcctgtactta

SEQ ID NO: 8412803 - DNA, 22 bp, Homo sapiens
acaggcactgtcaagtcatgaa

SEQ ID NO: 8412804 - DNA, 22 bp, Homo sapiens
acaggcagagaactcagccaga

SEQ ID NO: 8412805 - DNA, 22 bp, Homo sapiens
acagatttaggactgtagcgat

SEQ ID NO: 8412806 - DNA, 22 bp, Homo sapiens
acagatgaggaagagtcagcca

SEQ ID NO: 8412807 - DNA, 22 bp, Homo sapiens
acagatttggcccagccaatgc

SEQ ID NO: 8412808 - DNA, 22 bp, Homo sapiens
acagatttattgaagctgctgc

SEQ ID NO: 8412809 - DNA, 22 bp, Homo sapiens
acagatttgactggtacctggc

SEQ ID NO: 8412810 - DNA, 22 bp, Homo sapiens
acagattttaaatgacactccc

SEQ ID NO: 8412811 - DNA, 22 bp, Homo sapiens
acagatttgttcttttgggcta

SEQ ID NO: 8412812 - DNA, 22 bp, Homo sapiens
acagattttaaatgacactccc

SEQ ID NO: 8412813 - DNA, 22 bp, Homo sapiens
acagattttaaatgacactccc

SEQ ID NO: 8412814 - DNA, 22 bp, Homo sapiens
acagattttattattcaggtat

SEQ ID NO: 8412815 - DNA, 21 bp, Homo sapiens
acagattttatatctctgctg

SEQ ID NO: 8412816 - DNA, 22 bp, Homo sapiens
acagctttttactaatagattg

SEQ ID NO: 8412817 - DNA, 22 bp, Homo sapiens
acagcttttgaaaaattactgg

SEQ ID NO: 8412818 - DNA, 22 bp, Homo sapiens
acagcttttcaattctgctgag

SEQ ID NO: 8412819 - DNA, 22 bp, Homo sapiens
acagcttttctgatagatcctg

SEQ ID NO: 8412820 - DNA, 22 bp, Homo sapiens
acagcttttatgggaccagcca

SEQ ID NO: 8412821 - DNA, 22 bp, Homo sapiens
acagctttgttttccctgctga

SEQ ID NO: 8412822 - DNA, 22 bp, Homo sapiens
acagctttgggcaatgctatga

SEQ ID NO: 8412823 - DNA, 22 bp, Homo sapiens
acagctttgtgttaatgggaag

SEQ ID NO: 8412824 - DNA, 22 bp, Homo sapiens
acagctttatctcagggatcag

SEQ ID NO: 8412825 - DNA, 22 bp, Homo sapiens
acagctttagtgtgggtggtgc

SEQ ID NO: 8412826 - DNA, 22 bp, Homo sapiens
acataataggtacctgaataat

SEQ ID NO: 8412827 - DNA, 22 bp, Homo sapiens
acataatgagctctttataaat

SEQ ID NO: 8412828 - DNA, 22 bp, Homo sapiens
acataataggtgcctgaatatt

SEQ ID NO: 8412829 - DNA, 22 bp, Homo sapiens
acatggtgagcggcaggcctat

SEQ ID NO: 8412830 - DNA, 21 bp, Homo sapiens
acattacagggtgatgtgtct

SEQ ID NO: 8412831 - DNA, 22 bp, Homo sapiens
acattctatttcatcatgtcta

SEQ ID NO: 8412832 - DNA, 22 bp, Homo sapiens
acattctattctgcaggacaag

SEQ ID NO: 8412833 - DNA, 22 bp, Homo sapiens
acattcaagatgcattcactta

SEQ ID NO: 8412834 - DNA, 22 bp, Homo sapiens
acattcaaccaatgtttgctat

SEQ ID NO: 8412835 - DNA, 22 bp, Homo sapiens
acattctattctgcaggacaag

SEQ ID NO: 8412836 - DNA, 22 bp, Homo sapiens
acattcaaaaagcatctgtcac

SEQ ID NO: 8412837 - DNA, 22 bp, Homo sapiens
acattcaaaatatttctgatgt

SEQ ID NO: 8412838 - DNA, 22 bp, Homo sapiens
acattcaaaattaggttagttg

SEQ ID NO: 8412839 - DNA, 22 bp, Homo sapiens
acattcaaaattgtggtttaga

SEQ ID NO: 8412840 - DNA, 22 bp, Homo sapiens
acattcaacatggctggtctag

SEQ ID NO: 8412841 - DNA, 22 bp, Homo sapiens
acattcttataagagtgaggca

SEQ ID NO: 8412842 - DNA, 22 bp, Homo sapiens
acattcttcagctttgtcaggc

SEQ ID NO: 8412843 - DNA, 22 bp, Homo sapiens
acattcttaacagttaaaaact

SEQ ID NO: 8412844 - DNA, 22 bp, Homo sapiens
accaggcactcttgtggcagtg

SEQ ID NO: 8412845 - DNA, 22 bp, Homo sapiens
accaggcactcctgaggtctga

SEQ ID NO: 8412846 - DNA, 22 bp, Homo sapiens
accaggcaactgtgaatgggct

SEQ ID NO: 8412847 - DNA, 17 bp, Homo sapiens
accaggcaacacgccca

SEQ ID NO: 8412848 - DNA, 22 bp, Homo sapiens
accaggcaaaaccacaggagca

SEQ ID NO: 8412849 - DNA, 22 bp, Homo sapiens
accaggcagtatggtgctgcaa

SEQ ID NO: 8412850 - DNA, 22 bp, Homo sapiens
accaggcagctgggggtgatgt

SEQ ID NO: 8412851 - DNA, 22 bp, Homo sapiens
accaggcagtcaccgtccagga

SEQ ID NO: 8412852 - DNA, 22 bp, Homo sapiens
accaggcagagctgggccttaa

SEQ ID NO: 8412853 - DNA, 22 bp, Homo sapiens
accaggcagcactttccttgca

SEQ ID NO: 8412854 - DNA, 22 bp, Homo sapiens
accaggcagcaccaaagccggt

SEQ ID NO: 8412855 - DNA, 22 bp, Homo sapiens
accaggcatgatgtggagcaca

SEQ ID NO: 8412856 - DNA, 22 bp, Homo sapiens
aagtaaaatgtttcctttatta

SEQ ID NO: 8412857 - DNA, 22 bp, Homo sapiens
agcatccaggccaggttgggca

SEQ ID NO: 8412858 - DNA, 19 bp, Homo sapiens
agcatccagtcatgggatc

SEQ ID NO: 8412859 - DNA, 22 bp, Homo sapiens
agcatccaactttgattagaga

SEQ ID NO: 8412860 - DNA, 22 bp, Homo sapiens
agcatccactcactgggagagg

SEQ ID NO: 8412861 - DNA, 22 bp, Homo sapiens
acacacagaaggaagccccact

SEQ ID NO: 8412862 - DNA, 22 bp, Homo sapiens
agattttagtgtagaggacttg

SEQ ID NO: 8412863 - DNA, 22 bp, Homo sapiens
agattttagtgtagaggacttg

SEQ ID NO: 8412864 - DNA, 22 bp, Homo sapiens
agattttagtttggggaggtgc

SEQ ID NO: 8412865 - DNA, 22 bp, Homo sapiens
agattttagtttggggaggtgc

SEQ ID NO: 8412866 - DNA, 22 bp, Homo sapiens
agattttatagataatttccca

SEQ ID NO: 8412867 - DNA, 22 bp, Homo sapiens
agattttatagataatttccca

SEQ ID NO: 8412868 - DNA, 22 bp, Homo sapiens
agatttctctttccctggctga

SEQ ID NO: 8412869 - DNA, 22 bp, Homo sapiens
agatttgcggctttactttgca

SEQ ID NO: 8412870 - DNA, 23 bp, Homo sapiens
agcacttgtatcttactaaaatg

SEQ ID NO: 8412871 - DNA, 22 bp, Homo sapiens
agcacttaagttaattgaactg

SEQ ID NO: 8412872 - DNA, 17 bp, Homo sapiens
agcacttgaaaatttct

SEQ ID NO: 8412873 - DNA, 19 bp, Homo sapiens
agcagcagctaccacttgt

SEQ ID NO: 8412874 - DNA, 22 bp, Homo sapiens
acacacttcacccttgagctaa

SEQ ID NO: 8412875 - DNA, 20 bp, Homo sapiens
acacactttgatcttgagcc

SEQ ID NO: 8412876 - DNA, 21 bp, Homo sapiens
acagacagggccagtgtcccc

SEQ ID NO: 8412877 - DNA, 22 bp, Homo sapiens
acagaacttcagtagtattccc

SEQ ID NO: 8412878 - DNA, 22 bp, Homo sapiens
acagaactgagaattctctatc

SEQ ID NO: 8412879 - DNA, 20 bp, Homo sapiens
agcattcattcagcaagcct

SEQ ID NO: 8412880 - DNA, 22 bp, Homo sapiens
agcattcatgatgacaacagga

SEQ ID NO: 8412881 - DNA, 22 bp, Homo sapiens
agcattcattgctagaatgtaa

SEQ ID NO: 8412882 - DNA, 22 bp, Homo sapiens
agcattcaagtaattcacttgg

SEQ ID NO: 8412883 - DNA, 22 bp, Homo sapiens
agcatcctgcttgctgtctgtg

SEQ ID NO: 8412884 - DNA, 22 bp, Homo sapiens
agcatctaaactatcagtttga

SEQ ID NO: 8412885 - DNA, 22 bp, Homo sapiens
agctcagggcaaagactcaaat

SEQ ID NO: 8412886 - DNA, 22 bp, Homo sapiens
aatgctttgagggaagatgaaa

SEQ ID NO: 8412887 - DNA, 22 bp, Homo sapiens
aatgctttgtctgctccagact

SEQ ID NO: 8412888 - DNA, 22 bp, Homo sapiens
agaataaatgctacctatcaca

SEQ ID NO: 8412889 - DNA, 22 bp, Homo sapiens
agaataaatcaaatgtcctgag

SEQ ID NO: 8412890 - DNA, 19 bp, Homo sapiens
agaatcaggtcaggtgaca

SEQ ID NO: 8412891 - DNA, 19 bp, Homo sapiens
agaatcatcttgaagtgat

SEQ ID NO: 8412892 - DNA, 22 bp, Homo sapiens
agaataatactgaaatgctgaa

SEQ ID NO: 8412893 - DNA, 22 bp, Homo sapiens
aatgtataaagtgttaataact

SEQ ID NO: 8412894 - DNA, 22 bp, Homo sapiens
aatgtataaagtgttaataact

SEQ ID NO: 8412895 - DNA, 20 bp, Homo sapiens
agagagaggtaaattgagca

SEQ ID NO: 8412896 - DNA, 22 bp, Homo sapiens
agagagagggaaactgctaaac

SEQ ID NO: 8412897 - DNA, 22 bp, Homo sapiens
agagagcagtctggaagaaaca

SEQ ID NO: 8412898 - DNA, 22 bp, Homo sapiens
agagatctctgaagctgctgct

SEQ ID NO: 8412899 - DNA, 19 bp, Homo sapiens
agacactggatggaaaatg

SEQ ID NO: 8412900 - DNA, 22 bp, Homo sapiens
agaggcatgatcttataattta

SEQ ID NO: 8412901 - DNA, 22 bp, Homo sapiens
agaggcatgcacagatgtgctg

SEQ ID NO: 8412902 - DNA, 22 bp, Homo sapiens
agagggcataaaatagagcacg

SEQ ID NO: 8412903 - DNA, 22 bp, Homo sapiens
agagggcatgcttggtggcctg

SEQ ID NO: 8412904 - DNA, 22 bp, Homo sapiens
agagggctgctgcacagtgctc

SEQ ID NO: 8412905 - DNA, 22 bp, Homo sapiens
agagggctgctgcacagtgctc

SEQ ID NO: 8412906 - DNA, 22 bp, Homo sapiens
agagggctgcctcagtcagcta

SEQ ID NO: 8412907 - DNA, 20 bp, Homo sapiens
agaggttcagtctggagaag

SEQ ID NO: 8412908 - DNA, 22 bp, Homo sapiens
agatatacacccatatcacata

SEQ ID NO: 8412909 - DNA, 22 bp, Homo sapiens
agatctttaaaagttattatta

SEQ ID NO: 8412910 - DNA, 22 bp, Homo sapiens
agattatttaagacaggaacca

SEQ ID NO: 8412911 - DNA, 22 bp, Homo sapiens
agattcaaagtgaagaacttaa

SEQ ID NO: 8412912 - DNA, 22 bp, Homo sapiens
agatatgtccctgtctaatatt

SEQ ID NO: 8412913 - DNA, 22 bp, Homo sapiens
agatatacagagaattattcac

SEQ ID NO: 8412914 - DNA, 22 bp, Homo sapiens
agatatgttactgcatcatggg

SEQ ID NO: 8412915 - DNA, 22 bp, Homo sapiens
agatatgtttgtatatatttgt

SEQ ID NO: 8412916 - DNA, 22 bp, Homo sapiens
agatctgagtggctgcatgtaa

SEQ ID NO: 8412917 - DNA, 22 bp, Homo sapiens
aatgtattctgggaaaatgtta

SEQ ID NO: 8412918 - DNA, 22 bp, Homo sapiens
aatgtattctgggaaaatgtta

SEQ ID NO: 8412919 - DNA, 22 bp, Homo sapiens
aactctcattttaggtgtaagg

SEQ ID NO: 8412920 - DNA, 22 bp, Homo sapiens
aatgttaatgtgtttgcttatg

SEQ ID NO: 8412921 - DNA, 22 bp, Homo sapiens
aatgttaagtttagattataac

SEQ ID NO: 8412922 - DNA, 22 bp, Homo sapiens
aatgttaatttactgtcttcat

SEQ ID NO: 8412923 - DNA, 22 bp, Homo sapiens
aatgttaattcacagccaaata

SEQ ID NO: 8412924 - DNA, 21 bp, Homo sapiens
aatgtctttgtccatgctctg

SEQ ID NO: 8412925 - DNA, 22 bp, Homo sapiens
aatgttaaaaccttcagtgctt

SEQ ID NO: 8412926 - DNA, 22 bp, Homo sapiens
aatgtgttttatgagagaatat

SEQ ID NO: 8412927 - DNA, 22 bp, Homo sapiens
aactttcaggcaatgaatattt

SEQ ID NO: 8412928 - DNA, 22 bp, Homo sapiens
aatgttattacacttgtgaaat

SEQ ID NO: 8412929 - DNA, 22 bp, Homo sapiens
aactttatcggaacaggtactc

SEQ ID NO: 8412930 - DNA, 22 bp, Homo sapiens
aagacaataatttttgggcagg

SEQ ID NO: 8412931 - DNA, 17 bp, Homo sapiens
aagacaagacaaatgca

SEQ ID NO: 8412932 - DNA, 22 bp, Homo sapiens
aagacaagcatcaaatcaggca

SEQ ID NO: 8412933 - DNA, 22 bp, Homo sapiens
aattcaaagccgcttgggaatc

SEQ ID NO: 8412934 - DNA, 22 bp, Homo sapiens
aattcaaagactagaattttgc

SEQ ID NO: 8412935 - DNA, 22 bp, Homo sapiens
aattcaaattacaatagttgtt

SEQ ID NO: 8412936 - DNA, 22 bp, Homo sapiens
aattcaacagtcagttatctca

SEQ ID NO: 8412937 - DNA, 22 bp, Homo sapiens
aattcaacagtcagttatctca

SEQ ID NO: 8412938 - DNA, 22 bp, Homo sapiens
aattcaaatttgagtttgtgat

SEQ ID NO: 8412939 - DNA, 23 bp, Homo sapiens
aattcaaattcagtgtgactagg

SEQ ID NO: 8412940 - DNA, 22 bp, Homo sapiens
aattagaagggagttattgata

SEQ ID NO: 8412941 - DNA, 22 bp, Homo sapiens
aagacaatttgatactagttgc

SEQ ID NO: 8412942 - DNA, 22 bp, Homo sapiens
aagacaattttgagtatgcaca

SEQ ID NO: 8412943 - DNA, 22 bp, Homo sapiens
aagacaatgcattactaagaag

SEQ ID NO: 8412944 - DNA, 22 bp, Homo sapiens
aagacaatgagtcctgatggga

SEQ ID NO: 8412945 - DNA, 22 bp, Homo sapiens
aagacacacacatatgctgagt

SEQ ID NO: 8412946 - DNA, 22 bp, Homo sapiens
aagacacagcgaaatgttcctg

SEQ ID NO: 8412947 - DNA, 22 bp, Homo sapiens
aagacattgtcattttataatt

SEQ ID NO: 8412948 - DNA, 22 bp, Homo sapiens
aagatttttttccacagactca

SEQ ID NO: 8412949 - DNA, 22 bp, Homo sapiens
aagatttttttccacagactca

SEQ ID NO: 8412950 - DNA, 22 bp, Homo sapiens
aagattttctcaactgtatttg

SEQ ID NO: 8412951 - DNA, 22 bp, Homo sapiens
aagattttcagtgcctaaaaca

SEQ ID NO: 8412952 - DNA, 22 bp, Homo sapiens
aagattttcagctaatggtgca

SEQ ID NO: 8412953 - DNA, 22 bp, Homo sapiens
aagcacattaaggaacattgaa

SEQ ID NO: 8412954 - DNA, 22 bp, Homo sapiens
aagcacattgcctggcacatag

SEQ ID NO: 8412955 - DNA, 22 bp, Homo sapiens
aagcacattgtacatttgtgct

SEQ ID NO: 8412956 - DNA, 23 bp, Homo sapiens
acagatgaaagtgtggctcagag

SEQ ID NO: 8412957 - DNA, 22 bp, Homo sapiens
aagcaaaaggttacacttctgg

SEQ ID NO: 8412958 - DNA, 22 bp, Homo sapiens
acactaatcttttatttggttt

SEQ ID NO: 8412959 - DNA, 22 bp, Homo sapiens
acactaattaagctgctttact

SEQ ID NO: 8412960 - DNA, 22 bp, Homo sapiens
acactaattaagctgctttact

SEQ ID NO: 8412961 - DNA, 22 bp, Homo sapiens
aagagtctattggaactagaca

SEQ ID NO: 8412962 - DNA, 22 bp, Homo sapiens
aagaggttgtctgtgatgagtt

SEQ ID NO: 8412963 - DNA, 22 bp, Homo sapiens
aagagtaaatgtctaattagga

SEQ ID NO: 8412964 - DNA, 22 bp, Homo sapiens
acacacaggtaaaggagcctgg

SEQ ID NO: 8412965 - DNA, 20 bp, Homo sapiens
acacacagagacatgcgcat

SEQ ID NO: 8412966 - DNA, 22 bp, Homo sapiens
aacaatcaagtttctaaatgac

SEQ ID NO: 8412967 - DNA, 22 bp, Homo sapiens
aagtatgtcaatcatacttcaa

SEQ ID NO: 8412968 - DNA, 22 bp, Homo sapiens
aaatttcaagcaaagtagctat

SEQ ID NO: 8412969 - DNA, 22 bp, Homo sapiens
aaatttctaagcagccacttcc

SEQ ID NO: 8412970 - DNA, 22 bp, Homo sapiens
aacaagtctttggttttggcta

SEQ ID NO: 8412971 - DNA, 22 bp, Homo sapiens
aacaagtctaagagaatggcag

SEQ ID NO: 8412972 - DNA, 22 bp, Homo sapiens
aacaagtcattccatttgacag

SEQ ID NO: 8412973 - DNA, 22 bp, Homo sapiens
aacaagatgttttgatatatgt

SEQ ID NO: 8412974 - DNA, 22 bp, Homo sapiens
aacaataactagacatgccatg

SEQ ID NO: 8412975 - DNA, 22 bp, Homo sapiens
aagccagatttcactcttaatt

SEQ ID NO: 8412976 - DNA, 22 bp, Homo sapiens
aagccagatttcactcttaatt

SEQ ID NO: 8412977 - DNA, 22 bp, Homo sapiens
aagccatttgttgtccttcagg

SEQ ID NO: 8412978 - DNA, 22 bp, Homo sapiens
aagctgattctaaaatttatta

SEQ ID NO: 8412979 - DNA, 22 bp, Homo sapiens
aagctttatgacttggagacag

SEQ ID NO: 8412980 - DNA, 22 bp, Homo sapiens
aagctttatgatctctcagcta

SEQ ID NO: 8412981 - DNA, 22 bp, Homo sapiens
aagctgtgaaatagattacaca

SEQ ID NO: 8412982 - DNA, 22 bp, Homo sapiens
aagctttagagatgagttcctt

SEQ ID NO: 8412983 - DNA, 22 bp, Homo sapiens
aaggactctccagctagcaaat

SEQ ID NO: 8412984 - DNA, 22 bp, Homo sapiens
aaggacctatattgtcagagga

SEQ ID NO: 8412985 - DNA, 22 bp, Homo sapiens
aaggagaaatggtagatgtgca

SEQ ID NO: 8412986 - DNA, 22 bp, Homo sapiens
aaattattacaagctagttggc

SEQ ID NO: 8412987 - DNA, 22 bp, Homo sapiens
aaattattatgcccctctataa

SEQ ID NO: 8412988 - DNA, 22 bp, Homo sapiens
aaattagtcggtttaggaattt

SEQ ID NO: 8412989 - DNA, 22 bp, Homo sapiens
aaattaactatcacttttgtga

SEQ ID NO: 8412990 - DNA, 22 bp, Homo sapiens
aaattagtacattgcaaagtcc

SEQ ID NO: 8412991 - DNA, 18 bp, Homo sapiens
aaattagatggacctgtg

SEQ ID NO: 8412992 - DNA, 22 bp, Homo sapiens
aacattctttagctcttcctgc

SEQ ID NO: 8412993 - DNA, 22 bp, Homo sapiens
aacattgagttctacttccatt

SEQ ID NO: 8412994 - DNA, 22 bp, Homo sapiens
aacattgaaatatttgcaatag

SEQ ID NO: 8412995 - DNA, 22 bp, Homo sapiens
aacattgaatttaaaatacagt

SEQ ID NO: 8412996 - DNA, 22 bp, Homo sapiens
aacattctggttctaaaaacct

SEQ ID NO: 8412997 - DNA, 22 bp, Homo sapiens
aacatttcagcaaataagaaca

SEQ ID NO: 8412998 - DNA, 22 bp, Homo sapiens
aagttacattttggtctaattg

SEQ ID NO: 8412999 - DNA, 22 bp, Homo sapiens
aacactgctgctgggttctgtg

SEQ ID NO: 8413000 - DNA, 22 bp, Homo sapiens
aaatgctacacaggaattctca

SEQ ID NO: 8413001 - DNA, 22 bp, Homo sapiens
aaatgcctgtgtaaattctagc

SEQ ID NO: 8413002 - DNA, 22 bp, Homo sapiens
aaatgcctatttgttccttcag

SEQ ID NO: 8413003 - DNA, 22 bp, Homo sapiens
aaatgcctcattttctctcact

SEQ ID NO: 8413004 - DNA, 22 bp, Homo sapiens
aaatgcctctgggttattctag

SEQ ID NO: 8413005 - DNA, 22 bp, Homo sapiens
aaatgcctcccattctactgac

SEQ ID NO: 8413006 - DNA, 22 bp, Homo sapiens
aaatgctagggagaaactctcc

SEQ ID NO: 8413007 - DNA, 22 bp, Homo sapiens
aaatgctagggagaaactctcc

SEQ ID NO: 8413008 - DNA, 22 bp, Homo sapiens
aaatggcaggctctttgctagt

SEQ ID NO: 8413009 - DNA, 22 bp, Homo sapiens
aaatcatgaggacattatgcca

SEQ ID NO: 8413010 - DNA, 22 bp, Homo sapiens
aaatcatgtgcagagatcagga

SEQ ID NO: 8413011 - DNA, 22 bp, Homo sapiens
aaatattattgcttaaggggag

SEQ ID NO: 8413012 - DNA, 22 bp, Homo sapiens
aaactacatctcatggatgagg

SEQ ID NO: 8413013 - DNA, 23 bp, Homo sapiens
aaactacaacgccaggcactgag

SEQ ID NO: 8413014 - DNA, 23 bp, Homo sapiens
aaactacaacgccaggcactgag

SEQ ID NO: 8413015 - DNA, 22 bp, Homo sapiens
aaactaaacctggcttagtaag

SEQ ID NO: 8413016 - DNA, 22 bp, Homo sapiens
aaaggcattttaattctaaaga

SEQ ID NO: 8413017 - DNA, 22 bp, Homo sapiens
aaaggaggaatggagagatgct

SEQ ID NO: 8413018 - DNA, 22 bp, Homo sapiens
aaaggaggaatggagagatgct

SEQ ID NO: 8413019 - DNA, 22 bp, Homo sapiens
aaaggcatggaacagattctcc

SEQ ID NO: 8413020 - DNA, 22 bp, Homo sapiens
aaacatcaccattttacctaat

SEQ ID NO: 8413021 - DNA, 22 bp, Homo sapiens
aaacatcaattgcatctcccaa

SEQ ID NO: 8413022 - DNA, 22 bp, Homo sapiens
aaacatcaccattttacctaat

SEQ ID NO: 8413023 - DNA, 22 bp, Homo sapiens
aaacatcataggcatgcatgat

SEQ ID NO: 8413024 - DNA, 22 bp, Homo sapiens
aaacatcataggcatgcatgat

SEQ ID NO: 8413025 - DNA, 22 bp, Homo sapiens
aaacatcataggcatgcatgat

SEQ ID NO: 8413026 - DNA, 22 bp, Homo sapiens
aaagtgcagtccatgaaattaa

SEQ ID NO: 8413027 - DNA, 22 bp, Homo sapiens
aaagatgatctacaagttcatt

SEQ ID NO: 8413028 - DNA, 22 bp, Homo sapiens
aaagaaggatgggagaaatcct

SEQ ID NO: 8413029 - DNA, 22 bp, Homo sapiens
aaagaaggacctggaggaggat

SEQ ID NO: 8413030 - DNA, 22 bp, Homo sapiens
aaacttgacagtagacagatta

SEQ ID NO: 8413031 - DNA, 22 bp, Homo sapiens
aaacatgagcatttctgtttaa

SEQ ID NO: 8413032 - DNA, 22 bp, Homo sapiens
aaaccatcagataattcatact

SEQ ID NO: 8413033 - DNA, 22 bp, Homo sapiens
aaaccacacttagcagtttcgt

SEQ ID NO: 8413034 - DNA, 22 bp, Homo sapiens
aaaaatgtgaccacagggtgtt

SEQ ID NO: 8413035 - DNA, 22 bp, Homo sapiens
aaaaatgtcattatggaactga

SEQ ID NO: 8413036 - DNA, 22 bp, Homo sapiens
aaaaagatagcattgtgctcct

SEQ ID NO: 8413037 - DNA, 22 bp, Homo sapiens
aaaaagatgtcctgaagtttag

SEQ ID NO: 8413038 - DNA, 22 bp, Homo sapiens
aaacacacctttggaactgtga

SEQ ID NO: 8413039 - DNA, 22 bp, Homo sapiens
aaacacaatgtttctttgttct

SEQ ID NO: 8413040 - DNA, 22 bp, Homo sapiens
aaacaaacataggtttgaaagt

SEQ ID NO: 8413041 - DNA, 22 bp, Homo sapiens
aaaagtctgctttctattatca

SEQ ID NO: 8413042 - DNA, 22 bp, Homo sapiens
aaaattcattcctcagactgcc

SEQ ID NO: 8413043 - DNA, 22 bp, Homo sapiens
aacatttcttctgaaactgagt

SEQ ID NO: 8413044 - DNA, 22 bp, Homo sapiens
aactgacagcaggaaccattcc

SEQ ID NO: 8413045 - DNA, 21 bp, Homo sapiens
aactgagaccagctaaagtgg

SEQ ID NO: 8413046 - DNA, 22 bp, Homo sapiens
aacatttctgagaatatcagtt

SEQ ID NO: 8413047 - DNA, 21 bp, Homo sapiens
aacatttctgggagaactcac

SEQ ID NO: 8413048 - DNA, 22 bp, Homo sapiens
aacatttcattggaagctatgt

SEQ ID NO: 8413049 - DNA, 22 bp, Homo sapiens
aacattctactgtactgcattg

SEQ ID NO: 8413050 - DNA, 22 bp, Homo sapiens
aacattcaattgaggaagttaa

SEQ ID NO: 8413051 - DNA, 22 bp, Homo sapiens
aacattcacctctacctccttc

SEQ ID NO: 8413052 - DNA, 22 bp, Homo sapiens
aacagtcttacagaagtagcca

SEQ ID NO: 8413053 - DNA, 22 bp, Homo sapiens
aacagtcttcctacggccatta

SEQ ID NO: 8413054 - DNA, 22 bp, Homo sapiens
aacagtctaaattatacccttt

SEQ ID NO: 8413055 - DNA, 22 bp, Homo sapiens
aacagtctactgaatatctgcg

SEQ ID NO: 8413056 - DNA, 22 bp, Homo sapiens
aacaagaagggaaggcatgatt

SEQ ID NO: 8413057 - DNA, 22 bp, Homo sapiens
aacacaaagaagctgcaggatc

SEQ ID NO: 8413058 - DNA, 22 bp, Homo sapiens
aacagcttttttggtcagcatt

SEQ ID NO: 8413059 - DNA, 22 bp, Homo sapiens
aaagcacagagctcccacagga

SEQ ID NO: 8413060 - DNA, 22 bp, Homo sapiens
aaagcacagggtgctagagagt

SEQ ID NO: 8413061 - DNA, 22 bp, Homo sapiens
aaagcacatgagtagtgtagta

SEQ ID NO: 8413062 - DNA, 22 bp, Homo sapiens
aaagcacattacaagctcagtc

SEQ ID NO: 8413063 - DNA, 22 bp, Homo sapiens
aaagcacatagtagaaggattt

SEQ ID NO: 8413064 - DNA, 22 bp, Homo sapiens
aacaaattagttgcaagactgg

SEQ ID NO: 8413065 - DNA, 22 bp, Homo sapiens
aacaaccaaaaagatgaatgta

SEQ ID NO: 8413066 - DNA, 22 bp, Homo sapiens
aagagcatcggtggagccccca

SEQ ID NO: 8413067 - DNA, 22 bp, Homo sapiens
aagagcatctatttcacagtgg

SEQ ID NO: 8413068 - DNA, 22 bp, Homo sapiens
aagagcatcaatgactcgcagt

SEQ ID NO: 8413069 - DNA, 22 bp, Homo sapiens
aagagcatcaatgactcgcagt

SEQ ID NO: 8413070 - DNA, 22 bp, Homo sapiens
aagagcatattaatagtggaga

SEQ ID NO: 8413071 - DNA, 22 bp, Homo sapiens
aagagcatggaatggagatcca

SEQ ID NO: 8413072 - DNA, 22 bp, Homo sapiens
aagagcattttgtaaaatcctt

SEQ ID NO: 8413073 - DNA, 22 bp, Homo sapiens
aagaatgtggcatttatttata

SEQ ID NO: 8413074 - DNA, 22 bp, Homo sapiens
aagaaagggagaaggatggtgt

SEQ ID NO: 8413075 - DNA, 22 bp, Homo sapiens
aacttttagacttgggtataaa

SEQ ID NO: 8413076 - DNA, 22 bp, Homo sapiens
aacttttaaaatacacagacaa

SEQ ID NO: 8413077 - DNA, 22 bp, Homo sapiens
aagcaacagaaacattctaata

SEQ ID NO: 8413078 - DNA, 22 bp, Homo sapiens
aaatatcatttataacttttaa

SEQ ID NO: 8413079 - DNA, 19 bp, Homo sapiens
aaatatcagagagatgata

SEQ ID NO: 8413080 - DNA, 22 bp, Homo sapiens
aagcaacattctctgtggcatt

SEQ ID NO: 8413081 - DNA, 22 bp, Homo sapiens
aagccacagatcgttctgtcac

SEQ ID NO: 8413082 - DNA, 22 bp, Homo sapiens
aagccagatagaagaactcatt

SEQ ID NO: 8413083 - DNA, 22 bp, Homo sapiens
aagccagatcaaagtgtccagg

SEQ ID NO: 8413084 - DNA, 22 bp, Homo sapiens
aagccaatgatacgggtgatct

SEQ ID NO: 8413085 - DNA, 22 bp, Homo sapiens
aagccaatggattggttgcttt

SEQ ID NO: 8413086 - DNA, 22 bp, Homo sapiens
aagcactaggtcacacaagtta

SEQ ID NO: 8413087 - DNA, 22 bp, Homo sapiens
aagcactaatattttggcacct

SEQ ID NO: 8413088 - DNA, 22 bp, Homo sapiens
agctctgttactgattttcctg

SEQ ID NO: 8413089 - DNA, 20 bp, Homo sapiens
agctcttactttgcagcagc

SEQ ID NO: 8413090 - DNA, 22 bp, Homo sapiens
agctcctgggccaagcccatgc

SEQ ID NO: 8413091 - DNA, 22 bp, Homo sapiens
agctacagttgccctcagcagg

SEQ ID NO: 8413092 - DNA, 22 bp, Homo sapiens
agctagaatgttccttttcatt

SEQ ID NO: 8413093 - DNA, 22 bp, Homo sapiens
agctaatgatgagatacagata

SEQ ID NO: 8413094 - DNA, 22 bp, Homo sapiens
agctaatgaaatattttctgat

SEQ ID NO: 8413095 - DNA, 22 bp, Homo sapiens
agctaatgatacatgctccaca

SEQ ID NO: 8413096 - DNA, 23 bp, Homo sapiens
agctaatgggacagattccatgg

SEQ ID NO: 8413097 - DNA, 22 bp, Homo sapiens
agctaatgggagaccctttcac

SEQ ID NO: 8413098 - DNA, 22 bp, Homo sapiens
cagcaacatgtggtagtgtagg

SEQ ID NO: 8413099 - DNA, 22 bp, Homo sapiens
cagcaacatatatgaaactgtg

SEQ ID NO: 8413100 - DNA, 22 bp, Homo sapiens
cactttattataaatttgagag

SEQ ID NO: 8413101 - DNA, 19 bp, Homo sapiens
cactttatttctgttttgt

SEQ ID NO: 8413102 - DNA, 22 bp, Homo sapiens
cactttatatgcattacctcat

SEQ ID NO: 8413103 - DNA, 22 bp, Homo sapiens
agccagagttgaatgtgagtct

SEQ ID NO: 8413104 - DNA, 22 bp, Homo sapiens
agccagagttgaatgtgagtct

SEQ ID NO: 8413105 - DNA, 21 bp, Homo sapiens
agccagatccattttgcatgg

SEQ ID NO: 8413106 - DNA, 22 bp, Homo sapiens
agccagctaagggaagcatgat

SEQ ID NO: 8413107 - DNA, 22 bp, Homo sapiens
cagagcctggcgatgtcatgga

SEQ ID NO: 8413108 - DNA, 22 bp, Homo sapiens
cagagccttcctagcagactct

SEQ ID NO: 8413109 - DNA, 18 bp, Homo sapiens
cagagctcctggatgcag

SEQ ID NO: 8413110 - DNA, 20 bp, Homo sapiens
cagagaccaggccaggtgtc

SEQ ID NO: 8413111 - DNA, 22 bp, Homo sapiens
cagagacattaagtgccatgat

SEQ ID NO: 8413112 - DNA, 22 bp, Homo sapiens
cagagctctgacagctacagcc

SEQ ID NO: 8413113 - DNA, 22 bp, Homo sapiens
caccacttcataggctttaagg

SEQ ID NO: 8413114 - DNA, 22 bp, Homo sapiens
agcatgtgtaatctcaatacct

SEQ ID NO: 8413115 - DNA, 22 bp, Homo sapiens
agcatgtgtggagaaatatttt

SEQ ID NO: 8413116 - DNA, 22 bp, Homo sapiens
agcagtccaactgaggtggcat

SEQ ID NO: 8413117 - DNA, 22 bp, Homo sapiens
caatacaattaccagttaatca

SEQ ID NO: 8413118 - DNA, 22 bp, Homo sapiens
cacagaacatccttagctcatg

SEQ ID NO: 8413119 - DNA, 19 bp, Homo sapiens
agcagctggaggtggagtg

SEQ ID NO: 8413120 - DNA, 20 bp, Homo sapiens
agcagagtgcccatcccgga

SEQ ID NO: 8413121 - DNA, 22 bp, Homo sapiens
caataattgctttccagagtta

SEQ ID NO: 8413122 - DNA, 22 bp, Homo sapiens
caataatttacattggatacca

SEQ ID NO: 8413123 - DNA, 20 bp, Homo sapiens
caataatttacttccctatt

SEQ ID NO: 8413124 - DNA, 22 bp, Homo sapiens
agcactgtgatttataacattt

SEQ ID NO: 8413125 - DNA, 22 bp, Homo sapiens
agcactgtggggaactcacaga

SEQ ID NO: 8413126 - DNA, 18 bp, Homo sapiens
agcaccagtcactaacag

SEQ ID NO: 8413127 - DNA, 17 bp, Homo sapiens
agcactaaaatgcttcc

SEQ ID NO: 8413128 - DNA, 22 bp, Homo sapiens
agcacgttcttcattacttcac

SEQ ID NO: 8413129 - DNA, 22 bp, Homo sapiens
agcactgatttaaactggattt

SEQ ID NO: 8413130 - DNA, 22 bp, Homo sapiens
agcactattccaatgatccaat

SEQ ID NO: 8413131 - DNA, 22 bp, Homo sapiens
agagagcatggcacagaggggt

SEQ ID NO: 8413132 - DNA, 22 bp, Homo sapiens
agacttctttgtgagcattttc

SEQ ID NO: 8413133 - DNA, 22 bp, Homo sapiens
agacttcactcccagagattct

SEQ ID NO: 8413134 - DNA, 22 bp, Homo sapiens
agagaatacaaagaagatatgt

SEQ ID NO: 8413135 - DNA, 22 bp, Homo sapiens
agagaaaactcattgaggtgtc

SEQ ID NO: 8413136 - DNA, 22 bp, Homo sapiens
agagcactgctgatttacagtc

SEQ ID NO: 8413137 - DNA, 22 bp, Homo sapiens
agagcacaggctcaccattgtt

SEQ ID NO: 8413138 - DNA, 22 bp, Homo sapiens
agagcacagggttttgtgccgg

SEQ ID NO: 8413139 - DNA, 22 bp, Homo sapiens
agagctggcagcagcttctcct

SEQ ID NO: 8413140 - DNA, 22 bp, Homo sapiens
agagctggaatcagacctcagg

SEQ ID NO: 8413141 - DNA, 22 bp, Homo sapiens
atgaggcacgtgttactggcct

SEQ ID NO: 8413142 - DNA, 19 bp, Homo sapiens
agacaagtttccagaagcc

SEQ ID NO: 8413143 - DNA, 22 bp, Homo sapiens
agacaagttctgtgggtcacct

SEQ ID NO: 8413144 - DNA, 22 bp, Homo sapiens
agacaacaccaaatgctagtgt

SEQ ID NO: 8413145 - DNA, 21 bp, Homo sapiens
agacaactgtgactattccct

SEQ ID NO: 8413146 - DNA, 22 bp, Homo sapiens
atgaaggacaacaggggagcag

SEQ ID NO: 8413147 - DNA, 22 bp, Homo sapiens
atgaaggatagggcaaaatttt

SEQ ID NO: 8413148 - DNA, 22 bp, Homo sapiens
atgaaggcagttaaacgtcatc

SEQ ID NO: 8413149 - DNA, 22 bp, Homo sapiens
atgatacatcttgtttatttca

SEQ ID NO: 8413150 - DNA, 22 bp, Homo sapiens
agacctgcagggccaggcctgc

SEQ ID NO: 8413151 - DNA, 23 bp, Homo sapiens
agacctgcatctgataggccctg

SEQ ID NO: 8413152 - DNA, 22 bp, Homo sapiens
agacctggagtgaagagttccc

SEQ ID NO: 8413153 - DNA, 22 bp, Homo sapiens
agagggctttgattctcagttc

SEQ ID NO: 8413154 - DNA, 18 bp, Homo sapiens
agagtccagggtgaggtg

SEQ ID NO: 8413155 - DNA, 22 bp, Homo sapiens
agagtcagcttatgacacagtc

SEQ ID NO: 8413156 - DNA, 22 bp, Homo sapiens
agagtccaaatgtgcagttatg

SEQ ID NO: 8413157 - DNA, 22 bp, Homo sapiens
attacagtaacagctacaatgc

SEQ ID NO: 8413158 - DNA, 22 bp, Homo sapiens
attacagaagatatgctcaaca

SEQ ID NO: 8413159 - DNA, 22 bp, Homo sapiens
attacagattataaatttgagc

SEQ ID NO: 8413160 - DNA, 22 bp, Homo sapiens
attacagaaagcaatattgagt

SEQ ID NO: 8413161 - DNA, 22 bp, Homo sapiens
agaggaggctgggtccagataa

SEQ ID NO: 8413162 - DNA, 22 bp, Homo sapiens
agaggcaagattatcagggcat

SEQ ID NO: 8413163 - DNA, 22 bp, Homo sapiens
agagctggctgtgggtgacttt

SEQ ID NO: 8413164 - DNA, 22 bp, Homo sapiens
agaggcaagggacctttctggg

SEQ ID NO: 8413165 - DNA, 22 bp, Homo sapiens
agaggcaaggcaggattcttct

SEQ ID NO: 8413166 - DNA, 19 bp, Homo sapiens
agaggcaagggtggaagta

SEQ ID NO: 8413167 - DNA, 22 bp, Homo sapiens
agatattaggaggattcataat

SEQ ID NO: 8413168 - DNA, 22 bp, Homo sapiens
agatattaatcgtacataaggt

SEQ ID NO: 8413169 - DNA, 22 bp, Homo sapiens
agatcatatgcagtaatgaact

SEQ ID NO: 8413170 - DNA, 22 bp, Homo sapiens
agatcatatgaaaaatttcaag

SEQ ID NO: 8413171 - DNA, 22 bp, Homo sapiens
agatcatagcacaaaagtgaca

SEQ ID NO: 8413172 - DNA, 22 bp, Homo sapiens
agatcagactttgtgactagga

SEQ ID NO: 8413173 - DNA, 22 bp, Homo sapiens
agatggctctttgaaggggaat

SEQ ID NO: 8413174 - DNA, 22 bp, Homo sapiens
agatggcttagcctggctccca

SEQ ID NO: 8413175 - DNA, 22 bp, Homo sapiens
agatgttatcattcagagtagc

SEQ ID NO: 8413176 - DNA, 18 bp, Homo sapiens
agcaacagaaacatatgg

SEQ ID NO: 8413177 - DNA, 22 bp, Homo sapiens
agcaacagccctgtttcattag

SEQ ID NO: 8413178 - DNA, 22 bp, Homo sapiens
agcaacagccctgaggttcatg

SEQ ID NO: 8413179 - DNA, 22 bp, Homo sapiens
agcaacaggaatattatggcaa

SEQ ID NO: 8413180 - DNA, 22 bp, Homo sapiens
agcaacaggaaatagctgatta

SEQ ID NO: 8413181 - DNA, 22 bp, Homo sapiens
agcaacagaagatagagtgaat

SEQ ID NO: 8413182 - DNA, 22 bp, Homo sapiens
agcaacagcaacgacatttctc

SEQ ID NO: 8413183 - DNA, 22 bp, Homo sapiens
agcaacagcaggtttgcactcc

SEQ ID NO: 8413184 - DNA, 22 bp, Homo sapiens
attttatctgcttactttcagg

SEQ ID NO: 8413185 - DNA, 22 bp, Homo sapiens
attttcaagggagaggcctctg

SEQ ID NO: 8413186 - DNA, 22 bp, Homo sapiens
caaagataatcacagaataccc

SEQ ID NO: 8413187 - DNA, 22 bp, Homo sapiens
caaagattttagaatttgcaat

SEQ ID NO: 8413188 - DNA, 18 bp, Homo sapiens
agcaacaggatcccaggg

SEQ ID NO: 8413189 - DNA, 22 bp, Homo sapiens
agcaacaggaccatggagccca

SEQ ID NO: 8413190 - DNA, 22 bp, Homo sapiens
agcaacaggcataatgtgttga

SEQ ID NO: 8413191 - DNA, 22 bp, Homo sapiens
agcaacagggggatggccactg

SEQ ID NO: 8413192 - DNA, 22 bp, Homo sapiens
agcaacagggtggtcttcagaa

SEQ ID NO: 8413193 - DNA, 23 bp, Homo sapiens
agcaacagtgggtgagtgttgct

SEQ ID NO: 8413194 - DNA, 22 bp, Homo sapiens
agcaacaggtttattatcttat

SEQ ID NO: 8413195 - DNA, 22 bp, Homo sapiens
agcaacatttttcaattaacat

SEQ ID NO: 8413196 - DNA, 22 bp, Homo sapiens
agcaacattgagactgcagttg

SEQ ID NO: 8413197 - DNA, 22 bp, Homo sapiens
agcaacagtgtatatcataggc

SEQ ID NO: 8413198 - DNA, 22 bp, Homo sapiens
agcaactagccaggatgcagag

SEQ ID NO: 8413199 - DNA, 21 bp, Homo sapiens
agcaactctgactagatgagg

SEQ ID NO: 8413200 - DNA, 22 bp, Homo sapiens
aggcaaatctgagacatttaaa

SEQ ID NO: 8413201 - DNA, 22 bp, Homo sapiens
aggagggacaccaatatatgtt

SEQ ID NO: 8413202 - DNA, 22 bp, Homo sapiens
aggagggaataagaaagagtca

SEQ ID NO: 8413203 - DNA, 17 bp, Homo sapiens
aggagggaaatagcttg

SEQ ID NO: 8413204 - DNA, 22 bp, Homo sapiens
aggagggagatgcccatcctgg

SEQ ID NO: 8413205 - DNA, 22 bp, Homo sapiens
aggagggacctaggaatattgc

SEQ ID NO: 8413206 - DNA, 20 bp, Homo sapiens
aggagggacctggattggcg

SEQ ID NO: 8413207 - DNA, 22 bp, Homo sapiens
aggcaacataacacgaaagtct

SEQ ID NO: 8413208 - DNA, 22 bp, Homo sapiens
aggcaacatgactcacttgcac

SEQ ID NO: 8413209 - DNA, 22 bp, Homo sapiens
aggcaacaagggtagtcagtga

SEQ ID NO: 8413210 - DNA, 22 bp, Homo sapiens
aggcacaagaaactgctcccca

SEQ ID NO: 8413211 - DNA, 22 bp, Homo sapiens
acataacaatcataggacatag

SEQ ID NO: 8413212 - DNA, 22 bp, Homo sapiens
aggagacataactatgatgaga

SEQ ID NO: 8413213 - DNA, 22 bp, Homo sapiens
aggagacatctaactgtaggtt

SEQ ID NO: 8413214 - DNA, 22 bp, Homo sapiens
agctcccagaaggccctgcgcc

SEQ ID NO: 8413215 - DNA, 22 bp, Homo sapiens
agctcccaattgacttgaacta

SEQ ID NO: 8413216 - DNA, 22 bp, Homo sapiens
agctcccagaagccagagtcgg

SEQ ID NO: 8413217 - DNA, 22 bp, Homo sapiens
aggaaactgtcccctcatccta

SEQ ID NO: 8413218 - DNA, 22 bp, Homo sapiens
aggaaactgaagcccagagagg

SEQ ID NO: 8413219 - DNA, 22 bp, Homo sapiens
agcttttacataatgatcttga

SEQ ID NO: 8413220 - DNA, 23 bp, Homo sapiens
agcttcattgacctccgcagggg

SEQ ID NO: 8413221 - DNA, 22 bp, Homo sapiens
agctttatggtgcctcacttga

SEQ ID NO: 8413222 - DNA, 23 bp, Homo sapiens
agctttgtgaaagcagacatggg

SEQ ID NO: 8413223 - DNA, 22 bp, Homo sapiens
agctttgtggctttgcaagact

SEQ ID NO: 8413224 - DNA, 22 bp, Homo sapiens
agctgtgtaagtcatgtaggtg

SEQ ID NO: 8413225 - DNA, 22 bp, Homo sapiens
agctgtggttctgggcagcgac

SEQ ID NO: 8413226 - DNA, 22 bp, Homo sapiens
agctgtggggcaggcagcgagg

SEQ ID NO: 8413227 - DNA, 22 bp, Homo sapiens
agctgtgggcctgggagagctg

SEQ ID NO: 8413228 - DNA, 22 bp, Homo sapiens
agctgtggggaggaggctagca

SEQ ID NO: 8413229 - DNA, 18 bp, Homo sapiens
agcttagcatacttttcc

SEQ ID NO: 8413230 - DNA, 22 bp, Homo sapiens
agctgtgggagaatctctgggt

SEQ ID NO: 8413231 - DNA, 22 bp, Homo sapiens
agctgtgggatttgggtgtgcc

SEQ ID NO: 8413232 - DNA, 21 bp, Homo sapiens
agctgtggcgaggggaacatg

SEQ ID NO: 8413233 - DNA, 22 bp, Homo sapiens
agctgggaggctcctctgtgac

SEQ ID NO: 8413234 - DNA, 22 bp, Homo sapiens
aggcttcccagctgagctcagc

SEQ ID NO: 8413235 - DNA, 22 bp, Homo sapiens
aggctgtgcaattagggtaaga

SEQ ID NO: 8413236 - DNA, 22 bp, Homo sapiens
acattctttcaccttgtgtcca

SEQ ID NO: 8413237 - DNA, 22 bp, Homo sapiens
acattctttcgatgtctgattt

SEQ ID NO: 8413238 - DNA, 23 bp, Homo sapiens
acattcttgattcaggccttagc

SEQ ID NO: 8413239 - DNA, 22 bp, Homo sapiens
acattcttggactccactctag

SEQ ID NO: 8413240 - DNA, 22 bp, Homo sapiens
acattctttgagttttgttaaa

SEQ ID NO: 8413241 - DNA, 22 bp, Homo sapiens
acattctttctcttcaggaaac

SEQ ID NO: 8413242 - DNA, 19 bp, Homo sapiens
acattcccatcagcaatgt

SEQ ID NO: 8413243 - DNA, 22 bp, Homo sapiens
acattcccaccaacagtgtaaa

SEQ ID NO: 8413244 - DNA, 22 bp, Homo sapiens
acattcccttggcttgaagcag

SEQ ID NO: 8413245 - DNA, 22 bp, Homo sapiens
acattctacagttaaccattag

SEQ ID NO: 8413246 - DNA, 22 bp, Homo sapiens
acattctaacattgtacagata

SEQ ID NO: 8413247 - DNA, 22 bp, Homo sapiens
acattcaagtttctgctcatgg

SEQ ID NO: 8413248 - DNA, 22 bp, Homo sapiens
acattcaaggcagcactgagtg

SEQ ID NO: 8413249 - DNA, 22 bp, Homo sapiens
acattcaaggccttctgacaca

SEQ ID NO: 8413250 - DNA, 22 bp, Homo sapiens
acattcaagatgcattcactta

SEQ ID NO: 8413251 - DNA, 22 bp, Homo sapiens
agggcctctgacgcccccagcc

SEQ ID NO: 8413252 - DNA, 22 bp, Homo sapiens
acccatgagtgtatctttaaaa

SEQ ID NO: 8413253 - DNA, 20 bp, Homo sapiens
accccagcccctctatctga

SEQ ID NO: 8413254 - DNA, 22 bp, Homo sapiens
accccagctctgagccacacca

SEQ ID NO: 8413255 - DNA, 22 bp, Homo sapiens
accaaggaagaatctatttgag

SEQ ID NO: 8413256 - DNA, 22 bp, Homo sapiens
accaaggagacaaaggtgtatt

SEQ ID NO: 8413257 - DNA, 22 bp, Homo sapiens
accaaggagaaggtgcaagctt

SEQ ID NO: 8413258 - DNA, 22 bp, Homo sapiens
accaaggaagagattctcagtt

SEQ ID NO: 8413259 - DNA, 22 bp, Homo sapiens
accaaggagtttggtattttag

SEQ ID NO: 8413260 - DNA, 22 bp, Homo sapiens
accaaggagccacatacaacct

SEQ ID NO: 8413261 - DNA, 22 bp, Homo sapiens
agggcctctaccatccaaggtt

SEQ ID NO: 8413262 - DNA, 22 bp, Homo sapiens
agtactgtcagcagggtgttga

SEQ ID NO: 8413263 - DNA, 22 bp, Homo sapiens
agtcaccctccaactctccact

SEQ ID NO: 8413264 - DNA, 22 bp, Homo sapiens
actacattcatgctcgtgttgg

SEQ ID NO: 8413265 - DNA, 22 bp, Homo sapiens
actacattatgaggaaagagtg

SEQ ID NO: 8413266 - DNA, 22 bp, Homo sapiens
actacatttgcagagaagcaat

SEQ ID NO: 8413267 - DNA, 22 bp, Homo sapiens
actacatttctcagtacctgaa

SEQ ID NO: 8413268 - DNA, 22 bp, Homo sapiens
actacatttcctgacccctgtg

SEQ ID NO: 8413269 - DNA, 22 bp, Homo sapiens
aggtatttcaaagcccacttcc

SEQ ID NO: 8413270 - DNA, 22 bp, Homo sapiens
actctgaatgtgcatgtaaatc

SEQ ID NO: 8413271 - DNA, 22 bp, Homo sapiens
actgcattgaggtttcatactt

SEQ ID NO: 8413272 - DNA, 22 bp, Homo sapiens
agtgctcctatggatcagttgt

SEQ ID NO: 8413273 - DNA, 22 bp, Homo sapiens
actgcacttcaccctgggtgac

SEQ ID NO: 8413274 - DNA, 22 bp, Homo sapiens
actgcactcctgcctgggtaac

SEQ ID NO: 8413275 - DNA, 22 bp, Homo sapiens
actgcactgatttatcatccca

SEQ ID NO: 8413276 - DNA, 22 bp, Homo sapiens
actgcactccagcctgggtgat

SEQ ID NO: 8413277 - DNA, 22 bp, Homo sapiens
agtgaatatttttagacaccca

SEQ ID NO: 8413278 - DNA, 20 bp, Homo sapiens
agtgaatagagacattgccc

SEQ ID NO: 8413279 - DNA, 22 bp, Homo sapiens
actgcatttgtctgtctcaatt

SEQ ID NO: 8413280 - DNA, 22 bp, Homo sapiens
actgccaatggtagtttgatgg

SEQ ID NO: 8413281 - DNA, 22 bp, Homo sapiens
atagatatttgagttgtttcca

SEQ ID NO: 8413282 - DNA, 22 bp, Homo sapiens
actttgcagggcttgatatcca

SEQ ID NO: 8413283 - DNA, 21 bp, Homo sapiens
actttacaatttacatagtga

SEQ ID NO: 8413284 - DNA, 23 bp, Homo sapiens
atacaaaccttgcaggacatgtt

SEQ ID NO: 8413285 - DNA, 22 bp, Homo sapiens
actgttttcttagctccctgct

SEQ ID NO: 8413286 - DNA, 22 bp, Homo sapiens
actgttttctgtaaagggccag

SEQ ID NO: 8413287 - DNA, 22 bp, Homo sapiens
acttaaaaacagatccagcagg

SEQ ID NO: 8413288 - DNA, 22 bp, Homo sapiens
acttaaaaagaatcttttcacg

SEQ ID NO: 8413289 - DNA, 22 bp, Homo sapiens
acttaaaaccagacagcgtcat

SEQ ID NO: 8413290 - DNA, 20 bp, Homo sapiens
atcaaaatcctattgaggtt

SEQ ID NO: 8413291 - DNA, 22 bp, Homo sapiens
atcaaaatgctccagtgatggt

SEQ ID NO: 8413292 - DNA, 21 bp, Homo sapiens
agaaaaacacgatataagccc

SEQ ID NO: 8413293 - DNA, 22 bp, Homo sapiens
agaacatctgaagatacaaagt

SEQ ID NO: 8413294 - DNA, 22 bp, Homo sapiens
agaagccaatccttgtctctct

SEQ ID NO: 8413295 - DNA, 22 bp, Homo sapiens
atctctggttgttttgctccca

SEQ ID NO: 8413296 - DNA, 22 bp, Homo sapiens
atctctggccttccttttccaa

SEQ ID NO: 8413297 - DNA, 20 bp, Homo sapiens
agaaggcaggagacaaaagg

SEQ ID NO: 8413298 - DNA, 22 bp, Homo sapiens
ataaagatttctttttctctac

SEQ ID NO: 8413299 - DNA, 22 bp, Homo sapiens
ataaagacatgcttacttgccc

SEQ ID NO: 8413300 - DNA, 22 bp, Homo sapiens
ataaagcctttctgttttcagg

SEQ ID NO: 8413301 - DNA, 22 bp, Homo sapiens
ataaagcatctagtctgtcact

SEQ ID NO: 8413302 - DNA, 22 bp, Homo sapiens
ataaagcaaataggactattgc

SEQ ID NO: 8413303 - DNA, 22 bp, Homo sapiens
ctgcagggaccacaagcaggtt

SEQ ID NO: 8413304 - DNA, 22 bp, Homo sapiens
ctgcagggaccacaagcaggtt

SEQ ID NO: 8413305 - DNA, 22 bp, Homo sapiens
ctgcagggagaggggacagcct

SEQ ID NO: 8413306 - DNA, 22 bp, Homo sapiens
ctgcagggaactgaggcccaga

SEQ ID NO: 8413307 - DNA, 22 bp, Homo sapiens
agttttgtaattctcaaaaata

SEQ ID NO: 8413308 - DNA, 22 bp, Homo sapiens
ataaaaggaaagcctgttgtga

SEQ ID NO: 8413309 - DNA, 22 bp, Homo sapiens
ctgcctgtattgtctgcttggg

SEQ ID NO: 8413310 - DNA, 22 bp, Homo sapiens
ctgctaaacctctctgagagct

SEQ ID NO: 8413311 - DNA, 22 bp, Homo sapiens
ctgctaaacctctctgagagct

SEQ ID NO: 8413312 - DNA, 22 bp, Homo sapiens
ctgctaaacctctctgagagct

SEQ ID NO: 8413313 - DNA, 22 bp, Homo sapiens
ctgctgggctcctcatgtgact

SEQ ID NO: 8413314 - DNA, 22 bp, Homo sapiens
ctgctggggaggcgcctcgacg

SEQ ID NO: 8413315 - DNA, 22 bp, Homo sapiens
ctgctgggcctggtctctgagg

SEQ ID NO: 8413316 - DNA, 21 bp, Homo sapiens
atacacatacacataaatgtg

SEQ ID NO: 8413317 - DNA, 22 bp, Homo sapiens
atacacatatcaggtgtataca

SEQ ID NO: 8413318 - DNA, 22 bp, Homo sapiens
atacacatatatacacgtttaa

SEQ ID NO: 8413319 - DNA, 19 bp, Homo sapiens
atacacatacgtaaactga

SEQ ID NO: 8413320 - DNA, 22 bp, Homo sapiens
atacacatgcacacatgtgtgt

SEQ ID NO: 8413321 - DNA, 20 bp, Homo sapiens
atacacatgcagacagatgc

SEQ ID NO: 8413322 - DNA, 22 bp, Homo sapiens
atacacatctatttaagagaca

SEQ ID NO: 8413323 - DNA, 15 bp, Homo sapiens
atacacatgagggag

SEQ ID NO: 8413324 - DNA, 20 bp, Homo sapiens
atacacatattcttgcaact

SEQ ID NO: 8413325 - DNA, 22 bp, Homo sapiens
atacacatatgtgtgtatatgt

SEQ ID NO: 8413326 - DNA, 22 bp, Homo sapiens
ctggccctatgagcctcctgat

SEQ ID NO: 8413327 - DNA, 22 bp, Homo sapiens
ctggcctcacagaggctaagcc

SEQ ID NO: 8413328 - DNA, 22 bp, Homo sapiens
ctggcctcatagccaagctgtg

SEQ ID NO: 8413329 - DNA, 22 bp, Homo sapiens
ctggcctcagagggtcatggtg

SEQ ID NO: 8413330 - DNA, 20 bp, Homo sapiens
atacacattcatagaaaaat

SEQ ID NO: 8413331 - DNA, 22 bp, Homo sapiens
atacacatgtgtatgtgcatgc

SEQ ID NO: 8413332 - DNA, 22 bp, Homo sapiens
atacacatgttattgtggaagc

SEQ ID NO: 8413333 - DNA, 22 bp, Homo sapiens
atacacattactttctgtctga

SEQ ID NO: 8413334 - DNA, 22 bp, Homo sapiens
ctggccttgttcctccccaagt

SEQ ID NO: 8413335 - DNA, 22 bp, Homo sapiens
ctggccttcagactcggactga

SEQ ID NO: 8413336 - DNA, 22 bp, Homo sapiens
ctggcctttcgtgagagctggg

SEQ ID NO: 8413337 - DNA, 22 bp, Homo sapiens
ctggcctttagccccagtgtct

SEQ ID NO: 8413338 - DNA, 22 bp, Homo sapiens
atataaagaagtggaaaatgag

SEQ ID NO: 8413339 - DNA, 22 bp, Homo sapiens
atatacagggagaaacagctta

SEQ ID NO: 8413340 - DNA, 22 bp, Homo sapiens
atatacaggtggtatgtgtaaa

SEQ ID NO: 8413341 - DNA, 22 bp, Homo sapiens
atataatagtttcataaaggct

SEQ ID NO: 8413342 - DNA, 22 bp, Homo sapiens
ctggctgatctcaatcatggct

SEQ ID NO: 8413343 - DNA, 22 bp, Homo sapiens
atcataattgctccagtgatat

SEQ ID NO: 8413344 - DNA, 22 bp, Homo sapiens
ctgtaatcccagctacctggga

SEQ ID NO: 8413345 - DNA, 22 bp, Homo sapiens
ctgtaatcccagctacctggga

SEQ ID NO: 8413346 - DNA, 22 bp, Homo sapiens
ctgtaatcccagctactcggga

SEQ ID NO: 8413347 - DNA, 22 bp, Homo sapiens
ctgtaatcccagctactcggga

SEQ ID NO: 8413348 - DNA, 22 bp, Homo sapiens
ctgtaaatatgaagaatatatg

SEQ ID NO: 8413349 - DNA, 22 bp, Homo sapiens
atcacaatccctctctctgata

SEQ ID NO: 8413350 - DNA, 22 bp, Homo sapiens
atcacaatgtacgttaaaatgt

SEQ ID NO: 8413351 - DNA, 22 bp, Homo sapiens
atattattctagtaacagtgat

SEQ ID NO: 8413352 - DNA, 22 bp, Homo sapiens
atattattctagtaacagtgat

SEQ ID NO: 8413353 - DNA, 18 bp, Homo sapiens
atattcaagaagacagag

SEQ ID NO: 8413354 - DNA, 22 bp, Homo sapiens
cttctgagcagacctcctgggg

SEQ ID NO: 8413355 - DNA, 22 bp, Homo sapiens
cttctgaggcagctattcagtt

SEQ ID NO: 8413356 - DNA, 22 bp, Homo sapiens
atctctaatttaaaaagtaaca

SEQ ID NO: 8413357 - DNA, 22 bp, Homo sapiens
atcttatttaacacagcaaaac

SEQ ID NO: 8413358 - DNA, 22 bp, Homo sapiens
atctgtctggaggcctggcatg

SEQ ID NO: 8413359 - DNA, 22 bp, Homo sapiens
cttcttaatcccttatatattt

SEQ ID NO: 8413360 - DNA, 22 bp, Homo sapiens
cttcttaactgtatatactatg

SEQ ID NO: 8413361 - DNA, 22 bp, Homo sapiens
atctgtaaatgcaaatgtagct

SEQ ID NO: 8413362 - DNA, 22 bp, Homo sapiens
atctggttcttcttaggcatca

SEQ ID NO: 8413363 - DNA, 22 bp, Homo sapiens
cttaatctcacctgcaaagtcc

SEQ ID NO: 8413364 - DNA, 22 bp, Homo sapiens
ctgtttctccacactcttccca

SEQ ID NO: 8413365 - DNA, 22 bp, Homo sapiens
ctgtttctccacactcttccca

SEQ ID NO: 8413366 - DNA, 22 bp, Homo sapiens
cttaacatcctgcatttttctt

SEQ ID NO: 8413367 - DNA, 22 bp, Homo sapiens
cttaacatggggggtaagtctg

SEQ ID NO: 8413368 - DNA, 21 bp, Homo sapiens
cttaacattttaaatgaaagg

SEQ ID NO: 8413369 - DNA, 22 bp, Homo sapiens
cttcaaatgtgattttaataac

SEQ ID NO: 8413370 - DNA, 22 bp, Homo sapiens
cttcaaattcgaggagtagatg

SEQ ID NO: 8413371 - DNA, 22 bp, Homo sapiens
cttattaatggaatcctaatga

SEQ ID NO: 8413372 - DNA, 19 bp, Homo sapiens
cttattagagtgagagctt

SEQ ID NO: 8413373 - DNA, 22 bp, Homo sapiens
cttattagaaagaaaagacatg

SEQ ID NO: 8413374 - DNA, 22 bp, Homo sapiens
cttattagtgtctgtctgagtt

SEQ ID NO: 8413375 - DNA, 22 bp, Homo sapiens
cttattagagttgtgttctgtt

SEQ ID NO: 8413376 - DNA, 22 bp, Homo sapiens
cttcaagatatttctagaatca

SEQ ID NO: 8413377 - DNA, 22 bp, Homo sapiens
cttcaagaagacagcagagcat

SEQ ID NO: 8413378 - DNA, 22 bp, Homo sapiens
agtcacagttcctacccagtaa

SEQ ID NO: 8413379 - DNA, 22 bp, Homo sapiens
agtcacacttcgtatctctagc

SEQ ID NO: 8413380 - DNA, 22 bp, Homo sapiens
ctattgaggacataaggactct

SEQ ID NO: 8413381 - DNA, 22 bp, Homo sapiens
aggtaaaatgagtctccattat

SEQ ID NO: 8413382 - DNA, 22 bp, Homo sapiens
aggtaaaatagatagtatttct

SEQ ID NO: 8413383 - DNA, 22 bp, Homo sapiens
aggtcagccctctctgggcagg

SEQ ID NO: 8413384 - DNA, 22 bp, Homo sapiens
aggtcagctagacagctctctg

SEQ ID NO: 8413385 - DNA, 22 bp, Homo sapiens
aggtcagcaggccaggggcgaa

SEQ ID NO: 8413386 - DNA, 22 bp, Homo sapiens
ccttccaagtgctgctttttcc

SEQ ID NO: 8413387 - DNA, 21 bp, Homo sapiens
cctgtgccagtctatgtgttc

SEQ ID NO: 8413388 - DNA, 22 bp, Homo sapiens
agtgtggctgcgtagggctctc

SEQ ID NO: 8413389 - DNA, 17 bp, Homo sapiens
agtgtttccttatcatt

SEQ ID NO: 8413390 - DNA, 22 bp, Homo sapiens
agtgtttgggggccttgtaaca

SEQ ID NO: 8413391 - DNA, 22 bp, Homo sapiens
agttaaatcatggccattggaa

SEQ ID NO: 8413392 - DNA, 22 bp, Homo sapiens
agttaaatcattactgacagag

SEQ ID NO: 8413393 - DNA, 22 bp, Homo sapiens
agttaaatgtcagtagcttaac

SEQ ID NO: 8413394 - DNA, 22 bp, Homo sapiens
agttaaatgtgttagccagggt

SEQ ID NO: 8413395 - DNA, 22 bp, Homo sapiens
agtgtttgtcccgttagaaatg

SEQ ID NO: 8413396 - DNA, 22 bp, Homo sapiens
agtgtttggggtgattgtaacc

SEQ ID NO: 8413397 - DNA, 22 bp, Homo sapiens
agttatttcagtaacataatag

SEQ ID NO: 8413398 - DNA, 22 bp, Homo sapiens
agttccaccatttaggatctgt

SEQ ID NO: 8413399 - DNA, 22 bp, Homo sapiens
ctgagccagctggcatgtgcta

SEQ ID NO: 8413400 - DNA, 22 bp, Homo sapiens
agtgggtgtagtcttcctcctg

SEQ ID NO: 8413401 - DNA, 22 bp, Homo sapiens
agtgtgagaacggactaataaa

SEQ ID NO: 8413402 - DNA, 22 bp, Homo sapiens
agtgtctttgtctctcaagcac

SEQ ID NO: 8413403 - DNA, 22 bp, Homo sapiens
agtgtcctcaggctttgttcct

SEQ ID NO: 8413404 - DNA, 22 bp, Homo sapiens
agtggaggcactaattggattt

SEQ ID NO: 8413405 - DNA, 22 bp, Homo sapiens
agtggagaccccacttctacat

SEQ ID NO: 8413406 - DNA, 22 bp, Homo sapiens
agtggcaaaagcaggcttaggc

SEQ ID NO: 8413407 - DNA, 22 bp, Homo sapiens
agtggcaaagtcttcagaagtt

SEQ ID NO: 8413408 - DNA, 22 bp, Homo sapiens
agtgctaatgtgcaatatagag

SEQ ID NO: 8413409 - DNA, 22 bp, Homo sapiens
agtgcagggcctgcccagcagg

SEQ ID NO: 8413410 - DNA, 22 bp, Homo sapiens
agtgcatgttcactggcatggt

SEQ ID NO: 8413411 - DNA, 22 bp, Homo sapiens
agtgcagggggaaagggtgtct

SEQ ID NO: 8413412 - DNA, 22 bp, Homo sapiens
agtgaaatagcatttatgaagc

SEQ ID NO: 8413413 - DNA, 22 bp, Homo sapiens
agtgaaatcaggttttgactgc

SEQ ID NO: 8413414 - DNA, 18 bp, Homo sapiens
agtgagttgttgaaagaa

SEQ ID NO: 8413415 - DNA, 22 bp, Homo sapiens
agtgagttgaacattgataatg

SEQ ID NO: 8413416 - DNA, 22 bp, Homo sapiens
agtgatattagcaaatggttat

SEQ ID NO: 8413417 - DNA, 22 bp, Homo sapiens
agtgaggtaattagagctgctg

SEQ ID NO: 8413418 - DNA, 23 bp, Homo sapiens
ctcaccaagcgccgccgctgtgt

SEQ ID NO: 8413419 - DNA, 22 bp, Homo sapiens
agtctcaagcaccgaaagctgt

SEQ ID NO: 8413420 - DNA, 23 bp, Homo sapiens
agtctcaagctggagaattacct

SEQ ID NO: 8413421 - DNA, 22 bp, Homo sapiens
agtctcaagtgttagtattatt

SEQ ID NO: 8413422 - DNA, 19 bp, Homo sapiens
agtctcacccaagcagtct

SEQ ID NO: 8413423 - DNA, 22 bp, Homo sapiens
agtctcacttcttgagctatgc

SEQ ID NO: 8413424 - DNA, 22 bp, Homo sapiens
aggaatgtcgtcataaacatga

SEQ ID NO: 8413425 - DNA, 22 bp, Homo sapiens
aggaatgtctgagaaagaggca

SEQ ID NO: 8413426 - DNA, 22 bp, Homo sapiens
aggaatgtgaaacaggtggctg

SEQ ID NO: 8413427 - DNA, 22 bp, Homo sapiens
aggaatgtgaccactagactct

SEQ ID NO: 8413428 - DNA, 23 bp, Homo sapiens
aggaatgtgcccacccatctcct

SEQ ID NO: 8413429 - DNA, 22 bp, Homo sapiens
aggaatgtgaggcaagttgtga

SEQ ID NO: 8413430 - DNA, 22 bp, Homo sapiens
aggaatgtgactattttttcag

SEQ ID NO: 8413431 - DNA, 22 bp, Homo sapiens
aggaatgtggaaggtggcggcg

SEQ ID NO: 8413432 - DNA, 22 bp, Homo sapiens
aggaatgtgcctagcctccctg

SEQ ID NO: 8413433 - DNA, 16 bp, Homo sapiens
aggaatgtggcggaac

SEQ ID NO: 8413434 - DNA, 22 bp, Homo sapiens
aggaatgtggcctagggaggag

SEQ ID NO: 8413435 - DNA, 22 bp, Homo sapiens
aggaatgtggcaatcttcaagt

SEQ ID NO: 8413436 - DNA, 22 bp, Homo sapiens
aggaatgtttagaatgtcagaa

SEQ ID NO: 8413437 - DNA, 22 bp, Homo sapiens
aggaatgttaggagatgagtct

SEQ ID NO: 8413438 - DNA, 22 bp, Homo sapiens
aggaatgttagttctgtataca

SEQ ID NO: 8413439 - DNA, 22 bp, Homo sapiens
aggaatgtttacacgacagaaa

SEQ ID NO: 8413440 - DNA, 22 bp, Homo sapiens
aggaatgttaagaaggtctacc

SEQ ID NO: 8413441 - DNA, 22 bp, Homo sapiens
aggaatgtgtttctaggctgtt

SEQ ID NO: 8413442 - DNA, 22 bp, Homo sapiens
aggaatgttaaagattaagagc

SEQ ID NO: 8413443 - DNA, 21 bp, Homo sapiens
aggaatgtgtatatatacaat

SEQ ID NO: 8413444 - DNA, 22 bp, Homo sapiens
aggaatgtgtgtccaccgggga

SEQ ID NO: 8413445 - DNA, 21 bp, Homo sapiens
aggaagatctggaggtcggcg

SEQ ID NO: 8413446 - DNA, 22 bp, Homo sapiens
cagggttgcatgcatctgtggg

SEQ ID NO: 8413447 - DNA, 22 bp, Homo sapiens
aggaaaagtgtgaagtatggag

SEQ ID NO: 8413448 - DNA, 22 bp, Homo sapiens
cagggaccctactagctcacac

SEQ ID NO: 8413449 - DNA, 22 bp, Homo sapiens
cagggacccgcacaggtagcat

SEQ ID NO: 8413450 - DNA, 21 bp, Homo sapiens
caggcttgaggaatgtgcctg

SEQ ID NO: 8413451 - DNA, 22 bp, Homo sapiens
caggcttgagggcaggcccagt

SEQ ID NO: 8413452 - DNA, 22 bp, Homo sapiens
caggcttgaagcttcagagtat

SEQ ID NO: 8413453 - DNA, 22 bp, Homo sapiens
caggcttgattattcagacaat

SEQ ID NO: 8413454 - DNA, 22 bp, Homo sapiens
caggcttgctagaggagccaaa

SEQ ID NO: 8413455 - DNA, 22 bp, Homo sapiens
caggcttgctgctagagcactt

SEQ ID NO: 8413456 - DNA, 22 bp, Homo sapiens
agctttatttgtcattcacggc

SEQ ID NO: 8413457 - DNA, 22 bp, Homo sapiens
agctttatatttaatgaattct

SEQ ID NO: 8413458 - DNA, 22 bp, Homo sapiens
agctttattaactctccaggtg

SEQ ID NO: 8413459 - DNA, 22 bp, Homo sapiens
agctttattcatgatttcaggg

SEQ ID NO: 8413460 - DNA, 17 bp, Homo sapiens
agctgaaattgctgaag

SEQ ID NO: 8413461 - DNA, 22 bp, Homo sapiens
agctgaaagtgctttgaggact

SEQ ID NO: 8413462 - DNA, 22 bp, Homo sapiens
caggaaatcagaactcaagtgg

SEQ ID NO: 8413463 - DNA, 22 bp, Homo sapiens
caggaaatatctcctggcagag

SEQ ID NO: 8413464 - DNA, 22 bp, Homo sapiens
caggaaatgaacaggaatgaac

SEQ ID NO: 8413465 - DNA, 22 bp, Homo sapiens
caggaaatgctatcatagctga

SEQ ID NO: 8413466 - DNA, 23 bp, Homo sapiens
caggaaatgaatccaggaggatg

SEQ ID NO: 8413467 - DNA, 22 bp, Homo sapiens
agctggagcttcaagcaggtaa

SEQ ID NO: 8413468 - DNA, 22 bp, Homo sapiens
agctggagaataggaattagtg

SEQ ID NO: 8413469 - DNA, 22 bp, Homo sapiens
agctggagatgagtgacgtgcc

SEQ ID NO: 8413470 - DNA, 22 bp, Homo sapiens
agctggagaatgtggatgatcc

SEQ ID NO: 8413471 - DNA, 22 bp, Homo sapiens
agctgggactcaactgtctggg

SEQ ID NO: 8413472 - DNA, 22 bp, Homo sapiens
aggcacagtggccctgtttggg

SEQ ID NO: 8413473 - DNA, 22 bp, Homo sapiens
aggatcaggccctctagggtag

SEQ ID NO: 8413474 - DNA, 22 bp, Homo sapiens
aggatctgtgcctcaacccaga

SEQ ID NO: 8413475 - DNA, 22 bp, Homo sapiens
aggatcctttttctgctgtttg

SEQ ID NO: 8413476 - DNA, 22 bp, Homo sapiens
aggagtttggggattagtcagg

SEQ ID NO: 8413477 - DNA, 22 bp, Homo sapiens
aggagttatggcagaatcaaat

SEQ ID NO: 8413478 - DNA, 23 bp, Homo sapiens
catgtgtgacagtatcactgttt

SEQ ID NO: 8413479 - DNA, 22 bp, Homo sapiens
catgtgtgaatcttgtgatcat

SEQ ID NO: 8413480 - DNA, 22 bp, Homo sapiens
ccaaaataacagcccaattcac

SEQ ID NO: 8413481 - DNA, 20 bp, Homo sapiens
aggcagctggccaggcaggt

SEQ ID NO: 8413482 - DNA, 22 bp, Homo sapiens
ccaaaatattagtgcttaagta

SEQ ID NO: 8413483 - DNA, 22 bp, Homo sapiens
catcactgtcctcagcattcca

SEQ ID NO: 8413484 - DNA, 22 bp, Homo sapiens
cagttcaaagttaagcagcagt

SEQ ID NO: 8413485 - DNA, 22 bp, Homo sapiens
cagttcaaaattttgaagaagg

SEQ ID NO: 8413486 - DNA, 22 bp, Homo sapiens
cagttctaattaataggagtaa

SEQ ID NO: 8413487 - DNA, 22 bp, Homo sapiens
cagttctatcattttagagatg

SEQ ID NO: 8413488 - DNA, 22 bp, Homo sapiens
cagtgcagctgccccgctggta

SEQ ID NO: 8413489 - DNA, 22 bp, Homo sapiens
cagtgcaggaagtgagatgcct

SEQ ID NO: 8413490 - DNA, 22 bp, Homo sapiens
cagtgcaggctgggggccctgc

SEQ ID NO: 8413491 - DNA, 21 bp, Homo sapiens
cagtgcaggggttagcgtgta

SEQ ID NO: 8413492 - DNA, 22 bp, Homo sapiens
cagtgcaggcttgtggccgcag

SEQ ID NO: 8413493 - DNA, 23 bp, Homo sapiens
cagtgcagggcaactcagactcc

SEQ ID NO: 8413494 - DNA, 22 bp, Homo sapiens
cagtgagggcattcagtgctgg

SEQ ID NO: 8413495 - DNA, 22 bp, Homo sapiens
cagtgcagccaaggacaggcac

SEQ ID NO: 8413496 - DNA, 22 bp, Homo sapiens
cagtgagggcccccttccaggt

SEQ ID NO: 8413497 - DNA, 17 bp, Homo sapiens
cagtgcagataagtgag

SEQ ID NO: 8413498 - DNA, 17 bp, Homo sapiens
cagtgaggcctttcctc

SEQ ID NO: 8413499 - DNA, 21 bp, Homo sapiens
cagtgaggccctcctgttccc

SEQ ID NO: 8413500 - DNA, 22 bp, Homo sapiens
cagtgagggaagatctcagcac

SEQ ID NO: 8413501 - DNA, 22 bp, Homo sapiens
cagtgaggctctgctgagcggt

SEQ ID NO: 8413502 - DNA, 22 bp, Homo sapiens
aggacaaaggaccagatctgga

SEQ ID NO: 8413503 - DNA, 22 bp, Homo sapiens
cagtgaggagtccagggcagag

SEQ ID NO: 8413504 - DNA, 22 bp, Homo sapiens
aggctagaggcttctggcttca

SEQ ID NO: 8413505 - DNA, 22 bp, Homo sapiens
aggctgcttcttgtccttggca

SEQ ID NO: 8413506 - DNA, 22 bp, Homo sapiens
ccagcaggagatgcctgtgtct

SEQ ID NO: 8413507 - DNA, 22 bp, Homo sapiens
ccagctcttttggctgagtgag

SEQ ID NO: 8413508 - DNA, 22 bp, Homo sapiens
ccagctctggcttcttgctggg

SEQ ID NO: 8413509 - DNA, 22 bp, Homo sapiens
ccagaccctgctctggggctct

SEQ ID NO: 8413510 - DNA, 22 bp, Homo sapiens
agggctgcttacctggaatggc

SEQ ID NO: 8413511 - DNA, 22 bp, Homo sapiens
agggctactgcctgccttcagg

SEQ ID NO: 8413512 - DNA, 22 bp, Homo sapiens
agggctgcatctgcctggtgaa

SEQ ID NO: 8413513 - DNA, 22 bp, Homo sapiens
cctcaggatccgcaggtgcagt

SEQ ID NO: 8413514 - DNA, 22 bp, Homo sapiens
agggcgacaatggagagcgttt

SEQ ID NO: 8413515 - DNA, 22 bp, Homo sapiens
aggggaggtgtccccaaatctc

SEQ ID NO: 8413516 - DNA, 22 bp, Homo sapiens
aggggcagcctcacaatcctct

SEQ ID NO: 8413517 - DNA, 22 bp, Homo sapiens
cccatgccttctgactcacagg

SEQ ID NO: 8413518 - DNA, 20 bp, Homo sapiens
ccctcccagatgcttcccaa

SEQ ID NO: 8413519 - DNA, 22 bp, Homo sapiens
cccaggagcttctctctgcctc

SEQ ID NO: 8413520 - DNA, 22 bp, Homo sapiens
aggctgtgacagggtcatggag

SEQ ID NO: 8413521 - DNA, 22 bp, Homo sapiens
aggctgtgaaatgtggcaagga

SEQ ID NO: 8413522 - DNA, 22 bp, Homo sapiens
aggctggtgcttcctagggcag

SEQ ID NO: 8413523 - DNA, 22 bp, Homo sapiens
cccagtattgagctacaggcct

SEQ ID NO: 8413524 - DNA, 22 bp, Homo sapiens
cccatcaggaacccaggagccc

SEQ ID NO: 8413525 - DNA, 22 bp, Homo sapiens
cccagtttcaactttccagtgg

SEQ ID NO: 8413526 - DNA, 22 bp, Homo sapiens
gctgaggaaaggctggaaggga

SEQ ID NO: 8413527 - DNA, 22 bp, Homo sapiens
gctgaggacatcatggaaggaa

SEQ ID NO: 8413528 - DNA, 22 bp, Homo sapiens
caaattcaaatttcatcagtgt

SEQ ID NO: 8413529 - DNA, 22 bp, Homo sapiens
caaatgaatatttccatgggtt

SEQ ID NO: 8413530 - DNA, 22 bp, Homo sapiens
caaatgaatagggagtgtgatg

SEQ ID NO: 8413531 - DNA, 22 bp, Homo sapiens
caaatgaagtccaaagggctta

SEQ ID NO: 8413532 - DNA, 22 bp, Homo sapiens
caaatgaaggtggtgggtcatt

SEQ ID NO: 8413533 - DNA, 22 bp, Homo sapiens
caaatgaagggagctgaagtct

SEQ ID NO: 8413534 - DNA, 22 bp, Homo sapiens
gctctgagacagtagagatggc

SEQ ID NO: 8413535 - DNA, 20 bp, Homo sapiens
caaatccctgctctgtgctg

SEQ ID NO: 8413536 - DNA, 22 bp, Homo sapiens
caaatctttaattgaggaatca

SEQ ID NO: 8413537 - DNA, 22 bp, Homo sapiens
gctattcatcaattgttctagc

SEQ ID NO: 8413538 - DNA, 22 bp, Homo sapiens
gctattcatggagcatgtactg

SEQ ID NO: 8413539 - DNA, 22 bp, Homo sapiens
gctaatgatagcaagataaaca

SEQ ID NO: 8413540 - DNA, 22 bp, Homo sapiens
gctaatactttggaaagaatgt

SEQ ID NO: 8413541 - DNA, 22 bp, Homo sapiens
gctctaggaggtgtgcttagaa

SEQ ID NO: 8413542 - DNA, 22 bp, Homo sapiens
gctctagtaggaatgtccctct

SEQ ID NO: 8413543 - DNA, 22 bp, Homo sapiens
atttacatttatttgagaaggt

SEQ ID NO: 8413544 - DNA, 22 bp, Homo sapiens
atttacagacgtggattagtgc

SEQ ID NO: 8413545 - DNA, 22 bp, Homo sapiens
atttacataatagactttaggt

SEQ ID NO: 8413546 - DNA, 22 bp, Homo sapiens
atttacattccatggtggttac

SEQ ID NO: 8413547 - DNA, 17 bp, Homo sapiens
atttacattgtcaccga

SEQ ID NO: 8413548 - DNA, 23 bp, Homo sapiens
attttacaggtcagttccttgaa

SEQ ID NO: 8413549 - DNA, 22 bp, Homo sapiens
attttacataaggaaggtttaa

SEQ ID NO: 8413550 - DNA, 22 bp, Homo sapiens
attttactaagtggatatctgt

SEQ ID NO: 8413551 - DNA, 22 bp, Homo sapiens
attttaaccctcttatatatac

SEQ ID NO: 8413552 - DNA, 23 bp, Homo sapiens
attttacaggtcagttccttgaa

SEQ ID NO: 8413553 - DNA, 21 bp, Homo sapiens
gccactgcactccagcctggg

SEQ ID NO: 8413554 - DNA, 22 bp, Homo sapiens
gccactgcactccagcccaggc

SEQ ID NO: 8413555 - DNA, 22 bp, Homo sapiens
atttaaattttctgatggagag

SEQ ID NO: 8413556 - DNA, 22 bp, Homo sapiens
atttaaatgcttaagagggttt

SEQ ID NO: 8413557 - DNA, 22 bp, Homo sapiens
gccactgtcatcttgtgaagca

SEQ ID NO: 8413558 - DNA, 18 bp, Homo sapiens
gcagtgcaggaagaagag

SEQ ID NO: 8413559 - DNA, 22 bp, Homo sapiens
attgttgggtagtttgttcagc

SEQ ID NO: 8413560 - DNA, 22 bp, Homo sapiens
gcattattaatagctgcatgag

SEQ ID NO: 8413561 - DNA, 22 bp, Homo sapiens
attgttatgaaaataagatgtt

SEQ ID NO: 8413562 - DNA, 22 bp, Homo sapiens
gcaggctgtggtatgttgggca

SEQ ID NO: 8413563 - DNA, 22 bp, Homo sapiens
gcagggctgggatttgagccca

SEQ ID NO: 8413564 - DNA, 22 bp, Homo sapiens
gcaggagagtctgtgccaggtt

SEQ ID NO: 8413565 - DNA, 22 bp, Homo sapiens
gcagctttaaacattggaaata

SEQ ID NO: 8413566 - DNA, 22 bp, Homo sapiens
gcagctttaaaggaggctctga

SEQ ID NO: 8413567 - DNA, 22 bp, Homo sapiens
gcagctttaatctgaataagta

SEQ ID NO: 8413568 - DNA, 22 bp, Homo sapiens
gcagctttctaagctttattgc

SEQ ID NO: 8413569 - DNA, 22 bp, Homo sapiens
gcagctttagaaacaagggctg

SEQ ID NO: 8413570 - DNA, 22 bp, Homo sapiens
gcaaatgctctccttggtcagg

SEQ ID NO: 8413571 - DNA, 21 bp, Homo sapiens
gcaaccagaccacagggcagt

SEQ ID NO: 8413572 - DNA, 20 bp, Homo sapiens
gcaactagggagacacagct

SEQ ID NO: 8413573 - DNA, 22 bp, Homo sapiens
gcaacagcattctcattgacat

SEQ ID NO: 8413574 - DNA, 22 bp, Homo sapiens
gcaacagttggattccagagga

SEQ ID NO: 8413575 - DNA, 22 bp, Homo sapiens
gcaacaggcagtttgctcatgt

SEQ ID NO: 8413576 - DNA, 18 bp, Homo sapiens
gcaacagtatcagcaggc

SEQ ID NO: 8413577 - DNA, 20 bp, Homo sapiens
gcaaaataggctctgttggt

SEQ ID NO: 8413578 - DNA, 22 bp, Homo sapiens
gcactggttaccctgagtggct

SEQ ID NO: 8413579 - DNA, 22 bp, Homo sapiens
gcactggtatcacctgagagct

SEQ ID NO: 8413580 - DNA, 22 bp, Homo sapiens
gcacagagctggccctccaggc

SEQ ID NO: 8413581 - DNA, 22 bp, Homo sapiens
gagctttaagggataaaatgat

SEQ ID NO: 8413582 - DNA, 22 bp, Homo sapiens
gagctttaggagaaggaggtca

SEQ ID NO: 8413583 - DNA, 22 bp, Homo sapiens
gagctttagctgagacctgctt

SEQ ID NO: 8413584 - DNA, 22 bp, Homo sapiens
gagctttacttctgactggtgc

SEQ ID NO: 8413585 - DNA, 22 bp, Homo sapiens
gagctttaccttaggttctgtt

SEQ ID NO: 8413586 - DNA, 22 bp, Homo sapiens
gagctttaagggcactggtctt

SEQ ID NO: 8413587 - DNA, 22 bp, Homo sapiens
atgtacaacctgcatgacagtc

SEQ ID NO: 8413588 - DNA, 22 bp, Homo sapiens
atgtacaagctgttttactgca

SEQ ID NO: 8413589 - DNA, 22 bp, Homo sapiens
atgtacaagctgttttactgca

SEQ ID NO: 8413590 - DNA, 22 bp, Homo sapiens
atgtacaaaatgttttgaaatg

SEQ ID NO: 8413591 - DNA, 22 bp, Homo sapiens
atgtaaattgtactgacacacg

SEQ ID NO: 8413592 - DNA, 22 bp, Homo sapiens
atgtaatttgccctcaagttaa

SEQ ID NO: 8413593 - DNA, 22 bp, Homo sapiens
gagaggctgaaatcacaggagc

SEQ ID NO: 8413594 - DNA, 22 bp, Homo sapiens
gagaggtgaatgtggatgccac

SEQ ID NO: 8413595 - DNA, 22 bp, Homo sapiens
gagtgcaggcctgagcaccatc

SEQ ID NO: 8413596 - DNA, 17 bp, Homo sapiens
gagtgcagacacaagca

SEQ ID NO: 8413597 - DNA, 22 bp, Homo sapiens
gagtccagtgatgttcctggtc

SEQ ID NO: 8413598 - DNA, 20 bp, Homo sapiens
gagtccaggggcctgtagca

SEQ ID NO: 8413599 - DNA, 23 bp, Homo sapiens
gagtgcagaatagacatgcagtg

SEQ ID NO: 8413600 - DNA, 22 bp, Homo sapiens
atgtttcaaatatatagagttg

SEQ ID NO: 8413601 - DNA, 22 bp, Homo sapiens
atgtttcagatacagatcaaat

SEQ ID NO: 8413602 - DNA, 22 bp, Homo sapiens
atgtttcagatacagatcaaat

SEQ ID NO: 8413603 - DNA, 22 bp, Homo sapiens
atgtttcatgactgagcaaaat

SEQ ID NO: 8413604 - DNA, 22 bp, Homo sapiens
atgtttcatcagtaaggttttg

SEQ ID NO: 8413605 - DNA, 22 bp, Homo sapiens
atgtttcatgactgagcaaaat

SEQ ID NO: 8413606 - DNA, 22 bp, Homo sapiens
gatctctgtggactcttagcac

SEQ ID NO: 8413607 - DNA, 22 bp, Homo sapiens
gatctctgggtcctgttggcct

SEQ ID NO: 8413608 - DNA, 22 bp, Homo sapiens
gatctctgaatctgaagccttc

SEQ ID NO: 8413609 - DNA, 22 bp, Homo sapiens
gagttaattcgaatattctagc

SEQ ID NO: 8413610 - DNA, 22 bp, Homo sapiens
gagttataacctagtttaactg

SEQ ID NO: 8413611 - DNA, 22 bp, Homo sapiens
gagggcagaaaattatgcggtg

SEQ ID NO: 8413612 - DNA, 22 bp, Homo sapiens
gaggccaactttggagaacagg

SEQ ID NO: 8413613 - DNA, 22 bp, Homo sapiens
gaggccaagttggagaccaggt

SEQ ID NO: 8413614 - DNA, 22 bp, Homo sapiens
gagggaaaggttaatacatgat

SEQ ID NO: 8413615 - DNA, 22 bp, Homo sapiens
gagggcaagagttggaaacggt

SEQ ID NO: 8413616 - DNA, 22 bp, Homo sapiens
gagggcaaaacagagaagatgt

SEQ ID NO: 8413617 - DNA, 22 bp, Homo sapiens
atgctttattattttgcaggga

SEQ ID NO: 8413618 - DNA, 22 bp, Homo sapiens
gacccggctccaggcccagcag

SEQ ID NO: 8413619 - DNA, 22 bp, Homo sapiens
gaccctgactctaatgcttggc

SEQ ID NO: 8413620 - DNA, 22 bp, Homo sapiens
gaccctgaggatgcaccagcag

SEQ ID NO: 8413621 - DNA, 22 bp, Homo sapiens
gaccctgagcaaaagcagttct

SEQ ID NO: 8413622 - DNA, 22 bp, Homo sapiens
gaccctgccatgagtgacaggg

SEQ ID NO: 8413623 - DNA, 22 bp, Homo sapiens
gaccctgaggattccctgctga

SEQ ID NO: 8413624 - DNA, 22 bp, Homo sapiens
gaccctgataggagtagaagaa

SEQ ID NO: 8413625 - DNA, 22 bp, Homo sapiens
atgcttttccaggagaaatata

SEQ ID NO: 8413626 - DNA, 22 bp, Homo sapiens
atgcttttatgtcacatggtca

SEQ ID NO: 8413627 - DNA, 22 bp, Homo sapiens
gactttggcatctagacattgt

SEQ ID NO: 8413628 - DNA, 22 bp, Homo sapiens
gaatgttattgaactacgagct

SEQ ID NO: 8413629 - DNA, 22 bp, Homo sapiens
gaatgttattggacagcagtgg

SEQ ID NO: 8413630 - DNA, 22 bp, Homo sapiens
gaatgttagagattcttaggtt

SEQ ID NO: 8413631 - DNA, 22 bp, Homo sapiens
gaatgttatgtatccagtcaca

SEQ ID NO: 8413632 - DNA, 22 bp, Homo sapiens
gaatgttaatgcacttctagct

SEQ ID NO: 8413633 - DNA, 22 bp, Homo sapiens
gaatgttactttgattttgtcc

SEQ ID NO: 8413634 - DNA, 22 bp, Homo sapiens
atgcataatgtatgtattgact

SEQ ID NO: 8413635 - DNA, 22 bp, Homo sapiens
atgccccaggaggtgccatcca

SEQ ID NO: 8413636 - DNA, 22 bp, Homo sapiens
atgccccagtgtgtgcttcctt

SEQ ID NO: 8413637 - DNA, 22 bp, Homo sapiens
atgccacttcattccagcctcg

SEQ ID NO: 8413638 - DNA, 22 bp, Homo sapiens
atgaagcaggcacagcttcagg

SEQ ID NO: 8413639 - DNA, 22 bp, Homo sapiens
atcttcccaggctggggagagg

SEQ ID NO: 8413640 - DNA, 22 bp, Homo sapiens
atcttcccaggctggggagagg

SEQ ID NO: 8413641 - DNA, 22 bp, Homo sapiens
cttgagaatcttctctgaagag

SEQ ID NO: 8413642 - DNA, 22 bp, Homo sapiens
gaaaactattggcctagaacaa

SEQ ID NO: 8413643 - DNA, 22 bp, Homo sapiens
gaaaactaacggaaaagttagg

SEQ ID NO: 8413644 - DNA, 22 bp, Homo sapiens
atgaggcatatcctcctatggt

SEQ ID NO: 8413645 - DNA, 22 bp, Homo sapiens
gaacatacaagaattaagtaca

SEQ ID NO: 8413646 - DNA, 22 bp, Homo sapiens
gaaaatgtgtcatccctactgt

SEQ ID NO: 8413647 - DNA, 22 bp, Homo sapiens
gaaaatgtgcctttgggtattg

SEQ ID NO: 8413648 - DNA, 22 bp, Homo sapiens
gaaatgaaacaggcttttaagg

SEQ ID NO: 8413649 - DNA, 22 bp, Homo sapiens
gaagaaagattggcatgcttca

SEQ ID NO: 8413650 - DNA, 22 bp, Homo sapiens
atgcaatatagggaagatagat

SEQ ID NO: 8413651 - DNA, 22 bp, Homo sapiens
atgcaataccttctgaaaataa

SEQ ID NO: 8413652 - DNA, 22 bp, Homo sapiens
atgcaatttactgtacataaat

SEQ ID NO: 8413653 - DNA, 22 bp, Homo sapiens
atgcacaagaggctagaaaaga

SEQ ID NO: 8413654 - DNA, 21 bp, Homo sapiens
atgcacaaaaagactctttct

SEQ ID NO: 8413655 - DNA, 22 bp, Homo sapiens
gaacattcacagactcaccatt

SEQ ID NO: 8413656 - DNA, 22 bp, Homo sapiens
gaacatctgggatcattgctgt

SEQ ID NO: 8413657 - DNA, 22 bp, Homo sapiens
gaacatcttatccatttcctct

SEQ ID NO: 8413658 - DNA, 22 bp, Homo sapiens
cacatgcccagaacttctcatt

SEQ ID NO: 8413659 - DNA, 22 bp, Homo sapiens
ggatcctgatatgtgtttctca

SEQ ID NO: 8413660 - DNA, 22 bp, Homo sapiens
ggagtgactcacagctgggaca

SEQ ID NO: 8413661 - DNA, 22 bp, Homo sapiens
ggaggtggaggttgcagtgagc

SEQ ID NO: 8413662 - DNA, 22 bp, Homo sapiens
ggccccaggcctttggtctggc

SEQ ID NO: 8413663 - DNA, 22 bp, Homo sapiens
ggcgcacaatgtgcaggtttgt

SEQ ID NO: 8413664 - DNA, 22 bp, Homo sapiens
cacccagcattggctaagagag

SEQ ID NO: 8413665 - DNA, 22 bp, Homo sapiens
cacccagccttcacacaggagt

SEQ ID NO: 8413666 - DNA, 22 bp, Homo sapiens
cacccagcttttgcatcctccg

SEQ ID NO: 8413667 - DNA, 22 bp, Homo sapiens
cacccaggcaggtggctgagaa

SEQ ID NO: 8413668 - DNA, 22 bp, Homo sapiens
cacccaggacaggccagatgtg

SEQ ID NO: 8413669 - DNA, 20 bp, Homo sapiens
caccacagaattggggacag

SEQ ID NO: 8413670 - DNA, 19 bp, Homo sapiens
cacattttgagtctgagat

SEQ ID NO: 8413671 - DNA, 22 bp, Homo sapiens
cactgtctattaatataactta

SEQ ID NO: 8413672 - DNA, 22 bp, Homo sapiens
cactgtcttttgtgaagacaat

SEQ ID NO: 8413673 - DNA, 22 bp, Homo sapiens
cactgtcttttgtgaagacaat

SEQ ID NO: 8413674 - DNA, 22 bp, Homo sapiens
cactgtcttcagtttcactgca

SEQ ID NO: 8413675 - DNA, 22 bp, Homo sapiens
cactgtcttgattactatgggt

SEQ ID NO: 8413676 - DNA, 22 bp, Homo sapiens
cactgtctgggacatgtggtct

SEQ ID NO: 8413677 - DNA, 22 bp, Homo sapiens
cactgtctgcttcgactcttca

SEQ ID NO: 8413678 - DNA, 22 bp, Homo sapiens
cactgtctgtgtgtccttgggg

SEQ ID NO: 8413679 - DNA, 22 bp, Homo sapiens
cactgtctgagctggtgattag

SEQ ID NO: 8413680 - DNA, 22 bp, Homo sapiens
cactgtctcctagggggacttc

SEQ ID NO: 8413681 - DNA, 22 bp, Homo sapiens
ggcttgatcacataggtctccc

SEQ ID NO: 8413682 - DNA, 22 bp, Homo sapiens
cagaagaggactgggtagctca

SEQ ID NO: 8413683 - DNA, 22 bp, Homo sapiens
cagaaatgtactgacatgcagt

SEQ ID NO: 8413684 - DNA, 22 bp, Homo sapiens
cagaaatggagcccaggaatct

SEQ ID NO: 8413685 - DNA, 22 bp, Homo sapiens
ggacacaaaagtgaataaaata

SEQ ID NO: 8413686 - DNA, 22 bp, Homo sapiens
cacagcaaagacactctcaact

SEQ ID NO: 8413687 - DNA, 22 bp, Homo sapiens
cacagctaggaggaaagcagag

SEQ ID NO: 8413688 - DNA, 22 bp, Homo sapiens
caatgcatgatggaattgcctt

SEQ ID NO: 8413689 - DNA, 22 bp, Homo sapiens
caatgcattattctcccacttc

SEQ ID NO: 8413690 - DNA, 22 bp, Homo sapiens
caatgtatcaaccagaaagttc

SEQ ID NO: 8413691 - DNA, 17 bp, Homo sapiens
ggaacaaatactatgca

SEQ ID NO: 8413692 - DNA, 20 bp, Homo sapiens
caagtgttattgtgcattta

SEQ ID NO: 8413693 - DNA, 22 bp, Homo sapiens
gctggtctccgccgctccctga

SEQ ID NO: 8413694 - DNA, 22 bp, Homo sapiens
caatgatttttccattgcagga

SEQ ID NO: 8413695 - DNA, 22 bp, Homo sapiens
caatgcacatggacatcaggct

SEQ ID NO: 8413696 - DNA, 16 bp, Homo sapiens
gctggagggaggggtt

SEQ ID NO: 8413697 - DNA, 20 bp, Homo sapiens
gctgaggtcattatgcctca

SEQ ID NO: 8413698 - DNA, 22 bp, Homo sapiens
gctgaggtccagcattcgccta

SEQ ID NO: 8413699 - DNA, 22 bp, Homo sapiens
caaatttaagttagaaagcaat

SEQ ID NO: 8413700 - DNA, 22 bp, Homo sapiens
caaatttaggtaacagtctgta

SEQ ID NO: 8413701 - DNA, 22 bp, Homo sapiens
caaatttaagtgaggtctttgt

SEQ ID NO: 8413702 - DNA, 22 bp, Homo sapiens
caaatttaagtgaggtctttgt

SEQ ID NO: 8413703 - DNA, 18 bp, Homo sapiens
caaattcagtgctggaag

SEQ ID NO: 8413704 - DNA, 22 bp, Homo sapiens
gtgcagctgccgatcagatagg

SEQ ID NO: 8413705 - DNA, 22 bp, Homo sapiens
gtgaatattctttgtgcagtat

SEQ ID NO: 8413706 - DNA, 22 bp, Homo sapiens
gtgaatatgatcttatttggaa

SEQ ID NO: 8413707 - DNA, 22 bp, Homo sapiens
gtgaataattttttagtataag

SEQ ID NO: 8413708 - DNA, 22 bp, Homo sapiens
gtgaataactttctatgttaat

SEQ ID NO: 8413709 - DNA, 22 bp, Homo sapiens
gtgaataatattgtttataaaa

SEQ ID NO: 8413710 - DNA, 22 bp, Homo sapiens
gtgaggtagcagagacagtgaa

SEQ ID NO: 8413711 - DNA, 22 bp, Homo sapiens
gtcttacccacagcatctagaa

SEQ ID NO: 8413712 - DNA, 22 bp, Homo sapiens
gtctttctgccatgtgaagaga

SEQ ID NO: 8413713 - DNA, 22 bp, Homo sapiens
gtctcttagaatcgcatattgt

SEQ ID NO: 8413714 - DNA, 20 bp, Homo sapiens
gtctccactgggggttaacc

SEQ ID NO: 8413715 - DNA, 22 bp, Homo sapiens
gtctcaagggggaactcactgt

SEQ ID NO: 8413716 - DNA, 22 bp, Homo sapiens
gtctcacacagagtagattttg

SEQ ID NO: 8413717 - DNA, 22 bp, Homo sapiens
gtcctgagatgtcacaaggttt

SEQ ID NO: 8413718 - DNA, 22 bp, Homo sapiens
gtcctgagaccatggccttagt

SEQ ID NO: 8413719 - DNA, 22 bp, Homo sapiens
gtcctgaggcaggatgggtttc

SEQ ID NO: 8413720 - DNA, 22 bp, Homo sapiens
gtcctgagtcaagtgtgggcag

SEQ ID NO: 8413721 - DNA, 22 bp, Homo sapiens
gtcctgagggcccaggcattct

SEQ ID NO: 8413722 - DNA, 22 bp, Homo sapiens
gtgcatgcaaattactgtaaag

SEQ ID NO: 8413723 - DNA, 22 bp, Homo sapiens
cagctcctcacgagtcttgaaa

SEQ ID NO: 8413724 - DNA, 22 bp, Homo sapiens
cagctctgaggaacactccttt

SEQ ID NO: 8413725 - DNA, 22 bp, Homo sapiens
cagctcctgaggactgctggga

SEQ ID NO: 8413726 - DNA, 22 bp, Homo sapiens
cagaggctgccagccatgtgca

SEQ ID NO: 8413727 - DNA, 22 bp, Homo sapiens
gtaaacatgctgtgtactcagc

SEQ ID NO: 8413728 - DNA, 22 bp, Homo sapiens
gtaaacatcgacccaacagggg

SEQ ID NO: 8413729 - DNA, 22 bp, Homo sapiens
ggtgtcctttgggggctccgag

SEQ ID NO: 8413730 - DNA, 22 bp, Homo sapiens
cagatggattttgtaggctgat

SEQ ID NO: 8413731 - DNA, 22 bp, Homo sapiens
cagatggaaggcatagaggttt

SEQ ID NO: 8413732 - DNA, 22 bp, Homo sapiens
cagatggagtcccgtggagttc

SEQ ID NO: 8413733 - DNA, 22 bp, Homo sapiens
ggtggcagtggtctctgacaga

SEQ ID NO: 8413734 - DNA, 22 bp, Homo sapiens
cagcactatgacatttaattct

SEQ ID NO: 8413735 - DNA, 22 bp, Homo sapiens
cagcactgctgctgtacacaca

SEQ ID NO: 8413736 - DNA, 22 bp, Homo sapiens
cagaggaaatgggaaggagata

SEQ ID NO: 8413737 - DNA, 22 bp, Homo sapiens
gggggaggtgaatgcaataagg

SEQ ID NO: 8413738 - DNA, 22 bp, Homo sapiens
cagaggcagaccctccagggcg

SEQ ID NO: 8413739 - DNA, 18 bp, Homo sapiens
gggccctggcgtccgccc

SEQ ID NO: 8413740 - DNA, 22 bp, Homo sapiens
cagagagcttagtgtgctgcat

SEQ ID NO: 8413741 - DNA, 22 bp, Homo sapiens
cagagagcatgggaggcccgag

SEQ ID NO: 8413742 - DNA, 22 bp, Homo sapiens
gggccctggacgtggcggcaga

SEQ ID NO: 8413743 - DNA, 22 bp, Homo sapiens
gggccctggccgaatccctctg

SEQ ID NO: 8413744 - DNA, 22 bp, Homo sapiens
gggccctggatttaagcatgga

SEQ ID NO: 8413745 - DNA, 22 bp, Homo sapiens
cagagactggagtgcagtggcg

SEQ ID NO: 8413746 - DNA, 22 bp, Homo sapiens
cagaagagtagctgaacaagtt

SEQ ID NO: 8413747 - DNA, 22 bp, Homo sapiens
tccaagagaatactggagagta

SEQ ID NO: 8413748 - DNA, 19 bp, Homo sapiens
catgctgacctgctgtggt

SEQ ID NO: 8413749 - DNA, 22 bp, Homo sapiens
catgccaacaacaagcaatgag

SEQ ID NO: 8413750 - DNA, 22 bp, Homo sapiens
catgtacaaaaggcaaatgcct

SEQ ID NO: 8413751 - DNA, 22 bp, Homo sapiens
cattacaaagttataaacagtt

SEQ ID NO: 8413752 - DNA, 22 bp, Homo sapiens
catgttttgtgtacagaatatt

SEQ ID NO: 8413753 - DNA, 22 bp, Homo sapiens
tccaggcttgagaccaggctct

SEQ ID NO: 8413754 - DNA, 22 bp, Homo sapiens
tccaggctgggctgaagggtgc

SEQ ID NO: 8413755 - DNA, 22 bp, Homo sapiens
catcaagatggaagagcaaata

SEQ ID NO: 8413756 - DNA, 22 bp, Homo sapiens
catcaaatctgacttttcttcc

SEQ ID NO: 8413757 - DNA, 22 bp, Homo sapiens
catcaggaggagatgaagaaaa

SEQ ID NO: 8413758 - DNA, 22 bp, Homo sapiens
catcagtggatatagattagcg

SEQ ID NO: 8413759 - DNA, 22 bp, Homo sapiens
catcagtgcccttggggatgcc

SEQ ID NO: 8413760 - DNA, 22 bp, Homo sapiens
catcagtgagccccttgatgag

SEQ ID NO: 8413761 - DNA, 22 bp, Homo sapiens
catcagtgaaagtgaatgttct

SEQ ID NO: 8413762 - DNA, 17 bp, Homo sapiens
catccgtgagctcggca

SEQ ID NO: 8413763 - DNA, 22 bp, Homo sapiens
catcctgagaggtctctctacc

SEQ ID NO: 8413764 - DNA, 22 bp, Homo sapiens
catctaatacctcatttaatct

SEQ ID NO: 8413765 - DNA, 22 bp, Homo sapiens
tcatacaactaagagtttcaga

SEQ ID NO: 8413766 - DNA, 22 bp, Homo sapiens
tcatacaactaagagtttcaga

SEQ ID NO: 8413767 - DNA, 22 bp, Homo sapiens
ccaacaggttgagagtctgaat

SEQ ID NO: 8413768 - DNA, 23 bp, Homo sapiens
tcctgagggtttcccagccttgg

SEQ ID NO: 8413769 - DNA, 22 bp, Homo sapiens
tcctgaggtatatgctttgcag

SEQ ID NO: 8413770 - DNA, 22 bp, Homo sapiens
tcctgaggtggattgagcagag

SEQ ID NO: 8413771 - DNA, 22 bp, Homo sapiens
ccacaggctgctgcaggtcccg

SEQ ID NO: 8413772 - DNA, 22 bp, Homo sapiens
tcctggccttagcgaggcggtc

SEQ ID NO: 8413773 - DNA, 22 bp, Homo sapiens
catttcaccttagagaattatt

SEQ ID NO: 8413774 - DNA, 22 bp, Homo sapiens
catttattggcatgtagtaggt

SEQ ID NO: 8413775 - DNA, 19 bp, Homo sapiens
tccagtttggcaggaagac

SEQ ID NO: 8413776 - DNA, 22 bp, Homo sapiens
catttcactattcactaaaagg

SEQ ID NO: 8413777 - DNA, 22 bp, Homo sapiens
catttctaagaagatctgggta

SEQ ID NO: 8413778 - DNA, 22 bp, Homo sapiens
catttctagagtcccaagaggt

SEQ ID NO: 8413779 - DNA, 22 bp, Homo sapiens
catttctaccaaatgtgactgg

SEQ ID NO: 8413780 - DNA, 22 bp, Homo sapiens
catttctagacaagtcctggag

SEQ ID NO: 8413781 - DNA, 21 bp, Homo sapiens
catttctaagcctggctatag

SEQ ID NO: 8413782 - DNA, 22 bp, Homo sapiens
catttctaagaaggctgcacat

SEQ ID NO: 8413783 - DNA, 22 bp, Homo sapiens
catttctacagcttcttcagaa

SEQ ID NO: 8413784 - DNA, 22 bp, Homo sapiens
cattttcatgagtttctgttca

SEQ ID NO: 8413785 - DNA, 22 bp, Homo sapiens
cattttcatgagtttctgttca

SEQ ID NO: 8413786 - DNA, 23 bp, Homo sapiens
catttctaggtgtgtttggccat

SEQ ID NO: 8413787 - DNA, 22 bp, Homo sapiens
catttctagggatcataaagta

SEQ ID NO: 8413788 - DNA, 22 bp, Homo sapiens
cattttcagcacccatctgaaa

SEQ ID NO: 8413789 - DNA, 22 bp, Homo sapiens
cattttcagcacccatctgaaa

SEQ ID NO: 8413790 - DNA, 22 bp, Homo sapiens
cattttcagcacccatctgaaa

SEQ ID NO: 8413791 - DNA, 22 bp, Homo sapiens
cattttcagcacccatctgaaa

SEQ ID NO: 8413792 - DNA, 22 bp, Homo sapiens
cattttcatgagtttctgttca

SEQ ID NO: 8413793 - DNA, 22 bp, Homo sapiens
cattttactgactcttgaatta

SEQ ID NO: 8413794 - DNA, 22 bp, Homo sapiens
cattttacctagaagctgaaag

SEQ ID NO: 8413795 - DNA, 22 bp, Homo sapiens
cattttacctagaagctgaaag

SEQ ID NO: 8413796 - DNA, 22 bp, Homo sapiens
cattttactgactcttgaatta

SEQ ID NO: 8413797 - DNA, 22 bp, Homo sapiens
cattttacgacatagggcaggc

SEQ ID NO: 8413798 - DNA, 22 bp, Homo sapiens
cattttacgacatagggcaggc

SEQ ID NO: 8413799 - DNA, 22 bp, Homo sapiens
tctatacaagtttcactttgac

SEQ ID NO: 8413800 - DNA, 22 bp, Homo sapiens
tctataaattatgcagtctcag

SEQ ID NO: 8413801 - DNA, 22 bp, Homo sapiens
tctagaatttgcgtaggttaga

SEQ ID NO: 8413802 - DNA, 22 bp, Homo sapiens
tctagaatgacatgcaagagta

SEQ ID NO: 8413803 - DNA, 22 bp, Homo sapiens
tctcaggatctaatacatggta

SEQ ID NO: 8413804 - DNA, 22 bp, Homo sapiens
tcctgttgttcgcctgcgatgg

SEQ ID NO: 8413805 - DNA, 22 bp, Homo sapiens
tctaatgaggactttatagaga

SEQ ID NO: 8413806 - DNA, 22 bp, Homo sapiens
tctaatgagggtgaaggcccag

SEQ ID NO: 8413807 - DNA, 22 bp, Homo sapiens
tctaatgagttagataattttg

SEQ ID NO: 8413808 - DNA, 21 bp, Homo sapiens
tctaatgacatcctctgacaa

SEQ ID NO: 8413809 - DNA, 21 bp, Homo sapiens
tctagaatcctgtataagact

SEQ ID NO: 8413810 - DNA, 22 bp, Homo sapiens
tctagaaagccaaattaggaat

SEQ ID NO: 8413811 - DNA, 22 bp, Homo sapiens
ccagagagggcgccacctggag

SEQ ID NO: 8413812 - DNA, 22 bp, Homo sapiens
ccagagcccagggtcatgcagg

SEQ ID NO: 8413813 - DNA, 22 bp, Homo sapiens
ccagattcatagaaactcatag

SEQ ID NO: 8413814 - DNA, 22 bp, Homo sapiens
tacctcaagttccaggaaagcg

SEQ ID NO: 8413815 - DNA, 22 bp, Homo sapiens
tagaaagagcatagtattataa

SEQ ID NO: 8413816 - DNA, 22 bp, Homo sapiens
caggctgcagcagcagtggccc

SEQ ID NO: 8413817 - DNA, 22 bp, Homo sapiens
tacccagggcttttctgatgca

SEQ ID NO: 8413818 - DNA, 22 bp, Homo sapiens
tacccaggaggaaactgaggct

SEQ ID NO: 8413819 - DNA, 22 bp, Homo sapiens
tacccaggggctgagcagaggt

SEQ ID NO: 8413820 - DNA, 22 bp, Homo sapiens
tagaacacttgaccactgctcc

SEQ ID NO: 8413821 - DNA, 22 bp, Homo sapiens
tagaaatgtgataatagcttaa

SEQ ID NO: 8413822 - DNA, 22 bp, Homo sapiens
tagcagtgtctaggtaggccat

SEQ ID NO: 8413823 - DNA, 22 bp, Homo sapiens
tagcacaaagagtctttcagag

SEQ ID NO: 8413824 - DNA, 22 bp, Homo sapiens
tacagttcctctcgtggaggtg

SEQ ID NO: 8413825 - DNA, 20 bp, Homo sapiens
tacagcccctgcttctgttg

SEQ ID NO: 8413826 - DNA, 22 bp, Homo sapiens
tacagcccaagaagtttatacg

SEQ ID NO: 8413827 - DNA, 22 bp, Homo sapiens
tacagcgaaaatttagcttgat

SEQ ID NO: 8413828 - DNA, 22 bp, Homo sapiens
tacagagactttatggcacaaa

SEQ ID NO: 8413829 - DNA, 22 bp, Homo sapiens
tacagagagtacagcatccaca

SEQ ID NO: 8413830 - DNA, 22 bp, Homo sapiens
tacagaccagtagttctcagcg

SEQ ID NO: 8413831 - DNA, 22 bp, Homo sapiens
tacagacattcaattttgaccc

SEQ ID NO: 8413832 - DNA, 17 bp, Homo sapiens
cagctctgcatcttcct

SEQ ID NO: 8413833 - DNA, 22 bp, Homo sapiens
tagtacactctgtaagtttaaa

SEQ ID NO: 8413834 - DNA, 22 bp, Homo sapiens
tagtacaactcacttgatttta

SEQ ID NO: 8413835 - DNA, 19 bp, Homo sapiens
tagtacaaaagcagccata

SEQ ID NO: 8413836 - DNA, 22 bp, Homo sapiens
tagtaaattaaaatattgactt

SEQ ID NO: 8413837 - DNA, 22 bp, Homo sapiens
taggtataggattctaggttgg

SEQ ID NO: 8413838 - DNA, 22 bp, Homo sapiens
tagtaaatctcagaaaaagatc

SEQ ID NO: 8413839 - DNA, 22 bp, Homo sapiens
tatattcacttgtgtccaacca

SEQ ID NO: 8413840 - DNA, 22 bp, Homo sapiens
tatgcaattctcttaatattct

SEQ ID NO: 8413841 - DNA, 22 bp, Homo sapiens
tatattgaccagtacaattggt

SEQ ID NO: 8413842 - DNA, 22 bp, Homo sapiens
cagtaaaagatggaaatagaat

SEQ ID NO: 8413843 - DNA, 22 bp, Homo sapiens
cagtaattccaagtgcttatac

SEQ ID NO: 8413844 - DNA, 22 bp, Homo sapiens
tatgcacacatgtatgcatgtg

SEQ ID NO: 8413845 - DNA, 22 bp, Homo sapiens
tattccctgatgtacactggca

SEQ ID NO: 8413846 - DNA, 22 bp, Homo sapiens
tattcctatttctaaacatatg

SEQ ID NO: 8413847 - DNA, 22 bp, Homo sapiens
tcaaagcaatttcaccagtgcc

SEQ ID NO: 8413848 - DNA, 22 bp, Homo sapiens
tattcccactcctcagcaattt

SEQ ID NO: 8413849 - DNA, 22 bp, Homo sapiens
cagtagacacattaatatggaa

SEQ ID NO: 8413850 - DNA, 22 bp, Homo sapiens
tcaaattagtggaataataatg

SEQ ID NO: 8413851 - DNA, 22 bp, Homo sapiens
cagtctgggactgagctccacc

SEQ ID NO: 8413852 - DNA, 22 bp, Homo sapiens
cagtctggaggtcagctggctt

SEQ ID NO: 8413853 - DNA, 22 bp, Homo sapiens
cagtgcaggtttagggctgggg

SEQ ID NO: 8413854 - DNA, 22 bp, Homo sapiens
cagtgcaggtggcagaggacag

SEQ ID NO: 8413855 - DNA, 22 bp, Homo sapiens
cagtgcagaggtgcaagcatgt

SEQ ID NO: 8413856 - DNA, 22 bp, Homo sapiens
cagtgcagtcaaggaagaacca

SEQ ID NO: 8413857 - DNA, 22 bp, Homo sapiens
cagtgcagttggtggcaggggt

SEQ ID NO: 8413858 - DNA, 22 bp, Homo sapiens
cagtgcagtttcccagatgctg

SEQ ID NO: 8413859 - DNA, 22 bp, Homo sapiens
cagtggcaagtccggtattgaa

SEQ ID NO: 8413860 - DNA, 22 bp, Homo sapiens
cagtgctgttgtaagctcattg

SEQ ID NO: 8413861 - DNA, 22 bp, Homo sapiens
tcacacttagagcgaattgttt

SEQ ID NO: 8413862 - DNA, 17 bp, Homo sapiens
cagtggcagatcttctc

SEQ ID NO: 8413863 - DNA, 22 bp, Homo sapiens
tcacattcttccctgacttctt

SEQ ID NO: 8413864 - DNA, 22 bp, Homo sapiens
tcacattctcagcatctataca

SEQ ID NO: 8413865 - DNA, 22 bp, Homo sapiens
tcacattcatggtgctaataaa

SEQ ID NO: 8413866 - DNA, 22 bp, Homo sapiens
tcacattctagaatgttatcgt

SEQ ID NO: 8413867 - DNA, 19 bp, Homo sapiens
tcacattcagccttgctga

SEQ ID NO: 8413868 - DNA, 22 bp, Homo sapiens
tgcttcctatccacacaatgcc

SEQ ID NO: 8413869 - DNA, 22 bp, Homo sapiens
ccccaggcagggcctaacagag

SEQ ID NO: 8413870 - DNA, 22 bp, Homo sapiens
tgcttgctggaggcagacagaa

SEQ ID NO: 8413871 - DNA, 22 bp, Homo sapiens
tgcagggctaagtcagagcctg

SEQ ID NO: 8413872 - DNA, 19 bp, Homo sapiens
tgctagaaattctgtgact

SEQ ID NO: 8413873 - DNA, 22 bp, Homo sapiens
tgctagtgtgtgagatgttcaa

SEQ ID NO: 8413874 - DNA, 23 bp, Homo sapiens
tggaggaaacacatcagaagacc

SEQ ID NO: 8413875 - DNA, 18 bp, Homo sapiens
tggaggaatcacaatggc

SEQ ID NO: 8413876 - DNA, 22 bp, Homo sapiens
tggaggaataacagcaacctta

SEQ ID NO: 8413877 - DNA, 22 bp, Homo sapiens
tggaggaataacagcaacctta

SEQ ID NO: 8413878 - DNA, 21 bp, Homo sapiens
tggaggaataaagcacagaag

SEQ ID NO: 8413879 - DNA, 22 bp, Homo sapiens
tggaggaagttgctggaagtca

SEQ ID NO: 8413880 - DNA, 22 bp, Homo sapiens
tggaggaatcagggcttaggct

SEQ ID NO: 8413881 - DNA, 22 bp, Homo sapiens
tggaggaatcagggcttaggct

SEQ ID NO: 8413882 - DNA, 19 bp, Homo sapiens
tggaggaagtatatttcat

SEQ ID NO: 8413883 - DNA, 22 bp, Homo sapiens
tggaggaagtggacagttgtgt

SEQ ID NO: 8413884 - DNA, 22 bp, Homo sapiens
tggaggaagtggctggccagaa

SEQ ID NO: 8413885 - DNA, 22 bp, Homo sapiens
tggaggcagtttaagtctgaga

SEQ ID NO: 8413886 - DNA, 22 bp, Homo sapiens
tggcagaaagaaccatgtgcaa

SEQ ID NO: 8413887 - DNA, 21 bp, Homo sapiens
tggccaaaaccatattattaa

SEQ ID NO: 8413888 - DNA, 21 bp, Homo sapiens
tggccaaactggagcatttga

SEQ ID NO: 8413889 - DNA, 22 bp, Homo sapiens
cctcccaccatttagagagagc

SEQ ID NO: 8413890 - DNA, 22 bp, Homo sapiens
cctcctggcttttcccattgaa

SEQ ID NO: 8413891 - DNA, 22 bp, Homo sapiens
tggcttgggagattctcgaact

SEQ ID NO: 8413892 - DNA, 22 bp, Homo sapiens
tggcttgggtgtctcagctctt

SEQ ID NO: 8413893 - DNA, 19 bp, Homo sapiens
tggcttggctgcagatgct

SEQ ID NO: 8413894 - DNA, 16 bp, Homo sapiens
tggcttgggtttcatg

SEQ ID NO: 8413895 - DNA, 22 bp, Homo sapiens
tggcttggtaaggaccagcagg

SEQ ID NO: 8413896 - DNA, 22 bp, Homo sapiens
tggcttggtgagcagagtgtag

SEQ ID NO: 8413897 - DNA, 22 bp, Homo sapiens
tggcttggtcctggcccttccc

SEQ ID NO: 8413898 - DNA, 22 bp, Homo sapiens
tggcttggctaagatctaagct

SEQ ID NO: 8413899 - DNA, 22 bp, Homo sapiens
tggcttggactaaatggaccgt

SEQ ID NO: 8413900 - DNA, 22 bp, Homo sapiens
cctctccagttttaacgtgacc

SEQ ID NO: 8413901 - DNA, 22 bp, Homo sapiens
tgggcagactaaggtcaaagct

SEQ ID NO: 8413902 - DNA, 22 bp, Homo sapiens
tgggctccagcacctgtgctct

SEQ ID NO: 8413903 - DNA, 22 bp, Homo sapiens
tgggctccaatttgtcctttca

SEQ ID NO: 8413904 - DNA, 22 bp, Homo sapiens
tgggctccagcacctgtgctct

SEQ ID NO: 8413905 - DNA, 22 bp, Homo sapiens
tgggctccggcggcctcaggct

SEQ ID NO: 8413906 - DNA, 22 bp, Homo sapiens
tgggctccgttgcctggggcag

SEQ ID NO: 8413907 - DNA, 22 bp, Homo sapiens
tgggctcctcgtcactcgctgt

SEQ ID NO: 8413908 - DNA, 22 bp, Homo sapiens
tgggctcctcgtcactcgctgt

SEQ ID NO: 8413909 - DNA, 22 bp, Homo sapiens
tggggagagattgaggagtttt

SEQ ID NO: 8413910 - DNA, 22 bp, Homo sapiens
cctgcagggaatcgaggcagaa

SEQ ID NO: 8413911 - DNA, 22 bp, Homo sapiens
cctgcagggaatcgaggcagaa

SEQ ID NO: 8413912 - DNA, 22 bp, Homo sapiens
cctgcaggctgcaggccagttc

SEQ ID NO: 8413913 - DNA, 22 bp, Homo sapiens
cctgcaggctgcaggccagttc

SEQ ID NO: 8413914 - DNA, 22 bp, Homo sapiens
cctgagtggtgctaagcagata

SEQ ID NO: 8413915 - DNA, 22 bp, Homo sapiens
cctgagtgtaataatgaaggca

SEQ ID NO: 8413916 - DNA, 17 bp, Homo sapiens
cctgagtgggagaggaa

SEQ ID NO: 8413917 - DNA, 22 bp, Homo sapiens
cctgagtcttggcttcttggct

SEQ ID NO: 8413918 - DNA, 22 bp, Homo sapiens
cctgagtgccatgagagcaccc

SEQ ID NO: 8413919 - DNA, 22 bp, Homo sapiens
cctgagtgacctgaggtctagt

SEQ ID NO: 8413920 - DNA, 22 bp, Homo sapiens
tggggagagaccggaatgtttc

SEQ ID NO: 8413921 - DNA, 22 bp, Homo sapiens
tggtaatatatgccagataaaa

SEQ ID NO: 8413922 - DNA, 23 bp, Homo sapiens
tggtaatagggagcagaaggtag

SEQ ID NO: 8413923 - DNA, 19 bp, Homo sapiens
tggtacaaaccaagagaga

SEQ ID NO: 8413924 - DNA, 22 bp, Homo sapiens
cctgcagtttgttgtgaccccg

SEQ ID NO: 8413925 - DNA, 22 bp, Homo sapiens
cctgcaggtttcccccggacgg

SEQ ID NO: 8413926 - DNA, 22 bp, Homo sapiens
cctgcaggttgcagaggcggaa

SEQ ID NO: 8413927 - DNA, 22 bp, Homo sapiens
cctgcaggtccccggatgcgca

SEQ ID NO: 8413928 - DNA, 22 bp, Homo sapiens
cctgcaggttgcagaggcggaa

SEQ ID NO: 8413929 - DNA, 22 bp, Homo sapiens
cctgcagggtgctgccacagat

SEQ ID NO: 8413930 - DNA, 22 bp, Homo sapiens
cctgcagggtgctgccacagat

SEQ ID NO: 8413931 - DNA, 22 bp, Homo sapiens
cctgcaggtaaggctaactgcc

SEQ ID NO: 8413932 - DNA, 19 bp, Homo sapiens
cctgcagggatgagaggtt

SEQ ID NO: 8413933 - DNA, 22 bp, Homo sapiens
cctgcaggggagagacttctag

SEQ ID NO: 8413934 - DNA, 22 bp, Homo sapiens
tggtacacatgtccaaggtcag

SEQ ID NO: 8413935 - DNA, 22 bp, Homo sapiens
cctgcctactgagttttatatt

SEQ ID NO: 8413936 - DNA, 22 bp, Homo sapiens
cccagcagccttgtcccttctc

SEQ ID NO: 8413937 - DNA, 22 bp, Homo sapiens
cccagcagcctggatgttcttt

SEQ ID NO: 8413938 - DNA, 22 bp, Homo sapiens
cccagcagcttgcacagtgctg

SEQ ID NO: 8413939 - DNA, 22 bp, Homo sapiens
cccagcagggtctctgtgtcta

SEQ ID NO: 8413940 - DNA, 22 bp, Homo sapiens
tgcagggatcctagctgaagag

SEQ ID NO: 8413941 - DNA, 22 bp, Homo sapiens
tgcagggccttctagaccatgg

SEQ ID NO: 8413942 - DNA, 22 bp, Homo sapiens
tgcaggaagtttcctgaacttt

SEQ ID NO: 8413943 - DNA, 22 bp, Homo sapiens
tgcaggaatattgatgaactta

SEQ ID NO: 8413944 - DNA, 22 bp, Homo sapiens
tgcactccaggctgggtgacag

SEQ ID NO: 8413945 - DNA, 22 bp, Homo sapiens
tgcactccaggctgggtgacag

SEQ ID NO: 8413946 - DNA, 22 bp, Homo sapiens
cccaaggaagacgcttgtgata

SEQ ID NO: 8413947 - DNA, 22 bp, Homo sapiens
cccaaggaataggatcccagga

SEQ ID NO: 8413948 - DNA, 22 bp, Homo sapiens
cccaaggacacgggcagggaca

SEQ ID NO: 8413949 - DNA, 22 bp, Homo sapiens
cccaaggccttcaagccagctc

SEQ ID NO: 8413950 - DNA, 16 bp, Homo sapiens
cccaaggagctccagg

SEQ ID NO: 8413951 - DNA, 22 bp, Homo sapiens
tgatacagaattgatatctgag

SEQ ID NO: 8413952 - DNA, 22 bp, Homo sapiens
tgatacagagaaagcatctttt

SEQ ID NO: 8413953 - DNA, 22 bp, Homo sapiens
tgatacagagcaagcatctttt

SEQ ID NO: 8413954 - DNA, 22 bp, Homo sapiens
tgcaatattttatatccaacaa

SEQ ID NO: 8413955 - DNA, 22 bp, Homo sapiens
tgcaatatgttgcattgtatgg

SEQ ID NO: 8413956 - DNA, 22 bp, Homo sapiens
tgcaataaggagtaatagtaaa

SEQ ID NO: 8413957 - DNA, 22 bp, Homo sapiens
ccatcctgaatggtctcagcca

SEQ ID NO: 8413958 - DNA, 21 bp, Homo sapiens
tgagtctcccttagcccacgc

SEQ ID NO: 8413959 - DNA, 22 bp, Homo sapiens
tgagttttttcaacatatgaag

SEQ ID NO: 8413960 - DNA, 22 bp, Homo sapiens
tgaggccagtgacatatattaa

SEQ ID NO: 8413961 - DNA, 22 bp, Homo sapiens
ccagtgcataatcaatacagcc

SEQ ID NO: 8413962 - DNA, 22 bp, Homo sapiens
tgagcagagacttcaagggcag

SEQ ID NO: 8413963 - DNA, 22 bp, Homo sapiens
ccaggcttccctgagaggctgc

SEQ ID NO: 8413964 - DNA, 22 bp, Homo sapiens
ccaggcttcctaatgtgtgcag

SEQ ID NO: 8413965 - DNA, 22 bp, Homo sapiens
ccaggcttctgattccaggcac

SEQ ID NO: 8413966 - DNA, 22 bp, Homo sapiens
tgaaatgaatgtgattcgatag

SEQ ID NO: 8413967 - DNA, 22 bp, Homo sapiens
tcttttctgtaactcagtgtct

SEQ ID NO: 8413968 - DNA, 22 bp, Homo sapiens
tcttttctggactctgcatgga

SEQ ID NO: 8413969 - DNA, 22 bp, Homo sapiens
tcttttctgccacagcctgagc

SEQ ID NO: 8413970 - DNA, 19 bp, Homo sapiens
ccaggcctctggggcctgt

SEQ ID NO: 8413971 - DNA, 22 bp, Homo sapiens
ccaggcctctggctgcttagtc

SEQ ID NO: 8413972 - DNA, 23 bp, Homo sapiens
ccaggcctctcagagggtgtgcc

SEQ ID NO: 8413973 - DNA, 22 bp, Homo sapiens
tgaaatgagataatttaagtgc

SEQ ID NO: 8413974 - DNA, 22 bp, Homo sapiens
tctgggcctcacctgctgctca

SEQ ID NO: 8413975 - DNA, 22 bp, Homo sapiens
tctgggcctcagtttcttcatc

SEQ ID NO: 8413976 - DNA, 22 bp, Homo sapiens
ccaggagcagagtaggtgttca

SEQ ID NO: 8413977 - DNA, 23 bp, Homo sapiens
tctgtggctccttcaggctgctg

SEQ ID NO: 8413978 - DNA, 23 bp, Homo sapiens
tctgtggctccttcaggctgctg

SEQ ID NO: 8413979 - DNA, 22 bp, Homo sapiens
tctgtggctatcatactgaagg

SEQ ID NO: 8413980 - DNA, 22 bp, Homo sapiens
ccaggaggctcttgtccctggt

SEQ ID NO: 8413981 - DNA, 22 bp, Homo sapiens
ccaggcagagggaatagcaagt

SEQ ID NO: 8413982 - DNA, 22 bp, Homo sapiens
tcttacccggcaacgtgtgtcg

SEQ ID NO: 8413983 - DNA, 22 bp, Homo sapiens
tcttacgaattcttagaggaca

SEQ ID NO: 8413984 - DNA, 19 bp, Homo sapiens
ccaggcctcctgggaggtc

SEQ ID NO: 8413985 - DNA, 22 bp, Homo sapiens
ccaggcaggcgatggtgcagtg

SEQ ID NO: 8413986 - DNA, 22 bp, Homo sapiens
tcttctggatcgatcacattgt

SEQ ID NO: 8413987 - DNA, 22 bp, Homo sapiens
tcttctctgtggcctggtggtg

SEQ ID NO: 8413988 - DNA, 22 bp, Homo sapiens
ctgggccttgcatcccagagcc

SEQ ID NO: 8413989 - DNA, 19 bp, Homo sapiens
ctgtccttggctgcactgt

SEQ ID NO: 8413990 - DNA, 22 bp, Homo sapiens
ctgtatatcatggttttgcagt

SEQ ID NO: 8413991 - DNA, 22 bp, Homo sapiens
ctgtatatggcttactttatat

SEQ ID NO: 8413992 - DNA, 22 bp, Homo sapiens
ctgtatttgtcctctatttatt

SEQ ID NO: 8413993 - DNA, 22 bp, Homo sapiens
ctggtgaccggacctcagtttt

SEQ ID NO: 8413994 - DNA, 22 bp, Homo sapiens
ctggtgcaagattccctgcttc

SEQ ID NO: 8413995 - DNA, 22 bp, Homo sapiens
ctggtgcacgtggctgcagtcg

SEQ ID NO: 8413996 - DNA, 22 bp, Homo sapiens
ctggtgcactacagcctggaac

SEQ ID NO: 8413997 - DNA, 22 bp, Homo sapiens
ctggtgcaggaaggagctggca

SEQ ID NO: 8413998 - DNA, 22 bp, Homo sapiens
ctggtgcatgtggccttgctct

SEQ ID NO: 8413999 - DNA, 22 bp, Homo sapiens
ctgtaaaacactgtagtatctg

SEQ ID NO: 8414000 - DNA, 22 bp, Homo sapiens
ctgtacaagtccttcatcaggg

SEQ ID NO: 8414001 - DNA, 22 bp, Homo sapiens
cttcattggcttccatagatgc

SEQ ID NO: 8414002 - DNA, 19 bp, Homo sapiens
cttatacagattttctcat

SEQ ID NO: 8414003 - DNA, 22 bp, Homo sapiens
cttatacacgaacacaaggtgt

SEQ ID NO: 8414004 - DNA, 22 bp, Homo sapiens
cttataaagtccatctgaacaa

SEQ ID NO: 8414005 - DNA, 22 bp, Homo sapiens
cttagggaattgggaggatgcc

SEQ ID NO: 8414006 - DNA, 22 bp, Homo sapiens
cttagggagaatgcctctgcag

SEQ ID NO: 8414007 - DNA, 22 bp, Homo sapiens
cttagtgaggaatgaatttgtt

SEQ ID NO: 8414008 - DNA, 22 bp, Homo sapiens
cttaggcaagcagagcccatcc

SEQ ID NO: 8414009 - DNA, 22 bp, Homo sapiens
cttagggaatcttagagctgga

SEQ ID NO: 8414010 - DNA, 22 bp, Homo sapiens
cttaggaacgctctgcctagtg

SEQ ID NO: 8414011 - DNA, 22 bp, Homo sapiens
cttagctagtgctcagctgtca

SEQ ID NO: 8414012 - DNA, 22 bp, Homo sapiens
cttagctagaggcaattatgtt

SEQ ID NO: 8414013 - DNA, 22 bp, Homo sapiens
cttctagatttttgtaattgtt

SEQ ID NO: 8414014 - DNA, 22 bp, Homo sapiens
cttctcagaggccagaagctat

SEQ ID NO: 8414015 - DNA, 22 bp, Homo sapiens
cttacattgtgtgcatgagggg

SEQ ID NO: 8414016 - DNA, 22 bp, Homo sapiens
cttagaaataatggtttcagtt

SEQ ID NO: 8414017 - DNA, 22 bp, Homo sapiens
cttagcagaagcttcagcttca

SEQ ID NO: 8414018 - DNA, 22 bp, Homo sapiens
cttagaaatgcagattctcagg

SEQ ID NO: 8414019 - DNA, 22 bp, Homo sapiens
cttagaaatgcagattctcagg

SEQ ID NO: 8414020 - DNA, 22 bp, Homo sapiens
cttacaaaggagaggagatagg

SEQ ID NO: 8414021 - DNA, 22 bp, Homo sapiens
cttacaaaggagaggagatagg

SEQ ID NO: 8414022 - DNA, 22 bp, Homo sapiens
cttaatttaagcctagaatgca

SEQ ID NO: 8414023 - DNA, 22 bp, Homo sapiens
cttaatttaaaatagttcaggc

SEQ ID NO: 8414024 - DNA, 22 bp, Homo sapiens
cttaatttcaaactgctagtga

SEQ ID NO: 8414025 - DNA, 22 bp, Homo sapiens
cttaatttttgtagtagatgga

SEQ ID NO: 8414026 - DNA, 22 bp, Homo sapiens
cttaaattcttaatgccctcat

SEQ ID NO: 8414027 - DNA, 22 bp, Homo sapiens
cttaaattttcatctacaagaa

SEQ ID NO: 8414028 - DNA, 22 bp, Homo sapiens
cttaaattggatgagttaagtt

SEQ ID NO: 8414029 - DNA, 22 bp, Homo sapiens
cttaattacccaatgtggtagg

SEQ ID NO: 8414030 - DNA, 22 bp, Homo sapiens
cttaaaatctggcagttagcta

SEQ ID NO: 8414031 - DNA, 19 bp, Homo sapiens
ctgtttctgagcttgcttt

SEQ ID NO: 8414032 - DNA, 21 bp, Homo sapiens
ctgtttcttgtgaagtgacac

SEQ ID NO: 8414033 - DNA, 22 bp, Homo sapiens
gaaaatgtttcctgttatttgc

SEQ ID NO: 8414034 - DNA, 22 bp, Homo sapiens
gaaaatgtttgtccggagctga

SEQ ID NO: 8414035 - DNA, 22 bp, Homo sapiens
gaaacacatatgaacagttgat

SEQ ID NO: 8414036 - DNA, 22 bp, Homo sapiens
gaaagccatctggctgctggga

SEQ ID NO: 8414037 - DNA, 22 bp, Homo sapiens
ctttgcaagggatttcatgtct

SEQ ID NO: 8414038 - DNA, 21 bp, Homo sapiens
cttttacattcagtcatgatg

SEQ ID NO: 8414039 - DNA, 22 bp, Homo sapiens
cttttacagtggacctgccatt

SEQ ID NO: 8414040 - DNA, 22 bp, Homo sapiens
cttttacatttgttgaagagta

SEQ ID NO: 8414041 - DNA, 22 bp, Homo sapiens
cttttcattgtttgtacatgca

SEQ ID NO: 8414042 - DNA, 22 bp, Homo sapiens
cttttctctgcgggtctttcat

SEQ ID NO: 8414043 - DNA, 22 bp, Homo sapiens
ctttctcttcactgtcatgatc

SEQ ID NO: 8414044 - DNA, 22 bp, Homo sapiens
ctttaacaaatgactcttgtct

SEQ ID NO: 8414045 - DNA, 22 bp, Homo sapiens
ctttaacagttccattcaattt

SEQ ID NO: 8414046 - DNA, 22 bp, Homo sapiens
ctttaagactaaattagagttt

SEQ ID NO: 8414047 - DNA, 22 bp, Homo sapiens
gaggaagaaagcataggtgggg

SEQ ID NO: 8414048 - DNA, 22 bp, Homo sapiens
gaggaaatggttgttcaggtgg

SEQ ID NO: 8414049 - DNA, 22 bp, Homo sapiens
gagaggggcgcgcagctcgcga

SEQ ID NO: 8414050 - DNA, 22 bp, Homo sapiens
gaggcataagtagaagagattg

SEQ ID NO: 8414051 - DNA, 22 bp, Homo sapiens
gaggcataaatcacagtgttca

SEQ ID NO: 8414052 - DNA, 22 bp, Homo sapiens
gaggagcacatgaggctgaggg

SEQ ID NO: 8414053 - DNA, 22 bp, Homo sapiens
gaggctgcagctatcagacatt

SEQ ID NO: 8414054 - DNA, 22 bp, Homo sapiens
gaggctgcaggcaatgctgccc

SEQ ID NO: 8414055 - DNA, 22 bp, Homo sapiens
gagggaggcatcatgaatccag

SEQ ID NO: 8414056 - DNA, 22 bp, Homo sapiens
gagggaggggagctccaccctc

SEQ ID NO: 8414057 - DNA, 22 bp, Homo sapiens
gagggctgctggaaaaatgcag

SEQ ID NO: 8414058 - DNA, 22 bp, Homo sapiens
gagggaggtgatactgaacgta

SEQ ID NO: 8414059 - DNA, 22 bp, Homo sapiens
gaatccagggttgtttgagcta

SEQ ID NO: 8414060 - DNA, 22 bp, Homo sapiens
gaatcatttagctctgcatgga

SEQ ID NO: 8414061 - DNA, 22 bp, Homo sapiens
gaatcattggaaccacatccaa

SEQ ID NO: 8414062 - DNA, 22 bp, Homo sapiens
gaagggcttggctgggaggcca

SEQ ID NO: 8414063 - DNA, 22 bp, Homo sapiens
gaaggggaaagttgagcaaata

SEQ ID NO: 8414064 - DNA, 22 bp, Homo sapiens
gacagacaggaggcattcaggg

SEQ ID NO: 8414065 - DNA, 22 bp, Homo sapiens
gacagacacaattgatccatga

SEQ ID NO: 8414066 - DNA, 22 bp, Homo sapiens
gaatgaagcaggtcacacagtt

SEQ ID NO: 8414067 - DNA, 22 bp, Homo sapiens
gaatgaataggtgtccagatgg

SEQ ID NO: 8414068 - DNA, 22 bp, Homo sapiens
gaatgaattcagcacatggaat

SEQ ID NO: 8414069 - DNA, 22 bp, Homo sapiens
gaatgacattgaaaagacattg

SEQ ID NO: 8414070 - DNA, 22 bp, Homo sapiens
gaatgatatattagcagatttt

SEQ ID NO: 8414071 - DNA, 22 bp, Homo sapiens
gaagccaagccagctgatggag

SEQ ID NO: 8414072 - DNA, 22 bp, Homo sapiens
gaagccaacattccaagtagaa

SEQ ID NO: 8414073 - DNA, 18 bp, Homo sapiens
gaaaggagagacagtagg

SEQ ID NO: 8414074 - DNA, 22 bp, Homo sapiens
gaaggcatcacagaggctgtgg

SEQ ID NO: 8414075 - DNA, 22 bp, Homo sapiens
gaaggcatcacagaggctgtga

SEQ ID NO: 8414076 - DNA, 22 bp, Homo sapiens
gacattcaggtgttcaatgcca

SEQ ID NO: 8414077 - DNA, 22 bp, Homo sapiens
gacattcagccaattactttct

SEQ ID NO: 8414078 - DNA, 22 bp, Homo sapiens
gacattcattgatgtcttcctc

SEQ ID NO: 8414079 - DNA, 19 bp, Homo sapiens
gacattcctgacactggct

SEQ ID NO: 8414080 - DNA, 22 bp, Homo sapiens
gacattcattaagcctttctgt

SEQ ID NO: 8414081 - DNA, 22 bp, Homo sapiens
gacagagattgaatcaggaaat

SEQ ID NO: 8414082 - DNA, 22 bp, Homo sapiens
gacagagaggctgagcagtaca

SEQ ID NO: 8414083 - DNA, 22 bp, Homo sapiens
gacagacatttcctgatccaat

SEQ ID NO: 8414084 - DNA, 22 bp, Homo sapiens
gactgaggaggtaaggtttgaa

SEQ ID NO: 8414085 - DNA, 22 bp, Homo sapiens
gactgccagaatgtgaggcctg

SEQ ID NO: 8414086 - DNA, 22 bp, Homo sapiens
gagaaactgaatatttaacggg

SEQ ID NO: 8414087 - DNA, 22 bp, Homo sapiens
gagactgcatagatggccacaa

SEQ ID NO: 8414088 - DNA, 22 bp, Homo sapiens
gagagaaaggcttgcaggctgt

SEQ ID NO: 8414089 - DNA, 22 bp, Homo sapiens
ctgcaggggctggagttggctt

SEQ ID NO: 8414090 - DNA, 17 bp, Homo sapiens
ctgctggctggggcttg

SEQ ID NO: 8414091 - DNA, 22 bp, Homo sapiens
ctgcctgcatgctgccatagct

SEQ ID NO: 8414092 - DNA, 19 bp, Homo sapiens
tttttacaagtaggtgtga

SEQ ID NO: 8414093 - DNA, 22 bp, Homo sapiens
ctgaaaaacgggatttggctgg

SEQ ID NO: 8414094 - DNA, 22 bp, Homo sapiens
ctgaaaaatatgttttggagaa

SEQ ID NO: 8414095 - DNA, 22 bp, Homo sapiens
ctgaaaatgttacacaggaaga

SEQ ID NO: 8414096 - DNA, 22 bp, Homo sapiens
ctgaaggattagagagcactta

SEQ ID NO: 8414097 - DNA, 22 bp, Homo sapiens
ctgaaggagaaggccactgttc

SEQ ID NO: 8414098 - DNA, 22 bp, Homo sapiens
ctgagatctttatacgaggcac

SEQ ID NO: 8414099 - DNA, 22 bp, Homo sapiens
ctgaggaagacagcagctgtgt

SEQ ID NO: 8414100 - DNA, 19 bp, Homo sapiens
ctctggagcagacactgga

SEQ ID NO: 8414101 - DNA, 22 bp, Homo sapiens
tttcttatactatattgtcatc

SEQ ID NO: 8414102 - DNA, 22 bp, Homo sapiens
tttcttaggctctaaaatgact

SEQ ID NO: 8414103 - DNA, 22 bp, Homo sapiens
tttcttagcgatgcttgataaa

SEQ ID NO: 8414104 - DNA, 21 bp, Homo sapiens
ctctgctgtctaccagctgtt

SEQ ID NO: 8414105 - DNA, 22 bp, Homo sapiens
ctctgctgctttgccagtggaa

SEQ ID NO: 8414106 - DNA, 22 bp, Homo sapiens
ctctgaggtcctacagtgaccc

SEQ ID NO: 8414107 - DNA, 22 bp, Homo sapiens
ctctgagggtctaaggagtcac

SEQ ID NO: 8414108 - DNA, 22 bp, Homo sapiens
ctctgagggctcgagggacgcg

SEQ ID NO: 8414109 - DNA, 22 bp, Homo sapiens
ctctctggcccatcctgttgcc

SEQ ID NO: 8414110 - DNA, 22 bp, Homo sapiens
ctctctggcacttcattgctgt

SEQ ID NO: 8414111 - DNA, 22 bp, Homo sapiens
ctctctggatatttgtatgctg

SEQ ID NO: 8414112 - DNA, 22 bp, Homo sapiens
tttctctctggccctgattgtc

SEQ ID NO: 8414113 - DNA, 22 bp, Homo sapiens
tttctctcttaaggagtttaaa

SEQ ID NO: 8414114 - DNA, 22 bp, Homo sapiens
tttctctctgactgggagctga

SEQ ID NO: 8414115 - DNA, 22 bp, Homo sapiens
ctctaggggctggtcagcgtct

SEQ ID NO: 8414116 - DNA, 22 bp, Homo sapiens
ctctagggctctgtgaggttgg

SEQ ID NO: 8414117 - DNA, 22 bp, Homo sapiens
tttcaaataccataaacctaat

SEQ ID NO: 8414118 - DNA, 22 bp, Homo sapiens
tttcaaataccataaacctaat

SEQ ID NO: 8414119 - DNA, 22 bp, Homo sapiens
tttcaaataccataaacctaat

SEQ ID NO: 8414120 - DNA, 22 bp, Homo sapiens
tttcaaatgcatgtctttcctc

SEQ ID NO: 8414121 - DNA, 22 bp, Homo sapiens
tttcaaatagaatctttccaaa

SEQ ID NO: 8414122 - DNA, 22 bp, Homo sapiens
tttcaaatagaatctttccaaa

SEQ ID NO: 8414123 - DNA, 22 bp, Homo sapiens
ctctaatactgaccaagtcacc

SEQ ID NO: 8414124 - DNA, 22 bp, Homo sapiens
ctcctgtgaggcttaagcccag

SEQ ID NO: 8414125 - DNA, 22 bp, Homo sapiens
tttacacaaaagatagcacacc

SEQ ID NO: 8414126 - DNA, 22 bp, Homo sapiens
tttacacaaaatgttagtagat

SEQ ID NO: 8414127 - DNA, 22 bp, Homo sapiens
ttgtttcaaatatttcagaata

SEQ ID NO: 8414128 - DNA, 22 bp, Homo sapiens
ctccccagccctggtattctga

SEQ ID NO: 8414129 - DNA, 22 bp, Homo sapiens
ttctacatatatttttctcact

SEQ ID NO: 8414130 - DNA, 22 bp, Homo sapiens
ttctacagaataaatgtttaca

SEQ ID NO: 8414131 - DNA, 23 bp, Homo sapiens
ttctacagcttcttcagttaagg

SEQ ID NO: 8414132 - DNA, 22 bp, Homo sapiens
ttctacatgagaaaatgtattt

SEQ ID NO: 8414133 - DNA, 22 bp, Homo sapiens
ttctacctaccctctgcataca

SEQ ID NO: 8414134 - DNA, 19 bp, Homo sapiens
ttctaccttactgtaggct

SEQ ID NO: 8414135 - DNA, 22 bp, Homo sapiens
ctacataatctggatttgtctg

SEQ ID NO: 8414136 - DNA, 22 bp, Homo sapiens
ctacataaatatttatgtgtct

SEQ ID NO: 8414137 - DNA, 22 bp, Homo sapiens
ctagtttaaagcagctgaaagg

SEQ ID NO: 8414138 - DNA, 22 bp, Homo sapiens
ctagttctagatccctgaggaa

SEQ ID NO: 8414139 - DNA, 22 bp, Homo sapiens
ctagtgagtctgaatgagttgc

SEQ ID NO: 8414140 - DNA, 22 bp, Homo sapiens
ttctcagtgaagtttagaacat

SEQ ID NO: 8414141 - DNA, 22 bp, Homo sapiens
ttctcatggtgtctttatacat

SEQ ID NO: 8414142 - DNA, 19 bp, Homo sapiens
ttccaccatcactctgttt

SEQ ID NO: 8414143 - DNA, 20 bp, Homo sapiens
cgggacactcaagctctggg

SEQ ID NO: 8414144 - DNA, 23 bp, Homo sapiens
ttcagggcctcagaggtgaagct

SEQ ID NO: 8414145 - DNA, 22 bp, Homo sapiens
ttcttcatgggttcttttagga

SEQ ID NO: 8414146 - DNA, 20 bp, Homo sapiens
ttcttaaagacctcactttg

SEQ ID NO: 8414147 - DNA, 22 bp, Homo sapiens
ttcttaaagaggcaaaacacag

SEQ ID NO: 8414148 - DNA, 22 bp, Homo sapiens
ttcttaagcgtatgataatgaa

SEQ ID NO: 8414149 - DNA, 22 bp, Homo sapiens
ttcttaagtcagtaagatgcaa

SEQ ID NO: 8414150 - DNA, 22 bp, Homo sapiens
ttcttacaagtattccaggtcc

SEQ ID NO: 8414151 - DNA, 22 bp, Homo sapiens
ttctgaaaggcaggttgtttgc

SEQ ID NO: 8414152 - DNA, 22 bp, Homo sapiens
ttgctgggtgctattatgaaca

SEQ ID NO: 8414153 - DNA, 22 bp, Homo sapiens
ttgctgatttgtttctattcca

SEQ ID NO: 8414154 - DNA, 22 bp, Homo sapiens
ttgctgatctgaaacgttactg

SEQ ID NO: 8414155 - DNA, 22 bp, Homo sapiens
ttgctgatctgtgaatcagcca

SEQ ID NO: 8414156 - DNA, 22 bp, Homo sapiens
ttgctgatgcccttgtccaggc

SEQ ID NO: 8414157 - DNA, 22 bp, Homo sapiens
ttgctgatggtattatgctagt

SEQ ID NO: 8414158 - DNA, 22 bp, Homo sapiens
ttgctgattcatgatttgagaa

SEQ ID NO: 8414159 - DNA, 22 bp, Homo sapiens
ttgcctattgttcttacatgtt

SEQ ID NO: 8414160 - DNA, 22 bp, Homo sapiens
ttgcactccagcccgagcaaca

SEQ ID NO: 8414161 - DNA, 22 bp, Homo sapiens
ttacctaaaatagctcaattta

SEQ ID NO: 8414162 - DNA, 21 bp, Homo sapiens
cctttacaattttgcattcct

SEQ ID NO: 8414163 - DNA, 22 bp, Homo sapiens
cgcaacagagcaggtttgatga

SEQ ID NO: 8414164 - DNA, 22 bp, Homo sapiens
cgcaacagcgtggcgcccagct

SEQ ID NO: 8414165 - DNA, 22 bp, Homo sapiens
cgcaccactgaattccagcctg

SEQ ID NO: 8414166 - DNA, 22 bp, Homo sapiens
cgcaccactgaattccagcctg

SEQ ID NO: 8414167 - DNA, 22 bp, Homo sapiens
ttatgggagcaattggggaggt

SEQ ID NO: 8414168 - DNA, 22 bp, Homo sapiens
cctttgatttcccccgtctcag

SEQ ID NO: 8414169 - DNA, 17 bp, Homo sapiens
ttattttttgggctgag

SEQ ID NO: 8414170 - DNA, 17 bp, Homo sapiens
ttattttttgggctgag

SEQ ID NO: 8414171 - DNA, 22 bp, Homo sapiens
ttatttttaaaagttcacacag

SEQ ID NO: 8414172 - DNA, 22 bp, Homo sapiens
ttatttttaaaagttcacacag

SEQ ID NO: 8414173 - DNA, 18 bp, Homo sapiens
ttattcagacgcatatga

SEQ ID NO: 8414174 - DNA, 22 bp, Homo sapiens
tgtttctaggtcaataattttt

SEQ ID NO: 8414175 - DNA, 22 bp, Homo sapiens
tgtttctagagaaaatatttac

SEQ ID NO: 8414176 - DNA, 17 bp, Homo sapiens
tgttttcattcattgct

SEQ ID NO: 8414177 - DNA, 22 bp, Homo sapiens
tgttttcatttgatgtaacaaa

SEQ ID NO: 8414178 - DNA, 20 bp, Homo sapiens
tgtttctgacggtaggagag

SEQ ID NO: 8414179 - DNA, 22 bp, Homo sapiens
tgttgatttgtgggctgcaaaa

SEQ ID NO: 8414180 - DNA, 22 bp, Homo sapiens
tggttcctcaagcgctggcggc

SEQ ID NO: 8414181 - DNA, 22 bp, Homo sapiens
tggttcagagagttgctgacca

SEQ ID NO: 8414182 - DNA, 22 bp, Homo sapiens
tggttcagatatggagctggga

SEQ ID NO: 8414183 - DNA, 22 bp, Homo sapiens
tggttcagttgcacaggctgtt

SEQ ID NO: 8414184 - DNA, 20 bp, Homo sapiens
cctgtggctcttgtaattca

SEQ ID NO: 8414185 - DNA, 22 bp, Homo sapiens
cctgtggctgccacttgggtga

SEQ ID NO: 8414186 - DNA, 18 bp, Homo sapiens
cctgtggctcagcccaca

SEQ ID NO: 8414187 - DNA, 22 bp, Homo sapiens
cctgtggctctctttggaggtc

SEQ ID NO: 8414188 - DNA, 22 bp, Homo sapiens
cctgtggcgggggccagtgcct

SEQ ID NO: 8414189 - DNA, 22 bp, Homo sapiens
cctgtggcctgaatttggtaaa

SEQ ID NO: 8414190 - DNA, 22 bp, Homo sapiens
cctgtggctggtcaggccagca

SEQ ID NO: 8414191 - DNA, 22 bp, Homo sapiens
cctgtggctgccccgctgttgg

SEQ ID NO: 8414192 - DNA, 22 bp, Homo sapiens
cctgtggctggtagtatcgttt

SEQ ID NO: 8414193 - DNA, 22 bp, Homo sapiens
ttacaatagttccttcttttgt

SEQ ID NO: 8414194 - DNA, 22 bp, Homo sapiens
ttacaagttcagattttctcat

SEQ ID NO: 8414195 - DNA, 22 bp, Homo sapiens
cctgtggccgcgtcgggcggcg

SEQ ID NO: 8414196 - DNA, 19 bp, Homo sapiens
cctgtggcagagtggaaac

SEQ ID NO: 8414197 - DNA, 22 bp, Homo sapiens
cctgtggcacatgcagggattc

SEQ ID NO: 8414198 - DNA, 23 bp, Homo sapiens
cctgtggcaagtagatgagatga

SEQ ID NO: 8414199 - DNA, 22 bp, Homo sapiens
ttaatgacctagagcagtaatt

SEQ ID NO: 8414200 - DNA, 22 bp, Homo sapiens
ttaatgacatcataggtgaagt

SEQ ID NO: 8414201 - DNA, 22 bp, Homo sapiens
ttaagcatttattatgtgccag

SEQ ID NO: 8414202 - DNA, 22 bp, Homo sapiens
gtaacagaaagtcatgctcatt

SEQ ID NO: 8414203 - DNA, 22 bp, Homo sapiens
gtaatagtctcaaactcctgga

SEQ ID NO: 8414204 - DNA, 22 bp, Homo sapiens
gtaatctcagctacttgggagg

SEQ ID NO: 8414205 - DNA, 22 bp, Homo sapiens
gtaatctcagctacttgggagg

SEQ ID NO: 8414206 - DNA, 22 bp, Homo sapiens
ggtgggcagctcttggcaggca

SEQ ID NO: 8414207 - DNA, 22 bp, Homo sapiens
gtagccattggcaatgaagcct

SEQ ID NO: 8414208 - DNA, 22 bp, Homo sapiens
gtagctctgtttaaagttcttt

SEQ ID NO: 8414209 - DNA, 22 bp, Homo sapiens
gtcattttatgggaacagattt

SEQ ID NO: 8414210 - DNA, 17 bp, Homo sapiens
gtcaatattgttgacag

SEQ ID NO: 8414211 - DNA, 22 bp, Homo sapiens
gtcaatatcttggttgtactat

SEQ ID NO: 8414212 - DNA, 22 bp, Homo sapiens
gtcaatataggtttcaaacatg

SEQ ID NO: 8414213 - DNA, 19 bp, Homo sapiens
gtcacatttgtctcccagg

SEQ ID NO: 8414214 - DNA, 22 bp, Homo sapiens
gtcagttattcaattggtttaa

SEQ ID NO: 8414215 - DNA, 22 bp, Homo sapiens
gtcagttacagccacggcgggt

SEQ ID NO: 8414216 - DNA, 22 bp, Homo sapiens
gtcagttattttgagcaattgg

SEQ ID NO: 8414217 - DNA, 22 bp, Homo sapiens
gtgatccgatgtcagtcgcaga

SEQ ID NO: 8414218 - DNA, 22 bp, Homo sapiens
gtgaggtgcctaataccgtgac

SEQ ID NO: 8414219 - DNA, 22 bp, Homo sapiens
gtgaggtctttgggaggtgatt

SEQ ID NO: 8414220 - DNA, 22 bp, Homo sapiens
gtcttagatttcaccgataatg

SEQ ID NO: 8414221 - DNA, 22 bp, Homo sapiens
gtcttagatttcaccgataatg

SEQ ID NO: 8414222 - DNA, 23 bp, Homo sapiens
gtctctagagtgtggagcaaaga

SEQ ID NO: 8414223 - DNA, 22 bp, Homo sapiens
gtgcccaggggccagctgccgg

SEQ ID NO: 8414224 - DNA, 18 bp, Homo sapiens
gtgcaatgaatagcagag

SEQ ID NO: 8414225 - DNA, 22 bp, Homo sapiens
gtgcaatattgccatgttcttg

SEQ ID NO: 8414226 - DNA, 22 bp, Homo sapiens
gtgcaatagactgtggtattaa

SEQ ID NO: 8414227 - DNA, 22 bp, Homo sapiens
gtgcaataaataaatagattgt

SEQ ID NO: 8414228 - DNA, 22 bp, Homo sapiens
gtgcaaggtacatccttgatgt

SEQ ID NO: 8414229 - DNA, 22 bp, Homo sapiens
ggtaggagtattttgcagcagt

SEQ ID NO: 8414230 - DNA, 22 bp, Homo sapiens
ggtaacaaggccgatagaaaca

SEQ ID NO: 8414231 - DNA, 22 bp, Homo sapiens
ggtccagtcctgctcaccactt

SEQ ID NO: 8414232 - DNA, 22 bp, Homo sapiens
ggtgcatggaaagagtaagtaa

SEQ ID NO: 8414233 - DNA, 22 bp, Homo sapiens
ggtgcatggtggaggtgaccct

SEQ ID NO: 8414234 - DNA, 22 bp, Homo sapiens
ggtgcatgtagccatcaagata

SEQ ID NO: 8414235 - DNA, 22 bp, Homo sapiens
ggtgccactgcactctggcctg

SEQ ID NO: 8414236 - DNA, 23 bp, Homo sapiens
gggctccagtctctgctcagttg

SEQ ID NO: 8414237 - DNA, 22 bp, Homo sapiens
gggctccacctagggacactgg

SEQ ID NO: 8414238 - DNA, 22 bp, Homo sapiens
gggctctcaaggcagggcccca

SEQ ID NO: 8414239 - DNA, 22 bp, Homo sapiens
gggctctcgattagaccctggg

SEQ ID NO: 8414240 - DNA, 22 bp, Homo sapiens
ggatgcaggaacacagcgacct

SEQ ID NO: 8414241 - DNA, 22 bp, Homo sapiens
ggatctgttttgcctctgaggg

SEQ ID NO: 8414242 - DNA, 22 bp, Homo sapiens
ggatctttaagttcttttccat

SEQ ID NO: 8414243 - DNA, 22 bp, Homo sapiens
ggagcacaccgggagcttgcct

SEQ ID NO: 8414244 - DNA, 22 bp, Homo sapiens
ggatttcttccttcctcagaag

SEQ ID NO: 8414245 - DNA, 21 bp, Homo sapiens
ggattttaaaaactgcacctg

SEQ ID NO: 8414246 - DNA, 22 bp, Homo sapiens
ggcactgggtgagggtcactgg

SEQ ID NO: 8414247 - DNA, 22 bp, Homo sapiens
ggcatccaaataccaagatgta

SEQ ID NO: 8414248 - DNA, 19 bp, Homo sapiens
ggcatccacgaatgcagag

SEQ ID NO: 8414249 - DNA, 19 bp, Homo sapiens
ggcatccagaactaccagt

SEQ ID NO: 8414250 - DNA, 22 bp, Homo sapiens
ggcatccagttctgatcaacaa

SEQ ID NO: 8414251 - DNA, 18 bp, Homo sapiens
ggcgggtgttttattcac

SEQ ID NO: 8414252 - DNA, 22 bp, Homo sapiens
ggctttattttgcatgaatgct

SEQ ID NO: 8414253 - DNA, 22 bp, Homo sapiens
ggctttctatgaactcaaaggc

SEQ ID NO: 8414254 - DNA, 22 bp, Homo sapiens
ggctttgccctggactgaggca

SEQ ID NO: 8414255 - DNA, 22 bp, Homo sapiens
ggctttgcaaaatcggcttctg

SEQ ID NO: 8414256 - DNA, 22 bp, Homo sapiens
ggctttatagggtagaggatca

SEQ ID NO: 8414257 - DNA, 22 bp, Homo sapiens
ggctttatattgtttgagcaga

SEQ ID NO: 8414258 - DNA, 22 bp, Homo sapiens
ggctttatcaaatgagaccctg

SEQ ID NO: 8414259 - DNA, 22 bp, Homo sapiens
ggctttatgcacagcagatggt

SEQ ID NO: 8414260 - DNA, 22 bp, Homo sapiens
ggctttatgcagggatagaaat

SEQ ID NO: 8414261 - DNA, 22 bp, Homo sapiens
ggctttattaagcagggtaagt

SEQ ID NO: 8414262 - DNA, 22 bp, Homo sapiens
ggctttattaactcatccgtaa

SEQ ID NO: 8414263 - DNA, 22 bp, Homo sapiens
ggctttatgtttttcatgtggt

SEQ ID NO: 8414264 - DNA, 21 bp, Homo sapiens
ggctttatgctcacccagcct

SEQ ID NO: 8414265 - DNA, 22 bp, Homo sapiens
ggctttatttgcagccattgtt

SEQ ID NO: 8414266 - DNA, 22 bp, Homo sapiens
ggctttatttcactgtaccata

SEQ ID NO: 8414267 - DNA, 22 bp, Homo sapiens
ggctttattatgtggccatgtg

SEQ ID NO: 8414268 - DNA, 22 bp, Homo sapiens
gggagctggagctggaagactc

SEQ ID NO: 8414269 - DNA, 22 bp, Homo sapiens
gggagctgagctggaagagaat

SEQ ID NO: 8414270 - DNA, 22 bp, Homo sapiens
gggaggtgatggcaagcagcgg

SEQ ID NO: 8414271 - DNA, 22 bp, Homo sapiens
gggagggattagttctgcctgg

SEQ ID NO: 8414272 - DNA, 21 bp, Homo sapiens
gggagggatggaaatgatgtt

SEQ ID NO: 8414273 - DNA, 22 bp, Homo sapiens
gggaggttgaggctgcagtgag

SEQ ID NO: 8414274 - DNA, 22 bp, Homo sapiens
gggaggttgaggctgcagtgag

SEQ ID NO: 8414275 - DNA, 22 bp, Homo sapiens
gggaggttctgttcgcacttga

SEQ ID NO: 8414276 - DNA, 22 bp, Homo sapiens
gggagggaggtgatgcttggct

SEQ ID NO: 8414277 - DNA, 22 bp, Homo sapiens
gggagggaggtgctggttcacg

SEQ ID NO: 8414278 - DNA, 16 bp, Homo sapiens
gggagggagttggtgg

SEQ ID NO: 8414279 - DNA, 22 bp, Homo sapiens
gggagggatctgctaggcaatg

SEQ ID NO: 8414280 - DNA, 22 bp, Homo sapiens
gggagggatctgctaggcaatg

SEQ ID NO: 8414281 - DNA, 22 bp, Homo sapiens
gggagggacacaaagagttccc

SEQ ID NO: 8414282 - DNA, 22 bp, Homo sapiens
gggagggagaggacagttctat

SEQ ID NO: 8414283 - DNA, 22 bp, Homo sapiens
ggctactgtgatggtctgcaag

SEQ ID NO: 8414284 - DNA, 22 bp, Homo sapiens
ggctagatggtatataaggatg

SEQ ID NO: 8414285 - DNA, 22 bp, Homo sapiens
ggctcccacccatagggcgagt

SEQ ID NO: 8414286 - DNA, 22 bp, Homo sapiens
ggctcccaggagggcctggagg

SEQ ID NO: 8414287 - DNA, 22 bp, Homo sapiens
ggctccctgcctgtcctcagtc

SEQ ID NO: 8414288 - DNA, 22 bp, Homo sapiens
ggctctggttgaccatgatggc

SEQ ID NO: 8414289 - DNA, 22 bp, Homo sapiens
ggctctgggtctgtggggagcg

SEQ ID NO: 8414290 - DNA, 22 bp, Homo sapiens
ggctcctgaggaccaggcacag

SEQ ID NO: 8414291 - DNA, 22 bp, Homo sapiens
ggctcctgagaatgggccatca

SEQ ID NO: 8414292 - DNA, 22 bp, Homo sapiens
ggctctgggcctccaaggtctg

SEQ ID NO: 8414293 - DNA, 18 bp, Homo sapiens
ggctgaggttgactagaa

SEQ ID NO: 8414294 - DNA, 22 bp, Homo sapiens
ggctgagggttaagatcagaca

SEQ ID NO: 8414295 - DNA, 18 bp, Homo sapiens
ggctgcttaaggagatcc

SEQ ID NO: 8414296 - DNA, 22 bp, Homo sapiens
gcccagtttcagctctgccttt

SEQ ID NO: 8414297 - DNA, 22 bp, Homo sapiens
gcctacatttcccagttgaatg

SEQ ID NO: 8414298 - DNA, 22 bp, Homo sapiens
gcctacatgcttttagtgtttc

SEQ ID NO: 8414299 - DNA, 22 bp, Homo sapiens
gcccagagagatgctgtagacc

SEQ ID NO: 8414300 - DNA, 23 bp, Homo sapiens
gcccagagaggctcaccaggaat

SEQ ID NO: 8414301 - DNA, 22 bp, Homo sapiens
gccaggcacagttctaggtgct

SEQ ID NO: 8414302 - DNA, 23 bp, Homo sapiens
gccaggcacatggtggacacgca

SEQ ID NO: 8414303 - DNA, 22 bp, Homo sapiens
gccaggcaatgtgttagaagcg

SEQ ID NO: 8414304 - DNA, 22 bp, Homo sapiens
gccaggcaaattaaggaatgca

SEQ ID NO: 8414305 - DNA, 22 bp, Homo sapiens
gccagcagtcctgctgtgtgcc

SEQ ID NO: 8414306 - DNA, 22 bp, Homo sapiens
gccaaggataccagctgtgaga

SEQ ID NO: 8414307 - DNA, 21 bp, Homo sapiens
gccaaggaggctagagaacat

SEQ ID NO: 8414308 - DNA, 20 bp, Homo sapiens
gccaaggaggagaaacaggc

SEQ ID NO: 8414309 - DNA, 22 bp, Homo sapiens
gccaaggaaggcttcctggaag

SEQ ID NO: 8414310 - DNA, 22 bp, Homo sapiens
gccaaggagacacggtgttgta

SEQ ID NO: 8414311 - DNA, 22 bp, Homo sapiens
gccaagctcaccttctgatgga

SEQ ID NO: 8414312 - DNA, 22 bp, Homo sapiens
gcagggctcaacaggacacccc

SEQ ID NO: 8414313 - DNA, 22 bp, Homo sapiens
gcagggctcaacaggacacccc

SEQ ID NO: 8414314 - DNA, 22 bp, Homo sapiens
gcagggctccactgtggccaag

SEQ ID NO: 8414315 - DNA, 22 bp, Homo sapiens
gcagggctcattgccaggcatt

SEQ ID NO: 8414316 - DNA, 22 bp, Homo sapiens
gcagggctctgctgtagtccta

SEQ ID NO: 8414317 - DNA, 22 bp, Homo sapiens
gcagtatgagtgttttagacat

SEQ ID NO: 8414318 - DNA, 22 bp, Homo sapiens
gcagtcagacaggaggagctcc

SEQ ID NO: 8414319 - DNA, 22 bp, Homo sapiens
gcagtcagtgttgactacatgc

SEQ ID NO: 8414320 - DNA, 22 bp, Homo sapiens
gcagtccaaagtggctctcacc

SEQ ID NO: 8414321 - DNA, 22 bp, Homo sapiens
gcatctaaacttgcatcattgt

SEQ ID NO: 8414322 - DNA, 22 bp, Homo sapiens
gcatctaaatcactttaatgta

SEQ ID NO: 8414323 - DNA, 22 bp, Homo sapiens
gcatctaaggtggataacttct

SEQ ID NO: 8414324 - DNA, 22 bp, Homo sapiens
gcatccaaatgtttcatttctt

SEQ ID NO: 8414325 - DNA, 22 bp, Homo sapiens
gcatccaaatgtttcatttctt

SEQ ID NO: 8414326 - DNA, 20 bp, Homo sapiens
gcatccagacacccagctgc

SEQ ID NO: 8414327 - DNA, 17 bp, Homo sapiens
gcatccagtaacatgcc

SEQ ID NO: 8414328 - DNA, 22 bp, Homo sapiens
gcacagctcgagctcaggaggg

SEQ ID NO: 8414329 - DNA, 22 bp, Homo sapiens
gcaagcagcccagaacagctct

SEQ ID NO: 8414330 - DNA, 22 bp, Homo sapiens
gcaaatgaaggtggtgctacag

SEQ ID NO: 8414331 - DNA, 22 bp, Homo sapiens
gagggtcagaagggcctggttc

SEQ ID NO: 8414332 - DNA, 22 bp, Homo sapiens
gcaagagcgctctctttcatta

SEQ ID NO: 8414333 - DNA, 22 bp, Homo sapiens
gcacttatgctcaccttgttct

SEQ ID NO: 8414334 - DNA, 22 bp, Homo sapiens
gcacttcatgactttgtcaaat

SEQ ID NO: 8414335 - DNA, 22 bp, Homo sapiens
gcacttcacatgccttttcctg

SEQ ID NO: 8414336 - DNA, 17 bp, Homo sapiens
gcactgaacaatcctgt

SEQ ID NO: 8414337 - DNA, 22 bp, Homo sapiens
gcactggaaatacctagatgaa

SEQ ID NO: 8414338 - DNA, 22 bp, Homo sapiens
gcactggagatacagagatgaa

SEQ ID NO: 8414339 - DNA, 22 bp, Homo sapiens
gcactgatgcaaaaatcactca

SEQ ID NO: 8414340 - DNA, 22 bp, Homo sapiens
gcagggctaatggggcaagtag

SEQ ID NO: 8414341 - DNA, 22 bp, Homo sapiens
gcagggctagatatttgcaagt

SEQ ID NO: 8414342 - DNA, 22 bp, Homo sapiens
gcagggctattggaaggagatg

SEQ ID NO: 8414343 - DNA, 22 bp, Homo sapiens
gcagggctaggtcttctagggc

SEQ ID NO: 8414344 - DNA, 22 bp, Homo sapiens
gcgactgtacagaattgcccct

SEQ ID NO: 8414345 - DNA, 22 bp, Homo sapiens
gctcaatgctcaatgctgcaaa

SEQ ID NO: 8414346 - DNA, 22 bp, Homo sapiens
gctcaagccttctgcccacctc

SEQ ID NO: 8414347 - DNA, 22 bp, Homo sapiens
gccttaggggtcagacagagct

SEQ ID NO: 8414348 - DNA, 22 bp, Homo sapiens
gctgatggcttgctggctgaca

SEQ ID NO: 8414349 - DNA, 22 bp, Homo sapiens
gctgatgtttagttgatgttac

SEQ ID NO: 8414350 - DNA, 22 bp, Homo sapiens
gctgccaggggcagctgtctca

SEQ ID NO: 8414351 - DNA, 22 bp, Homo sapiens
gctcctggtgctgtagagattt

SEQ ID NO: 8414352 - DNA, 22 bp, Homo sapiens
gctctcactttaggttggaccg

SEQ ID NO: 8414353 - DNA, 22 bp, Homo sapiens
gctctcagggtgatggcatact

SEQ ID NO: 8414354 - DNA, 22 bp, Homo sapiens
gctctgctaatattgtagtacc

SEQ ID NO: 8414355 - DNA, 22 bp, Homo sapiens
gctgtgcccagctccagctctg

SEQ ID NO: 8414356 - DNA, 22 bp, Homo sapiens
gctgtcttggaaaaggcaaaga

SEQ ID NO: 8414357 - DNA, 22 bp, Homo sapiens
gctgtcttgggtagaaagaggt

SEQ ID NO: 8414358 - DNA, 22 bp, Homo sapiens
gctgtcttgctcactcttgcag

SEQ ID NO: 8414359 - DNA, 22 bp, Homo sapiens
gctgtcttttcctggcagtaaa

SEQ ID NO: 8414360 - DNA, 22 bp, Homo sapiens
gctgtctttcccctgctccaga

SEQ ID NO: 8414361 - DNA, 22 bp, Homo sapiens
gctgtcttgtatgttgtaggac

SEQ ID NO: 8414362 - DNA, 22 bp, Homo sapiens
gctgtcttcacttcctggtttc

SEQ ID NO: 8414363 - DNA, 22 bp, Homo sapiens
gctgtcttgatgattggatgct

SEQ ID NO: 8414364 - DNA, 22 bp, Homo sapiens
gctgtcttccttgctccaaggg

SEQ ID NO: 8414365 - DNA, 22 bp, Homo sapiens
ggacctgctctcccagttctct

SEQ ID NO: 8414366 - DNA, 22 bp, Homo sapiens
ggacctgccctggctcagatgc

SEQ ID NO: 8414367 - DNA, 22 bp, Homo sapiens
ggactcctctagaagttgaggc

SEQ ID NO: 8414368 - DNA, 22 bp, Homo sapiens
ggagagctggtagctggctcca

SEQ ID NO: 8414369 - DNA, 22 bp, Homo sapiens
ggagagctggtatatgaagaca

SEQ ID NO: 8414370 - DNA, 22 bp, Homo sapiens
ggacctgccagaactcaggcta

SEQ ID NO: 8414371 - DNA, 22 bp, Homo sapiens
ggacctgcattttaacaagatc

SEQ ID NO: 8414372 - DNA, 22 bp, Homo sapiens
ggacctgaacataaaacgaggc

SEQ ID NO: 8414373 - DNA, 22 bp, Homo sapiens
gcttcctaaatgcacagggcag

SEQ ID NO: 8414374 - DNA, 22 bp, Homo sapiens
gcttcctggaacaactgttgct

SEQ ID NO: 8414375 - DNA, 20 bp, Homo sapiens
tatttgtatttgggaaagtt

SEQ ID NO: 8414376 - DNA, 22 bp, Homo sapiens
tattttcaccttctctggatat

SEQ ID NO: 8414377 - DNA, 22 bp, Homo sapiens
tattttcaccttctctggatat

SEQ ID NO: 8414378 - DNA, 22 bp, Homo sapiens
tattttcatcttgtccttggat

SEQ ID NO: 8414379 - DNA, 22 bp, Homo sapiens
tattttcatcttgtccttggat

SEQ ID NO: 8414380 - DNA, 22 bp, Homo sapiens
tattttcattctgtgtgactgt

SEQ ID NO: 8414381 - DNA, 22 bp, Homo sapiens
tattttcattctgtgtgactgt

SEQ ID NO: 8414382 - DNA, 22 bp, Homo sapiens
tatttgtatgtgtgtacatata

SEQ ID NO: 8414383 - DNA, 22 bp, Homo sapiens
tatttctaagagatatctgtac

SEQ ID NO: 8414384 - DNA, 22 bp, Homo sapiens
tatttcccagggagcaacaagc

SEQ ID NO: 8414385 - DNA, 22 bp, Homo sapiens
tattcatagtaaacaaaagtgg

SEQ ID NO: 8414386 - DNA, 22 bp, Homo sapiens
tattcaggtcgagctaactgct

SEQ ID NO: 8414387 - DNA, 19 bp, Homo sapiens
tattcaggatgatggcaca

SEQ ID NO: 8414388 - DNA, 23 bp, Homo sapiens
tattcagcagtgggatttgttgt

SEQ ID NO: 8414389 - DNA, 22 bp, Homo sapiens
tattgaggatctcctgctaatt

SEQ ID NO: 8414390 - DNA, 22 bp, Homo sapiens
tattcacagctgccgcactcag

SEQ ID NO: 8414391 - DNA, 22 bp, Homo sapiens
tattcaaagtaccttcattgcc

SEQ ID NO: 8414392 - DNA, 22 bp, Homo sapiens
tattcaaagtgcgaggtcaggg

SEQ ID NO: 8414393 - DNA, 20 bp, Homo sapiens
tattcaactttaaaaactta

SEQ ID NO: 8414394 - DNA, 22 bp, Homo sapiens
tatgttcatgtcaaacaaatgc

SEQ ID NO: 8414395 - DNA, 22 bp, Homo sapiens
tatgtttagtatccattttcag

SEQ ID NO: 8414396 - DNA, 22 bp, Homo sapiens
tatctttagaggaagagaatct

SEQ ID NO: 8414397 - DNA, 22 bp, Homo sapiens
tatgcacattcacacaaaaatg

SEQ ID NO: 8414398 - DNA, 22 bp, Homo sapiens
tatgcagcaccactcactgcag

SEQ ID NO: 8414399 - DNA, 22 bp, Homo sapiens
tatgcatacaatgagatattcc

SEQ ID NO: 8414400 - DNA, 18 bp, Homo sapiens
tatatttcacacatattc

SEQ ID NO: 8414401 - DNA, 22 bp, Homo sapiens
tatcaatatctcagtgtgcttc

SEQ ID NO: 8414402 - DNA, 22 bp, Homo sapiens
tatcacaattcctatagtttgt

SEQ ID NO: 8414403 - DNA, 21 bp, Homo sapiens
tatcaaggcactttttaaaga

SEQ ID NO: 8414404 - DNA, 22 bp, Homo sapiens
tataccaaaaaaattcttgtct

SEQ ID NO: 8414405 - DNA, 22 bp, Homo sapiens
tataccaaaatatcagaaaggg

SEQ ID NO: 8414406 - DNA, 22 bp, Homo sapiens
tagttaaagccctaaattgata

SEQ ID NO: 8414407 - DNA, 22 bp, Homo sapiens
tatagagctttggcattgatta

SEQ ID NO: 8414408 - DNA, 22 bp, Homo sapiens
tatagcaaaatagtttccacac

SEQ ID NO: 8414409 - DNA, 22 bp, Homo sapiens
tatagcaagcaggacagtctca

SEQ ID NO: 8414410 - DNA, 22 bp, Homo sapiens
tatagcaagctctttgtaacca

SEQ ID NO: 8414411 - DNA, 22 bp, Homo sapiens
tatattataagccctttcagaa

SEQ ID NO: 8414412 - DNA, 22 bp, Homo sapiens
taggaatgattggaattccagg

SEQ ID NO: 8414413 - DNA, 19 bp, Homo sapiens
taggaatgtagaatcctag

SEQ ID NO: 8414414 - DNA, 22 bp, Homo sapiens
taggcctcaggaccccagggct

SEQ ID NO: 8414415 - DNA, 22 bp, Homo sapiens
taggctctagatgtggtctttg

SEQ ID NO: 8414416 - DNA, 22 bp, Homo sapiens
taggaaatactgtaagtttggg

SEQ ID NO: 8414417 - DNA, 22 bp, Homo sapiens
taggaaatatttgaacatagga

SEQ ID NO: 8414418 - DNA, 22 bp, Homo sapiens
taggaaatggctcagttactgc

SEQ ID NO: 8414419 - DNA, 22 bp, Homo sapiens
taggaaatgctccattgcataa

SEQ ID NO: 8414420 - DNA, 22 bp, Homo sapiens
tagtcagtagcaaggtattttg

SEQ ID NO: 8414421 - DNA, 23 bp, Homo sapiens
tagtcagtatgtaagtctaattg

SEQ ID NO: 8414422 - DNA, 22 bp, Homo sapiens
tagtcagtatgaaattgctcaa

SEQ ID NO: 8414423 - DNA, 22 bp, Homo sapiens
tagtcagttgggtctagtggca

SEQ ID NO: 8414424 - DNA, 22 bp, Homo sapiens
tagtcagtgcacagacacttgt

SEQ ID NO: 8414425 - DNA, 22 bp, Homo sapiens
tagtcagtgatcagtggagttg

SEQ ID NO: 8414426 - DNA, 22 bp, Homo sapiens
tagtcagtcttacatatttgaa

SEQ ID NO: 8414427 - DNA, 22 bp, Homo sapiens
taggctgctcaccaggctcaga

SEQ ID NO: 8414428 - DNA, 22 bp, Homo sapiens
taggttcactgtcttgaggagc

SEQ ID NO: 8414429 - DNA, 22 bp, Homo sapiens
taggttcacacatcttccagat

SEQ ID NO: 8414430 - DNA, 22 bp, Homo sapiens
taggttcagtgtcttgttctgc

SEQ ID NO: 8414431 - DNA, 22 bp, Homo sapiens
taggttcatgaaattttcagga

SEQ ID NO: 8414432 - DNA, 22 bp, Homo sapiens
taggttcatattctagaatcat

SEQ ID NO: 8414433 - DNA, 22 bp, Homo sapiens
taggttcagagaactgaaaata

SEQ ID NO: 8414434 - DNA, 22 bp, Homo sapiens
taggttcacttagctgtgggaa

SEQ ID NO: 8414435 - DNA, 22 bp, Homo sapiens
taggtttactgaattagtggaa

SEQ ID NO: 8414436 - DNA, 22 bp, Homo sapiens
tagcacttgtgttatgccttgt

SEQ ID NO: 8414437 - DNA, 22 bp, Homo sapiens
tagcactgagtctagctttgga

SEQ ID NO: 8414438 - DNA, 22 bp, Homo sapiens
tagcacccatggaatctgctgg

SEQ ID NO: 8414439 - DNA, 22 bp, Homo sapiens
tagcacccacctcgtggggttt

SEQ ID NO: 8414440 - DNA, 22 bp, Homo sapiens
tagcaaaaactgcagttacttt

SEQ ID NO: 8414441 - DNA, 22 bp, Homo sapiens
tagcacaagcaactactgaagt

SEQ ID NO: 8414442 - DNA, 22 bp, Homo sapiens
tagcacaagtatctgcttttcc

SEQ ID NO: 8414443 - DNA, 22 bp, Homo sapiens
tagcacaagaagtacacataga

SEQ ID NO: 8414444 - DNA, 18 bp, Homo sapiens
tagattaaaattgaattc

SEQ ID NO: 8414445 - DNA, 22 bp, Homo sapiens
gtgtgttcagcaagaggtaagg

SEQ ID NO: 8414446 - DNA, 22 bp, Homo sapiens
gttagggaagcgctgtgttctt

SEQ ID NO: 8414447 - DNA, 22 bp, Homo sapiens
gttagggatcaggaacaagagc

SEQ ID NO: 8414448 - DNA, 22 bp, Homo sapiens
gttaggtagaagtttactttga

SEQ ID NO: 8414449 - DNA, 22 bp, Homo sapiens
gttagggagggtgcatatgtgt

SEQ ID NO: 8414450 - DNA, 22 bp, Homo sapiens
gttagggagtcaggtggctctt

SEQ ID NO: 8414451 - DNA, 22 bp, Homo sapiens
gtttaattttaggttgtcaagc

SEQ ID NO: 8414452 - DNA, 22 bp, Homo sapiens
gttccacaaaaggtctagttta

SEQ ID NO: 8414453 - DNA, 22 bp, Homo sapiens
gttccacagagtctcactatga

SEQ ID NO: 8414454 - DNA, 22 bp, Homo sapiens
gttttacacacctatgaaagac

SEQ ID NO: 8414455 - DNA, 22 bp, Homo sapiens
gttttacacacctatgaaagac

SEQ ID NO: 8414456 - DNA, 22 bp, Homo sapiens
gttttacaaggttaatcagcag

SEQ ID NO: 8414457 - DNA, 23 bp, Homo sapiens
gttttacaggtgagaaaatggag

SEQ ID NO: 8414458 - DNA, 23 bp, Homo sapiens
gttttacaggtgagaaaatggag

SEQ ID NO: 8414459 - DNA, 22 bp, Homo sapiens
gttttacaaggttaatcagcag

SEQ ID NO: 8414460 - DNA, 20 bp, Homo sapiens
gtttatacagaagaccccaa

SEQ ID NO: 8414461 - DNA, 22 bp, Homo sapiens
gtttatacagtgcatggtgtta

SEQ ID NO: 8414462 - DNA, 22 bp, Homo sapiens
gtttcgtcaggcttattctatc

SEQ ID NO: 8414463 - DNA, 22 bp, Homo sapiens
taagaggcaaaagatactcaga

SEQ ID NO: 8414464 - DNA, 22 bp, Homo sapiens
taagataaggaacattctgtga

SEQ ID NO: 8414465 - DNA, 22 bp, Homo sapiens
taagataataagtatgtctatg

SEQ ID NO: 8414466 - DNA, 22 bp, Homo sapiens
taactgtgaagtaattgtggat

SEQ ID NO: 8414467 - DNA, 22 bp, Homo sapiens
taactgtgtgaacgtgatcatt

SEQ ID NO: 8414468 - DNA, 22 bp, Homo sapiens
taacacatatctacaacatgtg

SEQ ID NO: 8414469 - DNA, 22 bp, Homo sapiens
taacacataagctgagaccatg

SEQ ID NO: 8414470 - DNA, 22 bp, Homo sapiens
taaagtttggcagacaataaca

SEQ ID NO: 8414471 - DNA, 21 bp, Homo sapiens
taaataataagttgctgagat

SEQ ID NO: 8414472 - DNA, 22 bp, Homo sapiens
taaactgtgtaatatgatgtct

SEQ ID NO: 8414473 - DNA, 22 bp, Homo sapiens
taaagacaataggaaagttgtt

SEQ ID NO: 8414474 - DNA, 22 bp, Homo sapiens
gttttataggtgaaatattact

SEQ ID NO: 8414475 - DNA, 22 bp, Homo sapiens
gttttatagttcgggacctgtt

SEQ ID NO: 8414476 - DNA, 22 bp, Homo sapiens
gttttatatgtctctgctgaca

SEQ ID NO: 8414477 - DNA, 22 bp, Homo sapiens
gttttatatgtctctgctgaca

SEQ ID NO: 8414478 - DNA, 22 bp, Homo sapiens
gttttataattgcttcataaga

SEQ ID NO: 8414479 - DNA, 22 bp, Homo sapiens
gttttataggctgttgctatat

SEQ ID NO: 8414480 - DNA, 22 bp, Homo sapiens
gttttataggctgttgctatat

SEQ ID NO: 8414481 - DNA, 22 bp, Homo sapiens
gttttataattgcttcataaga

SEQ ID NO: 8414482 - DNA, 22 bp, Homo sapiens
taaacatctgtcatgtgtttat

SEQ ID NO: 8414483 - DNA, 20 bp, Homo sapiens
tacaggaccttctttgtatc

SEQ ID NO: 8414484 - DNA, 22 bp, Homo sapiens
tacaggacagatgtttacagga

SEQ ID NO: 8414485 - DNA, 22 bp, Homo sapiens
tacataataaggggcatggtgt

SEQ ID NO: 8414486 - DNA, 22 bp, Homo sapiens
tacataatgagctagttaagtt

SEQ ID NO: 8414487 - DNA, 22 bp, Homo sapiens
tacataattaatctttaagttc

SEQ ID NO: 8414488 - DNA, 22 bp, Homo sapiens
tacataattgtctttgtcctca

SEQ ID NO: 8414489 - DNA, 20 bp, Homo sapiens
tacattcaaaacaaactctg

SEQ ID NO: 8414490 - DNA, 22 bp, Homo sapiens
tacattcacagttgttcatctc

SEQ ID NO: 8414491 - DNA, 22 bp, Homo sapiens
tacattcaacatgtcactatgt

SEQ ID NO: 8414492 - DNA, 22 bp, Homo sapiens
tacattcaaacgatttattgat

SEQ ID NO: 8414493 - DNA, 23 bp, Homo sapiens
tacattcatttgcacagccagta

SEQ ID NO: 8414494 - DNA, 15 bp, Homo sapiens
tacattcatttccac

SEQ ID NO: 8414495 - DNA, 22 bp, Homo sapiens
tacattcatggtgacttgtatg

SEQ ID NO: 8414496 - DNA, 22 bp, Homo sapiens
tacattcatatgtgtgcataca

SEQ ID NO: 8414497 - DNA, 22 bp, Homo sapiens
tacattcagagaaagtttccat

SEQ ID NO: 8414498 - DNA, 22 bp, Homo sapiens
tacattcagaattgggaggcaa

SEQ ID NO: 8414499 - DNA, 22 bp, Homo sapiens
tacattcagcaaaagaatggtt

SEQ ID NO: 8414500 - DNA, 22 bp, Homo sapiens
tacattcacttgttgaaggtgg

SEQ ID NO: 8414501 - DNA, 22 bp, Homo sapiens
tacattcagaagaatggacacg

SEQ ID NO: 8414502 - DNA, 22 bp, Homo sapiens
tacattaaggatatggacatga

SEQ ID NO: 8414503 - DNA, 22 bp, Homo sapiens
tacatgtttggtaaatgatggc

SEQ ID NO: 8414504 - DNA, 22 bp, Homo sapiens
tacgcctgtaatcccagcactt

SEQ ID NO: 8414505 - DNA, 22 bp, Homo sapiens
tacctgcagcgggaatccatta

SEQ ID NO: 8414506 - DNA, 22 bp, Homo sapiens
taccttcaccagcgaatgtttg

SEQ ID NO: 8414507 - DNA, 22 bp, Homo sapiens
tacccagcttcaagtcaggact

SEQ ID NO: 8414508 - DNA, 22 bp, Homo sapiens
tacccagctcctcagaagacca

SEQ ID NO: 8414509 - DNA, 22 bp, Homo sapiens
tacccagcccatgcctacctca

SEQ ID NO: 8414510 - DNA, 22 bp, Homo sapiens
tacccagcaatccctagaggtt

SEQ ID NO: 8414511 - DNA, 22 bp, Homo sapiens
tacctgcacagccagccatgtg

SEQ ID NO: 8414512 - DNA, 22 bp, Homo sapiens
tacctgcaaagttccttttgcc

SEQ ID NO: 8414513 - DNA, 22 bp, Homo sapiens
tacctgcacagccagccatgtg

SEQ ID NO: 8414514 - DNA, 22 bp, Homo sapiens
tacctgcagcgggaatccatta

SEQ ID NO: 8414515 - DNA, 22 bp, Homo sapiens
tacattccatgtgtgtgtattc

SEQ ID NO: 8414516 - DNA, 22 bp, Homo sapiens
tacattcccccaattaccaatg

SEQ ID NO: 8414517 - DNA, 22 bp, Homo sapiens
tacttcatgagttaatatgcag

SEQ ID NO: 8414518 - DNA, 22 bp, Homo sapiens
tacttcatacctgctagaatgg

SEQ ID NO: 8414519 - DNA, 22 bp, Homo sapiens
tacttcattcctttgtaaaatg

SEQ ID NO: 8414520 - DNA, 22 bp, Homo sapiens
tacttattgttgaactgaatca

SEQ ID NO: 8414521 - DNA, 19 bp, Homo sapiens
tacttattagaaatatggg

SEQ ID NO: 8414522 - DNA, 22 bp, Homo sapiens
tactgagggtatgaagccaagg

SEQ ID NO: 8414523 - DNA, 22 bp, Homo sapiens
tacacatgatcatttagtagca

SEQ ID NO: 8414524 - DNA, 22 bp, Homo sapiens
tacacatgacagtggactgaga

SEQ ID NO: 8414525 - DNA, 22 bp, Homo sapiens
tacaccattttctgcagtgttt

SEQ ID NO: 8414526 - DNA, 22 bp, Homo sapiens
tacacatgtgcacgcgtgtcct

SEQ ID NO: 8414527 - DNA, 22 bp, Homo sapiens
tacacatgtccaaggtgtcacc

SEQ ID NO: 8414528 - DNA, 22 bp, Homo sapiens
tacacatgtttggcaagtatgt

SEQ ID NO: 8414529 - DNA, 22 bp, Homo sapiens
tacacatgtatttatgtgtaca

SEQ ID NO: 8414530 - DNA, 22 bp, Homo sapiens
tacacatgctcagattcctgtg

SEQ ID NO: 8414531 - DNA, 22 bp, Homo sapiens
tacacatgcatgtactccagga

SEQ ID NO: 8414532 - DNA, 22 bp, Homo sapiens
tacaatcaggataataatagtg

SEQ ID NO: 8414533 - DNA, 22 bp, Homo sapiens
tacaatgctgtgcatgtaatgg

SEQ ID NO: 8414534 - DNA, 22 bp, Homo sapiens
taattttatgacagtgtatttt

SEQ ID NO: 8414535 - DNA, 22 bp, Homo sapiens
taattttatgacagtgtatttt

SEQ ID NO: 8414536 - DNA, 22 bp, Homo sapiens
taattttaactgtgctgtttgg

SEQ ID NO: 8414537 - DNA, 22 bp, Homo sapiens
taatttcttcatctctgcagct

SEQ ID NO: 8414538 - DNA, 22 bp, Homo sapiens
taatttctagggactaaggtgc

SEQ ID NO: 8414539 - DNA, 22 bp, Homo sapiens
taatttctggagggagaaagag

SEQ ID NO: 8414540 - DNA, 22 bp, Homo sapiens
taattttacttcctgagcacct

SEQ ID NO: 8414541 - DNA, 22 bp, Homo sapiens
taattttacttcctgagcacct

SEQ ID NO: 8414542 - DNA, 23 bp, Homo sapiens
taattttagccttacaggaccct

SEQ ID NO: 8414543 - DNA, 22 bp, Homo sapiens
taattttaactgtgctgtttgg

SEQ ID NO: 8414544 - DNA, 22 bp, Homo sapiens
taattttaatagtatgtggcat

SEQ ID NO: 8414545 - DNA, 22 bp, Homo sapiens
taatttctaattcattttcagt

SEQ ID NO: 8414546 - DNA, 22 bp, Homo sapiens
taatttcactgatatgaagtca

SEQ ID NO: 8414547 - DNA, 22 bp, Homo sapiens
taatgacattgtatccacagag

SEQ ID NO: 8414548 - DNA, 22 bp, Homo sapiens
taatgaatgagaatataacaga

SEQ ID NO: 8414549 - DNA, 19 bp, Homo sapiens
taatgcacttaacacatgg

SEQ ID NO: 8414550 - DNA, 22 bp, Homo sapiens
taagtgttggtaattacaatga

SEQ ID NO: 8414551 - DNA, 22 bp, Homo sapiens
taagcactttatatgctttatc

SEQ ID NO: 8414552 - DNA, 22 bp, Homo sapiens
taagttttaagcaatctgataa

SEQ ID NO: 8414553 - DNA, 22 bp, Homo sapiens
taagttttctggaataacttgg

SEQ ID NO: 8414554 - DNA, 22 bp, Homo sapiens
tccgccaggactgagggcccat

SEQ ID NO: 8414555 - DNA, 19 bp, Homo sapiens
tcctcagtgacaacctcag

SEQ ID NO: 8414556 - DNA, 22 bp, Homo sapiens
tccctgatgccttgatccgtgg

SEQ ID NO: 8414557 - DNA, 22 bp, Homo sapiens
tcccaggcaaaggcagctcatt

SEQ ID NO: 8414558 - DNA, 22 bp, Homo sapiens
tcccaggattttaggctctcag

SEQ ID NO: 8414559 - DNA, 22 bp, Homo sapiens
tccaccatgtaacaagctctgt

SEQ ID NO: 8414560 - DNA, 22 bp, Homo sapiens
tccacacacatttctatgtgca

SEQ ID NO: 8414561 - DNA, 20 bp, Homo sapiens
tcatggctgctgagaggttc

SEQ ID NO: 8414562 - DNA, 22 bp, Homo sapiens
tcatgttattgactcataatat

SEQ ID NO: 8414563 - DNA, 20 bp, Homo sapiens
tccaggagaactgggagccg

SEQ ID NO: 8414564 - DNA, 22 bp, Homo sapiens
tccagtggcaccttggccctca

SEQ ID NO: 8414565 - DNA, 19 bp, Homo sapiens
tcccagagtctagaggttg

SEQ ID NO: 8414566 - DNA, 22 bp, Homo sapiens
tcccagagaaagtcaaggtctt

SEQ ID NO: 8414567 - DNA, 17 bp, Homo sapiens
tcccaggaacagggaat

SEQ ID NO: 8414568 - DNA, 22 bp, Homo sapiens
tcccagagtttcctgtgtccca

SEQ ID NO: 8414569 - DNA, 22 bp, Homo sapiens
tcacagaatgtctagcataatt

SEQ ID NO: 8414570 - DNA, 22 bp, Homo sapiens
tcacacacatttgctgtctgat

SEQ ID NO: 8414571 - DNA, 22 bp, Homo sapiens
tcaatgtttgttcatgaaaata

SEQ ID NO: 8414572 - DNA, 22 bp, Homo sapiens
tcaatgttcaagtatgacaatg

SEQ ID NO: 8414573 - DNA, 18 bp, Homo sapiens
tcaaaatatttctgtgga

SEQ ID NO: 8414574 - DNA, 22 bp, Homo sapiens
tcaaaattctagggagaatggt

SEQ ID NO: 8414575 - DNA, 20 bp, Homo sapiens
tcaaaataggtgtgggcgga

SEQ ID NO: 8414576 - DNA, 22 bp, Homo sapiens
tattttcatcttgtccttggat

SEQ ID NO: 8414577 - DNA, 22 bp, Homo sapiens
tcaatacttaagcttaattcta

SEQ ID NO: 8414578 - DNA, 22 bp, Homo sapiens
tcaatgatagtacaatcagcct

SEQ ID NO: 8414579 - DNA, 23 bp, Homo sapiens
tcaaacatattgtgagacacagg

SEQ ID NO: 8414580 - DNA, 22 bp, Homo sapiens
tcagagagctggtgggcagagg

SEQ ID NO: 8414581 - DNA, 22 bp, Homo sapiens
tcagagagcctcaggcactgcc

SEQ ID NO: 8414582 - DNA, 22 bp, Homo sapiens
tcagagagcagaacttttttac

SEQ ID NO: 8414583 - DNA, 18 bp, Homo sapiens
tcagagagcagctttatt

SEQ ID NO: 8414584 - DNA, 20 bp, Homo sapiens
tcagagagagggtgccactt

SEQ ID NO: 8414585 - DNA, 18 bp, Homo sapiens
tcagagagaatagtaatt

SEQ ID NO: 8414586 - DNA, 22 bp, Homo sapiens
tcagagagaaatagtttttgac

SEQ ID NO: 8414587 - DNA, 22 bp, Homo sapiens
tcagagacctagcaagaaattg

SEQ ID NO: 8414588 - DNA, 23 bp, Homo sapiens
tcagagagctgttgagagctgcc

SEQ ID NO: 8414589 - DNA, 22 bp, Homo sapiens
tcagagaggattttaataagtg

SEQ ID NO: 8414590 - DNA, 22 bp, Homo sapiens
tcagaggcctatgtctacaact

SEQ ID NO: 8414591 - DNA, 22 bp, Homo sapiens
tcagaggccttggttatggtat

SEQ ID NO: 8414592 - DNA, 19 bp, Homo sapiens
tcagaactcagaatgtgta

SEQ ID NO: 8414593 - DNA, 22 bp, Homo sapiens
tcagaactacatggacatgtta

SEQ ID NO: 8414594 - DNA, 22 bp, Homo sapiens
tcagagaatctctccttagttt

SEQ ID NO: 8414595 - DNA, 22 bp, Homo sapiens
tcagagaattcgattaaatgca

SEQ ID NO: 8414596 - DNA, 22 bp, Homo sapiens
tcagagaattgtttaatggaat

SEQ ID NO: 8414597 - DNA, 22 bp, Homo sapiens
tcagagaagtaggctaatggtg

SEQ ID NO: 8414598 - DNA, 22 bp, Homo sapiens
tcagagaagtaaggtggggtgc

SEQ ID NO: 8414599 - DNA, 22 bp, Homo sapiens
tcacatctgttgatacagcatc

SEQ ID NO: 8414600 - DNA, 20 bp, Homo sapiens
tcacatctggcagctgatga

SEQ ID NO: 8414601 - DNA, 22 bp, Homo sapiens
tcacatgagtattattttccaa

SEQ ID NO: 8414602 - DNA, 22 bp, Homo sapiens
tcactgggtaggacatgctgat

SEQ ID NO: 8414603 - DNA, 22 bp, Homo sapiens
tcactggggcccacatcaacat

SEQ ID NO: 8414604 - DNA, 17 bp, Homo sapiens
tcactgggcctgctccc

SEQ ID NO: 8414605 - DNA, 22 bp, Homo sapiens
tcactggggagcactgacatgt

SEQ ID NO: 8414606 - DNA, 22 bp, Homo sapiens
tcaggcaaggcccttagagtgt

SEQ ID NO: 8414607 - DNA, 22 bp, Homo sapiens
tcaggagctgcactgggcccac

SEQ ID NO: 8414608 - DNA, 22 bp, Homo sapiens
tcaggagcttggtagtgtgatt

SEQ ID NO: 8414609 - DNA, 22 bp, Homo sapiens
tcagctttctcagaggcctaac

SEQ ID NO: 8414610 - DNA, 22 bp, Homo sapiens
tcagctttctctcgccatcagg

SEQ ID NO: 8414611 - DNA, 22 bp, Homo sapiens
tcagagtcctcaccctgaggat

SEQ ID NO: 8414612 - DNA, 22 bp, Homo sapiens
tcagagtctaaatagaagaata

SEQ ID NO: 8414613 - DNA, 22 bp, Homo sapiens
tcagaggcttgaagcccaagcc

SEQ ID NO: 8414614 - DNA, 22 bp, Homo sapiens
tcagcctacactccaacagcat

SEQ ID NO: 8414615 - DNA, 22 bp, Homo sapiens
tcagctttccttgctttagatt

SEQ ID NO: 8414616 - DNA, 22 bp, Homo sapiens
tcagctttctatgttgctaaac

SEQ ID NO: 8414617 - DNA, 22 bp, Homo sapiens
tcagctttctcaaagaagctgg

SEQ ID NO: 8414618 - DNA, 22 bp, Homo sapiens
tcagctttcctgcagctaaggg

SEQ ID NO: 8414619 - DNA, 22 bp, Homo sapiens
tcagctgtgatccatctatcta

SEQ ID NO: 8414620 - DNA, 22 bp, Homo sapiens
tcataaagcatttcagcttttg

SEQ ID NO: 8414621 - DNA, 22 bp, Homo sapiens
tcataaagctcttccaaatgta

SEQ ID NO: 8414622 - DNA, 20 bp, Homo sapiens
tcaggtagatctttgaggtc

SEQ ID NO: 8414623 - DNA, 22 bp, Homo sapiens
tcaggtagtggttaagttctgt

SEQ ID NO: 8414624 - DNA, 22 bp, Homo sapiens
tcagggctgccgggcagaccgt

SEQ ID NO: 8414625 - DNA, 22 bp, Homo sapiens
tcagggctggcttttgcagagc

SEQ ID NO: 8414626 - DNA, 22 bp, Homo sapiens
tcagggactgcagagggaagct

SEQ ID NO: 8414627 - DNA, 22 bp, Homo sapiens
ttctcttcccactttctgtatt

SEQ ID NO: 8414628 - DNA, 22 bp, Homo sapiens
ttctcttagctgtaaagtcaat

SEQ ID NO: 8414629 - DNA, 22 bp, Homo sapiens
ttctcttatctggcattattgg

SEQ ID NO: 8414630 - DNA, 22 bp, Homo sapiens
ttctgaggcatagaggatgaga

SEQ ID NO: 8414631 - DNA, 22 bp, Homo sapiens
ttctgagggctaatgtactgta

SEQ ID NO: 8414632 - DNA, 22 bp, Homo sapiens
ttctgaggtccatgcagtactg

SEQ ID NO: 8414633 - DNA, 22 bp, Homo sapiens
ttctaactaattggaaatggaa

SEQ ID NO: 8414634 - DNA, 22 bp, Homo sapiens
ttctaacaagtggcttgttagt

SEQ ID NO: 8414635 - DNA, 22 bp, Homo sapiens
ttctaactctgttatgtgtttc

SEQ ID NO: 8414636 - DNA, 22 bp, Homo sapiens
ttctaaagcctgtcctatcaga

SEQ ID NO: 8414637 - DNA, 22 bp, Homo sapiens
ttctaaagtgcaatctgacaga

SEQ ID NO: 8414638 - DNA, 22 bp, Homo sapiens
ttctaaagagaatgcgtttctg

SEQ ID NO: 8414639 - DNA, 18 bp, Homo sapiens
ttcggcagatacgcttgg

SEQ ID NO: 8414640 - DNA, 22 bp, Homo sapiens
ttccctctctagctttccccaa

SEQ ID NO: 8414641 - DNA, 22 bp, Homo sapiens
ttccctctcctactcaggaaag

SEQ ID NO: 8414642 - DNA, 22 bp, Homo sapiens
ttccctctctccagggctgcct

SEQ ID NO: 8414643 - DNA, 22 bp, Homo sapiens
ttccctctgcgcattgaatttc

SEQ ID NO: 8414644 - DNA, 22 bp, Homo sapiens
ttccctctccaggagccctgag

SEQ ID NO: 8414645 - DNA, 22 bp, Homo sapiens
ttccctctcacttaaagcttgg

SEQ ID NO: 8414646 - DNA, 22 bp, Homo sapiens
ttccctcttttccaacagttgt

SEQ ID NO: 8414647 - DNA, 22 bp, Homo sapiens
ttccctctttcactgtgatttt

SEQ ID NO: 8414648 - DNA, 22 bp, Homo sapiens
ttctatcatacttgaatacatt

SEQ ID NO: 8414649 - DNA, 22 bp, Homo sapiens
ttctaactggtgcagtgctgca

SEQ ID NO: 8414650 - DNA, 22 bp, Homo sapiens
ttctaactggcttgacagtttc

SEQ ID NO: 8414651 - DNA, 22 bp, Homo sapiens
ttctaacttttgaggcaatgtg

SEQ ID NO: 8414652 - DNA, 22 bp, Homo sapiens
ttctcacaggaagtaggacttt

SEQ ID NO: 8414653 - DNA, 22 bp, Homo sapiens
ttctcagaaaatgtagagaaaa

SEQ ID NO: 8414654 - DNA, 22 bp, Homo sapiens
ttctttctttgtagtcctgaac

SEQ ID NO: 8414655 - DNA, 22 bp, Homo sapiens
ttctttgcccttaatgaaataa

SEQ ID NO: 8414656 - DNA, 22 bp, Homo sapiens
ttctttgcccttaatgaaataa

SEQ ID NO: 8414657 - DNA, 22 bp, Homo sapiens
ttcttcttcaagtgctgcattc

SEQ ID NO: 8414658 - DNA, 22 bp, Homo sapiens
ttcttctcctaaggagagtcct

SEQ ID NO: 8414659 - DNA, 22 bp, Homo sapiens
ttgagacacaaggcacagtaag

SEQ ID NO: 8414660 - DNA, 22 bp, Homo sapiens
ttgagacactttgggcatcact

SEQ ID NO: 8414661 - DNA, 22 bp, Homo sapiens
ttgagacagtggggtgttgccg

SEQ ID NO: 8414662 - DNA, 19 bp, Homo sapiens
ttgagaacaccaagtactg

SEQ ID NO: 8414663 - DNA, 22 bp, Homo sapiens
ttgagaaggtggtcatttgcaa

SEQ ID NO: 8414664 - DNA, 23 bp, Homo sapiens
ttgaaaaatatagtcccattgtc

SEQ ID NO: 8414665 - DNA, 22 bp, Homo sapiens
ttgaaaaaattggtagaggatg

SEQ ID NO: 8414666 - DNA, 22 bp, Homo sapiens
ttgaaaaaattggtagaggatg

SEQ ID NO: 8414667 - DNA, 22 bp, Homo sapiens
ttagttagtggggctgtcagtc

SEQ ID NO: 8414668 - DNA, 22 bp, Homo sapiens
ttagttagtccctggtaccttt

SEQ ID NO: 8414669 - DNA, 22 bp, Homo sapiens
ttatacactgcagaaccagcat

SEQ ID NO: 8414670 - DNA, 22 bp, Homo sapiens
ttatacaccatcactgccttgg

SEQ ID NO: 8414671 - DNA, 22 bp, Homo sapiens
ttatacacgtttatggagctac

SEQ ID NO: 8414672 - DNA, 22 bp, Homo sapiens
ttatacacaattcttttactac

SEQ ID NO: 8414673 - DNA, 22 bp, Homo sapiens
ttatgcagtcgacatctgatca

SEQ ID NO: 8414674 - DNA, 22 bp, Homo sapiens
ttattttaccttcctctgagct

SEQ ID NO: 8414675 - DNA, 22 bp, Homo sapiens
ttattttctcctcagaaagtgg

SEQ ID NO: 8414676 - DNA, 22 bp, Homo sapiens
ttattttcagctaggaaagcca

SEQ ID NO: 8414677 - DNA, 22 bp, Homo sapiens
ttattttcagctaggaaagcca

SEQ ID NO: 8414678 - DNA, 22 bp, Homo sapiens
ttattttctcctcagaaagtgg

SEQ ID NO: 8414679 - DNA, 22 bp, Homo sapiens
ttcaaaatccgggaggcgcccc

SEQ ID NO: 8414680 - DNA, 22 bp, Homo sapiens
ttcaaaatgcacaaagggctag

SEQ ID NO: 8414681 - DNA, 21 bp, Homo sapiens
ttcaaaatggtgtgtttgtct

SEQ ID NO: 8414682 - DNA, 22 bp, Homo sapiens
ttcaaaattgttctaagctctg

SEQ ID NO: 8414683 - DNA, 22 bp, Homo sapiens
ttcaaaattgttctaagctctg

SEQ ID NO: 8414684 - DNA, 22 bp, Homo sapiens
ttcaaaattgttctaagctctg

SEQ ID NO: 8414685 - DNA, 22 bp, Homo sapiens
ttatttaggagaaggaaccctg

SEQ ID NO: 8414686 - DNA, 22 bp, Homo sapiens
ttatttaattttctcactcaga

SEQ ID NO: 8414687 - DNA, 22 bp, Homo sapiens
ttatttacaactcttctcttcc

SEQ ID NO: 8414688 - DNA, 22 bp, Homo sapiens
ttatttaattttctcactcaga

SEQ ID NO: 8414689 - DNA, 22 bp, Homo sapiens
ttatttaaaagtggtaagattc

SEQ ID NO: 8414690 - DNA, 22 bp, Homo sapiens
ttatttaaaagtggtaagattc

SEQ ID NO: 8414691 - DNA, 22 bp, Homo sapiens
ttcaatatctctaagaatgagg

SEQ ID NO: 8414692 - DNA, 21 bp, Homo sapiens
ttcaatgaaaacaaagtgagg

SEQ ID NO: 8414693 - DNA, 22 bp, Homo sapiens
ttcatacatttttactaacagc

SEQ ID NO: 8414694 - DNA, 22 bp, Homo sapiens
ttcatactaaagtgtaagatgt

SEQ ID NO: 8414695 - DNA, 22 bp, Homo sapiens
ttcatactcactccaataactg

SEQ ID NO: 8414696 - DNA, 22 bp, Homo sapiens
ttcatagagcagctcactgaat

SEQ ID NO: 8414697 - DNA, 22 bp, Homo sapiens
ttcagaatgctatttctgaaat

SEQ ID NO: 8414698 - DNA, 22 bp, Homo sapiens
ttcatcaccttggtagcactcc

SEQ ID NO: 8414699 - DNA, 22 bp, Homo sapiens
ttcataggtttgctgtgaacat

SEQ ID NO: 8414700 - DNA, 22 bp, Homo sapiens
ttcatagcagtccctttctggg

SEQ ID NO: 8414701 - DNA, 22 bp, Homo sapiens
ttcatataaatggaatcagaat

SEQ ID NO: 8414702 - DNA, 22 bp, Homo sapiens
ttcatagtgtttccttccagtg

SEQ ID NO: 8414703 - DNA, 22 bp, Homo sapiens
ttcatagtgtttccttccagtg

SEQ ID NO: 8414704 - DNA, 22 bp, Homo sapiens
ttcccagagaaggatgaaaaag

SEQ ID NO: 8414705 - DNA, 22 bp, Homo sapiens
ttccccaggctggagtgcagtg

SEQ ID NO: 8414706 - DNA, 22 bp, Homo sapiens
ttccccagtagtgacaatcaaa

SEQ ID NO: 8414707 - DNA, 22 bp, Homo sapiens
ttcccagttagtcatttttaca

SEQ ID NO: 8414708 - DNA, 21 bp, Homo sapiens
ttcccagcacctagcacaggt

SEQ ID NO: 8414709 - DNA, 22 bp, Homo sapiens
ttccatacgactgaggtctcgg

SEQ ID NO: 8414710 - DNA, 22 bp, Homo sapiens
ttggaacatgccggggtccagg

SEQ ID NO: 8414711 - DNA, 22 bp, Homo sapiens
ttgcttgcagacttagcaaatt

SEQ ID NO: 8414712 - DNA, 23 bp, Homo sapiens
ttgcttgagcccaggaagtggag

SEQ ID NO: 8414713 - DNA, 22 bp, Homo sapiens
ttgcttgccctgcagcatactt

SEQ ID NO: 8414714 - DNA, 22 bp, Homo sapiens
ttggaggatgcaatgagggagt

SEQ ID NO: 8414715 - DNA, 22 bp, Homo sapiens
ttggaggataaggatattgatt

SEQ ID NO: 8414716 - DNA, 22 bp, Homo sapiens
ttggaggatggagttagcatct

SEQ ID NO: 8414717 - DNA, 22 bp, Homo sapiens
ttggaggattgctctcagccca

SEQ ID NO: 8414718 - DNA, 15 bp, Homo sapiens
ttggaggatgtagta

SEQ ID NO: 8414719 - DNA, 22 bp, Homo sapiens
ttggaggatgtcggcatattta

SEQ ID NO: 8414720 - DNA, 18 bp, Homo sapiens
ttggaggatgtccatgaa

SEQ ID NO: 8414721 - DNA, 22 bp, Homo sapiens
ttgcccagagctgcctgttaca

SEQ ID NO: 8414722 - DNA, 22 bp, Homo sapiens
ttgctagctggtgtatgcattg

SEQ ID NO: 8414723 - DNA, 22 bp, Homo sapiens
ttggcctcatggacagctcatc

SEQ ID NO: 8414724 - DNA, 22 bp, Homo sapiens
ttggcctccacattttccaggt

SEQ ID NO: 8414725 - DNA, 22 bp, Homo sapiens
ttggccttccctacctgggcca

SEQ ID NO: 8414726 - DNA, 22 bp, Homo sapiens
ttgggctcaggagtttgagacc

SEQ ID NO: 8414727 - DNA, 22 bp, Homo sapiens
ttgtagaacatgcagcacaatg

SEQ ID NO: 8414728 - DNA, 22 bp, Homo sapiens
ttgtgcaatttaaaatcttcct

SEQ ID NO: 8414729 - DNA, 22 bp, Homo sapiens
ttgtgatctgtgttgatggcct

SEQ ID NO: 8414730 - DNA, 22 bp, Homo sapiens
ttgtatttcctataacctttct

SEQ ID NO: 8414731 - DNA, 19 bp, Homo sapiens
ttgtgagctgaagaacagg

SEQ ID NO: 8414732 - DNA, 22 bp, Homo sapiens
ttgtgagcaggctgcacaaacc

SEQ ID NO: 8414733 - DNA, 22 bp, Homo sapiens
ttgtgagcatgtttacttgatt

SEQ ID NO: 8414734 - DNA, 22 bp, Homo sapiens
ttgttcatggttgtaagtttga

SEQ ID NO: 8414735 - DNA, 22 bp, Homo sapiens
tttcacatatggttgttgattg

SEQ ID NO: 8414736 - DNA, 22 bp, Homo sapiens
tttcacatatggttgttgattg

SEQ ID NO: 8414737 - DNA, 22 bp, Homo sapiens
tttcacatatcaactctatcct

SEQ ID NO: 8414738 - DNA, 22 bp, Homo sapiens
tttcacatcatgggatggaagc

SEQ ID NO: 8414739 - DNA, 22 bp, Homo sapiens
tttcacatcagaggtagattag

SEQ ID NO: 8414740 - DNA, 22 bp, Homo sapiens
tttcacatgtatataggcatta

SEQ ID NO: 8414741 - DNA, 22 bp, Homo sapiens
tttcacatggtactgcctgttt

SEQ ID NO: 8414742 - DNA, 22 bp, Homo sapiens
tttcacatgcagcagggaagtg

SEQ ID NO: 8414743 - DNA, 20 bp, Homo sapiens
tttcacatctgtccctttaa

SEQ ID NO: 8414744 - DNA, 22 bp, Homo sapiens
tttcacatggaagctctcgaga

SEQ ID NO: 8414745 - DNA, 20 bp, Homo sapiens
tttcacatctgtccctttaa

SEQ ID NO: 8414746 - DNA, 22 bp, Homo sapiens
tttcacattggcttctatttct

SEQ ID NO: 8414747 - DNA, 22 bp, Homo sapiens
tttcacattggcttctatttct

SEQ ID NO: 8414748 - DNA, 22 bp, Homo sapiens
tttcacattcttctgaatctac

SEQ ID NO: 8414749 - DNA, 22 bp, Homo sapiens
tttcacattcttctgaatctac

SEQ ID NO: 8414750 - DNA, 22 bp, Homo sapiens
tttcacattcagatatagactt

SEQ ID NO: 8414751 - DNA, 23 bp, Homo sapiens
tttcacattaatgtttagcagga

SEQ ID NO: 8414752 - DNA, 22 bp, Homo sapiens
tttcacattagatatgtcattt

SEQ ID NO: 8414753 - DNA, 23 bp, Homo sapiens
tttcacattaatgtttagcagga

SEQ ID NO: 8414754 - DNA, 22 bp, Homo sapiens
tttcacatgtggaatgccaggt

SEQ ID NO: 8414755 - DNA, 23 bp, Homo sapiens
tttcacatttactgttagatggc

SEQ ID NO: 8414756 - DNA, 22 bp, Homo sapiens
tttcacatttaggcgtgaattg

SEQ ID NO: 8414757 - DNA, 22 bp, Homo sapiens
tttcacatttaggcgtgaattg

SEQ ID NO: 8414758 - DNA, 22 bp, Homo sapiens
tttcataaacagtagaagacta

SEQ ID NO: 8414759 - DNA, 18 bp, Homo sapiens
tttcacaacctccagagg

SEQ ID NO: 8414760 - DNA, 23 bp, Homo sapiens
tttatttatttaggctgagggat

SEQ ID NO: 8414761 - DNA, 22 bp, Homo sapiens
tttcataatagtgcagtttgtt

SEQ ID NO: 8414762 - DNA, 22 bp, Homo sapiens
tttcataatactgtacatgaaa

SEQ ID NO: 8414763 - DNA, 22 bp, Homo sapiens
tttcataacctcaagctacagt

SEQ ID NO: 8414764 - DNA, 22 bp, Homo sapiens
tttccaaataaggtcacattct

SEQ ID NO: 8414765 - DNA, 21 bp, Homo sapiens
tttctaaggaggaagaaaaga

SEQ ID NO: 8414766 - DNA, 22 bp, Homo sapiens
tttcctttgcccaatacatgtc

SEQ ID NO: 8414767 - DNA, 22 bp, Homo sapiens
tttacagaatgttgaatttggg

SEQ ID NO: 8414768 - DNA, 22 bp, Homo sapiens
tttacagcactgaagccagggg

SEQ ID NO: 8414769 - DNA, 22 bp, Homo sapiens
tttacagcagcatgatttataa

SEQ ID NO: 8414770 - DNA, 22 bp, Homo sapiens
tttacagctactgtcctatttc

SEQ ID NO: 8414771 - DNA, 19 bp, Homo sapiens
tttacaagttctttgtatg

SEQ ID NO: 8414772 - DNA, 22 bp, Homo sapiens
tttaagactcttgtagtacaca

SEQ ID NO: 8414773 - DNA, 22 bp, Homo sapiens
tttaagacttagatttattggg

SEQ ID NO: 8414774 - DNA, 22 bp, Homo sapiens
ttgttgaatggataaataaatt

SEQ ID NO: 8414775 - DNA, 22 bp, Homo sapiens
tttaacatgtgaattttggaag

SEQ ID NO: 8414776 - DNA, 22 bp, Homo sapiens
tttaacatgtaattgctgcttt

SEQ ID NO: 8414777 - DNA, 22 bp, Homo sapiens
tttaacagatgtgaaattttca

SEQ ID NO: 8414778 - DNA, 22 bp, Homo sapiens
tttaaattatagttaatgtctg

SEQ ID NO: 8414779 - DNA, 22 bp, Homo sapiens
tttaacttaatctgcttgatga

SEQ ID NO: 8414780 - DNA, 22 bp, Homo sapiens
tttaacccaaataaccacagga

SEQ ID NO: 8414781 - DNA, 22 bp, Homo sapiens
tttaacctgtcaatttgcatgc

SEQ ID NO: 8414782 - DNA, 23 bp, Homo sapiens
tttaaccttggtcaagaatttcc

SEQ ID NO: 8414783 - DNA, 22 bp, Homo sapiens
tttaacatgttcaagaaacata

SEQ ID NO: 8414784 - DNA, 23 bp, Homo sapiens
tttaacatttgaacatgtggcca

SEQ ID NO: 8414785 - DNA, 22 bp, Homo sapiens
tttagccaactatatgactagt

SEQ ID NO: 8414786 - DNA, 21 bp, Homo sapiens
tttagcatttacatatttcca

SEQ ID NO: 8414787 - DNA, 22 bp, Homo sapiens
tttagcatgttcctttcataga

SEQ ID NO: 8414788 - DNA, 22 bp, Homo sapiens
tttagcatcgaagtaaatttag

SEQ ID NO: 8414789 - DNA, 22 bp, Homo sapiens
tttatctttaggactttgcaga

SEQ ID NO: 8414790 - DNA, 22 bp, Homo sapiens
tttatctgtcatttcccatatc

SEQ ID NO: 8414791 - DNA, 22 bp, Homo sapiens
tttatgagcaatgctgagggga

SEQ ID NO: 8414792 - DNA, 22 bp, Homo sapiens
tttatgaactacagatataact

SEQ ID NO: 8414793 - DNA, 22 bp, Homo sapiens
ttttacctgaaccacacagtat

SEQ ID NO: 8414794 - DNA, 18 bp, Homo sapiens
ttttactcatagcaggcc

SEQ ID NO: 8414795 - DNA, 22 bp, Homo sapiens
ttttacctgaaccacacagtat

SEQ ID NO: 8414796 - DNA, 22 bp, Homo sapiens
ttttacattgggaaatgcctct

SEQ ID NO: 8414797 - DNA, 22 bp, Homo sapiens
ttttattgggagtcctctactg

SEQ ID NO: 8414798 - DNA, 22 bp, Homo sapiens
tttgtgatctcctccctctaga

SEQ ID NO: 8414799 - DNA, 22 bp, Homo sapiens
tttgtgcagatgtatatttgtg

SEQ ID NO: 8414800 - DNA, 22 bp, Homo sapiens
ttttacagttccatgcaaagcg

SEQ ID NO: 8414801 - DNA, 22 bp, Homo sapiens
ttttacagtcagtcaaactcag

SEQ ID NO: 8414802 - DNA, 22 bp, Homo sapiens
ttttacaggtgtgagccaccat

SEQ ID NO: 8414803 - DNA, 22 bp, Homo sapiens
ttttacaggtgaaaaatgaaga

SEQ ID NO: 8414804 - DNA, 22 bp, Homo sapiens
ttttacaggtcataggtatagt

SEQ ID NO: 8414805 - DNA, 21 bp, Homo sapiens
ttttacagatgaggggaaggg

SEQ ID NO: 8414806 - DNA, 22 bp, Homo sapiens
ttttacaggtcataggtatagt

SEQ ID NO: 8414807 - DNA, 22 bp, Homo sapiens
ttttacacctcagatgagcaga

SEQ ID NO: 8414808 - DNA, 23 bp, Homo sapiens
ttttaatttggacataagaagat

SEQ ID NO: 8414809 - DNA, 22 bp, Homo sapiens
ttttgtgagctgagaaatgtat

SEQ ID NO: 8414810 - DNA, 22 bp, Homo sapiens
ttttgtgagctccttggaggta

SEQ ID NO: 8414811 - DNA, 22 bp, Homo sapiens
ttttgtgacacttcttgagaca

SEQ ID NO: 8414812 - DNA, 22 bp, Homo sapiens
ttttttatatcaactgaagtct

SEQ ID NO: 8414813 - DNA, 22 bp, Homo sapiens
ttttttatagcaatgaacccac

SEQ ID NO: 8414814 - DNA, 22 bp, Homo sapiens
ttttttatctatggtagtacca

SEQ ID NO: 8414815 - DNA, 22 bp, Homo sapiens
tttgtcatatcacacaattttg

SEQ ID NO: 8414816 - DNA, 22 bp, Homo sapiens
tttgtcatcccttttgaaactg

SEQ ID NO: 8414817 - DNA, 22 bp, Homo sapiens
tttgctgactggatgcagttgg

SEQ ID NO: 8414818 - DNA, 18 bp, Homo sapiens
tttgctgatgagcatcat

SEQ ID NO: 8414819 - DNA, 20 bp, Homo sapiens
tttgagaccagtctgcccaa

SEQ ID NO: 8414820 - DNA, 20 bp, Homo sapiens
tttgagaccagtctgcccaa

SEQ ID NO: 8414821 - DNA, 22 bp, Homo sapiens
tttctagtaaaagctaattacc

SEQ ID NO: 8414822 - DNA, 22 bp, Homo sapiens
tttctagtaatcaatataaagt

SEQ ID NO: 8414823 - DNA, 22 bp, Homo sapiens
tttctagtatataactagatct

SEQ ID NO: 8414824 - DNA, 22 bp, Homo sapiens
tttctagtaaaagctaattacc

SEQ ID NO: 8414825 - DNA, 22 bp, Homo sapiens
tttctagttctctgccaaaaaa

SEQ ID NO: 8414826 - DNA, 22 bp, Homo sapiens
tttctataactggactggattg

SEQ ID NO: 8414827 - DNA, 22 bp, Homo sapiens
tttctattgatctaataaacat

SEQ ID NO: 8414828 - DNA, 22 bp, Homo sapiens
tttgaaatatgaggcattatga

SEQ ID NO: 8414829 - DNA, 22 bp, Homo sapiens
tttgaagacagatcaatataag

SEQ ID NO: 8414830 - DNA, 22 bp, Homo sapiens
tttgaagacatattgttacata

SEQ ID NO: 8414831 - DNA, 22 bp, Homo sapiens
tttgaagacagatcaatataag

SEQ ID NO: 8414832 - DNA, 22 bp, Homo sapiens
tttgaacatgctgcatgataat

SEQ ID NO: 8414833 - DNA, 22 bp, Homo sapiens
tttgacatctaagaattcttac

SEQ ID NO: 8414834 - DNA, 22 bp, Homo sapiens
tttgacatgaagtagcttataa

SEQ ID NO: 8414835 - DNA, 22 bp, Homo sapiens
acaaggcagtacaatgatgaca

SEQ ID NO: 8414836 - DNA, 22 bp, Homo sapiens
acaaggctgttggtcacaaacc

SEQ ID NO: 8414837 - DNA, 21 bp, Homo sapiens
aagagctggatcaaggataag

SEQ ID NO: 8414838 - DNA, 22 bp, Homo sapiens
acaaagattcatttgcattatt

SEQ ID NO: 8414839 - DNA, 22 bp, Homo sapiens
acaaagatcttgctttcctact

SEQ ID NO: 8414840 - DNA, 22 bp, Homo sapiens
acaaagatgtttaaagcattta

SEQ ID NO: 8414841 - DNA, 17 bp, Homo sapiens
aagagaggctgagctgg

SEQ ID NO: 8414842 - DNA, 22 bp, Homo sapiens
acaaggaggatatgtttaaggg

SEQ ID NO: 8414843 - DNA, 22 bp, Homo sapiens
acaaggaggtctggggggccct

SEQ ID NO: 8414844 - DNA, 22 bp, Homo sapiens
acaaggagagcacacatgggga

SEQ ID NO: 8414845 - DNA, 22 bp, Homo sapiens
acaaggagaagaaattggtcat

SEQ ID NO: 8414846 - DNA, 22 bp, Homo sapiens
aatttaactgagagtactttta

SEQ ID NO: 8414847 - DNA, 22 bp, Homo sapiens
aagaataaattaagatacttag

SEQ ID NO: 8414848 - DNA, 22 bp, Homo sapiens
aagaataagaggatttagaaca

SEQ ID NO: 8414849 - DNA, 22 bp, Homo sapiens
aattggcagaactttatatatt

SEQ ID NO: 8414850 - DNA, 22 bp, Homo sapiens
aattggcaagcagatttccact

SEQ ID NO: 8414851 - DNA, 22 bp, Homo sapiens
aagaaagcattagacaggcatt

SEQ ID NO: 8414852 - DNA, 22 bp, Homo sapiens
aagaaatattgggccttataaa

SEQ ID NO: 8414853 - DNA, 22 bp, Homo sapiens
aagaaatgcacacaactgctgg

SEQ ID NO: 8414854 - DNA, 22 bp, Homo sapiens
aacttcatgggttcaaagctgg

SEQ ID NO: 8414855 - DNA, 21 bp, Homo sapiens
aagaaagataattaaggaccc

SEQ ID NO: 8414856 - DNA, 22 bp, Homo sapiens
aagaaatgctgatgttggatgg

SEQ ID NO: 8414857 - DNA, 22 bp, Homo sapiens
aagaaatggcttcatctgagta

SEQ ID NO: 8414858 - DNA, 22 bp, Homo sapiens
aagaaatggaagatccatggtg

SEQ ID NO: 8414859 - DNA, 22 bp, Homo sapiens
aagaaatgcagaaatgtgctgg

SEQ ID NO: 8414860 - DNA, 22 bp, Homo sapiens
acagagtattggaaaggcagtg

SEQ ID NO: 8414861 - DNA, 22 bp, Homo sapiens
aagcattctgcattttcaaaga

SEQ ID NO: 8414862 - DNA, 20 bp, Homo sapiens
acacagtagcaattagtgca

SEQ ID NO: 8414863 - DNA, 22 bp, Homo sapiens
aagattcttacctatacccagt

SEQ ID NO: 8414864 - DNA, 22 bp, Homo sapiens
aatagtgaacaggaacatgctt

SEQ ID NO: 8414865 - DNA, 22 bp, Homo sapiens
aacagtaaaaatcatttagttg

SEQ ID NO: 8414866 - DNA, 22 bp, Homo sapiens
aacatgcatgttatttatcagt

SEQ ID NO: 8414867 - DNA, 22 bp, Homo sapiens
aacaggcttttggaaagttaca

SEQ ID NO: 8414868 - DNA, 22 bp, Homo sapiens
aacaggcaggagaattctgcct

SEQ ID NO: 8414869 - DNA, 22 bp, Homo sapiens
aacaggctatttctttacaaac

SEQ ID NO: 8414870 - DNA, 23 bp, Homo sapiens
aacaggatgtgcttcatcttttg

SEQ ID NO: 8414871 - DNA, 22 bp, Homo sapiens
aactgcatttgcataagtccat

SEQ ID NO: 8414872 - DNA, 22 bp, Homo sapiens
aactgcatttaacaaatactct

SEQ ID NO: 8414873 - DNA, 22 bp, Homo sapiens
aatgataccaaacatgtagata

SEQ ID NO: 8414874 - DNA, 22 bp, Homo sapiens
aatgataccgccaatattacca

SEQ ID NO: 8414875 - DNA, 22 bp, Homo sapiens
aatgatctactctcattatctc

SEQ ID NO: 8414876 - DNA, 22 bp, Homo sapiens
aatgatctggctcaggatatca

SEQ ID NO: 8414877 - DNA, 22 bp, Homo sapiens
aacttaatgatttcatgcatgt

SEQ ID NO: 8414878 - DNA, 22 bp, Homo sapiens
aacttaaacccactcatgtaga

SEQ ID NO: 8414879 - DNA, 22 bp, Homo sapiens
aactgtttcagaaatattgttg

SEQ ID NO: 8414880 - DNA, 22 bp, Homo sapiens
aatccaatcctactcagaaagt

SEQ ID NO: 8414881 - DNA, 22 bp, Homo sapiens
aactgcataatatatcatgcag

SEQ ID NO: 8414882 - DNA, 22 bp, Homo sapiens
aactgcatgtgtgtggcatgat

SEQ ID NO: 8414883 - DNA, 22 bp, Homo sapiens
aactgcattcagaaagctcact

SEQ ID NO: 8414884 - DNA, 22 bp, Homo sapiens
aactgcattgtactaaacttgt

SEQ ID NO: 8414885 - DNA, 22 bp, Homo sapiens
aagtccagctctaaatatctga

SEQ ID NO: 8414886 - DNA, 17 bp, Homo sapiens
aagtccagagttgagca

SEQ ID NO: 8414887 - DNA, 22 bp, Homo sapiens
aacagaggctccctgcacttgt

SEQ ID NO: 8414888 - DNA, 22 bp, Homo sapiens
aaggtctctgttgagaacattt

SEQ ID NO: 8414889 - DNA, 22 bp, Homo sapiens
aacacctaaaaatcattgttga

SEQ ID NO: 8414890 - DNA, 22 bp, Homo sapiens
aacaaagtcgttgcctagaaga

SEQ ID NO: 8414891 - DNA, 22 bp, Homo sapiens
aaggtcagagcaggaaggagtc

SEQ ID NO: 8414892 - DNA, 22 bp, Homo sapiens
aaatgttccgggtaaggagaaa

SEQ ID NO: 8414893 - DNA, 22 bp, Homo sapiens
aaattctaaggtcacaatgttg

SEQ ID NO: 8414894 - DNA, 22 bp, Homo sapiens
aacaaacagttaagtgtggatg

SEQ ID NO: 8414895 - DNA, 22 bp, Homo sapiens
aaattttagaccaggcaaaact

SEQ ID NO: 8414896 - DNA, 22 bp, Homo sapiens
aaattctttcatggctaataag

SEQ ID NO: 8414897 - DNA, 22 bp, Homo sapiens
aaatcctaaggagaatatgatt

SEQ ID NO: 8414898 - DNA, 22 bp, Homo sapiens
aaatcctaagcagaggaattta

SEQ ID NO: 8414899 - DNA, 22 bp, Homo sapiens
aaatcctaaaagtttgacttaa

SEQ ID NO: 8414900 - DNA, 22 bp, Homo sapiens
aaatcctaccaagaaattccct

SEQ ID NO: 8414901 - DNA, 22 bp, Homo sapiens
aaatcctaatgacaagtttagt

SEQ ID NO: 8414902 - DNA, 22 bp, Homo sapiens
aaatcctaataatgcactagtg

SEQ ID NO: 8414903 - DNA, 22 bp, Homo sapiens
aaatgcaggaaattatgctttt

SEQ ID NO: 8414904 - DNA, 23 bp, Homo sapiens
aaatgcacagtattgatttttaa

SEQ ID NO: 8414905 - DNA, 22 bp, Homo sapiens
aaatgcacaggttttaaatcct

SEQ ID NO: 8414906 - DNA, 22 bp, Homo sapiens
aaatgcatcagctcataagaga

SEQ ID NO: 8414907 - DNA, 22 bp, Homo sapiens
aaatagatttcctagcattgga

SEQ ID NO: 8414908 - DNA, 22 bp, Homo sapiens
aaatagcagcctttagttaaca

SEQ ID NO: 8414909 - DNA, 22 bp, Homo sapiens
aaataattatagcgagtctatc

SEQ ID NO: 8414910 - DNA, 22 bp, Homo sapiens
aaataattgagttggtcaatat

SEQ ID NO: 8414911 - DNA, 23 bp, Homo sapiens
aaataggagtatctggatcatga

SEQ ID NO: 8414912 - DNA, 22 bp, Homo sapiens
aaataactttctgtgtatagtc

SEQ ID NO: 8414913 - DNA, 22 bp, Homo sapiens
aaagtgttttgatttagtggta

SEQ ID NO: 8414914 - DNA, 22 bp, Homo sapiens
aaagtgtttttgagctgtagtt

SEQ ID NO: 8414915 - DNA, 22 bp, Homo sapiens
aaagtgttgggattacaggcat

SEQ ID NO: 8414916 - DNA, 22 bp, Homo sapiens
aacaaacaaacattttgtcatc

SEQ ID NO: 8414917 - DNA, 22 bp, Homo sapiens
aaagataatgtttccttattct

SEQ ID NO: 8414918 - DNA, 22 bp, Homo sapiens
aacaaaagccgaagtaggtgtc

SEQ ID NO: 8414919 - DNA, 22 bp, Homo sapiens
aaattttagtaaggaagttgag

SEQ ID NO: 8414920 - DNA, 22 bp, Homo sapiens
aaattttagactcctgggtcta

SEQ ID NO: 8414921 - DNA, 22 bp, Homo sapiens
aaattttcctggtaaagatgga

SEQ ID NO: 8414922 - DNA, 22 bp, Homo sapiens
aaagccacgtggcctggggagc

SEQ ID NO: 8414923 - DNA, 22 bp, Homo sapiens
aaagcttttcagtatgttcatg

SEQ ID NO: 8414924 - DNA, 22 bp, Homo sapiens
aactaaaactggtttgttctct

SEQ ID NO: 8414925 - DNA, 22 bp, Homo sapiens
aactaaaagtgtgtctcttgta

SEQ ID NO: 8414926 - DNA, 22 bp, Homo sapiens
aactaaatctggcatttagagc

SEQ ID NO: 8414927 - DNA, 22 bp, Homo sapiens
aaagtgctttaggatatttgga

SEQ ID NO: 8414928 - DNA, 22 bp, Homo sapiens
aaagtgctttcccacatttgtt

SEQ ID NO: 8414929 - DNA, 22 bp, Homo sapiens
aaagtatttttgacaggcatta

SEQ ID NO: 8414930 - DNA, 19 bp, Homo sapiens
aaactctgaaggccactgg

SEQ ID NO: 8414931 - DNA, 22 bp, Homo sapiens
aaacaatgttcctatattagag

SEQ ID NO: 8414932 - DNA, 22 bp, Homo sapiens
aaagagttctatgatctttcca

SEQ ID NO: 8414933 - DNA, 22 bp, Homo sapiens
aaatgcactgaacacatgttgt

SEQ ID NO: 8414934 - DNA, 22 bp, Homo sapiens
aaatgcagaatgatttcatcta

SEQ ID NO: 8414935 - DNA, 22 bp, Homo sapiens
aaatgcagaatgatttcatcta

SEQ ID NO: 8414936 - DNA, 22 bp, Homo sapiens
aaatgcagatccctgaatctca

SEQ ID NO: 8414937 - DNA, 22 bp, Homo sapiens
aaactgaaacatcatcatgttg

SEQ ID NO: 8414938 - DNA, 22 bp, Homo sapiens
aaactctggagatgtttatgca

SEQ ID NO: 8414939 - DNA, 22 bp, Homo sapiens
aaactctgccatttttggcctg

SEQ ID NO: 8414940 - DNA, 22 bp, Homo sapiens
aaactctgcactgcggtaaggt

SEQ ID NO: 8414941 - DNA, 22 bp, Homo sapiens
aaactctgatgcttattgggaa

SEQ ID NO: 8414942 - DNA, 22 bp, Homo sapiens
aaactctggattggagtccagc

SEQ ID NO: 8414943 - DNA, 22 bp, Homo sapiens
aaactctgggggtggagcccag

SEQ ID NO: 8414944 - DNA, 22 bp, Homo sapiens
aaactctgtagctaaacataat

SEQ ID NO: 8414945 - DNA, 22 bp, Homo sapiens
aaactctgtagctaaacataat

SEQ ID NO: 8414946 - DNA, 22 bp, Homo sapiens
aaactctgtatttgctgtgggt

SEQ ID NO: 8414947 - DNA, 22 bp, Homo sapiens
aaactctgttgagataatattt

SEQ ID NO: 8414948 - DNA, 22 bp, Homo sapiens
aaactctttccacgattacttt

SEQ ID NO: 8414949 - DNA, 22 bp, Homo sapiens
aaagaaggtagggctggtgact

SEQ ID NO: 8414950 - DNA, 22 bp, Homo sapiens
aaaaatcacttttataggcagc

SEQ ID NO: 8414951 - DNA, 22 bp, Homo sapiens
aaaatgaagcaaaggcattcag

SEQ ID NO: 8414952 - DNA, 22 bp, Homo sapiens
aaaaaccattgtcttcagtctc

SEQ ID NO: 8414953 - DNA, 23 bp, Homo sapiens
aaaaaaccatgtaggcactcagt

SEQ ID NO: 8414954 - DNA, 22 bp, Homo sapiens
aaaaaattccattctgtgcctt

SEQ ID NO: 8414955 - DNA, 22 bp, Homo sapiens
aaaaaattatcatagttcctga

SEQ ID NO: 8414956 - DNA, 22 bp, Homo sapiens
aaaagagaatcctgtacagaga

SEQ ID NO: 8414957 - DNA, 22 bp, Homo sapiens
aaactcagatgtggtgaagacc

SEQ ID NO: 8414958 - DNA, 22 bp, Homo sapiens
aaaatcctgctgactcgagatg

SEQ ID NO: 8414959 - DNA, 22 bp, Homo sapiens
aaaatccttagccgagtgaggt

SEQ ID NO: 8414960 - DNA, 22 bp, Homo sapiens
aaaatcctctaattctagaata

SEQ ID NO: 8414961 - DNA, 22 bp, Homo sapiens
aaaattttgccctatccttcat

SEQ ID NO: 8414962 - DNA, 20 bp, Homo sapiens
aaaatctcccagaaacttat

SEQ ID NO: 8414963 - DNA, 22 bp, Homo sapiens
aaaatccttagccgagtgaggt

SEQ ID NO: 8414964 - DNA, 22 bp, Homo sapiens
aaacaagtttgtagactagcca

SEQ ID NO: 8414965 - DNA, 22 bp, Homo sapiens
aaacaatgaaatatttttatgg

SEQ ID NO: 8414966 - DNA, 22 bp, Homo sapiens
aaacaagtcactttatcttgaa

SEQ ID NO: 8414967 - DNA, 22 bp, Homo sapiens
aaacaagtgtaaactagtctgt

SEQ ID NO: 8414968 - DNA, 23 bp, Homo sapiens
aaacaagtctctcaatggcttgc

SEQ ID NO: 8414969 - DNA, 22 bp, Homo sapiens
aaacaagtttagaataatgaat

SEQ ID NO: 8414970 - DNA, 22 bp, Homo sapiens
aattttattaactggatgtagc

SEQ ID NO: 8414971 - DNA, 22 bp, Homo sapiens
aattttatgccttgcacgttgg

SEQ ID NO: 8414972 - DNA, 22 bp, Homo sapiens
aattttcacagtgctgtgagat

SEQ ID NO: 8414973 - DNA, 22 bp, Homo sapiens
aattttcacagtgctgtgagat

SEQ ID NO: 8414974 - DNA, 22 bp, Homo sapiens
agagctgggtggtggtgactca

SEQ ID NO: 8414975 - DNA, 20 bp, Homo sapiens
acaaaataggtactgggtag

SEQ ID NO: 8414976 - DNA, 22 bp, Homo sapiens
acaaaattgtgttaaactttat

SEQ ID NO: 8414977 - DNA, 22 bp, Homo sapiens
acaaaccagcttaagcaagatg

SEQ ID NO: 8414978 - DNA, 19 bp, Homo sapiens
acaaatgatgttgcactga

SEQ ID NO: 8414979 - DNA, 22 bp, Homo sapiens
acaaatgcaagttttatgtcaa

SEQ ID NO: 8414980 - DNA, 22 bp, Homo sapiens
acaagtttatttgattagaaca

SEQ ID NO: 8414981 - DNA, 22 bp, Homo sapiens
acaagtttatttgattagaaca

SEQ ID NO: 8414982 - DNA, 22 bp, Homo sapiens
acaaggtatccacattaaatgt

SEQ ID NO: 8414983 - DNA, 22 bp, Homo sapiens
acaagtaccaaatgctcaagta

SEQ ID NO: 8414984 - DNA, 22 bp, Homo sapiens
acaagtctcaacagcagccagc

SEQ ID NO: 8414985 - DNA, 22 bp, Homo sapiens
acaagtctttttcatgtcttct

SEQ ID NO: 8414986 - DNA, 22 bp, Homo sapiens
acaagtctgttatgcacctgga

SEQ ID NO: 8414987 - DNA, 22 bp, Homo sapiens
acaatgtttttgttcaaagagt

SEQ ID NO: 8414988 - DNA, 22 bp, Homo sapiens
acaattcattaatgtgaggtag

SEQ ID NO: 8414989 - DNA, 22 bp, Homo sapiens
aatgtattctctttataagata

SEQ ID NO: 8414990 - DNA, 22 bp, Homo sapiens
agacaggctttgctgtatatca

SEQ ID NO: 8414991 - DNA, 22 bp, Homo sapiens
aatgtctcaccgtaaatgtaac

SEQ ID NO: 8414992 - DNA, 21 bp, Homo sapiens
agacagagtgcagtctacata

SEQ ID NO: 8414993 - DNA, 22 bp, Homo sapiens
aatgttatttctgcatagtagt

SEQ ID NO: 8414994 - DNA, 22 bp, Homo sapiens
aatgttgaggatatcagaaaat

SEQ ID NO: 8414995 - DNA, 21 bp, Homo sapiens
aattagggtgcctcttataat

SEQ ID NO: 8414996 - DNA, 22 bp, Homo sapiens
aattagtaacctaattccatct

SEQ ID NO: 8414997 - DNA, 22 bp, Homo sapiens
aattaggggaggacgtatcata

SEQ ID NO: 8414998 - DNA, 19 bp, Homo sapiens
aattagggagtcggttaag

SEQ ID NO: 8414999 - DNA, 22 bp, Homo sapiens
aattagggagccatcataaggt

SEQ ID NO: 8415000 - DNA, 22 bp, Homo sapiens
aattagggagaggtagctaggt

SEQ ID NO: 8415001 - DNA, 22 bp, Homo sapiens
aattagggaggacaaaggtaca

SEQ ID NO: 8415002 - DNA, 22 bp, Homo sapiens
aattagggaaaatttacttgta

SEQ ID NO: 8415003 - DNA, 22 bp, Homo sapiens
aattagggaagtatttagtagt

SEQ ID NO: 8415004 - DNA, 22 bp, Homo sapiens
aattagggaaaacatttgcttt

SEQ ID NO: 8415005 - DNA, 22 bp, Homo sapiens
aatgttgtttttctgcatgtct

SEQ ID NO: 8415006 - DNA, 19 bp, Homo sapiens
aatgtttaagagaaaaagg

SEQ ID NO: 8415007 - DNA, 22 bp, Homo sapiens
aatttacagttgctgatggtac

SEQ ID NO: 8415008 - DNA, 22 bp, Homo sapiens
aatttacaggtgcactcgccat

SEQ ID NO: 8415009 - DNA, 22 bp, Homo sapiens
aatttagattgataaacatgga

SEQ ID NO: 8415010 - DNA, 22 bp, Homo sapiens
aattatattgtggtgtgaatgt

SEQ ID NO: 8415011 - DNA, 22 bp, Homo sapiens
aattatgaggtagatatcacat

SEQ ID NO: 8415012 - DNA, 22 bp, Homo sapiens
aattatgattggtctaaaccag

SEQ ID NO: 8415013 - DNA, 22 bp, Homo sapiens
aattatatgttaatcttcaatt

SEQ ID NO: 8415014 - DNA, 22 bp, Homo sapiens
aattatattgaagttgaatgtc

SEQ ID NO: 8415015 - DNA, 20 bp, Homo sapiens
aattatataactccaacatt

SEQ ID NO: 8415016 - DNA, 22 bp, Homo sapiens
acagagaggtaaaatatatagt

SEQ ID NO: 8415017 - DNA, 22 bp, Homo sapiens
acagagagggagtgataaatcc

SEQ ID NO: 8415018 - DNA, 22 bp, Homo sapiens
agccatcctcccacctcagcct

SEQ ID NO: 8415019 - DNA, 22 bp, Homo sapiens
agccacagtcaacctgtccata

SEQ ID NO: 8415020 - DNA, 22 bp, Homo sapiens
agccattgttgtcttcatcttc

SEQ ID NO: 8415021 - DNA, 21 bp, Homo sapiens
acagagcataatggtgtggca

SEQ ID NO: 8415022 - DNA, 22 bp, Homo sapiens
acagagcatgctcagtgtgtga

SEQ ID NO: 8415023 - DNA, 22 bp, Homo sapiens
acagagtctgacaggtaggcgc

SEQ ID NO: 8415024 - DNA, 22 bp, Homo sapiens
acagcaactcctgcttctgagt

SEQ ID NO: 8415025 - DNA, 22 bp, Homo sapiens
acagcaataggaaatacttgca

SEQ ID NO: 8415026 - DNA, 21 bp, Homo sapiens
agcctgcaatgtaggtaccgg

SEQ ID NO: 8415027 - DNA, 22 bp, Homo sapiens
agcctgcgatcccacctggcct

SEQ ID NO: 8415028 - DNA, 22 bp, Homo sapiens
acacaggaactctgagaggtgg

SEQ ID NO: 8415029 - DNA, 22 bp, Homo sapiens
acacaggaagcaatttcagagc

SEQ ID NO: 8415030 - DNA, 22 bp, Homo sapiens
acacaggaagagagataataat

SEQ ID NO: 8415031 - DNA, 22 bp, Homo sapiens
agcacctccttagctatgacca

SEQ ID NO: 8415032 - DNA, 20 bp, Homo sapiens
agcacctcccatatgctaga

SEQ ID NO: 8415033 - DNA, 22 bp, Homo sapiens
agcacccttcagcccagcctgg

SEQ ID NO: 8415034 - DNA, 18 bp, Homo sapiens
acactgcagcagtctgct

SEQ ID NO: 8415035 - DNA, 19 bp, Homo sapiens
acacatttgcacaatccac

SEQ ID NO: 8415036 - DNA, 22 bp, Homo sapiens
acacatttctctttttgtaagt

SEQ ID NO: 8415037 - DNA, 22 bp, Homo sapiens
acacattttctaacagggatca

SEQ ID NO: 8415038 - DNA, 22 bp, Homo sapiens
acacattttcaacactgtcaag

SEQ ID NO: 8415039 - DNA, 22 bp, Homo sapiens
acacattttggctaggtggaga

SEQ ID NO: 8415040 - DNA, 22 bp, Homo sapiens
agcagtgttcaatgatacactg

SEQ ID NO: 8415041 - DNA, 22 bp, Homo sapiens
acagaaagataggcacaaggtc

SEQ ID NO: 8415042 - DNA, 22 bp, Homo sapiens
accatcttagcagactgcagtg

SEQ ID NO: 8415043 - DNA, 22 bp, Homo sapiens
accatgatgggaagctcagggc

SEQ ID NO: 8415044 - DNA, 23 bp, Homo sapiens
accatgatgggagtgcaaataag

SEQ ID NO: 8415045 - DNA, 22 bp, Homo sapiens
accatgatgcatccttaaggaa

SEQ ID NO: 8415046 - DNA, 22 bp, Homo sapiens
accatgatctgctctggtgttt

SEQ ID NO: 8415047 - DNA, 22 bp, Homo sapiens
aaggtgctgtggacttgggagc

SEQ ID NO: 8415048 - DNA, 22 bp, Homo sapiens
aagtacatttttaacttacagc

SEQ ID NO: 8415049 - DNA, 22 bp, Homo sapiens
aagtacattatatgagcagaat

SEQ ID NO: 8415050 - DNA, 22 bp, Homo sapiens
aagtacatgctgtaatgattgg

SEQ ID NO: 8415051 - DNA, 22 bp, Homo sapiens
aagtacatggaggatagctgct

SEQ ID NO: 8415052 - DNA, 22 bp, Homo sapiens
aagtacatgttgttcaaaagcc

SEQ ID NO: 8415053 - DNA, 23 bp, Homo sapiens
aagtacatatatttagatagtga

SEQ ID NO: 8415054 - DNA, 22 bp, Homo sapiens
aagggctcacccaactcacttc

SEQ ID NO: 8415055 - DNA, 22 bp, Homo sapiens
aagggctccacttgaatcacac

SEQ ID NO: 8415056 - DNA, 22 bp, Homo sapiens
aagggctccaagaggtagctgg

SEQ ID NO: 8415057 - DNA, 22 bp, Homo sapiens
aagggctcccaactcatctttt

SEQ ID NO: 8415058 - DNA, 22 bp, Homo sapiens
aagggctccctgcctgaggtgg

SEQ ID NO: 8415059 - DNA, 22 bp, Homo sapiens
aagggctccatccttataaatg

SEQ ID NO: 8415060 - DNA, 22 bp, Homo sapiens
aagggctctgctgtctctcccc

SEQ ID NO: 8415061 - DNA, 22 bp, Homo sapiens
aagggctctctgcattgaaatt

SEQ ID NO: 8415062 - DNA, 22 bp, Homo sapiens
aagggctcggtagcagtcctga

SEQ ID NO: 8415063 - DNA, 22 bp, Homo sapiens
aagggctctgtgcttgtcccat

SEQ ID NO: 8415064 - DNA, 22 bp, Homo sapiens
aagggctctgggctacgcactg

SEQ ID NO: 8415065 - DNA, 22 bp, Homo sapiens
aagggctcttctatttatggcc

SEQ ID NO: 8415066 - DNA, 22 bp, Homo sapiens
aagggctctgtgtgcctcccca

SEQ ID NO: 8415067 - DNA, 22 bp, Homo sapiens
aagggctctgttgccatttcag

SEQ ID NO: 8415068 - DNA, 22 bp, Homo sapiens
aagggccatcccagaacagaaa

SEQ ID NO: 8415069 - DNA, 22 bp, Homo sapiens
aagggccattgctgagagcagt

SEQ ID NO: 8415070 - DNA, 22 bp, Homo sapiens
aagggcattgaggctgagagac

SEQ ID NO: 8415071 - DNA, 22 bp, Homo sapiens
aaggctttcagctaacttgatt

SEQ ID NO: 8415072 - DNA, 22 bp, Homo sapiens
aaggcttttgttcctatttagt

SEQ ID NO: 8415073 - DNA, 22 bp, Homo sapiens
aaggcttttgggaattttcaac

SEQ ID NO: 8415074 - DNA, 22 bp, Homo sapiens
aaggcttttaactactgtttta

SEQ ID NO: 8415075 - DNA, 22 bp, Homo sapiens
aagggaccctggatcaaatgga

SEQ ID NO: 8415076 - DNA, 22 bp, Homo sapiens
acatgtgtacttttaaggatgt

SEQ ID NO: 8415077 - DNA, 22 bp, Homo sapiens
acatgtgtggccgctgtagaca

SEQ ID NO: 8415078 - DNA, 22 bp, Homo sapiens
aaggctttatgtgaccaaaaga

SEQ ID NO: 8415079 - DNA, 22 bp, Homo sapiens
aaggctgcctctgccagaggag

SEQ ID NO: 8415080 - DNA, 22 bp, Homo sapiens
aaggcatgatgtaatcaatgat

SEQ ID NO: 8415081 - DNA, 22 bp, Homo sapiens
aaggcatatgctgtgtacagtt

SEQ ID NO: 8415082 - DNA, 22 bp, Homo sapiens
aaggcatagtctttaagttctg

SEQ ID NO: 8415083 - DNA, 22 bp, Homo sapiens
aaggcataggacaaatcagtga

SEQ ID NO: 8415084 - DNA, 22 bp, Homo sapiens
aaggcatatattctaaacagga

SEQ ID NO: 8415085 - DNA, 22 bp, Homo sapiens
aaggcatatgcatagaagacag

SEQ ID NO: 8415086 - DNA, 22 bp, Homo sapiens
aaggcatacatattgttatagg

SEQ ID NO: 8415087 - DNA, 22 bp, Homo sapiens
aaggcatacctgaatgtttgtg

SEQ ID NO: 8415088 - DNA, 22 bp, Homo sapiens
acagttgacagggagagggtta

SEQ ID NO: 8415089 - DNA, 22 bp, Homo sapiens
acagttctgcaagatatttttt

SEQ ID NO: 8415090 - DNA, 22 bp, Homo sapiens
aaggcaggatgggaaaagattt

SEQ ID NO: 8415091 - DNA, 22 bp, Homo sapiens
aaggcagcttcaccacagcatt

SEQ ID NO: 8415092 - DNA, 22 bp, Homo sapiens
aaggcagtcaaagcagacttct

SEQ ID NO: 8415093 - DNA, 22 bp, Homo sapiens
aaggcagtaggatcttccacag

SEQ ID NO: 8415094 - DNA, 22 bp, Homo sapiens
aaggcagtactttatgtccata

SEQ ID NO: 8415095 - DNA, 22 bp, Homo sapiens
acagtataaactcctaaaagcc

SEQ ID NO: 8415096 - DNA, 22 bp, Homo sapiens
acagtatacattgattaggacc

SEQ ID NO: 8415097 - DNA, 21 bp, Homo sapiens
acagtacttgagatcttttga

SEQ ID NO: 8415098 - DNA, 22 bp, Homo sapiens
aagctttaagtgtcagtcagcc

SEQ ID NO: 8415099 - DNA, 22 bp, Homo sapiens
aagctttaaggaattttatgga

SEQ ID NO: 8415100 - DNA, 22 bp, Homo sapiens
acaggcagtgggccagatttgt

SEQ ID NO: 8415101 - DNA, 22 bp, Homo sapiens
acaggcaggtcctgtcccagct

SEQ ID NO: 8415102 - DNA, 22 bp, Homo sapiens
aatgagaaccttgaaaggaact

SEQ ID NO: 8415103 - DNA, 22 bp, Homo sapiens
agaagggaactcagagatgatt

SEQ ID NO: 8415104 - DNA, 22 bp, Homo sapiens
aatgagatggaattcccgccta

SEQ ID NO: 8415105 - DNA, 22 bp, Homo sapiens
agaaagttttgtgctatatatg

SEQ ID NO: 8415106 - DNA, 22 bp, Homo sapiens
aatatttgttagtgttttaatg

SEQ ID NO: 8415107 - DNA, 22 bp, Homo sapiens
aatacaatcaaattcactagca

SEQ ID NO: 8415108 - DNA, 22 bp, Homo sapiens
aatcctgacctgggcatgcttg

SEQ ID NO: 8415109 - DNA, 22 bp, Homo sapiens
aatccatttactctttacaaga

SEQ ID NO: 8415110 - DNA, 22 bp, Homo sapiens
acttgtctggcagatcatgcaa

SEQ ID NO: 8415111 - DNA, 22 bp, Homo sapiens
aatcaagaaaatgaggattctt

SEQ ID NO: 8415112 - DNA, 22 bp, Homo sapiens
aagtggactaatacaaggacta

SEQ ID NO: 8415113 - DNA, 23 bp, Homo sapiens
actaaatggggctttgcttaaag

SEQ ID NO: 8415114 - DNA, 22 bp, Homo sapiens
actaaatggaatgattactata

SEQ ID NO: 8415115 - DNA, 22 bp, Homo sapiens
aagtcacagagttggaagtcag

SEQ ID NO: 8415116 - DNA, 22 bp, Homo sapiens
actaatgattattgtcattgtg

SEQ ID NO: 8415117 - DNA, 22 bp, Homo sapiens
actaagtagtttcacatataat

SEQ ID NO: 8415118 - DNA, 22 bp, Homo sapiens
actaattgagtgcatgatcttt

SEQ ID NO: 8415119 - DNA, 22 bp, Homo sapiens
actaattgtatagttgatgtaa

SEQ ID NO: 8415120 - DNA, 22 bp, Homo sapiens
aagtttaacttgaattctttct

SEQ ID NO: 8415121 - DNA, 22 bp, Homo sapiens
aagtttatgttggtaagatatc

SEQ ID NO: 8415122 - DNA, 22 bp, Homo sapiens
aagtttatgttggtaagatatc

SEQ ID NO: 8415123 - DNA, 22 bp, Homo sapiens
aataagatcctgaagatatgtt

SEQ ID NO: 8415124 - DNA, 22 bp, Homo sapiens
aataattatttgagagcagacc

SEQ ID NO: 8415125 - DNA, 22 bp, Homo sapiens
aataatattcctctgtgtgcgt

SEQ ID NO: 8415126 - DNA, 22 bp, Homo sapiens
actgcgctccagcctgggtgac

SEQ ID NO: 8415127 - DNA, 22 bp, Homo sapiens
actgccttcaaacagcgccacc

SEQ ID NO: 8415128 - DNA, 22 bp, Homo sapiens
atgtcaaatcagttttatcaga

SEQ ID NO: 8415129 - DNA, 22 bp, Homo sapiens
atgtgggccgtgcgggtgtcct

SEQ ID NO: 8415130 - DNA, 22 bp, Homo sapiens
atgtggttgaagaattacatct

SEQ ID NO: 8415131 - DNA, 22 bp, Homo sapiens
agagccaatcttcagagcagag

SEQ ID NO: 8415132 - DNA, 22 bp, Homo sapiens
agagccaaggctgagagctatt

SEQ ID NO: 8415133 - DNA, 22 bp, Homo sapiens
agagcatccatcggccaggacc

SEQ ID NO: 8415134 - DNA, 23 bp, Homo sapiens
agagcatcatgatgctaagtctg

SEQ ID NO: 8415135 - DNA, 22 bp, Homo sapiens
agagcatctaacacataagcct

SEQ ID NO: 8415136 - DNA, 22 bp, Homo sapiens
atggccgcctgtccttcccgcc

SEQ ID NO: 8415137 - DNA, 22 bp, Homo sapiens
agagacagggttttgtcgtgtt

SEQ ID NO: 8415138 - DNA, 22 bp, Homo sapiens
agagaagagtcttgtcaaatta

SEQ ID NO: 8415139 - DNA, 22 bp, Homo sapiens
atgaaagatgatttaaagtact

SEQ ID NO: 8415140 - DNA, 22 bp, Homo sapiens
atctcagaaacatatctaatcc

SEQ ID NO: 8415141 - DNA, 22 bp, Homo sapiens
atctcagatctacagatctaca

SEQ ID NO: 8415142 - DNA, 22 bp, Homo sapiens
agacatcaatgatcagaggtag

SEQ ID NO: 8415143 - DNA, 22 bp, Homo sapiens
agacatattggcttgctttaat

SEQ ID NO: 8415144 - DNA, 22 bp, Homo sapiens
agacaggatgcatactcttggt

SEQ ID NO: 8415145 - DNA, 20 bp, Homo sapiens
agacaggagcccccattcag

SEQ ID NO: 8415146 - DNA, 22 bp, Homo sapiens
agacaggagagggaactgccgg

SEQ ID NO: 8415147 - DNA, 22 bp, Homo sapiens
atgacaaaggctgaaagggaaa

SEQ ID NO: 8415148 - DNA, 22 bp, Homo sapiens
atgacaagggttgacacatgtc

SEQ ID NO: 8415149 - DNA, 22 bp, Homo sapiens
atgacaagggagggtcctgcta

SEQ ID NO: 8415150 - DNA, 22 bp, Homo sapiens
atgacaagagtgttcagggaga

SEQ ID NO: 8415151 - DNA, 22 bp, Homo sapiens
atgcacctgaactccatcagct

SEQ ID NO: 8415152 - DNA, 22 bp, Homo sapiens
atgtttatgttgggctatattt

SEQ ID NO: 8415153 - DNA, 22 bp, Homo sapiens
atgtttatggagcaggtattag

SEQ ID NO: 8415154 - DNA, 22 bp, Homo sapiens
agaggacagacggaaagtgcca

SEQ ID NO: 8415155 - DNA, 22 bp, Homo sapiens
agaggacacatctttcctcaaa

SEQ ID NO: 8415156 - DNA, 22 bp, Homo sapiens
atgtttatgacctccataagga

SEQ ID NO: 8415157 - DNA, 21 bp, Homo sapiens
agagctggtaggtaggtaggt

SEQ ID NO: 8415158 - DNA, 20 bp, Homo sapiens
agaggaggattattttattc

SEQ ID NO: 8415159 - DNA, 22 bp, Homo sapiens
agaggacaggttttccatgggc

SEQ ID NO: 8415160 - DNA, 22 bp, Homo sapiens
agaggaggcagcttaactcagt

SEQ ID NO: 8415161 - DNA, 22 bp, Homo sapiens
agaggaggctgggtccagataa

SEQ ID NO: 8415162 - DNA, 22 bp, Homo sapiens
attattagacttatatggtagt

SEQ ID NO: 8415163 - DNA, 22 bp, Homo sapiens
attattagtgatgttgttactg

SEQ ID NO: 8415164 - DNA, 22 bp, Homo sapiens
attattaggtgctctctgacaa

SEQ ID NO: 8415165 - DNA, 22 bp, Homo sapiens
attattaggactactggggttg

SEQ ID NO: 8415166 - DNA, 22 bp, Homo sapiens
attattagattcttaattgtaa

SEQ ID NO: 8415167 - DNA, 22 bp, Homo sapiens
attcattagccactaactagca

SEQ ID NO: 8415168 - DNA, 22 bp, Homo sapiens
attcatttaggtattcacttac

SEQ ID NO: 8415169 - DNA, 17 bp, Homo sapiens
agagggaaaatgcggtt

SEQ ID NO: 8415170 - DNA, 22 bp, Homo sapiens
agagggaaaaactcatgtcatt

SEQ ID NO: 8415171 - DNA, 22 bp, Homo sapiens
agagggaagatggtccaatctt

SEQ ID NO: 8415172 - DNA, 22 bp, Homo sapiens
agagggaacggatcccagcgcg

SEQ ID NO: 8415173 - DNA, 18 bp, Homo sapiens
agagggaatcagttggat

SEQ ID NO: 8415174 - DNA, 22 bp, Homo sapiens
agagggaaggacagatgtttca

SEQ ID NO: 8415175 - DNA, 18 bp, Homo sapiens
agagggaaagcaggctga

SEQ ID NO: 8415176 - DNA, 22 bp, Homo sapiens
agagggaaatccaggagtgctt

SEQ ID NO: 8415177 - DNA, 22 bp, Homo sapiens
agagggaatgtgattgcaccat

SEQ ID NO: 8415178 - DNA, 22 bp, Homo sapiens
attgagtacctccagattcata

SEQ ID NO: 8415179 - DNA, 22 bp, Homo sapiens
attgagtattgtaaataaaaca

SEQ ID NO: 8415180 - DNA, 22 bp, Homo sapiens
attgagtagtaggaaaataact

SEQ ID NO: 8415181 - DNA, 22 bp, Homo sapiens
attgctgaaagtattttatgac

SEQ ID NO: 8415182 - DNA, 22 bp, Homo sapiens
attgctgactcaataattgaag

SEQ ID NO: 8415183 - DNA, 22 bp, Homo sapiens
agaggtcagaacaggaaagtgt

SEQ ID NO: 8415184 - DNA, 22 bp, Homo sapiens
agaggtcagagcaggaaaggca

SEQ ID NO: 8415185 - DNA, 22 bp, Homo sapiens
agaggtcatatctcagaagaga

SEQ ID NO: 8415186 - DNA, 22 bp, Homo sapiens
agaggtcagctgcatgccacat

SEQ ID NO: 8415187 - DNA, 22 bp, Homo sapiens
atttcacagctgtcagtgttac

SEQ ID NO: 8415188 - DNA, 22 bp, Homo sapiens
atttcacatctatctcagattt

SEQ ID NO: 8415189 - DNA, 22 bp, Homo sapiens
atttcacagctgctgttcaggt

SEQ ID NO: 8415190 - DNA, 22 bp, Homo sapiens
atttcacaaagaacagatgcag

SEQ ID NO: 8415191 - DNA, 22 bp, Homo sapiens
atttctcatcaagtgccaactc

SEQ ID NO: 8415192 - DNA, 22 bp, Homo sapiens
atttctcagttcctactgttta

SEQ ID NO: 8415193 - DNA, 22 bp, Homo sapiens
atttctcattttgcttcaaagg

SEQ ID NO: 8415194 - DNA, 22 bp, Homo sapiens
atttgttccacacatatttact

SEQ ID NO: 8415195 - DNA, 22 bp, Homo sapiens
atttggcaacattaattgaatc

SEQ ID NO: 8415196 - DNA, 20 bp, Homo sapiens
atttggcatgaagtattgat

SEQ ID NO: 8415197 - DNA, 22 bp, Homo sapiens
cacccagggctgtgcctgccca

SEQ ID NO: 8415198 - DNA, 22 bp, Homo sapiens
cacccaggctggagagcagtgg

SEQ ID NO: 8415199 - DNA, 22 bp, Homo sapiens
agcaggcactatgccaggatct

SEQ ID NO: 8415200 - DNA, 22 bp, Homo sapiens
cacacacagttttgtattctgt

SEQ ID NO: 8415201 - DNA, 22 bp, Homo sapiens
cacaaggcacattccttgtcca

SEQ ID NO: 8415202 - DNA, 22 bp, Homo sapiens
cacaagatggtcacataagtgc

SEQ ID NO: 8415203 - DNA, 22 bp, Homo sapiens
caagatttccaaccctgggtaa

SEQ ID NO: 8415204 - DNA, 22 bp, Homo sapiens
caagatttatattttcacacaa

SEQ ID NO: 8415205 - DNA, 22 bp, Homo sapiens
caagatttagctcccttatctc

SEQ ID NO: 8415206 - DNA, 22 bp, Homo sapiens
caagatttagcctgctgcctgt

SEQ ID NO: 8415207 - DNA, 19 bp, Homo sapiens
caagatttgttcacacatg

SEQ ID NO: 8415208 - DNA, 22 bp, Homo sapiens
caagattttatctccgtttctg

SEQ ID NO: 8415209 - DNA, 19 bp, Homo sapiens
caagatttgttcacacatg

SEQ ID NO: 8415210 - DNA, 22 bp, Homo sapiens
caagatttgtattgggcctctg

SEQ ID NO: 8415211 - DNA, 22 bp, Homo sapiens
caagatttgggggcacggaatc

SEQ ID NO: 8415212 - DNA, 22 bp, Homo sapiens
caagatttgccagtggccaact

SEQ ID NO: 8415213 - DNA, 22 bp, Homo sapiens
caagatttatattttcacacaa

SEQ ID NO: 8415214 - DNA, 22 bp, Homo sapiens
caagatttgacttcgtggtttg

SEQ ID NO: 8415215 - DNA, 22 bp, Homo sapiens
caagatttggcattctgaggag

SEQ ID NO: 8415216 - DNA, 22 bp, Homo sapiens
caagatttggcaactttgtcat

SEQ ID NO: 8415217 - DNA, 22 bp, Homo sapiens
agcagcaggaggccattgtctt

SEQ ID NO: 8415218 - DNA, 22 bp, Homo sapiens
caaaagtctgtcctttaacttc

SEQ ID NO: 8415219 - DNA, 22 bp, Homo sapiens
agcaaagaaatggaggctcaga

SEQ ID NO: 8415220 - DNA, 22 bp, Homo sapiens
caacaggctttatgtttaaagt

SEQ ID NO: 8415221 - DNA, 22 bp, Homo sapiens
caacagctttagaaacactttc

SEQ ID NO: 8415222 - DNA, 22 bp, Homo sapiens
agcaccagctcaaggtgcacct

SEQ ID NO: 8415223 - DNA, 22 bp, Homo sapiens
agcccaaggcttccctgctggc

SEQ ID NO: 8415224 - DNA, 22 bp, Homo sapiens
agcccaatcctagcactttgag

SEQ ID NO: 8415225 - DNA, 22 bp, Homo sapiens
cagagaaagaagcccattcatt

SEQ ID NO: 8415226 - DNA, 22 bp, Homo sapiens
cagagaaagggtgaattccttc

SEQ ID NO: 8415227 - DNA, 22 bp, Homo sapiens
agccatcctactacctcagcat

SEQ ID NO: 8415228 - DNA, 22 bp, Homo sapiens
cagaggcatactcccagtcttg

SEQ ID NO: 8415229 - DNA, 22 bp, Homo sapiens
cagaggagttcagtacacagcc

SEQ ID NO: 8415230 - DNA, 21 bp, Homo sapiens
cagaggcaggctctgtgtgtg

SEQ ID NO: 8415231 - DNA, 22 bp, Homo sapiens
cagaggagttcagtacacagcc

SEQ ID NO: 8415232 - DNA, 22 bp, Homo sapiens
cagaatgcaaattttataatat

SEQ ID NO: 8415233 - DNA, 22 bp, Homo sapiens
cagaatgcattgcttctgatgg

SEQ ID NO: 8415234 - DNA, 22 bp, Homo sapiens
cagaatctcgacttctggcccc

SEQ ID NO: 8415235 - DNA, 19 bp, Homo sapiens
agccagaactagtgtttct

SEQ ID NO: 8415236 - DNA, 22 bp, Homo sapiens
agccactgtgtgaccagctgtc

SEQ ID NO: 8415237 - DNA, 22 bp, Homo sapiens
agccactgtctgaacttctgtg

SEQ ID NO: 8415238 - DNA, 22 bp, Homo sapiens
cagacatgatgtaagcagaggc

SEQ ID NO: 8415239 - DNA, 21 bp, Homo sapiens
cagacatgagtctcagctttg

SEQ ID NO: 8415240 - DNA, 22 bp, Homo sapiens
agccagagactgtgtctgtaat

SEQ ID NO: 8415241 - DNA, 22 bp, Homo sapiens
agccagagagtgttggagatgt

SEQ ID NO: 8415242 - DNA, 22 bp, Homo sapiens
agcctccctatgcaccttcagg

SEQ ID NO: 8415243 - DNA, 22 bp, Homo sapiens
agcctctggccctagactgctt

SEQ ID NO: 8415244 - DNA, 22 bp, Homo sapiens
agcctctgctggccctggcact

SEQ ID NO: 8415245 - DNA, 22 bp, Homo sapiens
cagcgtctcgttgtgggcctcg

SEQ ID NO: 8415246 - DNA, 22 bp, Homo sapiens
actgaggatggataggtcatat

SEQ ID NO: 8415247 - DNA, 22 bp, Homo sapiens
actgaggagaaatttgagtgaa

SEQ ID NO: 8415248 - DNA, 22 bp, Homo sapiens
actgaggacagtgaggagggct

SEQ ID NO: 8415249 - DNA, 22 bp, Homo sapiens
actgaggaacatatataagatg

SEQ ID NO: 8415250 - DNA, 22 bp, Homo sapiens
agtgcatgccttcctgtggatg

SEQ ID NO: 8415251 - DNA, 22 bp, Homo sapiens
agtgcatgtatctacagtcaca

SEQ ID NO: 8415252 - DNA, 18 bp, Homo sapiens
agtgcatgctaggggaag

SEQ ID NO: 8415253 - DNA, 19 bp, Homo sapiens
agtgcatgggcgaggtgca

SEQ ID NO: 8415254 - DNA, 20 bp, Homo sapiens
agtgcatggagggagagggc

SEQ ID NO: 8415255 - DNA, 22 bp, Homo sapiens
actcttcaccgctactgaaata

SEQ ID NO: 8415256 - DNA, 22 bp, Homo sapiens
agtgcaggttaaggaactggcc

SEQ ID NO: 8415257 - DNA, 22 bp, Homo sapiens
agtgcagtgatgaataatggtt

SEQ ID NO: 8415258 - DNA, 22 bp, Homo sapiens
actgcacttcagcctgggtgtc

SEQ ID NO: 8415259 - DNA, 22 bp, Homo sapiens
actgcacttcagcctgggtgac

SEQ ID NO: 8415260 - DNA, 22 bp, Homo sapiens
agtaaaatcaccatctctttgt

SEQ ID NO: 8415261 - DNA, 22 bp, Homo sapiens
agtaaaatttctgctgaggaga

SEQ ID NO: 8415262 - DNA, 22 bp, Homo sapiens
actagattttggccattataca

SEQ ID NO: 8415263 - DNA, 22 bp, Homo sapiens
acgatgtggcctgaatcaggca

SEQ ID NO: 8415264 - DNA, 22 bp, Homo sapiens
acgcccagactcccatactttg

SEQ ID NO: 8415265 - DNA, 22 bp, Homo sapiens
acgcctgtaatcccagcacttt

SEQ ID NO: 8415266 - DNA, 22 bp, Homo sapiens
acgcctgtaatcccagcacttt

SEQ ID NO: 8415267 - DNA, 22 bp, Homo sapiens
agtatttgatcagatgatagta

SEQ ID NO: 8415268 - DNA, 22 bp, Homo sapiens
agtcccagcttcccccatgcag

SEQ ID NO: 8415269 - DNA, 22 bp, Homo sapiens
agtcaacagagtggccgcagcg

SEQ ID NO: 8415270 - DNA, 22 bp, Homo sapiens
acctgatgtatagattctagat

SEQ ID NO: 8415271 - DNA, 22 bp, Homo sapiens
acctgcagtggccactcctaat

SEQ ID NO: 8415272 - DNA, 22 bp, Homo sapiens
acctgcaggcacaggtgtgcgc

SEQ ID NO: 8415273 - DNA, 22 bp, Homo sapiens
acctgcaggggtgctctctggg

SEQ ID NO: 8415274 - DNA, 22 bp, Homo sapiens
acctgcaggtgtttccacactt

SEQ ID NO: 8415275 - DNA, 22 bp, Homo sapiens
acctgcaggtgtttccacactt

SEQ ID NO: 8415276 - DNA, 19 bp, Homo sapiens
acctgcagtaataattcct

SEQ ID NO: 8415277 - DNA, 19 bp, Homo sapiens
acctgcagtaataattcct

SEQ ID NO: 8415278 - DNA, 22 bp, Homo sapiens
acctgcaggggtgctctctggg

SEQ ID NO: 8415279 - DNA, 22 bp, Homo sapiens
acctgcagtggccactcctaat

SEQ ID NO: 8415280 - DNA, 22 bp, Homo sapiens
acctgcaggcacaggtgtgcgc

SEQ ID NO: 8415281 - DNA, 22 bp, Homo sapiens
acctgcagctgagaaaatgact

SEQ ID NO: 8415282 - DNA, 22 bp, Homo sapiens
acctgcagctgagaaaatgact

SEQ ID NO: 8415283 - DNA, 22 bp, Homo sapiens
acctgcagctaaagatgtaggg

SEQ ID NO: 8415284 - DNA, 22 bp, Homo sapiens
acctgcagctaaagatgtaggg

SEQ ID NO: 8415285 - DNA, 22 bp, Homo sapiens
acctgcagccacttctctcctt

SEQ ID NO: 8415286 - DNA, 22 bp, Homo sapiens
acctgcagccacttctctcctt

SEQ ID NO: 8415287 - DNA, 22 bp, Homo sapiens
accctccaggctgcagctcctg

SEQ ID NO: 8415288 - DNA, 19 bp, Homo sapiens
aggtctaatcataagacaa

SEQ ID NO: 8415289 - DNA, 22 bp, Homo sapiens
atacagcctattcttaccattg

SEQ ID NO: 8415290 - DNA, 23 bp, Homo sapiens
acttaaatggttctttatctcag

SEQ ID NO: 8415291 - DNA, 22 bp, Homo sapiens
ataatgcatttagaataattca

SEQ ID NO: 8415292 - DNA, 22 bp, Homo sapiens
ataatggcatgacagttatata

SEQ ID NO: 8415293 - DNA, 22 bp, Homo sapiens
atactgtatcacttgtgagtga

SEQ ID NO: 8415294 - DNA, 22 bp, Homo sapiens
actttatcaggaatcacacagc

SEQ ID NO: 8415295 - DNA, 22 bp, Homo sapiens
actgtgccacaattcaccaggg

SEQ ID NO: 8415296 - DNA, 22 bp, Homo sapiens
ataatctgagctatttcatgag

SEQ ID NO: 8415297 - DNA, 22 bp, Homo sapiens
ataatctggtctttgtatgagt

SEQ ID NO: 8415298 - DNA, 22 bp, Homo sapiens
ataaacagagtagttgctactg

SEQ ID NO: 8415299 - DNA, 22 bp, Homo sapiens
ataaacagtaaatgtgagcagt

SEQ ID NO: 8415300 - DNA, 22 bp, Homo sapiens
ataaaatttgctactgttaaat

SEQ ID NO: 8415301 - DNA, 22 bp, Homo sapiens
actgtactcttctagccatctg

SEQ ID NO: 8415302 - DNA, 22 bp, Homo sapiens
actgtactcttatagccatctg

SEQ ID NO: 8415303 - DNA, 22 bp, Homo sapiens
actgtattggaaatatagcaaa

SEQ ID NO: 8415304 - DNA, 22 bp, Homo sapiens
actgtatttggatataagatct

SEQ ID NO: 8415305 - DNA, 22 bp, Homo sapiens
actgtatttccaacagacaaat

SEQ ID NO: 8415306 - DNA, 22 bp, Homo sapiens
actgtattcctactagaatcta

SEQ ID NO: 8415307 - DNA, 22 bp, Homo sapiens
agaaagtgtgtcatactaagtg

SEQ ID NO: 8415308 - DNA, 22 bp, Homo sapiens
agaacagcaacatcagacaaag

SEQ ID NO: 8415309 - DNA, 22 bp, Homo sapiens
agaacagaggccttatgtttca

SEQ ID NO: 8415310 - DNA, 22 bp, Homo sapiens
atctaacttatgttttaccaaa

SEQ ID NO: 8415311 - DNA, 22 bp, Homo sapiens
atctaactgggctattttattg

SEQ ID NO: 8415312 - DNA, 16 bp, Homo sapiens
atctaagaatgtagag

SEQ ID NO: 8415313 - DNA, 22 bp, Homo sapiens
atctaagagagagagcatgtct

SEQ ID NO: 8415314 - DNA, 22 bp, Homo sapiens
atctaagaggatggttggaaat

SEQ ID NO: 8415315 - DNA, 22 bp, Homo sapiens
atctaaaaggagctctttatct

SEQ ID NO: 8415316 - DNA, 22 bp, Homo sapiens
atctcacagaggcccaccagga

SEQ ID NO: 8415317 - DNA, 23 bp, Homo sapiens
atctaatttctccaaatctctac

SEQ ID NO: 8415318 - DNA, 22 bp, Homo sapiens
atctaagatgtattgagcactt

SEQ ID NO: 8415319 - DNA, 16 bp, Homo sapiens
atctaagatgtgcatt

SEQ ID NO: 8415320 - DNA, 22 bp, Homo sapiens
atctaagattttgctaagatca

SEQ ID NO: 8415321 - DNA, 22 bp, Homo sapiens
atcgccaatggggaggaaagaa

SEQ ID NO: 8415322 - DNA, 22 bp, Homo sapiens
atcgaataattgcattctataa

SEQ ID NO: 8415323 - DNA, 22 bp, Homo sapiens
atatttataagcaagcaggact

SEQ ID NO: 8415324 - DNA, 22 bp, Homo sapiens
atatttcatggggttccatact

SEQ ID NO: 8415325 - DNA, 21 bp, Homo sapiens
agaaaagtatttgaatcaaga

SEQ ID NO: 8415326 - DNA, 22 bp, Homo sapiens
agaaaagtgctctagtgagagc

SEQ ID NO: 8415327 - DNA, 22 bp, Homo sapiens
atattacataaacatgagtgaa

SEQ ID NO: 8415328 - DNA, 22 bp, Homo sapiens
actttcaagcaagaacactttg

SEQ ID NO: 8415329 - DNA, 18 bp, Homo sapiens
atatgcttgagctaagga

SEQ ID NO: 8415330 - DNA, 22 bp, Homo sapiens
atatgctttgggattagatcat

SEQ ID NO: 8415331 - DNA, 22 bp, Homo sapiens
acagtgtgttctgggacctcca

SEQ ID NO: 8415332 - DNA, 22 bp, Homo sapiens
acagtgtgttggaggagactgt

SEQ ID NO: 8415333 - DNA, 21 bp, Homo sapiens
acagttcatgataactccatc

SEQ ID NO: 8415334 - DNA, 22 bp, Homo sapiens
acatatttccatgcagcatgtc

SEQ ID NO: 8415335 - DNA, 22 bp, Homo sapiens
aggcagctgaccacagtatgat

SEQ ID NO: 8415336 - DNA, 17 bp, Homo sapiens
aggcagctcagaacatc

SEQ ID NO: 8415337 - DNA, 22 bp, Homo sapiens
acatagatctgtgattcattct

SEQ ID NO: 8415338 - DNA, 22 bp, Homo sapiens
aggacacaggcaggaggagatc

SEQ ID NO: 8415339 - DNA, 22 bp, Homo sapiens
acagtaaaaagccttagaattt

SEQ ID NO: 8415340 - DNA, 22 bp, Homo sapiens
acagtatatatagtctaaaagc

SEQ ID NO: 8415341 - DNA, 22 bp, Homo sapiens
acagtgtgtgctttcccttacg

SEQ ID NO: 8415342 - DNA, 23 bp, Homo sapiens
acagtgtggtggacaaggagcag

SEQ ID NO: 8415343 - DNA, 22 bp, Homo sapiens
acagtgtggtttgagcactggg

SEQ ID NO: 8415344 - DNA, 21 bp, Homo sapiens
acagtgtgcttctctccctcc

SEQ ID NO: 8415345 - DNA, 22 bp, Homo sapiens
acagtgtgatgggcctgcctga

SEQ ID NO: 8415346 - DNA, 22 bp, Homo sapiens
acagtcaatcagaacagcatgt

SEQ ID NO: 8415347 - DNA, 23 bp, Homo sapiens
acagtcgtaggtatccttttcct

SEQ ID NO: 8415348 - DNA, 22 bp, Homo sapiens
acagtctaatcttgtgttctgt

SEQ ID NO: 8415349 - DNA, 22 bp, Homo sapiens
acagtctactaaacatcatcag

SEQ ID NO: 8415350 - DNA, 22 bp, Homo sapiens
agctggaggggccagcaggtgt

SEQ ID NO: 8415351 - DNA, 22 bp, Homo sapiens
agctgaatctcaggcatccttt

SEQ ID NO: 8415352 - DNA, 22 bp, Homo sapiens
acaggaggggcatgaaagacgg

SEQ ID NO: 8415353 - DNA, 22 bp, Homo sapiens
acaggatcgccctgttgcccag

SEQ ID NO: 8415354 - DNA, 22 bp, Homo sapiens
aggacacacaaagagtgagaac

SEQ ID NO: 8415355 - DNA, 22 bp, Homo sapiens
acaggcaggcttcggccagagc

SEQ ID NO: 8415356 - DNA, 22 bp, Homo sapiens
acaggcaggagctccccattcc

SEQ ID NO: 8415357 - DNA, 22 bp, Homo sapiens
acaggcaggcgggacagcccga

SEQ ID NO: 8415358 - DNA, 17 bp, Homo sapiens
acaggcagatcacctga

SEQ ID NO: 8415359 - DNA, 22 bp, Homo sapiens
aggctctgtttgctgtggtacc

SEQ ID NO: 8415360 - DNA, 22 bp, Homo sapiens
acattgcaataataattctctt

SEQ ID NO: 8415361 - DNA, 22 bp, Homo sapiens
acatccagatctcagcatggct

SEQ ID NO: 8415362 - DNA, 23 bp, Homo sapiens
acatcatgatagccaacttggga

SEQ ID NO: 8415363 - DNA, 20 bp, Homo sapiens
aggcctgagagatgactggg

SEQ ID NO: 8415364 - DNA, 22 bp, Homo sapiens
agggcagcaatgcagctgctgc

SEQ ID NO: 8415365 - DNA, 19 bp, Homo sapiens
agggagaattccaagagga

SEQ ID NO: 8415366 - DNA, 22 bp, Homo sapiens
aggctttaagtggcctacagct

SEQ ID NO: 8415367 - DNA, 22 bp, Homo sapiens
aggctttaattatctacaggag

SEQ ID NO: 8415368 - DNA, 22 bp, Homo sapiens
aggcttgggactgcttaggagc

SEQ ID NO: 8415369 - DNA, 20 bp, Homo sapiens
aggcttggcttggcaggaac

SEQ ID NO: 8415370 - DNA, 19 bp, Homo sapiens
aggcttggttgcagcaagc

SEQ ID NO: 8415371 - DNA, 22 bp, Homo sapiens
aggcttggtttatagaagtaat

SEQ ID NO: 8415372 - DNA, 22 bp, Homo sapiens
aggcttggttaattctgtgtga

SEQ ID NO: 8415373 - DNA, 22 bp, Homo sapiens
aggcttgggtcagaaggcttgt

SEQ ID NO: 8415374 - DNA, 22 bp, Homo sapiens
aggcttggtgccaaggagcctg

SEQ ID NO: 8415375 - DNA, 19 bp, Homo sapiens
aggcttggtgttgaatggg

SEQ ID NO: 8415376 - DNA, 21 bp, Homo sapiens
aggcttgggtaaaaaggtcat

SEQ ID NO: 8415377 - DNA, 18 bp, Homo sapiens
aggcttgggcccagcagc

SEQ ID NO: 8415378 - DNA, 22 bp, Homo sapiens
agggctgacagtgaggagtcaa

SEQ ID NO: 8415379 - DNA, 22 bp, Homo sapiens
agggctgcccagtgtgagagct

SEQ ID NO: 8415380 - DNA, 22 bp, Homo sapiens
acccagctaaccctaccctgga

SEQ ID NO: 8415381 - DNA, 20 bp, Homo sapiens
acccagctctgtgccctggg

SEQ ID NO: 8415382 - DNA, 22 bp, Homo sapiens
acccagctaaccctaccctgga

SEQ ID NO: 8415383 - DNA, 20 bp, Homo sapiens
acccagctctgtgccctggg

SEQ ID NO: 8415384 - DNA, 22 bp, Homo sapiens
acccagctgtttcccgtgtcat

SEQ ID NO: 8415385 - DNA, 22 bp, Homo sapiens
acccagctggatgcatggaggc

SEQ ID NO: 8415386 - DNA, 22 bp, Homo sapiens
acccagcctacaaagctcacct

SEQ ID NO: 8415387 - DNA, 22 bp, Homo sapiens
acccagcctacaaagctcacct

SEQ ID NO: 8415388 - DNA, 22 bp, Homo sapiens
acccagcaaagataaacttatg

SEQ ID NO: 8415389 - DNA, 22 bp, Homo sapiens
acccagcatgacacctgcacat

SEQ ID NO: 8415390 - DNA, 22 bp, Homo sapiens
acccagccatgttcagttctct

SEQ ID NO: 8415391 - DNA, 22 bp, Homo sapiens
acccagccacagcattgaggga

SEQ ID NO: 8415392 - DNA, 22 bp, Homo sapiens
atactttggtcactattattgg

SEQ ID NO: 8415393 - DNA, 22 bp, Homo sapiens
atagaaacagaggtcaggcatt

SEQ ID NO: 8415394 - DNA, 22 bp, Homo sapiens
atagtacagatccattaattat

SEQ ID NO: 8415395 - DNA, 22 bp, Homo sapiens
atagtacagagggctactggtt

SEQ ID NO: 8415396 - DNA, 22 bp, Homo sapiens
atagtacacatcctacaatgtt

SEQ ID NO: 8415397 - DNA, 22 bp, Homo sapiens
atagtacaatcagttaattagt

SEQ ID NO: 8415398 - DNA, 22 bp, Homo sapiens
atagtacaagggaagagtgaag

SEQ ID NO: 8415399 - DNA, 20 bp, Homo sapiens
atagacaaagacatgccaga

SEQ ID NO: 8415400 - DNA, 22 bp, Homo sapiens
atagacaatcccccatcctacc

SEQ ID NO: 8415401 - DNA, 22 bp, Homo sapiens
atagacaacacttattattcct

SEQ ID NO: 8415402 - DNA, 22 bp, Homo sapiens
atacagaagcctgtatttctgg

SEQ ID NO: 8415403 - DNA, 22 bp, Homo sapiens
ataattcaggttttctggcaca

SEQ ID NO: 8415404 - DNA, 22 bp, Homo sapiens
ataatggcttctgagtattagg

SEQ ID NO: 8415405 - DNA, 22 bp, Homo sapiens
ataatggcttgtggtgttattc

SEQ ID NO: 8415406 - DNA, 20 bp, Homo sapiens
agtttattccaggagaactg

SEQ ID NO: 8415407 - DNA, 22 bp, Homo sapiens
agtttatgtctttacttcagct

SEQ ID NO: 8415408 - DNA, 22 bp, Homo sapiens
agtttcacacaacatttgcatg

SEQ ID NO: 8415409 - DNA, 22 bp, Homo sapiens
agttttattccaatgtgcagca

SEQ ID NO: 8415410 - DNA, 22 bp, Homo sapiens
agtttctgttaccatatttgac

SEQ ID NO: 8415411 - DNA, 22 bp, Homo sapiens
agtttctttagatagaaagttc

SEQ ID NO: 8415412 - DNA, 22 bp, Homo sapiens
agttttctgttctacaatttga

SEQ ID NO: 8415413 - DNA, 23 bp, Homo sapiens
cttcagcagaaacataaattctc

SEQ ID NO: 8415414 - DNA, 22 bp, Homo sapiens
cttcagcagcctcttgcataaa

SEQ ID NO: 8415415 - DNA, 19 bp, Homo sapiens
cttcagcatctccggagct

SEQ ID NO: 8415416 - DNA, 23 bp, Homo sapiens
cttcatgagagccctgaggaaaa

SEQ ID NO: 8415417 - DNA, 22 bp, Homo sapiens
cttcatgctgatatcctcgatg

SEQ ID NO: 8415418 - DNA, 17 bp, Homo sapiens
atctgcatttctaatga

SEQ ID NO: 8415419 - DNA, 22 bp, Homo sapiens
cttcattaaccaaaatgcaata

SEQ ID NO: 8415420 - DNA, 21 bp, Homo sapiens
ctgtccagtaattcctggcac

SEQ ID NO: 8415421 - DNA, 18 bp, Homo sapiens
ctgtccagtagactctgc

SEQ ID NO: 8415422 - DNA, 22 bp, Homo sapiens
ctgtccagcttggctcctgggg

SEQ ID NO: 8415423 - DNA, 22 bp, Homo sapiens
atcattcaagtgctctaaaatg

SEQ ID NO: 8415424 - DNA, 21 bp, Homo sapiens
atcattaattgctgagtgaca

SEQ ID NO: 8415425 - DNA, 23 bp, Homo sapiens
ctgttattccaggctgatgggtg

SEQ ID NO: 8415426 - DNA, 22 bp, Homo sapiens
ctgttatttctgaatgccatcc

SEQ ID NO: 8415427 - DNA, 22 bp, Homo sapiens
ctgttatttctgaatgccatcc

SEQ ID NO: 8415428 - DNA, 22 bp, Homo sapiens
ctgttatttctgccaggtgagt

SEQ ID NO: 8415429 - DNA, 22 bp, Homo sapiens
ctgttatttagaacatggaatc

SEQ ID NO: 8415430 - DNA, 22 bp, Homo sapiens
ctgggctgtcaatggccctctg

SEQ ID NO: 8415431 - DNA, 22 bp, Homo sapiens
ctgtcattgtacatgttataca

SEQ ID NO: 8415432 - DNA, 22 bp, Homo sapiens
ctgtcatttaagacattctgga

SEQ ID NO: 8415433 - DNA, 22 bp, Homo sapiens
ctgtcattttcttccaatataa

SEQ ID NO: 8415434 - DNA, 22 bp, Homo sapiens
ctgtccagaaagggggcaacaa

SEQ ID NO: 8415435 - DNA, 22 bp, Homo sapiens
atattttcacagaacttgcaaa

SEQ ID NO: 8415436 - DNA, 22 bp, Homo sapiens
atattttcacagaacttgcaaa

SEQ ID NO: 8415437 - DNA, 22 bp, Homo sapiens
atattttccgaacttgaggtag

SEQ ID NO: 8415438 - DNA, 22 bp, Homo sapiens
atattttcactgaaccaaagta

SEQ ID NO: 8415439 - DNA, 22 bp, Homo sapiens
atattttcactgaaccaaagta

SEQ ID NO: 8415440 - DNA, 22 bp, Homo sapiens
atattttctggaactatgcctg

SEQ ID NO: 8415441 - DNA, 22 bp, Homo sapiens
atattttccgaacttgaggtag

SEQ ID NO: 8415442 - DNA, 22 bp, Homo sapiens
atattttctggaactatgcctg

SEQ ID NO: 8415443 - DNA, 22 bp, Homo sapiens
ctgtatctgtgttggatgagtt

SEQ ID NO: 8415444 - DNA, 22 bp, Homo sapiens
ctgggctgtaatgtggcactga

SEQ ID NO: 8415445 - DNA, 22 bp, Homo sapiens
atagtcagtgtctatatcgttg

SEQ ID NO: 8415446 - DNA, 22 bp, Homo sapiens
atagtcttacttttctctgcta

SEQ ID NO: 8415447 - DNA, 22 bp, Homo sapiens
atagtacagcatttttcctgag

SEQ ID NO: 8415448 - DNA, 22 bp, Homo sapiens
atagtacatgggtgtcctcaca

SEQ ID NO: 8415449 - DNA, 22 bp, Homo sapiens
agtctctccacattgttataaa

SEQ ID NO: 8415450 - DNA, 22 bp, Homo sapiens
agtctctcacagaggattctcc

SEQ ID NO: 8415451 - DNA, 22 bp, Homo sapiens
agtctctttaatcacagtgtct

SEQ ID NO: 8415452 - DNA, 20 bp, Homo sapiens
agtctctcccagaatgagca

SEQ ID NO: 8415453 - DNA, 21 bp, Homo sapiens
agtctctctaataaatgcttg

SEQ ID NO: 8415454 - DNA, 22 bp, Homo sapiens
agtctctctcctcgtggtaacc

SEQ ID NO: 8415455 - DNA, 22 bp, Homo sapiens
agtccaagattagggtgacagc

SEQ ID NO: 8415456 - DNA, 22 bp, Homo sapiens
agtccaaagcagatgagggcca

SEQ ID NO: 8415457 - DNA, 22 bp, Homo sapiens
ctcaggagttggaggctacagt

SEQ ID NO: 8415458 - DNA, 22 bp, Homo sapiens
agtgcaggagcctggccagagc

SEQ ID NO: 8415459 - DNA, 22 bp, Homo sapiens
ctcccaggttccgacgcctctt

SEQ ID NO: 8415460 - DNA, 22 bp, Homo sapiens
agtgactggtgtgaagttaaat

SEQ ID NO: 8415461 - DNA, 22 bp, Homo sapiens
ctccagtggcaagtccgggcgg

SEQ ID NO: 8415462 - DNA, 22 bp, Homo sapiens
ctccagttggccccagttggtt

SEQ ID NO: 8415463 - DNA, 22 bp, Homo sapiens
ctcttagatatggagaattacc

SEQ ID NO: 8415464 - DNA, 22 bp, Homo sapiens
ctcttagaaagaaacacactgg

SEQ ID NO: 8415465 - DNA, 20 bp, Homo sapiens
ctcttaaatgtaaagtaggc

SEQ ID NO: 8415466 - DNA, 19 bp, Homo sapiens
ctcttaaattgtctcttgc

SEQ ID NO: 8415467 - DNA, 22 bp, Homo sapiens
ctcttaaataacatcattgctt

SEQ ID NO: 8415468 - DNA, 22 bp, Homo sapiens
ctcttaaagcttccagtttcaa

SEQ ID NO: 8415469 - DNA, 22 bp, Homo sapiens
ctcttaaaaacttgatatattt

SEQ ID NO: 8415470 - DNA, 22 bp, Homo sapiens
ctcttaaagaatgttccagctg

SEQ ID NO: 8415471 - DNA, 19 bp, Homo sapiens
agtgcagggagcaccctca

SEQ ID NO: 8415472 - DNA, 19 bp, Homo sapiens
agtgcagggagcaccctca

SEQ ID NO: 8415473 - DNA, 22 bp, Homo sapiens
agtgcaggctcgcttgtgaggc

SEQ ID NO: 8415474 - DNA, 22 bp, Homo sapiens
agtgcaggccccaggccaggcc

SEQ ID NO: 8415475 - DNA, 22 bp, Homo sapiens
ctctgagaagagttcaagtaaa

SEQ ID NO: 8415476 - DNA, 22 bp, Homo sapiens
ctctgaccattcccttgatttt

SEQ ID NO: 8415477 - DNA, 22 bp, Homo sapiens
cctggctcagagtatgtcatcg

SEQ ID NO: 8415478 - DNA, 22 bp, Homo sapiens
aggtatatattctggtccttat

SEQ ID NO: 8415479 - DNA, 17 bp, Homo sapiens
agggggaacctgggagg

SEQ ID NO: 8415480 - DNA, 22 bp, Homo sapiens
cctgcctggagctgagtgtgga

SEQ ID NO: 8415481 - DNA, 22 bp, Homo sapiens
aggtattattagcatctctatt

SEQ ID NO: 8415482 - DNA, 20 bp, Homo sapiens
aggtctgattccagaatcag

SEQ ID NO: 8415483 - DNA, 22 bp, Homo sapiens
aggttcaaatgcaagagatgct

SEQ ID NO: 8415484 - DNA, 22 bp, Homo sapiens
aggttcaaattgttgcagtttc

SEQ ID NO: 8415485 - DNA, 23 bp, Homo sapiens
aggttatgattatagagcgagga

SEQ ID NO: 8415486 - DNA, 22 bp, Homo sapiens
aggtttcatgggagacaactca

SEQ ID NO: 8415487 - DNA, 22 bp, Homo sapiens
aggtttatgtttggtgcaggag

SEQ ID NO: 8415488 - DNA, 22 bp, Homo sapiens
aggtttatgccttggagctggg

SEQ ID NO: 8415489 - DNA, 22 bp, Homo sapiens
cctttattcaattagtcctaat

SEQ ID NO: 8415490 - DNA, 20 bp, Homo sapiens
cctttattatttgtatgatg

SEQ ID NO: 8415491 - DNA, 20 bp, Homo sapiens
cctttattatttgtatgatg

SEQ ID NO: 8415492 - DNA, 21 bp, Homo sapiens
agtacaaaaattcctttctca

SEQ ID NO: 8415493 - DNA, 22 bp, Homo sapiens
agtacaaaatgcagcatcatca

SEQ ID NO: 8415494 - DNA, 22 bp, Homo sapiens
agtacaaactgtttcaaagtag

SEQ ID NO: 8415495 - DNA, 22 bp, Homo sapiens
agtacaaaggcccttgattact

SEQ ID NO: 8415496 - DNA, 22 bp, Homo sapiens
agtacaaaggcccttgattact

SEQ ID NO: 8415497 - DNA, 22 bp, Homo sapiens
agtacaaagtgctcctggttct

SEQ ID NO: 8415498 - DNA, 22 bp, Homo sapiens
agtacaaatgcagccagagtag

SEQ ID NO: 8415499 - DNA, 22 bp, Homo sapiens
agtacaaattatagcgcttgga

SEQ ID NO: 8415500 - DNA, 22 bp, Homo sapiens
ctaaaattatcaagataattcc

SEQ ID NO: 8415501 - DNA, 18 bp, Homo sapiens
ctaaactgcacctaatga

SEQ ID NO: 8415502 - DNA, 22 bp, Homo sapiens
cgcgaggtggaggttgcagtga

SEQ ID NO: 8415503 - DNA, 22 bp, Homo sapiens
cgcggtggcggcctccagcgcc

SEQ ID NO: 8415504 - DNA, 22 bp, Homo sapiens
agtcagttgcaaacatcaggca

SEQ ID NO: 8415505 - DNA, 22 bp, Homo sapiens
agtcagttgcagtttatggatg

SEQ ID NO: 8415506 - DNA, 22 bp, Homo sapiens
agtcagttgtggagatttaact

SEQ ID NO: 8415507 - DNA, 19 bp, Homo sapiens
agtcagttctgaggaggaa

SEQ ID NO: 8415508 - DNA, 18 bp, Homo sapiens
agtcagttgatggggacc

SEQ ID NO: 8415509 - DNA, 22 bp, Homo sapiens
agtcagttaacctcacagcatc

SEQ ID NO: 8415510 - DNA, 22 bp, Homo sapiens
agtcagttcatggctctgtcct

SEQ ID NO: 8415511 - DNA, 22 bp, Homo sapiens
agtcagtttccctggaaagcag

SEQ ID NO: 8415512 - DNA, 22 bp, Homo sapiens
agtcagttttctccagggggct

SEQ ID NO: 8415513 - DNA, 22 bp, Homo sapiens
agtcagttttaccaatctcagt

SEQ ID NO: 8415514 - DNA, 22 bp, Homo sapiens
agtcagttttcttaaagggaag

SEQ ID NO: 8415515 - DNA, 22 bp, Homo sapiens
agtcagttaaactttgtaaagt

SEQ ID NO: 8415516 - DNA, 22 bp, Homo sapiens
caggcataagtaatgttttatg

SEQ ID NO: 8415517 - DNA, 22 bp, Homo sapiens
caggcatagaagggcaagaata

SEQ ID NO: 8415518 - DNA, 22 bp, Homo sapiens
caggcataggtaggatgtttct

SEQ ID NO: 8415519 - DNA, 22 bp, Homo sapiens
caggcataatctcatcttgttt

SEQ ID NO: 8415520 - DNA, 22 bp, Homo sapiens
caggcatatctacattatccaa

SEQ ID NO: 8415521 - DNA, 22 bp, Homo sapiens
cagggtgactgccctggccact

SEQ ID NO: 8415522 - DNA, 22 bp, Homo sapiens
cagggctcgctcgctcgctcgc

SEQ ID NO: 8415523 - DNA, 22 bp, Homo sapiens
cagggctcgctcttgcccttcg

SEQ ID NO: 8415524 - DNA, 22 bp, Homo sapiens
cagggctcgctgccagcttcag

SEQ ID NO: 8415525 - DNA, 22 bp, Homo sapiens
cagggctctgccttgagggatg

SEQ ID NO: 8415526 - DNA, 22 bp, Homo sapiens
cagggctccccagagagcctct

SEQ ID NO: 8415527 - DNA, 22 bp, Homo sapiens
cagggctccccgcaccgcagcc

SEQ ID NO: 8415528 - DNA, 22 bp, Homo sapiens
cagggctcccaaatatctcttc

SEQ ID NO: 8415529 - DNA, 22 bp, Homo sapiens
cagggctcccttgcaaggaggg

SEQ ID NO: 8415530 - DNA, 22 bp, Homo sapiens
cagggctccctgcagcctctgt

SEQ ID NO: 8415531 - DNA, 22 bp, Homo sapiens
cagggctccctctggctcccag

SEQ ID NO: 8415532 - DNA, 22 bp, Homo sapiens
cagggagctttcccaggaccct

SEQ ID NO: 8415533 - DNA, 22 bp, Homo sapiens
cagggagctggtgccagccgac

SEQ ID NO: 8415534 - DNA, 22 bp, Homo sapiens
agctgtggaagactgtcagggt

SEQ ID NO: 8415535 - DNA, 22 bp, Homo sapiens
agctgtggagtagggggttgga

SEQ ID NO: 8415536 - DNA, 22 bp, Homo sapiens
caggctgcggccgtgtgagcat

SEQ ID NO: 8415537 - DNA, 22 bp, Homo sapiens
agctgtggcagcactttggagt

SEQ ID NO: 8415538 - DNA, 22 bp, Homo sapiens
caggctgcgtttgtgaaaggta

SEQ ID NO: 8415539 - DNA, 22 bp, Homo sapiens
caggctgctccagggtaggaaa

SEQ ID NO: 8415540 - DNA, 22 bp, Homo sapiens
aggagggatagaaaaatacttg

SEQ ID NO: 8415541 - DNA, 22 bp, Homo sapiens
aggagggctaggaaaaccagga

SEQ ID NO: 8415542 - DNA, 22 bp, Homo sapiens
aggattcagaatgtatgcagtg

SEQ ID NO: 8415543 - DNA, 19 bp, Homo sapiens
catggtgaaaccccgtctc

SEQ ID NO: 8415544 - DNA, 19 bp, Homo sapiens
catggtgaaaccccgtctc

SEQ ID NO: 8415545 - DNA, 22 bp, Homo sapiens
catggctgaacactcagtgact

SEQ ID NO: 8415546 - DNA, 22 bp, Homo sapiens
catggctgaacactcagtgact

SEQ ID NO: 8415547 - DNA, 23 bp, Homo sapiens
ccaagcttctaatgctgctgagc

SEQ ID NO: 8415548 - DNA, 23 bp, Homo sapiens
ccaagcttgtccctgcctgcttt

SEQ ID NO: 8415549 - DNA, 22 bp, Homo sapiens
ccaagcttctttcctactacag

SEQ ID NO: 8415550 - DNA, 22 bp, Homo sapiens
ccaaggagaaatgctgtgcttt

SEQ ID NO: 8415551 - DNA, 22 bp, Homo sapiens
ccaagtactctcaccaaagctt

SEQ ID NO: 8415552 - DNA, 22 bp, Homo sapiens
ccaagtacagattcctccactg

SEQ ID NO: 8415553 - DNA, 22 bp, Homo sapiens
cattaaatcttccagacctcac

SEQ ID NO: 8415554 - DNA, 22 bp, Homo sapiens
cattaaatatcaacctagacta

SEQ ID NO: 8415555 - DNA, 22 bp, Homo sapiens
cattaaattccttgttctcaaa

SEQ ID NO: 8415556 - DNA, 22 bp, Homo sapiens
aggactaaggaacagctgattc

SEQ ID NO: 8415557 - DNA, 22 bp, Homo sapiens
aggactaaaaagatgctctccc

SEQ ID NO: 8415558 - DNA, 22 bp, Homo sapiens
cagtgctatttggacacaggga

SEQ ID NO: 8415559 - DNA, 18 bp, Homo sapiens
cagtggcatagttgagta

SEQ ID NO: 8415560 - DNA, 22 bp, Homo sapiens
aggacctggatcacagagatct

SEQ ID NO: 8415561 - DNA, 22 bp, Homo sapiens
aggacctgctaatgtgccaagt

SEQ ID NO: 8415562 - DNA, 22 bp, Homo sapiens
aggacctgactggctcctgctt

SEQ ID NO: 8415563 - DNA, 22 bp, Homo sapiens
aggacctgagagttggaaatcc

SEQ ID NO: 8415564 - DNA, 22 bp, Homo sapiens
aggacctgccaggtgcaaagca

SEQ ID NO: 8415565 - DNA, 22 bp, Homo sapiens
aggacctgtacctcagcatcta

SEQ ID NO: 8415566 - DNA, 22 bp, Homo sapiens
aggacctgtagggcctgcatcc

SEQ ID NO: 8415567 - DNA, 22 bp, Homo sapiens
aggacctgtgttttccttgaat

SEQ ID NO: 8415568 - DNA, 22 bp, Homo sapiens
aggacctgacattgtgttttct

SEQ ID NO: 8415569 - DNA, 22 bp, Homo sapiens
aggacctgaaattcttgctttt

SEQ ID NO: 8415570 - DNA, 22 bp, Homo sapiens
aggaccatcctaaggtaggcaa

SEQ ID NO: 8415571 - DNA, 22 bp, Homo sapiens
aggaccaacatagcagcagtgg

SEQ ID NO: 8415572 - DNA, 22 bp, Homo sapiens
caggtggcttctccctaggcca

SEQ ID NO: 8415573 - DNA, 22 bp, Homo sapiens
aggagggagcttaagccaggca

SEQ ID NO: 8415574 - DNA, 22 bp, Homo sapiens
aggagggagcactatatgggga

SEQ ID NO: 8415575 - DNA, 22 bp, Homo sapiens
catatttagtgtttggagatcg

SEQ ID NO: 8415576 - DNA, 22 bp, Homo sapiens
catagcaacagcatcaagtcaa

SEQ ID NO: 8415577 - DNA, 22 bp, Homo sapiens
catagacattcagcactcacta

SEQ ID NO: 8415578 - DNA, 22 bp, Homo sapiens
catagcggtattccacgtggtt

SEQ ID NO: 8415579 - DNA, 22 bp, Homo sapiens
cagtttatttccaagatgacaa

SEQ ID NO: 8415580 - DNA, 22 bp, Homo sapiens
cagtggtgaagagcaggggctc

SEQ ID NO: 8415581 - DNA, 22 bp, Homo sapiens
aggcaggggagctggaagggta

SEQ ID NO: 8415582 - DNA, 22 bp, Homo sapiens
ccacaggatccaagggaaggca

SEQ ID NO: 8415583 - DNA, 22 bp, Homo sapiens
ccagagagtcgatgggggacac

SEQ ID NO: 8415584 - DNA, 22 bp, Homo sapiens
ccagagagtatcatggagagta

SEQ ID NO: 8415585 - DNA, 22 bp, Homo sapiens
ccagagagtaggaggcattatt

SEQ ID NO: 8415586 - DNA, 22 bp, Homo sapiens
ccagagagtaaacattttccgg

SEQ ID NO: 8415587 - DNA, 17 bp, Homo sapiens
ccagagagtagttagga

SEQ ID NO: 8415588 - DNA, 20 bp, Homo sapiens
ccagagagtaggttagtgat

SEQ ID NO: 8415589 - DNA, 22 bp, Homo sapiens
ccagagaggggaagggcttgcc

SEQ ID NO: 8415590 - DNA, 22 bp, Homo sapiens
ccagagaggtagcttaccctct

SEQ ID NO: 8415591 - DNA, 22 bp, Homo sapiens
ccagctttctcagaggcttcta

SEQ ID NO: 8415592 - DNA, 22 bp, Homo sapiens
ccagctttcctgcgagttgatt

SEQ ID NO: 8415593 - DNA, 20 bp, Homo sapiens
ccagctttccctgcagcatc

SEQ ID NO: 8415594 - DNA, 22 bp, Homo sapiens
ccagctttggagtgttgttgct

SEQ ID NO: 8415595 - DNA, 22 bp, Homo sapiens
ccagcttttcagaatctgcctg

SEQ ID NO: 8415596 - DNA, 22 bp, Homo sapiens
ccagcttttagtgggcttatta

SEQ ID NO: 8415597 - DNA, 22 bp, Homo sapiens
ccagctttctgggtggtttctg

SEQ ID NO: 8415598 - DNA, 22 bp, Homo sapiens
ccagcttttcctctcattgctt

SEQ ID NO: 8415599 - DNA, 22 bp, Homo sapiens
ccagcttttcttatcattataa

SEQ ID NO: 8415600 - DNA, 22 bp, Homo sapiens
ccagcttttggggtgacaattt

SEQ ID NO: 8415601 - DNA, 22 bp, Homo sapiens
ccagcttttgcactggactggg

SEQ ID NO: 8415602 - DNA, 22 bp, Homo sapiens
ccagctttaggttgcctgccag

SEQ ID NO: 8415603 - DNA, 22 bp, Homo sapiens
ccagctttatcaagtctgagct

SEQ ID NO: 8415604 - DNA, 22 bp, Homo sapiens
ccagctttatagcttcaaagga

SEQ ID NO: 8415605 - DNA, 22 bp, Homo sapiens
ccagctttcatatcatgaggta

SEQ ID NO: 8415606 - DNA, 22 bp, Homo sapiens
ccagctttccagggttgactgg

SEQ ID NO: 8415607 - DNA, 21 bp, Homo sapiens
ccagctttcccaagtcccttt

SEQ ID NO: 8415608 - DNA, 22 bp, Homo sapiens
ccagcctgaaatgcctcatcct

SEQ ID NO: 8415609 - DNA, 23 bp, Homo sapiens
cccagagcacagcctccagatgc

SEQ ID NO: 8415610 - DNA, 20 bp, Homo sapiens
cccagagccatagccagaca

SEQ ID NO: 8415611 - DNA, 22 bp, Homo sapiens
ccagggagcctggtgtgtcagc

SEQ ID NO: 8415612 - DNA, 17 bp, Homo sapiens
ccaggagcgtgggtctc

SEQ ID NO: 8415613 - DNA, 18 bp, Homo sapiens
agggctgatgagtttggg

SEQ ID NO: 8415614 - DNA, 22 bp, Homo sapiens
agggctgcaccggggcttcgcg

SEQ ID NO: 8415615 - DNA, 22 bp, Homo sapiens
cctgagctttaaaagccatgta

SEQ ID NO: 8415616 - DNA, 17 bp, Homo sapiens
aggggagagtgggaaga

SEQ ID NO: 8415617 - DNA, 22 bp, Homo sapiens
aggggagagttaatgtgaatgt

SEQ ID NO: 8415618 - DNA, 22 bp, Homo sapiens
aggggagaggtgagcaacttct

SEQ ID NO: 8415619 - DNA, 22 bp, Homo sapiens
aggggagagaacataaggaagt

SEQ ID NO: 8415620 - DNA, 22 bp, Homo sapiens
aggggagaatttcaactcaggt

SEQ ID NO: 8415621 - DNA, 22 bp, Homo sapiens
aggggagactggaatctaacat

SEQ ID NO: 8415622 - DNA, 22 bp, Homo sapiens
aggggagaaaaatgccttctgt

SEQ ID NO: 8415623 - DNA, 22 bp, Homo sapiens
agggccctaaggaaggcacaca

SEQ ID NO: 8415624 - DNA, 22 bp, Homo sapiens
agggctccaaggaagtgtagct

SEQ ID NO: 8415625 - DNA, 22 bp, Homo sapiens
agggctccaggggaccatcagt

SEQ ID NO: 8415626 - DNA, 22 bp, Homo sapiens
agggctcccgcggtgtccggga

SEQ ID NO: 8415627 - DNA, 22 bp, Homo sapiens
agggctccaggggctgggtgac

SEQ ID NO: 8415628 - DNA, 22 bp, Homo sapiens
agggctcccgtgaggtgactgc

SEQ ID NO: 8415629 - DNA, 22 bp, Homo sapiens
agggccctagggaatgagacat

SEQ ID NO: 8415630 - DNA, 22 bp, Homo sapiens
agggctctgagctggaccacct

SEQ ID NO: 8415631 - DNA, 22 bp, Homo sapiens
agggctcctgaggcccttctgg

SEQ ID NO: 8415632 - DNA, 23 bp, Homo sapiens
agggctccttgttgattagcatt

SEQ ID NO: 8415633 - DNA, 22 bp, Homo sapiens
agggctcctccccggcctccac

SEQ ID NO: 8415634 - DNA, 22 bp, Homo sapiens
agggctcctatgatgctctgcc

SEQ ID NO: 8415635 - DNA, 22 bp, Homo sapiens
agggctccgggcaggcgatgga

SEQ ID NO: 8415636 - DNA, 22 bp, Homo sapiens
agggctccgggccaccggcctg

SEQ ID NO: 8415637 - DNA, 22 bp, Homo sapiens
agggctcctatgccccatggac

SEQ ID NO: 8415638 - DNA, 22 bp, Homo sapiens
agggctcctatgccccatggac

SEQ ID NO: 8415639 - DNA, 22 bp, Homo sapiens
agggacttgatgtcagggagat

SEQ ID NO: 8415640 - DNA, 22 bp, Homo sapiens
agggagaagagaacaaagccct

SEQ ID NO: 8415641 - DNA, 19 bp, Homo sapiens
agggatatttaaaaagctc

SEQ ID NO: 8415642 - DNA, 21 bp, Homo sapiens
aggcttggatctagacaggcc

SEQ ID NO: 8415643 - DNA, 21 bp, Homo sapiens
aggcttggataggttatgtga

SEQ ID NO: 8415644 - DNA, 19 bp, Homo sapiens
aggcttggaacagccttat

SEQ ID NO: 8415645 - DNA, 22 bp, Homo sapiens
aggcttggaagtggcagaactg

SEQ ID NO: 8415646 - DNA, 22 bp, Homo sapiens
aggcttggaggttctgtagcca

SEQ ID NO: 8415647 - DNA, 21 bp, Homo sapiens
aggcttggatagatattcata

SEQ ID NO: 8415648 - DNA, 19 bp, Homo sapiens
aggcttggattgtggccaa

SEQ ID NO: 8415649 - DNA, 22 bp, Homo sapiens
aggcttggaaaatttacagtgt

SEQ ID NO: 8415650 - DNA, 22 bp, Homo sapiens
attttagatttaagaataaggt

SEQ ID NO: 8415651 - DNA, 22 bp, Homo sapiens
atttgtagtgaagtgaaaataa

SEQ ID NO: 8415652 - DNA, 22 bp, Homo sapiens
atttgggaatgtgcattatact

SEQ ID NO: 8415653 - DNA, 22 bp, Homo sapiens
atttgggaattatttgcctaat

SEQ ID NO: 8415654 - DNA, 22 bp, Homo sapiens
atttgggagttgctagtgagtt

SEQ ID NO: 8415655 - DNA, 20 bp, Homo sapiens
atttgggacgattggccacc

SEQ ID NO: 8415656 - DNA, 22 bp, Homo sapiens
attttctaagcctgtcagactt

SEQ ID NO: 8415657 - DNA, 22 bp, Homo sapiens
attttcatggcttctgctcagt

SEQ ID NO: 8415658 - DNA, 22 bp, Homo sapiens
attttcatgactaccttaaata

SEQ ID NO: 8415659 - DNA, 22 bp, Homo sapiens
attttcatcgctaggttggcct

SEQ ID NO: 8415660 - DNA, 22 bp, Homo sapiens
attttcatcatgggtttaacat

SEQ ID NO: 8415661 - DNA, 22 bp, Homo sapiens
attttcattttgcagggtgaga

SEQ ID NO: 8415662 - DNA, 21 bp, Homo sapiens
attttcatttccaggggagga

SEQ ID NO: 8415663 - DNA, 21 bp, Homo sapiens
attttcattaattcagtgtgg

SEQ ID NO: 8415664 - DNA, 21 bp, Homo sapiens
attttcattaattcagtgtgg

SEQ ID NO: 8415665 - DNA, 22 bp, Homo sapiens
caaagaagagatttacagagct

SEQ ID NO: 8415666 - DNA, 22 bp, Homo sapiens
caaagagctgttcagtgtcgct

SEQ ID NO: 8415667 - DNA, 22 bp, Homo sapiens
attttgcacactatgcagcttt

SEQ ID NO: 8415668 - DNA, 22 bp, Homo sapiens
attttgacagaagaggccctaa

SEQ ID NO: 8415669 - DNA, 22 bp, Homo sapiens
attttgatgctatctaatgaat

SEQ ID NO: 8415670 - DNA, 22 bp, Homo sapiens
caaaagatacttgcatctaact

SEQ ID NO: 8415671 - DNA, 22 bp, Homo sapiens
gctcagagagaggctcaccatt

SEQ ID NO: 8415672 - DNA, 19 bp, Homo sapiens
gctcagagacacctgttgc

SEQ ID NO: 8415673 - DNA, 22 bp, Homo sapiens
caaaagaagctcttggggctag

SEQ ID NO: 8415674 - DNA, 22 bp, Homo sapiens
gccatctggcattgcagcacct

SEQ ID NO: 8415675 - DNA, 22 bp, Homo sapiens
gccatctgctgctctccagtgt

SEQ ID NO: 8415676 - DNA, 22 bp, Homo sapiens
gccatctgcgcggtgtccagct

SEQ ID NO: 8415677 - DNA, 22 bp, Homo sapiens
gcccaggttggagagcagtggc

SEQ ID NO: 8415678 - DNA, 22 bp, Homo sapiens
gcccagtagttcaaggttgcag

SEQ ID NO: 8415679 - DNA, 22 bp, Homo sapiens
atttccctccagggaaagctta

SEQ ID NO: 8415680 - DNA, 22 bp, Homo sapiens
attgtacaggttggaggaagtg

SEQ ID NO: 8415681 - DNA, 22 bp, Homo sapiens
attgtacagatgaggtaagtga

SEQ ID NO: 8415682 - DNA, 22 bp, Homo sapiens
atttatctctggaaactaagca

SEQ ID NO: 8415683 - DNA, 22 bp, Homo sapiens
atttatgacaaccaaagagtga

SEQ ID NO: 8415684 - DNA, 22 bp, Homo sapiens
gccatcatatcccctgtgacct

SEQ ID NO: 8415685 - DNA, 22 bp, Homo sapiens
atttattacctcggagtttctg

SEQ ID NO: 8415686 - DNA, 22 bp, Homo sapiens
atttattatgggatttggcaca

SEQ ID NO: 8415687 - DNA, 22 bp, Homo sapiens
atttatgattagcctattgttg

SEQ ID NO: 8415688 - DNA, 22 bp, Homo sapiens
atttatgactggtgaatagaac

SEQ ID NO: 8415689 - DNA, 22 bp, Homo sapiens
atttattaagcatctgctatgt

SEQ ID NO: 8415690 - DNA, 23 bp, Homo sapiens
atgttattattagcagtcttgcc

SEQ ID NO: 8415691 - DNA, 22 bp, Homo sapiens
atgttattaaagtacagattct

SEQ ID NO: 8415692 - DNA, 22 bp, Homo sapiens
atgttatttctgaaagatcatt

SEQ ID NO: 8415693 - DNA, 22 bp, Homo sapiens
gatgtgtagagggaatttcaaa

SEQ ID NO: 8415694 - DNA, 22 bp, Homo sapiens
gattcttacttctaagcaagct

SEQ ID NO: 8415695 - DNA, 22 bp, Homo sapiens
attaaattggacgctgggggaa

SEQ ID NO: 8415696 - DNA, 22 bp, Homo sapiens
gattcttatgagtgaactttac

SEQ ID NO: 8415697 - DNA, 22 bp, Homo sapiens
attaaattggatctgcatagtt

SEQ ID NO: 8415698 - DNA, 22 bp, Homo sapiens
attaaattttcactaggctccc

SEQ ID NO: 8415699 - DNA, 19 bp, Homo sapiens
attaacatcagtgttggcc

SEQ ID NO: 8415700 - DNA, 22 bp, Homo sapiens
attaacatgagttggagatagg

SEQ ID NO: 8415701 - DNA, 22 bp, Homo sapiens
attaacatgcagccagacacac

SEQ ID NO: 8415702 - DNA, 22 bp, Homo sapiens
gcacacagaattgattcactgt

SEQ ID NO: 8415703 - DNA, 22 bp, Homo sapiens
attataggcttgagccaccgtg

SEQ ID NO: 8415704 - DNA, 22 bp, Homo sapiens
attaagactattgatatttaca

SEQ ID NO: 8415705 - DNA, 22 bp, Homo sapiens
attatatgtgggatagaattta

SEQ ID NO: 8415706 - DNA, 22 bp, Homo sapiens
attatctatgtagaatgatttt

SEQ ID NO: 8415707 - DNA, 22 bp, Homo sapiens
gcagagaaggattgaaaccaga

SEQ ID NO: 8415708 - DNA, 22 bp, Homo sapiens
gcagagaggaatgaagccatcc

SEQ ID NO: 8415709 - DNA, 22 bp, Homo sapiens
gcagagaggatattattgtcca

SEQ ID NO: 8415710 - DNA, 22 bp, Homo sapiens
gcagagagttgggctgcgccag

SEQ ID NO: 8415711 - DNA, 22 bp, Homo sapiens
gcagagaccccgcagtgaggcc

SEQ ID NO: 8415712 - DNA, 22 bp, Homo sapiens
attcaagtccagcttctctaca

SEQ ID NO: 8415713 - DNA, 22 bp, Homo sapiens
attctttccagacactgattgc

SEQ ID NO: 8415714 - DNA, 22 bp, Homo sapiens
attgcactccagcctgggtgac

SEQ ID NO: 8415715 - DNA, 19 bp, Homo sapiens
gcatcagagcagaaggggt

SEQ ID NO: 8415716 - DNA, 22 bp, Homo sapiens
gcatccaaaccattcatcagcc

SEQ ID NO: 8415717 - DNA, 22 bp, Homo sapiens
attgcactccggcctgggtgac

SEQ ID NO: 8415718 - DNA, 22 bp, Homo sapiens
attgcaaatgagtcttaatata

SEQ ID NO: 8415719 - DNA, 22 bp, Homo sapiens
attgcaaaggtcccattcaaga

SEQ ID NO: 8415720 - DNA, 22 bp, Homo sapiens
gcagtaagatgtaagtgctata

SEQ ID NO: 8415721 - DNA, 22 bp, Homo sapiens
attctgagacaattgccgtcag

SEQ ID NO: 8415722 - DNA, 22 bp, Homo sapiens
attctgagaaatgcattgtcag

SEQ ID NO: 8415723 - DNA, 22 bp, Homo sapiens
attctcagttcactagtttctt

SEQ ID NO: 8415724 - DNA, 22 bp, Homo sapiens
attctgagtccatgggggcagg

SEQ ID NO: 8415725 - DNA, 21 bp, Homo sapiens
attctgagttgtcagtcttca

SEQ ID NO: 8415726 - DNA, 22 bp, Homo sapiens
attccacagctcagcctctctt

SEQ ID NO: 8415727 - DNA, 22 bp, Homo sapiens
attccacagaggactccgattg

SEQ ID NO: 8415728 - DNA, 22 bp, Homo sapiens
attccaaaggttaatgcccatt

SEQ ID NO: 8415729 - DNA, 22 bp, Homo sapiens
attccaaagacagaagcagctg

SEQ ID NO: 8415730 - DNA, 22 bp, Homo sapiens
attccaaacttaccccagagga

SEQ ID NO: 8415731 - DNA, 22 bp, Homo sapiens
attcacaaataacaggtgcaga

SEQ ID NO: 8415732 - DNA, 22 bp, Homo sapiens
gacagcttagtgaaaatgtaaa

SEQ ID NO: 8415733 - DNA, 22 bp, Homo sapiens
atgctatacatatgacatcaca

SEQ ID NO: 8415734 - DNA, 17 bp, Homo sapiens
gaatttcttggtcaaaa

SEQ ID NO: 8415735 - DNA, 22 bp, Homo sapiens
gaatttgaaaagtgatgggaat

SEQ ID NO: 8415736 - DNA, 22 bp, Homo sapiens
gaatttcctctaaacccctgag

SEQ ID NO: 8415737 - DNA, 22 bp, Homo sapiens
gaatttctggaccctttgagaa

SEQ ID NO: 8415738 - DNA, 22 bp, Homo sapiens
gaattttaataaaggtttatca

SEQ ID NO: 8415739 - DNA, 22 bp, Homo sapiens
gaattttaagtgttcgcctctt

SEQ ID NO: 8415740 - DNA, 22 bp, Homo sapiens
gaattttagaatatgtgggctt

SEQ ID NO: 8415741 - DNA, 19 bp, Homo sapiens
gaattttaggacttcagca

SEQ ID NO: 8415742 - DNA, 22 bp, Homo sapiens
atgccactgcactccagcctgg

SEQ ID NO: 8415743 - DNA, 22 bp, Homo sapiens
atgccactgcactccagcctag

SEQ ID NO: 8415744 - DNA, 22 bp, Homo sapiens
atgcagttttcaaagactattc

SEQ ID NO: 8415745 - DNA, 22 bp, Homo sapiens
atgcagttttaaatcatttcag

SEQ ID NO: 8415746 - DNA, 22 bp, Homo sapiens
atgcagtttatctccaaatcat

SEQ ID NO: 8415747 - DNA, 22 bp, Homo sapiens
atgcagtttaaggcacaattag

SEQ ID NO: 8415748 - DNA, 22 bp, Homo sapiens
gaagtatatgtctttaatctat

SEQ ID NO: 8415749 - DNA, 22 bp, Homo sapiens
gaagtatagcagatgttattta

SEQ ID NO: 8415750 - DNA, 22 bp, Homo sapiens
atgatgttgataaattacttta

SEQ ID NO: 8415751 - DNA, 22 bp, Homo sapiens
atgatgttaccagtacttagag

SEQ ID NO: 8415752 - DNA, 22 bp, Homo sapiens
atgatgttattttcagaaacat

SEQ ID NO: 8415753 - DNA, 22 bp, Homo sapiens
atgcagttaggtaatagtctca

SEQ ID NO: 8415754 - DNA, 22 bp, Homo sapiens
gaaggagggtgcggatctgagc

SEQ ID NO: 8415755 - DNA, 22 bp, Homo sapiens
gaaggagggtgcggatctgagc

SEQ ID NO: 8415756 - DNA, 22 bp, Homo sapiens
gaaggaggtctgatacaatatg

SEQ ID NO: 8415757 - DNA, 22 bp, Homo sapiens
gaaggagggagcggcgcggatt

SEQ ID NO: 8415758 - DNA, 22 bp, Homo sapiens
gaaggaggtctgcattctacag

SEQ ID NO: 8415759 - DNA, 22 bp, Homo sapiens
gaaggaggtgtcagttggactg

SEQ ID NO: 8415760 - DNA, 22 bp, Homo sapiens
atgcaggagccctcttgagggc

SEQ ID NO: 8415761 - DNA, 22 bp, Homo sapiens
gaaggaggcgttagccctagga

SEQ ID NO: 8415762 - DNA, 22 bp, Homo sapiens
gaaggaggctccccaaagtctg

SEQ ID NO: 8415763 - DNA, 22 bp, Homo sapiens
atgacagaccctctaaagacaa

SEQ ID NO: 8415764 - DNA, 19 bp, Homo sapiens
atgagcaatagttttaatc

SEQ ID NO: 8415765 - DNA, 22 bp, Homo sapiens
atgagcaattaggaagaaaaca

SEQ ID NO: 8415766 - DNA, 22 bp, Homo sapiens
atgagcaagagctatgtacaga

SEQ ID NO: 8415767 - DNA, 22 bp, Homo sapiens
atgagaggtttcgtcagaggaa

SEQ ID NO: 8415768 - DNA, 22 bp, Homo sapiens
atctttcagagctccatcaggg

SEQ ID NO: 8415769 - DNA, 21 bp, Homo sapiens
atctttattacgcagagaaga

SEQ ID NO: 8415770 - DNA, 22 bp, Homo sapiens
atctttatttattgagcactta

SEQ ID NO: 8415771 - DNA, 22 bp, Homo sapiens
atctttctctgcactatacaat

SEQ ID NO: 8415772 - DNA, 22 bp, Homo sapiens
atctttctccatatacatcttt

SEQ ID NO: 8415773 - DNA, 22 bp, Homo sapiens
atctttctatggtactttctcc

SEQ ID NO: 8415774 - DNA, 22 bp, Homo sapiens
ctttactgaagtgaagacctgg

SEQ ID NO: 8415775 - DNA, 22 bp, Homo sapiens
ctttattagatgtagactttct

SEQ ID NO: 8415776 - DNA, 22 bp, Homo sapiens
ctttattcctacaagattttct

SEQ ID NO: 8415777 - DNA, 22 bp, Homo sapiens
ctttacatcctgtttcccgttt

SEQ ID NO: 8415778 - DNA, 22 bp, Homo sapiens
ctttacagcctccagaaggaac

SEQ ID NO: 8415779 - DNA, 22 bp, Homo sapiens
atgtatttctatgtagtgaaga

SEQ ID NO: 8415780 - DNA, 22 bp, Homo sapiens
gaggctccccatgaggccccag

SEQ ID NO: 8415781 - DNA, 22 bp, Homo sapiens
atgtattatggttttccttaag

SEQ ID NO: 8415782 - DNA, 22 bp, Homo sapiens
gaggagggcctggtgtcccttc

SEQ ID NO: 8415783 - DNA, 22 bp, Homo sapiens
gaggagggctttgttgatgtta

SEQ ID NO: 8415784 - DNA, 22 bp, Homo sapiens
gaggagggcagttcctctttta

SEQ ID NO: 8415785 - DNA, 22 bp, Homo sapiens
gaggaggggcacttgtctccta

SEQ ID NO: 8415786 - DNA, 22 bp, Homo sapiens
gaggaggggacagtacttgtgc

SEQ ID NO: 8415787 - DNA, 23 bp, Homo sapiens
gaggagggtcgtgctgtgttcct

SEQ ID NO: 8415788 - DNA, 20 bp, Homo sapiens
atgtgaggggttgaagtggg

SEQ ID NO: 8415789 - DNA, 22 bp, Homo sapiens
atgtgccctcttagagtctctg

SEQ ID NO: 8415790 - DNA, 22 bp, Homo sapiens
atgtgccctttctgctttgcag

SEQ ID NO: 8415791 - DNA, 23 bp, Homo sapiens
atgttaaacataactgaagagcc

SEQ ID NO: 8415792 - DNA, 22 bp, Homo sapiens
atgttaaaagtgaggatggcca

SEQ ID NO: 8415793 - DNA, 22 bp, Homo sapiens
atgttaaaagtctgagtgggag

SEQ ID NO: 8415794 - DNA, 22 bp, Homo sapiens
atgttacagagaaagtggaagc

SEQ ID NO: 8415795 - DNA, 19 bp, Homo sapiens
gaggttcacgcgctggatg

SEQ ID NO: 8415796 - DNA, 22 bp, Homo sapiens
gaggttcacttcctgaaatagc

SEQ ID NO: 8415797 - DNA, 22 bp, Homo sapiens
gaggttcacttcctggatcctt

SEQ ID NO: 8415798 - DNA, 22 bp, Homo sapiens
gaggttcaggaaatgggcaaag

SEQ ID NO: 8415799 - DNA, 22 bp, Homo sapiens
gaggttcagctgctgcctggta

SEQ ID NO: 8415800 - DNA, 22 bp, Homo sapiens
gaggttcagtaaggaatactga

SEQ ID NO: 8415801 - DNA, 22 bp, Homo sapiens
gaggttcacaggctatcacagt

SEQ ID NO: 8415802 - DNA, 22 bp, Homo sapiens
gagacaggcagctagtgggtca

SEQ ID NO: 8415803 - DNA, 18 bp, Homo sapiens
atggcacagtctttccct

SEQ ID NO: 8415804 - DNA, 22 bp, Homo sapiens
atggctctgctgggcaaagcaa

SEQ ID NO: 8415805 - DNA, 22 bp, Homo sapiens
cacacagtaggcactcattaat

SEQ ID NO: 8415806 - DNA, 22 bp, Homo sapiens
cacacagtgggaaaacctgaag

SEQ ID NO: 8415807 - DNA, 22 bp, Homo sapiens
cacacagtggagtattactcag

SEQ ID NO: 8415808 - DNA, 22 bp, Homo sapiens
ggagaagggacagactcagctt

SEQ ID NO: 8415809 - DNA, 22 bp, Homo sapiens
ggagaagggaactgagtttttg

SEQ ID NO: 8415810 - DNA, 22 bp, Homo sapiens
ggagaaggcgaagtcattcttt

SEQ ID NO: 8415811 - DNA, 22 bp, Homo sapiens
ggagaagggacagactcagctt

SEQ ID NO: 8415812 - DNA, 22 bp, Homo sapiens
ggagaagggcatggtagtttta

SEQ ID NO: 8415813 - DNA, 22 bp, Homo sapiens
ggagaagggccaattccatgta

SEQ ID NO: 8415814 - DNA, 22 bp, Homo sapiens
ggagaagggtatgtgtggcgga

SEQ ID NO: 8415815 - DNA, 22 bp, Homo sapiens
ggagaaggtgctggtcactgtg

SEQ ID NO: 8415816 - DNA, 22 bp, Homo sapiens
ggagaaggtggctcagcaaagg

SEQ ID NO: 8415817 - DNA, 23 bp, Homo sapiens
cacaactaatcagaatctctagg

SEQ ID NO: 8415818 - DNA, 22 bp, Homo sapiens
cacaaataccagtttcctaaca

SEQ ID NO: 8415819 - DNA, 22 bp, Homo sapiens
caatatgcaagctattaagtat

SEQ ID NO: 8415820 - DNA, 22 bp, Homo sapiens
caatatagagagaaaattatgt

SEQ ID NO: 8415821 - DNA, 22 bp, Homo sapiens
caatagcagcttctgaatgcaa

SEQ ID NO: 8415822 - DNA, 22 bp, Homo sapiens
caatactttagtaaaatggccc

SEQ ID NO: 8415823 - DNA, 22 bp, Homo sapiens
caatacttccttgttagaggca

SEQ ID NO: 8415824 - DNA, 22 bp, Homo sapiens
caataagatgtattgagcagag

SEQ ID NO: 8415825 - DNA, 22 bp, Homo sapiens
caactttatgattggtttgtca

SEQ ID NO: 8415826 - DNA, 22 bp, Homo sapiens
caacaagtgttcgtaaagtgcc

SEQ ID NO: 8415827 - DNA, 22 bp, Homo sapiens
caaagtcagccagctagtaggt

SEQ ID NO: 8415828 - DNA, 22 bp, Homo sapiens
gctggaagaatgagtgcctcgt

SEQ ID NO: 8415829 - DNA, 22 bp, Homo sapiens
caagcgtggctgctctgatgga

SEQ ID NO: 8415830 - DNA, 17 bp, Homo sapiens
cactagtagtctctggc

SEQ ID NO: 8415831 - DNA, 22 bp, Homo sapiens
cactatatctgttcttgtttat

SEQ ID NO: 8415832 - DNA, 21 bp, Homo sapiens
cactccacttagaacagggtt

SEQ ID NO: 8415833 - DNA, 22 bp, Homo sapiens
cactctaacctccatcttccat

SEQ ID NO: 8415834 - DNA, 20 bp, Homo sapiens
cactctaaccatatttcctc

SEQ ID NO: 8415835 - DNA, 22 bp, Homo sapiens
cactgcactccagcctgggaga

SEQ ID NO: 8415836 - DNA, 22 bp, Homo sapiens
cactgcactccagcctgggaga

SEQ ID NO: 8415837 - DNA, 22 bp, Homo sapiens
cacttgagttcttaatagtcag

SEQ ID NO: 8415838 - DNA, 20 bp, Homo sapiens
ggctctggaatctggtgggc

SEQ ID NO: 8415839 - DNA, 22 bp, Homo sapiens
cacttcaaggaatatctagaaa

SEQ ID NO: 8415840 - DNA, 19 bp, Homo sapiens
cacttcaatcctttatcaa

SEQ ID NO: 8415841 - DNA, 22 bp, Homo sapiens
cacttaagcagttaatttatct

SEQ ID NO: 8415842 - DNA, 22 bp, Homo sapiens
cacttatctcatttaatcacca

SEQ ID NO: 8415843 - DNA, 22 bp, Homo sapiens
cacttagtctcaccagttcagt

SEQ ID NO: 8415844 - DNA, 22 bp, Homo sapiens
cacttcaaatatggcttcatga

SEQ ID NO: 8415845 - DNA, 22 bp, Homo sapiens
cacttcaacagttatttcttag

SEQ ID NO: 8415846 - DNA, 22 bp, Homo sapiens
cactgggagtacaaagaatggg

SEQ ID NO: 8415847 - DNA, 22 bp, Homo sapiens
cactgcactccagcctgggtca

SEQ ID NO: 8415848 - DNA, 22 bp, Homo sapiens
cactgcactccagcctgggtca

SEQ ID NO: 8415849 - DNA, 22 bp, Homo sapiens
cactgcactccagcctgggtga

SEQ ID NO: 8415850 - DNA, 22 bp, Homo sapiens
cactgcactccagcctgggtga

SEQ ID NO: 8415851 - DNA, 22 bp, Homo sapiens
cactgcactccagcttgggtga

SEQ ID NO: 8415852 - DNA, 22 bp, Homo sapiens
cacaggcctgtctctttctaac

SEQ ID NO: 8415853 - DNA, 22 bp, Homo sapiens
cacagtgcatgatgggcagaag

SEQ ID NO: 8415854 - DNA, 22 bp, Homo sapiens
cacatgatggtggaagccatag

SEQ ID NO: 8415855 - DNA, 22 bp, Homo sapiens
cacatgacactattttgttcta

SEQ ID NO: 8415856 - DNA, 22 bp, Homo sapiens
cacatgaccactctttacttct

SEQ ID NO: 8415857 - DNA, 23 bp, Homo sapiens
cacatgacctgacctaggctagg

SEQ ID NO: 8415858 - DNA, 22 bp, Homo sapiens
cacatgactctggctacccaga

SEQ ID NO: 8415859 - DNA, 22 bp, Homo sapiens
ggcaatttcatgtggtttaaac

SEQ ID NO: 8415860 - DNA, 22 bp, Homo sapiens
cacattccccagagctggggct

SEQ ID NO: 8415861 - DNA, 21 bp, Homo sapiens
cacattccatgggtctattta

SEQ ID NO: 8415862 - DNA, 22 bp, Homo sapiens
cacattcaggtggcatgttaga

SEQ ID NO: 8415863 - DNA, 22 bp, Homo sapiens
cacattccttacattcatagag

SEQ ID NO: 8415864 - DNA, 22 bp, Homo sapiens
cacattcctggtgctcagcagc

SEQ ID NO: 8415865 - DNA, 22 bp, Homo sapiens
cacattcctgagcttcgacctg

SEQ ID NO: 8415866 - DNA, 22 bp, Homo sapiens
cacatgtgtgctgaggactgtg

SEQ ID NO: 8415867 - DNA, 22 bp, Homo sapiens
cacattcagggaacattggagg

SEQ ID NO: 8415868 - DNA, 22 bp, Homo sapiens
cacattcacttctctgtccacc

SEQ ID NO: 8415869 - DNA, 22 bp, Homo sapiens
cagagcaggggtttcccaggtt

SEQ ID NO: 8415870 - DNA, 22 bp, Homo sapiens
cagagcataattgacatgaggt

SEQ ID NO: 8415871 - DNA, 22 bp, Homo sapiens
cagagcatgaataaaagttaca

SEQ ID NO: 8415872 - DNA, 22 bp, Homo sapiens
cagagcatcgcgcagagagcct

SEQ ID NO: 8415873 - DNA, 22 bp, Homo sapiens
cagagcattaaaaccagctctg

SEQ ID NO: 8415874 - DNA, 22 bp, Homo sapiens
cagagcattgagggtctgccaa

SEQ ID NO: 8415875 - DNA, 22 bp, Homo sapiens
cagagcatttggaagccacgtg

SEQ ID NO: 8415876 - DNA, 21 bp, Homo sapiens
gggatcttgtactggcgtgga

SEQ ID NO: 8415877 - DNA, 22 bp, Homo sapiens
gggatcttgggaacacccttac

SEQ ID NO: 8415878 - DNA, 22 bp, Homo sapiens
gggatcttgaaacagctggatt

SEQ ID NO: 8415879 - DNA, 20 bp, Homo sapiens
gggatcttccaggctctcct

SEQ ID NO: 8415880 - DNA, 22 bp, Homo sapiens
gggatcttgtttaatattgttt

SEQ ID NO: 8415881 - DNA, 22 bp, Homo sapiens
gggatctttctgatgctgtggc

SEQ ID NO: 8415882 - DNA, 22 bp, Homo sapiens
cagagacaccccagaaaataag

SEQ ID NO: 8415883 - DNA, 22 bp, Homo sapiens
cagagacaacctggtagagaaa

SEQ ID NO: 8415884 - DNA, 22 bp, Homo sapiens
cagaaaataaagtttctacgca

SEQ ID NO: 8415885 - DNA, 22 bp, Homo sapiens
cagacacacaagcaatctaagt

SEQ ID NO: 8415886 - DNA, 22 bp, Homo sapiens
gggaggagggtgctggctaaac

SEQ ID NO: 8415887 - DNA, 22 bp, Homo sapiens
gggtaccaagctgcttgggggc

SEQ ID NO: 8415888 - DNA, 22 bp, Homo sapiens
gggttcctccagttcctagagc

SEQ ID NO: 8415889 - DNA, 19 bp, Homo sapiens
ggtatatgggcctcacttg

SEQ ID NO: 8415890 - DNA, 23 bp, Homo sapiens
cagatgaggttggcagcatggtc

SEQ ID NO: 8415891 - DNA, 22 bp, Homo sapiens
cagatgaggggcatataacaat

SEQ ID NO: 8415892 - DNA, 22 bp, Homo sapiens
cagatgaggacagatgactggg

SEQ ID NO: 8415893 - DNA, 22 bp, Homo sapiens
cagatgaggcaacctcattgct

SEQ ID NO: 8415894 - DNA, 19 bp, Homo sapiens
cagatgagaaaagtgaggt

SEQ ID NO: 8415895 - DNA, 22 bp, Homo sapiens
cagatgagagtggccagggttc

SEQ ID NO: 8415896 - DNA, 18 bp, Homo sapiens
cagatgagatgcaatctc

SEQ ID NO: 8415897 - DNA, 22 bp, Homo sapiens
cagatgcacattctcatcagca

SEQ ID NO: 8415898 - DNA, 22 bp, Homo sapiens
cagatgcagcaaaatgacaggc

SEQ ID NO: 8415899 - DNA, 22 bp, Homo sapiens
ggtccgtttttgaagacagtgg

SEQ ID NO: 8415900 - DNA, 20 bp, Homo sapiens
gggtaaaaggcagtgttgca

SEQ ID NO: 8415901 - DNA, 22 bp, Homo sapiens
cagccagaacctaggatgagct

SEQ ID NO: 8415902 - DNA, 22 bp, Homo sapiens
gtccagagatggacgagcagat

SEQ ID NO: 8415903 - DNA, 22 bp, Homo sapiens
gtagggacaatatgttattaga

SEQ ID NO: 8415904 - DNA, 22 bp, Homo sapiens
gtagggacccacagtctatatt

SEQ ID NO: 8415905 - DNA, 22 bp, Homo sapiens
gtagggacatgccattatctca

SEQ ID NO: 8415906 - DNA, 19 bp, Homo sapiens
gtagggacagtggttctga

SEQ ID NO: 8415907 - DNA, 21 bp, Homo sapiens
gtagggacagagagttggtga

SEQ ID NO: 8415908 - DNA, 22 bp, Homo sapiens
gtagggactgttctcacctgag

SEQ ID NO: 8415909 - DNA, 22 bp, Homo sapiens
gtagggacttgttttactagta

SEQ ID NO: 8415910 - DNA, 22 bp, Homo sapiens
gtacacatactattcaaagaga

SEQ ID NO: 8415911 - DNA, 22 bp, Homo sapiens
gtacacataggttactgattaa

SEQ ID NO: 8415912 - DNA, 23 bp, Homo sapiens
gtacacatagtgtagttatattt

SEQ ID NO: 8415913 - DNA, 22 bp, Homo sapiens
cagatttagagtggggcttgga

SEQ ID NO: 8415914 - DNA, 22 bp, Homo sapiens
cagatttacctaactccaagtt

SEQ ID NO: 8415915 - DNA, 22 bp, Homo sapiens
cagattcaacctaagacaatct

SEQ ID NO: 8415916 - DNA, 22 bp, Homo sapiens
cagccctctgaagaggcgcttg

SEQ ID NO: 8415917 - DNA, 22 bp, Homo sapiens
tcgggctcgctctcctagcgga

SEQ ID NO: 8415918 - DNA, 22 bp, Homo sapiens
tcggagctgtagatgaaaccct

SEQ ID NO: 8415919 - DNA, 22 bp, Homo sapiens
tcgcttgaacccaggaagtgga

SEQ ID NO: 8415920 - DNA, 22 bp, Homo sapiens
tcgcttgaacccaggaagtgga

SEQ ID NO: 8415921 - DNA, 22 bp, Homo sapiens
tctcaaattcccttttcctcct

SEQ ID NO: 8415922 - DNA, 22 bp, Homo sapiens
tctccacaccagaaggagctga

SEQ ID NO: 8415923 - DNA, 22 bp, Homo sapiens
tctccacaagtgttgagagtac

SEQ ID NO: 8415924 - DNA, 22 bp, Homo sapiens
tctccacagtcccacctcgctt

SEQ ID NO: 8415925 - DNA, 22 bp, Homo sapiens
tctccacagaaggttccaggcc

SEQ ID NO: 8415926 - DNA, 22 bp, Homo sapiens
tctccacattctattggctata

SEQ ID NO: 8415927 - DNA, 22 bp, Homo sapiens
tctccacactttctctcccagg

SEQ ID NO: 8415928 - DNA, 22 bp, Homo sapiens
ccagagagattgcttctaaaga

SEQ ID NO: 8415929 - DNA, 22 bp, Homo sapiens
ccagagagagtactgggctctg

SEQ ID NO: 8415930 - DNA, 21 bp, Homo sapiens
ccagagagagggaagtgggtt

SEQ ID NO: 8415931 - DNA, 19 bp, Homo sapiens
ccagagagctaggtacaga

SEQ ID NO: 8415932 - DNA, 22 bp, Homo sapiens
ccagagaggcaaaactccttcc

SEQ ID NO: 8415933 - DNA, 22 bp, Homo sapiens
ccagagagctacaaggcataaa

SEQ ID NO: 8415934 - DNA, 22 bp, Homo sapiens
ccagagaggccaaggtcgtggt

SEQ ID NO: 8415935 - DNA, 22 bp, Homo sapiens
ccagagaggccttggcaagaca

SEQ ID NO: 8415936 - DNA, 22 bp, Homo sapiens
tctccgatcacaggttttcaat

SEQ ID NO: 8415937 - DNA, 22 bp, Homo sapiens
ccagcatgagacgatgatgaag

SEQ ID NO: 8415938 - DNA, 22 bp, Homo sapiens
tctcttaaaagattttaatgac

SEQ ID NO: 8415939 - DNA, 22 bp, Homo sapiens
tctctgtgtgttggctgtatat

SEQ ID NO: 8415940 - DNA, 22 bp, Homo sapiens
tctctgtgttccctgttttctc

SEQ ID NO: 8415941 - DNA, 23 bp, Homo sapiens
tctctgtgtgcctcagtttcttc

SEQ ID NO: 8415942 - DNA, 22 bp, Homo sapiens
tctctgtgtgccttcatctgcc

SEQ ID NO: 8415943 - DNA, 22 bp, Homo sapiens
ccagcattcacactggttcctt

SEQ ID NO: 8415944 - DNA, 20 bp, Homo sapiens
ccagcatgtacacatgtgga

SEQ ID NO: 8415945 - DNA, 22 bp, Homo sapiens
ccagccacagcttccagctcct

SEQ ID NO: 8415946 - DNA, 22 bp, Homo sapiens
tctgagaggcatctgcacttct

SEQ ID NO: 8415947 - DNA, 21 bp, Homo sapiens
tctgagagcaactgcccttta

SEQ ID NO: 8415948 - DNA, 22 bp, Homo sapiens
catcttttcagaagccattctg

SEQ ID NO: 8415949 - DNA, 22 bp, Homo sapiens
catcttttggtaggagccgggc

SEQ ID NO: 8415950 - DNA, 22 bp, Homo sapiens
catcttttggcctattctgagg

SEQ ID NO: 8415951 - DNA, 22 bp, Homo sapiens
tcatcagtgtccttatcactta

SEQ ID NO: 8415952 - DNA, 22 bp, Homo sapiens
tcatcagtttagaaaaaatatg

SEQ ID NO: 8415953 - DNA, 22 bp, Homo sapiens
tcatgacaggtgagtttttagg

SEQ ID NO: 8415954 - DNA, 22 bp, Homo sapiens
tccagacccatgaccctgggga

SEQ ID NO: 8415955 - DNA, 22 bp, Homo sapiens
tccagaccatgtgagaggcgca

SEQ ID NO: 8415956 - DNA, 22 bp, Homo sapiens
tccagaccatggatggctgcaa

SEQ ID NO: 8415957 - DNA, 22 bp, Homo sapiens
tcattcttgatcactagttagt

SEQ ID NO: 8415958 - DNA, 22 bp, Homo sapiens
tcattctttaccaagttgtcac

SEQ ID NO: 8415959 - DNA, 22 bp, Homo sapiens
tcattcttgcgtatgccatggt

SEQ ID NO: 8415960 - DNA, 22 bp, Homo sapiens
tcattcccccataatggtattt

SEQ ID NO: 8415961 - DNA, 20 bp, Homo sapiens
tccaggcagctcagagtgtc

SEQ ID NO: 8415962 - DNA, 22 bp, Homo sapiens
tccaggcagcccttcctgactc

SEQ ID NO: 8415963 - DNA, 22 bp, Homo sapiens
tccaggctcccctgcgtgctcc

SEQ ID NO: 8415964 - DNA, 22 bp, Homo sapiens
tccaggctccctcaggatgcac

SEQ ID NO: 8415965 - DNA, 22 bp, Homo sapiens
catgtgtgtccatgtgactaag

SEQ ID NO: 8415966 - DNA, 22 bp, Homo sapiens
catgttaaaatatacattctga

SEQ ID NO: 8415967 - DNA, 22 bp, Homo sapiens
catgttaaaatatacattctga

SEQ ID NO: 8415968 - DNA, 21 bp, Homo sapiens
tccagacctccctctcctagc

SEQ ID NO: 8415969 - DNA, 22 bp, Homo sapiens
tccagacctagggcaccccagt

SEQ ID NO: 8415970 - DNA, 22 bp, Homo sapiens
tcctcaggatctaggagtgctt

SEQ ID NO: 8415971 - DNA, 22 bp, Homo sapiens
tccctagtcgcatctgtggaga

SEQ ID NO: 8415972 - DNA, 22 bp, Homo sapiens
tccctagtcgcatctgtggaga

SEQ ID NO: 8415973 - DNA, 22 bp, Homo sapiens
catttgtatcatatgtatctta

SEQ ID NO: 8415974 - DNA, 22 bp, Homo sapiens
catttgtatctgggctgctgtg

SEQ ID NO: 8415975 - DNA, 22 bp, Homo sapiens
catttgtatgttcctccttagg

SEQ ID NO: 8415976 - DNA, 22 bp, Homo sapiens
catttgtatagtgcttagacca

SEQ ID NO: 8415977 - DNA, 22 bp, Homo sapiens
catttgtagttaaaaatgtctc

SEQ ID NO: 8415978 - DNA, 22 bp, Homo sapiens
catttgtagtatctgtttatat

SEQ ID NO: 8415979 - DNA, 22 bp, Homo sapiens
catttgtacagaacagctttat

SEQ ID NO: 8415980 - DNA, 22 bp, Homo sapiens
catttgtaatactgacttgcag

SEQ ID NO: 8415981 - DNA, 22 bp, Homo sapiens
catttgtagctatttactgtat

SEQ ID NO: 8415982 - DNA, 22 bp, Homo sapiens
catttgtaggatgcttcttgtt

SEQ ID NO: 8415983 - DNA, 22 bp, Homo sapiens
tccccagcttgctacttctgct

SEQ ID NO: 8415984 - DNA, 21 bp, Homo sapiens
cattgagataggagagattgt

SEQ ID NO: 8415985 - DNA, 22 bp, Homo sapiens
tcccagaggaaatggcagctga

SEQ ID NO: 8415986 - DNA, 22 bp, Homo sapiens
tcccaggaattgaagccagtgt

SEQ ID NO: 8415987 - DNA, 22 bp, Homo sapiens
tcccagccaggctctaccactt

SEQ ID NO: 8415988 - DNA, 22 bp, Homo sapiens
cattcagagctttcttatcata

SEQ ID NO: 8415989 - DNA, 22 bp, Homo sapiens
cattcacattcttcttactgtt

SEQ ID NO: 8415990 - DNA, 21 bp, Homo sapiens
cattcacagtctggctcttga

SEQ ID NO: 8415991 - DNA, 22 bp, Homo sapiens
cattcaaattaagattttgtta

SEQ ID NO: 8415992 - DNA, 22 bp, Homo sapiens
cattcaaatgtgccactgtcct

SEQ ID NO: 8415993 - DNA, 22 bp, Homo sapiens
cattcaaaggcatgtcctattt

SEQ ID NO: 8415994 - DNA, 22 bp, Homo sapiens
catgttcatcagatcaattgta

SEQ ID NO: 8415995 - DNA, 22 bp, Homo sapiens
catgttcagtgacagttattga

SEQ ID NO: 8415996 - DNA, 22 bp, Homo sapiens
catgttcacctgtggcactagt

SEQ ID NO: 8415997 - DNA, 22 bp, Homo sapiens
catgttaactaagattaactat

SEQ ID NO: 8415998 - DNA, 22 bp, Homo sapiens
catgttaatatgcattgagtac

SEQ ID NO: 8415999 - DNA, 22 bp, Homo sapiens
catgttaatgaatttttgcagt

SEQ ID NO: 8416000 - DNA, 22 bp, Homo sapiens
catgttaatatgcattgagtac

SEQ ID NO: 8416001 - DNA, 22 bp, Homo sapiens
tcacagctttcagattgttccc

SEQ ID NO: 8416002 - DNA, 22 bp, Homo sapiens
cagtgaggaagctgtctggacc

SEQ ID NO: 8416003 - DNA, 22 bp, Homo sapiens
tcacagacgcctcccctcgcct

SEQ ID NO: 8416004 - DNA, 22 bp, Homo sapiens
tcacaaatattttaacagtagg

SEQ ID NO: 8416005 - DNA, 21 bp, Homo sapiens
tcacaactttgaatttcaata

SEQ ID NO: 8416006 - DNA, 22 bp, Homo sapiens
tcacaactctttccatttaata

SEQ ID NO: 8416007 - DNA, 22 bp, Homo sapiens
tcacaacaggaaggaccagctg

SEQ ID NO: 8416008 - DNA, 22 bp, Homo sapiens
tatttcattctttatcaggagc

SEQ ID NO: 8416009 - DNA, 22 bp, Homo sapiens
tatttcatctggaacaaggtaa

SEQ ID NO: 8416010 - DNA, 22 bp, Homo sapiens
cagtggctggttagggacagga

SEQ ID NO: 8416011 - DNA, 22 bp, Homo sapiens
cagttaaacagattgagtgtta

SEQ ID NO: 8416012 - DNA, 22 bp, Homo sapiens
cagttaaacgggccatgtgagt

SEQ ID NO: 8416013 - DNA, 22 bp, Homo sapiens
cagttaaacgatgatggggtca

SEQ ID NO: 8416014 - DNA, 22 bp, Homo sapiens
cagttaaaatgtgctataagaa

SEQ ID NO: 8416015 - DNA, 22 bp, Homo sapiens
cagttaaaaggtatgctaccaa

SEQ ID NO: 8416016 - DNA, 22 bp, Homo sapiens
cagttaaaagaagtctatctta

SEQ ID NO: 8416017 - DNA, 22 bp, Homo sapiens
cagtgtttgcttaagttatatg

SEQ ID NO: 8416018 - DNA, 22 bp, Homo sapiens
cagtgtttgtatagaatatgca

SEQ ID NO: 8416019 - DNA, 22 bp, Homo sapiens
cagtgtttctgagttccagctc

SEQ ID NO: 8416020 - DNA, 22 bp, Homo sapiens
tcagacttgactttgtaagttt

SEQ ID NO: 8416021 - DNA, 22 bp, Homo sapiens
tcagagaaatgaagtagggatt

SEQ ID NO: 8416022 - DNA, 22 bp, Homo sapiens
cagttaaattctccagttacca

SEQ ID NO: 8416023 - DNA, 22 bp, Homo sapiens
cagttaaatttggctgttttct

SEQ ID NO: 8416024 - DNA, 22 bp, Homo sapiens
cagttaaatgatgtgccctaga

SEQ ID NO: 8416025 - DNA, 22 bp, Homo sapiens
cagttaaaggcccaatatctgg

SEQ ID NO: 8416026 - DNA, 22 bp, Homo sapiens
cagttaaagtgcttatcacaga

SEQ ID NO: 8416027 - DNA, 22 bp, Homo sapiens
cagttaaagctgcatgtgtcag

SEQ ID NO: 8416028 - DNA, 22 bp, Homo sapiens
cagtttaaagaaggatgggagt

SEQ ID NO: 8416029 - DNA, 22 bp, Homo sapiens
cagtttatagctctagcagctt

SEQ ID NO: 8416030 - DNA, 21 bp, Homo sapiens
cagtttaataacaaagaagga

SEQ ID NO: 8416031 - DNA, 18 bp, Homo sapiens
tcagcttttgaaaaccaa

SEQ ID NO: 8416032 - DNA, 22 bp, Homo sapiens
tcagcttttaaaaacaagaagt

SEQ ID NO: 8416033 - DNA, 22 bp, Homo sapiens
tcagctttggtcacattgagtt

SEQ ID NO: 8416034 - DNA, 22 bp, Homo sapiens
tcagctttgccaccagctgtaa

SEQ ID NO: 8416035 - DNA, 22 bp, Homo sapiens
tcagctttgggggtctcaggag

SEQ ID NO: 8416036 - DNA, 22 bp, Homo sapiens
tcagctttgcaagttagaaaat

SEQ ID NO: 8416037 - DNA, 21 bp, Homo sapiens
tcagctttgcaactgcacatc

SEQ ID NO: 8416038 - DNA, 22 bp, Homo sapiens
tcagctttctcttctatcgata

SEQ ID NO: 8416039 - DNA, 22 bp, Homo sapiens
tcagctttgatctcaggcaatc

SEQ ID NO: 8416040 - DNA, 22 bp, Homo sapiens
tcagctttttggattgcccaag

SEQ ID NO: 8416041 - DNA, 22 bp, Homo sapiens
tcagctttttacatgtgaaata

SEQ ID NO: 8416042 - DNA, 22 bp, Homo sapiens
tcagcttttgtcagaaattgta

SEQ ID NO: 8416043 - DNA, 22 bp, Homo sapiens
tagctcaaaggttaagtgtgga

SEQ ID NO: 8416044 - DNA, 22 bp, Homo sapiens
tagctttaataagctgctgaat

SEQ ID NO: 8416045 - DNA, 22 bp, Homo sapiens
tagctttaagatgagatgtgga

SEQ ID NO: 8416046 - DNA, 22 bp, Homo sapiens
cagggcaggaatttgacattgc

SEQ ID NO: 8416047 - DNA, 22 bp, Homo sapiens
taggaaattctcttgctaagtt

SEQ ID NO: 8416048 - DNA, 22 bp, Homo sapiens
taggaaattgccaatatatgac

SEQ ID NO: 8416049 - DNA, 22 bp, Homo sapiens
taggaaattgccaatatatgac

SEQ ID NO: 8416050 - DNA, 22 bp, Homo sapiens
taggaaatttgaaatatgtggg

SEQ ID NO: 8416051 - DNA, 22 bp, Homo sapiens
taggaacaactgcaggtacaag

SEQ ID NO: 8416052 - DNA, 22 bp, Homo sapiens
cagggctagtgacaccccagtc

SEQ ID NO: 8416053 - DNA, 22 bp, Homo sapiens
cagggctcactcggctggcgtc

SEQ ID NO: 8416054 - DNA, 22 bp, Homo sapiens
cagggctcaccactgggatcct

SEQ ID NO: 8416055 - DNA, 22 bp, Homo sapiens
cagggctcagaagacagacctc

SEQ ID NO: 8416056 - DNA, 22 bp, Homo sapiens
cagggctcaggaaatcagacgt

SEQ ID NO: 8416057 - DNA, 22 bp, Homo sapiens
cagggctcaggctctgggattc

SEQ ID NO: 8416058 - DNA, 22 bp, Homo sapiens
cagggctcagggactgcagaaa

SEQ ID NO: 8416059 - DNA, 18 bp, Homo sapiens
taggaggatactgagatg

SEQ ID NO: 8416060 - DNA, 22 bp, Homo sapiens
tagtgaatagtccaatcccgca

SEQ ID NO: 8416061 - DNA, 22 bp, Homo sapiens
tagtgaattcctaataggaaga

SEQ ID NO: 8416062 - DNA, 22 bp, Homo sapiens
caggggagtgagtccctctctg

SEQ ID NO: 8416063 - DNA, 22 bp, Homo sapiens
caggggagttttatgcaacaga

SEQ ID NO: 8416064 - DNA, 22 bp, Homo sapiens
tagggctccactcccagagatt

SEQ ID NO: 8416065 - DNA, 20 bp, Homo sapiens
tagggctcattatgatctcc

SEQ ID NO: 8416066 - DNA, 22 bp, Homo sapiens
tagggctcagagtccagtttct

SEQ ID NO: 8416067 - DNA, 22 bp, Homo sapiens
tagggctcagctctagctcctg

SEQ ID NO: 8416068 - DNA, 22 bp, Homo sapiens
tagggctcgggcacaggacagg

SEQ ID NO: 8416069 - DNA, 22 bp, Homo sapiens
tagggctcactgagatgaatat

SEQ ID NO: 8416070 - DNA, 22 bp, Homo sapiens
tagggctcagagaagtggggcc

SEQ ID NO: 8416071 - DNA, 22 bp, Homo sapiens
tagggacaaagagctgaggcct

SEQ ID NO: 8416072 - DNA, 22 bp, Homo sapiens
cagggctcatctgtgtgaccag

SEQ ID NO: 8416073 - DNA, 22 bp, Homo sapiens
cagggcacggagaagtcacccc

SEQ ID NO: 8416074 - DNA, 22 bp, Homo sapiens
tagataaattagaaagtttact

SEQ ID NO: 8416075 - DNA, 22 bp, Homo sapiens
tagcaatagaaacatataaagt

SEQ ID NO: 8416076 - DNA, 22 bp, Homo sapiens
tagcaagtagatactcatttag

SEQ ID NO: 8416077 - DNA, 22 bp, Homo sapiens
tagaatatgattaattttctta

SEQ ID NO: 8416078 - DNA, 22 bp, Homo sapiens
tagagctgggcagtgctctgag

SEQ ID NO: 8416079 - DNA, 22 bp, Homo sapiens
tactgtctggagttgccaaagg

SEQ ID NO: 8416080 - DNA, 22 bp, Homo sapiens
tactgtctgcttcttatagctt

SEQ ID NO: 8416081 - DNA, 22 bp, Homo sapiens
tactgtctatacacttgattac

SEQ ID NO: 8416082 - DNA, 22 bp, Homo sapiens
tactgtctctgccctggccagg

SEQ ID NO: 8416083 - DNA, 22 bp, Homo sapiens
tactgtctaataagattgatgg

SEQ ID NO: 8416084 - DNA, 23 bp, Homo sapiens
tactgtcttctattaagtaagga

SEQ ID NO: 8416085 - DNA, 22 bp, Homo sapiens
tactgtctttaggggtagaaat

SEQ ID NO: 8416086 - DNA, 22 bp, Homo sapiens
tactgtctggcaattaagaatc

SEQ ID NO: 8416087 - DNA, 22 bp, Homo sapiens
tactgtctgggttcccaagcaa

SEQ ID NO: 8416088 - DNA, 22 bp, Homo sapiens
tactgtcttttcctaaatgggt

SEQ ID NO: 8416089 - DNA, 22 bp, Homo sapiens
tactgtctttccatccttgcct

SEQ ID NO: 8416090 - DNA, 22 bp, Homo sapiens
cctgcttaacattgccatgaca

SEQ ID NO: 8416091 - DNA, 22 bp, Homo sapiens
tgtacatagatcttgaaaatta

SEQ ID NO: 8416092 - DNA, 22 bp, Homo sapiens
tgtacatacatagatatacaca

SEQ ID NO: 8416093 - DNA, 22 bp, Homo sapiens
cctggaggggaccaggaccagg

SEQ ID NO: 8416094 - DNA, 18 bp, Homo sapiens
cctggaggtcttcggggt

SEQ ID NO: 8416095 - DNA, 16 bp, Homo sapiens
cctggaggtcacttca

SEQ ID NO: 8416096 - DNA, 19 bp, Homo sapiens
cctggaggtgaaggttctc

SEQ ID NO: 8416097 - DNA, 22 bp, Homo sapiens
tgtcaacacacctatctcaatt

SEQ ID NO: 8416098 - DNA, 22 bp, Homo sapiens
cctggaggagcgctgaccagct

SEQ ID NO: 8416099 - DNA, 22 bp, Homo sapiens
cctggaggctctgggagggcag

SEQ ID NO: 8416100 - DNA, 22 bp, Homo sapiens
cctggaggcagaaataggactt

SEQ ID NO: 8416101 - DNA, 22 bp, Homo sapiens
cctggaggcggaggttgcagtg

SEQ ID NO: 8416102 - DNA, 22 bp, Homo sapiens
cctggagggcagcccattctgg

SEQ ID NO: 8416103 - DNA, 22 bp, Homo sapiens
cctggagggcgccgcacagtcc

SEQ ID NO: 8416104 - DNA, 22 bp, Homo sapiens
cctggagggaccctggccctgt

SEQ ID NO: 8416105 - DNA, 22 bp, Homo sapiens
cctgctgtccctctgggctcca

SEQ ID NO: 8416106 - DNA, 22 bp, Homo sapiens
cctgaggtcagccattcttgcc

SEQ ID NO: 8416107 - DNA, 22 bp, Homo sapiens
tggggtccagtgccaccccaag

SEQ ID NO: 8416108 - DNA, 22 bp, Homo sapiens
tggggtccagtgcctggcaagg

SEQ ID NO: 8416109 - DNA, 22 bp, Homo sapiens
tggggtcccaactctgattgat

SEQ ID NO: 8416110 - DNA, 22 bp, Homo sapiens
tggggtcccactcagctcccct

SEQ ID NO: 8416111 - DNA, 22 bp, Homo sapiens
cctgcagaaagggtccccagga

SEQ ID NO: 8416112 - DNA, 20 bp, Homo sapiens
tggggtcctggaggggatcc

SEQ ID NO: 8416113 - DNA, 22 bp, Homo sapiens
tggggtcctctcacttggaggg

SEQ ID NO: 8416114 - DNA, 17 bp, Homo sapiens
tggggtccccgatggtg

SEQ ID NO: 8416115 - DNA, 22 bp, Homo sapiens
cctgcaagagcggagaagccag

SEQ ID NO: 8416116 - DNA, 22 bp, Homo sapiens
cctgacaggagaagcgcagcat

SEQ ID NO: 8416117 - DNA, 22 bp, Homo sapiens
cctgaaaatcaaggtagtttgg

SEQ ID NO: 8416118 - DNA, 22 bp, Homo sapiens
cctgaaaatatcctctcctttg

SEQ ID NO: 8416119 - DNA, 22 bp, Homo sapiens
ccggctactcgggaggctgacg

SEQ ID NO: 8416120 - DNA, 22 bp, Homo sapiens
ccgtggcttcccaggcggatgt

SEQ ID NO: 8416121 - DNA, 22 bp, Homo sapiens
ccctggttcaggtttctctgaa

SEQ ID NO: 8416122 - DNA, 21 bp, Homo sapiens
tggcctcccacacttccatgg

SEQ ID NO: 8416123 - DNA, 23 bp, Homo sapiens
tggcctctccccacctggcagaa

SEQ ID NO: 8416124 - DNA, 22 bp, Homo sapiens
tggctaacaaggtgaaaccccg

SEQ ID NO: 8416125 - DNA, 22 bp, Homo sapiens
tggctaacaaggtgaaaccccg

SEQ ID NO: 8416126 - DNA, 22 bp, Homo sapiens
tggctaggaatccatgactctc

SEQ ID NO: 8416127 - DNA, 22 bp, Homo sapiens
tggctaagctggggaggcctgg

SEQ ID NO: 8416128 - DNA, 19 bp, Homo sapiens
tggctaattttatagaggc

SEQ ID NO: 8416129 - DNA, 22 bp, Homo sapiens
tggctaatggcatttcctgggt

SEQ ID NO: 8416130 - DNA, 22 bp, Homo sapiens
cctccccatgacccggtgctgg

SEQ ID NO: 8416131 - DNA, 22 bp, Homo sapiens
tgctttattggaacctcatcct

SEQ ID NO: 8416132 - DNA, 22 bp, Homo sapiens
tgctttattgcatcagtgtggg

SEQ ID NO: 8416133 - DNA, 22 bp, Homo sapiens
tgctttattttaaatatgccat

SEQ ID NO: 8416134 - DNA, 22 bp, Homo sapiens
tgctttatttataaaatagcaa

SEQ ID NO: 8416135 - DNA, 22 bp, Homo sapiens
tgctttcaatgaattgtatact

SEQ ID NO: 8416136 - DNA, 22 bp, Homo sapiens
tgctttcaaaggctttctagat

SEQ ID NO: 8416137 - DNA, 22 bp, Homo sapiens
tgctttcatgaagtctatagag

SEQ ID NO: 8416138 - DNA, 22 bp, Homo sapiens
tgctttcagatatctgtttcaa

SEQ ID NO: 8416139 - DNA, 22 bp, Homo sapiens
tgcctcagtttcatctgcagaa

SEQ ID NO: 8416140 - DNA, 22 bp, Homo sapiens
tgcctccaccattgctcacttt

SEQ ID NO: 8416141 - DNA, 22 bp, Homo sapiens
cccgggaggaggaagttgcagt

SEQ ID NO: 8416142 - DNA, 22 bp, Homo sapiens
tggaagggaaagtttggggtcc

SEQ ID NO: 8416143 - DNA, 22 bp, Homo sapiens
ccctgcagccggccagctcatt

SEQ ID NO: 8416144 - DNA, 20 bp, Homo sapiens
ccctgcagccatgggagtgg

SEQ ID NO: 8416145 - DNA, 22 bp, Homo sapiens
ccctgcagcattctctaactgg

SEQ ID NO: 8416146 - DNA, 22 bp, Homo sapiens
ccctgcagcattctctaactgg

SEQ ID NO: 8416147 - DNA, 22 bp, Homo sapiens
ccctgcagatctagggtccttc

SEQ ID NO: 8416148 - DNA, 22 bp, Homo sapiens
ccctgcagatctagggtccttc

SEQ ID NO: 8416149 - DNA, 22 bp, Homo sapiens
ccctgcagatcagtgagaactt

SEQ ID NO: 8416150 - DNA, 22 bp, Homo sapiens
ccctgcagatcagtgagaactt

SEQ ID NO: 8416151 - DNA, 22 bp, Homo sapiens
ccctgcagagggatgggggcag

SEQ ID NO: 8416152 - DNA, 22 bp, Homo sapiens
ccctgcagagccagccctgacc

SEQ ID NO: 8416153 - DNA, 22 bp, Homo sapiens
ccctgcagaaccacagacaaac

SEQ ID NO: 8416154 - DNA, 22 bp, Homo sapiens
ccctgcagaccaatgccataga

SEQ ID NO: 8416155 - DNA, 22 bp, Homo sapiens
ccctgcagagagtgcttttgtg

SEQ ID NO: 8416156 - DNA, 22 bp, Homo sapiens
ccctgcagagccagccctgacc

SEQ ID NO: 8416157 - DNA, 22 bp, Homo sapiens
ccctgcagagagtgcttttgtg

SEQ ID NO: 8416158 - DNA, 22 bp, Homo sapiens
ccctgcagacgtcttgatgcct

SEQ ID NO: 8416159 - DNA, 22 bp, Homo sapiens
ccctgcagagaccactgacctt

SEQ ID NO: 8416160 - DNA, 22 bp, Homo sapiens
ccctgcagagaccactgacctt

SEQ ID NO: 8416161 - DNA, 22 bp, Homo sapiens
ccctgcagtcctttcttggctc

SEQ ID NO: 8416162 - DNA, 22 bp, Homo sapiens
ccctgcagtgtgacctcaccta

SEQ ID NO: 8416163 - DNA, 22 bp, Homo sapiens
cccagccagcctcttcccatat

SEQ ID NO: 8416164 - DNA, 22 bp, Homo sapiens
tgcagtggaaagactcagactt

SEQ ID NO: 8416165 - DNA, 22 bp, Homo sapiens
cccagctccagagccagaaaca

SEQ ID NO: 8416166 - DNA, 18 bp, Homo sapiens
cccagctccacttccctc

SEQ ID NO: 8416167 - DNA, 22 bp, Homo sapiens
cccaggactcttcactgcagcc

SEQ ID NO: 8416168 - DNA, 21 bp, Homo sapiens
cccaggagaagaaaagatgca

SEQ ID NO: 8416169 - DNA, 22 bp, Homo sapiens
cccaggagtaagtgacattgtt

SEQ ID NO: 8416170 - DNA, 21 bp, Homo sapiens
cccaggaggctgagaagagca

SEQ ID NO: 8416171 - DNA, 22 bp, Homo sapiens
tgcatatatcttatttttctgt

SEQ ID NO: 8416172 - DNA, 22 bp, Homo sapiens
tgcatatccacaccttatctct

SEQ ID NO: 8416173 - DNA, 22 bp, Homo sapiens
tgattcaactttcataacaaaa

SEQ ID NO: 8416174 - DNA, 19 bp, Homo sapiens
cccagagagatctcttgcc

SEQ ID NO: 8416175 - DNA, 22 bp, Homo sapiens
tgaggcagtgctgggaagcctg

SEQ ID NO: 8416176 - DNA, 22 bp, Homo sapiens
tgatgacagcaaaaaatgctag

SEQ ID NO: 8416177 - DNA, 22 bp, Homo sapiens
tgaggcagtattttagtgactt

SEQ ID NO: 8416178 - DNA, 18 bp, Homo sapiens
tgaggcagtcagtgatgg

SEQ ID NO: 8416179 - DNA, 18 bp, Homo sapiens
tgaggcagtcagtgatgg

SEQ ID NO: 8416180 - DNA, 22 bp, Homo sapiens
ccagtgttcataattttacact

SEQ ID NO: 8416181 - DNA, 22 bp, Homo sapiens
ccatggagcgggtgagtgagtg

SEQ ID NO: 8416182 - DNA, 22 bp, Homo sapiens
tgattatattaactatgttcct

SEQ ID NO: 8416183 - DNA, 17 bp, Homo sapiens
tgattcaactagaaact

SEQ ID NO: 8416184 - DNA, 22 bp, Homo sapiens
tgattatattctaacttcataa

SEQ ID NO: 8416185 - DNA, 21 bp, Homo sapiens
tgactttatttgacagcccag

SEQ ID NO: 8416186 - DNA, 22 bp, Homo sapiens
tgacccatttgcttttcctgta

SEQ ID NO: 8416187 - DNA, 22 bp, Homo sapiens
tgacccatggtctgatcatagg

SEQ ID NO: 8416188 - DNA, 22 bp, Homo sapiens
tgacccattggtccctagatcc

SEQ ID NO: 8416189 - DNA, 22 bp, Homo sapiens
tgacccattaaccactttccct

SEQ ID NO: 8416190 - DNA, 22 bp, Homo sapiens
tgacccatcaggccacatgagg

SEQ ID NO: 8416191 - DNA, 22 bp, Homo sapiens
tgacagagcatgtagtgacagc

SEQ ID NO: 8416192 - DNA, 22 bp, Homo sapiens
ccaggcttggtgtgtggtcagg

SEQ ID NO: 8416193 - DNA, 22 bp, Homo sapiens
tgaggacattaggaagtgaagg

SEQ ID NO: 8416194 - DNA, 22 bp, Homo sapiens
tgaggaatggcttaatgtggga

SEQ ID NO: 8416195 - DNA, 22 bp, Homo sapiens
tgaggaatgttttgagtgccga

SEQ ID NO: 8416196 - DNA, 22 bp, Homo sapiens
tgagcagaacacgggatccatg

SEQ ID NO: 8416197 - DNA, 22 bp, Homo sapiens
tgagcactttaaaatattccca

SEQ ID NO: 8416198 - DNA, 19 bp, Homo sapiens
ccaggcctggcgtctccgc

SEQ ID NO: 8416199 - DNA, 22 bp, Homo sapiens
tctttattttatgcttgtgcaa

SEQ ID NO: 8416200 - DNA, 22 bp, Homo sapiens
tctttattttatgcttgtgcaa

SEQ ID NO: 8416201 - DNA, 22 bp, Homo sapiens
tctttatttctgaatcccccat

SEQ ID NO: 8416202 - DNA, 22 bp, Homo sapiens
tctttatttaagtctgttgtaa

SEQ ID NO: 8416203 - DNA, 22 bp, Homo sapiens
tctttatttctgaatcccccat

SEQ ID NO: 8416204 - DNA, 22 bp, Homo sapiens
tctttatttaagtctgttgtaa

SEQ ID NO: 8416205 - DNA, 22 bp, Homo sapiens
tctttatttaagtctgttgtaa

SEQ ID NO: 8416206 - DNA, 22 bp, Homo sapiens
tctttaagccaagatatattta

SEQ ID NO: 8416207 - DNA, 22 bp, Homo sapiens
tgaaatgattatatggtgtttg

SEQ ID NO: 8416208 - DNA, 22 bp, Homo sapiens
tgaagctttaggatgggttcat

SEQ ID NO: 8416209 - DNA, 18 bp, Homo sapiens
tgaacagatgagttgaag

SEQ ID NO: 8416210 - DNA, 22 bp, Homo sapiens
ctgctgagaaaagactgaggga

SEQ ID NO: 8416211 - DNA, 22 bp, Homo sapiens
ctgctgtcatagccatccctcc

SEQ ID NO: 8416212 - DNA, 22 bp, Homo sapiens
ctgcaggagtgaaagcaggcct

SEQ ID NO: 8416213 - DNA, 21 bp, Homo sapiens
ctgcaggatgctgaagccagg

SEQ ID NO: 8416214 - DNA, 22 bp, Homo sapiens
ctgcccaggctgaaggaacatc

SEQ ID NO: 8416215 - DNA, 22 bp, Homo sapiens
ctgccccagtgccaggcaggtg

SEQ ID NO: 8416216 - DNA, 22 bp, Homo sapiens
ctgaggtgtggtctgggagtat

SEQ ID NO: 8416217 - DNA, 22 bp, Homo sapiens
ctgaggtgttgatgacctatgc

SEQ ID NO: 8416218 - DNA, 19 bp, Homo sapiens
ctgaggtgcagtaagaggc

SEQ ID NO: 8416219 - DNA, 22 bp, Homo sapiens
ctgaggtgagaggaggccatgt

SEQ ID NO: 8416220 - DNA, 22 bp, Homo sapiens
ttttgcttttgtaacacagtgt

SEQ ID NO: 8416221 - DNA, 23 bp, Homo sapiens
tttcagaagtggtcctaggaagc

SEQ ID NO: 8416222 - DNA, 22 bp, Homo sapiens
tttcagaaggggagaaaggtca

SEQ ID NO: 8416223 - DNA, 22 bp, Homo sapiens
tttcagaaccgctaaaataaat

SEQ ID NO: 8416224 - DNA, 22 bp, Homo sapiens
tttcacatataggggaagctac

SEQ ID NO: 8416225 - DNA, 22 bp, Homo sapiens
ctctgaaaatgtggtggggaaa

SEQ ID NO: 8416226 - DNA, 22 bp, Homo sapiens
tttctcaagttcagatatttga

SEQ ID NO: 8416227 - DNA, 22 bp, Homo sapiens
tttctcaaaagacagaagtgaa

SEQ ID NO: 8416228 - DNA, 22 bp, Homo sapiens
tttctacatgtcagtaactgat

SEQ ID NO: 8416229 - DNA, 22 bp, Homo sapiens
tttctacagtactgatttcata

SEQ ID NO: 8416230 - DNA, 22 bp, Homo sapiens
tttctacagctggtgcaacttt

SEQ ID NO: 8416231 - DNA, 22 bp, Homo sapiens
tttctacagctggtgcaacttt

SEQ ID NO: 8416232 - DNA, 22 bp, Homo sapiens
tttctacaatttttggcatgag

SEQ ID NO: 8416233 - DNA, 22 bp, Homo sapiens
ctctgtgccctactgctcagct

SEQ ID NO: 8416234 - DNA, 22 bp, Homo sapiens
tttgttcattttgagctcatca

SEQ ID NO: 8416235 - DNA, 19 bp, Homo sapiens
ctctgggctgcatcttggt

SEQ ID NO: 8416236 - DNA, 22 bp, Homo sapiens
tttgttcatgcctatattctca

SEQ ID NO: 8416237 - DNA, 22 bp, Homo sapiens
tttgttcatgcctatattctca

SEQ ID NO: 8416238 - DNA, 21 bp, Homo sapiens
tttgttcaggggcaaagttaa

SEQ ID NO: 8416239 - DNA, 22 bp, Homo sapiens
ctctgcaacttctagcagtgtc

SEQ ID NO: 8416240 - DNA, 22 bp, Homo sapiens
tttgaaaattagacacaggcta

SEQ ID NO: 8416241 - DNA, 22 bp, Homo sapiens
ctctgaagccccaaatagtccg

SEQ ID NO: 8416242 - DNA, 22 bp, Homo sapiens
ctctgaatggacactccagtgt

SEQ ID NO: 8416243 - DNA, 22 bp, Homo sapiens
ttctggaagctgcaggtggccg

SEQ ID NO: 8416244 - DNA, 22 bp, Homo sapiens
ttctgcatctgaatttaagtac

SEQ ID NO: 8416245 - DNA, 22 bp, Homo sapiens
cgttgtgagcttggtagacact

SEQ ID NO: 8416246 - DNA, 22 bp, Homo sapiens
ctagagaaaatgttaatacagt

SEQ ID NO: 8416247 - DNA, 22 bp, Homo sapiens
ctagagaaaatgatagcaggaa

SEQ ID NO: 8416248 - DNA, 22 bp, Homo sapiens
ctagagaatggcaaagattaga

SEQ ID NO: 8416249 - DNA, 22 bp, Homo sapiens
ctagagaattgtcttgagagtt

SEQ ID NO: 8416250 - DNA, 22 bp, Homo sapiens
ctagagaatcttttaagaagtg

SEQ ID NO: 8416251 - DNA, 18 bp, Homo sapiens
ctagagaaggttactatg

SEQ ID NO: 8416252 - DNA, 22 bp, Homo sapiens
ctagagaagaggttaagcatga

SEQ ID NO: 8416253 - DNA, 22 bp, Homo sapiens
ctcacccatatctccatgactc

SEQ ID NO: 8416254 - DNA, 22 bp, Homo sapiens
ctatacagtaaccacagtgatt

SEQ ID NO: 8416255 - DNA, 22 bp, Homo sapiens
ttctggcttagttgttgtatat

SEQ ID NO: 8416256 - DNA, 22 bp, Homo sapiens
ctcagagatatagtccctgctt

SEQ ID NO: 8416257 - DNA, 18 bp, Homo sapiens
ctcagagatgcccttatt

SEQ ID NO: 8416258 - DNA, 19 bp, Homo sapiens
ctcagagaggggcagtgcc

SEQ ID NO: 8416259 - DNA, 22 bp, Homo sapiens
ctcagagagggcaccagggcca

SEQ ID NO: 8416260 - DNA, 22 bp, Homo sapiens
ttctttctgaatacagttgagt

SEQ ID NO: 8416261 - DNA, 22 bp, Homo sapiens
ttctttctctccacaaggcttg

SEQ ID NO: 8416262 - DNA, 21 bp, Homo sapiens
ttctttctgaatctgaagtat

SEQ ID NO: 8416263 - DNA, 22 bp, Homo sapiens
ttctttctgggaagagttcaga

SEQ ID NO: 8416264 - DNA, 22 bp, Homo sapiens
ctcagagaaaaggagcaagggt

SEQ ID NO: 8416265 - DNA, 22 bp, Homo sapiens
ctcagagaaatgtcacaacaat

SEQ ID NO: 8416266 - DNA, 22 bp, Homo sapiens
ctcagagaacctaagcggagga

SEQ ID NO: 8416267 - DNA, 22 bp, Homo sapiens
ttctttctgtccataatgagac

SEQ ID NO: 8416268 - DNA, 22 bp, Homo sapiens
ttctttctggggtccttcggct

SEQ ID NO: 8416269 - DNA, 22 bp, Homo sapiens
ttctttctgtcatggtgtactg

SEQ ID NO: 8416270 - DNA, 22 bp, Homo sapiens
ctcaggagacagtgtccacatg

SEQ ID NO: 8416271 - DNA, 22 bp, Homo sapiens
ctcaggagatgacagaaggtat

SEQ ID NO: 8416272 - DNA, 22 bp, Homo sapiens
ctcaggagtagttcagcagctg

SEQ ID NO: 8416273 - DNA, 22 bp, Homo sapiens
ctcaggaggaggaagttcattg

SEQ ID NO: 8416274 - DNA, 22 bp, Homo sapiens
ctcaggagcttcctcagcccat

SEQ ID NO: 8416275 - DNA, 22 bp, Homo sapiens
ctcaggaggccattctcaaggt

SEQ ID NO: 8416276 - DNA, 22 bp, Homo sapiens
ctcaggaggtttcctgtctagg

SEQ ID NO: 8416277 - DNA, 22 bp, Homo sapiens
ctcaggaggtggtagaggccct

SEQ ID NO: 8416278 - DNA, 22 bp, Homo sapiens
ctcagggatggtgaagcaccca

SEQ ID NO: 8416279 - DNA, 22 bp, Homo sapiens
ttgcccaggctggagtgcagtg

SEQ ID NO: 8416280 - DNA, 22 bp, Homo sapiens
ttgcccagagtcacccagctca

SEQ ID NO: 8416281 - DNA, 22 bp, Homo sapiens
ttgcccagagtccacagcgtac

SEQ ID NO: 8416282 - DNA, 22 bp, Homo sapiens
ttgcccagagtccacagcgtac

SEQ ID NO: 8416283 - DNA, 22 bp, Homo sapiens
ttgcccaggctggagtgcagta

SEQ ID NO: 8416284 - DNA, 22 bp, Homo sapiens
ttgcccaggctggagtgcagtg

SEQ ID NO: 8416285 - DNA, 22 bp, Homo sapiens
ttgcccaggctggagtgcagta

SEQ ID NO: 8416286 - DNA, 22 bp, Homo sapiens
ttggctgatgcaagagcttcct

SEQ ID NO: 8416287 - DNA, 22 bp, Homo sapiens
ttggctgaatgaggtcaccttt

SEQ ID NO: 8416288 - DNA, 22 bp, Homo sapiens
ttggctgagagctgctctgcag

SEQ ID NO: 8416289 - DNA, 22 bp, Homo sapiens
ctccaggactgaggacagagct

SEQ ID NO: 8416290 - DNA, 22 bp, Homo sapiens
ttagcaatatgaatgcatttgc

SEQ ID NO: 8416291 - DNA, 22 bp, Homo sapiens
ttagcaattccaggtaagttat

SEQ ID NO: 8416292 - DNA, 22 bp, Homo sapiens
ttagcaaatatcttgaaacagg

SEQ ID NO: 8416293 - DNA, 22 bp, Homo sapiens
ttagcactggattaatcaaagt

SEQ ID NO: 8416294 - DNA, 22 bp, Homo sapiens
ttagttttcccatctttatggt

SEQ ID NO: 8416295 - DNA, 22 bp, Homo sapiens
ttataacaacagtttactttaa

SEQ ID NO: 8416296 - DNA, 22 bp, Homo sapiens
ttatattagttagacttgctgt

SEQ ID NO: 8416297 - DNA, 22 bp, Homo sapiens
ttataacatcaatcagagttaa

SEQ ID NO: 8416298 - DNA, 22 bp, Homo sapiens
ttatcacttatgagctttttgc

SEQ ID NO: 8416299 - DNA, 22 bp, Homo sapiens
ttacagtttatccaggaagagc

SEQ ID NO: 8416300 - DNA, 22 bp, Homo sapiens
ttacagtttagtccaagccaga

SEQ ID NO: 8416301 - DNA, 22 bp, Homo sapiens
ttacagtggtcatttgggaaaa

SEQ ID NO: 8416302 - DNA, 22 bp, Homo sapiens
ttacagtgtgcaatcccagaat

SEQ ID NO: 8416303 - DNA, 22 bp, Homo sapiens
ttacagtgttacttgatgtcca

SEQ ID NO: 8416304 - DNA, 21 bp, Homo sapiens
ttacaaagcaagtgctgtgtc

SEQ ID NO: 8416305 - DNA, 22 bp, Homo sapiens
cctgtgtgtctgtcactgcaca

SEQ ID NO: 8416306 - DNA, 22 bp, Homo sapiens
ccttagcattagaagctgtggg

SEQ ID NO: 8416307 - DNA, 22 bp, Homo sapiens
ccttaggggtgacagaaatacc

SEQ ID NO: 8416308 - DNA, 22 bp, Homo sapiens
ccttacactgcctggggccacg

SEQ ID NO: 8416309 - DNA, 22 bp, Homo sapiens
ccttagcaaattggcatcttct

SEQ ID NO: 8416310 - DNA, 22 bp, Homo sapiens
ccttagcatggctgtgctgtgt

SEQ ID NO: 8416311 - DNA, 22 bp, Homo sapiens
ccttagcagggagtctgtccag

SEQ ID NO: 8416312 - DNA, 22 bp, Homo sapiens
ccttagcaacacttagcaactg

SEQ ID NO: 8416313 - DNA, 22 bp, Homo sapiens
ccttagcaactgtcatagagca

SEQ ID NO: 8416314 - DNA, 22 bp, Homo sapiens
ttaaattccagcctcataatag

SEQ ID NO: 8416315 - DNA, 22 bp, Homo sapiens
ttaaattttagaaacagactct

SEQ ID NO: 8416316 - DNA, 22 bp, Homo sapiens
ttaaattccagcctcataatag

SEQ ID NO: 8416317 - DNA, 22 bp, Homo sapiens
ttaagagcaacatatggtgaca

SEQ ID NO: 8416318 - DNA, 22 bp, Homo sapiens
tgtcagaggctcagggtctcag

SEQ ID NO: 8416319 - DNA, 22 bp, Homo sapiens
tgtcagagcaaggccaggccag

SEQ ID NO: 8416320 - DNA, 22 bp, Homo sapiens
tgtcagagagcaggcagtagaa

SEQ ID NO: 8416321 - DNA, 21 bp, Homo sapiens
tgtcagagcttgtaggacatt

SEQ ID NO: 8416322 - DNA, 22 bp, Homo sapiens
tgtcagagcaatgaggttcagc

SEQ ID NO: 8416323 - DNA, 22 bp, Homo sapiens
ttaaatagtaggtctattttgg

SEQ ID NO: 8416324 - DNA, 22 bp, Homo sapiens
ttatttcatgtaaaatttatgt

SEQ ID NO: 8416325 - DNA, 22 bp, Homo sapiens
ttatttattgtgtacctactgt

SEQ ID NO: 8416326 - DNA, 22 bp, Homo sapiens
ttattcagattggctacaggat

SEQ ID NO: 8416327 - DNA, 22 bp, Homo sapiens
ttattcagcagggacttccttt

SEQ ID NO: 8416328 - DNA, 22 bp, Homo sapiens
cgactgtcatacacaagacatg

SEQ ID NO: 8416329 - DNA, 22 bp, Homo sapiens
cgaccctacagacagtgctgag

SEQ ID NO: 8416330 - DNA, 22 bp, Homo sapiens
ccttttctatccttctaggttc

SEQ ID NO: 8416331 - DNA, 22 bp, Homo sapiens
cgtgagcaaaatggacactccc

SEQ ID NO: 8416332 - DNA, 22 bp, Homo sapiens
cggggccctggggctgaaggtc

SEQ ID NO: 8416333 - DNA, 21 bp, Homo sapiens
ttcaaagtttgcctaaagatt

SEQ ID NO: 8416334 - DNA, 21 bp, Homo sapiens
ttcaaagtttgcctaaagatt

SEQ ID NO: 8416335 - DNA, 22 bp, Homo sapiens
ttcaaatcagaccgaaggcaac

SEQ ID NO: 8416336 - DNA, 22 bp, Homo sapiens
ttcaaatccctgctccactatt

SEQ ID NO: 8416337 - DNA, 22 bp, Homo sapiens
ttcaaagtgcatgttcctcaga

SEQ ID NO: 8416338 - DNA, 22 bp, Homo sapiens
cggaggttgaggctgcagtgag

SEQ ID NO: 8416339 - DNA, 22 bp, Homo sapiens
cggaggttgaggctgcagtgag

SEQ ID NO: 8416340 - DNA, 22 bp, Homo sapiens
ttcaaattaccacatttgctta

SEQ ID NO: 8416341 - DNA, 22 bp, Homo sapiens
cttcacatgttggagtcctttg

SEQ ID NO: 8416342 - DNA, 22 bp, Homo sapiens
cttcagaaccagccagaagagg

SEQ ID NO: 8416343 - DNA, 22 bp, Homo sapiens
cttcaaatccccctgagtttga

SEQ ID NO: 8416344 - DNA, 22 bp, Homo sapiens
cttcaaatacaagtagattatg

SEQ ID NO: 8416345 - DNA, 20 bp, Homo sapiens
ctgttaaaaggtatgaattc

SEQ ID NO: 8416346 - DNA, 22 bp, Homo sapiens
cttcaaatcctgtgtagggcta

SEQ ID NO: 8416347 - DNA, 22 bp, Homo sapiens
cttcccagcacctcagtctggc

SEQ ID NO: 8416348 - DNA, 22 bp, Homo sapiens
cttccccaggacctctgctaaa

SEQ ID NO: 8416349 - DNA, 22 bp, Homo sapiens
ctttctcttacccaaggatctg

SEQ ID NO: 8416350 - DNA, 22 bp, Homo sapiens
ctttctctgtgtttcacatgct

SEQ ID NO: 8416351 - DNA, 22 bp, Homo sapiens
ctttctagactgtccagatgat

SEQ ID NO: 8416352 - DNA, 22 bp, Homo sapiens
ctttctcaatgccggaaggcac

SEQ ID NO: 8416353 - DNA, 22 bp, Homo sapiens
gaagaagggagtgacaaatgca

SEQ ID NO: 8416354 - DNA, 22 bp, Homo sapiens
gaagaaggaagatcatgcttga

SEQ ID NO: 8416355 - DNA, 22 bp, Homo sapiens
gaagaacacttcatgattcatt

SEQ ID NO: 8416356 - DNA, 20 bp, Homo sapiens
gaaattctcgtattagttta

SEQ ID NO: 8416357 - DNA, 22 bp, Homo sapiens
gaaatgtttgggaggagtcaac

SEQ ID NO: 8416358 - DNA, 22 bp, Homo sapiens
gaaatgttttacaaggcatact

SEQ ID NO: 8416359 - DNA, 22 bp, Homo sapiens
gaaaaatgctccaaatctgtgg

SEQ ID NO: 8416360 - DNA, 22 bp, Homo sapiens
gaaaaatgagctgatgtcaggg

SEQ ID NO: 8416361 - DNA, 22 bp, Homo sapiens
gaaactgtttctggctttggtg

SEQ ID NO: 8416362 - DNA, 22 bp, Homo sapiens
gaaagaatgctatagtgacttc

SEQ ID NO: 8416363 - DNA, 22 bp, Homo sapiens
gaaactgaatataagaaaggta

SEQ ID NO: 8416364 - DNA, 22 bp, Homo sapiens
gaaactgagtaggctagagcac

SEQ ID NO: 8416365 - DNA, 22 bp, Homo sapiens
ctggtaaagaagacaaacaggg

SEQ ID NO: 8416366 - DNA, 23 bp, Homo sapiens
ctggtaaatcactaaaattacaa

SEQ ID NO: 8416367 - DNA, 22 bp, Homo sapiens
ctggtaaatgatgagaagcacc

SEQ ID NO: 8416368 - DNA, 22 bp, Homo sapiens
ctgggtgttgggtactgaccgt

SEQ ID NO: 8416369 - DNA, 22 bp, Homo sapiens
ctgggtgtagcccagtatgagg

SEQ ID NO: 8416370 - DNA, 22 bp, Homo sapiens
ctgggtgtcaggagacatgatg

SEQ ID NO: 8416371 - DNA, 22 bp, Homo sapiens
ctgggtgtagatggaagtttgg

SEQ ID NO: 8416372 - DNA, 22 bp, Homo sapiens
ctgggctcagcccatgctgtcc

SEQ ID NO: 8416373 - DNA, 22 bp, Homo sapiens
ctgggcctcaccctagaccaat

SEQ ID NO: 8416374 - DNA, 21 bp, Homo sapiens
ctgtggacaggctggggcatg

SEQ ID NO: 8416375 - DNA, 22 bp, Homo sapiens
ctgtgaccttagcaagggaaat

SEQ ID NO: 8416376 - DNA, 22 bp, Homo sapiens
ctgtgacctccaggaaggggtg

SEQ ID NO: 8416377 - DNA, 21 bp, Homo sapiens
ctgtgacctttctttcctcct

SEQ ID NO: 8416378 - DNA, 22 bp, Homo sapiens
ctgtctgtgtggacacggctgc

SEQ ID NO: 8416379 - DNA, 22 bp, Homo sapiens
ctgtgacccagttcctggcacc

SEQ ID NO: 8416380 - DNA, 20 bp, Homo sapiens
ctgtgaccagagacccagga

SEQ ID NO: 8416381 - DNA, 22 bp, Homo sapiens
ctgtcccaggatcctgactcca

SEQ ID NO: 8416382 - DNA, 22 bp, Homo sapiens
ctggtttgtcttgggaggatgt

SEQ ID NO: 8416383 - DNA, 22 bp, Homo sapiens
ctgtggctttctctgcctcctt

SEQ ID NO: 8416384 - DNA, 21 bp, Homo sapiens
ctgtggtacagctgggacgga

SEQ ID NO: 8416385 - DNA, 18 bp, Homo sapiens
ctgtgggctggtgcatga

SEQ ID NO: 8416386 - DNA, 22 bp, Homo sapiens
ctgtggtcactgttggggaatg

SEQ ID NO: 8416387 - DNA, 22 bp, Homo sapiens
gagtaaaagttggattacaaag

SEQ ID NO: 8416388 - DNA, 22 bp, Homo sapiens
gagtaaaataggtgagaatcaa

SEQ ID NO: 8416389 - DNA, 22 bp, Homo sapiens
gagggagaaggactatcaggct

SEQ ID NO: 8416390 - DNA, 22 bp, Homo sapiens
gagggacctttacacagacatt

SEQ ID NO: 8416391 - DNA, 22 bp, Homo sapiens
gagggaccccaggctggccctt

SEQ ID NO: 8416392 - DNA, 22 bp, Homo sapiens
gaggcctgtcgctaggcctctg

SEQ ID NO: 8416393 - DNA, 22 bp, Homo sapiens
gaggctaaggtgccagacgaat

SEQ ID NO: 8416394 - DNA, 22 bp, Homo sapiens
gaggctaaggttctgccagaag

SEQ ID NO: 8416395 - DNA, 22 bp, Homo sapiens
gaggctaagcactggcatttct

SEQ ID NO: 8416396 - DNA, 22 bp, Homo sapiens
gagctgtgtatgcatcattctg

SEQ ID NO: 8416397 - DNA, 22 bp, Homo sapiens
gagctggttctgtccagggaat

SEQ ID NO: 8416398 - DNA, 22 bp, Homo sapiens
gagctgtgaaaagtgcctgggg

SEQ ID NO: 8416399 - DNA, 22 bp, Homo sapiens
gaggaggtggagtcatgcagag

SEQ ID NO: 8416400 - DNA, 22 bp, Homo sapiens
gaggaggtggagtcatgcagag

SEQ ID NO: 8416401 - DNA, 22 bp, Homo sapiens
gaggactaacttggcagacgca

SEQ ID NO: 8416402 - DNA, 22 bp, Homo sapiens
gaggcaacacatttggaaagca

SEQ ID NO: 8416403 - DNA, 22 bp, Homo sapiens
gaggccagaatgagctgaatgc

SEQ ID NO: 8416404 - DNA, 22 bp, Homo sapiens
gaagacaagctgagtgttgtcc

SEQ ID NO: 8416405 - DNA, 22 bp, Homo sapiens
gaattttattactagtcaactg

SEQ ID NO: 8416406 - DNA, 20 bp, Homo sapiens
gaattttatgaacactacca

SEQ ID NO: 8416407 - DNA, 22 bp, Homo sapiens
gaattttattactagtcaactg

SEQ ID NO: 8416408 - DNA, 22 bp, Homo sapiens
gactactcaaactttctctata

SEQ ID NO: 8416409 - DNA, 22 bp, Homo sapiens
gacctggtgctagctggtgtgt

SEQ ID NO: 8416410 - DNA, 22 bp, Homo sapiens
gacctggtgcaggtggacagag

SEQ ID NO: 8416411 - DNA, 22 bp, Homo sapiens
gacatgcatgaatgcaggtctc

SEQ ID NO: 8416412 - DNA, 22 bp, Homo sapiens
gacatgcagttctcaagggtag

SEQ ID NO: 8416413 - DNA, 22 bp, Homo sapiens
gacatgatggaaaaaaatgctc

SEQ ID NO: 8416414 - DNA, 22 bp, Homo sapiens
gagcaacaaattagggggattt

SEQ ID NO: 8416415 - DNA, 22 bp, Homo sapiens
gagcaaaataaattctgacaaa

SEQ ID NO: 8416416 - DNA, 22 bp, Homo sapiens
gagcaacacgcagtagtatacg

SEQ ID NO: 8416417 - DNA, 22 bp, Homo sapiens
gagcaacacattgaatgaggat

SEQ ID NO: 8416418 - DNA, 22 bp, Homo sapiens
gagcaacagggcgaggagaact

SEQ ID NO: 8416419 - DNA, 22 bp, Homo sapiens
gagcaacagtggcagtggtggg

SEQ ID NO: 8416420 - DNA, 22 bp, Homo sapiens
gagcaacactccacattgctag

SEQ ID NO: 8416421 - DNA, 22 bp, Homo sapiens
gagcaacaggtgatggggctgt

SEQ ID NO: 8416422 - DNA, 22 bp, Homo sapiens
gagcaacagtttatggtttttc

SEQ ID NO: 8416423 - DNA, 19 bp, Homo sapiens
gagcaacatatgtaaactc

SEQ ID NO: 8416424 - DNA, 22 bp, Homo sapiens
gagcactgtactcatttgcact

SEQ ID NO: 8416425 - DNA, 22 bp, Homo sapiens
gagcactgatttatttttgtct

SEQ ID NO: 8416426 - DNA, 22 bp, Homo sapiens
gagcaccctttgcacatcagtc

SEQ ID NO: 8416427 - DNA, 22 bp, Homo sapiens
gagaggagtagacactttggtt

SEQ ID NO: 8416428 - DNA, 22 bp, Homo sapiens
gagaggagacttatccagattg

SEQ ID NO: 8416429 - DNA, 22 bp, Homo sapiens
gagaagaaatagaatcacattt

SEQ ID NO: 8416430 - DNA, 22 bp, Homo sapiens
gagaagccgagtcagctgagcc

SEQ ID NO: 8416431 - DNA, 22 bp, Homo sapiens
gagaagcaatttccaactgtgc

SEQ ID NO: 8416432 - DNA, 22 bp, Homo sapiens
gagaagcaatcagtggccaccc

SEQ ID NO: 8416433 - DNA, 22 bp, Homo sapiens
tcctagaatctttgtaagattg

SEQ ID NO: 8416434 - DNA, 22 bp, Homo sapiens
tcctagttctctgccagtcgct

SEQ ID NO: 8416435 - DNA, 22 bp, Homo sapiens
tcccaggctcttcaaggaagac

SEQ ID NO: 8416436 - DNA, 22 bp, Homo sapiens
tcccaggctggcaggcagcagt

SEQ ID NO: 8416437 - DNA, 20 bp, Homo sapiens
tcccaggctccaccctagac

SEQ ID NO: 8416438 - DNA, 22 bp, Homo sapiens
tcccaggctaggcctctgcgtt

SEQ ID NO: 8416439 - DNA, 22 bp, Homo sapiens
tcccaggctgggggcctgaagt

SEQ ID NO: 8416440 - DNA, 20 bp, Homo sapiens
tcccaggctgggctccagct

SEQ ID NO: 8416441 - DNA, 22 bp, Homo sapiens
tccctccaggcagctgggtact

SEQ ID NO: 8416442 - DNA, 19 bp, Homo sapiens
tccctcagtctgccaggcc

SEQ ID NO: 8416443 - DNA, 22 bp, Homo sapiens
tccctgagagcactggggagcc

SEQ ID NO: 8416444 - DNA, 22 bp, Homo sapiens
tccattctatgcttacatttat

SEQ ID NO: 8416445 - DNA, 22 bp, Homo sapiens
tcccagagcagatgtgctaaag

SEQ ID NO: 8416446 - DNA, 22 bp, Homo sapiens
tcccagagcagtactccaggag

SEQ ID NO: 8416447 - DNA, 22 bp, Homo sapiens
tcccagagccaagctatggatg

SEQ ID NO: 8416448 - DNA, 22 bp, Homo sapiens
tcccagagacagagcctcctcc

SEQ ID NO: 8416449 - DNA, 22 bp, Homo sapiens
tcccagagatttcctctccttc

SEQ ID NO: 8416450 - DNA, 22 bp, Homo sapiens
tcccagaggctccagtctctat

SEQ ID NO: 8416451 - DNA, 22 bp, Homo sapiens
tcccagaggtctctgctggttc

SEQ ID NO: 8416452 - DNA, 22 bp, Homo sapiens
tcccagaggttgagtcacttat

SEQ ID NO: 8416453 - DNA, 22 bp, Homo sapiens
tcccaggccataaaactcagag

SEQ ID NO: 8416454 - DNA, 22 bp, Homo sapiens
tcccagcctgacagtgcatcaa

SEQ ID NO: 8416455 - DNA, 22 bp, Homo sapiens
tccaggctagaagtcacaggcc

SEQ ID NO: 8416456 - DNA, 22 bp, Homo sapiens
tccaggctagagtgcagtggcc

SEQ ID NO: 8416457 - DNA, 22 bp, Homo sapiens
tccaggctagcctggtagagaa

SEQ ID NO: 8416458 - DNA, 21 bp, Homo sapiens
tccaggctggaaggggcgttg

SEQ ID NO: 8416459 - DNA, 22 bp, Homo sapiens
tccaggctggagtgcagtggca

SEQ ID NO: 8416460 - DNA, 22 bp, Homo sapiens
tccaggctggagtgcagtggcg

SEQ ID NO: 8416461 - DNA, 22 bp, Homo sapiens
tcctgcagccactgcaggcaga

SEQ ID NO: 8416462 - DNA, 22 bp, Homo sapiens
tcctgcagccaagggtcatcga

SEQ ID NO: 8416463 - DNA, 22 bp, Homo sapiens
tcctgcagcatccgtcgtctgt

SEQ ID NO: 8416464 - DNA, 22 bp, Homo sapiens
tcctgcagatcaaagcctttga

SEQ ID NO: 8416465 - DNA, 22 bp, Homo sapiens
tcctgcagccattagaggtcaa

SEQ ID NO: 8416466 - DNA, 22 bp, Homo sapiens
tcctgcagccattagaggtcaa

SEQ ID NO: 8416467 - DNA, 22 bp, Homo sapiens
tcctgcagagccgccctcaggt

SEQ ID NO: 8416468 - DNA, 22 bp, Homo sapiens
tcctgcagagccgccctcaggt

SEQ ID NO: 8416469 - DNA, 22 bp, Homo sapiens
tcctgcagagtcccactgattt

SEQ ID NO: 8416470 - DNA, 22 bp, Homo sapiens
tcctgcagagtcccactgattt

SEQ ID NO: 8416471 - DNA, 23 bp, Homo sapiens
tcctgcagataagctggttgaca

SEQ ID NO: 8416472 - DNA, 22 bp, Homo sapiens
tcctgcagatcaaagcctttga

SEQ ID NO: 8416473 - DNA, 23 bp, Homo sapiens
tcctgcagataagctggttgaca

SEQ ID NO: 8416474 - DNA, 19 bp, Homo sapiens
tcctgcagaccagacctgt

SEQ ID NO: 8416475 - DNA, 22 bp, Homo sapiens
tcctgcagacctcagtcaggtc

SEQ ID NO: 8416476 - DNA, 22 bp, Homo sapiens
tcctgcagagacagaggcctca

SEQ ID NO: 8416477 - DNA, 22 bp, Homo sapiens
tcctgcagacctcagtcaggtc

SEQ ID NO: 8416478 - DNA, 22 bp, Homo sapiens
tcctgcagagacagaggcctca

SEQ ID NO: 8416479 - DNA, 19 bp, Homo sapiens
tcctgcagaccagacctgt

SEQ ID NO: 8416480 - DNA, 21 bp, Homo sapiens
tcctgcagaatgccttcctac

SEQ ID NO: 8416481 - DNA, 22 bp, Homo sapiens
tcctgcagacatttacaccttt

SEQ ID NO: 8416482 - DNA, 22 bp, Homo sapiens
tcctgatgatattgctctttct

SEQ ID NO: 8416483 - DNA, 22 bp, Homo sapiens
tcctgcagctgcagacctgggg

SEQ ID NO: 8416484 - DNA, 22 bp, Homo sapiens
tcctgcagctgataaatacagt

SEQ ID NO: 8416485 - DNA, 22 bp, Homo sapiens
tcctgcagctgcagacctgggg

SEQ ID NO: 8416486 - DNA, 22 bp, Homo sapiens
tcctgcagctgaagctcatgtg

SEQ ID NO: 8416487 - DNA, 22 bp, Homo sapiens
tcctgcagctctgagaagcatc

SEQ ID NO: 8416488 - DNA, 22 bp, Homo sapiens
tcctgcagctgaagctcatgtg

SEQ ID NO: 8416489 - DNA, 22 bp, Homo sapiens
tcctgcagctctgagaagcatc

SEQ ID NO: 8416490 - DNA, 22 bp, Homo sapiens
tcctgcagccttgggctggagc

SEQ ID NO: 8416491 - DNA, 22 bp, Homo sapiens
tcctgcaggcctgttcccagta

SEQ ID NO: 8416492 - DNA, 22 bp, Homo sapiens
tcctgcaggcttgagtcctcag

SEQ ID NO: 8416493 - DNA, 22 bp, Homo sapiens
tcctgcaggcctgttcccagta

SEQ ID NO: 8416494 - DNA, 18 bp, Homo sapiens
tcctgcagcttctatgta

SEQ ID NO: 8416495 - DNA, 18 bp, Homo sapiens
tcctgcagcttctatgta

SEQ ID NO: 8416496 - DNA, 21 bp, Homo sapiens
tcctgcaggaggcctgagagg

SEQ ID NO: 8416497 - DNA, 22 bp, Homo sapiens
tcctgcaggccagaggggtgag

SEQ ID NO: 8416498 - DNA, 22 bp, Homo sapiens
tcctgcagtctgcactctgcct

SEQ ID NO: 8416499 - DNA, 20 bp, Homo sapiens
tcctgcagtcgctagcgccc

SEQ ID NO: 8416500 - DNA, 20 bp, Homo sapiens
tcctgcagtcgctagcgccc

SEQ ID NO: 8416501 - DNA, 22 bp, Homo sapiens
tcctgcaggtggatgattctct

SEQ ID NO: 8416502 - DNA, 19 bp, Homo sapiens
tcctgcaggtggcttgcag

SEQ ID NO: 8416503 - DNA, 22 bp, Homo sapiens
tcctgcaggtggatgattctct

SEQ ID NO: 8416504 - DNA, 22 bp, Homo sapiens
tcctgcaggggctgaggaacca

SEQ ID NO: 8416505 - DNA, 21 bp, Homo sapiens
tcctgcagggcagcagagtgg

SEQ ID NO: 8416506 - DNA, 22 bp, Homo sapiens
tcctgcaggcttgagtcctcag

SEQ ID NO: 8416507 - DNA, 22 bp, Homo sapiens
tcctctgtggaccgggctttgg

SEQ ID NO: 8416508 - DNA, 22 bp, Homo sapiens
tcctgaggcacaatcctagaat

SEQ ID NO: 8416509 - DNA, 22 bp, Homo sapiens
tcctgagtggttgttttcttcc

SEQ ID NO: 8416510 - DNA, 22 bp, Homo sapiens
tcctgaggctcactttgaatgt

SEQ ID NO: 8416511 - DNA, 22 bp, Homo sapiens
tcctgagcttcagtttcttcat

SEQ ID NO: 8416512 - DNA, 22 bp, Homo sapiens
tcacataaattatacaatttca

SEQ ID NO: 8416513 - DNA, 22 bp, Homo sapiens
tcaactaaggcacaatctctaa

SEQ ID NO: 8416514 - DNA, 22 bp, Homo sapiens
tcaactaactctattatttgaa

SEQ ID NO: 8416515 - DNA, 22 bp, Homo sapiens
tcaaatgaggctgatgaatgtg

SEQ ID NO: 8416516 - DNA, 22 bp, Homo sapiens
tcaacactctttggcacagtta

SEQ ID NO: 8416517 - DNA, 22 bp, Homo sapiens
tcaacactggctacagttatgc

SEQ ID NO: 8416518 - DNA, 22 bp, Homo sapiens
tcactgcaacctccacctcccg

SEQ ID NO: 8416519 - DNA, 22 bp, Homo sapiens
tcactgcaacctccacctcctg

SEQ ID NO: 8416520 - DNA, 22 bp, Homo sapiens
tcactgcgcttcagcctgggtg

SEQ ID NO: 8416521 - DNA, 22 bp, Homo sapiens
tcactgcgctgactgctacgat

SEQ ID NO: 8416522 - DNA, 20 bp, Homo sapiens
tcagatttttctaactttga

SEQ ID NO: 8416523 - DNA, 22 bp, Homo sapiens
tcagcaaccaggggcacagtcc

SEQ ID NO: 8416524 - DNA, 22 bp, Homo sapiens
tcagcattcctgaagacaagca

SEQ ID NO: 8416525 - DNA, 22 bp, Homo sapiens
tcagcatatcttgagcttcatg

SEQ ID NO: 8416526 - DNA, 22 bp, Homo sapiens
tcagtagttttgatctgagcag

SEQ ID NO: 8416527 - DNA, 22 bp, Homo sapiens
tcagggctgcatacaggagata

SEQ ID NO: 8416528 - DNA, 22 bp, Homo sapiens
tcagggctgcagaagaggcagg

SEQ ID NO: 8416529 - DNA, 22 bp, Homo sapiens
tcagggctccggaagtggcctc

SEQ ID NO: 8416530 - DNA, 22 bp, Homo sapiens
tcagggctcagcatctggcatt

SEQ ID NO: 8416531 - DNA, 22 bp, Homo sapiens
tcatagaaatggaaagtatatt

SEQ ID NO: 8416532 - DNA, 22 bp, Homo sapiens
tcatctttgtatccctaacaca

SEQ ID NO: 8416533 - DNA, 22 bp, Homo sapiens
tcatgcagagccagtcaggata

SEQ ID NO: 8416534 - DNA, 19 bp, Homo sapiens
tcagtctaggaatgagcta

SEQ ID NO: 8416535 - DNA, 22 bp, Homo sapiens
tcagtctatccagctcagatcc

SEQ ID NO: 8416536 - DNA, 18 bp, Homo sapiens
tcagtctattgtataaga

SEQ ID NO: 8416537 - DNA, 22 bp, Homo sapiens
tcagttaatggattctgtcaga

SEQ ID NO: 8416538 - DNA, 22 bp, Homo sapiens
tcagttaatatgggtaaagcat

SEQ ID NO: 8416539 - DNA, 22 bp, Homo sapiens
tcagttaatcaatgtggtctaa

SEQ ID NO: 8416540 - DNA, 22 bp, Homo sapiens
tcagttaagaggccacggcagt

SEQ ID NO: 8416541 - DNA, 22 bp, Homo sapiens
tcagttaagcactataccctaa

SEQ ID NO: 8416542 - DNA, 20 bp, Homo sapiens
tcagttaagttgctgaatct

SEQ ID NO: 8416543 - DNA, 22 bp, Homo sapiens
tcagttaacaactatttattga

SEQ ID NO: 8416544 - DNA, 23 bp, Homo sapiens
tcagttaactgtgttacctgtgc

SEQ ID NO: 8416545 - DNA, 22 bp, Homo sapiens
tcagttaagactgcactggact

SEQ ID NO: 8416546 - DNA, 22 bp, Homo sapiens
tcagttaacggaaaggggtgtg

SEQ ID NO: 8416547 - DNA, 22 bp, Homo sapiens
tcagttaacaactatttattga

SEQ ID NO: 8416548 - DNA, 22 bp, Homo sapiens
tcagttaatggtaagggtgaaa

SEQ ID NO: 8416549 - DNA, 22 bp, Homo sapiens
tcataaagcttgcctgcagtgt

SEQ ID NO: 8416550 - DNA, 22 bp, Homo sapiens
tcataaagtgaaggatgatggg

SEQ ID NO: 8416551 - DNA, 22 bp, Homo sapiens
tcatttaattggttttgctcgt

SEQ ID NO: 8416552 - DNA, 22 bp, Homo sapiens
tcattgtttctgcttttcatga

SEQ ID NO: 8416553 - DNA, 22 bp, Homo sapiens
tcatttataaggatgcaattaa

SEQ ID NO: 8416554 - DNA, 22 bp, Homo sapiens
tcattgccatggcatttgcaga

SEQ ID NO: 8416555 - DNA, 22 bp, Homo sapiens
tcattgccatggcatttgcaga

SEQ ID NO: 8416556 - DNA, 22 bp, Homo sapiens
tcatgcagtttcttatctgcca

SEQ ID NO: 8416557 - DNA, 22 bp, Homo sapiens
tcatgcagttactgttatgcaa

SEQ ID NO: 8416558 - DNA, 22 bp, Homo sapiens
tcatgcagtttgaagttcaggg

SEQ ID NO: 8416559 - DNA, 21 bp, Homo sapiens
tcatgcaggcagagtttggta

SEQ ID NO: 8416560 - DNA, 20 bp, Homo sapiens
tcatgcaggtgttctaggtt

SEQ ID NO: 8416561 - DNA, 22 bp, Homo sapiens
tcatttctgttgtgcatcactg

SEQ ID NO: 8416562 - DNA, 21 bp, Homo sapiens
tccaaatcccattctgtagtc

SEQ ID NO: 8416563 - DNA, 22 bp, Homo sapiens
tccaaggagtcttaagttacat

SEQ ID NO: 8416564 - DNA, 22 bp, Homo sapiens
tccaaggaggctttgacgtcca

SEQ ID NO: 8416565 - DNA, 22 bp, Homo sapiens
tccaaggagcagatccagagga

SEQ ID NO: 8416566 - DNA, 22 bp, Homo sapiens
tccaaggagcagtcttcaacct

SEQ ID NO: 8416567 - DNA, 22 bp, Homo sapiens
tccaaggaggagctggagattg

SEQ ID NO: 8416568 - DNA, 22 bp, Homo sapiens
tccaaggacattgttctagttg

SEQ ID NO: 8416569 - DNA, 22 bp, Homo sapiens
tccaaggaagtttgcactattg

SEQ ID NO: 8416570 - DNA, 22 bp, Homo sapiens
tccaaggaagtcatttaaactg

SEQ ID NO: 8416571 - DNA, 22 bp, Homo sapiens
tccaaggacgctggacccctgc

SEQ ID NO: 8416572 - DNA, 22 bp, Homo sapiens
tccaaggactcttgtcagctgt

SEQ ID NO: 8416573 - DNA, 22 bp, Homo sapiens
tccaaggactaaattctagatt

SEQ ID NO: 8416574 - DNA, 22 bp, Homo sapiens
tccaaaacagaactctgtgaat

SEQ ID NO: 8416575 - DNA, 22 bp, Homo sapiens
tcatttgttctcattctctact

SEQ ID NO: 8416576 - DNA, 22 bp, Homo sapiens
tcatttgttcatctgctcttct

SEQ ID NO: 8416577 - DNA, 22 bp, Homo sapiens
tcatttgtaccattttttaaga

SEQ ID NO: 8416578 - DNA, 21 bp, Homo sapiens
tcatttgtgatctgatttcca

SEQ ID NO: 8416579 - DNA, 22 bp, Homo sapiens
tcatttgtgtgagtgatttgac

SEQ ID NO: 8416580 - DNA, 22 bp, Homo sapiens
tcatttgtggaagtgattgtgg

SEQ ID NO: 8416581 - DNA, 22 bp, Homo sapiens
tagctgacagatacaatcagat

SEQ ID NO: 8416582 - DNA, 22 bp, Homo sapiens
tagcaacaagtgactatctata

SEQ ID NO: 8416583 - DNA, 22 bp, Homo sapiens
tagcaacagaaaataggagtgc

SEQ ID NO: 8416584 - DNA, 22 bp, Homo sapiens
tagcaacaccatctggtgagaa

SEQ ID NO: 8416585 - DNA, 22 bp, Homo sapiens
tagcaacagcaatagtggtatt

SEQ ID NO: 8416586 - DNA, 22 bp, Homo sapiens
tagcaacaatggaagtaacttc

SEQ ID NO: 8416587 - DNA, 22 bp, Homo sapiens
tagcaacataagaaacattttg

SEQ ID NO: 8416588 - DNA, 22 bp, Homo sapiens
tagcaacatggttatcacatta

SEQ ID NO: 8416589 - DNA, 22 bp, Homo sapiens
tagagaatggccttgaagtagt

SEQ ID NO: 8416590 - DNA, 22 bp, Homo sapiens
tagagacaccagtaccattctg

SEQ ID NO: 8416591 - DNA, 22 bp, Homo sapiens
tagagaggtttgaattggctgc

SEQ ID NO: 8416592 - DNA, 22 bp, Homo sapiens
tagtgcagggttttaagcactg

SEQ ID NO: 8416593 - DNA, 22 bp, Homo sapiens
tagtgcaggttaataggacttc

SEQ ID NO: 8416594 - DNA, 22 bp, Homo sapiens
tagtgccaccttccaagtatca

SEQ ID NO: 8416595 - DNA, 22 bp, Homo sapiens
tagttagggttctgcagagaca

SEQ ID NO: 8416596 - DNA, 22 bp, Homo sapiens
tagttaggaaagtccagggagc

SEQ ID NO: 8416597 - DNA, 22 bp, Homo sapiens
tagttaggaatagcagcgactc

SEQ ID NO: 8416598 - DNA, 22 bp, Homo sapiens
tagttcacccctctttattttc

SEQ ID NO: 8416599 - DNA, 22 bp, Homo sapiens
tagtttaatggtcaactaatga

SEQ ID NO: 8416600 - DNA, 22 bp, Homo sapiens
tagtttaatggtcaactaatga

SEQ ID NO: 8416601 - DNA, 22 bp, Homo sapiens
tagtttttactgcgagttataa

SEQ ID NO: 8416602 - DNA, 22 bp, Homo sapiens
tagttttgaggattatatgtga

SEQ ID NO: 8416603 - DNA, 22 bp, Homo sapiens
tagggctctggtgggctctgtt

SEQ ID NO: 8416604 - DNA, 22 bp, Homo sapiens
tagggctctgctcatcagttgt

SEQ ID NO: 8416605 - DNA, 18 bp, Homo sapiens
tagggctctagggagtga

SEQ ID NO: 8416606 - DNA, 22 bp, Homo sapiens
tagggctctgagagttcagcct

SEQ ID NO: 8416607 - DNA, 21 bp, Homo sapiens
tagggctctctgtgtcaggtg

SEQ ID NO: 8416608 - DNA, 21 bp, Homo sapiens
tagggctctatttttatttca

SEQ ID NO: 8416609 - DNA, 22 bp, Homo sapiens
taggccattcttggagcttact

SEQ ID NO: 8416610 - DNA, 22 bp, Homo sapiens
tataaaacagaaagcactacct

SEQ ID NO: 8416611 - DNA, 22 bp, Homo sapiens
tatcagatttagaggagtcata

SEQ ID NO: 8416612 - DNA, 22 bp, Homo sapiens
tatcagcaggccaaagctgcaa

SEQ ID NO: 8416613 - DNA, 22 bp, Homo sapiens
tatcagcaccgcggacagcatc

SEQ ID NO: 8416614 - DNA, 22 bp, Homo sapiens
tatgaaattgccatttttatgg

SEQ ID NO: 8416615 - DNA, 22 bp, Homo sapiens
tatgacaaggtggagtatgagt

SEQ ID NO: 8416616 - DNA, 22 bp, Homo sapiens
tatgacaaatgatatatttggc

SEQ ID NO: 8416617 - DNA, 22 bp, Homo sapiens
tatgacaagaaatacagaggta

SEQ ID NO: 8416618 - DNA, 22 bp, Homo sapiens
tatgaaggatacacctctgatt

SEQ ID NO: 8416619 - DNA, 18 bp, Homo sapiens
tatcttttccagtggtat

SEQ ID NO: 8416620 - DNA, 22 bp, Homo sapiens
tatcttttgagttctcaagatg

SEQ ID NO: 8416621 - DNA, 23 bp, Homo sapiens
tatctttttcaatgttggaaata

SEQ ID NO: 8416622 - DNA, 22 bp, Homo sapiens
tatccaaacatatagtctctct

SEQ ID NO: 8416623 - DNA, 22 bp, Homo sapiens
tattaaattatggatttaggag

SEQ ID NO: 8416624 - DNA, 21 bp, Homo sapiens
tattaatatgtctaagctgat

SEQ ID NO: 8416625 - DNA, 22 bp, Homo sapiens
tattaataagtgactactagct

SEQ ID NO: 8416626 - DNA, 22 bp, Homo sapiens
tattaacattttatgaaaataa

SEQ ID NO: 8416627 - DNA, 22 bp, Homo sapiens
tattaagatacgtagttgtaaa

SEQ ID NO: 8416628 - DNA, 22 bp, Homo sapiens
tattaagagatgtatgaagaga

SEQ ID NO: 8416629 - DNA, 22 bp, Homo sapiens
tatggaaagtgttttcttctgt

SEQ ID NO: 8416630 - DNA, 22 bp, Homo sapiens
tcaaatctcactctgcatttct

SEQ ID NO: 8416631 - DNA, 22 bp, Homo sapiens
tcaaataccagcttttccagaa

SEQ ID NO: 8416632 - DNA, 22 bp, Homo sapiens
tcaaatacatggtcaatcaact

SEQ ID NO: 8416633 - DNA, 22 bp, Homo sapiens
tcaaataccagcaatttcatgt

SEQ ID NO: 8416634 - DNA, 22 bp, Homo sapiens
tcaaactgctaccttttatgtg

SEQ ID NO: 8416635 - DNA, 22 bp, Homo sapiens
tcaaagagctattcagttgtgg

SEQ ID NO: 8416636 - DNA, 22 bp, Homo sapiens
tcaaagagctctatcttcaaaa

SEQ ID NO: 8416637 - DNA, 22 bp, Homo sapiens
tcaaagagctattcagttgtgg

SEQ ID NO: 8416638 - DNA, 22 bp, Homo sapiens
tattttgagcccctgacatcta

SEQ ID NO: 8416639 - DNA, 22 bp, Homo sapiens
tattttgacgattttatgcaaa

SEQ ID NO: 8416640 - DNA, 22 bp, Homo sapiens
tcaaaaataagatattctggac

SEQ ID NO: 8416641 - DNA, 22 bp, Homo sapiens
tatttaaaaagaggccagctgg

SEQ ID NO: 8416642 - DNA, 22 bp, Homo sapiens
tatttaaccagttaaatttcca

SEQ ID NO: 8416643 - DNA, 22 bp, Homo sapiens
tattacaatttacattgcactt

SEQ ID NO: 8416644 - DNA, 21 bp, Homo sapiens
tatttgctgccatctttgagg

SEQ ID NO: 8416645 - DNA, 22 bp, Homo sapiens
tatttgaagggagaaagtgcca

SEQ ID NO: 8416646 - DNA, 22 bp, Homo sapiens
tatttgatagagataaatgata

SEQ ID NO: 8416647 - DNA, 22 bp, Homo sapiens
taagcctgcatgaaccatgaga

SEQ ID NO: 8416648 - DNA, 22 bp, Homo sapiens
taagcctgcatgaaccatgaga

SEQ ID NO: 8416649 - DNA, 22 bp, Homo sapiens
taatataccaaactgtaatttt

SEQ ID NO: 8416650 - DNA, 19 bp, Homo sapiens
taatatacagacccatctg

SEQ ID NO: 8416651 - DNA, 22 bp, Homo sapiens
taaggaggttggtgggttggat

SEQ ID NO: 8416652 - DNA, 22 bp, Homo sapiens
taaggaggcgaggtggtgagca

SEQ ID NO: 8416653 - DNA, 22 bp, Homo sapiens
taaggaggctgctgtgaagaaa

SEQ ID NO: 8416654 - DNA, 22 bp, Homo sapiens
taaggagggggaatgattggca

SEQ ID NO: 8416655 - DNA, 22 bp, Homo sapiens
taaggaggtgcccactctcagg

SEQ ID NO: 8416656 - DNA, 22 bp, Homo sapiens
taaggaggcagtcattatcagg

SEQ ID NO: 8416657 - DNA, 22 bp, Homo sapiens
taaggacattagaaatgatgct

SEQ ID NO: 8416658 - DNA, 22 bp, Homo sapiens
taatttatgatgcaaagaaaag

SEQ ID NO: 8416659 - DNA, 22 bp, Homo sapiens
tacacaatctgtttttccattt

SEQ ID NO: 8416660 - DNA, 22 bp, Homo sapiens
tacacaatctgtttttccattt

SEQ ID NO: 8416661 - DNA, 22 bp, Homo sapiens
tacaagaggtatatagaaacag

SEQ ID NO: 8416662 - DNA, 22 bp, Homo sapiens
tacaagagaactaatgtaagtc

SEQ ID NO: 8416663 - DNA, 22 bp, Homo sapiens
tacaacatgtaaagtggtttaa

SEQ ID NO: 8416664 - DNA, 22 bp, Homo sapiens
tacaacatgtaaagtggtttaa

SEQ ID NO: 8416665 - DNA, 22 bp, Homo sapiens
tacaacatgtggtcctttatga

SEQ ID NO: 8416666 - DNA, 22 bp, Homo sapiens
tacaacattgtgttgcttcata

SEQ ID NO: 8416667 - DNA, 22 bp, Homo sapiens
tacaacatttacgttaggctgt

SEQ ID NO: 8416668 - DNA, 22 bp, Homo sapiens
tacacaatgacttaagatgtca

SEQ ID NO: 8416669 - DNA, 19 bp, Homo sapiens
tacatgcagcaggcacgca

SEQ ID NO: 8416670 - DNA, 22 bp, Homo sapiens
tacatgcatgtcacagaatgaa

SEQ ID NO: 8416671 - DNA, 22 bp, Homo sapiens
tacatgcaattaagagggtgaa

SEQ ID NO: 8416672 - DNA, 22 bp, Homo sapiens
tacagtatggaaaatgtatagt

SEQ ID NO: 8416673 - DNA, 22 bp, Homo sapiens
tacagtcaacattgatgatgat

SEQ ID NO: 8416674 - DNA, 22 bp, Homo sapiens
tacagtcaagcataagaagtca

SEQ ID NO: 8416675 - DNA, 22 bp, Homo sapiens
tacagtgctagaacctgctgta

SEQ ID NO: 8416676 - DNA, 22 bp, Homo sapiens
tacagtgcttggtatctagtaa

SEQ ID NO: 8416677 - DNA, 22 bp, Homo sapiens
tacagtgcgggtgcgggcctct

SEQ ID NO: 8416678 - DNA, 22 bp, Homo sapiens
tacagtgcgatttttaggcctc

SEQ ID NO: 8416679 - DNA, 22 bp, Homo sapiens
tacagtgcatagaggcatgata

SEQ ID NO: 8416680 - DNA, 22 bp, Homo sapiens
tacagtgcacatttcttaggaa

SEQ ID NO: 8416681 - DNA, 22 bp, Homo sapiens
tacagtgcaatgtgatgtagat

SEQ ID NO: 8416682 - DNA, 22 bp, Homo sapiens
tacagtgctttttggtggagaa

SEQ ID NO: 8416683 - DNA, 22 bp, Homo sapiens
tactccacacgctattataatg

SEQ ID NO: 8416684 - DNA, 22 bp, Homo sapiens
tactaggaagcagctgcattgg

SEQ ID NO: 8416685 - DNA, 22 bp, Homo sapiens
taccatttgagagagaacataa

SEQ ID NO: 8416686 - DNA, 22 bp, Homo sapiens
taccattttgaaacatttcatc

SEQ ID NO: 8416687 - DNA, 22 bp, Homo sapiens
taccatttcagtaaaaacttag

SEQ ID NO: 8416688 - DNA, 22 bp, Homo sapiens
taccataacgtaatgaacttga

SEQ ID NO: 8416689 - DNA, 22 bp, Homo sapiens
tacttaaaactgatagaatctc

SEQ ID NO: 8416690 - DNA, 18 bp, Homo sapiens
taacatgttttcattaag

SEQ ID NO: 8416691 - DNA, 22 bp, Homo sapiens
taagacaagcctcgcatttgta

SEQ ID NO: 8416692 - DNA, 22 bp, Homo sapiens
taagacaaatactatttcaaga

SEQ ID NO: 8416693 - DNA, 22 bp, Homo sapiens
taagagcagaggttgaataaat

SEQ ID NO: 8416694 - DNA, 22 bp, Homo sapiens
taagagaatgttgtggctaggt

SEQ ID NO: 8416695 - DNA, 22 bp, Homo sapiens
taagagaactggatagatagga

SEQ ID NO: 8416696 - DNA, 22 bp, Homo sapiens
taagagcagaacagcaacatat

SEQ ID NO: 8416697 - DNA, 22 bp, Homo sapiens
taacatctaagggagagaaagt

SEQ ID NO: 8416698 - DNA, 22 bp, Homo sapiens
taacatcttaactggatacttc

SEQ ID NO: 8416699 - DNA, 22 bp, Homo sapiens
taacatcttattggcaaagata

SEQ ID NO: 8416700 - DNA, 22 bp, Homo sapiens
taacatcttgcagtagcagaac

SEQ ID NO: 8416701 - DNA, 22 bp, Homo sapiens
taacagtcatgtgctactgcta

SEQ ID NO: 8416702 - DNA, 22 bp, Homo sapiens
taaatgctatcgcataaaacct

SEQ ID NO: 8416703 - DNA, 18 bp, Homo sapiens
taaatgcatgttaataac

SEQ ID NO: 8416704 - DNA, 22 bp, Homo sapiens
taaatgccattcgtttcataca

SEQ ID NO: 8416705 - DNA, 22 bp, Homo sapiens
taaaagattttataggaacaag

SEQ ID NO: 8416706 - DNA, 22 bp, Homo sapiens
taaaaggaggttgaagctgtca

SEQ ID NO: 8416707 - DNA, 22 bp, Homo sapiens
taaagacactggttttaatcat

SEQ ID NO: 8416708 - DNA, 22 bp, Homo sapiens
gttttacaaatgacggcattca

SEQ ID NO: 8416709 - DNA, 22 bp, Homo sapiens
gttttacaaatgacggcattca

SEQ ID NO: 8416710 - DNA, 22 bp, Homo sapiens
taaaagatcactggctgcttta

SEQ ID NO: 8416711 - DNA, 22 bp, Homo sapiens
taaaagatatcttagggatttg

SEQ ID NO: 8416712 - DNA, 21 bp, Homo sapiens
taaaagatgacaagacagctc

SEQ ID NO: 8416713 - DNA, 22 bp, Homo sapiens
taaagataagacatcaactgag

SEQ ID NO: 8416714 - DNA, 20 bp, Homo sapiens
taaatgcatctgttcaactg

SEQ ID NO: 8416715 - DNA, 22 bp, Homo sapiens
taaatgcagttagtacttgcca

SEQ ID NO: 8416716 - DNA, 18 bp, Homo sapiens
taaatgcatgttaataac

SEQ ID NO: 8416717 - DNA, 20 bp, Homo sapiens
taaatgcatgaatgtaaggc

SEQ ID NO: 8416718 - DNA, 22 bp, Homo sapiens
gttaaattcgatgatggataaa

SEQ ID NO: 8416719 - DNA, 22 bp, Homo sapiens
gttaacataggcttaggggttt

SEQ ID NO: 8416720 - DNA, 23 bp, Homo sapiens
gttaacatggtccatggaagagc

SEQ ID NO: 8416721 - DNA, 22 bp, Homo sapiens
gttaacattcaattaaacagtc

SEQ ID NO: 8416722 - DNA, 22 bp, Homo sapiens
gttaacataggagtttgttgta

SEQ ID NO: 8416723 - DNA, 20 bp, Homo sapiens
gtgtttcatgtgatacaatg

SEQ ID NO: 8416724 - DNA, 22 bp, Homo sapiens
gttatgatggcaccactgcact

SEQ ID NO: 8416725 - DNA, 22 bp, Homo sapiens
gttcttcagttcaggctgttca

SEQ ID NO: 8416726 - DNA, 21 bp, Homo sapiens
gttgaatatccatgtatgtgt

SEQ ID NO: 8416727 - DNA, 22 bp, Homo sapiens
gttgaatatcccgtatcttaaa

SEQ ID NO: 8416728 - DNA, 22 bp, Homo sapiens
gttgaatatcgtgttcttgttt

SEQ ID NO: 8416729 - DNA, 22 bp, Homo sapiens
gttgaatattttaagagttttg

SEQ ID NO: 8416730 - DNA, 22 bp, Homo sapiens
gttctttaaactgctgctctgt

SEQ ID NO: 8416731 - DNA, 22 bp, Homo sapiens
gttctttaacctagtctcattt

SEQ ID NO: 8416732 - DNA, 22 bp, Homo sapiens
gttctttaagtggagaaggaaa

SEQ ID NO: 8416733 - DNA, 19 bp, Homo sapiens
gttctttcatagtaagagc

SEQ ID NO: 8416734 - DNA, 22 bp, Homo sapiens
gttctttaggggcccaatttcc

SEQ ID NO: 8416735 - DNA, 22 bp, Homo sapiens
gtttattatacaacaaaagcta

SEQ ID NO: 8416736 - DNA, 22 bp, Homo sapiens
gtttattagagttttctgtctg

SEQ ID NO: 8416737 - DNA, 22 bp, Homo sapiens
gtttattaactgtcaagtgatt

SEQ ID NO: 8416738 - DNA, 22 bp, Homo sapiens
gtttcacataattttaaattgt

SEQ ID NO: 8416739 - DNA, 22 bp, Homo sapiens
gtttcacagtctgcagaatttt

SEQ ID NO: 8416740 - DNA, 22 bp, Homo sapiens
gtttcttaggtaaattctttga

SEQ ID NO: 8416741 - DNA, 22 bp, Homo sapiens
gcaaggacctttgagcgtgcca

SEQ ID NO: 8416742 - DNA, 22 bp, Homo sapiens
gcaaggactccctgggtcattc

SEQ ID NO: 8416743 - DNA, 22 bp, Homo sapiens
gcaaggagcacctttctggaac

SEQ ID NO: 8416744 - DNA, 22 bp, Homo sapiens
gcaaggagcctggaggtgagtg

SEQ ID NO: 8416745 - DNA, 22 bp, Homo sapiens
gcaaggagactgtagggccaag

SEQ ID NO: 8416746 - DNA, 22 bp, Homo sapiens
gcaaggaggctggtggaggaag

SEQ ID NO: 8416747 - DNA, 22 bp, Homo sapiens
gcagatttctaataagcaatgt

SEQ ID NO: 8416748 - DNA, 22 bp, Homo sapiens
gcagacagccagactgcactgg

SEQ ID NO: 8416749 - DNA, 22 bp, Homo sapiens
gcacccagaggtcagcagtgct

SEQ ID NO: 8416750 - DNA, 22 bp, Homo sapiens
gcacccagagggcagggtctcc

SEQ ID NO: 8416751 - DNA, 22 bp, Homo sapiens
gcacccagcccagggcgtgatg

SEQ ID NO: 8416752 - DNA, 22 bp, Homo sapiens
gcacccagccagcatctcagag

SEQ ID NO: 8416753 - DNA, 22 bp, Homo sapiens
gcagccactagttttcctgttt

SEQ ID NO: 8416754 - DNA, 22 bp, Homo sapiens
gcagccactctcattccacgtg

SEQ ID NO: 8416755 - DNA, 21 bp, Homo sapiens
gcagccactgccttcaacaat

SEQ ID NO: 8416756 - DNA, 22 bp, Homo sapiens
gcagcactgatcctaaacttag

SEQ ID NO: 8416757 - DNA, 22 bp, Homo sapiens
gcaggcctaagagaaggcattg

SEQ ID NO: 8416758 - DNA, 22 bp, Homo sapiens
gccaggcattattccgatccct

SEQ ID NO: 8416759 - DNA, 22 bp, Homo sapiens
gccaggcgggtctcaaactcct

SEQ ID NO: 8416760 - DNA, 22 bp, Homo sapiens
gccactgttccaccatcttgat

SEQ ID NO: 8416761 - DNA, 22 bp, Homo sapiens
gccactgtggtcctcccatgat

SEQ ID NO: 8416762 - DNA, 22 bp, Homo sapiens
gcattcttggtggagtgctaaa

SEQ ID NO: 8416763 - DNA, 22 bp, Homo sapiens
gcattcttggtatgaaggacag

SEQ ID NO: 8416764 - DNA, 22 bp, Homo sapiens
gcattcttgaggtgtggactca

SEQ ID NO: 8416765 - DNA, 22 bp, Homo sapiens
gcattcttgtttttcctaccct

SEQ ID NO: 8416766 - DNA, 22 bp, Homo sapiens
gcattctttccacgaggaggta

SEQ ID NO: 8416767 - DNA, 22 bp, Homo sapiens
gcattctttagactgagagata

SEQ ID NO: 8416768 - DNA, 22 bp, Homo sapiens
gcattcttcactaggtgagagc

SEQ ID NO: 8416769 - DNA, 22 bp, Homo sapiens
gcattcttcgaagtaagtagtg

SEQ ID NO: 8416770 - DNA, 22 bp, Homo sapiens
gcattcttcctgggctgggggc

SEQ ID NO: 8416771 - DNA, 21 bp, Homo sapiens
gcattcttcatgtgattcaga

SEQ ID NO: 8416772 - DNA, 22 bp, Homo sapiens
gcattcttcacagtattcctcc

SEQ ID NO: 8416773 - DNA, 22 bp, Homo sapiens
gcattcttagggcctggggtgt

SEQ ID NO: 8416774 - DNA, 22 bp, Homo sapiens
gcattgagtccactctgtcttt

SEQ ID NO: 8416775 - DNA, 22 bp, Homo sapiens
gcattgaaatggcaaaaagaga

SEQ ID NO: 8416776 - DNA, 22 bp, Homo sapiens
gcattctttgaatgcttctaat

SEQ ID NO: 8416777 - DNA, 22 bp, Homo sapiens
gcattctttttgactcctggtt

SEQ ID NO: 8416778 - DNA, 22 bp, Homo sapiens
gcattctttttaggaggttcct

SEQ ID NO: 8416779 - DNA, 22 bp, Homo sapiens
gcagttatgtatgtgtttgaga

SEQ ID NO: 8416780 - DNA, 22 bp, Homo sapiens
gcagtgtttacatattagaaac

SEQ ID NO: 8416781 - DNA, 22 bp, Homo sapiens
gcagtgttgttaaaagattaga

SEQ ID NO: 8416782 - DNA, 22 bp, Homo sapiens
gcctccctccaccactgcaggt

SEQ ID NO: 8416783 - DNA, 18 bp, Homo sapiens
gcctgagggtcaagtgtg

SEQ ID NO: 8416784 - DNA, 22 bp, Homo sapiens
gcctgcagaggtgctgctagct

SEQ ID NO: 8416785 - DNA, 20 bp, Homo sapiens
gcctgcagagaaggtcagag

SEQ ID NO: 8416786 - DNA, 22 bp, Homo sapiens
gcctgcagacgtgttttcctca

SEQ ID NO: 8416787 - DNA, 21 bp, Homo sapiens
gcctgcagaccccaccaggct

SEQ ID NO: 8416788 - DNA, 22 bp, Homo sapiens
gcctgcagaactgtgaggcaat

SEQ ID NO: 8416789 - DNA, 19 bp, Homo sapiens
gcctgcagaaaaggcaggg

SEQ ID NO: 8416790 - DNA, 22 bp, Homo sapiens
gcctgatgagcttccagctgag

SEQ ID NO: 8416791 - DNA, 22 bp, Homo sapiens
gcctgcagccagggagttctct

SEQ ID NO: 8416792 - DNA, 22 bp, Homo sapiens
gcctgcagcatgctaggtcttg

SEQ ID NO: 8416793 - DNA, 22 bp, Homo sapiens
gcctgcagatatataggatggt

SEQ ID NO: 8416794 - DNA, 22 bp, Homo sapiens
gcctgcagcctcaagggctgag

SEQ ID NO: 8416795 - DNA, 22 bp, Homo sapiens
gcctgcagcccctctgcagtag

SEQ ID NO: 8416796 - DNA, 22 bp, Homo sapiens
gcctgcagcctcagagaatttt

SEQ ID NO: 8416797 - DNA, 22 bp, Homo sapiens
gcctgcagctgcttccacacac

SEQ ID NO: 8416798 - DNA, 18 bp, Homo sapiens
gcctgcaggcacgggggt

SEQ ID NO: 8416799 - DNA, 17 bp, Homo sapiens
gcctgcaggcccgcaga

SEQ ID NO: 8416800 - DNA, 22 bp, Homo sapiens
gcctgcaggctgtagtttgtga

SEQ ID NO: 8416801 - DNA, 22 bp, Homo sapiens
gcctgcagggcccttgtgggtc

SEQ ID NO: 8416802 - DNA, 22 bp, Homo sapiens
gcctgcagggcctgggcctacc

SEQ ID NO: 8416803 - DNA, 22 bp, Homo sapiens
gcctgcagggtgatgggctgcc

SEQ ID NO: 8416804 - DNA, 20 bp, Homo sapiens
gcctgcaggttggatgggat

SEQ ID NO: 8416805 - DNA, 22 bp, Homo sapiens
gcctgcagtgagtgcagaaggt

SEQ ID NO: 8416806 - DNA, 22 bp, Homo sapiens
gcctgcagttctgtgctaggca

SEQ ID NO: 8416807 - DNA, 21 bp, Homo sapiens
gcctgcagttttgaagccctt

SEQ ID NO: 8416808 - DNA, 21 bp, Homo sapiens
gcctgcagttttgaagccctt

SEQ ID NO: 8416809 - DNA, 22 bp, Homo sapiens
gcctgcagtgagtgcagaaggt

SEQ ID NO: 8416810 - DNA, 22 bp, Homo sapiens
gcccggcagtcacacacccagg

SEQ ID NO: 8416811 - DNA, 22 bp, Homo sapiens
gcccgcagagatctttaacaaa

SEQ ID NO: 8416812 - DNA, 22 bp, Homo sapiens
ggaaaaatgacacatatctcaa

SEQ ID NO: 8416813 - DNA, 22 bp, Homo sapiens
ggaaaaatagagtatactttaa

SEQ ID NO: 8416814 - DNA, 22 bp, Homo sapiens
ggacaggctgcatctgagcatg

SEQ ID NO: 8416815 - DNA, 22 bp, Homo sapiens
gctgtaggttcagtctccatgc

SEQ ID NO: 8416816 - DNA, 22 bp, Homo sapiens
gctgtattggaacacatccatg

SEQ ID NO: 8416817 - DNA, 22 bp, Homo sapiens
gctgtattcctgcactgtatag

SEQ ID NO: 8416818 - DNA, 19 bp, Homo sapiens
gctgtattaaagatacatg

SEQ ID NO: 8416819 - DNA, 22 bp, Homo sapiens
gctttatccgcttgacccttac

SEQ ID NO: 8416820 - DNA, 22 bp, Homo sapiens
gctttatccgcttgacccttac

SEQ ID NO: 8416821 - DNA, 22 bp, Homo sapiens
gctttggtcaggtgtccagccc

SEQ ID NO: 8416822 - DNA, 22 bp, Homo sapiens
gcttttcctgactttccattag

SEQ ID NO: 8416823 - DNA, 22 bp, Homo sapiens
gctttacataaacatttattat

SEQ ID NO: 8416824 - DNA, 22 bp, Homo sapiens
gcttaaatcccaatgctagacc

SEQ ID NO: 8416825 - DNA, 22 bp, Homo sapiens
gcttggggtcatgaggctgctg

SEQ ID NO: 8416826 - DNA, 22 bp, Homo sapiens
gctggaggtttcacctgagttt

SEQ ID NO: 8416827 - DNA, 22 bp, Homo sapiens
gctggaggtggtgagaaaaggt

SEQ ID NO: 8416828 - DNA, 22 bp, Homo sapiens
gctggaggtagggaggtcctgt

SEQ ID NO: 8416829 - DNA, 22 bp, Homo sapiens
gctggaggggtaataggatggg

SEQ ID NO: 8416830 - DNA, 22 bp, Homo sapiens
gctgcagggagctggaaggctc

SEQ ID NO: 8416831 - DNA, 22 bp, Homo sapiens
gctgaggtggctgccttagtaa

SEQ ID NO: 8416832 - DNA, 22 bp, Homo sapiens
gctgaggttttctgcctgctca

SEQ ID NO: 8416833 - DNA, 22 bp, Homo sapiens
gctaggctcggaagcagcaggg

SEQ ID NO: 8416834 - DNA, 22 bp, Homo sapiens
gctaggaggaagaatgtgaatt

SEQ ID NO: 8416835 - DNA, 22 bp, Homo sapiens
gctagaaatcgacttcagaatt

SEQ ID NO: 8416836 - DNA, 22 bp, Homo sapiens
gctccctccatgaggcagaccg

SEQ ID NO: 8416837 - DNA, 22 bp, Homo sapiens
gctccctcccaccagcctgcag

SEQ ID NO: 8416838 - DNA, 22 bp, Homo sapiens
gctccctctgctcaggcacttg

SEQ ID NO: 8416839 - DNA, 21 bp, Homo sapiens
gctctccagggccagcccagg

SEQ ID NO: 8416840 - DNA, 22 bp, Homo sapiens
ggaggcaaagcactttgcttgg

SEQ ID NO: 8416841 - DNA, 22 bp, Homo sapiens
ggaggatttgtcatctgaagat

SEQ ID NO: 8416842 - DNA, 17 bp, Homo sapiens
ggaggcaacagacaggg

SEQ ID NO: 8416843 - DNA, 23 bp, Homo sapiens
ggcactcggccgtgaactcgtgc

SEQ ID NO: 8416844 - DNA, 22 bp, Homo sapiens
ggcagcactgcagcttgttggg

SEQ ID NO: 8416845 - DNA, 22 bp, Homo sapiens
ggcagcactgcagcttgttggg

SEQ ID NO: 8416846 - DNA, 23 bp, Homo sapiens
ggcagatttggtttgttttaata

SEQ ID NO: 8416847 - DNA, 22 bp, Homo sapiens
ggcaggctttcagcatcaagtc

SEQ ID NO: 8416848 - DNA, 18 bp, Homo sapiens
ggcagggaaaagataggg

SEQ ID NO: 8416849 - DNA, 22 bp, Homo sapiens
ggcagggaagctggcatcacgg

SEQ ID NO: 8416850 - DNA, 21 bp, Homo sapiens
ggcctctgccttgccccactc

SEQ ID NO: 8416851 - DNA, 22 bp, Homo sapiens
ggcctctctggcatggctgccc

SEQ ID NO: 8416852 - DNA, 22 bp, Homo sapiens
ggcctctcttgggacagctgtc

SEQ ID NO: 8416853 - DNA, 22 bp, Homo sapiens
ggctcactgcaacttccgcctc

SEQ ID NO: 8416854 - DNA, 22 bp, Homo sapiens
ggctcacgcaattatcccggcc

SEQ ID NO: 8416855 - DNA, 22 bp, Homo sapiens
ggctctgaaggagacagctgct

SEQ ID NO: 8416856 - DNA, 22 bp, Homo sapiens
ggctctgaattattcctgagtc

SEQ ID NO: 8416857 - DNA, 22 bp, Homo sapiens
ggctctgaagggtgacaggttt

SEQ ID NO: 8416858 - DNA, 23 bp, Homo sapiens
ggctctgaggatggagctggtgg

SEQ ID NO: 8416859 - DNA, 22 bp, Homo sapiens
gggctctgagctctgggaatta

SEQ ID NO: 8416860 - DNA, 18 bp, Homo sapiens
gggctcacacaggtcatc

SEQ ID NO: 8416861 - DNA, 22 bp, Homo sapiens
gggccctgggattcagagcaag

SEQ ID NO: 8416862 - DNA, 22 bp, Homo sapiens
ggctgtggggccgggtacagtg

SEQ ID NO: 8416863 - DNA, 22 bp, Homo sapiens
ggctgtggggggagcctgcccg

SEQ ID NO: 8416864 - DNA, 22 bp, Homo sapiens
ggctgtggccagcggggctgag

SEQ ID NO: 8416865 - DNA, 22 bp, Homo sapiens
ggctgtgggatgcataggagct

SEQ ID NO: 8416866 - DNA, 22 bp, Homo sapiens
ggctgtgggccagctagaccct

SEQ ID NO: 8416867 - DNA, 22 bp, Homo sapiens
ggctgtggtcattaggaggttg

SEQ ID NO: 8416868 - DNA, 22 bp, Homo sapiens
ggctgtgggtgtgacaggcctc

SEQ ID NO: 8416869 - DNA, 22 bp, Homo sapiens
ggctgtggtctcatctagcctt

SEQ ID NO: 8416870 - DNA, 22 bp, Homo sapiens
ggctgtggacactgagctcaga

SEQ ID NO: 8416871 - DNA, 22 bp, Homo sapiens
ggctgtggcattaggtgaggcc

SEQ ID NO: 8416872 - DNA, 22 bp, Homo sapiens
ggctgtggcagctggaagtggt

SEQ ID NO: 8416873 - DNA, 21 bp, Homo sapiens
ggctgtggagccatgactcac

SEQ ID NO: 8416874 - DNA, 22 bp, Homo sapiens
gggagccacagtagcagctact

SEQ ID NO: 8416875 - DNA, 22 bp, Homo sapiens
gggagccagcctttgcctataa

SEQ ID NO: 8416876 - DNA, 22 bp, Homo sapiens
gggagccagccatccagaacct

SEQ ID NO: 8416877 - DNA, 22 bp, Homo sapiens
gggagccatgctggtcttcttt

SEQ ID NO: 8416878 - DNA, 22 bp, Homo sapiens
ggctgccacgtcgagggtccaa

SEQ ID NO: 8416879 - DNA, 22 bp, Homo sapiens
ggctggagatatgtctggaaca

SEQ ID NO: 8416880 - DNA, 22 bp, Homo sapiens
gggtggagaggctaagtccagt

SEQ ID NO: 8416881 - DNA, 22 bp, Homo sapiens
ggggaggacctttccaaggctt

SEQ ID NO: 8416882 - DNA, 22 bp, Homo sapiens
ggggagaattacatggcgtgga

SEQ ID NO: 8416883 - DNA, 22 bp, Homo sapiens
ggggagaattaccaaaagcgct

SEQ ID NO: 8416884 - DNA, 22 bp, Homo sapiens
ggggagaataaatcagatttta

SEQ ID NO: 8416885 - DNA, 22 bp, Homo sapiens
gggcttaaggccagtgtgcttt

SEQ ID NO: 8416886 - DNA, 22 bp, Homo sapiens
ggtgagggagtggaacgaggtg

SEQ ID NO: 8416887 - DNA, 22 bp, Homo sapiens
gggtttcatggttctcacaatg

SEQ ID NO: 8416888 - DNA, 22 bp, Homo sapiens
ggtaaaaatcacaaatacttta

SEQ ID NO: 8416889 - DNA, 22 bp, Homo sapiens
gtacaataactagtcttatagt

SEQ ID NO: 8416890 - DNA, 22 bp, Homo sapiens
gtacaaattttgacatctagga

SEQ ID NO: 8416891 - DNA, 22 bp, Homo sapiens
gtacaaattgatacaggttttc

SEQ ID NO: 8416892 - DNA, 22 bp, Homo sapiens
gtacaaattgatacagatttga

SEQ ID NO: 8416893 - DNA, 22 bp, Homo sapiens
gtacaaatacattctgaaggta

SEQ ID NO: 8416894 - DNA, 22 bp, Homo sapiens
gtacaaatgaaaatagaccact

SEQ ID NO: 8416895 - DNA, 22 bp, Homo sapiens
gtacaaatgagagttctgtttt

SEQ ID NO: 8416896 - DNA, 22 bp, Homo sapiens
gtacaaatgcaggtttgttaca

SEQ ID NO: 8416897 - DNA, 22 bp, Homo sapiens
gtacaaatgtacacttgtataa

SEQ ID NO: 8416898 - DNA, 22 bp, Homo sapiens
gtacaaattaggaagctttgtg

SEQ ID NO: 8416899 - DNA, 22 bp, Homo sapiens
gtaggtcagacataagaggaca

SEQ ID NO: 8416900 - DNA, 22 bp, Homo sapiens
gtacaatagcagttttcccttt

SEQ ID NO: 8416901 - DNA, 23 bp, Homo sapiens
gtaggaattttcacttcctcttg

SEQ ID NO: 8416902 - DNA, 22 bp, Homo sapiens
gtatacactggtaagatttgtc

SEQ ID NO: 8416903 - DNA, 22 bp, Homo sapiens
gtattttcaagagcagtagtat

SEQ ID NO: 8416904 - DNA, 22 bp, Homo sapiens
gtattttcaagagcagtagtat

SEQ ID NO: 8416905 - DNA, 22 bp, Homo sapiens
gtattttcatgatttcagacca

SEQ ID NO: 8416906 - DNA, 22 bp, Homo sapiens
gtattttcatgatttcagacca

SEQ ID NO: 8416907 - DNA, 22 bp, Homo sapiens
gtcaaaatgagctttgttattg

SEQ ID NO: 8416908 - DNA, 22 bp, Homo sapiens
gtcctggcttagttcgctgtaa

SEQ ID NO: 8416909 - DNA, 22 bp, Homo sapiens
gtcactgtatccaggttccagc

SEQ ID NO: 8416910 - DNA, 21 bp, Homo sapiens
gtccagagagccggctcctga

SEQ ID NO: 8416911 - DNA, 23 bp, Homo sapiens
gtctttatagtggggcactttgt

SEQ ID NO: 8416912 - DNA, 22 bp, Homo sapiens
gtctttatatttactaaagaat

SEQ ID NO: 8416913 - DNA, 22 bp, Homo sapiens
gtctttatctttgaaattagtc

SEQ ID NO: 8416914 - DNA, 22 bp, Homo sapiens
gtctttatggtatgaaaactga

SEQ ID NO: 8416915 - DNA, 22 bp, Homo sapiens
gtctttattacaaatccttttc

SEQ ID NO: 8416916 - DNA, 20 bp, Homo sapiens
gtctttatgttttatgacct

SEQ ID NO: 8416917 - DNA, 22 bp, Homo sapiens
gtgaaaaatcatcatgacttga

SEQ ID NO: 8416918 - DNA, 22 bp, Homo sapiens
gtgaaaaatgatttgttaactg

SEQ ID NO: 8416919 - DNA, 22 bp, Homo sapiens
gtctttatttgagattgtcatt

SEQ ID NO: 8416920 - DNA, 16 bp, Homo sapiens
gtctttattcacttag

SEQ ID NO: 8416921 - DNA, 22 bp, Homo sapiens
gtctttctatgatgaactgttg

SEQ ID NO: 8416922 - DNA, 21 bp, Homo sapiens
gtcttttaagtgaagagaggc

SEQ ID NO: 8416923 - DNA, 22 bp, Homo sapiens
gtgaggagctctttgactcacg

SEQ ID NO: 8416924 - DNA, 22 bp, Homo sapiens
gtgaggagctgacactggggtg

SEQ ID NO: 8416925 - DNA, 22 bp, Homo sapiens
gtgaggagtctgaagcacataa

SEQ ID NO: 8416926 - DNA, 22 bp, Homo sapiens
gtgaggagggctggtcccaggc

SEQ ID NO: 8416927 - DNA, 22 bp, Homo sapiens
gtgaggcaggcattctcctttc

SEQ ID NO: 8416928 - DNA, 22 bp, Homo sapiens
gtgaggcagaagttccctttta

SEQ ID NO: 8416929 - DNA, 22 bp, Homo sapiens
gtgaggcagcaggagcctctgt

SEQ ID NO: 8416930 - DNA, 19 bp, Homo sapiens
gtgaggagtgtttacagaa

SEQ ID NO: 8416931 - DNA, 22 bp, Homo sapiens
gtgcagggagcccagaaggtcc

SEQ ID NO: 8416932 - DNA, 17 bp, Homo sapiens
gtgcagggatgaaggat

SEQ ID NO: 8416933 - DNA, 22 bp, Homo sapiens
gtgcaggggcctccccttgctg

SEQ ID NO: 8416934 - DNA, 22 bp, Homo sapiens
gtgcaggggcctccccttgctg

SEQ ID NO: 8416935 - DNA, 22 bp, Homo sapiens
gtgcagggtagcgacggcagga

SEQ ID NO: 8416936 - DNA, 22 bp, Homo sapiens
gtgcagggtagcgacggcagga

SEQ ID NO: 8416937 - DNA, 22 bp, Homo sapiens
gtgcagggcagccgaatgggct

SEQ ID NO: 8416938 - DNA, 22 bp, Homo sapiens
gtgcagggcaggtgtccttcca

SEQ ID NO: 8416939 - DNA, 22 bp, Homo sapiens
gtgcagggccctcctaacatct

SEQ ID NO: 8416940 - DNA, 22 bp, Homo sapiens
gtgcagggctggcaccggaggc

SEQ ID NO: 8416941 - DNA, 22 bp, Homo sapiens
gtgcagggctggcaccggaggc

SEQ ID NO: 8416942 - DNA, 22 bp, Homo sapiens
gtgcaggggatcaggttgcagc

SEQ ID NO: 8416943 - DNA, 22 bp, Homo sapiens
gtgccaggtgctaagctgtgct

SEQ ID NO: 8416944 - DNA, 22 bp, Homo sapiens
gtgcccagctccacctcacaga

SEQ ID NO: 8416945 - DNA, 22 bp, Homo sapiens
gtgcccagcagcagcgtccccg

SEQ ID NO: 8416946 - DNA, 22 bp, Homo sapiens
ttcctgagtcgccgagtctatg

SEQ ID NO: 8416947 - DNA, 23 bp, Homo sapiens
ttcctgagtgctggagagagtgc

SEQ ID NO: 8416948 - DNA, 22 bp, Homo sapiens
ttcctgaggctcatcggagtcg

SEQ ID NO: 8416949 - DNA, 22 bp, Homo sapiens
ttcctgaggaggaccaggacca

SEQ ID NO: 8416950 - DNA, 22 bp, Homo sapiens
ttcctgagggccccagaggagg

SEQ ID NO: 8416951 - DNA, 22 bp, Homo sapiens
ttcctgagggacttttgagatt

SEQ ID NO: 8416952 - DNA, 22 bp, Homo sapiens
ttcctgagaacatggcagctta

SEQ ID NO: 8416953 - DNA, 21 bp, Homo sapiens
ttctcagatcgagtagtgaga

SEQ ID NO: 8416954 - DNA, 22 bp, Homo sapiens
ttctctaggttttagatgaaga

SEQ ID NO: 8416955 - DNA, 22 bp, Homo sapiens
ttctctaatggtgatgattaga

SEQ ID NO: 8416956 - DNA, 22 bp, Homo sapiens
ttctctaagagttatatgaatt

SEQ ID NO: 8416957 - DNA, 22 bp, Homo sapiens
ttctctaagccttagtttcttc

SEQ ID NO: 8416958 - DNA, 22 bp, Homo sapiens
ttctgtgcccattttaaaatgg

SEQ ID NO: 8416959 - DNA, 22 bp, Homo sapiens
ttctggaagtgttagaatctgg

SEQ ID NO: 8416960 - DNA, 22 bp, Homo sapiens
ttctggaagggtggagtagctt

SEQ ID NO: 8416961 - DNA, 17 bp, Homo sapiens
ttcttttctgagccttg

SEQ ID NO: 8416962 - DNA, 22 bp, Homo sapiens
ttcttttaatgttctgaagttt

SEQ ID NO: 8416963 - DNA, 22 bp, Homo sapiens
ttcttttaatgtctggctttca

SEQ ID NO: 8416964 - DNA, 22 bp, Homo sapiens
ttcttttaatagagatcctgtg

SEQ ID NO: 8416965 - DNA, 22 bp, Homo sapiens
ttcttttaaaagagagcagaaa

SEQ ID NO: 8416966 - DNA, 22 bp, Homo sapiens
ttcttcagactactgatgattg

SEQ ID NO: 8416967 - DNA, 22 bp, Homo sapiens
ttgaacaatcaaaagaattcat

SEQ ID NO: 8416968 - DNA, 22 bp, Homo sapiens
ttgaacaatttggtatacaaac

SEQ ID NO: 8416969 - DNA, 22 bp, Homo sapiens
ttgaacataaatcactggtcag

SEQ ID NO: 8416970 - DNA, 19 bp, Homo sapiens
ttgaaattgtttgatatgg

SEQ ID NO: 8416971 - DNA, 22 bp, Homo sapiens
ttgaacattggcaatttcatat

SEQ ID NO: 8416972 - DNA, 22 bp, Homo sapiens
ttcataatgaggtcctagaggc

SEQ ID NO: 8416973 - DNA, 21 bp, Homo sapiens
ttcataaaccattctcatgca

SEQ ID NO: 8416974 - DNA, 22 bp, Homo sapiens
ttcatttttaccgcgtgtcaaa

SEQ ID NO: 8416975 - DNA, 22 bp, Homo sapiens
ttcagagagaaaccagtgggaa

SEQ ID NO: 8416976 - DNA, 22 bp, Homo sapiens
ttcagagagaccaagtggcgtg

SEQ ID NO: 8416977 - DNA, 22 bp, Homo sapiens
ttcagagacagcaaccaggaca

SEQ ID NO: 8416978 - DNA, 22 bp, Homo sapiens
ttcagagatggaaggcagaatg

SEQ ID NO: 8416979 - DNA, 22 bp, Homo sapiens
ttcagagaagcaaaggcagatt

SEQ ID NO: 8416980 - DNA, 23 bp, Homo sapiens
ttcagactgccttcagcattgtc

SEQ ID NO: 8416981 - DNA, 22 bp, Homo sapiens
ttcagcaacatttgttgagtgc

SEQ ID NO: 8416982 - DNA, 22 bp, Homo sapiens
ttcagcaaatggactgttcagg

SEQ ID NO: 8416983 - DNA, 22 bp, Homo sapiens
ttcagcaagaccaccatgtacc

SEQ ID NO: 8416984 - DNA, 22 bp, Homo sapiens
ttcagcaaggcatgtgcaggag

SEQ ID NO: 8416985 - DNA, 22 bp, Homo sapiens
ttcagcactttgttttgctcat

SEQ ID NO: 8416986 - DNA, 22 bp, Homo sapiens
ttcagcactggacagcgagtct

SEQ ID NO: 8416987 - DNA, 22 bp, Homo sapiens
ttcagcaatgggatggtgcagg

SEQ ID NO: 8416988 - DNA, 22 bp, Homo sapiens
ttcagcacctggaatagcacct

SEQ ID NO: 8416989 - DNA, 22 bp, Homo sapiens
ttcacaataggagcatgcaaat

SEQ ID NO: 8416990 - DNA, 22 bp, Homo sapiens
ttcaaactgtgtaatttataaa

SEQ ID NO: 8416991 - DNA, 22 bp, Homo sapiens
ttcaaacttaaggagcagcaga

SEQ ID NO: 8416992 - DNA, 22 bp, Homo sapiens
ttattgaaggaactgaaataaa

SEQ ID NO: 8416993 - DNA, 22 bp, Homo sapiens
ttattgaaggaactgaaataaa

SEQ ID NO: 8416994 - DNA, 22 bp, Homo sapiens
ttcaaactagttaaaagtcaga

SEQ ID NO: 8416995 - DNA, 22 bp, Homo sapiens
ttcaaactcttgctctgctagt

SEQ ID NO: 8416996 - DNA, 22 bp, Homo sapiens
ttcaaactctgagtagttctgc

SEQ ID NO: 8416997 - DNA, 22 bp, Homo sapiens
ttatatccaaaggcaaggagga

SEQ ID NO: 8416998 - DNA, 22 bp, Homo sapiens
ttattagctgggcttcagggtg

SEQ ID NO: 8416999 - DNA, 22 bp, Homo sapiens
ttattaggaaaaggtcagatgt

SEQ ID NO: 8417000 - DNA, 22 bp, Homo sapiens
ttattaggaactcaggattttt

SEQ ID NO: 8417001 - DNA, 22 bp, Homo sapiens
ttattagggtggtttatgttct

SEQ ID NO: 8417002 - DNA, 22 bp, Homo sapiens
ttattaggttattctctgtact

SEQ ID NO: 8417003 - DNA, 22 bp, Homo sapiens
ttattaggtttacataaaggtt

SEQ ID NO: 8417004 - DNA, 22 bp, Homo sapiens
ttattacagtcccagggagtag

SEQ ID NO: 8417005 - DNA, 22 bp, Homo sapiens
ttattacactgaaagaattgcg

SEQ ID NO: 8417006 - DNA, 22 bp, Homo sapiens
ttattacactgaaagaattgcg

SEQ ID NO: 8417007 - DNA, 22 bp, Homo sapiens
ttattatagattatgcaagatt

SEQ ID NO: 8417008 - DNA, 22 bp, Homo sapiens
ttattatagattatgcaagatt

SEQ ID NO: 8417009 - DNA, 22 bp, Homo sapiens
ttagctcagaaaatttaaactt

SEQ ID NO: 8417010 - DNA, 22 bp, Homo sapiens
ttagctcagaaaatttaaactt

SEQ ID NO: 8417011 - DNA, 22 bp, Homo sapiens
ttatacatgtgttttgagatga

SEQ ID NO: 8417012 - DNA, 22 bp, Homo sapiens
ttatacatgtttataaggttga

SEQ ID NO: 8417013 - DNA, 22 bp, Homo sapiens
ttataccctccatacctggcct

SEQ ID NO: 8417014 - DNA, 22 bp, Homo sapiens
ttatacgctcaatcctatcatc

SEQ ID NO: 8417015 - DNA, 22 bp, Homo sapiens
ttatacagtttatacttagaat

SEQ ID NO: 8417016 - DNA, 22 bp, Homo sapiens
ttaggaaaatcatgagagatga

SEQ ID NO: 8417017 - DNA, 22 bp, Homo sapiens
ttatagcagcatgatttacaat

SEQ ID NO: 8417018 - DNA, 22 bp, Homo sapiens
ttatagcaggtgactaatgagt

SEQ ID NO: 8417019 - DNA, 22 bp, Homo sapiens
tttcacaatgcaatcctacttc

SEQ ID NO: 8417020 - DNA, 22 bp, Homo sapiens
tttcaacaggatgataataggc

SEQ ID NO: 8417021 - DNA, 23 bp, Homo sapiens
tttcaaattactctgcagatgac

SEQ ID NO: 8417022 - DNA, 23 bp, Homo sapiens
tttcaacaatgcttagagaaaac

SEQ ID NO: 8417023 - DNA, 22 bp, Homo sapiens
tttattgacccaaagcgagagt

SEQ ID NO: 8417024 - DNA, 22 bp, Homo sapiens
tttattctgtgctacatgaaga

SEQ ID NO: 8417025 - DNA, 18 bp, Homo sapiens
tttcacagattcatgact

SEQ ID NO: 8417026 - DNA, 22 bp, Homo sapiens
tttcacatttgttttaagaagt

SEQ ID NO: 8417027 - DNA, 22 bp, Homo sapiens
tttcagaaaacttatcatcagt

SEQ ID NO: 8417028 - DNA, 22 bp, Homo sapiens
tttcagaaagcatcatcaaagt

SEQ ID NO: 8417029 - DNA, 22 bp, Homo sapiens
tttcagaaacgattatgaacac

SEQ ID NO: 8417030 - DNA, 22 bp, Homo sapiens
tttcagaaagctgaacatatga

SEQ ID NO: 8417031 - DNA, 22 bp, Homo sapiens
tttcagaaatggcactgaaatc

SEQ ID NO: 8417032 - DNA, 22 bp, Homo sapiens
tttcccaggctggaatgcagtg

SEQ ID NO: 8417033 - DNA, 19 bp, Homo sapiens
tttcccagtcccaggagtg

SEQ ID NO: 8417034 - DNA, 22 bp, Homo sapiens
tttccccaggtagatagataat

SEQ ID NO: 8417035 - DNA, 22 bp, Homo sapiens
tttaaagaaattcctcatcttt

SEQ ID NO: 8417036 - DNA, 22 bp, Homo sapiens
tttaaacatcttgttgccttaa

SEQ ID NO: 8417037 - DNA, 22 bp, Homo sapiens
tttaagatggtattttataaag

SEQ ID NO: 8417038 - DNA, 22 bp, Homo sapiens
tttaatgaataattcaaatctg

SEQ ID NO: 8417039 - DNA, 22 bp, Homo sapiens
tttacagtctgtctagcaatgt

SEQ ID NO: 8417040 - DNA, 22 bp, Homo sapiens
tttacagtctatgttgaattaa

SEQ ID NO: 8417041 - DNA, 22 bp, Homo sapiens
tttacagtctctatagtcaaaa

SEQ ID NO: 8417042 - DNA, 22 bp, Homo sapiens
tttacagtaaggtggatggtac

SEQ ID NO: 8417043 - DNA, 22 bp, Homo sapiens
tttacagtatagtaggactcat

SEQ ID NO: 8417044 - DNA, 22 bp, Homo sapiens
tttacagtcaccaaactttgct

SEQ ID NO: 8417045 - DNA, 22 bp, Homo sapiens
tttacagtccccaggtgaggat

SEQ ID NO: 8417046 - DNA, 22 bp, Homo sapiens
tttagataatgctcaagcaatt

SEQ ID NO: 8417047 - DNA, 22 bp, Homo sapiens
tttagattgtgacctcccccca

SEQ ID NO: 8417048 - DNA, 22 bp, Homo sapiens
tttagcaaaaaagctctgcgta

SEQ ID NO: 8417049 - DNA, 22 bp, Homo sapiens
tttagcaacgaagcactcgaca

SEQ ID NO: 8417050 - DNA, 20 bp, Homo sapiens
tttagcaaaagggactgctc

SEQ ID NO: 8417051 - DNA, 23 bp, Homo sapiens
tttaccagaatagcaggggagag

SEQ ID NO: 8417052 - DNA, 20 bp, Homo sapiens
tttacattttgaaacagtga

SEQ ID NO: 8417053 - DNA, 20 bp, Homo sapiens
tttacattttgaaacagtga

SEQ ID NO: 8417054 - DNA, 22 bp, Homo sapiens
tttacagtgagagcttagtgag

SEQ ID NO: 8417055 - DNA, 22 bp, Homo sapiens
tttacagtgtcttgttgactgt

SEQ ID NO: 8417056 - DNA, 22 bp, Homo sapiens
tttagcatatttaaggaatgat

SEQ ID NO: 8417057 - DNA, 22 bp, Homo sapiens
tttagcaattagaatccagcat

SEQ ID NO: 8417058 - DNA, 22 bp, Homo sapiens
tttagcaagtatttactgacta

SEQ ID NO: 8417059 - DNA, 22 bp, Homo sapiens
tttagcaagttctctgagagaa

SEQ ID NO: 8417060 - DNA, 22 bp, Homo sapiens
tttatattgtaaaaatggttct

SEQ ID NO: 8417061 - DNA, 22 bp, Homo sapiens
tttatcagtagcaaagttttaa

SEQ ID NO: 8417062 - DNA, 20 bp, Homo sapiens
tttatcaggcacttactatt

SEQ ID NO: 8417063 - DNA, 22 bp, Homo sapiens
tttatcagaggctatgtttcat

SEQ ID NO: 8417064 - DNA, 21 bp, Homo sapiens
tttatcatcacgagcttgagc

SEQ ID NO: 8417065 - DNA, 22 bp, Homo sapiens
tttatctattgtattgttgatg

SEQ ID NO: 8417066 - DNA, 22 bp, Homo sapiens
ttgacaagtggagatatttaag

SEQ ID NO: 8417067 - DNA, 22 bp, Homo sapiens
ttgcagggaaacagtttaggaa

SEQ ID NO: 8417068 - DNA, 22 bp, Homo sapiens
ttgcagggaaatagaaataaac

SEQ ID NO: 8417069 - DNA, 22 bp, Homo sapiens
ttgcagcttctaccactgtttc

SEQ ID NO: 8417070 - DNA, 22 bp, Homo sapiens
ttgcagggaaatcagtgaggat

SEQ ID NO: 8417071 - DNA, 22 bp, Homo sapiens
ttgcagggcaaatggtcagata

SEQ ID NO: 8417072 - DNA, 22 bp, Homo sapiens
ttgcagcttcgagtctatctgt

SEQ ID NO: 8417073 - DNA, 22 bp, Homo sapiens
ttgcagcttagtgatgttatct

SEQ ID NO: 8417074 - DNA, 22 bp, Homo sapiens
ttgcagctgcagtaaatgttca

SEQ ID NO: 8417075 - DNA, 22 bp, Homo sapiens
ttgcagggttgacactgcctgc

SEQ ID NO: 8417076 - DNA, 22 bp, Homo sapiens
ttgcaggggaaggagcagagct

SEQ ID NO: 8417077 - DNA, 22 bp, Homo sapiens
ttgcagggcatctatgtctggt

SEQ ID NO: 8417078 - DNA, 22 bp, Homo sapiens
ttgcagggtacattcttagaat

SEQ ID NO: 8417079 - DNA, 22 bp, Homo sapiens
ttgcagggttaaagtaaggtag

SEQ ID NO: 8417080 - DNA, 22 bp, Homo sapiens
ttgcagggtcccagaggcctgg

SEQ ID NO: 8417081 - DNA, 23 bp, Homo sapiens
ttgcttagagacctcctcatcag

SEQ ID NO: 8417082 - DNA, 22 bp, Homo sapiens
ttgcatttaagtagatgttaca

SEQ ID NO: 8417083 - DNA, 23 bp, Homo sapiens
ttgctttcatcatgagatgctcc

SEQ ID NO: 8417084 - DNA, 22 bp, Homo sapiens
ttgtacagaaaaaattcttggt

SEQ ID NO: 8417085 - DNA, 22 bp, Homo sapiens
ttgtacaagtattatgtgaaca

SEQ ID NO: 8417086 - DNA, 22 bp, Homo sapiens
ttgtaagtcacaccagggcagg

SEQ ID NO: 8417087 - DNA, 21 bp, Homo sapiens
ttgtaaaggtttagaagaatg

SEQ ID NO: 8417088 - DNA, 22 bp, Homo sapiens
ttgtaaagctgattagaaagcc

SEQ ID NO: 8417089 - DNA, 22 bp, Homo sapiens
ttgtaaatagtagtaagatgcc

SEQ ID NO: 8417090 - DNA, 22 bp, Homo sapiens
ttgtaaagttcttaggaagctc

SEQ ID NO: 8417091 - DNA, 22 bp, Homo sapiens
ttgtaaatgaccttttctaatt

SEQ ID NO: 8417092 - DNA, 22 bp, Homo sapiens
ttgtgtctatggtttgagcatc

SEQ ID NO: 8417093 - DNA, 22 bp, Homo sapiens
ttgggcaggtgtggctctcctt

SEQ ID NO: 8417094 - DNA, 22 bp, Homo sapiens
ttggaggaagctcatgggggat

SEQ ID NO: 8417095 - DNA, 22 bp, Homo sapiens
ttggaggactagttaagagacc

SEQ ID NO: 8417096 - DNA, 22 bp, Homo sapiens
ttggaggaaattgcttttgtgg

SEQ ID NO: 8417097 - DNA, 22 bp, Homo sapiens
ttggaggaaagaaggttgatat

SEQ ID NO: 8417098 - DNA, 22 bp, Homo sapiens
ttggaggaggcattggaggatt

SEQ ID NO: 8417099 - DNA, 22 bp, Homo sapiens
ttttccaaagtaccatgtccct

SEQ ID NO: 8417100 - DNA, 22 bp, Homo sapiens
ttttcatttacattagggaaga

SEQ ID NO: 8417101 - DNA, 22 bp, Homo sapiens
ttttcatttttgtagatgcaag

SEQ ID NO: 8417102 - DNA, 22 bp, Homo sapiens
ttttcattgagcacctgagtaa

SEQ ID NO: 8417103 - DNA, 22 bp, Homo sapiens
ttttcattagaatgactgagaa

SEQ ID NO: 8417104 - DNA, 22 bp, Homo sapiens
ttttcattgttcctcgagcatt

SEQ ID NO: 8417105 - DNA, 22 bp, Homo sapiens
ttttcattgttcctcgagcatt

SEQ ID NO: 8417106 - DNA, 22 bp, Homo sapiens
ttttcattgttactatgagcta

SEQ ID NO: 8417107 - DNA, 22 bp, Homo sapiens
ttttcattgtaaatcaggaaac

SEQ ID NO: 8417108 - DNA, 22 bp, Homo sapiens
ttttattatctttgaatgggac

SEQ ID NO: 8417109 - DNA, 22 bp, Homo sapiens
ttttattagtggctagatgggg

SEQ ID NO: 8417110 - DNA, 22 bp, Homo sapiens
tttgtaaatagcagtactcatg

SEQ ID NO: 8417111 - DNA, 22 bp, Homo sapiens
tttgtaaaggcctgaatttcag

SEQ ID NO: 8417112 - DNA, 22 bp, Homo sapiens
tttgttagagtgtgggaggctg

SEQ ID NO: 8417113 - DNA, 22 bp, Homo sapiens
ttttaacactcagcactatctc

SEQ ID NO: 8417114 - DNA, 21 bp, Homo sapiens
ttttaacaaggatttccctag

SEQ ID NO: 8417115 - DNA, 22 bp, Homo sapiens
ttttaaaggatactcttgtcta

SEQ ID NO: 8417116 - DNA, 22 bp, Homo sapiens
tttgacaaaggaaaaatgcaca

SEQ ID NO: 8417117 - DNA, 22 bp, Homo sapiens
tttcctcctagcctccagccgc

SEQ ID NO: 8417118 - DNA, 21 bp, Homo sapiens
tttctttctggctctcacagt

SEQ ID NO: 8417119 - DNA, 22 bp, Homo sapiens
tttctttgttgttatcacatca

SEQ ID NO: 8417120 - DNA, 22 bp, Homo sapiens
tttggtaagtacccacctgggt

SEQ ID NO: 8417121 - DNA, 22 bp, Homo sapiens
tttgcttgttcaagatttctgt

SEQ ID NO: 8417122 - DNA, 22 bp, Homo sapiens
tttgatttactggatattctca

SEQ ID NO: 8417123 - DNA, 17 bp, Homo sapiens
tttgatagaatcagagt

SEQ ID NO: 8417124 - DNA, 22 bp, Homo sapiens
tttgatagggaagtaagaatga

SEQ ID NO: 8417125 - DNA, 19 bp, Homo sapiens
tttgatagggcataatata

SEQ ID NO: 8417126 - DNA, 22 bp, Homo sapiens
tttgaggttagctagcagatca

SEQ ID NO: 8417127 - DNA, 22 bp, Homo sapiens
tttttatatgaaggatagtgcg

SEQ ID NO: 8417128 - DNA, 22 bp, Homo sapiens
tttttatactttgctcaagatt

SEQ ID NO: 8417129 - DNA, 22 bp, Homo sapiens
tttttataggtcagggcaagtc

SEQ ID NO: 8417130 - DNA, 22 bp, Homo sapiens
tttttataggtcagggcaagtc

SEQ ID NO: 8417131 - DNA, 22 bp, Homo sapiens
tttttatatgaaggatagtgcg

SEQ ID NO: 8417132 - DNA, 22 bp, Homo sapiens
tttttataccacctctcactta

SEQ ID NO: 8417133 - DNA, 22 bp, Homo sapiens
tttttatactttgctcaagatt

SEQ ID NO: 8417134 - DNA, 22 bp, Homo sapiens
tttttcagccatgaattacact

SEQ ID NO: 8417135 - DNA, 22 bp, Homo sapiens
tttttcatattcccctctctgg

SEQ ID NO: 8417136 - DNA, 22 bp, Homo sapiens
tttttcatctgattgataactc

SEQ ID NO: 8417137 - DNA, 22 bp, Homo sapiens
tttttataactcttttgtgaca

SEQ ID NO: 8417138 - DNA, 22 bp, Homo sapiens
tttttataactcttttgtgaca

SEQ ID NO: 8417139 - DNA, 22 bp, Homo sapiens
tttttataccacctctcactta

SEQ ID NO: 8417140 - DNA, 22 bp, Homo sapiens
tttttagaattggctgagaatt

SEQ ID NO: 8417141 - DNA, 22 bp, Homo sapiens
tttttacagtcatggtcactca

SEQ ID NO: 8417142 - DNA, 22 bp, Homo sapiens
tttttacagtcatggtcactca

SEQ ID NO: 8417143 - DNA, 22 bp, Homo sapiens
tttttacacttagcattgagcg

SEQ ID NO: 8417144 - DNA, 22 bp, Homo sapiens
aataatagcagagtttacaatc

SEQ ID NO: 8417145 - DNA, 22 bp, Homo sapiens
actgtccaagcatgcctggctt

SEQ ID NO: 8417146 - DNA, 22 bp, Homo sapiens
actgtccattcactcatattca

SEQ ID NO: 8417147 - DNA, 22 bp, Homo sapiens
aatagaatgtaatctaatacat

SEQ ID NO: 8417148 - DNA, 22 bp, Homo sapiens
aatagaatgtaatctaatacat

SEQ ID NO: 8417149 - DNA, 22 bp, Homo sapiens
actgtcctagaacctgcagctc

SEQ ID NO: 8417150 - DNA, 22 bp, Homo sapiens
actgtctcctcatcatgcctgg

SEQ ID NO: 8417151 - DNA, 22 bp, Homo sapiens
actgtctcctcatcatgcctgg

SEQ ID NO: 8417152 - DNA, 22 bp, Homo sapiens
actgtccttttaatgcagccgt

SEQ ID NO: 8417153 - DNA, 22 bp, Homo sapiens
aatagcaaacagacatgcacaa

SEQ ID NO: 8417154 - DNA, 22 bp, Homo sapiens
aatagcaaagttatcaaattaa

SEQ ID NO: 8417155 - DNA, 22 bp, Homo sapiens
aatagcaaatgctcatttgaaa

SEQ ID NO: 8417156 - DNA, 22 bp, Homo sapiens
aatagcaattacccttcaactc

SEQ ID NO: 8417157 - DNA, 22 bp, Homo sapiens
actgaaaatgaattagaaacag

SEQ ID NO: 8417158 - DNA, 22 bp, Homo sapiens
actgaaaaagacatcttggtaa

SEQ ID NO: 8417159 - DNA, 18 bp, Homo sapiens
actctttctgcccacagg

SEQ ID NO: 8417160 - DNA, 22 bp, Homo sapiens
actgcattatcaccaagatgta

SEQ ID NO: 8417161 - DNA, 22 bp, Homo sapiens
aagtgtttggggatcattttaa

SEQ ID NO: 8417162 - DNA, 22 bp, Homo sapiens
aagtgtttccattgtgcaggct

SEQ ID NO: 8417163 - DNA, 22 bp, Homo sapiens
aagtgtttatttataacgatct

SEQ ID NO: 8417164 - DNA, 22 bp, Homo sapiens
aagtgtttacttaaagtcatgg

SEQ ID NO: 8417165 - DNA, 22 bp, Homo sapiens
aagtgtgacactgtgttaatta

SEQ ID NO: 8417166 - DNA, 22 bp, Homo sapiens
aagtgtgatttgtagaatgcct

SEQ ID NO: 8417167 - DNA, 22 bp, Homo sapiens
aagtgtgaattttagagtcagg

SEQ ID NO: 8417168 - DNA, 22 bp, Homo sapiens
aatgaatgaaccacatataaca

SEQ ID NO: 8417169 - DNA, 22 bp, Homo sapiens
aatgccaacttggatatacatt

SEQ ID NO: 8417170 - DNA, 22 bp, Homo sapiens
aatgccttataggctgaaaatt

SEQ ID NO: 8417171 - DNA, 22 bp, Homo sapiens
aatgccttcccatttatacttt

SEQ ID NO: 8417172 - DNA, 22 bp, Homo sapiens
aatcacaattacttttgcacca

SEQ ID NO: 8417173 - DNA, 22 bp, Homo sapiens
aatcacaaatgcaagttgtcac

SEQ ID NO: 8417174 - DNA, 22 bp, Homo sapiens
aatagtacaatctacagacata

SEQ ID NO: 8417175 - DNA, 22 bp, Homo sapiens
acctctaaaaaattagaagcct

SEQ ID NO: 8417176 - DNA, 22 bp, Homo sapiens
acccagggtagaacctcagagc

SEQ ID NO: 8417177 - DNA, 22 bp, Homo sapiens
aagtccttggagaatagaaagg

SEQ ID NO: 8417178 - DNA, 22 bp, Homo sapiens
aagtccagtttcatttgaggtc

SEQ ID NO: 8417179 - DNA, 20 bp, Homo sapiens
aagggcagagggaacagact

SEQ ID NO: 8417180 - DNA, 22 bp, Homo sapiens
accagagcttacatgctagaaa

SEQ ID NO: 8417181 - DNA, 19 bp, Homo sapiens
aaggaatggctttaagtag

SEQ ID NO: 8417182 - DNA, 17 bp, Homo sapiens
aaggaatgtcagaagtt

SEQ ID NO: 8417183 - DNA, 16 bp, Homo sapiens
aaggaatgtcattctg

SEQ ID NO: 8417184 - DNA, 22 bp, Homo sapiens
aaggaagggaaatagtgatgtc

SEQ ID NO: 8417185 - DNA, 22 bp, Homo sapiens
aaggaggcctggcagatgaaga

SEQ ID NO: 8417186 - DNA, 22 bp, Homo sapiens
aaggatctgacagactatagaa

SEQ ID NO: 8417187 - DNA, 21 bp, Homo sapiens
aagctgtgttccactgatagc

SEQ ID NO: 8417188 - DNA, 22 bp, Homo sapiens
aaggcacagccacttgatcatc

SEQ ID NO: 8417189 - DNA, 22 bp, Homo sapiens
aaggcaatgctaagaggtttgg

SEQ ID NO: 8417190 - DNA, 22 bp, Homo sapiens
aaggcaatgtaaattacagctt

SEQ ID NO: 8417191 - DNA, 22 bp, Homo sapiens
aaggcaatgttagcaacataat

SEQ ID NO: 8417192 - DNA, 22 bp, Homo sapiens
aaggcaatattgagtttccctt

SEQ ID NO: 8417193 - DNA, 22 bp, Homo sapiens
acatgacaaaatgcacaggatt

SEQ ID NO: 8417194 - DNA, 22 bp, Homo sapiens
acatcctcccgatctactggct

SEQ ID NO: 8417195 - DNA, 22 bp, Homo sapiens
acatgacagtgcttagcaaact

SEQ ID NO: 8417196 - DNA, 22 bp, Homo sapiens
acatgacagtgactttataaga

SEQ ID NO: 8417197 - DNA, 22 bp, Homo sapiens
acatgacagggaatgaggtgaa

SEQ ID NO: 8417198 - DNA, 19 bp, Homo sapiens
acatgacaacaggggaggc

SEQ ID NO: 8417199 - DNA, 22 bp, Homo sapiens
acatgacaaggtttataaggct

SEQ ID NO: 8417200 - DNA, 22 bp, Homo sapiens
acatgacacctctggctgggtg

SEQ ID NO: 8417201 - DNA, 22 bp, Homo sapiens
acatgacacaggcctggccaat

SEQ ID NO: 8417202 - DNA, 22 bp, Homo sapiens
acatgacatagtagaaaagccc

SEQ ID NO: 8417203 - DNA, 22 bp, Homo sapiens
agagaaatggggtaatctttca

SEQ ID NO: 8417204 - DNA, 22 bp, Homo sapiens
agagcaatggcatccagctgat

SEQ ID NO: 8417205 - DNA, 22 bp, Homo sapiens
agagcaattagcttaggtaaaa

SEQ ID NO: 8417206 - DNA, 22 bp, Homo sapiens
agacattggctaaaagtagtgt

SEQ ID NO: 8417207 - DNA, 22 bp, Homo sapiens
aatgccttgcctgctacaactt

SEQ ID NO: 8417208 - DNA, 22 bp, Homo sapiens
agacatctcccatgcattttta

SEQ ID NO: 8417209 - DNA, 22 bp, Homo sapiens
agacatgacagatagttgctag

SEQ ID NO: 8417210 - DNA, 22 bp, Homo sapiens
agacatcttgcacacatatact

SEQ ID NO: 8417211 - DNA, 22 bp, Homo sapiens
agacatcagcttgtgtgcaggg

SEQ ID NO: 8417212 - DNA, 22 bp, Homo sapiens
agacaggtaaatagagatgctg

SEQ ID NO: 8417213 - DNA, 22 bp, Homo sapiens
agacatcatgttacagattaag

SEQ ID NO: 8417214 - DNA, 22 bp, Homo sapiens
agaggaatatgggtgcactaga

SEQ ID NO: 8417215 - DNA, 22 bp, Homo sapiens
agaggaataaatttctgtagtg

SEQ ID NO: 8417216 - DNA, 22 bp, Homo sapiens
agaggaggtggtgatgctttaa

SEQ ID NO: 8417217 - DNA, 22 bp, Homo sapiens
agaggaggtggtgatgctttaa

SEQ ID NO: 8417218 - DNA, 22 bp, Homo sapiens
agaggacaaaatgagaagtgct

SEQ ID NO: 8417219 - DNA, 22 bp, Homo sapiens
agaggagtattttctaagggaa

SEQ ID NO: 8417220 - DNA, 22 bp, Homo sapiens
aatttcctgggataaaaagcca

SEQ ID NO: 8417221 - DNA, 22 bp, Homo sapiens
agaggcaaaaatctatggcaac

SEQ ID NO: 8417222 - DNA, 21 bp, Homo sapiens
aattacagatggaattacaga

SEQ ID NO: 8417223 - DNA, 22 bp, Homo sapiens
agagctgaatttgggtggtgga

SEQ ID NO: 8417224 - DNA, 22 bp, Homo sapiens
aattaacagagggcttattact

SEQ ID NO: 8417225 - DNA, 22 bp, Homo sapiens
agagcacactgacgtcagtctg

SEQ ID NO: 8417226 - DNA, 22 bp, Homo sapiens
aattaattcagtttttaaggga

SEQ ID NO: 8417227 - DNA, 22 bp, Homo sapiens
aattaagagagagttgaagcaa

SEQ ID NO: 8417228 - DNA, 22 bp, Homo sapiens
aattaagaaaatgttttatgat

SEQ ID NO: 8417229 - DNA, 22 bp, Homo sapiens
aattaagaaaatgttttatgat

SEQ ID NO: 8417230 - DNA, 22 bp, Homo sapiens
aattcatatggatatgctagta

SEQ ID NO: 8417231 - DNA, 20 bp, Homo sapiens
agatcttttctatagaagtg

SEQ ID NO: 8417232 - DNA, 22 bp, Homo sapiens
agatctttagaagatagaatca

SEQ ID NO: 8417233 - DNA, 22 bp, Homo sapiens
aatttctccaagaatgcttaga

SEQ ID NO: 8417234 - DNA, 22 bp, Homo sapiens
aatttctaattgaatctctctt

SEQ ID NO: 8417235 - DNA, 22 bp, Homo sapiens
aatttgattttcttaaaccata

SEQ ID NO: 8417236 - DNA, 22 bp, Homo sapiens
aatttgcatgatgagaacaata

SEQ ID NO: 8417237 - DNA, 22 bp, Homo sapiens
aatttgattccctgcacctgtt

SEQ ID NO: 8417238 - DNA, 23 bp, Homo sapiens
agcacaaagtgttttccttgtag

SEQ ID NO: 8417239 - DNA, 22 bp, Homo sapiens
agcacacaggacttgattcatg

SEQ ID NO: 8417240 - DNA, 22 bp, Homo sapiens
agcacaatataaagtgaacgca

SEQ ID NO: 8417241 - DNA, 22 bp, Homo sapiens
agcacaatgtgaaaagagctct

SEQ ID NO: 8417242 - DNA, 22 bp, Homo sapiens
agcacaatatgggttttatagt

SEQ ID NO: 8417243 - DNA, 22 bp, Homo sapiens
acacaagaagttaatgggcaaa

SEQ ID NO: 8417244 - DNA, 22 bp, Homo sapiens
acaagtttcattgtttagaacc

SEQ ID NO: 8417245 - DNA, 22 bp, Homo sapiens
acaagttttggaagtcttaagg

SEQ ID NO: 8417246 - DNA, 22 bp, Homo sapiens
acaacattcttaaatacactga

SEQ ID NO: 8417247 - DNA, 22 bp, Homo sapiens
acacaagttctaaagattgcgc

SEQ ID NO: 8417248 - DNA, 22 bp, Homo sapiens
acacaatacagggctcaaaata

SEQ ID NO: 8417249 - DNA, 22 bp, Homo sapiens
acacaagaataatgatgaaggt

SEQ ID NO: 8417250 - DNA, 19 bp, Homo sapiens
acacaatgacacatatata

SEQ ID NO: 8417251 - DNA, 22 bp, Homo sapiens
acacaatgattcacaagcagca

SEQ ID NO: 8417252 - DNA, 22 bp, Homo sapiens
acacaatgtcatcataatgtca

SEQ ID NO: 8417253 - DNA, 22 bp, Homo sapiens
acacacaattagttttatgctt

SEQ ID NO: 8417254 - DNA, 22 bp, Homo sapiens
acacccagctgggccacctcca

SEQ ID NO: 8417255 - DNA, 22 bp, Homo sapiens
acaccatactcatgttggttcc

SEQ ID NO: 8417256 - DNA, 22 bp, Homo sapiens
agccagaggaacttgatgactg

SEQ ID NO: 8417257 - DNA, 22 bp, Homo sapiens
agccagagcagggaattggaca

SEQ ID NO: 8417258 - DNA, 22 bp, Homo sapiens
agctgaggttagtataaatgtg

SEQ ID NO: 8417259 - DNA, 22 bp, Homo sapiens
agctaacacattccagctattt

SEQ ID NO: 8417260 - DNA, 22 bp, Homo sapiens
aaatgatgctcacagattagtg

SEQ ID NO: 8417261 - DNA, 22 bp, Homo sapiens
aaatgagtttgcctctagatag

SEQ ID NO: 8417262 - DNA, 23 bp, Homo sapiens
aaatgacatatggtttctgaagg

SEQ ID NO: 8417263 - DNA, 23 bp, Homo sapiens
aaatgactaaatgttcttataga

SEQ ID NO: 8417264 - DNA, 22 bp, Homo sapiens
aaatgagtagcgatgcacatta

SEQ ID NO: 8417265 - DNA, 22 bp, Homo sapiens
aaatagtcctgggaatagtact

SEQ ID NO: 8417266 - DNA, 22 bp, Homo sapiens
aaatagtaaagtggtagccatc

SEQ ID NO: 8417267 - DNA, 22 bp, Homo sapiens
aagagtttctgggtcaaggatt

SEQ ID NO: 8417268 - DNA, 19 bp, Homo sapiens
aaatatcagagagatgata

SEQ ID NO: 8417269 - DNA, 22 bp, Homo sapiens
aaatacaaaaattagccaggca

SEQ ID NO: 8417270 - DNA, 22 bp, Homo sapiens
aaatacaaaaattagccaggca

SEQ ID NO: 8417271 - DNA, 22 bp, Homo sapiens
aaagttctttttctataaatcc

SEQ ID NO: 8417272 - DNA, 22 bp, Homo sapiens
aaagttgaccgaaagattttga

SEQ ID NO: 8417273 - DNA, 22 bp, Homo sapiens
aaagttgagttttatgtgttac

SEQ ID NO: 8417274 - DNA, 22 bp, Homo sapiens
aaaggctggggactgaggaagg

SEQ ID NO: 8417275 - DNA, 18 bp, Homo sapiens
aaaggctgaatatagaag

SEQ ID NO: 8417276 - DNA, 22 bp, Homo sapiens
aacatgatgtgaagcatgaact

SEQ ID NO: 8417277 - DNA, 22 bp, Homo sapiens
aacatgatggggaagaacaaga

SEQ ID NO: 8417278 - DNA, 22 bp, Homo sapiens
aacatgatttagtataatgcag

SEQ ID NO: 8417279 - DNA, 22 bp, Homo sapiens
aacatgatttcatgcatttaga

SEQ ID NO: 8417280 - DNA, 22 bp, Homo sapiens
aaaggcatgcatggtctgctcc

SEQ ID NO: 8417281 - DNA, 22 bp, Homo sapiens
aacttgaaactgttccagaaaa

SEQ ID NO: 8417282 - DNA, 22 bp, Homo sapiens
aaagtctttattttgtatcttt

SEQ ID NO: 8417283 - DNA, 20 bp, Homo sapiens
aaagtctgtttatctctgga

SEQ ID NO: 8417284 - DNA, 22 bp, Homo sapiens
aaagtcctagcgatccacagaa

SEQ ID NO: 8417285 - DNA, 22 bp, Homo sapiens
aaagtcctgactgcaggggatg

SEQ ID NO: 8417286 - DNA, 22 bp, Homo sapiens
aaagcaggttgcaattacagtg

SEQ ID NO: 8417287 - DNA, 22 bp, Homo sapiens
aaaggaggccacatggctagga

SEQ ID NO: 8417288 - DNA, 20 bp, Homo sapiens
aaaggaatatatgaagtata

SEQ ID NO: 8417289 - DNA, 22 bp, Homo sapiens
aacatgaagttttctatagtga

SEQ ID NO: 8417290 - DNA, 22 bp, Homo sapiens
aacatgaaagttgctaagtgca

SEQ ID NO: 8417291 - DNA, 23 bp, Homo sapiens
aaaggcacagcattgtctagcag

SEQ ID NO: 8417292 - DNA, 22 bp, Homo sapiens
aaagcagggatgaggctagagg

SEQ ID NO: 8417293 - DNA, 18 bp, Homo sapiens
aaaatgcaggcgacatgg

SEQ ID NO: 8417294 - DNA, 22 bp, Homo sapiens
aaaatgcatgagaatgtgctcg

SEQ ID NO: 8417295 - DNA, 22 bp, Homo sapiens
aaaatgatgctgtaatttggca

SEQ ID NO: 8417296 - DNA, 22 bp, Homo sapiens
aaaatgatatcctgacttttat

SEQ ID NO: 8417297 - DNA, 22 bp, Homo sapiens
aaaatgagatacagtttgaaag

SEQ ID NO: 8417298 - DNA, 22 bp, Homo sapiens
aaaaatgttatctactgtccga

SEQ ID NO: 8417299 - DNA, 22 bp, Homo sapiens
aaaaatctatgactgcttctcc

SEQ ID NO: 8417300 - DNA, 22 bp, Homo sapiens
aaaagagtgactgataagtata

SEQ ID NO: 8417301 - DNA, 22 bp, Homo sapiens
aaaacaggtgtcagcaaactat

SEQ ID NO: 8417302 - DNA, 23 bp, Homo sapiens
aaaacagcttcctccagtggctc

SEQ ID NO: 8417303 - DNA, 22 bp, Homo sapiens
aaatgacactcattcagtgtca

SEQ ID NO: 8417304 - DNA, 22 bp, Homo sapiens
aaactgtgagctagtaaatagg

SEQ ID NO: 8417305 - DNA, 22 bp, Homo sapiens
aaactgttgtggtttatcatta

SEQ ID NO: 8417306 - DNA, 22 bp, Homo sapiens
aaatgacaataaaagtccatgc

SEQ ID NO: 8417307 - DNA, 21 bp, Homo sapiens
aaatgaatgtggtagtgcaag

SEQ ID NO: 8417308 - DNA, 21 bp, Homo sapiens
aaatgaatgtggtagtgcaag

SEQ ID NO: 8417309 - DNA, 22 bp, Homo sapiens
aaatgaacatcaagaatagcct

SEQ ID NO: 8417310 - DNA, 22 bp, Homo sapiens
aaatacagattccagggtctta

SEQ ID NO: 8417311 - DNA, 22 bp, Homo sapiens
aaataaaggaactgttttccca

SEQ ID NO: 8417312 - DNA, 22 bp, Homo sapiens
aaatacaatttcaggctgtaat

SEQ ID NO: 8417313 - DNA, 22 bp, Homo sapiens
aaatacacgtacatgtgtaaaa

SEQ ID NO: 8417314 - DNA, 22 bp, Homo sapiens
aaacttcatggataatataaag

SEQ ID NO: 8417315 - DNA, 22 bp, Homo sapiens
aaacttcagtgaatgacttatg

SEQ ID NO: 8417316 - DNA, 22 bp, Homo sapiens
aaacttcagactccccacttct

SEQ ID NO: 8417317 - DNA, 22 bp, Homo sapiens
aaaattttgccctatccttcat

SEQ ID NO: 8417318 - DNA, 19 bp, Homo sapiens
aaagttttattctcatttg

SEQ ID NO: 8417319 - DNA, 22 bp, Homo sapiens
aatgcagtgagccattaaatgg

SEQ ID NO: 8417320 - DNA, 22 bp, Homo sapiens
aatgcacacatttggtactgaa

SEQ ID NO: 8417321 - DNA, 22 bp, Homo sapiens
aatgcacatatatttccttatt

SEQ ID NO: 8417322 - DNA, 22 bp, Homo sapiens
aatgcacatgttgtaataaata

SEQ ID NO: 8417323 - DNA, 22 bp, Homo sapiens
aatgcacttagtatgaatgcct

SEQ ID NO: 8417324 - DNA, 22 bp, Homo sapiens
aatgcagaccagtatgaaaaac

SEQ ID NO: 8417325 - DNA, 22 bp, Homo sapiens
aatctctttggctcaaggatcc

SEQ ID NO: 8417326 - DNA, 22 bp, Homo sapiens
aatctgaatatttatgtgtatt

SEQ ID NO: 8417327 - DNA, 22 bp, Homo sapiens
aatctggaatatttgcattgta

SEQ ID NO: 8417328 - DNA, 23 bp, Homo sapiens
aatctggctgatgttttttctct

SEQ ID NO: 8417329 - DNA, 22 bp, Homo sapiens
aatatctgtctctaatgcatat

SEQ ID NO: 8417330 - DNA, 22 bp, Homo sapiens
aatatctgtggccatacaattt

SEQ ID NO: 8417331 - DNA, 22 bp, Homo sapiens
aatatccaggtagatgtcttct

SEQ ID NO: 8417332 - DNA, 22 bp, Homo sapiens
aagttacagtcagaggttaaca

SEQ ID NO: 8417333 - DNA, 22 bp, Homo sapiens
aatacagaggggtcacaattca

SEQ ID NO: 8417334 - DNA, 22 bp, Homo sapiens
aaatggatctgtggaatacatt

SEQ ID NO: 8417335 - DNA, 22 bp, Homo sapiens
aaatggatctttttataatgca

SEQ ID NO: 8417336 - DNA, 22 bp, Homo sapiens
aaatggatggaattgacattta

SEQ ID NO: 8417337 - DNA, 22 bp, Homo sapiens
aaatggcaatttagtttattta

SEQ ID NO: 8417338 - DNA, 22 bp, Homo sapiens
aaggagggaaagcagtgcttct

SEQ ID NO: 8417339 - DNA, 16 bp, Homo sapiens
aaggagggaagagaat

SEQ ID NO: 8417340 - DNA, 22 bp, Homo sapiens
aaggagggttcccaggtcctgg

SEQ ID NO: 8417341 - DNA, 22 bp, Homo sapiens
aagggcaggaaaagatggatgt

SEQ ID NO: 8417342 - DNA, 22 bp, Homo sapiens
aagggcaggcagagatcatata

SEQ ID NO: 8417343 - DNA, 22 bp, Homo sapiens
aaggccatctacttacggaatt

SEQ ID NO: 8417344 - DNA, 22 bp, Homo sapiens
aagtcttaaccaaataaatgtt

SEQ ID NO: 8417345 - DNA, 22 bp, Homo sapiens
aagtgccccaggctgttaacat

SEQ ID NO: 8417346 - DNA, 22 bp, Homo sapiens
aacagtgtcaggattacagata

SEQ ID NO: 8417347 - DNA, 22 bp, Homo sapiens
aacagtgtgtacacatcatagg

SEQ ID NO: 8417348 - DNA, 22 bp, Homo sapiens
aagtgcttaaaagggtggtcta

SEQ ID NO: 8417349 - DNA, 22 bp, Homo sapiens
aacagtaacgagatgtcctaac

SEQ ID NO: 8417350 - DNA, 22 bp, Homo sapiens
aagtgctgtttctgatgaatgc

SEQ ID NO: 8417351 - DNA, 22 bp, Homo sapiens
aaggttaaataggtattttcca

SEQ ID NO: 8417352 - DNA, 22 bp, Homo sapiens
aagtacaacgcatacagagaaa

SEQ ID NO: 8417353 - DNA, 21 bp, Homo sapiens
acacttcagtttttaaaggga

SEQ ID NO: 8417354 - DNA, 22 bp, Homo sapiens
acacttcatttacattataggc

SEQ ID NO: 8417355 - DNA, 22 bp, Homo sapiens
acacataagcctaatcatctcc

SEQ ID NO: 8417356 - DNA, 23 bp, Homo sapiens
acagaaagttctgctggacagag

SEQ ID NO: 8417357 - DNA, 22 bp, Homo sapiens
aagccctcattagccatagccc

SEQ ID NO: 8417358 - DNA, 22 bp, Homo sapiens
aagaacattgactaagaggggc

SEQ ID NO: 8417359 - DNA, 22 bp, Homo sapiens
aagaactagtcttacagcctca

SEQ ID NO: 8417360 - DNA, 22 bp, Homo sapiens
aagaacatttatgatggcattt

SEQ ID NO: 8417361 - DNA, 22 bp, Homo sapiens
aagaacttcctaatatattttc

SEQ ID NO: 8417362 - DNA, 22 bp, Homo sapiens
aagaagaagtgttatttttaga

SEQ ID NO: 8417363 - DNA, 22 bp, Homo sapiens
aagaagaagtgttatttttaga

SEQ ID NO: 8417364 - DNA, 22 bp, Homo sapiens
acaaaatagagttctcccctgg

SEQ ID NO: 8417365 - DNA, 22 bp, Homo sapiens
aagaatcattgtaaagttctgt

SEQ ID NO: 8417366 - DNA, 22 bp, Homo sapiens
acaaaagtgtaggaattcctta

SEQ ID NO: 8417367 - DNA, 22 bp, Homo sapiens
acaaatgaacatataagcttga

SEQ ID NO: 8417368 - DNA, 22 bp, Homo sapiens
acaaatatttactgaatccact

SEQ ID NO: 8417369 - DNA, 22 bp, Homo sapiens
aagaatctccatctgattcact

SEQ ID NO: 8417370 - DNA, 23 bp, Homo sapiens
aagaatctcagaattagaaatac

SEQ ID NO: 8417371 - DNA, 22 bp, Homo sapiens
aagaatcattgtaaagttctgt

SEQ ID NO: 8417372 - DNA, 22 bp, Homo sapiens
aagatacaaatgtcaatattgg

SEQ ID NO: 8417373 - DNA, 22 bp, Homo sapiens
aagataatattcattaactaga

SEQ ID NO: 8417374 - DNA, 22 bp, Homo sapiens
acaatatgggatatacatttta

SEQ ID NO: 8417375 - DNA, 20 bp, Homo sapiens
acaatatgtagatgaatagc

SEQ ID NO: 8417376 - DNA, 22 bp, Homo sapiens
acaatagtcaatgcacgtcatt

SEQ ID NO: 8417377 - DNA, 22 bp, Homo sapiens
acaaatttcataggcaaatttt

SEQ ID NO: 8417378 - DNA, 22 bp, Homo sapiens
acaaatttattgaagggcatat

SEQ ID NO: 8417379 - DNA, 22 bp, Homo sapiens
acaaatttcataggcaaatttt

SEQ ID NO: 8417380 - DNA, 22 bp, Homo sapiens
acaaatttattgaagggcatat

SEQ ID NO: 8417381 - DNA, 22 bp, Homo sapiens
acaaatttgtgtagttatggca

SEQ ID NO: 8417382 - DNA, 22 bp, Homo sapiens
acaaatttggtgagagtaaata

SEQ ID NO: 8417383 - DNA, 22 bp, Homo sapiens
acaaatttgaatcctgacttct

SEQ ID NO: 8417384 - DNA, 22 bp, Homo sapiens
cacaggctccggccttgcagcc

SEQ ID NO: 8417385 - DNA, 22 bp, Homo sapiens
cactaattccatctccttttcc

SEQ ID NO: 8417386 - DNA, 22 bp, Homo sapiens
cactaagttggtgttaattagt

SEQ ID NO: 8417387 - DNA, 22 bp, Homo sapiens
cacctgcaaggagctttcattt

SEQ ID NO: 8417388 - DNA, 22 bp, Homo sapiens
cacctgcagggggagtcaagag

SEQ ID NO: 8417389 - DNA, 22 bp, Homo sapiens
agcatttagtctttattgcagc

SEQ ID NO: 8417390 - DNA, 20 bp, Homo sapiens
agcatttgaaatatgactat

SEQ ID NO: 8417391 - DNA, 22 bp, Homo sapiens
cactgcacttcagcctgggtga

SEQ ID NO: 8417392 - DNA, 22 bp, Homo sapiens
cactgcacttcagcctgggtga

SEQ ID NO: 8417393 - DNA, 22 bp, Homo sapiens
cactgcaccctcaaactcctgg

SEQ ID NO: 8417394 - DNA, 22 bp, Homo sapiens
cactgcactccagcccgggcaa

SEQ ID NO: 8417395 - DNA, 22 bp, Homo sapiens
cactgcactccagcccgggcaa

SEQ ID NO: 8417396 - DNA, 22 bp, Homo sapiens
cactgcactccatcctgggaaa

SEQ ID NO: 8417397 - DNA, 22 bp, Homo sapiens
cactgcactccatcctgggaaa

SEQ ID NO: 8417398 - DNA, 22 bp, Homo sapiens
agcattttctgagagtatagat

SEQ ID NO: 8417399 - DNA, 19 bp, Homo sapiens
agcatttggaattctacac

SEQ ID NO: 8417400 - DNA, 19 bp, Homo sapiens
cactttgctgaactcttct

SEQ ID NO: 8417401 - DNA, 22 bp, Homo sapiens
cactggtcagtcggtcagtctc

SEQ ID NO: 8417402 - DNA, 22 bp, Homo sapiens
agccaacaactctgagcccagt

SEQ ID NO: 8417403 - DNA, 22 bp, Homo sapiens
agccaacagccagcatcaacca

SEQ ID NO: 8417404 - DNA, 22 bp, Homo sapiens
caaggaagttttaggagaggaa

SEQ ID NO: 8417405 - DNA, 22 bp, Homo sapiens
caaggaaggagagatgatgggt

SEQ ID NO: 8417406 - DNA, 21 bp, Homo sapiens
agcagacagatgcacgcacac

SEQ ID NO: 8417407 - DNA, 22 bp, Homo sapiens
agcagacatatctcatgtcaca

SEQ ID NO: 8417408 - DNA, 22 bp, Homo sapiens
agcagacatatctcatgtcaca

SEQ ID NO: 8417409 - DNA, 22 bp, Homo sapiens
caagggaaggctaagggcaaca

SEQ ID NO: 8417410 - DNA, 22 bp, Homo sapiens
caaggcattgtgtaagcacttg

SEQ ID NO: 8417411 - DNA, 22 bp, Homo sapiens
caagcttgtttctcctgggggt

SEQ ID NO: 8417412 - DNA, 22 bp, Homo sapiens
caagcttgtttctcctgggggt

SEQ ID NO: 8417413 - DNA, 22 bp, Homo sapiens
caagggctcaaacggtggttgc

SEQ ID NO: 8417414 - DNA, 22 bp, Homo sapiens
caagggcttcaagtggccaaga

SEQ ID NO: 8417415 - DNA, 22 bp, Homo sapiens
caagggctctaagtcacaagat

SEQ ID NO: 8417416 - DNA, 22 bp, Homo sapiens
caagtccatcctactgccttct

SEQ ID NO: 8417417 - DNA, 22 bp, Homo sapiens
caagtccaagatcaagaagcca

SEQ ID NO: 8417418 - DNA, 22 bp, Homo sapiens
caatgattgctatttacataaa

SEQ ID NO: 8417419 - DNA, 22 bp, Homo sapiens
caattatatttagaatgataca

SEQ ID NO: 8417420 - DNA, 22 bp, Homo sapiens
cacacatgacccacttttaccg

SEQ ID NO: 8417421 - DNA, 22 bp, Homo sapiens
caatttctctttatatctcaca

SEQ ID NO: 8417422 - DNA, 22 bp, Homo sapiens
caatttctctttatatctcaca

SEQ ID NO: 8417423 - DNA, 22 bp, Homo sapiens
caatttctgggcctcacacaag

SEQ ID NO: 8417424 - DNA, 22 bp, Homo sapiens
caatttctgggcctcacacaag

SEQ ID NO: 8417425 - DNA, 22 bp, Homo sapiens
caatttctggaactaattctga

SEQ ID NO: 8417426 - DNA, 22 bp, Homo sapiens
caatttcttgttaattctcagg

SEQ ID NO: 8417427 - DNA, 22 bp, Homo sapiens
caatttcttgttaattctcagg

SEQ ID NO: 8417428 - DNA, 18 bp, Homo sapiens
caattttacccagtccct

SEQ ID NO: 8417429 - DNA, 22 bp, Homo sapiens
caattttactcttcctcttcca

SEQ ID NO: 8417430 - DNA, 22 bp, Homo sapiens
caattttattggtccaaataca

SEQ ID NO: 8417431 - DNA, 22 bp, Homo sapiens
agcccttagtacatttctcaag

SEQ ID NO: 8417432 - DNA, 22 bp, Homo sapiens
cagatatgtggattctattagc

SEQ ID NO: 8417433 - DNA, 22 bp, Homo sapiens
agcctattccaggatgagctca

SEQ ID NO: 8417434 - DNA, 22 bp, Homo sapiens
agcctggaattaaggaaatgca

SEQ ID NO: 8417435 - DNA, 22 bp, Homo sapiens
cagagtggcgaccccctcagct

SEQ ID NO: 8417436 - DNA, 22 bp, Homo sapiens
agccaagaggagcctaaagcga

SEQ ID NO: 8417437 - DNA, 20 bp, Homo sapiens
agccaagaacaggcagaacc

SEQ ID NO: 8417438 - DNA, 22 bp, Homo sapiens
cagagcagtctggagatccagc

SEQ ID NO: 8417439 - DNA, 22 bp, Homo sapiens
agcgccactgcactccagcctg

SEQ ID NO: 8417440 - DNA, 22 bp, Homo sapiens
agcgagggaggtctgaggacag

SEQ ID NO: 8417441 - DNA, 22 bp, Homo sapiens
agcgccactgcactccagcctg

SEQ ID NO: 8417442 - DNA, 22 bp, Homo sapiens
cagcactttgagggctcttaat

SEQ ID NO: 8417443 - DNA, 22 bp, Homo sapiens
cagcactgttcccagaccactg

SEQ ID NO: 8417444 - DNA, 22 bp, Homo sapiens
cagcacttcaatgagcatttca

SEQ ID NO: 8417445 - DNA, 22 bp, Homo sapiens
cagcacttcagcattcagattt

SEQ ID NO: 8417446 - DNA, 22 bp, Homo sapiens
agatacaactgtttaaacatta

SEQ ID NO: 8417447 - DNA, 22 bp, Homo sapiens
agataaattcctaagatttcag

SEQ ID NO: 8417448 - DNA, 22 bp, Homo sapiens
agatacaaaagataagatttag

SEQ ID NO: 8417449 - DNA, 22 bp, Homo sapiens
attgtataagtctatttacaat

SEQ ID NO: 8417450 - DNA, 22 bp, Homo sapiens
attgagctgttttgtaggataa

SEQ ID NO: 8417451 - DNA, 18 bp, Homo sapiens
attgagcatgacagacct

SEQ ID NO: 8417452 - DNA, 22 bp, Homo sapiens
attgagaatgcaatctactatg

SEQ ID NO: 8417453 - DNA, 22 bp, Homo sapiens
attgaaaatataattctaggag

SEQ ID NO: 8417454 - DNA, 22 bp, Homo sapiens
attgaaaaatgactattgctta

SEQ ID NO: 8417455 - DNA, 22 bp, Homo sapiens
attgaaaaattcacaattctgg

SEQ ID NO: 8417456 - DNA, 22 bp, Homo sapiens
attgagaagaaaatctaatata

SEQ ID NO: 8417457 - DNA, 22 bp, Homo sapiens
attattttatgtgcggcctgat

SEQ ID NO: 8417458 - DNA, 22 bp, Homo sapiens
attatttctcactcacataata

SEQ ID NO: 8417459 - DNA, 22 bp, Homo sapiens
agaggccggccgagcccatggg

SEQ ID NO: 8417460 - DNA, 22 bp, Homo sapiens
attcttctgcctactttcatcc

SEQ ID NO: 8417461 - DNA, 22 bp, Homo sapiens
attctaacacatgctctaagaa

SEQ ID NO: 8417462 - DNA, 22 bp, Homo sapiens
attctaaatgtaatttagaatt

SEQ ID NO: 8417463 - DNA, 20 bp, Homo sapiens
attctaaagctctgctcttt

SEQ ID NO: 8417464 - DNA, 22 bp, Homo sapiens
attcaaactgtgttaggcagca

SEQ ID NO: 8417465 - DNA, 22 bp, Homo sapiens
attcgcacattaacactcatat

SEQ ID NO: 8417466 - DNA, 22 bp, Homo sapiens
attcaaacaggaagaaatcatt

SEQ ID NO: 8417467 - DNA, 22 bp, Homo sapiens
attcaaaagaccatgcagactc

SEQ ID NO: 8417468 - DNA, 22 bp, Homo sapiens
attcaaacactttgagaagttc

SEQ ID NO: 8417469 - DNA, 22 bp, Homo sapiens
agatttaaagcagtattcgcaa

SEQ ID NO: 8417470 - DNA, 22 bp, Homo sapiens
agatttatgtggtcacactcag

SEQ ID NO: 8417471 - DNA, 22 bp, Homo sapiens
agatgatatactacatggcttc

SEQ ID NO: 8417472 - DNA, 22 bp, Homo sapiens
atttacaggtagaattttaagt

SEQ ID NO: 8417473 - DNA, 23 bp, Homo sapiens
atttacagctgtgtgagcaagtt

SEQ ID NO: 8417474 - DNA, 23 bp, Homo sapiens
agcaatgctgggagactctgtaa

SEQ ID NO: 8417475 - DNA, 22 bp, Homo sapiens
caaataattactatcctcactt

SEQ ID NO: 8417476 - DNA, 22 bp, Homo sapiens
caaacattttaaataagggata

SEQ ID NO: 8417477 - DNA, 22 bp, Homo sapiens
agcaatatgacattgctacatc

SEQ ID NO: 8417478 - DNA, 22 bp, Homo sapiens
agcaatcaccacctctatattt

SEQ ID NO: 8417479 - DNA, 23 bp, Homo sapiens
agcaataagaagggatacatgtg

SEQ ID NO: 8417480 - DNA, 23 bp, Homo sapiens
agcaataagaagggatacatgtg

SEQ ID NO: 8417481 - DNA, 22 bp, Homo sapiens
attttttatataccaaggtggg

SEQ ID NO: 8417482 - DNA, 22 bp, Homo sapiens
agagactgcgtgtcagcgctgg

SEQ ID NO: 8417483 - DNA, 22 bp, Homo sapiens
atgtgcaaatccaatgtgaatg

SEQ ID NO: 8417484 - DNA, 22 bp, Homo sapiens
atgtgcattaaatgtcaatgtt

SEQ ID NO: 8417485 - DNA, 22 bp, Homo sapiens
atgttattttggaaaatacaaa

SEQ ID NO: 8417486 - DNA, 22 bp, Homo sapiens
atgttacagaaagcaaagatga

SEQ ID NO: 8417487 - DNA, 22 bp, Homo sapiens
agagcctgttttgtgggagatg

SEQ ID NO: 8417488 - DNA, 22 bp, Homo sapiens
atgttctacagatggaaagggg

SEQ ID NO: 8417489 - DNA, 22 bp, Homo sapiens
attaagtgactaaagtaatgct

SEQ ID NO: 8417490 - DNA, 22 bp, Homo sapiens
attaagggccaatcctccagcc

SEQ ID NO: 8417491 - DNA, 22 bp, Homo sapiens
atgactttcctggcaaaagttg

SEQ ID NO: 8417492 - DNA, 22 bp, Homo sapiens
atgaggagctccttgaaatgag

SEQ ID NO: 8417493 - DNA, 22 bp, Homo sapiens
atgaggagctgttttaactgct

SEQ ID NO: 8417494 - DNA, 22 bp, Homo sapiens
atgaggaggccagtaagagcct

SEQ ID NO: 8417495 - DNA, 22 bp, Homo sapiens
atgaggagtcaaggagtcggag

SEQ ID NO: 8417496 - DNA, 22 bp, Homo sapiens
atgaggaggtcaggccttacaa

SEQ ID NO: 8417497 - DNA, 22 bp, Homo sapiens
atgaggagccctcatttaggtt

SEQ ID NO: 8417498 - DNA, 22 bp, Homo sapiens
atgaggagaccaaggcctgatg

SEQ ID NO: 8417499 - DNA, 22 bp, Homo sapiens
atgattgcagccctacagctgt

SEQ ID NO: 8417500 - DNA, 22 bp, Homo sapiens
atgatttctatataaacttaaa

SEQ ID NO: 8417501 - DNA, 22 bp, Homo sapiens
atgattttctgataaagaactg

SEQ ID NO: 8417502 - DNA, 22 bp, Homo sapiens
atgattctggggcaaaagctgg

SEQ ID NO: 8417503 - DNA, 22 bp, Homo sapiens
atgattgaaaatgacattgcca

SEQ ID NO: 8417504 - DNA, 22 bp, Homo sapiens
atgattcttttggatagatgat

SEQ ID NO: 8417505 - DNA, 22 bp, Homo sapiens
atgattgaaaatgacattgcca

SEQ ID NO: 8417506 - DNA, 21 bp, Homo sapiens
atgattctgcaaatgagtagt

SEQ ID NO: 8417507 - DNA, 22 bp, Homo sapiens
atgattctcattttataaactt

SEQ ID NO: 8417508 - DNA, 22 bp, Homo sapiens
atcttacagcagcaaggaagta

SEQ ID NO: 8417509 - DNA, 22 bp, Homo sapiens
atgacaatacttcaataagctg

SEQ ID NO: 8417510 - DNA, 22 bp, Homo sapiens
atcttagagagtcgtgttttgt

SEQ ID NO: 8417511 - DNA, 22 bp, Homo sapiens
atcttagaagtttgataaaatc

SEQ ID NO: 8417512 - DNA, 22 bp, Homo sapiens
atgacaatatagctttgatttt

SEQ ID NO: 8417513 - DNA, 22 bp, Homo sapiens
atgaccaagagtccaggtcaag

SEQ ID NO: 8417514 - DNA, 22 bp, Homo sapiens
atgcaacaaatgctacgaatcg

SEQ ID NO: 8417515 - DNA, 22 bp, Homo sapiens
agacataggattccacatagca

SEQ ID NO: 8417516 - DNA, 23 bp, Homo sapiens
agacagtggccgagaggtactag

SEQ ID NO: 8417517 - DNA, 22 bp, Homo sapiens
agacatagggaggcatataaat

SEQ ID NO: 8417518 - DNA, 22 bp, Homo sapiens
atgctgagtgagtgaaacccag

SEQ ID NO: 8417519 - DNA, 22 bp, Homo sapiens
atgctgagcagagctgacatgc

SEQ ID NO: 8417520 - DNA, 18 bp, Homo sapiens
atgcttctgatagaagca

SEQ ID NO: 8417521 - DNA, 22 bp, Homo sapiens
atgcttccaaggctaagacaag

SEQ ID NO: 8417522 - DNA, 22 bp, Homo sapiens
atgcttcagtgctaccttcaaa

SEQ ID NO: 8417523 - DNA, 22 bp, Homo sapiens
atagctttttgtcatagagtct

SEQ ID NO: 8417524 - DNA, 22 bp, Homo sapiens
atagctttcttaaatatataaa

SEQ ID NO: 8417525 - DNA, 22 bp, Homo sapiens
atagtgttacccttcttaaagt

SEQ ID NO: 8417526 - DNA, 22 bp, Homo sapiens
agaaaaatcttggcgcttgtct

SEQ ID NO: 8417527 - DNA, 22 bp, Homo sapiens
atagaatagcatagaaaattga

SEQ ID NO: 8417528 - DNA, 22 bp, Homo sapiens
actttacaggcacttcaagtat

SEQ ID NO: 8417529 - DNA, 22 bp, Homo sapiens
agttcacattccgaggtactgg

SEQ ID NO: 8417530 - DNA, 22 bp, Homo sapiens
agttcacagggaaggttattgt

SEQ ID NO: 8417531 - DNA, 22 bp, Homo sapiens
agttcacatatctgttttattt

SEQ ID NO: 8417532 - DNA, 22 bp, Homo sapiens
agttcagcttcccaggtcactg

SEQ ID NO: 8417533 - DNA, 22 bp, Homo sapiens
agttgaataattagacatatct

SEQ ID NO: 8417534 - DNA, 22 bp, Homo sapiens
agttgcagacgcagagatgttg

SEQ ID NO: 8417535 - DNA, 22 bp, Homo sapiens
agttgcagacgcagagatgttg

SEQ ID NO: 8417536 - DNA, 22 bp, Homo sapiens
atacacgtgccatgttggtgtg

SEQ ID NO: 8417537 - DNA, 22 bp, Homo sapiens
atacacatttgctagagatggg

SEQ ID NO: 8417538 - DNA, 22 bp, Homo sapiens
atacaatcatcattatattccc

SEQ ID NO: 8417539 - DNA, 22 bp, Homo sapiens
atacaatccagccattgccaca

SEQ ID NO: 8417540 - DNA, 22 bp, Homo sapiens
atacaagttgtgataatgtaaa

SEQ ID NO: 8417541 - DNA, 22 bp, Homo sapiens
ataaggcagaaatgattctagt

SEQ ID NO: 8417542 - DNA, 22 bp, Homo sapiens
agaagccaaaggggccagatat

SEQ ID NO: 8417543 - DNA, 22 bp, Homo sapiens
agaagccattccctgtaggctc

SEQ ID NO: 8417544 - DNA, 22 bp, Homo sapiens
agaagctgcgtttatttaaatc

SEQ ID NO: 8417545 - DNA, 22 bp, Homo sapiens
agaagccatagtctgggaggca

SEQ ID NO: 8417546 - DNA, 22 bp, Homo sapiens
atcctgaggtactgcagggccg

SEQ ID NO: 8417547 - DNA, 22 bp, Homo sapiens
atcctgaggaaggtgcagagat

SEQ ID NO: 8417548 - DNA, 22 bp, Homo sapiens
atatagaaggtgctatttacat

SEQ ID NO: 8417549 - DNA, 22 bp, Homo sapiens
atatagaaggtgctatttacat

SEQ ID NO: 8417550 - DNA, 22 bp, Homo sapiens
atatagcacttgttttgcatgt

SEQ ID NO: 8417551 - DNA, 22 bp, Homo sapiens
atattaatgggatttagtcagg

SEQ ID NO: 8417552 - DNA, 22 bp, Homo sapiens
atattaatgagcaagtaagtga

SEQ ID NO: 8417553 - DNA, 18 bp, Homo sapiens
atcaaggaggggaaggtc

SEQ ID NO: 8417554 - DNA, 22 bp, Homo sapiens
atcaagttttcttagttgactg

SEQ ID NO: 8417555 - DNA, 18 bp, Homo sapiens
atcaaggaggggaaggtc

SEQ ID NO: 8417556 - DNA, 22 bp, Homo sapiens
atcaatatcagatcagacagga

SEQ ID NO: 8417557 - DNA, 22 bp, Homo sapiens
atcaattttgaggatacaagaa

SEQ ID NO: 8417558 - DNA, 22 bp, Homo sapiens
agaaatgcattagcacatatag

SEQ ID NO: 8417559 - DNA, 22 bp, Homo sapiens
agaaatgctcaggtcaacttaa

SEQ ID NO: 8417560 - DNA, 22 bp, Homo sapiens
atattacacacggtatcacggg

SEQ ID NO: 8417561 - DNA, 22 bp, Homo sapiens
atattaattatttacacatgag

SEQ ID NO: 8417562 - DNA, 22 bp, Homo sapiens
agtgatttgggtgtcagaaagt

SEQ ID NO: 8417563 - DNA, 22 bp, Homo sapiens
agtgcaatagcaaagaacaaca

SEQ ID NO: 8417564 - DNA, 22 bp, Homo sapiens
agtgtcttactccctcaggcac

SEQ ID NO: 8417565 - DNA, 22 bp, Homo sapiens
actggtaaattatgcgactttg

SEQ ID NO: 8417566 - DNA, 22 bp, Homo sapiens
actggtaacaatggaagcttct

SEQ ID NO: 8417567 - DNA, 22 bp, Homo sapiens
agttcaaactctataagaactt

SEQ ID NO: 8417568 - DNA, 22 bp, Homo sapiens
agttcaaagctgcagtaatgga

SEQ ID NO: 8417569 - DNA, 22 bp, Homo sapiens
aggtgcatgatgcagagtgcag

SEQ ID NO: 8417570 - DNA, 22 bp, Homo sapiens
agggcaccctctctgcagtacc

SEQ ID NO: 8417571 - DNA, 20 bp, Homo sapiens
accagagctctcagtatgtg

SEQ ID NO: 8417572 - DNA, 22 bp, Homo sapiens
agggctgacaaatggcagtgac

SEQ ID NO: 8417573 - DNA, 22 bp, Homo sapiens
agggctgaagggaggtgctcat

SEQ ID NO: 8417574 - DNA, 22 bp, Homo sapiens
aggggagcttgaggcatggcct

SEQ ID NO: 8417575 - DNA, 22 bp, Homo sapiens
acctcacaagtctctgtcagct

SEQ ID NO: 8417576 - DNA, 22 bp, Homo sapiens
agggtcagtgatgagggagccc

SEQ ID NO: 8417577 - DNA, 22 bp, Homo sapiens
acctcccagaaagttttgcagg

SEQ ID NO: 8417578 - DNA, 21 bp, Homo sapiens
acatgtctggtcatttttagc

SEQ ID NO: 8417579 - DNA, 22 bp, Homo sapiens
acatgtgtaaaagtggataaaa

SEQ ID NO: 8417580 - DNA, 22 bp, Homo sapiens
acattaaaaaatgttgcatgaa

SEQ ID NO: 8417581 - DNA, 22 bp, Homo sapiens
acattaaatttcatagtgatta

SEQ ID NO: 8417582 - DNA, 22 bp, Homo sapiens
aggctctctagaaactgtgcct

SEQ ID NO: 8417583 - DNA, 21 bp, Homo sapiens
aggctctcatccagggaccca

SEQ ID NO: 8417584 - DNA, 22 bp, Homo sapiens
aggctctggagtgtggtgctgg

SEQ ID NO: 8417585 - DNA, 22 bp, Homo sapiens
aggctctgacgtcacacgtggc

SEQ ID NO: 8417586 - DNA, 22 bp, Homo sapiens
accactgcccatggtgaaaact

SEQ ID NO: 8417587 - DNA, 22 bp, Homo sapiens
accactgcccatggtgaaaact

SEQ ID NO: 8417588 - DNA, 22 bp, Homo sapiens
accacttatcatcactatctca

SEQ ID NO: 8417589 - DNA, 22 bp, Homo sapiens
aggctgtgagttttgtctcaga

SEQ ID NO: 8417590 - DNA, 22 bp, Homo sapiens
aggctgtgagaggtggctccca

SEQ ID NO: 8417591 - DNA, 22 bp, Homo sapiens
aggctctggcaacagctggtgt

SEQ ID NO: 8417592 - DNA, 22 bp, Homo sapiens
aggctgctctgcgaagtcagct

SEQ ID NO: 8417593 - DNA, 22 bp, Homo sapiens
aggctgcttcaatggataagat

SEQ ID NO: 8417594 - DNA, 22 bp, Homo sapiens
acatttctcagggagttttgct

SEQ ID NO: 8417595 - DNA, 22 bp, Homo sapiens
aggctgctgccttggagagtgt

SEQ ID NO: 8417596 - DNA, 18 bp, Homo sapiens
acatttctccttctgacc

SEQ ID NO: 8417597 - DNA, 22 bp, Homo sapiens
acatttctcaggtaagtcattt

SEQ ID NO: 8417598 - DNA, 23 bp, Homo sapiens
acagggctagctgacagtggtat

SEQ ID NO: 8417599 - DNA, 22 bp, Homo sapiens
aggacacagtggtggggaaaag

SEQ ID NO: 8417600 - DNA, 22 bp, Homo sapiens
aggacagtccggggtcctccac

SEQ ID NO: 8417601 - DNA, 22 bp, Homo sapiens
aggacagtgtggaagagggtgc

SEQ ID NO: 8417602 - DNA, 22 bp, Homo sapiens
aggacagtggtgttctggagtg

SEQ ID NO: 8417603 - DNA, 19 bp, Homo sapiens
aggaaaggtggccttagca

SEQ ID NO: 8417604 - DNA, 22 bp, Homo sapiens
acaggcctggtgctgctgacag

SEQ ID NO: 8417605 - DNA, 22 bp, Homo sapiens
acaggccttggcaggcatgtga

SEQ ID NO: 8417606 - DNA, 18 bp, Homo sapiens
acaggctattgcaggaga

SEQ ID NO: 8417607 - DNA, 22 bp, Homo sapiens
acagcattgctccatctcaaga

SEQ ID NO: 8417608 - DNA, 22 bp, Homo sapiens
acaggcaagaggaaagcaagta

SEQ ID NO: 8417609 - DNA, 22 bp, Homo sapiens
agcttcttggctcagcacttgg

SEQ ID NO: 8417610 - DNA, 22 bp, Homo sapiens
acaggacaggctgggctagact

SEQ ID NO: 8417611 - DNA, 22 bp, Homo sapiens
acaggacttaagtcatttataa

SEQ ID NO: 8417612 - DNA, 22 bp, Homo sapiens
acaggactgtggaaggatctct

SEQ ID NO: 8417613 - DNA, 22 bp, Homo sapiens
acaggactgtggaaggatctct

SEQ ID NO: 8417614 - DNA, 22 bp, Homo sapiens
acaggacatgtaccaggtggtc

SEQ ID NO: 8417615 - DNA, 22 bp, Homo sapiens
acatctttatactagtccttga

SEQ ID NO: 8417616 - DNA, 22 bp, Homo sapiens
aggacttagaacattatgtact

SEQ ID NO: 8417617 - DNA, 22 bp, Homo sapiens
aggacttagaacattatgtact

SEQ ID NO: 8417618 - DNA, 19 bp, Homo sapiens
aggaggccatgccactaga

SEQ ID NO: 8417619 - DNA, 22 bp, Homo sapiens
acagtgcagggtgggaagaagg

SEQ ID NO: 8417620 - DNA, 22 bp, Homo sapiens
acagtgcagggcgggaagaagg

SEQ ID NO: 8417621 - DNA, 22 bp, Homo sapiens
aggcacagcacacctggccccc

SEQ ID NO: 8417622 - DNA, 22 bp, Homo sapiens
aggcaccttgagagcaggagct

SEQ ID NO: 8417623 - DNA, 22 bp, Homo sapiens
acagtgttcacttaacaatgga

SEQ ID NO: 8417624 - DNA, 22 bp, Homo sapiens
caggtgtataaactcagtgact

SEQ ID NO: 8417625 - DNA, 23 bp, Homo sapiens
aggaagttaaggcagacagacag

SEQ ID NO: 8417626 - DNA, 22 bp, Homo sapiens
aggaatcagaattcttagaatt

SEQ ID NO: 8417627 - DNA, 22 bp, Homo sapiens
cagtatctgtcagtaatcaggt

SEQ ID NO: 8417628 - DNA, 22 bp, Homo sapiens
cagtatttatggcttgagtatt

SEQ ID NO: 8417629 - DNA, 22 bp, Homo sapiens
cagtaacatttcaaggtagagg

SEQ ID NO: 8417630 - DNA, 22 bp, Homo sapiens
aggaagagctggaccagaggac

SEQ ID NO: 8417631 - DNA, 22 bp, Homo sapiens
caggactatgttcaacagatag

SEQ ID NO: 8417632 - DNA, 22 bp, Homo sapiens
caggactgatgttcctccagcc

SEQ ID NO: 8417633 - DNA, 22 bp, Homo sapiens
caggcagggagctggaaaggat

SEQ ID NO: 8417634 - DNA, 22 bp, Homo sapiens
agctgtctttctgcctcctgat

SEQ ID NO: 8417635 - DNA, 22 bp, Homo sapiens
ccacgtgtaggtggacaggatc

SEQ ID NO: 8417636 - DNA, 23 bp, Homo sapiens
ccactagcacctgttcaacttct

SEQ ID NO: 8417637 - DNA, 22 bp, Homo sapiens
ccacccagcagaggaggcaaga

SEQ ID NO: 8417638 - DNA, 22 bp, Homo sapiens
ccacccagccagatgcaggaag

SEQ ID NO: 8417639 - DNA, 22 bp, Homo sapiens
ccacccagaccagggatctggg

SEQ ID NO: 8417640 - DNA, 22 bp, Homo sapiens
ccacctgtgcttggtactccat

SEQ ID NO: 8417641 - DNA, 22 bp, Homo sapiens
ccaccattcaaggtcttcacag

SEQ ID NO: 8417642 - DNA, 19 bp, Homo sapiens
ccaccagtgtgatctaaga

SEQ ID NO: 8417643 - DNA, 22 bp, Homo sapiens
ccaatgatggtgcccacgatga

SEQ ID NO: 8417644 - DNA, 22 bp, Homo sapiens
catttcaatactatctgagaat

SEQ ID NO: 8417645 - DNA, 22 bp, Homo sapiens
catttcacacataaacttgggt

SEQ ID NO: 8417646 - DNA, 22 bp, Homo sapiens
catttcacaaatggccacatca

SEQ ID NO: 8417647 - DNA, 22 bp, Homo sapiens
catttcaagcattgacttctat

SEQ ID NO: 8417648 - DNA, 23 bp, Homo sapiens
catttcaacgaattttccttctg

SEQ ID NO: 8417649 - DNA, 21 bp, Homo sapiens
catttcaaagagctggaaatc

SEQ ID NO: 8417650 - DNA, 22 bp, Homo sapiens
catttattggttaggccagcag

SEQ ID NO: 8417651 - DNA, 22 bp, Homo sapiens
aggcaatcccctgaggatactt

SEQ ID NO: 8417652 - DNA, 22 bp, Homo sapiens
aggcaatcccctgaggatactt

SEQ ID NO: 8417653 - DNA, 23 bp, Homo sapiens
aggcaagaacgggttgttcaccc

SEQ ID NO: 8417654 - DNA, 22 bp, Homo sapiens
aggatgggtcagctagagtcca

SEQ ID NO: 8417655 - DNA, 22 bp, Homo sapiens
catgagagatccttcatgagag

SEQ ID NO: 8417656 - DNA, 19 bp, Homo sapiens
catacaattaccataggat

SEQ ID NO: 8417657 - DNA, 22 bp, Homo sapiens
catacaatcaagttctttatta

SEQ ID NO: 8417658 - DNA, 22 bp, Homo sapiens
catccaaactctcattatctgt

SEQ ID NO: 8417659 - DNA, 22 bp, Homo sapiens
catccaaactctcattatctgt

SEQ ID NO: 8417660 - DNA, 22 bp, Homo sapiens
catccaaagcaaatatcttaaa

SEQ ID NO: 8417661 - DNA, 22 bp, Homo sapiens
catccaaagcaaatatcttaaa

SEQ ID NO: 8417662 - DNA, 22 bp, Homo sapiens
cagtgtggctgagacagaggct

SEQ ID NO: 8417663 - DNA, 22 bp, Homo sapiens
cagtgtggctgagacagaggct

SEQ ID NO: 8417664 - DNA, 22 bp, Homo sapiens
cagtgtggcttagggaataggc

SEQ ID NO: 8417665 - DNA, 22 bp, Homo sapiens
cagtgtggagggagagagcctg

SEQ ID NO: 8417666 - DNA, 22 bp, Homo sapiens
cagtatttgttccctatcaatg

SEQ ID NO: 8417667 - DNA, 22 bp, Homo sapiens
cagtgtttaatcattgtgaatt

SEQ ID NO: 8417668 - DNA, 21 bp, Homo sapiens
cagtgtggtgaccagggtctc

SEQ ID NO: 8417669 - DNA, 22 bp, Homo sapiens
cagtgtggtgagattccaggtg

SEQ ID NO: 8417670 - DNA, 22 bp, Homo sapiens
cagtgtggtgtgcacagcttag

SEQ ID NO: 8417671 - DNA, 22 bp, Homo sapiens
agggctgacagtggcgtggcgt

SEQ ID NO: 8417672 - DNA, 22 bp, Homo sapiens
cctacattctctgagttttcct

SEQ ID NO: 8417673 - DNA, 20 bp, Homo sapiens
agggctgagaagggactagc

SEQ ID NO: 8417674 - DNA, 22 bp, Homo sapiens
agggctgagaatgacagggccg

SEQ ID NO: 8417675 - DNA, 22 bp, Homo sapiens
agggctgaggcgagggagatgc

SEQ ID NO: 8417676 - DNA, 22 bp, Homo sapiens
agggctgagcccaggcatgtag

SEQ ID NO: 8417677 - DNA, 22 bp, Homo sapiens
agggctgagactaaggccagat

SEQ ID NO: 8417678 - DNA, 22 bp, Homo sapiens
aggggaaggccagcctgtagag

SEQ ID NO: 8417679 - DNA, 22 bp, Homo sapiens
aggggaatgggtagactgttga

SEQ ID NO: 8417680 - DNA, 22 bp, Homo sapiens
agggcattggcacagatctgct

SEQ ID NO: 8417681 - DNA, 22 bp, Homo sapiens
cccaggcattttcaactttagt

SEQ ID NO: 8417682 - DNA, 22 bp, Homo sapiens
agggacccatagagagaccagt

SEQ ID NO: 8417683 - DNA, 22 bp, Homo sapiens
agggaccctgatgactgaggag

SEQ ID NO: 8417684 - DNA, 22 bp, Homo sapiens
agggacctgctcactgcctggc

SEQ ID NO: 8417685 - DNA, 22 bp, Homo sapiens
agggacctgtcaatgacagtta

SEQ ID NO: 8417686 - DNA, 22 bp, Homo sapiens
agggacctcatgtaagtggatt

SEQ ID NO: 8417687 - DNA, 22 bp, Homo sapiens
agggacctcttcttgcagctga

SEQ ID NO: 8417688 - DNA, 22 bp, Homo sapiens
agggactatttacccatctcac

SEQ ID NO: 8417689 - DNA, 22 bp, Homo sapiens
agggaccttgatgggtttggga

SEQ ID NO: 8417690 - DNA, 23 bp, Homo sapiens
agggaaagtagtaatggcctttg

SEQ ID NO: 8417691 - DNA, 21 bp, Homo sapiens
agggaaagaaaatgagctaat

SEQ ID NO: 8417692 - DNA, 22 bp, Homo sapiens
aggcttggctggcagccctggg

SEQ ID NO: 8417693 - DNA, 22 bp, Homo sapiens
aggcttggctgcacgcctcgct

SEQ ID NO: 8417694 - DNA, 22 bp, Homo sapiens
aggcttggctctcctatgagaa

SEQ ID NO: 8417695 - DNA, 19 bp, Homo sapiens
aggcttggctagatttact

SEQ ID NO: 8417696 - DNA, 22 bp, Homo sapiens
ccaggcactggctgggttcttt

SEQ ID NO: 8417697 - DNA, 22 bp, Homo sapiens
aggctctgtatgaaggtttggg

SEQ ID NO: 8417698 - DNA, 22 bp, Homo sapiens
aggctctgggctctagattttg

SEQ ID NO: 8417699 - DNA, 22 bp, Homo sapiens
aggctctggttcatcatgatgg

SEQ ID NO: 8417700 - DNA, 22 bp, Homo sapiens
ccaggccttctgaggacactct

SEQ ID NO: 8417701 - DNA, 20 bp, Homo sapiens
ccaggcctgggcctgctcta

SEQ ID NO: 8417702 - DNA, 22 bp, Homo sapiens
ccaggcctcccttttccagcca

SEQ ID NO: 8417703 - DNA, 22 bp, Homo sapiens
ccaggcctgtgcaaggagggag

SEQ ID NO: 8417704 - DNA, 22 bp, Homo sapiens
ccaggccttccagtacgcagaa

SEQ ID NO: 8417705 - DNA, 22 bp, Homo sapiens
aggctgtgggagttgagagtct

SEQ ID NO: 8417706 - DNA, 22 bp, Homo sapiens
aggctgtgggaatggctgcttg

SEQ ID NO: 8417707 - DNA, 22 bp, Homo sapiens
aggctgtgcgaggtctcagagt

SEQ ID NO: 8417708 - DNA, 22 bp, Homo sapiens
aggctgtgctcagccaatggga

SEQ ID NO: 8417709 - DNA, 22 bp, Homo sapiens
aggctgtggccctggtctagca

SEQ ID NO: 8417710 - DNA, 22 bp, Homo sapiens
aggctgtggcatcacatcagga

SEQ ID NO: 8417711 - DNA, 22 bp, Homo sapiens
aggctgtggtgctgaaggaggg

SEQ ID NO: 8417712 - DNA, 22 bp, Homo sapiens
cccacacactggctgctgccaa

SEQ ID NO: 8417713 - DNA, 22 bp, Homo sapiens
cccacacacatttatgatagga

SEQ ID NO: 8417714 - DNA, 22 bp, Homo sapiens
cccacacatttttcacttaccg

SEQ ID NO: 8417715 - DNA, 22 bp, Homo sapiens
cccacacatttttcacttaccg

SEQ ID NO: 8417716 - DNA, 18 bp, Homo sapiens
cccacacagcagtagctc

SEQ ID NO: 8417717 - DNA, 22 bp, Homo sapiens
ccattttctgcagctgccgcgg

SEQ ID NO: 8417718 - DNA, 22 bp, Homo sapiens
ataaatggctttcattcctagg

SEQ ID NO: 8417719 - DNA, 22 bp, Homo sapiens
ataaatgcctcagaatcatccc

SEQ ID NO: 8417720 - DNA, 22 bp, Homo sapiens
ataaatgattcagcaggaaata

SEQ ID NO: 8417721 - DNA, 22 bp, Homo sapiens
atacaaatttatagatgcattt

SEQ ID NO: 8417722 - DNA, 22 bp, Homo sapiens
atacaactgctctcagataagt

SEQ ID NO: 8417723 - DNA, 22 bp, Homo sapiens
ctgaggagcagctggcccgcta

SEQ ID NO: 8417724 - DNA, 22 bp, Homo sapiens
ctgaggagcaaccccgtgccct

SEQ ID NO: 8417725 - DNA, 22 bp, Homo sapiens
ctgaggagatgataatgtcatt

SEQ ID NO: 8417726 - DNA, 22 bp, Homo sapiens
ctgaggagatgggctttttagg

SEQ ID NO: 8417727 - DNA, 22 bp, Homo sapiens
ctgaggagatccccccagaagt

SEQ ID NO: 8417728 - DNA, 22 bp, Homo sapiens
ctgaggagctgaaggccctcca

SEQ ID NO: 8417729 - DNA, 22 bp, Homo sapiens
ctgaggagcgttggtcacgtgt

SEQ ID NO: 8417730 - DNA, 22 bp, Homo sapiens
ctgaggagccccctctcagcat

SEQ ID NO: 8417731 - DNA, 22 bp, Homo sapiens
agttatttaaaatgattgtcct

SEQ ID NO: 8417732 - DNA, 20 bp, Homo sapiens
ctgcagggtgagtgggcgat

SEQ ID NO: 8417733 - DNA, 20 bp, Homo sapiens
ctgcagggttagaggctcca

SEQ ID NO: 8417734 - DNA, 22 bp, Homo sapiens
ctgcagggtgacgttgcccacc

SEQ ID NO: 8417735 - DNA, 22 bp, Homo sapiens
ctgcagggtttttcaaggacaa

SEQ ID NO: 8417736 - DNA, 22 bp, Homo sapiens
atacattcagcagtgctcatga

SEQ ID NO: 8417737 - DNA, 21 bp, Homo sapiens
atacattctattaagcattta

SEQ ID NO: 8417738 - DNA, 22 bp, Homo sapiens
atacatacatgtacacataaat

SEQ ID NO: 8417739 - DNA, 22 bp, Homo sapiens
atacagtaaccacattctatag

SEQ ID NO: 8417740 - DNA, 19 bp, Homo sapiens
atagagacagagtttaatc

SEQ ID NO: 8417741 - DNA, 22 bp, Homo sapiens
atactacaatcataattgtaca

SEQ ID NO: 8417742 - DNA, 22 bp, Homo sapiens
atactacacattgactatattt

SEQ ID NO: 8417743 - DNA, 22 bp, Homo sapiens
atactacactatgcatggatgt

SEQ ID NO: 8417744 - DNA, 22 bp, Homo sapiens
atagcaaaaggcaccagagtga

SEQ ID NO: 8417745 - DNA, 22 bp, Homo sapiens
atagcacaatattacctttatg

SEQ ID NO: 8417746 - DNA, 22 bp, Homo sapiens
atagcactggtttttcttggtt

SEQ ID NO: 8417747 - DNA, 22 bp, Homo sapiens
atagcacttattgtatgctgag

SEQ ID NO: 8417748 - DNA, 22 bp, Homo sapiens
atagcacttatagatttggtct

SEQ ID NO: 8417749 - DNA, 22 bp, Homo sapiens
atagcaaggtatgactggagcc

SEQ ID NO: 8417750 - DNA, 22 bp, Homo sapiens
atagcaacaccccaattttcta

SEQ ID NO: 8417751 - DNA, 22 bp, Homo sapiens
atagcaaatattttaatgagca

SEQ ID NO: 8417752 - DNA, 22 bp, Homo sapiens
ctgggctcagatgagaggaagg

SEQ ID NO: 8417753 - DNA, 22 bp, Homo sapiens
atattataagttatttcaagtt

SEQ ID NO: 8417754 - DNA, 22 bp, Homo sapiens
atattaggttggtgcaaaagta

SEQ ID NO: 8417755 - DNA, 22 bp, Homo sapiens
atattaggcaaggagattattt

SEQ ID NO: 8417756 - DNA, 23 bp, Homo sapiens
atattagggagattagccctcta

SEQ ID NO: 8417757 - DNA, 22 bp, Homo sapiens
atattagggtctctaaattcta

SEQ ID NO: 8417758 - DNA, 22 bp, Homo sapiens
atattaggtgctcaatacatgc

SEQ ID NO: 8417759 - DNA, 22 bp, Homo sapiens
atattacataaacatgagtgaa

SEQ ID NO: 8417760 - DNA, 22 bp, Homo sapiens
atattacttcctggtataaaat

SEQ ID NO: 8417761 - DNA, 22 bp, Homo sapiens
atattaggagttaaatgtatta

SEQ ID NO: 8417762 - DNA, 22 bp, Homo sapiens
atatgcatttacctggcatata

SEQ ID NO: 8417763 - DNA, 22 bp, Homo sapiens
atatgcatgtacgtgtgcacaa

SEQ ID NO: 8417764 - DNA, 22 bp, Homo sapiens
atcaaaatggaagaatttggct

SEQ ID NO: 8417765 - DNA, 22 bp, Homo sapiens
atcaaataaaggtacctagctt

SEQ ID NO: 8417766 - DNA, 22 bp, Homo sapiens
atcaaatacaaagggcataagg

SEQ ID NO: 8417767 - DNA, 22 bp, Homo sapiens
atcaaatataataattttcgct

SEQ ID NO: 8417768 - DNA, 23 bp, Homo sapiens
ctgtggccctgcttcatgcagcc

SEQ ID NO: 8417769 - DNA, 22 bp, Homo sapiens
ctgtggccctgtgatctggcac

SEQ ID NO: 8417770 - DNA, 21 bp, Homo sapiens
ctgtggcctggctagcaccgt

SEQ ID NO: 8417771 - DNA, 22 bp, Homo sapiens
atcagagaaatggagggcgctt

SEQ ID NO: 8417772 - DNA, 22 bp, Homo sapiens
atcagagaagtttcactggcat

SEQ ID NO: 8417773 - DNA, 22 bp, Homo sapiens
atcagagaccggtcaagtcatg

SEQ ID NO: 8417774 - DNA, 22 bp, Homo sapiens
atcagagacaaaaccagcactt

SEQ ID NO: 8417775 - DNA, 22 bp, Homo sapiens
atcagagattgtagtatgtgca

SEQ ID NO: 8417776 - DNA, 22 bp, Homo sapiens
atcagagatggctccagtgctc

SEQ ID NO: 8417777 - DNA, 22 bp, Homo sapiens
ctgtggctcagcacggggtcag

SEQ ID NO: 8417778 - DNA, 22 bp, Homo sapiens
ctgtggcttttccggggagcct

SEQ ID NO: 8417779 - DNA, 22 bp, Homo sapiens
ctgtgtgctgttagggagctgc

SEQ ID NO: 8417780 - DNA, 22 bp, Homo sapiens
atccagttaagatgaggtcata

SEQ ID NO: 8417781 - DNA, 22 bp, Homo sapiens
atccagttcttggaagcacagg

SEQ ID NO: 8417782 - DNA, 22 bp, Homo sapiens
atccagttccaaagatcattta

SEQ ID NO: 8417783 - DNA, 22 bp, Homo sapiens
atccaccctgtggtggctttct

SEQ ID NO: 8417784 - DNA, 22 bp, Homo sapiens
cttagatgaagtcacagaaccc

SEQ ID NO: 8417785 - DNA, 22 bp, Homo sapiens
cttagatacagtagaaagactc

SEQ ID NO: 8417786 - DNA, 22 bp, Homo sapiens
cttcattaatgtctataagttt

SEQ ID NO: 8417787 - DNA, 22 bp, Homo sapiens
atcctgtgcaatgactgcatct

SEQ ID NO: 8417788 - DNA, 22 bp, Homo sapiens
atctgcatcagactttgcatga

SEQ ID NO: 8417789 - DNA, 23 bp, Homo sapiens
atctgaaaagcatttgcagtttg

SEQ ID NO: 8417790 - DNA, 22 bp, Homo sapiens
atctgaaaagctttaatgagct

SEQ ID NO: 8417791 - DNA, 22 bp, Homo sapiens
atctgaataaatttcttttagt

SEQ ID NO: 8417792 - DNA, 18 bp, Homo sapiens
ctccagggaactcagtca

SEQ ID NO: 8417793 - DNA, 22 bp, Homo sapiens
ctcctacattccaccttggact

SEQ ID NO: 8417794 - DNA, 22 bp, Homo sapiens
ctcctacacatagatgctttca

SEQ ID NO: 8417795 - DNA, 22 bp, Homo sapiens
ctcctacagtgtttgagtccag

SEQ ID NO: 8417796 - DNA, 22 bp, Homo sapiens
ctcctacataacccagcgaact

SEQ ID NO: 8417797 - DNA, 22 bp, Homo sapiens
ctcatgtcttcacccattctaa

SEQ ID NO: 8417798 - DNA, 22 bp, Homo sapiens
ctcattaaaggaaatcacctgc

SEQ ID NO: 8417799 - DNA, 22 bp, Homo sapiens
agtcctctgctgtgcgtctttg

SEQ ID NO: 8417800 - DNA, 22 bp, Homo sapiens
agtccggggtctggacacctgg

SEQ ID NO: 8417801 - DNA, 22 bp, Homo sapiens
agtccggggtctggacacctgg

SEQ ID NO: 8417802 - DNA, 22 bp, Homo sapiens
agtcccttctcaaagtgtgcgg

SEQ ID NO: 8417803 - DNA, 22 bp, Homo sapiens
ctccaggctcgtccaagatcga

SEQ ID NO: 8417804 - DNA, 22 bp, Homo sapiens
ctccaggaaagcctgaggcccg

SEQ ID NO: 8417805 - DNA, 22 bp, Homo sapiens
agttatataactatctagatgc

SEQ ID NO: 8417806 - DNA, 22 bp, Homo sapiens
ctgaggagaggtggcctgtgtt

SEQ ID NO: 8417807 - DNA, 22 bp, Homo sapiens
ctgaggagaccatcaactaatt

SEQ ID NO: 8417808 - DNA, 22 bp, Homo sapiens
ctgaggagagatcacgtggtgt

SEQ ID NO: 8417809 - DNA, 22 bp, Homo sapiens
ctgaggagaacaatgagatcaa

SEQ ID NO: 8417810 - DNA, 22 bp, Homo sapiens
ctgaggagacagaagccaaata

SEQ ID NO: 8417811 - DNA, 17 bp, Homo sapiens
ctgaggagaacagaaag

SEQ ID NO: 8417812 - DNA, 18 bp, Homo sapiens
agtgtctggatatttggg

SEQ ID NO: 8417813 - DNA, 22 bp, Homo sapiens
ctctgcaggcacccagggtggg

SEQ ID NO: 8417814 - DNA, 21 bp, Homo sapiens
cctgtgccaaagtgtgttagg

SEQ ID NO: 8417815 - DNA, 22 bp, Homo sapiens
cctgtgccagccccttctgctg

SEQ ID NO: 8417816 - DNA, 22 bp, Homo sapiens
cctgtgaccactctggttctgc

SEQ ID NO: 8417817 - DNA, 22 bp, Homo sapiens
cctgtgacattagaatttcatt

SEQ ID NO: 8417818 - DNA, 19 bp, Homo sapiens
cctgtgactatctttgtaa

SEQ ID NO: 8417819 - DNA, 22 bp, Homo sapiens
cctgtgacccttccagtctact

SEQ ID NO: 8417820 - DNA, 22 bp, Homo sapiens
cctgtgacgtgtctcctggcac

SEQ ID NO: 8417821 - DNA, 22 bp, Homo sapiens
cctgtgacttggcaaacctcca

SEQ ID NO: 8417822 - DNA, 22 bp, Homo sapiens
cctgtgactctgtctgatggtc

SEQ ID NO: 8417823 - DNA, 19 bp, Homo sapiens
aggtcctcaggatgaccct

SEQ ID NO: 8417824 - DNA, 22 bp, Homo sapiens
ctaaggaaaggaaatacagtaa

SEQ ID NO: 8417825 - DNA, 22 bp, Homo sapiens
agtatgcatatttcaaagtaag

SEQ ID NO: 8417826 - DNA, 22 bp, Homo sapiens
ctacccagcacctaggctgcct

SEQ ID NO: 8417827 - DNA, 22 bp, Homo sapiens
agtccagtgtgttctggcagca

SEQ ID NO: 8417828 - DNA, 22 bp, Homo sapiens
agtccagtgtcaaggtgccatt

SEQ ID NO: 8417829 - DNA, 22 bp, Homo sapiens
agtccagtctcactcttggcag

SEQ ID NO: 8417830 - DNA, 22 bp, Homo sapiens
agtccaataacctctttccttc

SEQ ID NO: 8417831 - DNA, 18 bp, Homo sapiens
agtccatgcatggctata

SEQ ID NO: 8417832 - DNA, 22 bp, Homo sapiens
ctagggtcaggggcctgcgtcg

SEQ ID NO: 8417833 - DNA, 20 bp, Homo sapiens
agtacaatgtatgattcaga

SEQ ID NO: 8417834 - DNA, 22 bp, Homo sapiens
cgggctccgggtctttgcagtc

SEQ ID NO: 8417835 - DNA, 17 bp, Homo sapiens
cgggcatggagggcagg

SEQ ID NO: 8417836 - DNA, 22 bp, Homo sapiens
agtacacaagacacatttaaaa

SEQ ID NO: 8417837 - DNA, 22 bp, Homo sapiens
agtacacaagacacatttaaaa

SEQ ID NO: 8417838 - DNA, 22 bp, Homo sapiens
agtacaatgtctgacacagtag

SEQ ID NO: 8417839 - DNA, 22 bp, Homo sapiens
ctaagacatgccctgcatgata

SEQ ID NO: 8417840 - DNA, 19 bp, Homo sapiens
cctgttcttggctgaggct

SEQ ID NO: 8417841 - DNA, 22 bp, Homo sapiens
cctgttcaccctccatgcacag

SEQ ID NO: 8417842 - DNA, 22 bp, Homo sapiens
cctgttcagagctaagcatcat

SEQ ID NO: 8417843 - DNA, 22 bp, Homo sapiens
cctgttcaccatggtcacgtgc

SEQ ID NO: 8417844 - DNA, 22 bp, Homo sapiens
cctgtgttagttatgggtctct

SEQ ID NO: 8417845 - DNA, 22 bp, Homo sapiens
cacacaggaaaattggaattaa

SEQ ID NO: 8417846 - DNA, 22 bp, Homo sapiens
cacagacagtgtccctttgttg

SEQ ID NO: 8417847 - DNA, 22 bp, Homo sapiens
cacaggctgggaagcctaggcc

SEQ ID NO: 8417848 - DNA, 22 bp, Homo sapiens
cacaggcttccagtccccagct

SEQ ID NO: 8417849 - DNA, 18 bp, Homo sapiens
gctttgcactcatgttgt

SEQ ID NO: 8417850 - DNA, 22 bp, Homo sapiens
gctttgctagcactgcgcttcc

SEQ ID NO: 8417851 - DNA, 22 bp, Homo sapiens
gctttcttggttctgcaggggc

SEQ ID NO: 8417852 - DNA, 22 bp, Homo sapiens
caataaagaagatttttgcaat

SEQ ID NO: 8417853 - DNA, 22 bp, Homo sapiens
caataactgctaaattccctgt

SEQ ID NO: 8417854 - DNA, 19 bp, Homo sapiens
gctgttctgaccatcaccc

SEQ ID NO: 8417855 - DNA, 22 bp, Homo sapiens
caagtttaaggcactgataagt

SEQ ID NO: 8417856 - DNA, 22 bp, Homo sapiens
gctgtggcgattggtatcgatt

SEQ ID NO: 8417857 - DNA, 22 bp, Homo sapiens
caaggtgccatgctgggcgggg

SEQ ID NO: 8417858 - DNA, 22 bp, Homo sapiens
caagtatgagaaagctattacc

SEQ ID NO: 8417859 - DNA, 22 bp, Homo sapiens
gctggaggatggactggaagaa

SEQ ID NO: 8417860 - DNA, 22 bp, Homo sapiens
gctggaggatcacttgagccca

SEQ ID NO: 8417861 - DNA, 22 bp, Homo sapiens
gctggaggaggaagtgtgaggg

SEQ ID NO: 8417862 - DNA, 22 bp, Homo sapiens
caagatttaagagtcagccttg

SEQ ID NO: 8417863 - DNA, 22 bp, Homo sapiens
gctggaggctggagtgcagtgg

SEQ ID NO: 8417864 - DNA, 22 bp, Homo sapiens
gctggaggcagttcagacacca

SEQ ID NO: 8417865 - DNA, 22 bp, Homo sapiens
ggcagggagtggagactcccta

SEQ ID NO: 8417866 - DNA, 22 bp, Homo sapiens
cacctgtacagggccgggctgg

SEQ ID NO: 8417867 - DNA, 22 bp, Homo sapiens
ggccgctgcgcctccaaccgag

SEQ ID NO: 8417868 - DNA, 20 bp, Homo sapiens
caccttcaaatttcctggca

SEQ ID NO: 8417869 - DNA, 22 bp, Homo sapiens
ggccactgtcctctagcccaga

SEQ ID NO: 8417870 - DNA, 22 bp, Homo sapiens
ggccactgctctccagcctggg

SEQ ID NO: 8417871 - DNA, 22 bp, Homo sapiens
ggccactgccctggctacaccg

SEQ ID NO: 8417872 - DNA, 22 bp, Homo sapiens
ggccactgacctacatctgggg

SEQ ID NO: 8417873 - DNA, 22 bp, Homo sapiens
ggccactgcctccgccatggct

SEQ ID NO: 8417874 - DNA, 22 bp, Homo sapiens
ggcaggcaggtcttcatggccc

SEQ ID NO: 8417875 - DNA, 22 bp, Homo sapiens
cacaggcttttttggctgatgt

SEQ ID NO: 8417876 - DNA, 22 bp, Homo sapiens
cacataataaatgttcctgatg

SEQ ID NO: 8417877 - DNA, 22 bp, Homo sapiens
cacataataaatgttcctgatg

SEQ ID NO: 8417878 - DNA, 22 bp, Homo sapiens
cacataatacatgttccactta

SEQ ID NO: 8417879 - DNA, 22 bp, Homo sapiens
cacataatcaccaagtcctttc

SEQ ID NO: 8417880 - DNA, 22 bp, Homo sapiens
cacataatcaccaagtcctttc

SEQ ID NO: 8417881 - DNA, 22 bp, Homo sapiens
cacataattgaacgtgatgagt

SEQ ID NO: 8417882 - DNA, 22 bp, Homo sapiens
ggctgttgacagacataggttt

SEQ ID NO: 8417883 - DNA, 21 bp, Homo sapiens
ggctggtgtttagctgtgata

SEQ ID NO: 8417884 - DNA, 22 bp, Homo sapiens
ggctctggtgggaaggttagat

SEQ ID NO: 8417885 - DNA, 22 bp, Homo sapiens
ggctctggtgccctggctccca

SEQ ID NO: 8417886 - DNA, 22 bp, Homo sapiens
cagagtcattgacttccaggag

SEQ ID NO: 8417887 - DNA, 22 bp, Homo sapiens
cagagtcatgggccgtcaggca

SEQ ID NO: 8417888 - DNA, 17 bp, Homo sapiens
cagagtctgtctgcatc

SEQ ID NO: 8417889 - DNA, 22 bp, Homo sapiens
cagagggctcggcggccgctcc

SEQ ID NO: 8417890 - DNA, 22 bp, Homo sapiens
ggtgagaaagggattcctgttc

SEQ ID NO: 8417891 - DNA, 22 bp, Homo sapiens
ggtctggaagcgcagtaggctg

SEQ ID NO: 8417892 - DNA, 22 bp, Homo sapiens
cagcacacagtgactcgcacct

SEQ ID NO: 8417893 - DNA, 22 bp, Homo sapiens
cagagctgcttcccagtttgtg

SEQ ID NO: 8417894 - DNA, 22 bp, Homo sapiens
gggctgactctgcactgagcca

SEQ ID NO: 8417895 - DNA, 22 bp, Homo sapiens
gggctgacgaaggccatgtgtg

SEQ ID NO: 8417896 - DNA, 22 bp, Homo sapiens
cagagcctcagaatcctgtgga

SEQ ID NO: 8417897 - DNA, 17 bp, Homo sapiens
gggctgacagtggcctc

SEQ ID NO: 8417898 - DNA, 22 bp, Homo sapiens
gggctgacagtttcccctgaaa

SEQ ID NO: 8417899 - DNA, 22 bp, Homo sapiens
gggctgaccaatgccttgcttt

SEQ ID NO: 8417900 - DNA, 22 bp, Homo sapiens
gggctgaccccacccctcactc

SEQ ID NO: 8417901 - DNA, 22 bp, Homo sapiens
gggctgacaccacccaggcgca

SEQ ID NO: 8417902 - DNA, 22 bp, Homo sapiens
cagagacaggatctcgaagact

SEQ ID NO: 8417903 - DNA, 22 bp, Homo sapiens
cagagacaggagtgctcccagt

SEQ ID NO: 8417904 - DNA, 22 bp, Homo sapiens
cagaccctgggccacagaggag

SEQ ID NO: 8417905 - DNA, 21 bp, Homo sapiens
cagaccctctagaggccacct

SEQ ID NO: 8417906 - DNA, 22 bp, Homo sapiens
ggcttaggtgtctctctgcacc

SEQ ID NO: 8417907 - DNA, 22 bp, Homo sapiens
ggcttatgtttgtcaagcaatc

SEQ ID NO: 8417908 - DNA, 22 bp, Homo sapiens
cagacagggtcctgtccgtcac

SEQ ID NO: 8417909 - DNA, 22 bp, Homo sapiens
gtcccaggctccatggcagcca

SEQ ID NO: 8417910 - DNA, 22 bp, Homo sapiens
gtctgtctccctgtgactgaga

SEQ ID NO: 8417911 - DNA, 22 bp, Homo sapiens
gtctgtctgttgttgagaagca

SEQ ID NO: 8417912 - DNA, 22 bp, Homo sapiens
gtcagcatagttcacacacagt

SEQ ID NO: 8417913 - DNA, 22 bp, Homo sapiens
cagcactaatcctgcaatttct

SEQ ID NO: 8417914 - DNA, 22 bp, Homo sapiens
cagcactaggatatacatttcc

SEQ ID NO: 8417915 - DNA, 22 bp, Homo sapiens
gtgcccagttgaggccaggact

SEQ ID NO: 8417916 - DNA, 22 bp, Homo sapiens
gtgccccagacacgcatgtggg

SEQ ID NO: 8417917 - DNA, 22 bp, Homo sapiens
gtgcccagtaaatgaaagcttt

SEQ ID NO: 8417918 - DNA, 22 bp, Homo sapiens
gtgcccagtcctgccttgacag

SEQ ID NO: 8417919 - DNA, 22 bp, Homo sapiens
gtgcccaggtgtccctgagaag

SEQ ID NO: 8417920 - DNA, 22 bp, Homo sapiens
atgggagaaacatcatgaggca

SEQ ID NO: 8417921 - DNA, 22 bp, Homo sapiens
atgggagaaacatcatgaggca

SEQ ID NO: 8417922 - DNA, 22 bp, Homo sapiens
atggggagagaagggctgagct

SEQ ID NO: 8417923 - DNA, 22 bp, Homo sapiens
atggcattatagcaatggtttg

SEQ ID NO: 8417924 - DNA, 22 bp, Homo sapiens
atggcttgttcattggtacctg

SEQ ID NO: 8417925 - DNA, 22 bp, Homo sapiens
atggcttgtctatgagtgctct

SEQ ID NO: 8417926 - DNA, 22 bp, Homo sapiens
atggcttgcttttagagagatc

SEQ ID NO: 8417927 - DNA, 22 bp, Homo sapiens
atggcttgatagaaagctagtt

SEQ ID NO: 8417928 - DNA, 22 bp, Homo sapiens
gagagcacggtcttgggcatgg

SEQ ID NO: 8417929 - DNA, 22 bp, Homo sapiens
gagacagtgtccatccaggggc

SEQ ID NO: 8417930 - DNA, 22 bp, Homo sapiens
gagacagtggttgcagaagctc

SEQ ID NO: 8417931 - DNA, 22 bp, Homo sapiens
atggaggatgtgcagcatgggc

SEQ ID NO: 8417932 - DNA, 22 bp, Homo sapiens
atggaggatgtgcagcatgggc

SEQ ID NO: 8417933 - DNA, 22 bp, Homo sapiens
atgtagcagatatttgtgcaca

SEQ ID NO: 8417934 - DNA, 22 bp, Homo sapiens
gaggcagcgggtcaggaccgtg

SEQ ID NO: 8417935 - DNA, 22 bp, Homo sapiens
atgtctctgccccagagagctt

SEQ ID NO: 8417936 - DNA, 22 bp, Homo sapiens
gagggctctactcaccaccctg

SEQ ID NO: 8417937 - DNA, 23 bp, Homo sapiens
gagggctctgagtgcttgggcca

SEQ ID NO: 8417938 - DNA, 22 bp, Homo sapiens
gagggctctgaaaggaggtcac

SEQ ID NO: 8417939 - DNA, 22 bp, Homo sapiens
gagggctctgtctggaagggaa

SEQ ID NO: 8417940 - DNA, 22 bp, Homo sapiens
gagggctcctcacattctctat

SEQ ID NO: 8417941 - DNA, 22 bp, Homo sapiens
gagggctcctcacattctctat

SEQ ID NO: 8417942 - DNA, 22 bp, Homo sapiens
gagggctccattccccgtgccc

SEQ ID NO: 8417943 - DNA, 22 bp, Homo sapiens
gagggctccattccccgtgccc

SEQ ID NO: 8417944 - DNA, 22 bp, Homo sapiens
gagggctctaccaagtaactct

SEQ ID NO: 8417945 - DNA, 20 bp, Homo sapiens
gagggctcgtggatggataa

SEQ ID NO: 8417946 - DNA, 22 bp, Homo sapiens
gagggctcactgagaaagcagt

SEQ ID NO: 8417947 - DNA, 22 bp, Homo sapiens
gagggctccacacgggcccagc

SEQ ID NO: 8417948 - DNA, 19 bp, Homo sapiens
gagggctcatttgaacaat

SEQ ID NO: 8417949 - DNA, 22 bp, Homo sapiens
gagggctcaactactactaggc

SEQ ID NO: 8417950 - DNA, 22 bp, Homo sapiens
atgtgaatgcagttatctataa

SEQ ID NO: 8417951 - DNA, 21 bp, Homo sapiens
atgtgaaatatcatcagagca

SEQ ID NO: 8417952 - DNA, 22 bp, Homo sapiens
gataatattagaagatacaaat

SEQ ID NO: 8417953 - DNA, 22 bp, Homo sapiens
gatacaaaatataaatggagag

SEQ ID NO: 8417954 - DNA, 22 bp, Homo sapiens
gataattttagtctgaaaattg

SEQ ID NO: 8417955 - DNA, 22 bp, Homo sapiens
gataatttgatacctcaatcag

SEQ ID NO: 8417956 - DNA, 22 bp, Homo sapiens
gacataatcctcctcacctact

SEQ ID NO: 8417957 - DNA, 22 bp, Homo sapiens
gacataataatctgacctagat

SEQ ID NO: 8417958 - DNA, 22 bp, Homo sapiens
atgcacaaggtagattattatt

SEQ ID NO: 8417959 - DNA, 22 bp, Homo sapiens
gaataatagcagaaattagcag

SEQ ID NO: 8417960 - DNA, 22 bp, Homo sapiens
gaataattttgatcagaaggga

SEQ ID NO: 8417961 - DNA, 22 bp, Homo sapiens
gaataattgtgatgcttgaagt

SEQ ID NO: 8417962 - DNA, 22 bp, Homo sapiens
gaatacaaacttaaggctttac

SEQ ID NO: 8417963 - DNA, 22 bp, Homo sapiens
gaatacaaagcagaactcatac

SEQ ID NO: 8417964 - DNA, 23 bp, Homo sapiens
gaatacaaagcagatggtccagc

SEQ ID NO: 8417965 - DNA, 22 bp, Homo sapiens
gacaatacagaaagggacatgc

SEQ ID NO: 8417966 - DNA, 22 bp, Homo sapiens
gaattttatcttattacttgca

SEQ ID NO: 8417967 - DNA, 22 bp, Homo sapiens
gaatacaaataataccaaggtg

SEQ ID NO: 8417968 - DNA, 22 bp, Homo sapiens
gaatcaatggtagattaagtaa

SEQ ID NO: 8417969 - DNA, 22 bp, Homo sapiens
atgacataaagctatgctaggt

SEQ ID NO: 8417970 - DNA, 21 bp, Homo sapiens
atgacagatgctgcagatcgt

SEQ ID NO: 8417971 - DNA, 22 bp, Homo sapiens
atgacagatgctgtggggaggt

SEQ ID NO: 8417972 - DNA, 22 bp, Homo sapiens
gaaacatgtctgacaatttacc

SEQ ID NO: 8417973 - DNA, 22 bp, Homo sapiens
gaaaatgttagcttcatagtca

SEQ ID NO: 8417974 - DNA, 19 bp, Homo sapiens
atgatacaggtgaaaattg

SEQ ID NO: 8417975 - DNA, 22 bp, Homo sapiens
atgatgcaccattataagagtt

SEQ ID NO: 8417976 - DNA, 22 bp, Homo sapiens
atgatgaaattttctatcatgt

SEQ ID NO: 8417977 - DNA, 22 bp, Homo sapiens
atgaaaagttcgatctagaagg

SEQ ID NO: 8417978 - DNA, 22 bp, Homo sapiens
ctttcccttagccccattctat

SEQ ID NO: 8417979 - DNA, 22 bp, Homo sapiens
ctttcccacgcagtggatgaga

SEQ ID NO: 8417980 - DNA, 22 bp, Homo sapiens
cttctttaatgtatacaaaaga

SEQ ID NO: 8417981 - DNA, 22 bp, Homo sapiens
cttctttactttctagaaataa

SEQ ID NO: 8417982 - DNA, 22 bp, Homo sapiens
cttctttaccaagagatagagt

SEQ ID NO: 8417983 - DNA, 22 bp, Homo sapiens
atgaaattcatctgagaatgct

SEQ ID NO: 8417984 - DNA, 22 bp, Homo sapiens
atgaacagaggaatagaattct

SEQ ID NO: 8417985 - DNA, 22 bp, Homo sapiens
atgaaaagttcgatctagaagg

SEQ ID NO: 8417986 - DNA, 22 bp, Homo sapiens
ctttcttatacctgtcagggcc

SEQ ID NO: 8417987 - DNA, 22 bp, Homo sapiens
ctttctcttgagcaagagctgt

SEQ ID NO: 8417988 - DNA, 22 bp, Homo sapiens
atgaacatgtgactcagacctg

SEQ ID NO: 8417989 - DNA, 22 bp, Homo sapiens
atgaacatctctgatccaagca

SEQ ID NO: 8417990 - DNA, 22 bp, Homo sapiens
gcctgaagaacagctgtgagga

SEQ ID NO: 8417991 - DNA, 22 bp, Homo sapiens
atttgctagtggaattttcctg

SEQ ID NO: 8417992 - DNA, 22 bp, Homo sapiens
attttactactccaattaatga

SEQ ID NO: 8417993 - DNA, 22 bp, Homo sapiens
gcctgaaggagtcagagagggc

SEQ ID NO: 8417994 - DNA, 22 bp, Homo sapiens
attttacttcatttgaaatgcc

SEQ ID NO: 8417995 - DNA, 22 bp, Homo sapiens
attttacttagtgtaatgtcca

SEQ ID NO: 8417996 - DNA, 22 bp, Homo sapiens
atttttatgacaaaccatcctc

SEQ ID NO: 8417997 - DNA, 22 bp, Homo sapiens
caaacattcaagtacaagtctt

SEQ ID NO: 8417998 - DNA, 22 bp, Homo sapiens
caaaattctgcatttctaataa

SEQ ID NO: 8417999 - DNA, 22 bp, Homo sapiens
caaaatgttctggcacctttaa

SEQ ID NO: 8418000 - DNA, 22 bp, Homo sapiens
caaaatgtgagtcccacctcaa

SEQ ID NO: 8418001 - DNA, 22 bp, Homo sapiens
caaatactgagcacgcaatcaa

SEQ ID NO: 8418002 - DNA, 22 bp, Homo sapiens
caaatacaaatacgggcagctt

SEQ ID NO: 8418003 - DNA, 22 bp, Homo sapiens
caaagctgacgaggtcagcatc

SEQ ID NO: 8418004 - DNA, 22 bp, Homo sapiens
attcaagagctggctttgaaat

SEQ ID NO: 8418005 - DNA, 22 bp, Homo sapiens
attcaagaggaacaatgaagat

SEQ ID NO: 8418006 - DNA, 22 bp, Homo sapiens
attcacaatgatacataagcga

SEQ ID NO: 8418007 - DNA, 22 bp, Homo sapiens
attcacatgatgtatgtagggc

SEQ ID NO: 8418008 - DNA, 22 bp, Homo sapiens
attcacaatagcagcttgcatg

SEQ ID NO: 8418009 - DNA, 21 bp, Homo sapiens
attcagaaagggaataaactc

SEQ ID NO: 8418010 - DNA, 21 bp, Homo sapiens
attcagaaagggaataaactc

SEQ ID NO: 8418011 - DNA, 21 bp, Homo sapiens
attcagaaagggaataaactc

SEQ ID NO: 8418012 - DNA, 22 bp, Homo sapiens
attcagaaatagaaaatttgat

SEQ ID NO: 8418013 - DNA, 22 bp, Homo sapiens
attcacatttacaaagcactca

SEQ ID NO: 8418014 - DNA, 22 bp, Homo sapiens
attcacatttagacatcaggta

SEQ ID NO: 8418015 - DNA, 20 bp, Homo sapiens
attcaccaaatcatcccagg

SEQ ID NO: 8418016 - DNA, 22 bp, Homo sapiens
attcacatgtgcttcttatcac

SEQ ID NO: 8418017 - DNA, 22 bp, Homo sapiens
attcagaagcaatcacagtgag

SEQ ID NO: 8418018 - DNA, 20 bp, Homo sapiens
attcagaataggcatgtaaa

SEQ ID NO: 8418019 - DNA, 22 bp, Homo sapiens
attcagactcttgagcagtccc

SEQ ID NO: 8418020 - DNA, 22 bp, Homo sapiens
attcagactatgaacacgtcag

SEQ ID NO: 8418021 - DNA, 22 bp, Homo sapiens
gcagcctttggaattagagact

SEQ ID NO: 8418022 - DNA, 22 bp, Homo sapiens
attcataagtaaatgattacct

SEQ ID NO: 8418023 - DNA, 22 bp, Homo sapiens
attcataacggcaaatgtcacc

SEQ ID NO: 8418024 - DNA, 22 bp, Homo sapiens
attagaggtacaaaccttcact

SEQ ID NO: 8418025 - DNA, 19 bp, Homo sapiens
gatttctacaaatgtcaga

SEQ ID NO: 8418026 - DNA, 22 bp, Homo sapiens
gatttctaaggaggctgaactt

SEQ ID NO: 8418027 - DNA, 22 bp, Homo sapiens
gatttctaagttttaccacaaa

SEQ ID NO: 8418028 - DNA, 22 bp, Homo sapiens
gatttctagttcattatctatt

SEQ ID NO: 8418029 - DNA, 22 bp, Homo sapiens
gatttctagtaagtcatgaagg

SEQ ID NO: 8418030 - DNA, 22 bp, Homo sapiens
gatttctacttgaacttgctaa

SEQ ID NO: 8418031 - DNA, 22 bp, Homo sapiens
gatttctagtaagtcatgaagg

SEQ ID NO: 8418032 - DNA, 22 bp, Homo sapiens
attacagtgggtaaacagaatt

SEQ ID NO: 8418033 - DNA, 22 bp, Homo sapiens
attacaatcgagagaaacaaat

SEQ ID NO: 8418034 - DNA, 22 bp, Homo sapiens
attcaaatgtcaaatccaccag

SEQ ID NO: 8418035 - DNA, 22 bp, Homo sapiens
attcaacttacaaaggagaaga

SEQ ID NO: 8418036 - DNA, 22 bp, Homo sapiens
attcaactgtaaacttgttcac

SEQ ID NO: 8418037 - DNA, 22 bp, Homo sapiens
attcaactatgtatagtcttct

SEQ ID NO: 8418038 - DNA, 22 bp, Homo sapiens
attcaacttataagatattaat

SEQ ID NO: 8418039 - DNA, 22 bp, Homo sapiens
attcaagagcccatgtttcctg

SEQ ID NO: 8418040 - DNA, 22 bp, Homo sapiens
attcaactagtgattgtgttat

SEQ ID NO: 8418041 - DNA, 21 bp, Homo sapiens
attcaactagatgattatttc

SEQ ID NO: 8418042 - DNA, 22 bp, Homo sapiens
attcaaattaagttaattcagc

SEQ ID NO: 8418043 - DNA, 22 bp, Homo sapiens
attagggaaactgacttgtctc

SEQ ID NO: 8418044 - DNA, 22 bp, Homo sapiens
attagggaaggatttggcctga

SEQ ID NO: 8418045 - DNA, 22 bp, Homo sapiens
attagggctggatgcaaggaaa

SEQ ID NO: 8418046 - DNA, 22 bp, Homo sapiens
attagatatttgctgttggatt

SEQ ID NO: 8418047 - DNA, 22 bp, Homo sapiens
attagatacacagatttccact

SEQ ID NO: 8418048 - DNA, 22 bp, Homo sapiens
attagatatttgctgttggatt

SEQ ID NO: 8418049 - DNA, 22 bp, Homo sapiens
gcatagtcagtaggattctcaa

SEQ ID NO: 8418050 - DNA, 22 bp, Homo sapiens
gcatatcatgacttctatctta

SEQ ID NO: 8418051 - DNA, 20 bp, Homo sapiens
gcagtgtgtatgaatagctg

SEQ ID NO: 8418052 - DNA, 22 bp, Homo sapiens
gcatacagagaggatgtggcat

SEQ ID NO: 8418053 - DNA, 22 bp, Homo sapiens
gccaacaggccttgctctgctc

SEQ ID NO: 8418054 - DNA, 22 bp, Homo sapiens
gccaaatctggatttagcaaga

SEQ ID NO: 8418055 - DNA, 22 bp, Homo sapiens
gccaaatcttgcacactcttgt

SEQ ID NO: 8418056 - DNA, 22 bp, Homo sapiens
gccaacagctgggtgcatgtcc

SEQ ID NO: 8418057 - DNA, 22 bp, Homo sapiens
gccaacaggccttgctctgctc

SEQ ID NO: 8418058 - DNA, 22 bp, Homo sapiens
gccaaatcacagggccaaaagc

SEQ ID NO: 8418059 - DNA, 23 bp, Homo sapiens
attgtgagattactatcacactg

SEQ ID NO: 8418060 - DNA, 19 bp, Homo sapiens
attcttggtgcaccttgta

SEQ ID NO: 8418061 - DNA, 19 bp, Homo sapiens
attcttcagcagtgagacc

SEQ ID NO: 8418062 - DNA, 22 bp, Homo sapiens
attctttattgctgatggttat

SEQ ID NO: 8418063 - DNA, 22 bp, Homo sapiens
attctttagccagcaggtatat

SEQ ID NO: 8418064 - DNA, 22 bp, Homo sapiens
attctttagttggcttcttgcc

SEQ ID NO: 8418065 - DNA, 22 bp, Homo sapiens
attctttcaaggaatagttatt

SEQ ID NO: 8418066 - DNA, 22 bp, Homo sapiens
attctttcatataaaggctcag

SEQ ID NO: 8418067 - DNA, 22 bp, Homo sapiens
attctttacattggcttcttcc

SEQ ID NO: 8418068 - DNA, 22 bp, Homo sapiens
attctttaattcaattgaagga

SEQ ID NO: 8418069 - DNA, 22 bp, Homo sapiens
gcagggctgatgttattgacga

SEQ ID NO: 8418070 - DNA, 22 bp, Homo sapiens
gcagggctgggacttactggta

SEQ ID NO: 8418071 - DNA, 22 bp, Homo sapiens
gcagggctgcagagggcactgt

SEQ ID NO: 8418072 - DNA, 22 bp, Homo sapiens
tgcccagcgcccacattctgtc

SEQ ID NO: 8418073 - DNA, 22 bp, Homo sapiens
cccaggcatcccattaaggagc

SEQ ID NO: 8418074 - DNA, 22 bp, Homo sapiens
tgcccagccagtttatggtaat

SEQ ID NO: 8418075 - DNA, 22 bp, Homo sapiens
cccaggctggagggcagtgtca

SEQ ID NO: 8418076 - DNA, 22 bp, Homo sapiens
cccaggctggcactgctgaagt

SEQ ID NO: 8418077 - DNA, 22 bp, Homo sapiens
cccaggctggtcctgaactcct

SEQ ID NO: 8418078 - DNA, 22 bp, Homo sapiens
cccagggaagggctacctgagg

SEQ ID NO: 8418079 - DNA, 22 bp, Homo sapiens
tgctggctttgcgagatgcatt

SEQ ID NO: 8418080 - DNA, 22 bp, Homo sapiens
cccagttgttgccggctctgga

SEQ ID NO: 8418081 - DNA, 22 bp, Homo sapiens
cccattcatcctcgcttccttc

SEQ ID NO: 8418082 - DNA, 22 bp, Homo sapiens
tggaatggaaacaaactgagga

SEQ ID NO: 8418083 - DNA, 22 bp, Homo sapiens
tggaagggagctggaatttgga

SEQ ID NO: 8418084 - DNA, 22 bp, Homo sapiens
ccctgaggaaagggtggagggc

SEQ ID NO: 8418085 - DNA, 22 bp, Homo sapiens
ccctctcctggctgcatggagc

SEQ ID NO: 8418086 - DNA, 18 bp, Homo sapiens
ccctctcctgctagtggg

SEQ ID NO: 8418087 - DNA, 22 bp, Homo sapiens
ccctctccctgcagaatgtggc

SEQ ID NO: 8418088 - DNA, 22 bp, Homo sapiens
tggctgagaccatcagggtgta

SEQ ID NO: 8418089 - DNA, 22 bp, Homo sapiens
cctgagctgaactaagcagttt

SEQ ID NO: 8418090 - DNA, 22 bp, Homo sapiens
cctgagctcaagaaggtgacca

SEQ ID NO: 8418091 - DNA, 22 bp, Homo sapiens
cctgagctagggaaggaagacc

SEQ ID NO: 8418092 - DNA, 22 bp, Homo sapiens
tgggctccttgggagcaagtga

SEQ ID NO: 8418093 - DNA, 22 bp, Homo sapiens
ccctgcagccttgcatgccttc

SEQ ID NO: 8418094 - DNA, 22 bp, Homo sapiens
ccctgcagcttttgcatagtca

SEQ ID NO: 8418095 - DNA, 22 bp, Homo sapiens
ccctgcaggctcagactggagt

SEQ ID NO: 8418096 - DNA, 21 bp, Homo sapiens
ccctgcaggccagggctgagc

SEQ ID NO: 8418097 - DNA, 21 bp, Homo sapiens
ccctgcaggccagggctgagc

SEQ ID NO: 8418098 - DNA, 23 bp, Homo sapiens
ccctgcagtcagggtgagatggt

SEQ ID NO: 8418099 - DNA, 23 bp, Homo sapiens
ccctgcagtcagggtgagatggt

SEQ ID NO: 8418100 - DNA, 22 bp, Homo sapiens
ccctgcaggggacctgcagcct

SEQ ID NO: 8418101 - DNA, 22 bp, Homo sapiens
ccctgcaggggacctgcagcct

SEQ ID NO: 8418102 - DNA, 22 bp, Homo sapiens
ccctgcagggaggattctgaag

SEQ ID NO: 8418103 - DNA, 22 bp, Homo sapiens
ccctgcagggaggattctgaag

SEQ ID NO: 8418104 - DNA, 22 bp, Homo sapiens
cctaaggaaagccaaagaggcc

SEQ ID NO: 8418105 - DNA, 22 bp, Homo sapiens
cctagatgggatggcggccggg

SEQ ID NO: 8418106 - DNA, 22 bp, Homo sapiens
tggcctgggcatgaagcatcgt

SEQ ID NO: 8418107 - DNA, 22 bp, Homo sapiens
tggcctggggaagaccatgggc

SEQ ID NO: 8418108 - DNA, 22 bp, Homo sapiens
tgatttcttccttgtcattaga

SEQ ID NO: 8418109 - DNA, 22 bp, Homo sapiens
tgatttcttccttgtcattaga

SEQ ID NO: 8418110 - DNA, 23 bp, Homo sapiens
tgattttaaaaagtaagttatca

SEQ ID NO: 8418111 - DNA, 22 bp, Homo sapiens
tgattttattgaaacttcactt

SEQ ID NO: 8418112 - DNA, 22 bp, Homo sapiens
tgattttacttagcatgatgtt

SEQ ID NO: 8418113 - DNA, 22 bp, Homo sapiens
tgattttattggtgaggaaatt

SEQ ID NO: 8418114 - DNA, 21 bp, Homo sapiens
ccattcttagtcaagtgtctc

SEQ ID NO: 8418115 - DNA, 22 bp, Homo sapiens
ccattctttcagtgtctcatgt

SEQ ID NO: 8418116 - DNA, 22 bp, Homo sapiens
ccattcaataccttagagaaaa

SEQ ID NO: 8418117 - DNA, 22 bp, Homo sapiens
tgaggtaggtgtcgagagaggt

SEQ ID NO: 8418118 - DNA, 22 bp, Homo sapiens
ccatgccccaccaggacgctgc

SEQ ID NO: 8418119 - DNA, 22 bp, Homo sapiens
ccatgccccaatacaggacacc

SEQ ID NO: 8418120 - DNA, 22 bp, Homo sapiens
ccatgccatactggccacccgg

SEQ ID NO: 8418121 - DNA, 22 bp, Homo sapiens
ccatgcagtgctggagctgatt

SEQ ID NO: 8418122 - DNA, 22 bp, Homo sapiens
tgacaagaggcagaatcagctg

SEQ ID NO: 8418123 - DNA, 22 bp, Homo sapiens
tgacaagatcacagtcaagtgt

SEQ ID NO: 8418124 - DNA, 22 bp, Homo sapiens
tgacaagatagattgagtttta

SEQ ID NO: 8418125 - DNA, 19 bp, Homo sapiens
tgacaagataatagccttg

SEQ ID NO: 8418126 - DNA, 22 bp, Homo sapiens
tgacaagtacataatttcatgt

SEQ ID NO: 8418127 - DNA, 22 bp, Homo sapiens
tgacaatacagagagagcaaaa

SEQ ID NO: 8418128 - DNA, 22 bp, Homo sapiens
tgacataataatccaaacatac

SEQ ID NO: 8418129 - DNA, 22 bp, Homo sapiens
tgaatgatgtataatattgaga

SEQ ID NO: 8418130 - DNA, 22 bp, Homo sapiens
tgaatgatttgggtgcattcag

SEQ ID NO: 8418131 - DNA, 22 bp, Homo sapiens
tgacaagaagacctggtaatga

SEQ ID NO: 8418132 - DNA, 22 bp, Homo sapiens
tgacaagaaagcgtcttctttt

SEQ ID NO: 8418133 - DNA, 22 bp, Homo sapiens
tgacaagagacccctccgcagg

SEQ ID NO: 8418134 - DNA, 22 bp, Homo sapiens
tgacaagagcattcccacacct

SEQ ID NO: 8418135 - DNA, 22 bp, Homo sapiens
tgacaagagacccctccgcagg

SEQ ID NO: 8418136 - DNA, 22 bp, Homo sapiens
tgacaagaatttgggactgtta

SEQ ID NO: 8418137 - DNA, 22 bp, Homo sapiens
tgaatgatgcagtataatgata

SEQ ID NO: 8418138 - DNA, 22 bp, Homo sapiens
tgaatgatacagaattatgtag

SEQ ID NO: 8418139 - DNA, 22 bp, Homo sapiens
tgaggcagatatttattgggtt

SEQ ID NO: 8418140 - DNA, 22 bp, Homo sapiens
ccaggcctggccaggggatgcc

SEQ ID NO: 8418141 - DNA, 22 bp, Homo sapiens
ccaggcctgcatctgctgcgca

SEQ ID NO: 8418142 - DNA, 22 bp, Homo sapiens
ccaggcctggaccatgccaggg

SEQ ID NO: 8418143 - DNA, 19 bp, Homo sapiens
ccaggcctgcgggcgttgg

SEQ ID NO: 8418144 - DNA, 22 bp, Homo sapiens
tctttcttggtattctgagcta

SEQ ID NO: 8418145 - DNA, 22 bp, Homo sapiens
ccaggcaggctagaatgtaaat

SEQ ID NO: 8418146 - DNA, 22 bp, Homo sapiens
tcttcccagctgctgcgatgcc

SEQ ID NO: 8418147 - DNA, 22 bp, Homo sapiens
tcttcagagcatttctgaggta

SEQ ID NO: 8418148 - DNA, 22 bp, Homo sapiens
tcttcagagcatttctgaggta

SEQ ID NO: 8418149 - DNA, 22 bp, Homo sapiens
tcttagaatgtcaactgatgtt

SEQ ID NO: 8418150 - DNA, 22 bp, Homo sapiens
tctggaggccatagggaaggat

SEQ ID NO: 8418151 - DNA, 22 bp, Homo sapiens
ccagctctgcagggcctggggt

SEQ ID NO: 8418152 - DNA, 22 bp, Homo sapiens
ccagagagagaggtcaatggca

SEQ ID NO: 8418153 - DNA, 22 bp, Homo sapiens
ccagagagaaatggatttgagt

SEQ ID NO: 8418154 - DNA, 22 bp, Homo sapiens
ccagagacgtcggtcagggcgc

SEQ ID NO: 8418155 - DNA, 22 bp, Homo sapiens
ccagagagaaaatggagggcca

SEQ ID NO: 8418156 - DNA, 22 bp, Homo sapiens
tctcagactctttagtgaaggt

SEQ ID NO: 8418157 - DNA, 22 bp, Homo sapiens
ccagctctcagcgggagactca

SEQ ID NO: 8418158 - DNA, 22 bp, Homo sapiens
tctggtaactcagaagaaagga

SEQ ID NO: 8418159 - DNA, 22 bp, Homo sapiens
tctggtaataggcaatagcttg

SEQ ID NO: 8418160 - DNA, 22 bp, Homo sapiens
tcagatattctctaagaacaat

SEQ ID NO: 8418161 - DNA, 22 bp, Homo sapiens
tcagatagtgataatagcatgt

SEQ ID NO: 8418162 - DNA, 22 bp, Homo sapiens
tcagagagttttcactagggtg

SEQ ID NO: 8418163 - DNA, 22 bp, Homo sapiens
tcagagagttagtgtcttagct

SEQ ID NO: 8418164 - DNA, 22 bp, Homo sapiens
tcagagagttacacaaattgtt

SEQ ID NO: 8418165 - DNA, 22 bp, Homo sapiens
tcagagagttggaaagaattaa

SEQ ID NO: 8418166 - DNA, 21 bp, Homo sapiens
tcagagagtcacagtgaactg

SEQ ID NO: 8418167 - DNA, 22 bp, Homo sapiens
tcagagagtgcaaaatatagct

SEQ ID NO: 8418168 - DNA, 22 bp, Homo sapiens
tcagagagtcctggtcatttgc

SEQ ID NO: 8418169 - DNA, 22 bp, Homo sapiens
tcaatattcttctttagtagga

SEQ ID NO: 8418170 - DNA, 22 bp, Homo sapiens
tcaatcacgtgttccatgttct

SEQ ID NO: 8418171 - DNA, 22 bp, Homo sapiens
cataatatctccgattacttgc

SEQ ID NO: 8418172 - DNA, 22 bp, Homo sapiens
cataacagtggcttcagcaagt

SEQ ID NO: 8418173 - DNA, 22 bp, Homo sapiens
cataatcccccatttgtgacat

SEQ ID NO: 8418174 - DNA, 22 bp, Homo sapiens
cataatcccaggcttgcattca

SEQ ID NO: 8418175 - DNA, 22 bp, Homo sapiens
cataatccatttgcactgcaga

SEQ ID NO: 8418176 - DNA, 22 bp, Homo sapiens
cataatcctggtgtagccctct

SEQ ID NO: 8418177 - DNA, 22 bp, Homo sapiens
cataatccttgattcaaataat

SEQ ID NO: 8418178 - DNA, 22 bp, Homo sapiens
cataatcctgtcctggattctt

SEQ ID NO: 8418179 - DNA, 22 bp, Homo sapiens
cataattaggcagttgatcatt

SEQ ID NO: 8418180 - DNA, 22 bp, Homo sapiens
cataattactgatatgctgatt

SEQ ID NO: 8418181 - DNA, 18 bp, Homo sapiens
cataattttctttcttta

SEQ ID NO: 8418182 - DNA, 22 bp, Homo sapiens
cataatttctgtatcagcacca

SEQ ID NO: 8418183 - DNA, 22 bp, Homo sapiens
catagaatggattgacaagatt

SEQ ID NO: 8418184 - DNA, 22 bp, Homo sapiens
catagaatgcagcaggaaagtt

SEQ ID NO: 8418185 - DNA, 22 bp, Homo sapiens
catagaatcatagcacatttga

SEQ ID NO: 8418186 - DNA, 22 bp, Homo sapiens
catgcagggactagagaacagg

SEQ ID NO: 8418187 - DNA, 22 bp, Homo sapiens
catgcaggcctatggagcagtg

SEQ ID NO: 8418188 - DNA, 22 bp, Homo sapiens
catgacaatatgttctttcatt

SEQ ID NO: 8418189 - DNA, 22 bp, Homo sapiens
catgacaataagccagcagaaa

SEQ ID NO: 8418190 - DNA, 22 bp, Homo sapiens
catgacaaataaacctttgcca

SEQ ID NO: 8418191 - DNA, 22 bp, Homo sapiens
catgacaaatcagaggggcttg

SEQ ID NO: 8418192 - DNA, 23 bp, Homo sapiens
catgacaaaggatctcatgggcc

SEQ ID NO: 8418193 - DNA, 22 bp, Homo sapiens
catgaatgctgggttcatgtaa

SEQ ID NO: 8418194 - DNA, 22 bp, Homo sapiens
catgaaggaataattgtttaga

SEQ ID NO: 8418195 - DNA, 22 bp, Homo sapiens
catgaaggaattaaggtaagga

SEQ ID NO: 8418196 - DNA, 22 bp, Homo sapiens
catgaaggctgccagcaggcat

SEQ ID NO: 8418197 - DNA, 23 bp, Homo sapiens
catgaaggtagcacaaagcctct

SEQ ID NO: 8418198 - DNA, 22 bp, Homo sapiens
catgaaggaccatttcacggtc

SEQ ID NO: 8418199 - DNA, 19 bp, Homo sapiens
ccagagacattggcatctt

SEQ ID NO: 8418200 - DNA, 22 bp, Homo sapiens
ccagagaccagaacatggggat

SEQ ID NO: 8418201 - DNA, 22 bp, Homo sapiens
tctaatcctatggtggggaggg

SEQ ID NO: 8418202 - DNA, 22 bp, Homo sapiens
tctaatccttgctacctgggtg

SEQ ID NO: 8418203 - DNA, 22 bp, Homo sapiens
tctaagaatactcatatcttct

SEQ ID NO: 8418204 - DNA, 22 bp, Homo sapiens
tctaagacactgtactttcagt

SEQ ID NO: 8418205 - DNA, 22 bp, Homo sapiens
tctaagaggcatcaagacaagc

SEQ ID NO: 8418206 - DNA, 22 bp, Homo sapiens
ccactgtcttttccaggctgaa

SEQ ID NO: 8418207 - DNA, 22 bp, Homo sapiens
ccactgtctgtgacatcagaaa

SEQ ID NO: 8418208 - DNA, 22 bp, Homo sapiens
tcctgggcttcacagactctgt

SEQ ID NO: 8418209 - DNA, 22 bp, Homo sapiens
tcctttatctgctcagaaagta

SEQ ID NO: 8418210 - DNA, 22 bp, Homo sapiens
ccaaggctcctcagctggtctt

SEQ ID NO: 8418211 - DNA, 22 bp, Homo sapiens
ccaaggctggagtgcagtggcg

SEQ ID NO: 8418212 - DNA, 22 bp, Homo sapiens
ccaaggctgtcattcagtagct

SEQ ID NO: 8418213 - DNA, 22 bp, Homo sapiens
ccaaggctgtggggctgtgcag

SEQ ID NO: 8418214 - DNA, 22 bp, Homo sapiens
ccaaggctgaggtttccagttg

SEQ ID NO: 8418215 - DNA, 22 bp, Homo sapiens
ccaaggcttcccagagatgctc

SEQ ID NO: 8418216 - DNA, 22 bp, Homo sapiens
tcctacatcagctctcagtagc

SEQ ID NO: 8418217 - DNA, 22 bp, Homo sapiens
ccaaggagctcatattcttgtt

SEQ ID NO: 8418218 - DNA, 22 bp, Homo sapiens
ccaaggagctgcaggcacttgt

SEQ ID NO: 8418219 - DNA, 22 bp, Homo sapiens
ccaaggagcaagtttacacctg

SEQ ID NO: 8418220 - DNA, 22 bp, Homo sapiens
ccaaggagcaaggctcaacaag

SEQ ID NO: 8418221 - DNA, 22 bp, Homo sapiens
ccaaggagaatgacaccatgga

SEQ ID NO: 8418222 - DNA, 22 bp, Homo sapiens
ccaaggagtagagcaggaagct

SEQ ID NO: 8418223 - DNA, 22 bp, Homo sapiens
ccaaggaggccccaggtcagct

SEQ ID NO: 8418224 - DNA, 22 bp, Homo sapiens
ccaaggcaggggatcaaagttt

SEQ ID NO: 8418225 - DNA, 20 bp, Homo sapiens
tcccaaaattctactttatc

SEQ ID NO: 8418226 - DNA, 22 bp, Homo sapiens
tccaggagaggcctgaccaggt

SEQ ID NO: 8418227 - DNA, 22 bp, Homo sapiens
cattagggtctctcagctgaat

SEQ ID NO: 8418228 - DNA, 22 bp, Homo sapiens
cattagggactgaggaataagg

SEQ ID NO: 8418229 - DNA, 22 bp, Homo sapiens
cattagggtaattgaacactta

SEQ ID NO: 8418230 - DNA, 22 bp, Homo sapiens
cattagggccaccataacaaaa

SEQ ID NO: 8418231 - DNA, 21 bp, Homo sapiens
cattagggcagaagcaggaag

SEQ ID NO: 8418232 - DNA, 22 bp, Homo sapiens
cattctaaagtgttttatacct

SEQ ID NO: 8418233 - DNA, 22 bp, Homo sapiens
cattagagcagataatatgtgt

SEQ ID NO: 8418234 - DNA, 22 bp, Homo sapiens
catttacaatgtacaggttgtg

SEQ ID NO: 8418235 - DNA, 22 bp, Homo sapiens
catttacacacagaggtgtgct

SEQ ID NO: 8418236 - DNA, 22 bp, Homo sapiens
cattgttaccatcttttaccta

SEQ ID NO: 8418237 - DNA, 22 bp, Homo sapiens
cattgttatagcattacacacc

SEQ ID NO: 8418238 - DNA, 22 bp, Homo sapiens
tccctctccctattgcctggag

SEQ ID NO: 8418239 - DNA, 22 bp, Homo sapiens
tccctctctagcctgttcagta

SEQ ID NO: 8418240 - DNA, 22 bp, Homo sapiens
tccctctctggctggggtgcgg

SEQ ID NO: 8418241 - DNA, 22 bp, Homo sapiens
tccctctcttgggcgtggctca

SEQ ID NO: 8418242 - DNA, 22 bp, Homo sapiens
catttattcatgatctgtagct

SEQ ID NO: 8418243 - DNA, 22 bp, Homo sapiens
catttattcatttgctagggct

SEQ ID NO: 8418244 - DNA, 22 bp, Homo sapiens
catttattgagtggccacagtg

SEQ ID NO: 8418245 - DNA, 22 bp, Homo sapiens
catttattctcagatccttgtc

SEQ ID NO: 8418246 - DNA, 22 bp, Homo sapiens
caggtaaggtcacattctgaag

SEQ ID NO: 8418247 - DNA, 22 bp, Homo sapiens
caggtacattcgtagacccatt

SEQ ID NO: 8418248 - DNA, 22 bp, Homo sapiens
tattaaatgttatttgggttgt

SEQ ID NO: 8418249 - DNA, 22 bp, Homo sapiens
tattatgcataggcaataatgg

SEQ ID NO: 8418250 - DNA, 22 bp, Homo sapiens
cagtcaaacttataggcacatt

SEQ ID NO: 8418251 - DNA, 22 bp, Homo sapiens
cagtatatgctctttcatcaaa

SEQ ID NO: 8418252 - DNA, 22 bp, Homo sapiens
tattttaaagtgaagggtcttg

SEQ ID NO: 8418253 - DNA, 22 bp, Homo sapiens
tattttacaaatgggaatgctg

SEQ ID NO: 8418254 - DNA, 22 bp, Homo sapiens
tattttacaaatgggaatgctg

SEQ ID NO: 8418255 - DNA, 22 bp, Homo sapiens
tattttacaaatgggaatgctg

SEQ ID NO: 8418256 - DNA, 22 bp, Homo sapiens
tattttacagactactttagat

SEQ ID NO: 8418257 - DNA, 22 bp, Homo sapiens
tattttacagactactttagat

SEQ ID NO: 8418258 - DNA, 22 bp, Homo sapiens
tattttacagactactttagat

SEQ ID NO: 8418259 - DNA, 22 bp, Homo sapiens
tcaagcagcagatcaagagcta

SEQ ID NO: 8418260 - DNA, 22 bp, Homo sapiens
tattttactttaaagcgagaga

SEQ ID NO: 8418261 - DNA, 22 bp, Homo sapiens
tattttactttaaagcgagaga

SEQ ID NO: 8418262 - DNA, 22 bp, Homo sapiens
tattttactatttggcaaagtc

SEQ ID NO: 8418263 - DNA, 22 bp, Homo sapiens
tattttacatgatccagagttg

SEQ ID NO: 8418264 - DNA, 22 bp, Homo sapiens
tattttactttaaagcgagaga

SEQ ID NO: 8418265 - DNA, 22 bp, Homo sapiens
tattttactatttggcaaagtc

SEQ ID NO: 8418266 - DNA, 22 bp, Homo sapiens
tattttacatgatccagagttg

SEQ ID NO: 8418267 - DNA, 22 bp, Homo sapiens
tattttacatgacaggtgttta

SEQ ID NO: 8418268 - DNA, 22 bp, Homo sapiens
tattttacatgacaggtgttta

SEQ ID NO: 8418269 - DNA, 22 bp, Homo sapiens
tattttcaccatgtatccctgt

SEQ ID NO: 8418270 - DNA, 22 bp, Homo sapiens
tattttcaccatgtatccctgt

SEQ ID NO: 8418271 - DNA, 22 bp, Homo sapiens
tcaaaaatgttttatattggta

SEQ ID NO: 8418272 - DNA, 22 bp, Homo sapiens
tcaaaaatgttttatattggta

SEQ ID NO: 8418273 - DNA, 22 bp, Homo sapiens
tattttcaccatgtatccctgt

SEQ ID NO: 8418274 - DNA, 22 bp, Homo sapiens
taggagggccctgaaaatggca

SEQ ID NO: 8418275 - DNA, 22 bp, Homo sapiens
tagctttaaaaatcatcaaagc

SEQ ID NO: 8418276 - DNA, 22 bp, Homo sapiens
tagctttaagacatggtgaatg

SEQ ID NO: 8418277 - DNA, 22 bp, Homo sapiens
cagggctccatgcagggactcc

SEQ ID NO: 8418278 - DNA, 22 bp, Homo sapiens
cagggtccatctttcatcactg

SEQ ID NO: 8418279 - DNA, 23 bp, Homo sapiens
cagggctggtagggaagagcgtg

SEQ ID NO: 8418280 - DNA, 22 bp, Homo sapiens
taggcttgcttctcctccacag

SEQ ID NO: 8418281 - DNA, 22 bp, Homo sapiens
cagggctcttccggagcaggga

SEQ ID NO: 8418282 - DNA, 22 bp, Homo sapiens
cagggctcttcatcacacagta

SEQ ID NO: 8418283 - DNA, 20 bp, Homo sapiens
cagggctctgggcctggcct

SEQ ID NO: 8418284 - DNA, 22 bp, Homo sapiens
cagggaaagttcttgtccactc

SEQ ID NO: 8418285 - DNA, 22 bp, Homo sapiens
cagggaaactaggaaataagct

SEQ ID NO: 8418286 - DNA, 22 bp, Homo sapiens
caggcttggagggcagtggcat

SEQ ID NO: 8418287 - DNA, 22 bp, Homo sapiens
caggcttgggagcagagccact

SEQ ID NO: 8418288 - DNA, 22 bp, Homo sapiens
caggcttgtgtctcagctgcag

SEQ ID NO: 8418289 - DNA, 22 bp, Homo sapiens
caggctgccgtgaagcaggcct

SEQ ID NO: 8418290 - DNA, 22 bp, Homo sapiens
caggctgcagtgcagtggctat

SEQ ID NO: 8418291 - DNA, 22 bp, Homo sapiens
caggctgccaaggctggggagg

SEQ ID NO: 8418292 - DNA, 22 bp, Homo sapiens
caggcctgagacatctgagata

SEQ ID NO: 8418293 - DNA, 18 bp, Homo sapiens
caggcctcttgatcttcc

SEQ ID NO: 8418294 - DNA, 22 bp, Homo sapiens
tacatgttatttcactattggt

SEQ ID NO: 8418295 - DNA, 19 bp, Homo sapiens
tacattgctggtggggatg

SEQ ID NO: 8418296 - DNA, 22 bp, Homo sapiens
tacatgtttactccaagtcagg

SEQ ID NO: 8418297 - DNA, 22 bp, Homo sapiens
tactttaaaaactgataattca

SEQ ID NO: 8418298 - DNA, 22 bp, Homo sapiens
tactgtgggatgttgtgattag

SEQ ID NO: 8418299 - DNA, 18 bp, Homo sapiens
tactgtggatcaggggtt

SEQ ID NO: 8418300 - DNA, 22 bp, Homo sapiens
caggctaaagctttgagcatgt

SEQ ID NO: 8418301 - DNA, 22 bp, Homo sapiens
caggcatggtgagaactcagcc

SEQ ID NO: 8418302 - DNA, 22 bp, Homo sapiens
taatatgggcagtctgaatata

SEQ ID NO: 8418303 - DNA, 21 bp, Homo sapiens
taataattccactacagagta

SEQ ID NO: 8418304 - DNA, 22 bp, Homo sapiens
taataattagttattgatcgtg

SEQ ID NO: 8418305 - DNA, 22 bp, Homo sapiens
taataattggcaatgttgagca

SEQ ID NO: 8418306 - DNA, 22 bp, Homo sapiens
taataattttaaagaaggctag

SEQ ID NO: 8418307 - DNA, 22 bp, Homo sapiens
taataattggctaaccctggga

SEQ ID NO: 8418308 - DNA, 22 bp, Homo sapiens
taatacaatggagttgggcccc

SEQ ID NO: 8418309 - DNA, 22 bp, Homo sapiens
taatacaaggcaggaagcagta

SEQ ID NO: 8418310 - DNA, 22 bp, Homo sapiens
cagctattttctcattaaggat

SEQ ID NO: 8418311 - DNA, 22 bp, Homo sapiens
tttcacatacagtgtatagtag

SEQ ID NO: 8418312 - DNA, 22 bp, Homo sapiens
tttcacataaatggagtaaaga

SEQ ID NO: 8418313 - DNA, 22 bp, Homo sapiens
tttcacataaatattatgccta

SEQ ID NO: 8418314 - DNA, 22 bp, Homo sapiens
tttcctaaggtagtgataattt

SEQ ID NO: 8418315 - DNA, 22 bp, Homo sapiens
tttcaaatggagtcgtgaaatg

SEQ ID NO: 8418316 - DNA, 22 bp, Homo sapiens
tttcaaatggatccctcagcct

SEQ ID NO: 8418317 - DNA, 22 bp, Homo sapiens
ctcctggccctgagctcccagg

SEQ ID NO: 8418318 - DNA, 22 bp, Homo sapiens
tttcctcacacagaagatcttg

SEQ ID NO: 8418319 - DNA, 22 bp, Homo sapiens
ctcctggcaggctgagtgaaat

SEQ ID NO: 8418320 - DNA, 22 bp, Homo sapiens
ctcctggcactgtcttgaccca

SEQ ID NO: 8418321 - DNA, 22 bp, Homo sapiens
ctcctggcagttccccttgtca

SEQ ID NO: 8418322 - DNA, 17 bp, Homo sapiens
ctcctggccacccctct

SEQ ID NO: 8418323 - DNA, 22 bp, Homo sapiens
ctcctggccacgttcttgctgg

SEQ ID NO: 8418324 - DNA, 22 bp, Homo sapiens
ctcctggccccagatcccaatc

SEQ ID NO: 8418325 - DNA, 22 bp, Homo sapiens
ctcctggcactcagtgtggaag

SEQ ID NO: 8418326 - DNA, 22 bp, Homo sapiens
tttagggatgtcagaacaggga

SEQ ID NO: 8418327 - DNA, 22 bp, Homo sapiens
tttagggatgtcagaacaggga

SEQ ID NO: 8418328 - DNA, 21 bp, Homo sapiens
tttagggaggatatttaactt

SEQ ID NO: 8418329 - DNA, 22 bp, Homo sapiens
tttagggaaattgagggttaag

SEQ ID NO: 8418330 - DNA, 22 bp, Homo sapiens
tttagggaaattgagggttaag

SEQ ID NO: 8418331 - DNA, 22 bp, Homo sapiens
tttagggaatagaagatctgaa

SEQ ID NO: 8418332 - DNA, 22 bp, Homo sapiens
tttagggaagaagcccatggcc

SEQ ID NO: 8418333 - DNA, 22 bp, Homo sapiens
tttagggaagaagcccatggcc

SEQ ID NO: 8418334 - DNA, 21 bp, Homo sapiens
tttagggaccaggtcataggc

SEQ ID NO: 8418335 - DNA, 21 bp, Homo sapiens
tttagggaccaggtcataggc

SEQ ID NO: 8418336 - DNA, 22 bp, Homo sapiens
tttagggacaagggtctggggt

SEQ ID NO: 8418337 - DNA, 22 bp, Homo sapiens
tttagtagaatgatacagggca

SEQ ID NO: 8418338 - DNA, 22 bp, Homo sapiens
ttgtacaaaggatttggaagag

SEQ ID NO: 8418339 - DNA, 20 bp, Homo sapiens
ctccacacctgttcgcaggc

SEQ ID NO: 8418340 - DNA, 22 bp, Homo sapiens
ctccacagctcaggctcagagt

SEQ ID NO: 8418341 - DNA, 22 bp, Homo sapiens
ttcttttcggcctgtgagaagg

SEQ ID NO: 8418342 - DNA, 22 bp, Homo sapiens
ttcttttacattaagatttcag

SEQ ID NO: 8418343 - DNA, 22 bp, Homo sapiens
ttcttttagaatttcctaaggt

SEQ ID NO: 8418344 - DNA, 22 bp, Homo sapiens
ttcttttagtcattcagggaag

SEQ ID NO: 8418345 - DNA, 22 bp, Homo sapiens
ttcttttaattgtgggggagtg

SEQ ID NO: 8418346 - DNA, 22 bp, Homo sapiens
ttcttttacattaagatttcag

SEQ ID NO: 8418347 - DNA, 22 bp, Homo sapiens
ttcttttaatttctgtctgcag

SEQ ID NO: 8418348 - DNA, 22 bp, Homo sapiens
ttctttcttagcaatctatggt

SEQ ID NO: 8418349 - DNA, 22 bp, Homo sapiens
ctcccaagctgtgctgaactgt

SEQ ID NO: 8418350 - DNA, 22 bp, Homo sapiens
ctcccaagataaataaggcagt

SEQ ID NO: 8418351 - DNA, 22 bp, Homo sapiens
tttaacagatgctatgtctacc

SEQ ID NO: 8418352 - DNA, 20 bp, Homo sapiens
tttgcgaggccaaggcgggc

SEQ ID NO: 8418353 - DNA, 22 bp, Homo sapiens
tttgctcagttctctgtatttt

SEQ ID NO: 8418354 - DNA, 22 bp, Homo sapiens
tttgggaactctatcatggaaa

SEQ ID NO: 8418355 - DNA, 18 bp, Homo sapiens
tttgggatcctcttttct

SEQ ID NO: 8418356 - DNA, 22 bp, Homo sapiens
tttgggattttacattgtatgg

SEQ ID NO: 8418357 - DNA, 22 bp, Homo sapiens
tttgggatgctagacacctcag

SEQ ID NO: 8418358 - DNA, 22 bp, Homo sapiens
tttgggaaatagtagaaaatgt

SEQ ID NO: 8418359 - DNA, 22 bp, Homo sapiens
tttgggaacaatgaggatctga

SEQ ID NO: 8418360 - DNA, 22 bp, Homo sapiens
ttttagacttgtatgtaaagcc

SEQ ID NO: 8418361 - DNA, 22 bp, Homo sapiens
tttgtacatataaatcttgtat

SEQ ID NO: 8418362 - DNA, 22 bp, Homo sapiens
tttgtacatatataaaatctgt

SEQ ID NO: 8418363 - DNA, 22 bp, Homo sapiens
tttgtacacaggatgttataat

SEQ ID NO: 8418364 - DNA, 22 bp, Homo sapiens
tttgtacagtgatgttgtatgc

SEQ ID NO: 8418365 - DNA, 22 bp, Homo sapiens
tttgtacactgtctactatgaa

SEQ ID NO: 8418366 - DNA, 22 bp, Homo sapiens
ctgacccttgctcgggccctgt

SEQ ID NO: 8418367 - DNA, 22 bp, Homo sapiens
ctgactctgacaggacttgtgg

SEQ ID NO: 8418368 - DNA, 22 bp, Homo sapiens
ctgaggcagagggcagaccaga

SEQ ID NO: 8418369 - DNA, 22 bp, Homo sapiens
ctctttctcgccgcccgcagtc

SEQ ID NO: 8418370 - DNA, 22 bp, Homo sapiens
ctctttccagggtaccccaggt

SEQ ID NO: 8418371 - DNA, 21 bp, Homo sapiens
ctctttatatagtaaagatat

SEQ ID NO: 8418372 - DNA, 17 bp, Homo sapiens
ctctttataaagagtta

SEQ ID NO: 8418373 - DNA, 21 bp, Homo sapiens
ctgaggcatgcaggcctgggc

SEQ ID NO: 8418374 - DNA, 22 bp, Homo sapiens
ctgaggcatgggaagttgggtg

SEQ ID NO: 8418375 - DNA, 22 bp, Homo sapiens
ctgcacagtcatttcctctcaa

SEQ ID NO: 8418376 - DNA, 22 bp, Homo sapiens
ctgcacagtttgatttcttgct

SEQ ID NO: 8418377 - DNA, 22 bp, Homo sapiens
ctgcaggggcctcgagcacagg

SEQ ID NO: 8418378 - DNA, 22 bp, Homo sapiens
ctgcaggggaccaaagtctgac

SEQ ID NO: 8418379 - DNA, 22 bp, Homo sapiens
ctgcagggcagaagggcataga

SEQ ID NO: 8418380 - DNA, 19 bp, Homo sapiens
ctgcagggatgtgcagagt

SEQ ID NO: 8418381 - DNA, 19 bp, Homo sapiens
ctgcagggatgtgcagagt

SEQ ID NO: 8418382 - DNA, 22 bp, Homo sapiens
ctgcagggatgtgaggcccgtt

SEQ ID NO: 8418383 - DNA, 22 bp, Homo sapiens
ctacaggtcaagcagtagctct

SEQ ID NO: 8418384 - DNA, 22 bp, Homo sapiens
ttccaggactcgttctggctca

SEQ ID NO: 8418385 - DNA, 22 bp, Homo sapiens
ctaaatgacaggtaccatagtg

SEQ ID NO: 8418386 - DNA, 22 bp, Homo sapiens
ctacaacattatgctttctgtc

SEQ ID NO: 8418387 - DNA, 16 bp, Homo sapiens
ctacccagtgagaagg

SEQ ID NO: 8418388 - DNA, 22 bp, Homo sapiens
ctactgagtccttcagctgcca

SEQ ID NO: 8418389 - DNA, 19 bp, Homo sapiens
ctactttataatatgcctc

SEQ ID NO: 8418390 - DNA, 22 bp, Homo sapiens
ctacttgttcactgtaggtcgc

SEQ ID NO: 8418391 - DNA, 22 bp, Homo sapiens
ctcacagctgcttcaggatcca

SEQ ID NO: 8418392 - DNA, 22 bp, Homo sapiens
ctcaaggccagttcttctgact

SEQ ID NO: 8418393 - DNA, 22 bp, Homo sapiens
ctattagacacaattagtgatt

SEQ ID NO: 8418394 - DNA, 22 bp, Homo sapiens
ctattaggcttccatttcatgc

SEQ ID NO: 8418395 - DNA, 22 bp, Homo sapiens
ctattaggtatgcagcctattt

SEQ ID NO: 8418396 - DNA, 22 bp, Homo sapiens
ctattaggtatgtggttgctat

SEQ ID NO: 8418397 - DNA, 22 bp, Homo sapiens
ctattaggttggtgcaaaagta

SEQ ID NO: 8418398 - DNA, 22 bp, Homo sapiens
ctattatttcctcatctataaa

SEQ ID NO: 8418399 - DNA, 22 bp, Homo sapiens
ctcaaaatccataaaatcaggt

SEQ ID NO: 8418400 - DNA, 22 bp, Homo sapiens
ctcaaaagacttaaacataaga

SEQ ID NO: 8418401 - DNA, 22 bp, Homo sapiens
ctattaaacactactgtgcact

SEQ ID NO: 8418402 - DNA, 22 bp, Homo sapiens
ctattacatttctggacattca

SEQ ID NO: 8418403 - DNA, 22 bp, Homo sapiens
ctattaaatactcttcaaattg

SEQ ID NO: 8418404 - DNA, 22 bp, Homo sapiens
ttctctggatgtttctcagtca

SEQ ID NO: 8418405 - DNA, 22 bp, Homo sapiens
ctagcactgagaatagtgcata

SEQ ID NO: 8418406 - DNA, 22 bp, Homo sapiens
ctagcacttagggattgttatg

SEQ ID NO: 8418407 - DNA, 22 bp, Homo sapiens
ttcatgaaacttaactgttggg

SEQ ID NO: 8418408 - DNA, 22 bp, Homo sapiens
ttcatcttgatggcttcctaat

SEQ ID NO: 8418409 - DNA, 22 bp, Homo sapiens
cggtggtcataagtggctggcg

SEQ ID NO: 8418410 - DNA, 22 bp, Homo sapiens
ttcatgaaattctcgtgtacct

SEQ ID NO: 8418411 - DNA, 22 bp, Homo sapiens
ttcatgaatatattgaattagc

SEQ ID NO: 8418412 - DNA, 22 bp, Homo sapiens
ttcatgaatgttccatgtgagt

SEQ ID NO: 8418413 - DNA, 22 bp, Homo sapiens
ctaaaattacctaccagtttag

SEQ ID NO: 8418414 - DNA, 22 bp, Homo sapiens
ctaaagacacaataagtagctt

SEQ ID NO: 8418415 - DNA, 22 bp, Homo sapiens
ctaaaggctaggtctgaactca

SEQ ID NO: 8418416 - DNA, 22 bp, Homo sapiens
ctaaaggctcagcattcttttc

SEQ ID NO: 8418417 - DNA, 22 bp, Homo sapiens
ctaaagctcaacaggcactatt

SEQ ID NO: 8418418 - DNA, 22 bp, Homo sapiens
ctaaatactagccttcagattt

SEQ ID NO: 8418419 - DNA, 22 bp, Homo sapiens
ttcacactttggaattccacct

SEQ ID NO: 8418420 - DNA, 22 bp, Homo sapiens
ttcacactgtttttcatagtgg

SEQ ID NO: 8418421 - DNA, 22 bp, Homo sapiens
ttcagggcagagagttcaggga

SEQ ID NO: 8418422 - DNA, 22 bp, Homo sapiens
ttcagcaaaatatctcagatag

SEQ ID NO: 8418423 - DNA, 23 bp, Homo sapiens
ttaggcacttagtagggccagag

SEQ ID NO: 8418424 - DNA, 23 bp, Homo sapiens
cgcccagcctcagtgacctgggc

SEQ ID NO: 8418425 - DNA, 23 bp, Homo sapiens
cgcccagcctcagtgacctgggc

SEQ ID NO: 8418426 - DNA, 22 bp, Homo sapiens
cgccccagccagttgagcggcg

SEQ ID NO: 8418427 - DNA, 22 bp, Homo sapiens
ttcacaatttcccttcatcagg

SEQ ID NO: 8418428 - DNA, 21 bp, Homo sapiens
ttcaatactatttcaatagtc

SEQ ID NO: 8418429 - DNA, 22 bp, Homo sapiens
ttcaatacaaagaaaggaattt

SEQ ID NO: 8418430 - DNA, 22 bp, Homo sapiens
ttcacaattaactttatactta

SEQ ID NO: 8418431 - DNA, 22 bp, Homo sapiens
cctggtttatgccagatcctgt

SEQ ID NO: 8418432 - DNA, 22 bp, Homo sapiens
cctggtttaatgctcactgttg

SEQ ID NO: 8418433 - DNA, 22 bp, Homo sapiens
cctgggctgttgcatcatcctt

SEQ ID NO: 8418434 - DNA, 22 bp, Homo sapiens
ttaaaggcgataaggcagtgtt

SEQ ID NO: 8418435 - DNA, 22 bp, Homo sapiens
ttaaaggcatggttagacatgg

SEQ ID NO: 8418436 - DNA, 22 bp, Homo sapiens
ttaaaggctatggctgcctggg

SEQ ID NO: 8418437 - DNA, 22 bp, Homo sapiens
ttaaaggctgatcttaatatta

SEQ ID NO: 8418438 - DNA, 22 bp, Homo sapiens
ttaaagtgttaactgaagctta

SEQ ID NO: 8418439 - DNA, 22 bp, Homo sapiens
ttaaatagctcttgtagaagaa

SEQ ID NO: 8418440 - DNA, 22 bp, Homo sapiens
cctgtggcttccacgacctaat

SEQ ID NO: 8418441 - DNA, 22 bp, Homo sapiens
cctgtgccttccttaggcacct

SEQ ID NO: 8418442 - DNA, 22 bp, Homo sapiens
cctgtgccctcagcctggctct

SEQ ID NO: 8418443 - DNA, 23 bp, Homo sapiens
ttaaaggcagatgttgagtatta

SEQ ID NO: 8418444 - DNA, 22 bp, Homo sapiens
cctgtctgtcctttgcattctt

SEQ ID NO: 8418445 - DNA, 22 bp, Homo sapiens
cctgtgccatcctgagcatccc

SEQ ID NO: 8418446 - DNA, 18 bp, Homo sapiens
cctgtgacagaggcatca

SEQ ID NO: 8418447 - DNA, 23 bp, Homo sapiens
cctgtgacactgtttgtggtaag

SEQ ID NO: 8418448 - DNA, 22 bp, Homo sapiens
cctgtgacaaacccgcctattc

SEQ ID NO: 8418449 - DNA, 17 bp, Homo sapiens
cctgtcttgtttctgcc

SEQ ID NO: 8418450 - DNA, 17 bp, Homo sapiens
cctgtcttgtttctgcc

SEQ ID NO: 8418451 - DNA, 22 bp, Homo sapiens
cctgtcttagggaaagactgga

SEQ ID NO: 8418452 - DNA, 21 bp, Homo sapiens
cctgtcttggactgaggcacc

SEQ ID NO: 8418453 - DNA, 22 bp, Homo sapiens
cctgtctggaacatggcctgtt

SEQ ID NO: 8418454 - DNA, 22 bp, Homo sapiens
cctgtctgcatgatccctgcca

SEQ ID NO: 8418455 - DNA, 22 bp, Homo sapiens
ccttcccaggctagaccaacat

SEQ ID NO: 8418456 - DNA, 22 bp, Homo sapiens
ttagaatctaacattcttatct

SEQ ID NO: 8418457 - DNA, 22 bp, Homo sapiens
ctggcccaggtggtcgttgagg

SEQ ID NO: 8418458 - DNA, 22 bp, Homo sapiens
ctggccctcggagtccagctgc

SEQ ID NO: 8418459 - DNA, 22 bp, Homo sapiens
ctggctttcatttcaagcacgt

SEQ ID NO: 8418460 - DNA, 22 bp, Homo sapiens
ctgggtctggctactgcttcct

SEQ ID NO: 8418461 - DNA, 22 bp, Homo sapiens
ctgggctgctgtccactagggt

SEQ ID NO: 8418462 - DNA, 22 bp, Homo sapiens
ctgggctgcaggagtggggcaa

SEQ ID NO: 8418463 - DNA, 19 bp, Homo sapiens
ctgggccagagctgtcctc

SEQ ID NO: 8418464 - DNA, 22 bp, Homo sapiens
cttattttaagtcagtttgggt

SEQ ID NO: 8418465 - DNA, 22 bp, Homo sapiens
cttattttgctgatgacccagg

SEQ ID NO: 8418466 - DNA, 22 bp, Homo sapiens
cttcaaaagccagaagcctgcg

SEQ ID NO: 8418467 - DNA, 22 bp, Homo sapiens
ctgttgttcatcatctgtcatt

SEQ ID NO: 8418468 - DNA, 22 bp, Homo sapiens
ctgttggcctttcatcagtaat

SEQ ID NO: 8418469 - DNA, 22 bp, Homo sapiens
cttcaggaaaatctctaaggat

SEQ ID NO: 8418470 - DNA, 22 bp, Homo sapiens
cttcagtgaatgttgagtaagg

SEQ ID NO: 8418471 - DNA, 22 bp, Homo sapiens
cttgatctacatagtgaaaccc

SEQ ID NO: 8418472 - DNA, 22 bp, Homo sapiens
cttcctggccattgccatggca

SEQ ID NO: 8418473 - DNA, 22 bp, Homo sapiens
cttgtccagatgtttgttaggt

SEQ ID NO: 8418474 - DNA, 22 bp, Homo sapiens
ctgtggctgcgccctgggggag

SEQ ID NO: 8418475 - DNA, 23 bp, Homo sapiens
ctgtggctgagtcctgttggagt

SEQ ID NO: 8418476 - DNA, 22 bp, Homo sapiens
ctgtggctctctgcagggtccc

SEQ ID NO: 8418477 - DNA, 22 bp, Homo sapiens
ctgtggctctccaatggaggga

SEQ ID NO: 8418478 - DNA, 20 bp, Homo sapiens
ctgtggctcatgcatctgcc

SEQ ID NO: 8418479 - DNA, 22 bp, Homo sapiens
ctgtggctcattcttggtggca

SEQ ID NO: 8418480 - DNA, 22 bp, Homo sapiens
ctgtggctggctcatcataggt

SEQ ID NO: 8418481 - DNA, 22 bp, Homo sapiens
ctgttctttagttccactgcaa

SEQ ID NO: 8418482 - DNA, 22 bp, Homo sapiens
gagctgaattgctgccatttgc

SEQ ID NO: 8418483 - DNA, 22 bp, Homo sapiens
gagctgaagcgctacagcatcc

SEQ ID NO: 8418484 - DNA, 22 bp, Homo sapiens
gagcttcatatgttgcagagaa

SEQ ID NO: 8418485 - DNA, 22 bp, Homo sapiens
gagcctcctcctggtgtgccga

SEQ ID NO: 8418486 - DNA, 22 bp, Homo sapiens
gagcctcgtggcggccactgcg

SEQ ID NO: 8418487 - DNA, 22 bp, Homo sapiens
gaggaggaaaggagttgaaatg

SEQ ID NO: 8418488 - DNA, 22 bp, Homo sapiens
gaggaggaagttctctgtaggc

SEQ ID NO: 8418489 - DNA, 22 bp, Homo sapiens
gaggaggaagttctctgtaggc

SEQ ID NO: 8418490 - DNA, 22 bp, Homo sapiens
gaggaaaatgcaacaggaatgc

SEQ ID NO: 8418491 - DNA, 22 bp, Homo sapiens
gaggcaaggccgcacgtctcag

SEQ ID NO: 8418492 - DNA, 22 bp, Homo sapiens
gagatggagtctttttctgtca

SEQ ID NO: 8418493 - DNA, 22 bp, Homo sapiens
gagccagaaaagctgcctgact

SEQ ID NO: 8418494 - DNA, 17 bp, Homo sapiens
gagccaccctgtgcgag

SEQ ID NO: 8418495 - DNA, 22 bp, Homo sapiens
gagccaccttcaactcaggaat

SEQ ID NO: 8418496 - DNA, 22 bp, Homo sapiens
gagccaggggtcagctccgagg

SEQ ID NO: 8418497 - DNA, 22 bp, Homo sapiens
gagaggctgggttggagatcga

SEQ ID NO: 8418498 - DNA, 22 bp, Homo sapiens
gagaggcatggaacagattctt

SEQ ID NO: 8418499 - DNA, 22 bp, Homo sapiens
gagacacaaacacatttagagg

SEQ ID NO: 8418500 - DNA, 22 bp, Homo sapiens
gagacaaagcttcctgtgggta

SEQ ID NO: 8418501 - DNA, 22 bp, Homo sapiens
gacctcagtgaatggtcatgta

SEQ ID NO: 8418502 - DNA, 22 bp, Homo sapiens
gagaaggagtagctgacctggg

SEQ ID NO: 8418503 - DNA, 22 bp, Homo sapiens
gagaatgggaatgaaagtagca

SEQ ID NO: 8418504 - DNA, 22 bp, Homo sapiens
ctttcatttgataagaatgcca

SEQ ID NO: 8418505 - DNA, 22 bp, Homo sapiens
ctttcatttgataagaatgcca

SEQ ID NO: 8418506 - DNA, 23 bp, Homo sapiens
ctttcattgtggtttcacagagc

SEQ ID NO: 8418507 - DNA, 22 bp, Homo sapiens
ctttcattcttagatattagtg

SEQ ID NO: 8418508 - DNA, 22 bp, Homo sapiens
ctttcacagcacaagcctgcct

SEQ ID NO: 8418509 - DNA, 22 bp, Homo sapiens
ctttcacacacatacatttgga

SEQ ID NO: 8418510 - DNA, 22 bp, Homo sapiens
gaagatttaagcacaatagtct

SEQ ID NO: 8418511 - DNA, 23 bp, Homo sapiens
gaagccctcattggttctccaga

SEQ ID NO: 8418512 - DNA, 19 bp, Homo sapiens
gaagccctgcattctccgc

SEQ ID NO: 8418513 - DNA, 22 bp, Homo sapiens
gaagaggcaattgaataagcta

SEQ ID NO: 8418514 - DNA, 22 bp, Homo sapiens
gaagacaattctgggtggagga

SEQ ID NO: 8418515 - DNA, 22 bp, Homo sapiens
gaatattagtatcagttatacc

SEQ ID NO: 8418516 - DNA, 22 bp, Homo sapiens
gaatatcccgctatgcaaagta

SEQ ID NO: 8418517 - DNA, 22 bp, Homo sapiens
gacaagatttagagtctgctaa

SEQ ID NO: 8418518 - DNA, 22 bp, Homo sapiens
gacaagattaaccatagttaag

SEQ ID NO: 8418519 - DNA, 22 bp, Homo sapiens
gacaagatgagcagctcagtgt

SEQ ID NO: 8418520 - DNA, 22 bp, Homo sapiens
gacaagatgacatcatggcttc

SEQ ID NO: 8418521 - DNA, 22 bp, Homo sapiens
gacaagattaaccatagttaag

SEQ ID NO: 8418522 - DNA, 22 bp, Homo sapiens
gacaagacattggtaaagatat

SEQ ID NO: 8418523 - DNA, 22 bp, Homo sapiens
gacaagataatgaagtgcaatt

SEQ ID NO: 8418524 - DNA, 22 bp, Homo sapiens
gaagcctcaacatctctgcgtc

SEQ ID NO: 8418525 - DNA, 22 bp, Homo sapiens
gaatacaagcctgccacctgga

SEQ ID NO: 8418526 - DNA, 22 bp, Homo sapiens
gaatacaagccaggcacaaggc

SEQ ID NO: 8418527 - DNA, 22 bp, Homo sapiens
gacaggctttgagtcccagaac

SEQ ID NO: 8418528 - DNA, 22 bp, Homo sapiens
gacaggcttcctaagtgccaga

SEQ ID NO: 8418529 - DNA, 22 bp, Homo sapiens
gacaagtcatctggggcctgtg

SEQ ID NO: 8418530 - DNA, 22 bp, Homo sapiens
gacaggtggggaaactaaggta

SEQ ID NO: 8418531 - DNA, 22 bp, Homo sapiens
gacccataggaatctgttgtcc

SEQ ID NO: 8418532 - DNA, 22 bp, Homo sapiens
gacccatatatacgtaatttgt

SEQ ID NO: 8418533 - DNA, 22 bp, Homo sapiens
gacccatataggaccctccaaa

SEQ ID NO: 8418534 - DNA, 22 bp, Homo sapiens
gaccctgtttctacaaataatt

SEQ ID NO: 8418535 - DNA, 22 bp, Homo sapiens
gggagaagtggaaatctcatta

SEQ ID NO: 8418536 - DNA, 22 bp, Homo sapiens
ggcttgggagcaggcatgtgac

SEQ ID NO: 8418537 - DNA, 22 bp, Homo sapiens
gggagaggttacccgagcaact

SEQ ID NO: 8418538 - DNA, 22 bp, Homo sapiens
gggagctgtaagggacaggtag

SEQ ID NO: 8418539 - DNA, 22 bp, Homo sapiens
gggaggaatgcaacttatttag

SEQ ID NO: 8418540 - DNA, 22 bp, Homo sapiens
gggaggacggtccagggcaaag

SEQ ID NO: 8418541 - DNA, 22 bp, Homo sapiens
gggaggaaggcttgggtgagta

SEQ ID NO: 8418542 - DNA, 21 bp, Homo sapiens
gggaggaagctgcttctctct

SEQ ID NO: 8418543 - DNA, 22 bp, Homo sapiens
gggaggaaatgtgcagcgaatt

SEQ ID NO: 8418544 - DNA, 22 bp, Homo sapiens
gggaggaaagagaagtggtcca

SEQ ID NO: 8418545 - DNA, 22 bp, Homo sapiens
gggcaacagagcgagggcctgt

SEQ ID NO: 8418546 - DNA, 22 bp, Homo sapiens
ggctgctgaagtgtggcaatct

SEQ ID NO: 8418547 - DNA, 22 bp, Homo sapiens
ggctccaccctgcttccagaag

SEQ ID NO: 8418548 - DNA, 22 bp, Homo sapiens
ggctccactgctgaccactcca

SEQ ID NO: 8418549 - DNA, 22 bp, Homo sapiens
ggctgaatgttggacacttacg

SEQ ID NO: 8418550 - DNA, 22 bp, Homo sapiens
ggctctgggaaatggtcttcct

SEQ ID NO: 8418551 - DNA, 22 bp, Homo sapiens
ggcctgatctttgaccctcatc

SEQ ID NO: 8418552 - DNA, 23 bp, Homo sapiens
ggcctctgtgttctgcccacatg

SEQ ID NO: 8418553 - DNA, 22 bp, Homo sapiens
ggcctctgtttggagccaggat

SEQ ID NO: 8418554 - DNA, 22 bp, Homo sapiens
ggcctctggttcacagggagga

SEQ ID NO: 8418555 - DNA, 22 bp, Homo sapiens
ggcctcagagaaggctgtgcgg

SEQ ID NO: 8418556 - DNA, 22 bp, Homo sapiens
ggagtcacacaggaagaaggac

SEQ ID NO: 8418557 - DNA, 22 bp, Homo sapiens
ggattttagagtacctaagtgt

SEQ ID NO: 8418558 - DNA, 19 bp, Homo sapiens
ggcaagcacaaaagctttg

SEQ ID NO: 8418559 - DNA, 21 bp, Homo sapiens
ggcaacagatattttgcttag

SEQ ID NO: 8418560 - DNA, 22 bp, Homo sapiens
gggccaagggtgcgtggcagga

SEQ ID NO: 8418561 - DNA, 22 bp, Homo sapiens
gggctgctgtgttcctgaggca

SEQ ID NO: 8418562 - DNA, 22 bp, Homo sapiens
gggcttggctcataagtggatg

SEQ ID NO: 8418563 - DNA, 22 bp, Homo sapiens
gggcttggccccagaagagcta

SEQ ID NO: 8418564 - DNA, 22 bp, Homo sapiens
gggcttggctggggccaccaga

SEQ ID NO: 8418565 - DNA, 19 bp, Homo sapiens
gggcttggggctgaagcct

SEQ ID NO: 8418566 - DNA, 20 bp, Homo sapiens
gggcttggaggactcgaggg

SEQ ID NO: 8418567 - DNA, 22 bp, Homo sapiens
gggcttggcacatgggctcagc

SEQ ID NO: 8418568 - DNA, 22 bp, Homo sapiens
gggcttggagtaggctgatgaa

SEQ ID NO: 8418569 - DNA, 22 bp, Homo sapiens
ggggaagaggcgtgatggatcc

SEQ ID NO: 8418570 - DNA, 22 bp, Homo sapiens
gggcttggtggagagaatgctg

SEQ ID NO: 8418571 - DNA, 22 bp, Homo sapiens
gggcttgggtattgtgagaggt

SEQ ID NO: 8418572 - DNA, 22 bp, Homo sapiens
ggggctcagttcggacagcctg

SEQ ID NO: 8418573 - DNA, 22 bp, Homo sapiens
ggggctccagtcttcacatttt

SEQ ID NO: 8418574 - DNA, 22 bp, Homo sapiens
ggtggctctcttaagggcagcg

SEQ ID NO: 8418575 - DNA, 22 bp, Homo sapiens
ggtggctcggccagtgcaggcc

SEQ ID NO: 8418576 - DNA, 22 bp, Homo sapiens
ggtttcaaagtggacagttagt

SEQ ID NO: 8418577 - DNA, 22 bp, Homo sapiens
ggtttattaatgtgaactgtat

SEQ ID NO: 8418578 - DNA, 21 bp, Homo sapiens
ggtggctcacctgattggata

SEQ ID NO: 8418579 - DNA, 18 bp, Homo sapiens
ggtggctcagtcatgggg

SEQ ID NO: 8418580 - DNA, 22 bp, Homo sapiens
gtccactgctgtgtgcttcacc

SEQ ID NO: 8418581 - DNA, 22 bp, Homo sapiens
gtccaagagtcaagaagggggc

SEQ ID NO: 8418582 - DNA, 22 bp, Homo sapiens
ggtttcaacttttgtgaggaat

SEQ ID NO: 8418583 - DNA, 22 bp, Homo sapiens
ggtttcaacttcaacctctcca

SEQ ID NO: 8418584 - DNA, 22 bp, Homo sapiens
ggtttcaaattaaagtcttaag

SEQ ID NO: 8418585 - DNA, 22 bp, Homo sapiens
ggtttcaactcagctagtaagg

SEQ ID NO: 8418586 - DNA, 22 bp, Homo sapiens
ggtttcaactaaatcaagaagg

SEQ ID NO: 8418587 - DNA, 22 bp, Homo sapiens
ggtttcacaatttagagcagtg

SEQ ID NO: 8418588 - DNA, 22 bp, Homo sapiens
ggtttcaatgagaagtgcttgt

SEQ ID NO: 8418589 - DNA, 22 bp, Homo sapiens
gtacccaggcacgccttgctga

SEQ ID NO: 8418590 - DNA, 22 bp, Homo sapiens
gtacccagaggcatgatcccag

SEQ ID NO: 8418591 - DNA, 22 bp, Homo sapiens
gtatttataggggaatgagagt

SEQ ID NO: 8418592 - DNA, 22 bp, Homo sapiens
gtagaatatatggttagtattg

SEQ ID NO: 8418593 - DNA, 20 bp, Homo sapiens
gtattaggaggtaaatgtaa

SEQ ID NO: 8418594 - DNA, 22 bp, Homo sapiens
gtattaggaaatatgaagaaag

SEQ ID NO: 8418595 - DNA, 22 bp, Homo sapiens
gtattaggaggaacacaggcct

SEQ ID NO: 8418596 - DNA, 22 bp, Homo sapiens
gtattaggtggtggaattgtag

SEQ ID NO: 8418597 - DNA, 22 bp, Homo sapiens
gtattaggaggtggagcctttg

SEQ ID NO: 8418598 - DNA, 22 bp, Homo sapiens
gtattagggccaaaggcaggaa

SEQ ID NO: 8418599 - DNA, 22 bp, Homo sapiens
gtattaggttggtgcaaaattg

SEQ ID NO: 8418600 - DNA, 20 bp, Homo sapiens
gtattaggtgttcctctttc

SEQ ID NO: 8418601 - DNA, 22 bp, Homo sapiens
gtattaggttggtgcaaaagta

SEQ ID NO: 8418602 - DNA, 22 bp, Homo sapiens
gtgaccatcatctcagctagtt

SEQ ID NO: 8418603 - DNA, 23 bp, Homo sapiens
gtgacccaaggaccttccagaat

SEQ ID NO: 8418604 - DNA, 22 bp, Homo sapiens
gtgacccagaggctgactaaca

SEQ ID NO: 8418605 - DNA, 22 bp, Homo sapiens
gtgacccaggtaggtaagcaat

SEQ ID NO: 8418606 - DNA, 22 bp, Homo sapiens
gtgacccaggacactgtgtatc

SEQ ID NO: 8418607 - DNA, 22 bp, Homo sapiens
gtgaacaggagaaagtgatgga

SEQ ID NO: 8418608 - DNA, 22 bp, Homo sapiens
gtgaaatattttgtttatgtca

SEQ ID NO: 8418609 - DNA, 22 bp, Homo sapiens
gtgacccatgcagtggttttgg

SEQ ID NO: 8418610 - DNA, 22 bp, Homo sapiens
gtgagaagataagtattgcaaa

SEQ ID NO: 8418611 - DNA, 22 bp, Homo sapiens
gtgcatttgtgcatgcacatgt

SEQ ID NO: 8418612 - DNA, 22 bp, Homo sapiens
gtgccaaaagctataatttggt

SEQ ID NO: 8418613 - DNA, 22 bp, Homo sapiens
gtgcattccaccgtgcaggttg

SEQ ID NO: 8418614 - DNA, 22 bp, Homo sapiens
gtgcatatatgcacatatgtgt

SEQ ID NO: 8418615 - DNA, 22 bp, Homo sapiens
gtgcagagtgtctgtggactga

SEQ ID NO: 8418616 - DNA, 20 bp, Homo sapiens
gtgcagatgtcctttcacac

SEQ ID NO: 8418617 - DNA, 22 bp, Homo sapiens
gtgcagatcctgattgcagttc

SEQ ID NO: 8418618 - DNA, 22 bp, Homo sapiens
gtgcagtggcagatcctagctc

SEQ ID NO: 8418619 - DNA, 22 bp, Homo sapiens
gtgcagggtcctaattgttaag

SEQ ID NO: 8418620 - DNA, 22 bp, Homo sapiens
gctgcgccggatcccacgttcc

SEQ ID NO: 8418621 - DNA, 22 bp, Homo sapiens
gctgctgttcctccagtggatc

SEQ ID NO: 8418622 - DNA, 22 bp, Homo sapiens
gctgcccagacattgaatcagg

SEQ ID NO: 8418623 - DNA, 22 bp, Homo sapiens
gctgaggccccagggtgatggg

SEQ ID NO: 8418624 - DNA, 22 bp, Homo sapiens
gctgaggctcaagtcatgggtc

SEQ ID NO: 8418625 - DNA, 23 bp, Homo sapiens
gctcagaggtttttctctggatg

SEQ ID NO: 8418626 - DNA, 22 bp, Homo sapiens
gcctgagctttaattttcttgt

SEQ ID NO: 8418627 - DNA, 22 bp, Homo sapiens
gcctctggggtggagcccagca

SEQ ID NO: 8418628 - DNA, 18 bp, Homo sapiens
gcctctgttgcttgcctg

SEQ ID NO: 8418629 - DNA, 22 bp, Homo sapiens
gcctctgtggctcagccttgct

SEQ ID NO: 8418630 - DNA, 22 bp, Homo sapiens
gcctctgtcatagctcatgtga

SEQ ID NO: 8418631 - DNA, 22 bp, Homo sapiens
gccttgtttcattacacgtggt

SEQ ID NO: 8418632 - DNA, 22 bp, Homo sapiens
gcctttgctgtgacaatgctgg

SEQ ID NO: 8418633 - DNA, 23 bp, Homo sapiens
gcgtccggcctctctcgctcccg

SEQ ID NO: 8418634 - DNA, 22 bp, Homo sapiens
gcgtccagggaaggcccagctg

SEQ ID NO: 8418635 - DNA, 18 bp, Homo sapiens
ggacatcatcaggtgctt

SEQ ID NO: 8418636 - DNA, 22 bp, Homo sapiens
ggagacagtgacttagagactg

SEQ ID NO: 8418637 - DNA, 22 bp, Homo sapiens
gctttattttgtgagggattac

SEQ ID NO: 8418638 - DNA, 22 bp, Homo sapiens
gctttattttgtgagggattac

SEQ ID NO: 8418639 - DNA, 22 bp, Homo sapiens
gctttgctgaggtctgaggatt

SEQ ID NO: 8418640 - DNA, 22 bp, Homo sapiens
gctttgctggaatcaacgaatg

SEQ ID NO: 8418641 - DNA, 22 bp, Homo sapiens
gctttgctatgactcaccagca

SEQ ID NO: 8418642 - DNA, 22 bp, Homo sapiens
gctttggaaatatagactcaag

SEQ ID NO: 8418643 - DNA, 22 bp, Homo sapiens
gctttgctgggtgcttcatgta

SEQ ID NO: 8418644 - DNA, 22 bp, Homo sapiens
gctttgcttcctgttctagcct

SEQ ID NO: 8418645 - DNA, 22 bp, Homo sapiens
ggaatgttctggtctggttcat

SEQ ID NO: 8418646 - DNA, 22 bp, Homo sapiens
ggaatgttgtcatttacattat

SEQ ID NO: 8418647 - DNA, 22 bp, Homo sapiens
ggaatgttctggaacaccgctt

SEQ ID NO: 8418648 - DNA, 23 bp, Homo sapiens
ggaatgtttacctgtgaatgtca

SEQ ID NO: 8418649 - DNA, 22 bp, Homo sapiens
ggaatgttttagcttgactttt

SEQ ID NO: 8418650 - DNA, 22 bp, Homo sapiens
ggaatgtttgctcccttcaggg

SEQ ID NO: 8418651 - DNA, 22 bp, Homo sapiens
ggacaaaacttcttgcatttct

SEQ ID NO: 8418652 - DNA, 22 bp, Homo sapiens
ggacaaaaatcagccatctcta

SEQ ID NO: 8418653 - DNA, 22 bp, Homo sapiens
ggacaaaatccaaacttcttag

SEQ ID NO: 8418654 - DNA, 22 bp, Homo sapiens
ggaatgttttccagacctagat

SEQ ID NO: 8418655 - DNA, 22 bp, Homo sapiens
ggaatgtttttcattgctctct

SEQ ID NO: 8418656 - DNA, 22 bp, Homo sapiens
gctgtggcggcagcagctggtg

SEQ ID NO: 8418657 - DNA, 22 bp, Homo sapiens
gctgtggctgaagatgcaggga

SEQ ID NO: 8418658 - DNA, 22 bp, Homo sapiens
gctgtggctgacattgcagaca

SEQ ID NO: 8418659 - DNA, 22 bp, Homo sapiens
gctgtggctgaccaccaggggg

SEQ ID NO: 8418660 - DNA, 22 bp, Homo sapiens
gctgtggctccaatggtgagcc

SEQ ID NO: 8418661 - DNA, 22 bp, Homo sapiens
gctgtggctctcacaagcaaat

SEQ ID NO: 8418662 - DNA, 22 bp, Homo sapiens
gctgtggctttctgtttctgtt

SEQ ID NO: 8418663 - DNA, 22 bp, Homo sapiens
gctgtggcttgcagctggggct

SEQ ID NO: 8418664 - DNA, 22 bp, Homo sapiens
gctgtggctgtacagagaccat

SEQ ID NO: 8418665 - DNA, 22 bp, Homo sapiens
gcttggaagtaggattgggaga

SEQ ID NO: 8418666 - DNA, 18 bp, Homo sapiens
gctttatttcttggggaa

SEQ ID NO: 8418667 - DNA, 18 bp, Homo sapiens
gctttatttcttggggaa

SEQ ID NO: 8418668 - DNA, 22 bp, Homo sapiens
gcttctttccttgggctggaac

SEQ ID NO: 8418669 - DNA, 22 bp, Homo sapiens
gctgtgtatcagatgccacggg

SEQ ID NO: 8418670 - DNA, 22 bp, Homo sapiens
gctgggcttctcaatgctgcct

SEQ ID NO: 8418671 - DNA, 22 bp, Homo sapiens
gctggcttgacagaggcctggg

SEQ ID NO: 8418672 - DNA, 22 bp, Homo sapiens
gcccagcttttcacttccacac

SEQ ID NO: 8418673 - DNA, 22 bp, Homo sapiens
gcccagctggcttccagcacat

SEQ ID NO: 8418674 - DNA, 22 bp, Homo sapiens
gcccagcagatctcagtgtctc

SEQ ID NO: 8418675 - DNA, 22 bp, Homo sapiens
gccccagccctgtggaccatgg

SEQ ID NO: 8418676 - DNA, 22 bp, Homo sapiens
gccccagcctagttttctttca

SEQ ID NO: 8418677 - DNA, 22 bp, Homo sapiens
gccccagcctcccgagtagctg

SEQ ID NO: 8418678 - DNA, 22 bp, Homo sapiens
gccccagccaaggtgacacgaa

SEQ ID NO: 8418679 - DNA, 22 bp, Homo sapiens
gccccagccaaggtgacacgaa

SEQ ID NO: 8418680 - DNA, 22 bp, Homo sapiens
gccccagctctgccacaactag

SEQ ID NO: 8418681 - DNA, 22 bp, Homo sapiens
gccccagctctgccacaactag

SEQ ID NO: 8418682 - DNA, 22 bp, Homo sapiens
gcagtggcccagcttgcaggct

SEQ ID NO: 8418683 - DNA, 22 bp, Homo sapiens
gcaggggagtggcaggcccgga

SEQ ID NO: 8418684 - DNA, 22 bp, Homo sapiens
gcaggggagtccactctatgca

SEQ ID NO: 8418685 - DNA, 22 bp, Homo sapiens
gcaggggagtggatgatggatt

SEQ ID NO: 8418686 - DNA, 22 bp, Homo sapiens
gccaggcatgtcctctgcagaa

SEQ ID NO: 8418687 - DNA, 22 bp, Homo sapiens
gccaggcatgggcttctgggcg

SEQ ID NO: 8418688 - DNA, 22 bp, Homo sapiens
gccaggcaggccacgctgtgtt

SEQ ID NO: 8418689 - DNA, 22 bp, Homo sapiens
gccaggcagctgggagggtgcc

SEQ ID NO: 8418690 - DNA, 22 bp, Homo sapiens
gccaggcagctagcaacccctg

SEQ ID NO: 8418691 - DNA, 22 bp, Homo sapiens
gccaggcagttcaagtacacca

SEQ ID NO: 8418692 - DNA, 22 bp, Homo sapiens
gccaggcaggtgtcggagccct

SEQ ID NO: 8418693 - DNA, 18 bp, Homo sapiens
gccaggcagggtggggaa

SEQ ID NO: 8418694 - DNA, 22 bp, Homo sapiens
gccaggcagcagcgaggatggt

SEQ ID NO: 8418695 - DNA, 22 bp, Homo sapiens
gccaggcagcaggaagccagtg

SEQ ID NO: 8418696 - DNA, 22 bp, Homo sapiens
gccaggcagccaccctctgcga

SEQ ID NO: 8418697 - DNA, 22 bp, Homo sapiens
gccaggcagatatgtgagctta

SEQ ID NO: 8418698 - DNA, 22 bp, Homo sapiens
gccaggcactgctctaagccct

SEQ ID NO: 8418699 - DNA, 22 bp, Homo sapiens
gccaggcagagccccgtgcagc

SEQ ID NO: 8418700 - DNA, 22 bp, Homo sapiens
gccaggcagacaggtcatcagg

SEQ ID NO: 8418701 - DNA, 20 bp, Homo sapiens
gccaggcactgttctcaata

SEQ ID NO: 8418702 - DNA, 22 bp, Homo sapiens
gccagctctgtggctgtacttg

SEQ ID NO: 8418703 - DNA, 22 bp, Homo sapiens
gccagctcagtttcaaagtagg

SEQ ID NO: 8418704 - DNA, 22 bp, Homo sapiens
gccagccttctgtggcctgcaa

SEQ ID NO: 8418705 - DNA, 22 bp, Homo sapiens
gcaaatcaccacctagctggat

SEQ ID NO: 8418706 - DNA, 22 bp, Homo sapiens
gcaaatatttctaattcctgaa

SEQ ID NO: 8418707 - DNA, 22 bp, Homo sapiens
gcaaatattcaagacttttcca

SEQ ID NO: 8418708 - DNA, 22 bp, Homo sapiens
gcaaatacatgttgagcaccta

SEQ ID NO: 8418709 - DNA, 22 bp, Homo sapiens
gcagagcaccctgcagtggtat

SEQ ID NO: 8418710 - DNA, 22 bp, Homo sapiens
gcacatatgtaaatagctgcct

SEQ ID NO: 8418711 - DNA, 22 bp, Homo sapiens
gcagctttttggatgtcagtta

SEQ ID NO: 8418712 - DNA, 18 bp, Homo sapiens
gcagcttttgattcaccc

SEQ ID NO: 8418713 - DNA, 22 bp, Homo sapiens
gcagctttgtggagaggcccat

SEQ ID NO: 8418714 - DNA, 22 bp, Homo sapiens
gcagctttctttttgcatgtct

SEQ ID NO: 8418715 - DNA, 22 bp, Homo sapiens
gcagctttcttgccctaatctt

SEQ ID NO: 8418716 - DNA, 22 bp, Homo sapiens
gcagctttctgggacagaaagg

SEQ ID NO: 8418717 - DNA, 22 bp, Homo sapiens
gcagctttgtaaagtatgaagc

SEQ ID NO: 8418718 - DNA, 22 bp, Homo sapiens
gcagctttgtcacggagtgtcg

SEQ ID NO: 8418719 - DNA, 22 bp, Homo sapiens
gcagctttggaggtggaactct

SEQ ID NO: 8418720 - DNA, 22 bp, Homo sapiens
gcagctttgaagacttatttgc

SEQ ID NO: 8418721 - DNA, 22 bp, Homo sapiens
gcagctttctacttcctacagc

SEQ ID NO: 8418722 - DNA, 22 bp, Homo sapiens
gcagctttctgcaatgtcatcc

SEQ ID NO: 8418723 - DNA, 22 bp, Homo sapiens
gcagggacaactgtgcacctga

SEQ ID NO: 8418724 - DNA, 22 bp, Homo sapiens
gcagggacatcttcagatcact

SEQ ID NO: 8418725 - DNA, 22 bp, Homo sapiens
gcagggaccagggccagatcca

SEQ ID NO: 8418726 - DNA, 22 bp, Homo sapiens
gcagggacctcactacccccag

SEQ ID NO: 8418727 - DNA, 22 bp, Homo sapiens
gcagggctgggtgggagacaga

SEQ ID NO: 8418728 - DNA, 22 bp, Homo sapiens
gcagggctgtaatttgagcctg

SEQ ID NO: 8418729 - DNA, 22 bp, Homo sapiens
gcagggctggggctgctcctga

SEQ ID NO: 8418730 - DNA, 22 bp, Homo sapiens
gcagggcttagaaatggtggct

SEQ ID NO: 8418731 - DNA, 22 bp, Homo sapiens
gcagggctgtggacactttggt

SEQ ID NO: 8418732 - DNA, 22 bp, Homo sapiens
gcagggctgttcaggagggtgg

SEQ ID NO: 8418733 - DNA, 22 bp, Homo sapiens
tcagcactttttaaagcagcat

SEQ ID NO: 8418734 - DNA, 22 bp, Homo sapiens
tcagcacttttactctctttgc

SEQ ID NO: 8418735 - DNA, 22 bp, Homo sapiens
tcagcactttgaagcagaagga

SEQ ID NO: 8418736 - DNA, 22 bp, Homo sapiens
tcaggagtaaagaagacttgac

SEQ ID NO: 8418737 - DNA, 22 bp, Homo sapiens
tcaggatgtccaaaatccagcc

SEQ ID NO: 8418738 - DNA, 22 bp, Homo sapiens
tcagggacgtgagctcagagtc

SEQ ID NO: 8418739 - DNA, 22 bp, Homo sapiens
tcagggacccctctgagtggag

SEQ ID NO: 8418740 - DNA, 23 bp, Homo sapiens
tcagggacatgatgtgtcatatc

SEQ ID NO: 8418741 - DNA, 22 bp, Homo sapiens
tcagggacagggtgctgctgcg

SEQ ID NO: 8418742 - DNA, 22 bp, Homo sapiens
tcagtgcagggtgggagagaga

SEQ ID NO: 8418743 - DNA, 21 bp, Homo sapiens
tcagtgcaattctatggggaa

SEQ ID NO: 8418744 - DNA, 22 bp, Homo sapiens
tcattcaggttgggcaagtgtc

SEQ ID NO: 8418745 - DNA, 23 bp, Homo sapiens
tcattcaaggctggtatctttca

SEQ ID NO: 8418746 - DNA, 22 bp, Homo sapiens
tcattcaatgtaagcatatata

SEQ ID NO: 8418747 - DNA, 22 bp, Homo sapiens
tcattcaagatttcaatagatt

SEQ ID NO: 8418748 - DNA, 18 bp, Homo sapiens
tcattcaaagtctactga

SEQ ID NO: 8418749 - DNA, 20 bp, Homo sapiens
tcattacagtgctaagatgt

SEQ ID NO: 8418750 - DNA, 22 bp, Homo sapiens
tcattacagtgtttatatgtct

SEQ ID NO: 8418751 - DNA, 22 bp, Homo sapiens
tcatggattaaattattaagtt

SEQ ID NO: 8418752 - DNA, 22 bp, Homo sapiens
tcatagctaagctccagagtgc

SEQ ID NO: 8418753 - DNA, 22 bp, Homo sapiens
tcataggagtagcagtgagagg

SEQ ID NO: 8418754 - DNA, 22 bp, Homo sapiens
tcaaggaggtgcttggcttcac

SEQ ID NO: 8418755 - DNA, 22 bp, Homo sapiens
tcaaggagcccacagtctaatg

SEQ ID NO: 8418756 - DNA, 22 bp, Homo sapiens
tcaaggagcccacagtctaatg

SEQ ID NO: 8418757 - DNA, 21 bp, Homo sapiens
tcaaggagtttctcttttcca

SEQ ID NO: 8418758 - DNA, 22 bp, Homo sapiens
tcaaggagacagaaagcaatgg

SEQ ID NO: 8418759 - DNA, 22 bp, Homo sapiens
tcaagagattgaataataactg

SEQ ID NO: 8418760 - DNA, 22 bp, Homo sapiens
tcaagagaaggggaaatagact

SEQ ID NO: 8418761 - DNA, 22 bp, Homo sapiens
tcaagagaaggggaaatagact

SEQ ID NO: 8418762 - DNA, 22 bp, Homo sapiens
tcacaatggcatagtataaaat

SEQ ID NO: 8418763 - DNA, 22 bp, Homo sapiens
tcacaatgaaaaacactacata

SEQ ID NO: 8418764 - DNA, 20 bp, Homo sapiens
tcacaatatgagctcataca

SEQ ID NO: 8418765 - DNA, 22 bp, Homo sapiens
tcacaatatttatcttccaatt

SEQ ID NO: 8418766 - DNA, 22 bp, Homo sapiens
tcacaggcttgtgaacattgca

SEQ ID NO: 8418767 - DNA, 22 bp, Homo sapiens
tcagcactgatagaagtcaata

SEQ ID NO: 8418768 - DNA, 22 bp, Homo sapiens
tcagcactgatgtttcagaaga

SEQ ID NO: 8418769 - DNA, 22 bp, Homo sapiens
tcagagaggttggtgataagaa

SEQ ID NO: 8418770 - DNA, 22 bp, Homo sapiens
tcagagaggttaaatatcttgt

SEQ ID NO: 8418771 - DNA, 23 bp, Homo sapiens
tcagagaggccccctgcagagat

SEQ ID NO: 8418772 - DNA, 22 bp, Homo sapiens
tcagagaggcaatactgtttaa

SEQ ID NO: 8418773 - DNA, 22 bp, Homo sapiens
tcagaaaagaccacattattct

SEQ ID NO: 8418774 - DNA, 22 bp, Homo sapiens
tcagaaaagagaaaatcttata

SEQ ID NO: 8418775 - DNA, 22 bp, Homo sapiens
tcacattttttactggacttaa

SEQ ID NO: 8418776 - DNA, 22 bp, Homo sapiens
tcaccaagtccatatgcatcat

SEQ ID NO: 8418777 - DNA, 22 bp, Homo sapiens
tcactttactttgttaatctgg

SEQ ID NO: 8418778 - DNA, 22 bp, Homo sapiens
tcactttacagatgggaaaact

SEQ ID NO: 8418779 - DNA, 22 bp, Homo sapiens
tcactttacagctaaggttgtt

SEQ ID NO: 8418780 - DNA, 22 bp, Homo sapiens
tccaggcataagccttgagtgt

SEQ ID NO: 8418781 - DNA, 22 bp, Homo sapiens
tccaggcatagaaggcacgcac

SEQ ID NO: 8418782 - DNA, 22 bp, Homo sapiens
tccaggcataatgcccagtggt

SEQ ID NO: 8418783 - DNA, 22 bp, Homo sapiens
tccaggcagttttccaggttgt

SEQ ID NO: 8418784 - DNA, 22 bp, Homo sapiens
tccaggcagtcattaatctcta

SEQ ID NO: 8418785 - DNA, 22 bp, Homo sapiens
tccaggcagggttaagggtcct

SEQ ID NO: 8418786 - DNA, 22 bp, Homo sapiens
tccaggcagggcagccatcaag

SEQ ID NO: 8418787 - DNA, 22 bp, Homo sapiens
tccaggaggtgaggggaccaaa

SEQ ID NO: 8418788 - DNA, 22 bp, Homo sapiens
tccaggagggttttctgccttc

SEQ ID NO: 8418789 - DNA, 22 bp, Homo sapiens
tccaggaggtagtgcttaattt

SEQ ID NO: 8418790 - DNA, 22 bp, Homo sapiens
tccaggcattggagagataatg

SEQ ID NO: 8418791 - DNA, 22 bp, Homo sapiens
tccaggcatgttgggaagatga

SEQ ID NO: 8418792 - DNA, 22 bp, Homo sapiens
tccaggcattccagccattcca

SEQ ID NO: 8418793 - DNA, 15 bp, Homo sapiens
tccaggcattcattc

SEQ ID NO: 8418794 - DNA, 23 bp, Homo sapiens
tccaggcatgagctctggatgga

SEQ ID NO: 8418795 - DNA, 22 bp, Homo sapiens
tccaggcatctgtattttttaa

SEQ ID NO: 8418796 - DNA, 19 bp, Homo sapiens
tccaggcatccttcaggct

SEQ ID NO: 8418797 - DNA, 22 bp, Homo sapiens
tccaggcatcccccaggacaga

SEQ ID NO: 8418798 - DNA, 17 bp, Homo sapiens
tccaggcatatctccta

SEQ ID NO: 8418799 - DNA, 16 bp, Homo sapiens
tccaggcatatctgag

SEQ ID NO: 8418800 - DNA, 22 bp, Homo sapiens
tccaggcatgtctgagtccttc

SEQ ID NO: 8418801 - DNA, 22 bp, Homo sapiens
tccaggcatgtcccaagccgga

SEQ ID NO: 8418802 - DNA, 22 bp, Homo sapiens
tccaggcatgtggccagtactc

SEQ ID NO: 8418803 - DNA, 22 bp, Homo sapiens
tccaggcatggtgtaattttgc

SEQ ID NO: 8418804 - DNA, 22 bp, Homo sapiens
tcccaaggtgctcggcaacagg

SEQ ID NO: 8418805 - DNA, 22 bp, Homo sapiens
tcccaaggccaggcatctagaa

SEQ ID NO: 8418806 - DNA, 20 bp, Homo sapiens
tcccaaggatgcctgggtgt

SEQ ID NO: 8418807 - DNA, 22 bp, Homo sapiens
tccatgagggacactggatgct

SEQ ID NO: 8418808 - DNA, 20 bp, Homo sapiens
tccatgagttagagactata

SEQ ID NO: 8418809 - DNA, 22 bp, Homo sapiens
tccatgagacagatactgtaag

SEQ ID NO: 8418810 - DNA, 22 bp, Homo sapiens
tccagtttcatagctaaggaac

SEQ ID NO: 8418811 - DNA, 22 bp, Homo sapiens
tccagtttatttttggcagggt

SEQ ID NO: 8418812 - DNA, 22 bp, Homo sapiens
tccaggctggaaatgtcaaact

SEQ ID NO: 8418813 - DNA, 22 bp, Homo sapiens
tcattgaagcccttgacaagcc

SEQ ID NO: 8418814 - DNA, 22 bp, Homo sapiens
tcattgaagtgactgaaagatt

SEQ ID NO: 8418815 - DNA, 22 bp, Homo sapiens
tcattgaatgagatgcaataga

SEQ ID NO: 8418816 - DNA, 22 bp, Homo sapiens
tcattgaatttggttcaatatg

SEQ ID NO: 8418817 - DNA, 22 bp, Homo sapiens
tcattgaggaaaggtagtggct

SEQ ID NO: 8418818 - DNA, 22 bp, Homo sapiens
tccagaggtatgtagagagtat

SEQ ID NO: 8418819 - DNA, 19 bp, Homo sapiens
tccaggaggctgccattga

SEQ ID NO: 8418820 - DNA, 22 bp, Homo sapiens
tccaggaggcctcatttcctgt

SEQ ID NO: 8418821 - DNA, 22 bp, Homo sapiens
tcccagtgaggtcctggctgtc

SEQ ID NO: 8418822 - DNA, 21 bp, Homo sapiens
gttttcatgatagagtctgta

SEQ ID NO: 8418823 - DNA, 22 bp, Homo sapiens
gttttcatgtctattgggcata

SEQ ID NO: 8418824 - DNA, 22 bp, Homo sapiens
gttttcattactgctgtgattt

SEQ ID NO: 8418825 - DNA, 22 bp, Homo sapiens
taaaatgtttgcaagagaccag

SEQ ID NO: 8418826 - DNA, 22 bp, Homo sapiens
taaaatgtagcttctaggctgg

SEQ ID NO: 8418827 - DNA, 19 bp, Homo sapiens
taaaatgtctgtggtcagt

SEQ ID NO: 8418828 - DNA, 22 bp, Homo sapiens
taaaatgtgtttctgtatggtt

SEQ ID NO: 8418829 - DNA, 22 bp, Homo sapiens
gtttttatctaatagcagttat

SEQ ID NO: 8418830 - DNA, 22 bp, Homo sapiens
taaagtgctggatttgagtaaa

SEQ ID NO: 8418831 - DNA, 22 bp, Homo sapiens
taactactaattgatgataatg

SEQ ID NO: 8418832 - DNA, 22 bp, Homo sapiens
taactctgcttgttctctgagt

SEQ ID NO: 8418833 - DNA, 23 bp, Homo sapiens
taactctgtgaagggtgactggg

SEQ ID NO: 8418834 - DNA, 22 bp, Homo sapiens
taactctgaatcctcacagcag

SEQ ID NO: 8418835 - DNA, 22 bp, Homo sapiens
taaattctgatcaagttccttc

SEQ ID NO: 8418836 - DNA, 22 bp, Homo sapiens
taaattgttttctagaagttgt

SEQ ID NO: 8418837 - DNA, 22 bp, Homo sapiens
gttgatgaaaatgaattgcatg

SEQ ID NO: 8418838 - DNA, 19 bp, Homo sapiens
gtttcattaagataggaaa

SEQ ID NO: 8418839 - DNA, 22 bp, Homo sapiens
gtttcattacctgacccatgag

SEQ ID NO: 8418840 - DNA, 22 bp, Homo sapiens
gtttcatttacatctgtaggta

SEQ ID NO: 8418841 - DNA, 22 bp, Homo sapiens
gtttcattcggcagctcataag

SEQ ID NO: 8418842 - DNA, 22 bp, Homo sapiens
gttggtgagtttctgatcacaa

SEQ ID NO: 8418843 - DNA, 22 bp, Homo sapiens
gttggtgatgccacacatattt

SEQ ID NO: 8418844 - DNA, 22 bp, Homo sapiens
gttaatttagtagagtccagat

SEQ ID NO: 8418845 - DNA, 22 bp, Homo sapiens
gttaatttgcagctttcgagct

SEQ ID NO: 8418846 - DNA, 18 bp, Homo sapiens
gttaattttgaagttcat

SEQ ID NO: 8418847 - DNA, 22 bp, Homo sapiens
gttacaaagcacttcaagtgaa

SEQ ID NO: 8418848 - DNA, 22 bp, Homo sapiens
gtgtggctgattgacatggtca

SEQ ID NO: 8418849 - DNA, 18 bp, Homo sapiens
gtgtggctgagatgaggc

SEQ ID NO: 8418850 - DNA, 22 bp, Homo sapiens
gttaacatttctaggtgcaggg

SEQ ID NO: 8418851 - DNA, 22 bp, Homo sapiens
tacagcacggtgcatttactac

SEQ ID NO: 8418852 - DNA, 22 bp, Homo sapiens
tacaggcactgaaatgcttatt

SEQ ID NO: 8418853 - DNA, 22 bp, Homo sapiens
tacattctcttcccattgtctc

SEQ ID NO: 8418854 - DNA, 22 bp, Homo sapiens
tacattctactttttcactccc

SEQ ID NO: 8418855 - DNA, 22 bp, Homo sapiens
tacattccttcgtttagagatt

SEQ ID NO: 8418856 - DNA, 22 bp, Homo sapiens
tacattcctgggctccacccta

SEQ ID NO: 8418857 - DNA, 22 bp, Homo sapiens
tacatccaaatgaattagaatt

SEQ ID NO: 8418858 - DNA, 21 bp, Homo sapiens
tacagatgaggagaccaaggc

SEQ ID NO: 8418859 - DNA, 21 bp, Homo sapiens
tacagatgaggagaccaaggc

SEQ ID NO: 8418860 - DNA, 22 bp, Homo sapiens
tacagcacaaagggcctttacc

SEQ ID NO: 8418861 - DNA, 22 bp, Homo sapiens
tacaacactggttcgacatgtg

SEQ ID NO: 8418862 - DNA, 22 bp, Homo sapiens
tacaacagacaggaataagatt

SEQ ID NO: 8418863 - DNA, 22 bp, Homo sapiens
tacaaatgaaccaactttgatg

SEQ ID NO: 8418864 - DNA, 22 bp, Homo sapiens
tacaaagtcagaataacaggtg

SEQ ID NO: 8418865 - DNA, 22 bp, Homo sapiens
tacaacataacgggcattcagt

SEQ ID NO: 8418866 - DNA, 22 bp, Homo sapiens
tacactgaagtgtcttggtata

SEQ ID NO: 8418867 - DNA, 22 bp, Homo sapiens
taaggcataaggccagaggcta

SEQ ID NO: 8418868 - DNA, 22 bp, Homo sapiens
taataccactgtgctcattata

SEQ ID NO: 8418869 - DNA, 22 bp, Homo sapiens
taataattaacagtgatgggtc

SEQ ID NO: 8418870 - DNA, 22 bp, Homo sapiens
taagtacaaatgtatacataag

SEQ ID NO: 8418871 - DNA, 21 bp, Homo sapiens
taagtgcaaagagacagatac

SEQ ID NO: 8418872 - DNA, 22 bp, Homo sapiens
taatggcagagtcatgctttct

SEQ ID NO: 8418873 - DNA, 22 bp, Homo sapiens
taattacaggtccaaaacaatc

SEQ ID NO: 8418874 - DNA, 22 bp, Homo sapiens
tacaaagaggtaattgcatata

SEQ ID NO: 8418875 - DNA, 22 bp, Homo sapiens
tacaaacttgttttaagtaagt

SEQ ID NO: 8418876 - DNA, 22 bp, Homo sapiens
tataaatctttgttcctagaat

SEQ ID NO: 8418877 - DNA, 22 bp, Homo sapiens
tataatttatcatgtcacagtt

SEQ ID NO: 8418878 - DNA, 22 bp, Homo sapiens
tatacaatgagtacattctggg

SEQ ID NO: 8418879 - DNA, 22 bp, Homo sapiens
tatacacaaacaaggggttaag

SEQ ID NO: 8418880 - DNA, 22 bp, Homo sapiens
tatacaatggctgaatcatcca

SEQ ID NO: 8418881 - DNA, 22 bp, Homo sapiens
tatacacaaggtgtgcatttgt

SEQ ID NO: 8418882 - DNA, 22 bp, Homo sapiens
tatacacaaggtgtgcatttgt

SEQ ID NO: 8418883 - DNA, 22 bp, Homo sapiens
tatacacacatgctccggcctt

SEQ ID NO: 8418884 - DNA, 22 bp, Homo sapiens
tatacacacctccaaagcagga

SEQ ID NO: 8418885 - DNA, 22 bp, Homo sapiens
tatacacacctccaaagcagga

SEQ ID NO: 8418886 - DNA, 22 bp, Homo sapiens
tataatttatcatgtcacagtt

SEQ ID NO: 8418887 - DNA, 22 bp, Homo sapiens
tataatttggggaaagtggtgt

SEQ ID NO: 8418888 - DNA, 22 bp, Homo sapiens
tataatttggggaaagtggtgt

SEQ ID NO: 8418889 - DNA, 22 bp, Homo sapiens
tataattttaagtggtaaatta

SEQ ID NO: 8418890 - DNA, 22 bp, Homo sapiens
tataattttaagtggtaaatta

SEQ ID NO: 8418891 - DNA, 22 bp, Homo sapiens
tatacaagtgagaagaagagtt

SEQ ID NO: 8418892 - DNA, 22 bp, Homo sapiens
tataattttagaagagatggaa

SEQ ID NO: 8418893 - DNA, 22 bp, Homo sapiens
tatacacatgtgtgtattcata

SEQ ID NO: 8418894 - DNA, 22 bp, Homo sapiens
tatacacatttttacctatagt

SEQ ID NO: 8418895 - DNA, 22 bp, Homo sapiens
tatacacattacagtttcagga

SEQ ID NO: 8418896 - DNA, 23 bp, Homo sapiens
tatacacatgtggcagtatagtg

SEQ ID NO: 8418897 - DNA, 22 bp, Homo sapiens
tatacacatcctccaaagatag

SEQ ID NO: 8418898 - DNA, 17 bp, Homo sapiens
tatacacagacagactg

SEQ ID NO: 8418899 - DNA, 22 bp, Homo sapiens
tatacacaggaatctgtgaaaa

SEQ ID NO: 8418900 - DNA, 17 bp, Homo sapiens
tatacacagacagactg

SEQ ID NO: 8418901 - DNA, 22 bp, Homo sapiens
tatacacatatcttctaggcct

SEQ ID NO: 8418902 - DNA, 22 bp, Homo sapiens
tatacacatatacgtttgtgtg

SEQ ID NO: 8418903 - DNA, 19 bp, Homo sapiens
tatgacaagtactagttct

SEQ ID NO: 8418904 - DNA, 22 bp, Homo sapiens
tatgagaaaggagaatgacttt

SEQ ID NO: 8418905 - DNA, 18 bp, Homo sapiens
tatgagaagattagcaat

SEQ ID NO: 8418906 - DNA, 22 bp, Homo sapiens
tatgagaacaagaacaatctcc

SEQ ID NO: 8418907 - DNA, 22 bp, Homo sapiens
tatgacagtgaaaaaaatcaga

SEQ ID NO: 8418908 - DNA, 22 bp, Homo sapiens
tatgacattttcccagatttat

SEQ ID NO: 8418909 - DNA, 22 bp, Homo sapiens
tatccaaagtttctcagaaact

SEQ ID NO: 8418910 - DNA, 22 bp, Homo sapiens
tatagcacacagtttataaaag

SEQ ID NO: 8418911 - DNA, 22 bp, Homo sapiens
tatgtacacacacatgcatgta

SEQ ID NO: 8418912 - DNA, 22 bp, Homo sapiens
tatgtgcaaattaattgctaga

SEQ ID NO: 8418913 - DNA, 22 bp, Homo sapiens
tatgtgcacattagagagatgg

SEQ ID NO: 8418914 - DNA, 22 bp, Homo sapiens
tatgtgcaaaatgctagactag

SEQ ID NO: 8418915 - DNA, 22 bp, Homo sapiens
tattacagggctagttatgagt

SEQ ID NO: 8418916 - DNA, 22 bp, Homo sapiens
tattacagttcgagtttctagg

SEQ ID NO: 8418917 - DNA, 23 bp, Homo sapiens
tattagcaattcccacagagcag

SEQ ID NO: 8418918 - DNA, 22 bp, Homo sapiens
tattagaaagcttaatatcgtg

SEQ ID NO: 8418919 - DNA, 22 bp, Homo sapiens
tattgacaataggcaactgagg

SEQ ID NO: 8418920 - DNA, 22 bp, Homo sapiens
tattattgcaagtatataaagt

SEQ ID NO: 8418921 - DNA, 22 bp, Homo sapiens
tattattatattggatgagact

SEQ ID NO: 8418922 - DNA, 22 bp, Homo sapiens
tattaggtaaaggacttgcagg

SEQ ID NO: 8418923 - DNA, 22 bp, Homo sapiens
tattagggttttgaaggtttgt

SEQ ID NO: 8418924 - DNA, 22 bp, Homo sapiens
tattagggtaaatttgacatgc

SEQ ID NO: 8418925 - DNA, 22 bp, Homo sapiens
tattagggaactgcaagactaa

SEQ ID NO: 8418926 - DNA, 23 bp, Homo sapiens
tattagggccaggactggcaaat

SEQ ID NO: 8418927 - DNA, 20 bp, Homo sapiens
tatttacaacttagagcctc

SEQ ID NO: 8418928 - DNA, 22 bp, Homo sapiens
tatttctattccccaggcaagt

SEQ ID NO: 8418929 - DNA, 22 bp, Homo sapiens
tatttctaagctgtaagtctga

SEQ ID NO: 8418930 - DNA, 22 bp, Homo sapiens
tagacacatcaaggatcagttt

SEQ ID NO: 8418931 - DNA, 19 bp, Homo sapiens
tagaatgcccacttaaaaa

SEQ ID NO: 8418932 - DNA, 22 bp, Homo sapiens
tagacacatacccttgcccaaa

SEQ ID NO: 8418933 - DNA, 22 bp, Homo sapiens
tagacacaagagaagggtataa

SEQ ID NO: 8418934 - DNA, 22 bp, Homo sapiens
tagaaatgattggttgagctct

SEQ ID NO: 8418935 - DNA, 22 bp, Homo sapiens
tagaaagaacttcatgtaaaac

SEQ ID NO: 8418936 - DNA, 22 bp, Homo sapiens
tagaaacattcagttgcagtcc

SEQ ID NO: 8418937 - DNA, 22 bp, Homo sapiens
tagaaacatataggatggcagg

SEQ ID NO: 8418938 - DNA, 22 bp, Homo sapiens
tagaaacagaaaactgtaatag

SEQ ID NO: 8418939 - DNA, 22 bp, Homo sapiens
tagaaacagaatatgagtgaga

SEQ ID NO: 8418940 - DNA, 22 bp, Homo sapiens
tacttttagcctatttgattct

SEQ ID NO: 8418941 - DNA, 22 bp, Homo sapiens
tagaaaactaatacatgcttga

SEQ ID NO: 8418942 - DNA, 22 bp, Homo sapiens
tacttttagcctatttgattct

SEQ ID NO: 8418943 - DNA, 21 bp, Homo sapiens
tagctttaatattcccacatt

SEQ ID NO: 8418944 - DNA, 22 bp, Homo sapiens
tagctttaatgagttggtaaga

SEQ ID NO: 8418945 - DNA, 22 bp, Homo sapiens
tagctttaatgagttggtaaga

SEQ ID NO: 8418946 - DNA, 22 bp, Homo sapiens
tagcagcattaattccatttgc

SEQ ID NO: 8418947 - DNA, 22 bp, Homo sapiens
taggagggttagagggaaatat

SEQ ID NO: 8418948 - DNA, 22 bp, Homo sapiens
taggagggggaacaaggcatac

SEQ ID NO: 8418949 - DNA, 22 bp, Homo sapiens
tagctttaggatggttctcttg

SEQ ID NO: 8418950 - DNA, 22 bp, Homo sapiens
tagctttaggcacgtttgaatt

SEQ ID NO: 8418951 - DNA, 22 bp, Homo sapiens
tagctttagtgaaaaatatcag

SEQ ID NO: 8418952 - DNA, 22 bp, Homo sapiens
tagctttacaaagtgctgcacc

SEQ ID NO: 8418953 - DNA, 22 bp, Homo sapiens
tagctttaccatagaagagtat

SEQ ID NO: 8418954 - DNA, 22 bp, Homo sapiens
tagctttagaaatattctcaga

SEQ ID NO: 8418955 - DNA, 22 bp, Homo sapiens
tagggaccttagaattgtatgt

SEQ ID NO: 8418956 - DNA, 22 bp, Homo sapiens
tagggacactgctcatgagttc

SEQ ID NO: 8418957 - DNA, 22 bp, Homo sapiens
tagggaccctccctgctctaac

SEQ ID NO: 8418958 - DNA, 22 bp, Homo sapiens
tagggacactgctcatgagttc

SEQ ID NO: 8418959 - DNA, 22 bp, Homo sapiens
tagggagaggaagcaggccgct

SEQ ID NO: 8418960 - DNA, 22 bp, Homo sapiens
tagggaggctacttcttgtagg

SEQ ID NO: 8418961 - DNA, 22 bp, Homo sapiens
tgttaaaaatgcagattcctat

SEQ ID NO: 8418962 - DNA, 22 bp, Homo sapiens
tgttcctggttcctgcatgatg

SEQ ID NO: 8418963 - DNA, 22 bp, Homo sapiens
tgtgttttgaactcatctactg

SEQ ID NO: 8418964 - DNA, 22 bp, Homo sapiens
tgtttcatgtggacatagttgt

SEQ ID NO: 8418965 - DNA, 22 bp, Homo sapiens
tgtttcaggacctatcttttag

SEQ ID NO: 8418966 - DNA, 22 bp, Homo sapiens
tgtttctttgtagatattcttt

SEQ ID NO: 8418967 - DNA, 22 bp, Homo sapiens
tgttctcttttcctgctgagcc

SEQ ID NO: 8418968 - DNA, 22 bp, Homo sapiens
tgttctctctccttttgaagtg

SEQ ID NO: 8418969 - DNA, 22 bp, Homo sapiens
tgtggtcttggaagaagttgct

SEQ ID NO: 8418970 - DNA, 22 bp, Homo sapiens
tgtggtggtaatgagccagatg

SEQ ID NO: 8418971 - DNA, 21 bp, Homo sapiens
tgtgtaaagttgaaatcctgt

SEQ ID NO: 8418972 - DNA, 22 bp, Homo sapiens
tgtgtaaagcttgttccagaaa

SEQ ID NO: 8418973 - DNA, 22 bp, Homo sapiens
tgtgtgaggtggttctgagaag

SEQ ID NO: 8418974 - DNA, 22 bp, Homo sapiens
tgtgtgagtaaggctgagagag

SEQ ID NO: 8418975 - DNA, 22 bp, Homo sapiens
ttaagtacttccctgttggaca

SEQ ID NO: 8418976 - DNA, 22 bp, Homo sapiens
ttaagtacagggttagtgacgg

SEQ ID NO: 8418977 - DNA, 22 bp, Homo sapiens
ttaaggcattgatatggtgcta

SEQ ID NO: 8418978 - DNA, 22 bp, Homo sapiens
ttaattaattagttaagcatgt

SEQ ID NO: 8418979 - DNA, 20 bp, Homo sapiens
ttaagaaaagcacatcctgc

SEQ ID NO: 8418980 - DNA, 20 bp, Homo sapiens
ttaagaaaagcacatcctgc

SEQ ID NO: 8418981 - DNA, 22 bp, Homo sapiens
ttaagaaggtactcaaagatct

SEQ ID NO: 8418982 - DNA, 21 bp, Homo sapiens
ttaagacacacagattaagga

SEQ ID NO: 8418983 - DNA, 22 bp, Homo sapiens
ttaaggaaagccaaaatgaatt

SEQ ID NO: 8418984 - DNA, 22 bp, Homo sapiens
ttaagacatttttggagattat

SEQ ID NO: 8418985 - DNA, 22 bp, Homo sapiens
ttaagacattcagatatttcta

SEQ ID NO: 8418986 - DNA, 22 bp, Homo sapiens
ttaacattgtccttagcagatt

SEQ ID NO: 8418987 - DNA, 22 bp, Homo sapiens
ttaacatgtcttgacttcatct

SEQ ID NO: 8418988 - DNA, 22 bp, Homo sapiens
ttaacattaaaagcagcatttt

SEQ ID NO: 8418989 - DNA, 22 bp, Homo sapiens
ttaacattgtccttagcagatt

SEQ ID NO: 8418990 - DNA, 22 bp, Homo sapiens
ttaacatttgtgaagcatttag

SEQ ID NO: 8418991 - DNA, 22 bp, Homo sapiens
ttaacacttgaactctacatgt

SEQ ID NO: 8418992 - DNA, 22 bp, Homo sapiens
ttaacagacatatatatttgta

SEQ ID NO: 8418993 - DNA, 22 bp, Homo sapiens
ttaacactatctgtcataatta

SEQ ID NO: 8418994 - DNA, 22 bp, Homo sapiens
ttaacactcctaactacagtct

SEQ ID NO: 8418995 - DNA, 22 bp, Homo sapiens
ttaacactgattgtagagacac

SEQ ID NO: 8418996 - DNA, 22 bp, Homo sapiens
ttaacatcctgtttaaatttgg

SEQ ID NO: 8418997 - DNA, 22 bp, Homo sapiens
ttaacatacatcatgaacaatg

SEQ ID NO: 8418998 - DNA, 22 bp, Homo sapiens
ttaacagttaaacaattggcta

SEQ ID NO: 8418999 - DNA, 22 bp, Homo sapiens
tgtttttcaaatattgctctgt

SEQ ID NO: 8419000 - DNA, 22 bp, Homo sapiens
ttaaagcccagcatatactagg

SEQ ID NO: 8419001 - DNA, 22 bp, Homo sapiens
ttaaatagtcaaatcagtggca

SEQ ID NO: 8419002 - DNA, 22 bp, Homo sapiens
ttaaatattatgttgtctgcaa

SEQ ID NO: 8419003 - DNA, 22 bp, Homo sapiens
tgttttgtctaatctaaattct

SEQ ID NO: 8419004 - DNA, 22 bp, Homo sapiens
ttaaatgctcacataaaggtag

SEQ ID NO: 8419005 - DNA, 22 bp, Homo sapiens
ttaaatgagatgttcagatatt

SEQ ID NO: 8419006 - DNA, 22 bp, Homo sapiens
ttaaatgaggctgatgtagatt

SEQ ID NO: 8419007 - DNA, 22 bp, Homo sapiens
ttaaatgaggctgatgtagatt

SEQ ID NO: 8419008 - DNA, 22 bp, Homo sapiens
ttaaatgacttttattattctc

SEQ ID NO: 8419009 - DNA, 22 bp, Homo sapiens
ttaaatgaacgagatatgcaac

SEQ ID NO: 8419010 - DNA, 22 bp, Homo sapiens
ttaaatattttcagcagggtca

SEQ ID NO: 8419011 - DNA, 22 bp, Homo sapiens
ttaaatcaggcatcatttcagt

SEQ ID NO: 8419012 - DNA, 22 bp, Homo sapiens
ttaaattagtcaagcttctctg

SEQ ID NO: 8419013 - DNA, 22 bp, Homo sapiens
ttaacaaggtgactgcattaaa

SEQ ID NO: 8419014 - DNA, 22 bp, Homo sapiens
ttaacaatagagtttcttcagg

SEQ ID NO: 8419015 - DNA, 22 bp, Homo sapiens
ttacagtcagtgaatggaaggg

SEQ ID NO: 8419016 - DNA, 22 bp, Homo sapiens
ttacagtgaagattcaggttcc

SEQ ID NO: 8419017 - DNA, 22 bp, Homo sapiens
ttacagtgactcacattaacaa

SEQ ID NO: 8419018 - DNA, 22 bp, Homo sapiens
ttacagtgagggtgacatttac

SEQ ID NO: 8419019 - DNA, 22 bp, Homo sapiens
ttacagtgacagttgctatgat

SEQ ID NO: 8419020 - DNA, 22 bp, Homo sapiens
ttacagtgaagtaccattaaaa

SEQ ID NO: 8419021 - DNA, 22 bp, Homo sapiens
ttacagtggcagagttgggtag

SEQ ID NO: 8419022 - DNA, 20 bp, Homo sapiens
ttacagtgggaccttcctga

SEQ ID NO: 8419023 - DNA, 22 bp, Homo sapiens
ttacagtgctcttcaagacttc

SEQ ID NO: 8419024 - DNA, 22 bp, Homo sapiens
ttacatcactttacttaataat

SEQ ID NO: 8419025 - DNA, 22 bp, Homo sapiens
ttacatcagcaagagtgtatgt

SEQ ID NO: 8419026 - DNA, 22 bp, Homo sapiens
ttacaaacaacagacatttatt

SEQ ID NO: 8419027 - DNA, 22 bp, Homo sapiens
ttacaaactgtcatatagtatt

SEQ ID NO: 8419028 - DNA, 22 bp, Homo sapiens
ttaatttttatgtatagtgtgt

SEQ ID NO: 8419029 - DNA, 22 bp, Homo sapiens
ttaattttctcatctgtgaaat

SEQ ID NO: 8419030 - DNA, 22 bp, Homo sapiens
ttaattttaacctgtttgtgtc

SEQ ID NO: 8419031 - DNA, 22 bp, Homo sapiens
ttacacatgctcacttatttgt

SEQ ID NO: 8419032 - DNA, 22 bp, Homo sapiens
ttacacatctagacccattttt

SEQ ID NO: 8419033 - DNA, 18 bp, Homo sapiens
ttacactagccttggttc

SEQ ID NO: 8419034 - DNA, 22 bp, Homo sapiens
ttacacacaattagcatagtaa

SEQ ID NO: 8419035 - DNA, 22 bp, Homo sapiens
ttactttatctcctagattcca

SEQ ID NO: 8419036 - DNA, 22 bp, Homo sapiens
ttagacatgtttgctaaaatga

SEQ ID NO: 8419037 - DNA, 22 bp, Homo sapiens
ttagacattaaatgccatttaa

SEQ ID NO: 8419038 - DNA, 22 bp, Homo sapiens
ttacttcttacaaaagaaatat

SEQ ID NO: 8419039 - DNA, 22 bp, Homo sapiens
ttacattttggggtaaggataa

SEQ ID NO: 8419040 - DNA, 22 bp, Homo sapiens
ttccagagaaaaggtttatttc

SEQ ID NO: 8419041 - DNA, 20 bp, Homo sapiens
ttccagagatctgcatttta

SEQ ID NO: 8419042 - DNA, 22 bp, Homo sapiens
ttcctacatttgtacaataaga

SEQ ID NO: 8419043 - DNA, 22 bp, Homo sapiens
ttcctacatttgtacaataaga

SEQ ID NO: 8419044 - DNA, 22 bp, Homo sapiens
ttcctacaattagagcctcttt

SEQ ID NO: 8419045 - DNA, 22 bp, Homo sapiens
ttcctacatttgcctcactccc

SEQ ID NO: 8419046 - DNA, 22 bp, Homo sapiens
ttcctacagccctgaatctcta

SEQ ID NO: 8419047 - DNA, 22 bp, Homo sapiens
ttcctacatcaccagggggagt

SEQ ID NO: 8419048 - DNA, 22 bp, Homo sapiens
ttcctagaatggttagaaaata

SEQ ID NO: 8419049 - DNA, 22 bp, Homo sapiens
ttcctccagcctggagcacttc

SEQ ID NO: 8419050 - DNA, 22 bp, Homo sapiens
ttcctccacgtgacaggagcca

SEQ ID NO: 8419051 - DNA, 22 bp, Homo sapiens
ttcctgtgaaatataggtccat

SEQ ID NO: 8419052 - DNA, 22 bp, Homo sapiens
ttcctgtgaagatctgggtgct

SEQ ID NO: 8419053 - DNA, 22 bp, Homo sapiens
ttcctgtggccttacatctgtg

SEQ ID NO: 8419054 - DNA, 22 bp, Homo sapiens
ttcctgtgcttattcttctctg

SEQ ID NO: 8419055 - DNA, 22 bp, Homo sapiens
ttcctgtgcttaattctcactg

SEQ ID NO: 8419056 - DNA, 19 bp, Homo sapiens
ttcctgtgctgctgtgtcc

SEQ ID NO: 8419057 - DNA, 22 bp, Homo sapiens
ttcctgtgaagccggtggtctc

SEQ ID NO: 8419058 - DNA, 22 bp, Homo sapiens
ttcctgtgcctcaggtctcagc

SEQ ID NO: 8419059 - DNA, 22 bp, Homo sapiens
ttcctgtgatattagccactgt

SEQ ID NO: 8419060 - DNA, 17 bp, Homo sapiens
ttcctgtggtttgatct

SEQ ID NO: 8419061 - DNA, 22 bp, Homo sapiens
ttcctgtggtgtttcccagaca

SEQ ID NO: 8419062 - DNA, 22 bp, Homo sapiens
ttcctgtggctgtcactcctgg

SEQ ID NO: 8419063 - DNA, 23 bp, Homo sapiens
ttcctgtggtatattttataggg

SEQ ID NO: 8419064 - DNA, 22 bp, Homo sapiens
ttcctgtggtccagagtcatcc

SEQ ID NO: 8419065 - DNA, 22 bp, Homo sapiens
ttcctgtgtgctctcatttagt

SEQ ID NO: 8419066 - DNA, 22 bp, Homo sapiens
ttcctgtgtgttggtggcagaa

SEQ ID NO: 8419067 - DNA, 22 bp, Homo sapiens
ttcctgtgtgactcaagtggtt

SEQ ID NO: 8419068 - DNA, 22 bp, Homo sapiens
ttcctgtgtgaccgagacagtg

SEQ ID NO: 8419069 - DNA, 22 bp, Homo sapiens
ttcctgtgtcctatttcgactt

SEQ ID NO: 8419070 - DNA, 22 bp, Homo sapiens
ttcctgtgtcccgggcaccctg

SEQ ID NO: 8419071 - DNA, 22 bp, Homo sapiens
ttcctgtgtacgtgtttcgctg

SEQ ID NO: 8419072 - DNA, 22 bp, Homo sapiens
ttctaagaggctaatgaagaat

SEQ ID NO: 8419073 - DNA, 22 bp, Homo sapiens
ttctaagaaatggaaaacgatt

SEQ ID NO: 8419074 - DNA, 22 bp, Homo sapiens
ttctaagtcactcagattttgg

SEQ ID NO: 8419075 - DNA, 19 bp, Homo sapiens
ttcacattggaagaagtag

SEQ ID NO: 8419076 - DNA, 22 bp, Homo sapiens
ttcacattctcacaagaggaaa

SEQ ID NO: 8419077 - DNA, 22 bp, Homo sapiens
ttcacattgaaggtgctttctt

SEQ ID NO: 8419078 - DNA, 22 bp, Homo sapiens
ttcacattataatcagttctgc

SEQ ID NO: 8419079 - DNA, 22 bp, Homo sapiens
ttcacattcagaaaaagcccgt

SEQ ID NO: 8419080 - DNA, 22 bp, Homo sapiens
ttcacattccgcggctattttc

SEQ ID NO: 8419081 - DNA, 22 bp, Homo sapiens
ttcacattatcaggattgtttc

SEQ ID NO: 8419082 - DNA, 22 bp, Homo sapiens
ttcacattagtggttctatata

SEQ ID NO: 8419083 - DNA, 22 bp, Homo sapiens
ttcacattagccaagagatgga

SEQ ID NO: 8419084 - DNA, 22 bp, Homo sapiens
ttcacagtggctgtgccatttg

SEQ ID NO: 8419085 - DNA, 22 bp, Homo sapiens
ttcagtaaaacactgcaatgtc

SEQ ID NO: 8419086 - DNA, 22 bp, Homo sapiens
ttcatgcttttaccgctgttaa

SEQ ID NO: 8419087 - DNA, 22 bp, Homo sapiens
ttcagtgtcaatttttaaatat

SEQ ID NO: 8419088 - DNA, 22 bp, Homo sapiens
ttcacaagtctggaatatgcta

SEQ ID NO: 8419089 - DNA, 22 bp, Homo sapiens
ttcacaactgccatagccagtg

SEQ ID NO: 8419090 - DNA, 22 bp, Homo sapiens
ttcacaatagctggcatcatct

SEQ ID NO: 8419091 - DNA, 22 bp, Homo sapiens
ttcacaaaacactattttctgg

SEQ ID NO: 8419092 - DNA, 22 bp, Homo sapiens
ttcaactttggagatttaataa

SEQ ID NO: 8419093 - DNA, 22 bp, Homo sapiens
ttcaacatgttctacataaggg

SEQ ID NO: 8419094 - DNA, 22 bp, Homo sapiens
ttcaacatttatcagtttatca

SEQ ID NO: 8419095 - DNA, 22 bp, Homo sapiens
ttcaacatttgaaatgaatgaa

SEQ ID NO: 8419096 - DNA, 22 bp, Homo sapiens
ttcaactaatgtttattttatg

SEQ ID NO: 8419097 - DNA, 22 bp, Homo sapiens
ttcaacatttttgagtttaggt

SEQ ID NO: 8419098 - DNA, 22 bp, Homo sapiens
ttcaactagatttatacaattc

SEQ ID NO: 8419099 - DNA, 22 bp, Homo sapiens
ttcaactagaggtgattttgcc

SEQ ID NO: 8419100 - DNA, 22 bp, Homo sapiens
ttcaactattatgaataaaatt

SEQ ID NO: 8419101 - DNA, 22 bp, Homo sapiens
ttcaactttatgcatatgtatt

SEQ ID NO: 8419102 - DNA, 22 bp, Homo sapiens
ttcaactttaggcaaagaaaac

SEQ ID NO: 8419103 - DNA, 22 bp, Homo sapiens
ttcaacatgctttatttctaaa

SEQ ID NO: 8419104 - DNA, 22 bp, Homo sapiens
ttgattaaaatgagacatcatt

SEQ ID NO: 8419105 - DNA, 22 bp, Homo sapiens
ttgattaaacaggcatattcaa

SEQ ID NO: 8419106 - DNA, 22 bp, Homo sapiens
ttgatttcttactcttccaagg

SEQ ID NO: 8419107 - DNA, 22 bp, Homo sapiens
ttgaggagtgtgaggtctccca

SEQ ID NO: 8419108 - DNA, 22 bp, Homo sapiens
ttgaggagtgtttagggtgagg

SEQ ID NO: 8419109 - DNA, 23 bp, Homo sapiens
ttgagctcagtagctctgctggt

SEQ ID NO: 8419110 - DNA, 22 bp, Homo sapiens
ttgaggagttgtgacagatact

SEQ ID NO: 8419111 - DNA, 18 bp, Homo sapiens
ttgaggagttcactgtct

SEQ ID NO: 8419112 - DNA, 22 bp, Homo sapiens
ttgaggagttaggatgtttata

SEQ ID NO: 8419113 - DNA, 22 bp, Homo sapiens
ttgagcaatgctgcaaagagat

SEQ ID NO: 8419114 - DNA, 22 bp, Homo sapiens
ttgagcaaagcagccattcatt

SEQ ID NO: 8419115 - DNA, 22 bp, Homo sapiens
ttgaatgaatggtccatataga

SEQ ID NO: 8419116 - DNA, 22 bp, Homo sapiens
ttgaatgaattctacttccaga

SEQ ID NO: 8419117 - DNA, 22 bp, Homo sapiens
ttctttatgttaatgaatctat

SEQ ID NO: 8419118 - DNA, 22 bp, Homo sapiens
ttctttattgagacttcattgt

SEQ ID NO: 8419119 - DNA, 22 bp, Homo sapiens
ttctttattagtttagtgagct

SEQ ID NO: 8419120 - DNA, 22 bp, Homo sapiens
ttctttatgcttctgtttaggc

SEQ ID NO: 8419121 - DNA, 22 bp, Homo sapiens
ttctttatcctatttgtaggtg

SEQ ID NO: 8419122 - DNA, 22 bp, Homo sapiens
ttctttatggaatggtgatagt

SEQ ID NO: 8419123 - DNA, 22 bp, Homo sapiens
ttgaagacacagacatatagag

SEQ ID NO: 8419124 - DNA, 22 bp, Homo sapiens
ttctttctcaacatgaatgttt

SEQ ID NO: 8419125 - DNA, 22 bp, Homo sapiens
ttctttccccatggagttcgga

SEQ ID NO: 8419126 - DNA, 22 bp, Homo sapiens
ttctttccttgcctcagtgaag

SEQ ID NO: 8419127 - DNA, 22 bp, Homo sapiens
ttgaagattctttttgttagta

SEQ ID NO: 8419128 - DNA, 22 bp, Homo sapiens
ttctggtaccgtgtcagaaacc

SEQ ID NO: 8419129 - DNA, 22 bp, Homo sapiens
ttcttaaaacttatggacaggt

SEQ ID NO: 8419130 - DNA, 22 bp, Homo sapiens
ttcttgcctgccctgtgtcgta

SEQ ID NO: 8419131 - DNA, 22 bp, Homo sapiens
ttctttatcagttactcatagg

SEQ ID NO: 8419132 - DNA, 22 bp, Homo sapiens
ttctttatatctgctagtgggt

SEQ ID NO: 8419133 - DNA, 22 bp, Homo sapiens
ttctttatagctattggatgag

SEQ ID NO: 8419134 - DNA, 23 bp, Homo sapiens
ttctttataaatcaatgggatgt

SEQ ID NO: 8419135 - DNA, 22 bp, Homo sapiens
ttctagtctatggctagatagt

SEQ ID NO: 8419136 - DNA, 22 bp, Homo sapiens
ttctagtcctagaaactacatg

SEQ ID NO: 8419137 - DNA, 22 bp, Homo sapiens
ttgcaacttctcccatcactct

SEQ ID NO: 8419138 - DNA, 22 bp, Homo sapiens
ttgcaatagccttatttccaaa

SEQ ID NO: 8419139 - DNA, 22 bp, Homo sapiens
ttgcaacatctgaacatttatc

SEQ ID NO: 8419140 - DNA, 22 bp, Homo sapiens
ttgtctgacttctttagttact

SEQ ID NO: 8419141 - DNA, 22 bp, Homo sapiens
ttgtctgaatctggagctctct

SEQ ID NO: 8419142 - DNA, 22 bp, Homo sapiens
ttgtttctcctggtgcctgata

SEQ ID NO: 8419143 - DNA, 22 bp, Homo sapiens
ttgtttctggaaaaggcgagaa

SEQ ID NO: 8419144 - DNA, 22 bp, Homo sapiens
ttgttagtgcaatgtttggtga

SEQ ID NO: 8419145 - DNA, 22 bp, Homo sapiens
tttattagattatcaaagaggt

SEQ ID NO: 8419146 - DNA, 22 bp, Homo sapiens
tttattagtgcttgtatcactg

SEQ ID NO: 8419147 - DNA, 19 bp, Homo sapiens
tttatttgagacatgcctt

SEQ ID NO: 8419148 - DNA, 22 bp, Homo sapiens
tttatttggcatccagggagaa

SEQ ID NO: 8419149 - DNA, 15 bp, Homo sapiens
tttcaaaatgaggcc

SEQ ID NO: 8419150 - DNA, 22 bp, Homo sapiens
tttcaaaagcgtacgtagtgaa

SEQ ID NO: 8419151 - DNA, 22 bp, Homo sapiens
tttcaaaattttgcagtggtaa

SEQ ID NO: 8419152 - DNA, 22 bp, Homo sapiens
tttcaaacatatcttcattact

SEQ ID NO: 8419153 - DNA, 23 bp, Homo sapiens
tttatacaagaaaccgctggcct

SEQ ID NO: 8419154 - DNA, 22 bp, Homo sapiens
tttatacatggagaatttttgc

SEQ ID NO: 8419155 - DNA, 22 bp, Homo sapiens
tttatacatggagaatttttgc

SEQ ID NO: 8419156 - DNA, 22 bp, Homo sapiens
tttatacctcattcttagcaaa

SEQ ID NO: 8419157 - DNA, 22 bp, Homo sapiens
tttatactccactctgcaagcg

SEQ ID NO: 8419158 - DNA, 22 bp, Homo sapiens
tttatacttcataatgtctatt

SEQ ID NO: 8419159 - DNA, 22 bp, Homo sapiens
tttatagatgtctgtattataa

SEQ ID NO: 8419160 - DNA, 22 bp, Homo sapiens
tttagttcacaccagggtagca

SEQ ID NO: 8419161 - DNA, 21 bp, Homo sapiens
tttattaacaactgtggacgt

SEQ ID NO: 8419162 - DNA, 22 bp, Homo sapiens
tttattaagatgcgaatgctga

SEQ ID NO: 8419163 - DNA, 22 bp, Homo sapiens
tttattaatgtagcatccatgg

SEQ ID NO: 8419164 - DNA, 22 bp, Homo sapiens
tttactacttcattgacttacg

SEQ ID NO: 8419165 - DNA, 22 bp, Homo sapiens
tttactttctcaagtatatagg

SEQ ID NO: 8419166 - DNA, 22 bp, Homo sapiens
tttactcttgctacacaactgt

SEQ ID NO: 8419167 - DNA, 22 bp, Homo sapiens
tttactacttgtgataactgaa

SEQ ID NO: 8419168 - DNA, 19 bp, Homo sapiens
tttactctccaaggtgagt

SEQ ID NO: 8419169 - DNA, 22 bp, Homo sapiens
tttactgaactgctagtacagg

SEQ ID NO: 8419170 - DNA, 22 bp, Homo sapiens
tttactgacctccaatcccact

SEQ ID NO: 8419171 - DNA, 21 bp, Homo sapiens
tttactgagcacttactatgt

SEQ ID NO: 8419172 - DNA, 22 bp, Homo sapiens
tttactttgtgtcaagtcaaga

SEQ ID NO: 8419173 - DNA, 22 bp, Homo sapiens
tttagttattgttacagtatga

SEQ ID NO: 8419174 - DNA, 22 bp, Homo sapiens
tttaaaatcagatgggagttgg

SEQ ID NO: 8419175 - DNA, 22 bp, Homo sapiens
tttaaaatttagacctctccac

SEQ ID NO: 8419176 - DNA, 22 bp, Homo sapiens
tttaatttgaaatgagtaaccc

SEQ ID NO: 8419177 - DNA, 22 bp, Homo sapiens
tttaattttcctcttcctggag

SEQ ID NO: 8419178 - DNA, 22 bp, Homo sapiens
tttaattttcctggtaggcctg

SEQ ID NO: 8419179 - DNA, 22 bp, Homo sapiens
tttaattttctgggcccagcag

SEQ ID NO: 8419180 - DNA, 22 bp, Homo sapiens
tttaatttgtatttctagaggg

SEQ ID NO: 8419181 - DNA, 21 bp, Homo sapiens
tttaatttgcatgtatgacgc

SEQ ID NO: 8419182 - DNA, 17 bp, Homo sapiens
tttcagattcactttct

SEQ ID NO: 8419183 - DNA, 22 bp, Homo sapiens
tttcagattatctcaactttgg

SEQ ID NO: 8419184 - DNA, 22 bp, Homo sapiens
tttcagatgtgtgtctctgaag

SEQ ID NO: 8419185 - DNA, 22 bp, Homo sapiens
tttcagatggaggtttaggaca

SEQ ID NO: 8419186 - DNA, 22 bp, Homo sapiens
tttctcatagtcatgcctctta

SEQ ID NO: 8419187 - DNA, 22 bp, Homo sapiens
tttctacattcaaaaactacca

SEQ ID NO: 8419188 - DNA, 22 bp, Homo sapiens
tttctacatgttttctattgaa

SEQ ID NO: 8419189 - DNA, 22 bp, Homo sapiens
tttctacatttgtaaccagatt

SEQ ID NO: 8419190 - DNA, 22 bp, Homo sapiens
tttctttaggctgtgttgccaa

SEQ ID NO: 8419191 - DNA, 22 bp, Homo sapiens
tttctttaattctcacagcaat

SEQ ID NO: 8419192 - DNA, 22 bp, Homo sapiens
tttctttatcatagcatctttg

SEQ ID NO: 8419193 - DNA, 22 bp, Homo sapiens
tttctttaaaggaactctgttt

SEQ ID NO: 8419194 - DNA, 22 bp, Homo sapiens
tttcttcagccttcacaacctg

SEQ ID NO: 8419195 - DNA, 22 bp, Homo sapiens
tttctggaaacgggttcaagct

SEQ ID NO: 8419196 - DNA, 22 bp, Homo sapiens
tttctgaagggcagcagactct

SEQ ID NO: 8419197 - DNA, 22 bp, Homo sapiens
tttctgaaggttaaggaattag

SEQ ID NO: 8419198 - DNA, 23 bp, Homo sapiens
tttctgaagttgagatggacttt

SEQ ID NO: 8419199 - DNA, 22 bp, Homo sapiens
tttctgaataactctatgatat

SEQ ID NO: 8419200 - DNA, 22 bp, Homo sapiens
tttctgaataactctatgatat

SEQ ID NO: 8419201 - DNA, 21 bp, Homo sapiens
tttctgaaggcaacatctatc

SEQ ID NO: 8419202 - DNA, 22 bp, Homo sapiens
tttctgaacttggtactggagc

SEQ ID NO: 8419203 - DNA, 22 bp, Homo sapiens
tttgcaaatatgtgtttctatt

SEQ ID NO: 8419204 - DNA, 22 bp, Homo sapiens
tttctttctcgtaaacttagtt

SEQ ID NO: 8419205 - DNA, 18 bp, Homo sapiens
tttctttctgcctggggc

SEQ ID NO: 8419206 - DNA, 22 bp, Homo sapiens
tttctttccatacatattgcta

SEQ ID NO: 8419207 - DNA, 22 bp, Homo sapiens
tttctttccatgagcctatgta

SEQ ID NO: 8419208 - DNA, 22 bp, Homo sapiens
tttctttatcctcctttgcaca

SEQ ID NO: 8419209 - DNA, 22 bp, Homo sapiens
tttctttccagagtgattggca

SEQ ID NO: 8419210 - DNA, 22 bp, Homo sapiens
tttctttcaattctcctaatgc

SEQ ID NO: 8419211 - DNA, 22 bp, Homo sapiens
tttctttcaattctcctaatgc

SEQ ID NO: 8419212 - DNA, 23 bp, Homo sapiens
tttgtacattgaggaggcagaat

SEQ ID NO: 8419213 - DNA, 22 bp, Homo sapiens
tttgtacatcctaattctgagt

SEQ ID NO: 8419214 - DNA, 22 bp, Homo sapiens
tttgtacatgtaagattgcatc

SEQ ID NO: 8419215 - DNA, 17 bp, Homo sapiens
tttgtacaacattttaa

SEQ ID NO: 8419216 - DNA, 22 bp, Homo sapiens
tttgttcactgagcaatgatta

SEQ ID NO: 8419217 - DNA, 22 bp, Homo sapiens
tttgttcacctagcaaactttt

SEQ ID NO: 8419218 - DNA, 22 bp, Homo sapiens
tttgttttcaatgtgtcattca

SEQ ID NO: 8419219 - DNA, 22 bp, Homo sapiens
ttttatacacatgaacatgcag

SEQ ID NO: 8419220 - DNA, 22 bp, Homo sapiens
ttttatacttaagacagagttt

SEQ ID NO: 8419221 - DNA, 22 bp, Homo sapiens
ttttatacacatgaacatgcag

SEQ ID NO: 8419222 - DNA, 22 bp, Homo sapiens
ttttatacttaagacagagttt

SEQ ID NO: 8419223 - DNA, 22 bp, Homo sapiens
tttttcattgcagcctctctcc

SEQ ID NO: 8419224 - DNA, 22 bp, Homo sapiens
tttttcatgagactagaagtca

SEQ ID NO: 8419225 - DNA, 22 bp, Homo sapiens
ttttgagatggtgtctcgctcc

SEQ ID NO: 8419226 - DNA, 22 bp, Homo sapiens
ttttgagatggagtcttgctct

SEQ ID NO: 8419227 - DNA, 22 bp, Homo sapiens
ttttctaacatctagtaatttg

SEQ ID NO: 8419228 - DNA, 22 bp, Homo sapiens
ttttctaaaagaagtcactgat

SEQ ID NO: 8419229 - DNA, 22 bp, Homo sapiens
ttttctagggtgctaaatgaac

SEQ ID NO: 8419230 - DNA, 22 bp, Homo sapiens
ttttatgagaatgcgccacttg

SEQ ID NO: 8419231 - DNA, 22 bp, Homo sapiens
ttttatcattacccagctgaaa

SEQ ID NO: 8419232 - DNA, 22 bp, Homo sapiens
ttttccttctgatactccattt

SEQ ID NO: 8419233 - DNA, 22 bp, Homo sapiens
ttttcctttcatcaggacaaag

SEQ ID NO: 8419234 - DNA, 22 bp, Homo sapiens
attaggaagtaagtatcacaag

SEQ ID NO: 8419235 - DNA, 22 bp, Homo sapiens
attaggtaatctttagatacac

SEQ ID NO: 8419236 - DNA, 22 bp, Homo sapiens
attagtagctgtaataactggg

SEQ ID NO: 8419237 - DNA, 22 bp, Homo sapiens
caaatactaaacataagatttt

SEQ ID NO: 8419238 - DNA, 22 bp, Homo sapiens
caaatactacgattcttgcagt

SEQ ID NO: 8419239 - DNA, 22 bp, Homo sapiens
caaatactgagcacgcaatcaa

SEQ ID NO: 8419240 - DNA, 22 bp, Homo sapiens
caaatactctggatgtgtttgt

SEQ ID NO: 8419241 - DNA, 22 bp, Homo sapiens
caaatactgggtaagttaattt

SEQ ID NO: 8419242 - DNA, 22 bp, Homo sapiens
caaatactgagtttattttcaa

SEQ ID NO: 8419243 - DNA, 22 bp, Homo sapiens
caaatactgtactgaacactgt

SEQ ID NO: 8419244 - DNA, 18 bp, Homo sapiens
caaatactgttgtcttat

SEQ ID NO: 8419245 - DNA, 22 bp, Homo sapiens
caaatacttactgaacctgtgc

SEQ ID NO: 8419246 - DNA, 22 bp, Homo sapiens
caaatacttttagcctattgag

SEQ ID NO: 8419247 - DNA, 22 bp, Homo sapiens
caaatactttatatacttcaaa

SEQ ID NO: 8419248 - DNA, 21 bp, Homo sapiens
caaatacttagaaacttaaga

SEQ ID NO: 8419249 - DNA, 22 bp, Homo sapiens
caaaattagaaatgcagctgtt

SEQ ID NO: 8419250 - DNA, 22 bp, Homo sapiens
caaaattagggagtgagctgga

SEQ ID NO: 8419251 - DNA, 22 bp, Homo sapiens
atttggaagcttgaagattatt

SEQ ID NO: 8419252 - DNA, 22 bp, Homo sapiens
atttggaaaatctggttataga

SEQ ID NO: 8419253 - DNA, 22 bp, Homo sapiens
atttggaacaaatattagtaaa

SEQ ID NO: 8419254 - DNA, 22 bp, Homo sapiens
atttggaacttataataagttt

SEQ ID NO: 8419255 - DNA, 22 bp, Homo sapiens
gccaggtggaggttgcagtgag

SEQ ID NO: 8419256 - DNA, 22 bp, Homo sapiens
atgaacagcattgaaatccagc

SEQ ID NO: 8419257 - DNA, 19 bp, Homo sapiens
atgatacaggtgaaaattg

SEQ ID NO: 8419258 - DNA, 22 bp, Homo sapiens
gaaatactgtaaagttattatt

SEQ ID NO: 8419259 - DNA, 20 bp, Homo sapiens
gaaatacttacccaactgtt

SEQ ID NO: 8419260 - DNA, 21 bp, Homo sapiens
gaaatactgccttaggagctg

SEQ ID NO: 8419261 - DNA, 22 bp, Homo sapiens
gaaatactgcacaccctgtaag

SEQ ID NO: 8419262 - DNA, 22 bp, Homo sapiens
gacatttattagaaaactatca

SEQ ID NO: 8419263 - DNA, 22 bp, Homo sapiens
atgttgttttttcataaagtat

SEQ ID NO: 8419264 - DNA, 22 bp, Homo sapiens
gagggctgaagattgtggcccc

SEQ ID NO: 8419265 - DNA, 22 bp, Homo sapiens
gagggcgttcagtcagtgtctc

SEQ ID NO: 8419266 - DNA, 22 bp, Homo sapiens
atggcttctgtcttggaaattt

SEQ ID NO: 8419267 - DNA, 22 bp, Homo sapiens
atggcttctgtcttggaaactt

SEQ ID NO: 8419268 - DNA, 22 bp, Homo sapiens
atggcttctagcattgtcacaa

SEQ ID NO: 8419269 - DNA, 22 bp, Homo sapiens
atggcttcctctggattggatt

SEQ ID NO: 8419270 - DNA, 22 bp, Homo sapiens
atggcttcgagtatatacatag

SEQ ID NO: 8419271 - DNA, 22 bp, Homo sapiens
gaggagaaatttggggacctga

SEQ ID NO: 8419272 - DNA, 22 bp, Homo sapiens
gaggagaagctaagaaacacag

SEQ ID NO: 8419273 - DNA, 22 bp, Homo sapiens
cagctaatcctctctatccaag

SEQ ID NO: 8419274 - DNA, 22 bp, Homo sapiens
cagcagctgcaaatggaaacag

SEQ ID NO: 8419275 - DNA, 22 bp, Homo sapiens
cagcaagacagtttcctaagtg

SEQ ID NO: 8419276 - DNA, 22 bp, Homo sapiens
cagcaagacaggattcccgtgg

SEQ ID NO: 8419277 - DNA, 21 bp, Homo sapiens
cagcaagacatgtttatcaag

SEQ ID NO: 8419278 - DNA, 22 bp, Homo sapiens
cagcaagacaaggaacaaactg

SEQ ID NO: 8419279 - DNA, 22 bp, Homo sapiens
cagcaagatggtgaatgagacg

SEQ ID NO: 8419280 - DNA, 22 bp, Homo sapiens
cagcaagattaagggcagaaaa

SEQ ID NO: 8419281 - DNA, 22 bp, Homo sapiens
cagcaagatttttaaagcaagg

SEQ ID NO: 8419282 - DNA, 22 bp, Homo sapiens
cagcaagacttcagggcttggt

SEQ ID NO: 8419283 - DNA, 22 bp, Homo sapiens
cagcaagagaggcagggcaaat

SEQ ID NO: 8419284 - DNA, 22 bp, Homo sapiens
cagcaagagactgttctctaag

SEQ ID NO: 8419285 - DNA, 22 bp, Homo sapiens
cagcaagagggtaaggttgaag

SEQ ID NO: 8419286 - DNA, 22 bp, Homo sapiens
cagcaagagttggggttgttgg

SEQ ID NO: 8419287 - DNA, 22 bp, Homo sapiens
ggctgtgttccaagtgtcagga

SEQ ID NO: 8419288 - DNA, 22 bp, Homo sapiens
ggctgtctctgtgactgccacc

SEQ ID NO: 8419289 - DNA, 23 bp, Homo sapiens
cagaaaacccagagctcagtccc

SEQ ID NO: 8419290 - DNA, 22 bp, Homo sapiens
caagattatcttcttcttgtta

SEQ ID NO: 8419291 - DNA, 22 bp, Homo sapiens
caagtaacttgattaaggtaag

SEQ ID NO: 8419292 - DNA, 22 bp, Homo sapiens
cacagataaggatgttaatttt

SEQ ID NO: 8419293 - DNA, 22 bp, Homo sapiens
ctaagaaatgttgtgaatgcca

SEQ ID NO: 8419294 - DNA, 19 bp, Homo sapiens
agtccatgaatggaggatg

SEQ ID NO: 8419295 - DNA, 22 bp, Homo sapiens
ctgactttgctcataggtcaaa

SEQ ID NO: 8419296 - DNA, 22 bp, Homo sapiens
ctgacttttccaaataatactt

SEQ ID NO: 8419297 - DNA, 22 bp, Homo sapiens
ctgactttagaacccaaaaagt

SEQ ID NO: 8419298 - DNA, 22 bp, Homo sapiens
ctgaattaatacacagaatggc

SEQ ID NO: 8419299 - DNA, 18 bp, Homo sapiens
ctgaattatctcatcatt

SEQ ID NO: 8419300 - DNA, 22 bp, Homo sapiens
ctgacaaaggcaaggcaggggg

SEQ ID NO: 8419301 - DNA, 22 bp, Homo sapiens
agttagagacacatgcacatgc

SEQ ID NO: 8419302 - DNA, 22 bp, Homo sapiens
agttagaatggatgttgagagc

SEQ ID NO: 8419303 - DNA, 22 bp, Homo sapiens
agtcttaggctccattagtaga

SEQ ID NO: 8419304 - DNA, 22 bp, Homo sapiens
cttagagcttaggctagccatt

SEQ ID NO: 8419305 - DNA, 22 bp, Homo sapiens
cttagagccttactcttcttgt

SEQ ID NO: 8419306 - DNA, 22 bp, Homo sapiens
atattaggagttaaatgtatta

SEQ ID NO: 8419307 - DNA, 22 bp, Homo sapiens
atattagggtctctaaattcta

SEQ ID NO: 8419308 - DNA, 22 bp, Homo sapiens
atattaggcaaggagattattt

SEQ ID NO: 8419309 - DNA, 22 bp, Homo sapiens
atattaggtgctcaatacatgc

SEQ ID NO: 8419310 - DNA, 22 bp, Homo sapiens
atagcactggtttttcttggtt

SEQ ID NO: 8419311 - DNA, 22 bp, Homo sapiens
atacagtaatttgtaactcatc

SEQ ID NO: 8419312 - DNA, 22 bp, Homo sapiens
ctggagagaatgtggaatgatt

SEQ ID NO: 8419313 - DNA, 22 bp, Homo sapiens
atacagtataactaataaaccc

SEQ ID NO: 8419314 - DNA, 20 bp, Homo sapiens
atacagtaggtgctcaatat

SEQ ID NO: 8419315 - DNA, 22 bp, Homo sapiens
agttatcaggtgttttcatgga

SEQ ID NO: 8419316 - DNA, 22 bp, Homo sapiens
agttatcatcccttacactttg

SEQ ID NO: 8419317 - DNA, 20 bp, Homo sapiens
ctgccgaccacagccatgga

SEQ ID NO: 8419318 - DNA, 23 bp, Homo sapiens
ataaattactatctccctagagc

SEQ ID NO: 8419319 - DNA, 22 bp, Homo sapiens
agggcctgtcagcggtgtcctg

SEQ ID NO: 8419320 - DNA, 22 bp, Homo sapiens
cctaattatctcccaaagatcc

SEQ ID NO: 8419321 - DNA, 20 bp, Homo sapiens
agggcctgttgcaagcgttt

SEQ ID NO: 8419322 - DNA, 21 bp, Homo sapiens
catcttaggttgtacatatat

SEQ ID NO: 8419323 - DNA, 20 bp, Homo sapiens
catacactattctgtatagt

SEQ ID NO: 8419324 - DNA, 22 bp, Homo sapiens
cagctgtgtatgagagcatgct

SEQ ID NO: 8419325 - DNA, 18 bp, Homo sapiens
cagggctgtggggtcact

SEQ ID NO: 8419326 - DNA, 22 bp, Homo sapiens
cagggctgttagctgctgctct

SEQ ID NO: 8419327 - DNA, 22 bp, Homo sapiens
cagggctggcttccaagttgtt

SEQ ID NO: 8419328 - DNA, 23 bp, Homo sapiens
cagggctgggcttggtgttaggc

SEQ ID NO: 8419329 - DNA, 22 bp, Homo sapiens
cagggctggctgtggcaatctc

SEQ ID NO: 8419330 - DNA, 22 bp, Homo sapiens
cagggctggctcatgaaaagtt

SEQ ID NO: 8419331 - DNA, 22 bp, Homo sapiens
acatctgacatgatcttcagta

SEQ ID NO: 8419332 - DNA, 22 bp, Homo sapiens
acatctgattacatgagaatat

SEQ ID NO: 8419333 - DNA, 22 bp, Homo sapiens
acctcagattgtggctccgctg

SEQ ID NO: 8419334 - DNA, 20 bp, Homo sapiens
accagagctctcagtatgtg

SEQ ID NO: 8419335 - DNA, 22 bp, Homo sapiens
actcaccacacccttgcacttg

SEQ ID NO: 8419336 - DNA, 22 bp, Homo sapiens
agtaactcatgtaaacctcaca

SEQ ID NO: 8419337 - DNA, 22 bp, Homo sapiens
agtaactctcctttgacatatt

SEQ ID NO: 8419338 - DNA, 22 bp, Homo sapiens
agtaacatctttgacatttgtt

SEQ ID NO: 8419339 - DNA, 23 bp, Homo sapiens
agtaacatgcaaataacagtctg

SEQ ID NO: 8419340 - DNA, 22 bp, Homo sapiens
agtaacatgagtttttctaatg

SEQ ID NO: 8419341 - DNA, 22 bp, Homo sapiens
agtaagttccagtttcattatg

SEQ ID NO: 8419342 - DNA, 22 bp, Homo sapiens
actctgggctttgatttgttac

SEQ ID NO: 8419343 - DNA, 22 bp, Homo sapiens
actctgggattgtttctggtat

SEQ ID NO: 8419344 - DNA, 20 bp, Homo sapiens
agttacgctattactctcct

SEQ ID NO: 8419345 - DNA, 22 bp, Homo sapiens
agttacagcactcaaagttttc

SEQ ID NO: 8419346 - DNA, 22 bp, Homo sapiens
agttacagtgaccatttattta

SEQ ID NO: 8419347 - DNA, 22 bp, Homo sapiens
agttacagtgttctattactct

SEQ ID NO: 8419348 - DNA, 22 bp, Homo sapiens
actggtgttgatttggaagggg

SEQ ID NO: 8419349 - DNA, 22 bp, Homo sapiens
agttacaaacactatcagttct

SEQ ID NO: 8419350 - DNA, 22 bp, Homo sapiens
ataaggaaatgaaactctaata

SEQ ID NO: 8419351 - DNA, 22 bp, Homo sapiens
ataaggtataaggcctattttt

SEQ ID NO: 8419352 - DNA, 19 bp, Homo sapiens
atacactaatataaaccac

SEQ ID NO: 8419353 - DNA, 22 bp, Homo sapiens
agttcagagtaaatgttgaagg

SEQ ID NO: 8419354 - DNA, 22 bp, Homo sapiens
actttactacatccacagatgg

SEQ ID NO: 8419355 - DNA, 22 bp, Homo sapiens
atacacttccaaatattgatta

SEQ ID NO: 8419356 - DNA, 20 bp, Homo sapiens
atacacttgcccagcttgtg

SEQ ID NO: 8419357 - DNA, 22 bp, Homo sapiens
atacacttgacctggagtgaag

SEQ ID NO: 8419358 - DNA, 20 bp, Homo sapiens
agaaaaagtgtggaaatttc

SEQ ID NO: 8419359 - DNA, 22 bp, Homo sapiens
agaaaagaggctttctaagcat

SEQ ID NO: 8419360 - DNA, 22 bp, Homo sapiens
atagttacaaagactttttaaa

SEQ ID NO: 8419361 - DNA, 22 bp, Homo sapiens
agagccagcatttgacactggc

SEQ ID NO: 8419362 - DNA, 22 bp, Homo sapiens
agagccagcatttgggccctgc

SEQ ID NO: 8419363 - DNA, 22 bp, Homo sapiens
atgtagttagaagattcaaaca

SEQ ID NO: 8419364 - DNA, 22 bp, Homo sapiens
agcaagatgaaggattcaagac

SEQ ID NO: 8419365 - DNA, 22 bp, Homo sapiens
agcaagatgcattatttcttat

SEQ ID NO: 8419366 - DNA, 22 bp, Homo sapiens
attaataaaataccactttgtt

SEQ ID NO: 8419367 - DNA, 22 bp, Homo sapiens
agataaattcctaagatttcag

SEQ ID NO: 8419368 - DNA, 22 bp, Homo sapiens
cagcagaaaatacctgtaactc

SEQ ID NO: 8419369 - DNA, 22 bp, Homo sapiens
cagagctgttactattcatgaa

SEQ ID NO: 8419370 - DNA, 22 bp, Homo sapiens
agcctaatgcttttcccaaagt

SEQ ID NO: 8419371 - DNA, 22 bp, Homo sapiens
cacacttttggcatgtttggtt

SEQ ID NO: 8419372 - DNA, 20 bp, Homo sapiens
cacaggaaagctactcagtt

SEQ ID NO: 8419373 - DNA, 22 bp, Homo sapiens
caattatatttagaatgataca

SEQ ID NO: 8419374 - DNA, 22 bp, Homo sapiens
caattacatttattgagcattc

SEQ ID NO: 8419375 - DNA, 22 bp, Homo sapiens
cagaaactagatttagacacaa

SEQ ID NO: 8419376 - DNA, 22 bp, Homo sapiens
cactggtatttgaaaatagatg

SEQ ID NO: 8419377 - DNA, 22 bp, Homo sapiens
cactggtagtttcagcaaccag

SEQ ID NO: 8419378 - DNA, 22 bp, Homo sapiens
cactggtagcagttaagttagg

SEQ ID NO: 8419379 - DNA, 22 bp, Homo sapiens
cactggtacgtaggttggggca

SEQ ID NO: 8419380 - DNA, 22 bp, Homo sapiens
cactggtagagagaagacaagg

SEQ ID NO: 8419381 - DNA, 21 bp, Homo sapiens
cactggtagatggcccgcagg

SEQ ID NO: 8419382 - DNA, 22 bp, Homo sapiens
cactggtacactgaatggcgtt

SEQ ID NO: 8419383 - DNA, 22 bp, Homo sapiens
cactaagttggtgttaattagt

SEQ ID NO: 8419384 - DNA, 22 bp, Homo sapiens
aagaactgtatcaagatgtagt

SEQ ID NO: 8419385 - DNA, 22 bp, Homo sapiens
aagaactgtgctccaggctcca

SEQ ID NO: 8419386 - DNA, 22 bp, Homo sapiens
aagaactgtttacaattttcac

SEQ ID NO: 8419387 - DNA, 23 bp, Homo sapiens
aagaactgcgaatggagaaagta

SEQ ID NO: 8419388 - DNA, 22 bp, Homo sapiens
aagaactggttatgttatcttg

SEQ ID NO: 8419389 - DNA, 18 bp, Homo sapiens
aagaactgaggtcctaga

SEQ ID NO: 8419390 - DNA, 22 bp, Homo sapiens
aagaactgagtacgttaataaa

SEQ ID NO: 8419391 - DNA, 22 bp, Homo sapiens
aagcagtttagataggcaaagg

SEQ ID NO: 8419392 - DNA, 22 bp, Homo sapiens
acagactggagcccttttgccc

SEQ ID NO: 8419393 - DNA, 22 bp, Homo sapiens
acacttctctttgaagaacaat

SEQ ID NO: 8419394 - DNA, 22 bp, Homo sapiens
aagtaatctggaatttggtttt

SEQ ID NO: 8419395 - DNA, 22 bp, Homo sapiens
aagtaagtcttacattcacatt

SEQ ID NO: 8419396 - DNA, 22 bp, Homo sapiens
aagggctgcaatccaaaacact

SEQ ID NO: 8419397 - DNA, 22 bp, Homo sapiens
aagggctgctgtagaagcagag

SEQ ID NO: 8419398 - DNA, 22 bp, Homo sapiens
aagggctgccagggggtgccag

SEQ ID NO: 8419399 - DNA, 22 bp, Homo sapiens
aagggctgcatttgatgtgtca

SEQ ID NO: 8419400 - DNA, 22 bp, Homo sapiens
aagggctggaatatctcttaga

SEQ ID NO: 8419401 - DNA, 22 bp, Homo sapiens
aagttacagtcagaggttaaca

SEQ ID NO: 8419402 - DNA, 22 bp, Homo sapiens
aagttacagttacagaatggag

SEQ ID NO: 8419403 - DNA, 22 bp, Homo sapiens
aagttacagttatgaaactcac

SEQ ID NO: 8419404 - DNA, 22 bp, Homo sapiens
aagttacataaatgtcctctag

SEQ ID NO: 8419405 - DNA, 22 bp, Homo sapiens
aagttacagttggaactgtgaa

SEQ ID NO: 8419406 - DNA, 22 bp, Homo sapiens
aagttacagttattatttaaaa

SEQ ID NO: 8419407 - DNA, 22 bp, Homo sapiens
aagttacacattttcattgtaa

SEQ ID NO: 8419408 - DNA, 22 bp, Homo sapiens
aagttaacccagtatttctttt

SEQ ID NO: 8419409 - DNA, 22 bp, Homo sapiens
aaaaatgaaacggctggttggc

SEQ ID NO: 8419410 - DNA, 22 bp, Homo sapiens
aaaatactactgtcttcttccc

SEQ ID NO: 8419411 - DNA, 22 bp, Homo sapiens
aaaagttacctctgtaatataa

SEQ ID NO: 8419412 - DNA, 22 bp, Homo sapiens
aacttctgccaaacagctgtta

SEQ ID NO: 8419413 - DNA, 22 bp, Homo sapiens
aagaagttaaataaatggacca

SEQ ID NO: 8419414 - DNA, 22 bp, Homo sapiens
aaatacatacactgtacgtggc

SEQ ID NO: 8419415 - DNA, 23 bp, Homo sapiens
aaatgacatatggtttctgaagg

SEQ ID NO: 8419416 - DNA, 22 bp, Homo sapiens
agcggctgctccgcaggctggc

SEQ ID NO: 8419417 - DNA, 22 bp, Homo sapiens
agcggctgctcttttcagatcc

SEQ ID NO: 8419418 - DNA, 22 bp, Homo sapiens
agcggctggaccagcgttcaag

SEQ ID NO: 8419419 - DNA, 22 bp, Homo sapiens
acagaacttccagggaacatac

SEQ ID NO: 8419420 - DNA, 22 bp, Homo sapiens
acagaagtgacaatttcttggg

SEQ ID NO: 8419421 - DNA, 22 bp, Homo sapiens
acagaagtgtctttttcattca

SEQ ID NO: 8419422 - DNA, 22 bp, Homo sapiens
acagagctgtacatgtgccatg

SEQ ID NO: 8419423 - DNA, 22 bp, Homo sapiens
acacagtattgtgactataact

SEQ ID NO: 8419424 - DNA, 22 bp, Homo sapiens
aattaactaatttggtacaaga

SEQ ID NO: 8419425 - DNA, 21 bp, Homo sapiens
aattacagatggaattacaga

SEQ ID NO: 8419426 - DNA, 22 bp, Homo sapiens
acatctagaagatctgggagat

SEQ ID NO: 8419427 - DNA, 22 bp, Homo sapiens
acatgaaatgcagcctgtaacc

SEQ ID NO: 8419428 - DNA, 22 bp, Homo sapiens
accagagctggctctgagcacc

SEQ ID NO: 8419429 - DNA, 22 bp, Homo sapiens
accagagcttacatgctagaaa

SEQ ID NO: 8419430 - DNA, 22 bp, Homo sapiens
aagggctggagactgggtcttc

SEQ ID NO: 8419431 - DNA, 22 bp, Homo sapiens
aagggctgatctcactttcttt

SEQ ID NO: 8419432 - DNA, 19 bp, Homo sapiens
aagggctgggcacctcact

SEQ ID NO: 8419433 - DNA, 18 bp, Homo sapiens
aagggctggcctttggag

SEQ ID NO: 8419434 - DNA, 22 bp, Homo sapiens
aagggctggccctgggaagagt

SEQ ID NO: 8419435 - DNA, 22 bp, Homo sapiens
aagggctggagaggaaaggttg

SEQ ID NO: 8419436 - DNA, 22 bp, Homo sapiens
aagggctggccacattctgggt

SEQ ID NO: 8419437 - DNA, 22 bp, Homo sapiens
aagggctggatctctctgagca

SEQ ID NO: 8419438 - DNA, 22 bp, Homo sapiens
aagtagttggaaataagacaga

SEQ ID NO: 8419439 - DNA, 22 bp, Homo sapiens
aagtagtgtgctccagcggtga

SEQ ID NO: 8419440 - DNA, 22 bp, Homo sapiens
aagtagttaggaacattctctc

SEQ ID NO: 8419441 - DNA, 22 bp, Homo sapiens
aatgccaacttggatatacatt

SEQ ID NO: 8419442 - DNA, 22 bp, Homo sapiens
agaagcagctttcaaggtgatt

SEQ ID NO: 8419443 - DNA, 22 bp, Homo sapiens
agaactgtccttggaggagagt

SEQ ID NO: 8419444 - DNA, 22 bp, Homo sapiens
agaactattgcaataacaagaa

SEQ ID NO: 8419445 - DNA, 22 bp, Homo sapiens
agaacgtggaatgtggctcctt

SEQ ID NO: 8419446 - DNA, 22 bp, Homo sapiens
taggatatgcatttttatacat

SEQ ID NO: 8419447 - DNA, 22 bp, Homo sapiens
taggatatgtgaaatcatatta

SEQ ID NO: 8419448 - DNA, 22 bp, Homo sapiens
tagcagagtaatactttggagc

SEQ ID NO: 8419449 - DNA, 22 bp, Homo sapiens
tagcagaggcaaggatgtgaat

SEQ ID NO: 8419450 - DNA, 22 bp, Homo sapiens
tagcagaggctgtctgacttaa

SEQ ID NO: 8419451 - DNA, 22 bp, Homo sapiens
tagaaaagataacattctgtgc

SEQ ID NO: 8419452 - DNA, 22 bp, Homo sapiens
tagaaaagaattttatttgata

SEQ ID NO: 8419453 - DNA, 22 bp, Homo sapiens
tagaaagtactaaatttaactg

SEQ ID NO: 8419454 - DNA, 22 bp, Homo sapiens
tagaaagtaaatcagttttatt

SEQ ID NO: 8419455 - DNA, 22 bp, Homo sapiens
tagaaagtagccacttacagag

SEQ ID NO: 8419456 - DNA, 22 bp, Homo sapiens
tagaaagtgaaggttaattaat

SEQ ID NO: 8419457 - DNA, 22 bp, Homo sapiens
tagacagagtgaagacaagtgg

SEQ ID NO: 8419458 - DNA, 22 bp, Homo sapiens
tattaggtagattttactgatt

SEQ ID NO: 8419459 - DNA, 22 bp, Homo sapiens
tatgactttggaaaaattactt

SEQ ID NO: 8419460 - DNA, 22 bp, Homo sapiens
tatctagataccaagaagcaca

SEQ ID NO: 8419461 - DNA, 23 bp, Homo sapiens
tatacacatgtggcagtatagtg

SEQ ID NO: 8419462 - DNA, 22 bp, Homo sapiens
tatacactgatataaggagtaa

SEQ ID NO: 8419463 - DNA, 22 bp, Homo sapiens
tatacactgttgttgggagtct

SEQ ID NO: 8419464 - DNA, 22 bp, Homo sapiens
tatacacatttttacctatagt

SEQ ID NO: 8419465 - DNA, 22 bp, Homo sapiens
taattatagccgctattttgct

SEQ ID NO: 8419466 - DNA, 22 bp, Homo sapiens
tacaaagtaatgtataatatcg

SEQ ID NO: 8419467 - DNA, 22 bp, Homo sapiens
taattaacatacaaaacagctg

SEQ ID NO: 8419468 - DNA, 22 bp, Homo sapiens
taattataacagttacatctta

SEQ ID NO: 8419469 - DNA, 22 bp, Homo sapiens
taattataaactgcagtaggta

SEQ ID NO: 8419470 - DNA, 22 bp, Homo sapiens
taattataacatgctttctggc

SEQ ID NO: 8419471 - DNA, 22 bp, Homo sapiens
taattatagcattggagtggcc

SEQ ID NO: 8419472 - DNA, 22 bp, Homo sapiens
taattatacaaaaaggcatgca

SEQ ID NO: 8419473 - DNA, 22 bp, Homo sapiens
taactgcctactgtgcaaatat

SEQ ID NO: 8419474 - DNA, 22 bp, Homo sapiens
taactggtactctggtagcctg

SEQ ID NO: 8419475 - DNA, 22 bp, Homo sapiens
taactgccagcagcgatgaaca

SEQ ID NO: 8419476 - DNA, 22 bp, Homo sapiens
tacactattttactgatacaaa

SEQ ID NO: 8419477 - DNA, 22 bp, Homo sapiens
tacacttttcaatgtagtctgt

SEQ ID NO: 8419478 - DNA, 22 bp, Homo sapiens
tacatctagccttacaattatt

SEQ ID NO: 8419479 - DNA, 22 bp, Homo sapiens
tacatctatactgatctacatt

SEQ ID NO: 8419480 - DNA, 22 bp, Homo sapiens
tacagtaagatgaaatagcaat

SEQ ID NO: 8419481 - DNA, 21 bp, Homo sapiens
tacagtaagttgggtggtcct

SEQ ID NO: 8419482 - DNA, 22 bp, Homo sapiens
tacagtaataaaatgagctaca

SEQ ID NO: 8419483 - DNA, 22 bp, Homo sapiens
tacatacatgtatgtgtgtatt

SEQ ID NO: 8419484 - DNA, 23 bp, Homo sapiens
gttaataatgaacactttctccc

SEQ ID NO: 8419485 - DNA, 22 bp, Homo sapiens
gttaataaaggtatagaatcag

SEQ ID NO: 8419486 - DNA, 22 bp, Homo sapiens
taaccatattttccattaagtt

SEQ ID NO: 8419487 - DNA, 22 bp, Homo sapiens
taactctagtcccaggcatgaa

SEQ ID NO: 8419488 - DNA, 22 bp, Homo sapiens
taactacaagggcggtctctgt

SEQ ID NO: 8419489 - DNA, 22 bp, Homo sapiens
taaattaaagattggagaagga

SEQ ID NO: 8419490 - DNA, 22 bp, Homo sapiens
taaagtggtggtgctaatgtat

SEQ ID NO: 8419491 - DNA, 22 bp, Homo sapiens
tcagaaaagaccacattattct

SEQ ID NO: 8419492 - DNA, 22 bp, Homo sapiens
tcagaaaagagaaaatcttata

SEQ ID NO: 8419493 - DNA, 22 bp, Homo sapiens
tcagaaaaggtagctgtgacaa

SEQ ID NO: 8419494 - DNA, 22 bp, Homo sapiens
tcagaaaataactgttagtttg

SEQ ID NO: 8419495 - DNA, 22 bp, Homo sapiens
tcacagaaggaccttgtttcat

SEQ ID NO: 8419496 - DNA, 22 bp, Homo sapiens
tcacagaaatctgttttttcta

SEQ ID NO: 8419497 - DNA, 22 bp, Homo sapiens
tcacagaacaatgtttagttct

SEQ ID NO: 8419498 - DNA, 22 bp, Homo sapiens
tcacaaaagcttttgaatttgg

SEQ ID NO: 8419499 - DNA, 22 bp, Homo sapiens
tcatataagtttaaaactatct

SEQ ID NO: 8419500 - DNA, 20 bp, Homo sapiens
tcattacagtgctaagatgt

SEQ ID NO: 8419501 - DNA, 22 bp, Homo sapiens
tcattcactttgaaataaacga

SEQ ID NO: 8419502 - DNA, 22 bp, Homo sapiens
gcacagaacagagaaatagcca

SEQ ID NO: 8419503 - DNA, 21 bp, Homo sapiens
gccacccctggcacaggtgct

SEQ ID NO: 8419504 - DNA, 18 bp, Homo sapiens
gctttatttcttggggaa

SEQ ID NO: 8419505 - DNA, 22 bp, Homo sapiens
gctttattttgtgagggattac

SEQ ID NO: 8419506 - DNA, 22 bp, Homo sapiens
ggagagaattccatggacatgt

SEQ ID NO: 8419507 - DNA, 22 bp, Homo sapiens
ggagagaatctgaacctgctcc

SEQ ID NO: 8419508 - DNA, 22 bp, Homo sapiens
ggagagaaattgaggtagcaag

SEQ ID NO: 8419509 - DNA, 22 bp, Homo sapiens
ggacagtagtcactaaactaga

SEQ ID NO: 8419510 - DNA, 22 bp, Homo sapiens
ggacaggttcagcagtttataa

SEQ ID NO: 8419511 - DNA, 22 bp, Homo sapiens
gcctttattgtttattcagtgc

SEQ ID NO: 8419512 - DNA, 22 bp, Homo sapiens
gctctgggctgaatcatttatc

SEQ ID NO: 8419513 - DNA, 22 bp, Homo sapiens
gctgccttatgtctattagtat

SEQ ID NO: 8419514 - DNA, 22 bp, Homo sapiens
gtattagttatctactgctgtg

SEQ ID NO: 8419515 - DNA, 22 bp, Homo sapiens
gtattagtcaattacagtgggg

SEQ ID NO: 8419516 - DNA, 18 bp, Homo sapiens
gtattagttttcagagag

SEQ ID NO: 8419517 - DNA, 22 bp, Homo sapiens
ggctttagggcaggcagtgtta

SEQ ID NO: 8419518 - DNA, 22 bp, Homo sapiens
gacagtaactgagagatgtaat

SEQ ID NO: 8419519 - DNA, 22 bp, Homo sapiens
gacagtaagtcagagacttggt

SEQ ID NO: 8419520 - DNA, 22 bp, Homo sapiens
gacaggttgaagtatcaaaggt

SEQ ID NO: 8419521 - DNA, 22 bp, Homo sapiens
gaatacacgaatagagcatggt

SEQ ID NO: 8419522 - DNA, 22 bp, Homo sapiens
gaatacaccaaggaatcagaat

SEQ ID NO: 8419523 - DNA, 22 bp, Homo sapiens
gaagtttagagtgttgtaattt

SEQ ID NO: 8419524 - DNA, 22 bp, Homo sapiens
gaaatccagttccctactctta

SEQ ID NO: 8419525 - DNA, 22 bp, Homo sapiens
gagcctggacatctcaggccca

SEQ ID NO: 8419526 - DNA, 19 bp, Homo sapiens
ctgtggctgacctctggcc

SEQ ID NO: 8419527 - DNA, 22 bp, Homo sapiens
cttgtagctgcttcttctgaag

SEQ ID NO: 8419528 - DNA, 22 bp, Homo sapiens
ctgccaccaaatagctgcatga

SEQ ID NO: 8419529 - DNA, 22 bp, Homo sapiens
ctgccaccatgccccagcagag

SEQ ID NO: 8419530 - DNA, 22 bp, Homo sapiens
ttagaaaacataagtggtaaag

SEQ ID NO: 8419531 - DNA, 22 bp, Homo sapiens
cctggttgtgagttgagttgag

SEQ ID NO: 8419532 - DNA, 22 bp, Homo sapiens
cctggttgagggaggtgtggac

SEQ ID NO: 8419533 - DNA, 22 bp, Homo sapiens
cctggtggcttctgggtggacg

SEQ ID NO: 8419534 - DNA, 22 bp, Homo sapiens
cctggtgggcaggagtgagacc

SEQ ID NO: 8419535 - DNA, 22 bp, Homo sapiens
cctggtggcgaatggtggtagg

SEQ ID NO: 8419536 - DNA, 22 bp, Homo sapiens
cctggtggagaggggcggagcg

SEQ ID NO: 8419537 - DNA, 22 bp, Homo sapiens
cctggtggaaggtgagtgaggc

SEQ ID NO: 8419538 - DNA, 21 bp, Homo sapiens
tgttacagtccaaatgtttgt

SEQ ID NO: 8419539 - DNA, 22 bp, Homo sapiens
ttcagaaagtgaatcttgttat

SEQ ID NO: 8419540 - DNA, 22 bp, Homo sapiens
ttcatctgtagtttttccaagg

SEQ ID NO: 8419541 - DNA, 22 bp, Homo sapiens
ctagaaaaatactttattgtga

SEQ ID NO: 8419542 - DNA, 22 bp, Homo sapiens
ctaaatgacaggtaccatagtg

SEQ ID NO: 8419543 - DNA, 22 bp, Homo sapiens
ctaaatgatattttggtttcct

SEQ ID NO: 8419544 - DNA, 18 bp, Homo sapiens
ctctttctttggcacaaa

SEQ ID NO: 8419545 - DNA, 22 bp, Homo sapiens
ctctgccatttatcagaactgt

SEQ ID NO: 8419546 - DNA, 22 bp, Homo sapiens
tttagtctaataaaagtggagt

SEQ ID NO: 8419547 - DNA, 22 bp, Homo sapiens
tttcacaaagcatagcacttta

SEQ ID NO: 8419548 - DNA, 22 bp, Homo sapiens
taatcacagaaacagactgttt

SEQ ID NO: 8419549 - DNA, 22 bp, Homo sapiens
tacaaaaaattgatactgacga

SEQ ID NO: 8419550 - DNA, 22 bp, Homo sapiens
cagggctgaaatcaaggtgtag

SEQ ID NO: 8419551 - DNA, 22 bp, Homo sapiens
cagggctgaagaaattcaaaag

SEQ ID NO: 8419552 - DNA, 22 bp, Homo sapiens
cagggctgaactgagcttgtga

SEQ ID NO: 8419553 - DNA, 22 bp, Homo sapiens
cagggctgggttaaaagcaggg

SEQ ID NO: 8419554 - DNA, 22 bp, Homo sapiens
cagggctggatttcatttctag

SEQ ID NO: 8419555 - DNA, 23 bp, Homo sapiens
cagggctggtagggaagagcgtg

SEQ ID NO: 8419556 - DNA, 22 bp, Homo sapiens
cagggctggtttgtcgaagaaa

SEQ ID NO: 8419557 - DNA, 22 bp, Homo sapiens
cagggctgtaaattagtgctga

SEQ ID NO: 8419558 - DNA, 22 bp, Homo sapiens
cagggctgtctccaaaggcccc

SEQ ID NO: 8419559 - DNA, 22 bp, Homo sapiens
cagggctgtggctttgtgctgt

SEQ ID NO: 8419560 - DNA, 22 bp, Homo sapiens
cagggctgtgcccatcttcccc

SEQ ID NO: 8419561 - DNA, 22 bp, Homo sapiens
cagggctgtggaaaactggtgc

SEQ ID NO: 8419562 - DNA, 17 bp, Homo sapiens
cagggctgtctgcctag

SEQ ID NO: 8419563 - DNA, 22 bp, Homo sapiens
tattaggttggtgcaaaattaa

SEQ ID NO: 8419564 - DNA, 23 bp, Homo sapiens
tcctttaatgctggaatggctag

SEQ ID NO: 8419565 - DNA, 22 bp, Homo sapiens
tctaagatctactatacatgtg

SEQ ID NO: 8419566 - DNA, 23 bp, Homo sapiens
cagttggaggtacagagacactg

SEQ ID NO: 8419567 - DNA, 17 bp, Homo sapiens
cagttggagacaagtcc

SEQ ID NO: 8419568 - DNA, 22 bp, Homo sapiens
cagttggaggaatgaggctgta

SEQ ID NO: 8419569 - DNA, 22 bp, Homo sapiens
tctgggagccatgccttggagt

SEQ ID NO: 8419570 - DNA, 22 bp, Homo sapiens
tctttcttggtataaagcaggg

SEQ ID NO: 8419571 - DNA, 22 bp, Homo sapiens
ccattagtacctctggaaaatt

SEQ ID NO: 8419572 - DNA, 22 bp, Homo sapiens
tttccaaataaggtcacactca

SEQ ID NO: 8419573 - DNA, 22 bp, Homo sapiens
tttagttctcccagtcttgatt

SEQ ID NO: 8419574 - DNA, 22 bp, Homo sapiens
ttggtcagctcaatggagaggg

SEQ ID NO: 8419575 - DNA, 22 bp, Homo sapiens
ttctagttcccacatagttgcc

SEQ ID NO: 8419576 - DNA, 22 bp, Homo sapiens
ttctgaatggcaagcattaggc

SEQ ID NO: 8419577 - DNA, 22 bp, Homo sapiens
ttctgagagtgccagaagttct

SEQ ID NO: 8419578 - DNA, 22 bp, Homo sapiens
ttctgttagaattttgaaaata

SEQ ID NO: 8419579 - DNA, 22 bp, Homo sapiens
ttctgttacaagtgaaaaaatg

SEQ ID NO: 8419580 - DNA, 22 bp, Homo sapiens
ttgaattataagtgtgtctact

SEQ ID NO: 8419581 - DNA, 22 bp, Homo sapiens
ttagataaagtgatgtaggcta

SEQ ID NO: 8419582 - DNA, 22 bp, Homo sapiens
ttagataaaagtgttcaataaa

SEQ ID NO: 8419583 - DNA, 22 bp, Homo sapiens
ttagataaattaagactttaca

SEQ ID NO: 8419584 - DNA, 22 bp, Homo sapiens
ttcacaaaacactattttctgg

SEQ ID NO: 8419585 - DNA, 20 bp, Homo sapiens
ttctaatttgatggagtagc

SEQ ID NO: 8419586 - DNA, 22 bp, Homo sapiens
ttctaattaaatctacgctagg

SEQ ID NO: 8419587 - DNA, 22 bp, Homo sapiens
ttctaattgaccttaggctgtg

SEQ ID NO: 8419588 - DNA, 16 bp, Homo sapiens
ttctagaaaagaaggt

SEQ ID NO: 8419589 - DNA, 22 bp, Homo sapiens
ttctacaaatatttactgttcc

SEQ ID NO: 8419590 - DNA, 22 bp, Homo sapiens
ttctagattgcctgtaagtaaa

SEQ ID NO: 8419591 - DNA, 22 bp, Homo sapiens
ttctagatgcttataggcatat

SEQ ID NO: 8419592 - DNA, 22 bp, Homo sapiens
ttagagaaagggtttgattccg

SEQ ID NO: 8419593 - DNA, 22 bp, Homo sapiens
ttagagccagttacaaggtcaa

SEQ ID NO: 8419594 - DNA, 22 bp, Homo sapiens
ttagagccccagaaaacagtgg

SEQ ID NO: 8419595 - DNA, 22 bp, Homo sapiens
ttagagaagctgtaattattca

SEQ ID NO: 8419596 - DNA, 21 bp, Homo sapiens
ttagaaagctcactacagtta

SEQ ID NO: 8419597 - DNA, 22 bp, Homo sapiens
ttagaaagaactttagatatca

SEQ ID NO: 8419598 - DNA, 22 bp, Homo sapiens
ttacacttgtaaatggcatgta

SEQ ID NO: 8419599 - DNA, 22 bp, Homo sapiens
ttacacttctgaaagcctaggt

SEQ ID NO: 8419600 - DNA, 19 bp, Homo sapiens
ttacacttctgctttgtga

SEQ ID NO: 8419601 - DNA, 22 bp, Homo sapiens
ttacacttctaaaaaaagcagg

SEQ ID NO: 8419602 - DNA, 22 bp, Homo sapiens
ttacacttagggtttgtcagag

SEQ ID NO: 8419603 - DNA, 22 bp, Homo sapiens
ttacacttacctgtccattgaa

SEQ ID NO: 8419604 - DNA, 20 bp, Homo sapiens
ttaagaaaagcacatcctgc

SEQ ID NO: 8419605 - DNA, 22 bp, Homo sapiens
ttaagtaacttgtccaaatgag

SEQ ID NO: 8419606 - DNA, 23 bp, Homo sapiens
ttaagtggtcagttttagacaac

SEQ ID NO: 8419607 - DNA, 22 bp, Homo sapiens
tgttctctaagaaaagaagcat

SEQ ID NO: 8419608 - DNA, 22 bp, Homo sapiens
gtgagagatcccccactcatct

SEQ ID NO: 8419609 - DNA, 20 bp, Homo sapiens
gtacacttcatgtttcacct

SEQ ID NO: 8419610 - DNA, 22 bp, Homo sapiens
gtacacttgactcataggaaat

SEQ ID NO: 8419611 - DNA, 22 bp, Homo sapiens
gtacacttgtcttgaacagcct

SEQ ID NO: 8419612 - DNA, 22 bp, Homo sapiens
gggtacagagagatgaggtaac

SEQ ID NO: 8419613 - DNA, 22 bp, Homo sapiens
cacattaaaatcctaacttcca

SEQ ID NO: 8419614 - DNA, 22 bp, Homo sapiens
cactggtgccagagaacagaat

SEQ ID NO: 8419615 - DNA, 22 bp, Homo sapiens
cactggtgtattagagctagaa

SEQ ID NO: 8419616 - DNA, 22 bp, Homo sapiens
cactgtaatagcattataagtg

SEQ ID NO: 8419617 - DNA, 22 bp, Homo sapiens
gctggaaatcaaagaagtggat

SEQ ID NO: 8419618 - DNA, 22 bp, Homo sapiens
caagaagtgtcagctttttaaa

SEQ ID NO: 8419619 - DNA, 22 bp, Homo sapiens
caactatagatcaaatgagttt

SEQ ID NO: 8419620 - DNA, 22 bp, Homo sapiens
atgttagtgatagtaaatagtg

SEQ ID NO: 8419621 - DNA, 22 bp, Homo sapiens
atctttctatttctaaaaacta

SEQ ID NO: 8419622 - DNA, 22 bp, Homo sapiens
atctttcttatttgaagaaaga

SEQ ID NO: 8419623 - DNA, 22 bp, Homo sapiens
attccaaaggttaatgcccatt

SEQ ID NO: 8419624 - DNA, 22 bp, Homo sapiens
attctttgcatctctgggtggc

SEQ ID NO: 8419625 - DNA, 22 bp, Homo sapiens
attaactgtactttctaatttt

SEQ ID NO: 8419626 - DNA, 22 bp, Homo sapiens
atttagtttaggaaaagtaggt

SEQ ID NO: 8419627 - DNA, 22 bp, Homo sapiens
atttggtagtgattgaaattat

SEQ ID NO: 8419628 - DNA, 22 bp, Homo sapiens
agctgtgaccttcaagagctac

SEQ ID NO: 8419629 - DNA, 22 bp, Homo sapiens
agtcagtttccctggaaagcag

SEQ ID NO: 8419630 - DNA, 20 bp, Homo sapiens
ctacacttggcacctggcat

SEQ ID NO: 8419631 - DNA, 22 bp, Homo sapiens
ctacactttggttgactttgtg

SEQ ID NO: 8419632 - DNA, 22 bp, Homo sapiens
agtaatcaatttttcggtggat

SEQ ID NO: 8419633 - DNA, 22 bp, Homo sapiens
agtaatctgattttatagctat

SEQ ID NO: 8419634 - DNA, 20 bp, Homo sapiens
cctttattatttgtatgatg

SEQ ID NO: 8419635 - DNA, 19 bp, Homo sapiens
agtctggagtaaaaggaat

SEQ ID NO: 8419636 - DNA, 22 bp, Homo sapiens
ctggtggcatcttgagatggtt

SEQ ID NO: 8419637 - DNA, 22 bp, Homo sapiens
ataagtgactgcagggaattca

SEQ ID NO: 8419638 - DNA, 22 bp, Homo sapiens
atacactttagaaaaacgctgc

SEQ ID NO: 8419639 - DNA, 22 bp, Homo sapiens
atacatctatgcctttctgaca

SEQ ID NO: 8419640 - DNA, 22 bp, Homo sapiens
atacatcttccttttaaaatgc

SEQ ID NO: 8419641 - DNA, 22 bp, Homo sapiens
atacatctctttgaagtgcttt

SEQ ID NO: 8419642 - DNA, 22 bp, Homo sapiens
atacatcttgtcagattcatgt

SEQ ID NO: 8419643 - DNA, 22 bp, Homo sapiens
atagaaaacagatgtccttaaa

SEQ ID NO: 8419644 - DNA, 22 bp, Homo sapiens
acccagagcagagcttggcttc

SEQ ID NO: 8419645 - DNA, 22 bp, Homo sapiens
acatgtttggctctatgctata

SEQ ID NO: 8419646 - DNA, 22 bp, Homo sapiens
acatgtttaagtttaatgaaaa

SEQ ID NO: 8419647 - DNA, 22 bp, Homo sapiens
acatgtttaagtttgttatatg

SEQ ID NO: 8419648 - DNA, 22 bp, Homo sapiens
acagtgtggtttgagcactggg

SEQ ID NO: 8419649 - DNA, 22 bp, Homo sapiens
acagtacaccactgtgtacagt

SEQ ID NO: 8419650 - DNA, 22 bp, Homo sapiens
atattctataagcagttggaag

SEQ ID NO: 8419651 - DNA, 22 bp, Homo sapiens
agaaaagtgctctagtgagagc

SEQ ID NO: 8419652 - DNA, 22 bp, Homo sapiens
agaaaagttttctgagactgac

SEQ ID NO: 8419653 - DNA, 23 bp, Homo sapiens
atctaatttctccaaatctctac

SEQ ID NO: 8419654 - DNA, 22 bp, Homo sapiens
agaaagttgttttagccaaacc

SEQ ID NO: 8419655 - DNA, 22 bp, Homo sapiens
agaaagtttgagaactgtagat

SEQ ID NO: 8419656 - DNA, 22 bp, Homo sapiens
agaaagttagcagactcttggc

SEQ ID NO: 8419657 - DNA, 22 bp, Homo sapiens
actgtaacacaatggtatctgt

SEQ ID NO: 8419658 - DNA, 22 bp, Homo sapiens
actgtaacactcatactgaagt

SEQ ID NO: 8419659 - DNA, 22 bp, Homo sapiens
ataaacagcctgcccaaattgg

SEQ ID NO: 8419660 - DNA, 22 bp, Homo sapiens
ataatcttgtatttcctaaagt

SEQ ID NO: 8419661 - DNA, 22 bp, Homo sapiens
ataatctttcttttccagatag

SEQ ID NO: 8419662 - DNA, 22 bp, Homo sapiens
actttatttcctattgcatcca

SEQ ID NO: 8419663 - DNA, 22 bp, Homo sapiens
atacatctagagtcataaaaac

SEQ ID NO: 8419664 - DNA, 22 bp, Homo sapiens
atacattagaatctggtactca

SEQ ID NO: 8419665 - DNA, 22 bp, Homo sapiens
atacacttgtacattttttaat

SEQ ID NO: 8419666 - DNA, 22 bp, Homo sapiens
atacagtaaccacattctatag

SEQ ID NO: 8419667 - DNA, 22 bp, Homo sapiens
agtaaacagaaagcaagatgat

SEQ ID NO: 8419668 - DNA, 21 bp, Homo sapiens
agcctgaatcccaccagttca

SEQ ID NO: 8419669 - DNA, 22 bp, Homo sapiens
agcagctgatggggaaggagtt

SEQ ID NO: 8419670 - DNA, 22 bp, Homo sapiens
agcatacagttgaaagtggctt

SEQ ID NO: 8419671 - DNA, 22 bp, Homo sapiens
atgacaaattcagaccatagca

SEQ ID NO: 8419672 - DNA, 19 bp, Homo sapiens
agaagttagacattgcaat

SEQ ID NO: 8419673 - DNA, 22 bp, Homo sapiens
agaagttatccaccttagatgc

SEQ ID NO: 8419674 - DNA, 22 bp, Homo sapiens
agaagttaattcctgaaattct

SEQ ID NO: 8419675 - DNA, 22 bp, Homo sapiens
agaagttaccacatacttctct

SEQ ID NO: 8419676 - DNA, 22 bp, Homo sapiens
atgaaattgatcttgaactttt

SEQ ID NO: 8419677 - DNA, 22 bp, Homo sapiens
agagaagagtcttgtcaaatta

SEQ ID NO: 8419678 - DNA, 22 bp, Homo sapiens
agagaagagcaatgataaattt

SEQ ID NO: 8419679 - DNA, 22 bp, Homo sapiens
agagcctgtgggagatgcagct

SEQ ID NO: 8419680 - DNA, 20 bp, Homo sapiens
actaatcatccagtcacagt

SEQ ID NO: 8419681 - DNA, 22 bp, Homo sapiens
actaacttgctgagtgaccatg

SEQ ID NO: 8419682 - DNA, 22 bp, Homo sapiens
aagttatatcatctcattgacg

SEQ ID NO: 8419683 - DNA, 20 bp, Homo sapiens
actaacatttgcaaggggct

SEQ ID NO: 8419684 - DNA, 22 bp, Homo sapiens
actaacatttgtgtatgtcttg

SEQ ID NO: 8419685 - DNA, 22 bp, Homo sapiens
aatacactattttgtgctcagt

SEQ ID NO: 8419686 - DNA, 22 bp, Homo sapiens
aatgaacatggacaagttaata

SEQ ID NO: 8419687 - DNA, 22 bp, Homo sapiens
aatgaaactcgaaataatcaca

SEQ ID NO: 8419688 - DNA, 22 bp, Homo sapiens
aatgaaactagtagaatctttg

SEQ ID NO: 8419689 - DNA, 22 bp, Homo sapiens
agaaaaatcttggcgcttgtct

SEQ ID NO: 8419690 - DNA, 22 bp, Homo sapiens
aagggctgagcacagtgagcca

SEQ ID NO: 8419691 - DNA, 22 bp, Homo sapiens
aagggctgagaagtggggctgg

SEQ ID NO: 8419692 - DNA, 22 bp, Homo sapiens
aagggctgaatgaagggttgaa

SEQ ID NO: 8419693 - DNA, 22 bp, Homo sapiens
aagggctgaaagaccttgggca

SEQ ID NO: 8419694 - DNA, 22 bp, Homo sapiens
agcagtgtggccttagacccgg

SEQ ID NO: 8419695 - DNA, 22 bp, Homo sapiens
acagaaattcaaactggaattt

SEQ ID NO: 8419696 - DNA, 22 bp, Homo sapiens
acagaaattagcagtgagttta

SEQ ID NO: 8419697 - DNA, 22 bp, Homo sapiens
acagaaattgctaatagctcat

SEQ ID NO: 8419698 - DNA, 19 bp, Homo sapiens
acactgtagatatagctat

SEQ ID NO: 8419699 - DNA, 22 bp, Homo sapiens
agcacctgctatgtgtcaggga

SEQ ID NO: 8419700 - DNA, 22 bp, Homo sapiens
aattatacatgaaggcattata

SEQ ID NO: 8419701 - DNA, 22 bp, Homo sapiens
aattatacaattgtcaagttct

SEQ ID NO: 8419702 - DNA, 22 bp, Homo sapiens
agcaagatttaaacccaggtca

SEQ ID NO: 8419703 - DNA, 22 bp, Homo sapiens
agcaagattttccttgaatgtt

SEQ ID NO: 8419704 - DNA, 22 bp, Homo sapiens
acaagttaccaaaaaagattca

SEQ ID NO: 8419705 - DNA, 22 bp, Homo sapiens
aaaaaagattgatggtggatgc

SEQ ID NO: 8419706 - DNA, 22 bp, Homo sapiens
aaaatgaagcaaaggcattcag

SEQ ID NO: 8419707 - DNA, 22 bp, Homo sapiens
aaaatgaacagaacaatgggga

SEQ ID NO: 8419708 - DNA, 22 bp, Homo sapiens
aaaatgaataagttaacccagg

SEQ ID NO: 8419709 - DNA, 22 bp, Homo sapiens
aaagaagtgttgaatttgcaag

SEQ ID NO: 8419710 - DNA, 22 bp, Homo sapiens
aaagagttggactttctcaggc

SEQ ID NO: 8419711 - DNA, 22 bp, Homo sapiens
aaatagcagcctttagttaaca

SEQ ID NO: 8419712 - DNA, 22 bp, Homo sapiens
aaattcacttgcctgcttagct

SEQ ID NO: 8419713 - DNA, 22 bp, Homo sapiens
aacagcctcagtgagattagga

SEQ ID NO: 8419714 - DNA, 22 bp, Homo sapiens
aactacattttacagaagatga

SEQ ID NO: 8419715 - DNA, 22 bp, Homo sapiens
aacttacaaggatgatagctgc

SEQ ID NO: 8419716 - DNA, 20 bp, Homo sapiens
aactgcctgcccagaggtgg

SEQ ID NO: 8419717 - DNA, 18 bp, Homo sapiens
aacatgcattagaactgc

SEQ ID NO: 8419718 - DNA, 22 bp, Homo sapiens
aacatgcatataggtaaatgga

SEQ ID NO: 8419719 - DNA, 22 bp, Homo sapiens
aatagttaagcaactttttcca

SEQ ID NO: 8419720 - DNA, 18 bp, Homo sapiens
aagaagttggccaaagag

SEQ ID NO: 8419721 - DNA, 20 bp, Homo sapiens
aagaagttggtaagcagtgc

SEQ ID NO: 8419722 - DNA, 21 bp, Homo sapiens
aagaagtttggattttgtcct

SEQ ID NO: 8419723 - DNA, 22 bp, Homo sapiens
gtataaggtatgtaaactattt

SEQ ID NO: 8419724 - DNA, 22 bp, Homo sapiens
gtagttattgctgtttacttct

SEQ ID NO: 8419725 - DNA, 22 bp, Homo sapiens
ggtggcaccttgatcttggact

SEQ ID NO: 8419726 - DNA, 22 bp, Homo sapiens
ggtggagtaattcgcagaggtt

SEQ ID NO: 8419727 - DNA, 19 bp, Homo sapiens
ggggagaactagagacagc

SEQ ID NO: 8419728 - DNA, 22 bp, Homo sapiens
ggacttctggggactgtagatt

SEQ ID NO: 8419729 - DNA, 22 bp, Homo sapiens
ggagaaaggataggaatgtgct

SEQ ID NO: 8419730 - DNA, 22 bp, Homo sapiens
ggagaaaggcatagcagaacct

SEQ ID NO: 8419731 - DNA, 18 bp, Homo sapiens
ggagaagaacagatgtgg

SEQ ID NO: 8419732 - DNA, 22 bp, Homo sapiens
gagtagcattctagagtatgct

SEQ ID NO: 8419733 - DNA, 22 bp, Homo sapiens
gagtagcagccacagaggaccc

SEQ ID NO: 8419734 - DNA, 22 bp, Homo sapiens
gttgacagaaaaataacatagc

SEQ ID NO: 8419735 - DNA, 22 bp, Homo sapiens
gttatacatatgtgttaacaaa

SEQ ID NO: 8419736 - DNA, 22 bp, Homo sapiens
taaaactgaatacatactgagg

SEQ ID NO: 8419737 - DNA, 22 bp, Homo sapiens
taaaactgcttggtatggtcta

SEQ ID NO: 8419738 - DNA, 21 bp, Homo sapiens
taaaactgtaactttgtcctg

SEQ ID NO: 8419739 - DNA, 22 bp, Homo sapiens
taacagtagccttatgtggtct

SEQ ID NO: 8419740 - DNA, 22 bp, Homo sapiens
taacagtaaagtaagttagctt

SEQ ID NO: 8419741 - DNA, 22 bp, Homo sapiens
taacatgatttgctatttagat

SEQ ID NO: 8419742 - DNA, 22 bp, Homo sapiens
taacatgaaactccaaatggta

SEQ ID NO: 8419743 - DNA, 22 bp, Homo sapiens
taacatattgtgtggcactagg

SEQ ID NO: 8419744 - DNA, 22 bp, Homo sapiens
tacttacagagcttataagtta

SEQ ID NO: 8419745 - DNA, 22 bp, Homo sapiens
taccacagtttatctattcagc

SEQ ID NO: 8419746 - DNA, 23 bp, Homo sapiens
tactacagggtcttgctatgaat

SEQ ID NO: 8419747 - DNA, 22 bp, Homo sapiens
tacagagatactctagatcaaa

SEQ ID NO: 8419748 - DNA, 22 bp, Homo sapiens
tacatgaatgtttcaatattgt

SEQ ID NO: 8419749 - DNA, 22 bp, Homo sapiens
tacatgaagaaaattaagcagt

SEQ ID NO: 8419750 - DNA, 22 bp, Homo sapiens
tacatgtaagacatgagactct

SEQ ID NO: 8419751 - DNA, 22 bp, Homo sapiens
tacatgtatgtgttaatatctg

SEQ ID NO: 8419752 - DNA, 22 bp, Homo sapiens
tacacatacaccaatgtggtca

SEQ ID NO: 8419753 - DNA, 22 bp, Homo sapiens
taatcgtatgtgtatcaaatca

SEQ ID NO: 8419754 - DNA, 22 bp, Homo sapiens
taatctatcaagcaacaaagtg

SEQ ID NO: 8419755 - DNA, 22 bp, Homo sapiens
taatataccaaactgtaatttt

SEQ ID NO: 8419756 - DNA, 22 bp, Homo sapiens
taaggaaaatggacatcaaaca

SEQ ID NO: 8419757 - DNA, 21 bp, Homo sapiens
tatggtaaccagacaagaatg

SEQ ID NO: 8419758 - DNA, 22 bp, Homo sapiens
tagggctgtttaaaagtgaggt

SEQ ID NO: 8419759 - DNA, 22 bp, Homo sapiens
tagggctgttagtaattctcag

SEQ ID NO: 8419760 - DNA, 22 bp, Homo sapiens
tagggctgtgtctccaggacca

SEQ ID NO: 8419761 - DNA, 16 bp, Homo sapiens
tagggctgggaaggag

SEQ ID NO: 8419762 - DNA, 22 bp, Homo sapiens
tagggctgtggtcagtcctcta

SEQ ID NO: 8419763 - DNA, 22 bp, Homo sapiens
tagggctgggtacactcttgcc

SEQ ID NO: 8419764 - DNA, 22 bp, Homo sapiens
tagggctgaggcaacaagggag

SEQ ID NO: 8419765 - DNA, 22 bp, Homo sapiens
tagggctgccatttgcttttct

SEQ ID NO: 8419766 - DNA, 22 bp, Homo sapiens
tagggctgcagaacaatggcct

SEQ ID NO: 8419767 - DNA, 22 bp, Homo sapiens
tagggctgcctatggctagata

SEQ ID NO: 8419768 - DNA, 19 bp, Homo sapiens
tagggctggccgggcggtg

SEQ ID NO: 8419769 - DNA, 22 bp, Homo sapiens
tagggctggcgtgctcagggaa

SEQ ID NO: 8419770 - DNA, 22 bp, Homo sapiens
tagggctgctgcagatgacagg

SEQ ID NO: 8419771 - DNA, 22 bp, Homo sapiens
tagggctgctttgtattctgct

SEQ ID NO: 8419772 - DNA, 22 bp, Homo sapiens
taggccagcccttagtcctgtc

SEQ ID NO: 8419773 - DNA, 22 bp, Homo sapiens
tagttacagaagataagggtat

SEQ ID NO: 8419774 - DNA, 22 bp, Homo sapiens
tagtgcaggttaataggacttc

SEQ ID NO: 8419775 - DNA, 22 bp, Homo sapiens
tagtgcagaggaggagcctctg

SEQ ID NO: 8419776 - DNA, 22 bp, Homo sapiens
tagagaaaagcagggatcagga

SEQ ID NO: 8419777 - DNA, 22 bp, Homo sapiens
tagactttgatattgtacaccc

SEQ ID NO: 8419778 - DNA, 22 bp, Homo sapiens
tagaagcacaggttaaaggcat

SEQ ID NO: 8419779 - DNA, 22 bp, Homo sapiens
tagacagatttaaaggaatgga

SEQ ID NO: 8419780 - DNA, 21 bp, Homo sapiens
tagaagcacataggttcaaag

SEQ ID NO: 8419781 - DNA, 22 bp, Homo sapiens
tagaactgtccaagtctgagct

SEQ ID NO: 8419782 - DNA, 22 bp, Homo sapiens
tagaactggcggctagaccact

SEQ ID NO: 8419783 - DNA, 22 bp, Homo sapiens
tagaactggaattttgtggttt

SEQ ID NO: 8419784 - DNA, 22 bp, Homo sapiens
tagaactgacgttagggaagaa

SEQ ID NO: 8419785 - DNA, 21 bp, Homo sapiens
tagaactgacgatttcagagt

SEQ ID NO: 8419786 - DNA, 22 bp, Homo sapiens
tagaactgctctcatacttgct

SEQ ID NO: 8419787 - DNA, 19 bp, Homo sapiens
tagaactgaggacttgcat

SEQ ID NO: 8419788 - DNA, 22 bp, Homo sapiens
tagcaagaaaacacaagaatta

SEQ ID NO: 8419789 - DNA, 22 bp, Homo sapiens
tagcaagaagctgtcacaggtg

SEQ ID NO: 8419790 - DNA, 22 bp, Homo sapiens
tagcaaaggatgactatgtacc

SEQ ID NO: 8419791 - DNA, 22 bp, Homo sapiens
tccaaatatacagaatctcctc

SEQ ID NO: 8419792 - DNA, 22 bp, Homo sapiens
tccaaagtaatttcacttctgt

SEQ ID NO: 8419793 - DNA, 22 bp, Homo sapiens
tccaaatattcatctacttctg

SEQ ID NO: 8419794 - DNA, 22 bp, Homo sapiens
tccaaatattcggtctttctga

SEQ ID NO: 8419795 - DNA, 18 bp, Homo sapiens
tcagctggggctgcagcc

SEQ ID NO: 8419796 - DNA, 22 bp, Homo sapiens
tcagctggaagatggtgcagaa

SEQ ID NO: 8419797 - DNA, 22 bp, Homo sapiens
tcaagaaggagactccactgtg

SEQ ID NO: 8419798 - DNA, 22 bp, Homo sapiens
tccaggtgagtgcaggtgcaga

SEQ ID NO: 8419799 - DNA, 22 bp, Homo sapiens
tcccagaggtctctgctggttc

SEQ ID NO: 8419800 - DNA, 22 bp, Homo sapiens
tcccagagtattagcaattgct

SEQ ID NO: 8419801 - DNA, 22 bp, Homo sapiens
tcccagagccaagctatggatg

SEQ ID NO: 8419802 - DNA, 22 bp, Homo sapiens
gagaagcaatcagtggccaccc

SEQ ID NO: 8419803 - DNA, 22 bp, Homo sapiens
gagagaagaacaatgtcattca

SEQ ID NO: 8419804 - DNA, 21 bp, Homo sapiens
gagaactgaaccagagcagct

SEQ ID NO: 8419805 - DNA, 22 bp, Homo sapiens
gagaactgattagcatttgcca

SEQ ID NO: 8419806 - DNA, 22 bp, Homo sapiens
gagagcaggctctcgggggcca

SEQ ID NO: 8419807 - DNA, 22 bp, Homo sapiens
gagcactgagctggaattggag

SEQ ID NO: 8419808 - DNA, 22 bp, Homo sapiens
gagcaagaccctgggttctctc

SEQ ID NO: 8419809 - DNA, 22 bp, Homo sapiens
gagcaagattaaaaggctgggt

SEQ ID NO: 8419810 - DNA, 22 bp, Homo sapiens
gagcaagagtgttggactttga

SEQ ID NO: 8419811 - DNA, 22 bp, Homo sapiens
gagcaagatcctgtttttctat

SEQ ID NO: 8419812 - DNA, 22 bp, Homo sapiens
gagcaagactacaggcagatga

SEQ ID NO: 8419813 - DNA, 22 bp, Homo sapiens
gagcaagactcactgcatcttg

SEQ ID NO: 8419814 - DNA, 22 bp, Homo sapiens
gagcaagattttataagttgtg

SEQ ID NO: 8419815 - DNA, 18 bp, Homo sapiens
gacaaaagtacagacaga

SEQ ID NO: 8419816 - DNA, 22 bp, Homo sapiens
gacaaaagtgttttgaacaagg

SEQ ID NO: 8419817 - DNA, 22 bp, Homo sapiens
gaattaactggcagttagtgct

SEQ ID NO: 8419818 - DNA, 22 bp, Homo sapiens
gagggctgaagtgttttatgag

SEQ ID NO: 8419819 - DNA, 22 bp, Homo sapiens
gagggctgataaatgcgcatgg

SEQ ID NO: 8419820 - DNA, 22 bp, Homo sapiens
gagggctgataacaggaataca

SEQ ID NO: 8419821 - DNA, 22 bp, Homo sapiens
gagggctgatgcttacttattt

SEQ ID NO: 8419822 - DNA, 22 bp, Homo sapiens
ctggtacaaaatgctgatatca

SEQ ID NO: 8419823 - DNA, 22 bp, Homo sapiens
ctggtacagtgttacaaaatgg

SEQ ID NO: 8419824 - DNA, 22 bp, Homo sapiens
ctggtggttcaggagaatggct

SEQ ID NO: 8419825 - DNA, 22 bp, Homo sapiens
gaaaaatgctccaaatctgtgg

SEQ ID NO: 8419826 - DNA, 22 bp, Homo sapiens
gaaaaatgagctgatgtcaggg

SEQ ID NO: 8419827 - DNA, 22 bp, Homo sapiens
gaaattaaccacctttggcttt

SEQ ID NO: 8419828 - DNA, 22 bp, Homo sapiens
gaaattaagcaggggtctgtgg

SEQ ID NO: 8419829 - DNA, 22 bp, Homo sapiens
gaaatacagaaagggctgaatg

SEQ ID NO: 8419830 - DNA, 22 bp, Homo sapiens
tgtcagctcccagtcagagaga

SEQ ID NO: 8419831 - DNA, 22 bp, Homo sapiens
tgtcagagcaatgaggttcagc

SEQ ID NO: 8419832 - DNA, 22 bp, Homo sapiens
ttagggaaataaaattatcagt

SEQ ID NO: 8419833 - DNA, 22 bp, Homo sapiens
ttagacaggatgtatgaaagct

SEQ ID NO: 8419834 - DNA, 22 bp, Homo sapiens
tttcagaatagcaaagcaagct

SEQ ID NO: 8419835 - DNA, 22 bp, Homo sapiens
ctgcctttgcccttgacactgt

SEQ ID NO: 8419836 - DNA, 22 bp, Homo sapiens
ctgcctttgaaagttctgttga

SEQ ID NO: 8419837 - DNA, 22 bp, Homo sapiens
ctggagagggagccctggcagt

SEQ ID NO: 8419838 - DNA, 22 bp, Homo sapiens
ctggagaggctgggaacaggtt

SEQ ID NO: 8419839 - DNA, 22 bp, Homo sapiens
ctggagagagaaaaagccttaa

SEQ ID NO: 8419840 - DNA, 22 bp, Homo sapiens
ctggagagttggaagatggact

SEQ ID NO: 8419841 - DNA, 21 bp, Homo sapiens
tgaaacagatggaagtatttg

SEQ ID NO: 8419842 - DNA, 22 bp, Homo sapiens
tgaaacagctatcagtagactg

SEQ ID NO: 8419843 - DNA, 22 bp, Homo sapiens
tctttatttaagtctgttgtaa

SEQ ID NO: 8419844 - DNA, 22 bp, Homo sapiens
tctttatttctgaatcccccat

SEQ ID NO: 8419845 - DNA, 22 bp, Homo sapiens
tctttattttatgcttgtgcaa

SEQ ID NO: 8419846 - DNA, 22 bp, Homo sapiens
tgactttaagctatctgattct

SEQ ID NO: 8419847 - DNA, 22 bp, Homo sapiens
tgactttagaattttatccaga

SEQ ID NO: 8419848 - DNA, 21 bp, Homo sapiens
tgatacaggaatggttctatg

SEQ ID NO: 8419849 - DNA, 22 bp, Homo sapiens
tggctacaagtgtgtttagttt

SEQ ID NO: 8419850 - DNA, 22 bp, Homo sapiens
ccctggtgtggatgtgattggc

SEQ ID NO: 8419851 - DNA, 22 bp, Homo sapiens
ccctggtggtacggcactggca

SEQ ID NO: 8419852 - DNA, 22 bp, Homo sapiens
ccctggtggggccagacttgct

SEQ ID NO: 8419853 - DNA, 22 bp, Homo sapiens
ccctggtgccctgggtcagcct

SEQ ID NO: 8419854 - DNA, 22 bp, Homo sapiens
tgggtcagaatcagagagttgc

SEQ ID NO: 8419855 - DNA, 22 bp, Homo sapiens
tgtaatcattacagtacatgga

SEQ ID NO: 8419856 - DNA, 22 bp, Homo sapiens
tagataaaagggcaaagggcat

SEQ ID NO: 8419857 - DNA, 22 bp, Homo sapiens
tagcaagatgatgaattattca

SEQ ID NO: 8419858 - DNA, 22 bp, Homo sapiens
tagcaagatgtcactccaagtt

SEQ ID NO: 8419859 - DNA, 22 bp, Homo sapiens
tagcaagatccttccctggcgt

SEQ ID NO: 8419860 - DNA, 22 bp, Homo sapiens
tagcaagatcgtgtctctaaaa

SEQ ID NO: 8419861 - DNA, 22 bp, Homo sapiens
tagcaagaggtgaaggtttcat

SEQ ID NO: 8419862 - DNA, 22 bp, Homo sapiens
tagcaagagtgggctttgtggg

SEQ ID NO: 8419863 - DNA, 22 bp, Homo sapiens
taggacatgtgttttatatatg

SEQ ID NO: 8419864 - DNA, 22 bp, Homo sapiens
taggacatgctacataaatagg

SEQ ID NO: 8419865 - DNA, 22 bp, Homo sapiens
taggaaattgccaatatatgac

SEQ ID NO: 8419866 - DNA, 22 bp, Homo sapiens
taggaaattagaacttggaaac

SEQ ID NO: 8419867 - DNA, 22 bp, Homo sapiens
cataaagtaaagatgtcttcca

SEQ ID NO: 8419868 - DNA, 22 bp, Homo sapiens
cataaagtctcataattcactt

SEQ ID NO: 8419869 - DNA, 22 bp, Homo sapiens
cagtgtgaggaattagtgtcca

SEQ ID NO: 8419870 - DNA, 23 bp, Homo sapiens
cagtgtgacgaggtgaggcaggc

SEQ ID NO: 8419871 - DNA, 22 bp, Homo sapiens
caggttggtcggcaagtacaca

SEQ ID NO: 8419872 - DNA, 22 bp, Homo sapiens
caggttgggctgcgaggaggag

SEQ ID NO: 8419873 - DNA, 22 bp, Homo sapiens
caggttgggatcggttgcaatg

SEQ ID NO: 8419874 - DNA, 22 bp, Homo sapiens
cagtagttattagttgccactg

SEQ ID NO: 8419875 - DNA, 22 bp, Homo sapiens
tcacaagactgagcttgcttga

SEQ ID NO: 8419876 - DNA, 22 bp, Homo sapiens
cagtgccaaggagaaggacagc

SEQ ID NO: 8419877 - DNA, 22 bp, Homo sapiens
tcccagaggaaatggcagctga

SEQ ID NO: 8419878 - DNA, 22 bp, Homo sapiens
tcccagaggactgttggtgcta

SEQ ID NO: 8419879 - DNA, 22 bp, Homo sapiens
tcccagagcccaagttggagag

SEQ ID NO: 8419880 - DNA, 22 bp, Homo sapiens
tccccagattcatgtctgctgt

SEQ ID NO: 8419881 - DNA, 22 bp, Homo sapiens
tccccagaggtgaggcagcttt

SEQ ID NO: 8419882 - DNA, 22 bp, Homo sapiens
ccactttctgagggaacagcag

SEQ ID NO: 8419883 - DNA, 22 bp, Homo sapiens
ccaccagagggcagactgtgat

SEQ ID NO: 8419884 - DNA, 17 bp, Homo sapiens
tttggtaatatattaag

SEQ ID NO: 8419885 - DNA, 22 bp, Homo sapiens
tttggaaagttgtcactttaga

SEQ ID NO: 8419886 - DNA, 22 bp, Homo sapiens
tttggaaagtgtgatttcaagg

SEQ ID NO: 8419887 - DNA, 22 bp, Homo sapiens
tttctttgttgttatcacatca

SEQ ID NO: 8419888 - DNA, 22 bp, Homo sapiens
ttgtaaatagtagtaagatgcc

SEQ ID NO: 8419889 - DNA, 22 bp, Homo sapiens
ttggaaaatgtatttctagaag

SEQ ID NO: 8419890 - DNA, 22 bp, Homo sapiens
ttggaaatacgagtagtatcat

SEQ ID NO: 8419891 - DNA, 22 bp, Homo sapiens
ttggaaatacagcagttacttt

SEQ ID NO: 8419892 - DNA, 22 bp, Homo sapiens
tttatcagaagttagagaaaga

SEQ ID NO: 8419893 - DNA, 22 bp, Homo sapiens
tttagagcccatgtgagtgtga

SEQ ID NO: 8419894 - DNA, 22 bp, Homo sapiens
tttagagctgtgctgccacatg

SEQ ID NO: 8419895 - DNA, 22 bp, Homo sapiens
tttagagcagggtgtggcacat

SEQ ID NO: 8419896 - DNA, 20 bp, Homo sapiens
tttattcacagagaagagtt

SEQ ID NO: 8419897 - DNA, 22 bp, Homo sapiens
ttaggaaaatgaaattacctgt

SEQ ID NO: 8419898 - DNA, 22 bp, Homo sapiens
ttaggaaaatggagtcctttta

SEQ ID NO: 8419899 - DNA, 22 bp, Homo sapiens
ttaggaaacagtagcctttgct

SEQ ID NO: 8419900 - DNA, 22 bp, Homo sapiens
ttatacagtttatacttagaat

SEQ ID NO: 8419901 - DNA, 22 bp, Homo sapiens
ttaggaaagtctcttggctggg

SEQ ID NO: 8419902 - DNA, 22 bp, Homo sapiens
ttaggaaacgctgctattgact

SEQ ID NO: 8419903 - DNA, 22 bp, Homo sapiens
ttaggaaagcattgtgtaaaag

SEQ ID NO: 8419904 - DNA, 22 bp, Homo sapiens
ttaggaaaggaacattgaaacg

SEQ ID NO: 8419905 - DNA, 22 bp, Homo sapiens
ttagcgcacatcacagggggaa

SEQ ID NO: 8419906 - DNA, 22 bp, Homo sapiens
ttattacaatgcagaaaataga

SEQ ID NO: 8419907 - DNA, 22 bp, Homo sapiens
ttctttggtgggagattgaggt

SEQ ID NO: 8419908 - DNA, 22 bp, Homo sapiens
ttctggaacatagcaagaagtt

SEQ ID NO: 8419909 - DNA, 23 bp, Homo sapiens
gtaactggggaatttgagctatg

SEQ ID NO: 8419910 - DNA, 22 bp, Homo sapiens
gtaactggttttcttccctctc

SEQ ID NO: 8419911 - DNA, 20 bp, Homo sapiens
gtaactctggctaagtaaat

SEQ ID NO: 8419912 - DNA, 22 bp, Homo sapiens
gtaactctgggtagaactcatg

SEQ ID NO: 8419913 - DNA, 22 bp, Homo sapiens
gtaactctttggaaaacatttt

SEQ ID NO: 8419914 - DNA, 22 bp, Homo sapiens
gtaagatttaaaatagcaattg

SEQ ID NO: 8419915 - DNA, 22 bp, Homo sapiens
gtaacttaccattgtagcatca

SEQ ID NO: 8419916 - DNA, 22 bp, Homo sapiens
cagataaatagacttggtcaga

SEQ ID NO: 8419917 - DNA, 22 bp, Homo sapiens
gtgaattaaatatagccaggtc

SEQ ID NO: 8419918 - DNA, 22 bp, Homo sapiens
cacagcaaagacactctcaact

SEQ ID NO: 8419919 - DNA, 22 bp, Homo sapiens
gaaatgaaacaggcttttaagg

SEQ ID NO: 8419920 - DNA, 22 bp, Homo sapiens
gaaatgaactgattatcattgc

SEQ ID NO: 8419921 - DNA, 22 bp, Homo sapiens
gaaatgaaatagcaccaaggtt

SEQ ID NO: 8419922 - DNA, 22 bp, Homo sapiens
gaaaactgtgattagaatgcct

SEQ ID NO: 8419923 - DNA, 22 bp, Homo sapiens
gaaaacttggatctctagaatg

SEQ ID NO: 8419924 - DNA, 22 bp, Homo sapiens
gactttctgtccagtgatttct

SEQ ID NO: 8419925 - DNA, 21 bp, Homo sapiens
gactttcttaccagatttttg

SEQ ID NO: 8419926 - DNA, 22 bp, Homo sapiens
gactttctgctatactttctgt

SEQ ID NO: 8419927 - DNA, 22 bp, Homo sapiens
gactttctgatgtaaacattta

SEQ ID NO: 8419928 - DNA, 22 bp, Homo sapiens
gactttcttgtagtgtctgatg

SEQ ID NO: 8419929 - DNA, 22 bp, Homo sapiens
gactttcttgcagaaatattcc

SEQ ID NO: 8419930 - DNA, 22 bp, Homo sapiens
gactttcttaggccccctaata

SEQ ID NO: 8419931 - DNA, 22 bp, Homo sapiens
gactttctgagtcaaagaaagg

SEQ ID NO: 8419932 - DNA, 22 bp, Homo sapiens
gactttctaatgctctgtagat

SEQ ID NO: 8419933 - DNA, 22 bp, Homo sapiens
gactttctctcctcccaggtgt

SEQ ID NO: 8419934 - DNA, 22 bp, Homo sapiens
gactttctgaaggtctcgcagt

SEQ ID NO: 8419935 - DNA, 22 bp, Homo sapiens
gagtccagttagtgaggctggg

SEQ ID NO: 8419936 - DNA, 22 bp, Homo sapiens
gagtccaggctgttgctcatct

SEQ ID NO: 8419937 - DNA, 22 bp, Homo sapiens
atgtaactgaaggaaatgcatg

SEQ ID NO: 8419938 - DNA, 22 bp, Homo sapiens
gcactggtatcacctgagagct

SEQ ID NO: 8419939 - DNA, 22 bp, Homo sapiens
gcaaaaaatgcttgttgcttag

SEQ ID NO: 8419940 - DNA, 22 bp, Homo sapiens
gcaactgttttgagcacccagt

SEQ ID NO: 8419941 - DNA, 18 bp, Homo sapiens
gcagatgagtagtgtacc

SEQ ID NO: 8419942 - DNA, 22 bp, Homo sapiens
gcagtgcagtgggacagggcgc

SEQ ID NO: 8419943 - DNA, 22 bp, Homo sapiens
gctaacattgattcagtgcctg

SEQ ID NO: 8419944 - DNA, 22 bp, Homo sapiens
caaatgaaaatggcgtcttgga

SEQ ID NO: 8419945 - DNA, 22 bp, Homo sapiens
caaatgaagagggcaacttctg

SEQ ID NO: 8419946 - DNA, 20 bp, Homo sapiens
caaatgaagctgttggcctc

SEQ ID NO: 8419947 - DNA, 22 bp, Homo sapiens
caaatgaagaaccttctcacct

SEQ ID NO: 8419948 - DNA, 22 bp, Homo sapiens
caaatgaaggtggtgggtcatt

SEQ ID NO: 8419949 - DNA, 22 bp, Homo sapiens
caaatgaagggagctgaagtct

SEQ ID NO: 8419950 - DNA, 22 bp, Homo sapiens
caaatgaagtccaaagggctta

SEQ ID NO: 8419951 - DNA, 22 bp, Homo sapiens
caaatgaatagggagtgtgatg

SEQ ID NO: 8419952 - DNA, 22 bp, Homo sapiens
caaatgaatatttccatgggtt

SEQ ID NO: 8419953 - DNA, 22 bp, Homo sapiens
caaatgaatttccctgcaaatg

SEQ ID NO: 8419954 - DNA, 22 bp, Homo sapiens
gctctgggttctgatttatgag

SEQ ID NO: 8419955 - DNA, 22 bp, Homo sapiens
ccccagagagcaccatgaagcc

SEQ ID NO: 8419956 - DNA, 19 bp, Homo sapiens
agggcctgcagctcaagct

SEQ ID NO: 8419957 - DNA, 23 bp, Homo sapiens
agggcctggcgtggagtgtgtgc

SEQ ID NO: 8419958 - DNA, 22 bp, Homo sapiens
agggcctggaactgtgggcagg

SEQ ID NO: 8419959 - DNA, 22 bp, Homo sapiens
ccagagctccagggctacagaa

SEQ ID NO: 8419960 - DNA, 22 bp, Homo sapiens
ccagagctgagggagcctgagc

SEQ ID NO: 8419961 - DNA, 17 bp, Homo sapiens
ccagagctactgagact

SEQ ID NO: 8419962 - DNA, 23 bp, Homo sapiens
cagtctgcagcccacttgggcag

SEQ ID NO: 8419963 - DNA, 22 bp, Homo sapiens
agctggtatttctgaaggaaag

SEQ ID NO: 8419964 - DNA, 22 bp, Homo sapiens
agctggtaaaggggaaagcaga

SEQ ID NO: 8419965 - DNA, 22 bp, Homo sapiens
agctggtaagtggcagagattc

SEQ ID NO: 8419966 - DNA, 22 bp, Homo sapiens
agctggaagctgatgagcacag

SEQ ID NO: 8419967 - DNA, 22 bp, Homo sapiens
aggaaaaataaggcagcagggc

SEQ ID NO: 8419968 - DNA, 20 bp, Homo sapiens
aggaaaaatggaaactggag

SEQ ID NO: 8419969 - DNA, 20 bp, Homo sapiens
agtgccagggcaggtgagag

SEQ ID NO: 8419970 - DNA, 22 bp, Homo sapiens
agtgtcattccagggaccctcg

SEQ ID NO: 8419971 - DNA, 22 bp, Homo sapiens
agtgtcagcctgggcaaggaac

SEQ ID NO: 8419972 - DNA, 17 bp, Homo sapiens
agtgtcagggcccttcc

SEQ ID NO: 8419973 - DNA, 22 bp, Homo sapiens
agttaacacaagtaagattcca

SEQ ID NO: 8419974 - DNA, 22 bp, Homo sapiens
agttaaagaaagataattcgcc

SEQ ID NO: 8419975 - DNA, 22 bp, Homo sapiens
aggtaaacaggagaaaatgaga

SEQ ID NO: 8419976 - DNA, 22 bp, Homo sapiens
aggtaacactacttagtatact

SEQ ID NO: 8419977 - DNA, 22 bp, Homo sapiens
aggtaaattcagcagtgacatt

SEQ ID NO: 8419978 - DNA, 22 bp, Homo sapiens
aggtaactgtggctaggtaact

SEQ ID NO: 8419979 - DNA, 22 bp, Homo sapiens
ctaggaaagacacagagagttt

SEQ ID NO: 8419980 - DNA, 22 bp, Homo sapiens
atcatacagaacctgagcactt

SEQ ID NO: 8419981 - DNA, 19 bp, Homo sapiens
atcatacatgttacactct

SEQ ID NO: 8419982 - DNA, 22 bp, Homo sapiens
atcatacatgtaactaagtaaa

SEQ ID NO: 8419983 - DNA, 22 bp, Homo sapiens
cttaataataggtgaggctatg

SEQ ID NO: 8419984 - DNA, 22 bp, Homo sapiens
cttaataaatggtagctgttat

SEQ ID NO: 8419985 - DNA, 22 bp, Homo sapiens
atccattattgggccaataaag

SEQ ID NO: 8419986 - DNA, 22 bp, Homo sapiens
ctgtaactctgccaagaaggct

SEQ ID NO: 8419987 - DNA, 22 bp, Homo sapiens
ctgtaacttaatgagaggcaga

SEQ ID NO: 8419988 - DNA, 22 bp, Homo sapiens
ctgtaacttagcatggttacta

SEQ ID NO: 8419989 - DNA, 22 bp, Homo sapiens
atcatacactcacataaacaga

SEQ ID NO: 8419990 - DNA, 22 bp, Homo sapiens
ctgtctagttaggatgccagca

SEQ ID NO: 8419991 - DNA, 22 bp, Homo sapiens
atcagctgctacattggcctct

SEQ ID NO: 8419992 - DNA, 22 bp, Homo sapiens
atatacttccccattatggggg

SEQ ID NO: 8419993 - DNA, 22 bp, Homo sapiens
atatacatgggaatatgtggag

SEQ ID NO: 8419994 - DNA, 22 bp, Homo sapiens
atacacatgttattgtggaagc

SEQ ID NO: 8419995 - DNA, 22 bp, Homo sapiens
atacacattactttctgtctga

SEQ ID NO: 8419996 - DNA, 18 bp, Homo sapiens
ataaagtgctaataatgg

SEQ ID NO: 8419997 - DNA, 22 bp, Homo sapiens
actttaaggaggcactcatctc

SEQ ID NO: 8419998 - DNA, 22 bp, Homo sapiens
actttctgtcatctagacaagt

SEQ ID NO: 8419999 - DNA, 22 bp, Homo sapiens
actacatttctcagtacctgaa

SEQ ID NO: 8420000 - DNA, 22 bp, Homo sapiens
agtcactgtttcagaactgagt

SEQ ID NO: 8420001 - DNA, 22 bp, Homo sapiens
agtagtgaacagccacaggatt

SEQ ID NO: 8420002 - DNA, 22 bp, Homo sapiens
accccagaggcggaggctgcag

SEQ ID NO: 8420003 - DNA, 19 bp, Homo sapiens
agggcctgagcagatgttg

SEQ ID NO: 8420004 - DNA, 22 bp, Homo sapiens
acccagagaactgtgccttgag

SEQ ID NO: 8420005 - DNA, 22 bp, Homo sapiens
agatggctttgcttttagaagc

SEQ ID NO: 8420006 - DNA, 22 bp, Homo sapiens
agatcaatgtgtcagaagagat

SEQ ID NO: 8420007 - DNA, 22 bp, Homo sapiens
attacacagcggttactactag

SEQ ID NO: 8420008 - DNA, 22 bp, Homo sapiens
agagcactttcgagagccggag

SEQ ID NO: 8420009 - DNA, 22 bp, Homo sapiens
agagcagaggcatggccgtggg

SEQ ID NO: 8420010 - DNA, 22 bp, Homo sapiens
agagcagatggagctggaagag

SEQ ID NO: 8420011 - DNA, 22 bp, Homo sapiens
agagccagttgttaagcactta

SEQ ID NO: 8420012 - DNA, 21 bp, Homo sapiens
agactgtggattttgacatgt

SEQ ID NO: 8420013 - DNA, 22 bp, Homo sapiens
agcactgtgagcaccagcacgc

SEQ ID NO: 8420014 - DNA, 22 bp, Homo sapiens
agcactgtggggaactcacaga

SEQ ID NO: 8420015 - DNA, 21 bp, Homo sapiens
agcagctgggcaacatggagg

SEQ ID NO: 8420016 - DNA, 22 bp, Homo sapiens
agcagctggaacatatgaagaa

SEQ ID NO: 8420017 - DNA, 22 bp, Homo sapiens
cacagaacatccttagctcatg

SEQ ID NO: 8420018 - DNA, 22 bp, Homo sapiens
caatacactaaacttctctgaa

SEQ ID NO: 8420019 - DNA, 22 bp, Homo sapiens
cactggtgagtccagaagtcat

SEQ ID NO: 8420020 - DNA, 22 bp, Homo sapiens
caccagagttgtccaaatgatt

SEQ ID NO: 8420021 - DNA, 22 bp, Homo sapiens
cacagcaatagctaactgatac

SEQ ID NO: 8420022 - DNA, 22 bp, Homo sapiens
agccctggcagagccaggtagt

SEQ ID NO: 8420023 - DNA, 22 bp, Homo sapiens
cagagacatccatgttagttgg

SEQ ID NO: 8420024 - DNA, 22 bp, Homo sapiens
cactttctgtgttgtgcaaaaa

SEQ ID NO: 8420025 - DNA, 22 bp, Homo sapiens
cactttctcatgaatttggccc

SEQ ID NO: 8420026 - DNA, 22 bp, Homo sapiens
cagcaactgtgcctgacacaca

SEQ ID NO: 8420027 - DNA, 22 bp, Homo sapiens
cagcaagaaaattcacatgctc

SEQ ID NO: 8420028 - DNA, 22 bp, Homo sapiens
cagcaagaacagcctgatgtgc

SEQ ID NO: 8420029 - DNA, 22 bp, Homo sapiens
agctaagaacttgagctctgga

SEQ ID NO: 8420030 - DNA, 22 bp, Homo sapiens
agctaagacttagtgacttagt

SEQ ID NO: 8420031 - DNA, 22 bp, Homo sapiens
agctccaggataagacaggtgc

SEQ ID NO: 8420032 - DNA, 22 bp, Homo sapiens
aagcactgagcacagtggctga

SEQ ID NO: 8420033 - DNA, 22 bp, Homo sapiens
aagcagcagcaggattaaagag

SEQ ID NO: 8420034 - DNA, 22 bp, Homo sapiens
aactttctttgcatctaagttt

SEQ ID NO: 8420035 - DNA, 22 bp, Homo sapiens
aactttctttcacagaagtatc

SEQ ID NO: 8420036 - DNA, 22 bp, Homo sapiens
aagaagttggaaatgattgaga

SEQ ID NO: 8420037 - DNA, 22 bp, Homo sapiens
aagacactgatactctgtgatt

SEQ ID NO: 8420038 - DNA, 22 bp, Homo sapiens
aacaactgaaaagctttttctg

SEQ ID NO: 8420039 - DNA, 21 bp, Homo sapiens
aaaaatgaagttgttcaggaa

SEQ ID NO: 8420040 - DNA, 22 bp, Homo sapiens
aaaaactgtaattacttttgca

SEQ ID NO: 8420041 - DNA, 22 bp, Homo sapiens
aaaaactggtaactattcccca

SEQ ID NO: 8420042 - DNA, 22 bp, Homo sapiens
aaaaatgtcattatggaactga

SEQ ID NO: 8420043 - DNA, 22 bp, Homo sapiens
aaactggtattcaaatgtttgg

SEQ ID NO: 8420044 - DNA, 22 bp, Homo sapiens
aaactggtttctgagatggaac

SEQ ID NO: 8420045 - DNA, 22 bp, Homo sapiens
aaactggtgtcactgagggctg

SEQ ID NO: 8420046 - DNA, 22 bp, Homo sapiens
aaatcatggtggaagaaacaga

SEQ ID NO: 8420047 - DNA, 22 bp, Homo sapiens
aaatgcctctgggttattctag

SEQ ID NO: 8420048 - DNA, 22 bp, Homo sapiens
aactatacatatttacatagac

SEQ ID NO: 8420049 - DNA, 22 bp, Homo sapiens
aaattaactatcacttttgtga

SEQ ID NO: 8420050 - DNA, 22 bp, Homo sapiens
aaattataggtgccaccttgga

SEQ ID NO: 8420051 - DNA, 22 bp, Homo sapiens
aagagtaaagcaaagcacttgt

SEQ ID NO: 8420052 - DNA, 22 bp, Homo sapiens
aagagttagctcaataacttga

SEQ ID NO: 8420053 - DNA, 22 bp, Homo sapiens
aagagttatacctatttctaac

SEQ ID NO: 8420054 - DNA, 22 bp, Homo sapiens
acagagcttaggatgactccca

SEQ ID NO: 8420055 - DNA, 22 bp, Homo sapiens
acagagctgtactacttactga

SEQ ID NO: 8420056 - DNA, 22 bp, Homo sapiens
aagatactgatgatgtaggcta

SEQ ID NO: 8420057 - DNA, 22 bp, Homo sapiens
aactttctaattttggctgagc

SEQ ID NO: 8420058 - DNA, 22 bp, Homo sapiens
aactttctataggttgggattt

SEQ ID NO: 8420059 - DNA, 22 bp, Homo sapiens
aactttctccagtgccaactat

SEQ ID NO: 8420060 - DNA, 20 bp, Homo sapiens
aactttctcccattggactg

SEQ ID NO: 8420061 - DNA, 22 bp, Homo sapiens
aactttctgaaaagcttgatca

SEQ ID NO: 8420062 - DNA, 22 bp, Homo sapiens
aactttctggctttggggagag

SEQ ID NO: 8420063 - DNA, 22 bp, Homo sapiens
agatatatttaaggtaataagt

SEQ ID NO: 8420064 - DNA, 22 bp, Homo sapiens
agatatatttcctgcccaaggc

SEQ ID NO: 8420065 - DNA, 22 bp, Homo sapiens
aattcactgaacttctctgaga

SEQ ID NO: 8420066 - DNA, 21 bp, Homo sapiens
agagaaagtcatggctgtggc

SEQ ID NO: 8420067 - DNA, 23 bp, Homo sapiens
agacaaaagcctcagtcttaggc

SEQ ID NO: 8420068 - DNA, 22 bp, Homo sapiens
agaatctgaaggcacctctggt

SEQ ID NO: 8420069 - DNA, 22 bp, Homo sapiens
agccctgggttagggtgggagc

SEQ ID NO: 8420070 - DNA, 22 bp, Homo sapiens
acagaactgcaggaggaaaagc

SEQ ID NO: 8420071 - DNA, 22 bp, Homo sapiens
acagaactggaattggaactca

SEQ ID NO: 8420072 - DNA, 21 bp, Homo sapiens
acagaactgtatagtgataaa

SEQ ID NO: 8420073 - DNA, 20 bp, Homo sapiens
acacactttgatcttgagcc

SEQ ID NO: 8420074 - DNA, 22 bp, Homo sapiens
agcagttactagttaaatgcat

SEQ ID NO: 8420075 - DNA, 17 bp, Homo sapiens
agcagctgaagcagcca

SEQ ID NO: 8420076 - DNA, 21 bp, Homo sapiens
acattataattcatattccac

SEQ ID NO: 8420077 - DNA, 22 bp, Homo sapiens
acatgtaaaaattaaggtaaga

SEQ ID NO: 8420078 - DNA, 18 bp, Homo sapiens
acatacattctgtctgca

SEQ ID NO: 8420079 - DNA, 21 bp, Homo sapiens
acataactgtcaagtaacgtt

SEQ ID NO: 8420080 - DNA, 22 bp, Homo sapiens
agaaaactgggaggagagcttc

SEQ ID NO: 8420081 - DNA, 22 bp, Homo sapiens
aatcttacaccgaatttaaact

SEQ ID NO: 8420082 - DNA, 22 bp, Homo sapiens
aatctatatgcttttcacatac

SEQ ID NO: 8420083 - DNA, 22 bp, Homo sapiens
actgtggccaaagcctctggga

SEQ ID NO: 8420084 - DNA, 22 bp, Homo sapiens
aatactggctgtcaaagatgga

SEQ ID NO: 8420085 - DNA, 22 bp, Homo sapiens
aagtgacctcatggtttctcct

SEQ ID NO: 8420086 - DNA, 22 bp, Homo sapiens
aagtgagttcagcattcactcg

SEQ ID NO: 8420087 - DNA, 22 bp, Homo sapiens
actgactttggaatatttctag

SEQ ID NO: 8420088 - DNA, 22 bp, Homo sapiens
tcaattatttgatatgaaaggg

SEQ ID NO: 8420089 - DNA, 22 bp, Homo sapiens
tcatgttatcttggctctggga

SEQ ID NO: 8420090 - DNA, 22 bp, Homo sapiens
tacactaatagccacactaatg

SEQ ID NO: 8420091 - DNA, 22 bp, Homo sapiens
tactgggtatacaaagatgaat

SEQ ID NO: 8420092 - DNA, 22 bp, Homo sapiens
tacatacagagatgctagttaa

SEQ ID NO: 8420093 - DNA, 22 bp, Homo sapiens
taaacagctactgtgtcaaagg

SEQ ID NO: 8420094 - DNA, 17 bp, Homo sapiens
taaatacacaagggtat

SEQ ID NO: 8420095 - DNA, 22 bp, Homo sapiens
taactgtaatataaatatgagt

SEQ ID NO: 8420096 - DNA, 22 bp, Homo sapiens
taactggtttggctcagggtct

SEQ ID NO: 8420097 - DNA, 18 bp, Homo sapiens
taactggtttcttcccat

SEQ ID NO: 8420098 - DNA, 22 bp, Homo sapiens
taactggtttcatatcatttcc

SEQ ID NO: 8420099 - DNA, 22 bp, Homo sapiens
taactggttaagggtgaaatcc

SEQ ID NO: 8420100 - DNA, 19 bp, Homo sapiens
taactggttaaaaagcttg

SEQ ID NO: 8420101 - DNA, 22 bp, Homo sapiens
taactggtcctcggatgttgtg

SEQ ID NO: 8420102 - DNA, 22 bp, Homo sapiens
taactggtatatcagtgtacac

SEQ ID NO: 8420103 - DNA, 22 bp, Homo sapiens
taactggtagattttaaatcgg

SEQ ID NO: 8420104 - DNA, 19 bp, Homo sapiens
taactggtgccttcagtca

SEQ ID NO: 8420105 - DNA, 22 bp, Homo sapiens
taactggtgagttggttgagtg

SEQ ID NO: 8420106 - DNA, 22 bp, Homo sapiens
taactggtgagtaggatttata

SEQ ID NO: 8420107 - DNA, 22 bp, Homo sapiens
taactggtcctgaacagcccag

SEQ ID NO: 8420108 - DNA, 22 bp, Homo sapiens
taacaaactggaaattgacatt

SEQ ID NO: 8420109 - DNA, 22 bp, Homo sapiens
taaatacttagttttgtgtcta

SEQ ID NO: 8420110 - DNA, 22 bp, Homo sapiens
taaatactgagttggagttggc

SEQ ID NO: 8420111 - DNA, 22 bp, Homo sapiens
taactgtagttataaagctatc

SEQ ID NO: 8420112 - DNA, 22 bp, Homo sapiens
taactgtagctaaccgatgaga

SEQ ID NO: 8420113 - DNA, 22 bp, Homo sapiens
taactgtacaactggttagtca

SEQ ID NO: 8420114 - DNA, 22 bp, Homo sapiens
taactgtacctagataacgaac

SEQ ID NO: 8420115 - DNA, 22 bp, Homo sapiens
taactgtatagcttggactaaa

SEQ ID NO: 8420116 - DNA, 22 bp, Homo sapiens
taactgtatattaaggtggccc

SEQ ID NO: 8420117 - DNA, 22 bp, Homo sapiens
taactgtatttttctgagattc

SEQ ID NO: 8420118 - DNA, 22 bp, Homo sapiens
taagaaatttagttatagaatg

SEQ ID NO: 8420119 - DNA, 22 bp, Homo sapiens
taagatgaggtaggtaagactt

SEQ ID NO: 8420120 - DNA, 22 bp, Homo sapiens
taagatgatcaccaaatgctgg

SEQ ID NO: 8420121 - DNA, 22 bp, Homo sapiens
taagatgaccttataaagagca

SEQ ID NO: 8420122 - DNA, 20 bp, Homo sapiens
taagatgagctataagaagt

SEQ ID NO: 8420123 - DNA, 22 bp, Homo sapiens
taagatgactacttaccactga

SEQ ID NO: 8420124 - DNA, 22 bp, Homo sapiens
gttaggaatttgttactgtgta

SEQ ID NO: 8420125 - DNA, 22 bp, Homo sapiens
gttagagcacatactttgcatg

SEQ ID NO: 8420126 - DNA, 17 bp, Homo sapiens
tagattaaacacggcca

SEQ ID NO: 8420127 - DNA, 22 bp, Homo sapiens
tagcaagacaacttttctcagt

SEQ ID NO: 8420128 - DNA, 22 bp, Homo sapiens
tagcaagaccaatatgtagata

SEQ ID NO: 8420129 - DNA, 22 bp, Homo sapiens
tagcaagaggaaacaaggggcc

SEQ ID NO: 8420130 - DNA, 22 bp, Homo sapiens
tagcaaaaactgcagttacttt

SEQ ID NO: 8420131 - DNA, 22 bp, Homo sapiens
tagcaaaagccacgattacttt

SEQ ID NO: 8420132 - DNA, 22 bp, Homo sapiens
tagcaagaagggagatggggtt

SEQ ID NO: 8420133 - DNA, 22 bp, Homo sapiens
tagcaagaagtagctctggatt

SEQ ID NO: 8420134 - DNA, 22 bp, Homo sapiens
tactttctagctctccccagtt

SEQ ID NO: 8420135 - DNA, 22 bp, Homo sapiens
tactttctttctgatccttatg

SEQ ID NO: 8420136 - DNA, 22 bp, Homo sapiens
tactttctttcccaagaggtgg

SEQ ID NO: 8420137 - DNA, 22 bp, Homo sapiens
tactttcttgttcctttcataa

SEQ ID NO: 8420138 - DNA, 22 bp, Homo sapiens
tactttctgtccttctgttaaa

SEQ ID NO: 8420139 - DNA, 22 bp, Homo sapiens
tagaagcagcaggagtaaaggc

SEQ ID NO: 8420140 - DNA, 19 bp, Homo sapiens
tagaagcactaggcaaact

SEQ ID NO: 8420141 - DNA, 23 bp, Homo sapiens
tagagcagtagatcaccatggga

SEQ ID NO: 8420142 - DNA, 22 bp, Homo sapiens
tagagcagtgggtaccatggca

SEQ ID NO: 8420143 - DNA, 23 bp, Homo sapiens
tagagcagggaaatctgtcagag

SEQ ID NO: 8420144 - DNA, 20 bp, Homo sapiens
tagtccagtaggggggcttt

SEQ ID NO: 8420145 - DNA, 22 bp, Homo sapiens
tagtccagccttgggtgtagcc

SEQ ID NO: 8420146 - DNA, 22 bp, Homo sapiens
tagtccaggaaggtggggcaga

SEQ ID NO: 8420147 - DNA, 22 bp, Homo sapiens
tagtccaggacaatcttcatat

SEQ ID NO: 8420148 - DNA, 22 bp, Homo sapiens
tagtccaggttaatccctgcct

SEQ ID NO: 8420149 - DNA, 22 bp, Homo sapiens
taggaaatgctccattgcataa

SEQ ID NO: 8420150 - DNA, 22 bp, Homo sapiens
taggaaatatttgaacatagga

SEQ ID NO: 8420151 - DNA, 22 bp, Homo sapiens
tatagaggccaccaacatgaaa

SEQ ID NO: 8420152 - DNA, 22 bp, Homo sapiens
tagtgtcatcgttgcagctgag

SEQ ID NO: 8420153 - DNA, 22 bp, Homo sapiens
tagtgtcatgaaaagtacacta

SEQ ID NO: 8420154 - DNA, 22 bp, Homo sapiens
tagtgtcatttcagtggagttt

SEQ ID NO: 8420155 - DNA, 19 bp, Homo sapiens
tagtgtcaaggaggagggt

SEQ ID NO: 8420156 - DNA, 22 bp, Homo sapiens
tagtgtcaggagggaaatgcaa

SEQ ID NO: 8420157 - DNA, 23 bp, Homo sapiens
tagtgtcaagagggagtgtaatt

SEQ ID NO: 8420158 - DNA, 22 bp, Homo sapiens
tagtgtcaaacagggattagaa

SEQ ID NO: 8420159 - DNA, 22 bp, Homo sapiens
tatctataagtactaacatggt

SEQ ID NO: 8420160 - DNA, 23 bp, Homo sapiens
ggaccctgtggagggtgagagtc

SEQ ID NO: 8420161 - DNA, 22 bp, Homo sapiens
ggaccctgggctctgggcctat

SEQ ID NO: 8420162 - DNA, 22 bp, Homo sapiens
gcctggctagttagtgtcaggt

SEQ ID NO: 8420163 - DNA, 22 bp, Homo sapiens
gcactgtgctagaagccagggg

SEQ ID NO: 8420164 - DNA, 22 bp, Homo sapiens
gcaagatggttataaaaaatgt

SEQ ID NO: 8420165 - DNA, 22 bp, Homo sapiens
gccagagccggcttcacaggat

SEQ ID NO: 8420166 - DNA, 22 bp, Homo sapiens
gtcacaaaggtgagggacatga

SEQ ID NO: 8420167 - DNA, 22 bp, Homo sapiens
gtagacatctagatttatgtgt

SEQ ID NO: 8420168 - DNA, 22 bp, Homo sapiens
gtagataaggattgatttttat

SEQ ID NO: 8420169 - DNA, 22 bp, Homo sapiens
gtaaatcatggtcagaataaat

SEQ ID NO: 8420170 - DNA, 22 bp, Homo sapiens
gtaatcgtggtggttaattcca

SEQ ID NO: 8420171 - DNA, 22 bp, Homo sapiens
gtaatagaacactcagcatgga

SEQ ID NO: 8420172 - DNA, 22 bp, Homo sapiens
gtaagttatattaaaatttcag

SEQ ID NO: 8420173 - DNA, 21 bp, Homo sapiens
ttaccaatggcttctctttcc

SEQ ID NO: 8420174 - DNA, 22 bp, Homo sapiens
ttacagaactgtcttgaaattt

SEQ ID NO: 8420175 - DNA, 21 bp, Homo sapiens
ttccagaaatctctttcttca

SEQ ID NO: 8420176 - DNA, 22 bp, Homo sapiens
ctaaattatcatgagaattatg

SEQ ID NO: 8420177 - DNA, 22 bp, Homo sapiens
ctaacatttattgagcacttag

SEQ ID NO: 8420178 - DNA, 22 bp, Homo sapiens
ctaaattatttgcacattagag

SEQ ID NO: 8420179 - DNA, 22 bp, Homo sapiens
gagagaaaggcttgcaggctgt

SEQ ID NO: 8420180 - DNA, 22 bp, Homo sapiens
gagaaacttggagttattctgg

SEQ ID NO: 8420181 - DNA, 22 bp, Homo sapiens
gagaaaggcattcctatgcaaa

SEQ ID NO: 8420182 - DNA, 22 bp, Homo sapiens
gacactttattaagctgttgtt

SEQ ID NO: 8420183 - DNA, 22 bp, Homo sapiens
gacactttctcaggtaaagcat

SEQ ID NO: 8420184 - DNA, 22 bp, Homo sapiens
gacactttggtgctttgtggtt

SEQ ID NO: 8420185 - DNA, 22 bp, Homo sapiens
gaatcttaaatcggaatcttaa

SEQ ID NO: 8420186 - DNA, 22 bp, Homo sapiens
gagggctgatgttgccacctca

SEQ ID NO: 8420187 - DNA, 22 bp, Homo sapiens
gagggctgcaatgagacagaga

SEQ ID NO: 8420188 - DNA, 22 bp, Homo sapiens
gagggctgctgccagatatgcc

SEQ ID NO: 8420189 - DNA, 22 bp, Homo sapiens
gagggctgccacgttgggcgag

SEQ ID NO: 8420190 - DNA, 22 bp, Homo sapiens
gagggctgctggaaaaatgcag

SEQ ID NO: 8420191 - DNA, 22 bp, Homo sapiens
gagggctggggcttaggcttag

SEQ ID NO: 8420192 - DNA, 22 bp, Homo sapiens
gagggctgtggggcatgaccag

SEQ ID NO: 8420193 - DNA, 22 bp, Homo sapiens
gagggctgtgaaggagcgggtt

SEQ ID NO: 8420194 - DNA, 22 bp, Homo sapiens
gagcagtgtttgtggacctgga

SEQ ID NO: 8420195 - DNA, 22 bp, Homo sapiens
cttctgaagaggttatcataga

SEQ ID NO: 8420196 - DNA, 22 bp, Homo sapiens
gaaaattattgaaaatggctct

SEQ ID NO: 8420197 - DNA, 22 bp, Homo sapiens
cttctagagctggagcaaatgt

SEQ ID NO: 8420198 - DNA, 22 bp, Homo sapiens
cttctaattcttatgtaagctt

SEQ ID NO: 8420199 - DNA, 22 bp, Homo sapiens
ctggtgagactcagggatgctt

SEQ ID NO: 8420200 - DNA, 19 bp, Homo sapiens
ctgtctgtgcagagatgtg

SEQ ID NO: 8420201 - DNA, 22 bp, Homo sapiens
tgcacttcaaaaatgtcactga

SEQ ID NO: 8420202 - DNA, 21 bp, Homo sapiens
tgcacttcagtggctaaattc

SEQ ID NO: 8420203 - DNA, 22 bp, Homo sapiens
tgcacttcattgtaaattgtac

SEQ ID NO: 8420204 - DNA, 21 bp, Homo sapiens
tggtacagaggaggtgaagtg

SEQ ID NO: 8420205 - DNA, 22 bp, Homo sapiens
tggtagcaacatctcagtggct

SEQ ID NO: 8420206 - DNA, 22 bp, Homo sapiens
tggttacatatcctttggagcc

SEQ ID NO: 8420207 - DNA, 22 bp, Homo sapiens
tggctttaggagctatatacct

SEQ ID NO: 8420208 - DNA, 22 bp, Homo sapiens
tggcttctttgtagaaattgaa

SEQ ID NO: 8420209 - DNA, 22 bp, Homo sapiens
tgctagaatttgcagaagcata

SEQ ID NO: 8420210 - DNA, 22 bp, Homo sapiens
cagtgcaggtggcagaggacag

SEQ ID NO: 8420211 - DNA, 22 bp, Homo sapiens
tagtgtggtaaataaatgtttt

SEQ ID NO: 8420212 - DNA, 22 bp, Homo sapiens
tagtaactggttgaacaactgt

SEQ ID NO: 8420213 - DNA, 22 bp, Homo sapiens
tagtaactctacacacgacact

SEQ ID NO: 8420214 - DNA, 22 bp, Homo sapiens
tagtaatcagaggtaaacttta

SEQ ID NO: 8420215 - DNA, 22 bp, Homo sapiens
tagtacagtggagagcaaagaa

SEQ ID NO: 8420216 - DNA, 22 bp, Homo sapiens
cagggctgaggacacaagtaaa

SEQ ID NO: 8420217 - DNA, 22 bp, Homo sapiens
cagggctgagaatttagagaca

SEQ ID NO: 8420218 - DNA, 22 bp, Homo sapiens
cagggctgagtcatatagcctt

SEQ ID NO: 8420219 - DNA, 22 bp, Homo sapiens
cagggctggatcctccagactc

SEQ ID NO: 8420220 - DNA, 22 bp, Homo sapiens
cagggctgctggccgtgccctc

SEQ ID NO: 8420221 - DNA, 22 bp, Homo sapiens
tacagagaataataggacaggt

SEQ ID NO: 8420222 - DNA, 22 bp, Homo sapiens
tacactttcgtttgtggattag

SEQ ID NO: 8420223 - DNA, 22 bp, Homo sapiens
tagaaagagcatagtattataa

SEQ ID NO: 8420224 - DNA, 22 bp, Homo sapiens
tagaaagactgtccagatttca

SEQ ID NO: 8420225 - DNA, 22 bp, Homo sapiens
tagaaagatctgtaggcaagag

SEQ ID NO: 8420226 - DNA, 22 bp, Homo sapiens
tagaaagagctttgcttccttt

SEQ ID NO: 8420227 - DNA, 22 bp, Homo sapiens
tagaaagacagaggttttgtct

SEQ ID NO: 8420228 - DNA, 22 bp, Homo sapiens
tctagaaattttgccttgtatt

SEQ ID NO: 8420229 - DNA, 22 bp, Homo sapiens
tctagaatgacatgcaagagta

SEQ ID NO: 8420230 - DNA, 22 bp, Homo sapiens
catttattggcatgtagtaggt

SEQ ID NO: 8420231 - DNA, 22 bp, Homo sapiens
ccaaattaaatcatacagacag

SEQ ID NO: 8420232 - DNA, 22 bp, Homo sapiens
catgctttgggtcagaaatgcc

SEQ ID NO: 8420233 - DNA, 22 bp, Homo sapiens
tttacagatgtggaaagtgagc

SEQ ID NO: 8420234 - DNA, 22 bp, Homo sapiens
ttggcttcttgtgaaatctgag

SEQ ID NO: 8420235 - DNA, 22 bp, Homo sapiens
ttggaacaggattcaattaaag

SEQ ID NO: 8420236 - DNA, 20 bp, Homo sapiens
ttccaactcacatctctaca

SEQ ID NO: 8420237 - DNA, 22 bp, Homo sapiens
ttccatctttcagctttgttgg

SEQ ID NO: 8420238 - DNA, 22 bp, Homo sapiens
ttcatacatttttactaacagc

SEQ ID NO: 8420239 - DNA, 20 bp, Homo sapiens
ttcagaaataaggaatgagg

SEQ ID NO: 8420240 - DNA, 22 bp, Homo sapiens
ttcagaaataaaatatcccaac

SEQ ID NO: 8420241 - DNA, 22 bp, Homo sapiens
ttcagaaatcgagtttcatgtc

SEQ ID NO: 8420242 - DNA, 22 bp, Homo sapiens
ttatttatatctctgcagttta

SEQ ID NO: 8420243 - DNA, 22 bp, Homo sapiens
ttatggaaaatacaattataag

SEQ ID NO: 8420244 - DNA, 22 bp, Homo sapiens
ttatacagcattgctagtgatg

SEQ ID NO: 8420245 - DNA, 22 bp, Homo sapiens
ttgagaaatgttttttaagctg

SEQ ID NO: 8420246 - DNA, 22 bp, Homo sapiens
ttctcaaagaaagctgtcatta

SEQ ID NO: 8420247 - DNA, 22 bp, Homo sapiens
ttccttgttgaaaatgtctgca

SEQ ID NO: 8420248 - DNA, 22 bp, Homo sapiens
ttctaaattttggaagatgcag

SEQ ID NO: 8420249 - DNA, 22 bp, Homo sapiens
caaaactgtctagagagagaag

SEQ ID NO: 8420250 - DNA, 22 bp, Homo sapiens
attggaaatgctacaagttaga

SEQ ID NO: 8420251 - DNA, 22 bp, Homo sapiens
attggaaatacagtagaaaaat

SEQ ID NO: 8420252 - DNA, 22 bp, Homo sapiens
attctagataagaaaagggctg

SEQ ID NO: 8420253 - DNA, 22 bp, Homo sapiens
attctagaaggcaaagcaaggg

SEQ ID NO: 8420254 - DNA, 21 bp, Homo sapiens
attctagacaacactgaaatc

SEQ ID NO: 8420255 - DNA, 20 bp, Homo sapiens
attagagctacatggctaca

SEQ ID NO: 8420256 - DNA, 22 bp, Homo sapiens
attagagcagtaattgtggcag

SEQ ID NO: 8420257 - DNA, 22 bp, Homo sapiens
attagagcagtgtattatgata

SEQ ID NO: 8420258 - DNA, 22 bp, Homo sapiens
attagagctgttagtgaagtgc

SEQ ID NO: 8420259 - DNA, 22 bp, Homo sapiens
attaagatcattgtagaagatt

SEQ ID NO: 8420260 - DNA, 22 bp, Homo sapiens
atgagttcccaggtgatttgtg

SEQ ID NO: 8420261 - DNA, 22 bp, Homo sapiens
atctaggtttggaagatagagt

SEQ ID NO: 8420262 - DNA, 22 bp, Homo sapiens
atggtaaccagaagactatgac

SEQ ID NO: 8420263 - DNA, 22 bp, Homo sapiens
atggccatgccagtttacagcc

SEQ ID NO: 8420264 - DNA, 22 bp, Homo sapiens
atggacatttgagttatttcca

SEQ ID NO: 8420265 - DNA, 22 bp, Homo sapiens
gctgtctgactccaagttggag

SEQ ID NO: 8420266 - DNA, 22 bp, Homo sapiens
gcttctgaggaaggctcagcct

SEQ ID NO: 8420267 - DNA, 17 bp, Homo sapiens
ggaaaaggatgatacag

SEQ ID NO: 8420268 - DNA, 22 bp, Homo sapiens
ggaaaagacaggttaactgtga

SEQ ID NO: 8420269 - DNA, 19 bp, Homo sapiens
cacaattatgagacactta

SEQ ID NO: 8420270 - DNA, 22 bp, Homo sapiens
caagatgaaattgtgatatttt

SEQ ID NO: 8420271 - DNA, 22 bp, Homo sapiens
cagacaggagactggatcatgg

SEQ ID NO: 8420272 - DNA, 22 bp, Homo sapiens
cagaagtttgcaattgtttatt

SEQ ID NO: 8420273 - DNA, 22 bp, Homo sapiens
cagaagtttgacatgtttagct

SEQ ID NO: 8420274 - DNA, 22 bp, Homo sapiens
cagaagttgatcctgcgtttcc

SEQ ID NO: 8420275 - DNA, 22 bp, Homo sapiens
cagaagttggagctttccatca

SEQ ID NO: 8420276 - DNA, 22 bp, Homo sapiens
cagaagttcctatttacctcct

SEQ ID NO: 8420277 - DNA, 22 bp, Homo sapiens
cagaagttagacttcaactaat

SEQ ID NO: 8420278 - DNA, 22 bp, Homo sapiens
atatgttactctttcaagcaga

SEQ ID NO: 8420279 - DNA, 22 bp, Homo sapiens
agttgtaagagacagatataaa

SEQ ID NO: 8420280 - DNA, 22 bp, Homo sapiens
ataaaagtaggaccaacttaca

SEQ ID NO: 8420281 - DNA, 22 bp, Homo sapiens
cctggctggactggaccgtggc

SEQ ID NO: 8420282 - DNA, 22 bp, Homo sapiens
cctttattcaattagtcctaat

SEQ ID NO: 8420283 - DNA, 22 bp, Homo sapiens
agtgacagggaaaatgacactg

SEQ ID NO: 8420284 - DNA, 22 bp, Homo sapiens
agtgacagggaaggataggatt

SEQ ID NO: 8420285 - DNA, 21 bp, Homo sapiens
cattaagtaccagggcactgt

SEQ ID NO: 8420286 - DNA, 22 bp, Homo sapiens
agcttgacagacagatggtagc

SEQ ID NO: 8420287 - DNA, 22 bp, Homo sapiens
agaattagtcacaattatagga

SEQ ID NO: 8420288 - DNA, 19 bp, Homo sapiens
atggaaaattgtactcaat

SEQ ID NO: 8420289 - DNA, 22 bp, Homo sapiens
attatacattttgtgtagagat

SEQ ID NO: 8420290 - DNA, 17 bp, Homo sapiens
agcaaaagtatcaaagc

SEQ ID NO: 8420291 - DNA, 22 bp, Homo sapiens
agcaaaagatagattaacaaga

SEQ ID NO: 8420292 - DNA, 22 bp, Homo sapiens
cagcaagaatcagacaacctca

SEQ ID NO: 8420293 - DNA, 19 bp, Homo sapiens
cagcaagaatgaaggcata

SEQ ID NO: 8420294 - DNA, 22 bp, Homo sapiens
cagaactgacctctgattctag

SEQ ID NO: 8420295 - DNA, 22 bp, Homo sapiens
cagaactgggcagggagcagag

SEQ ID NO: 8420296 - DNA, 22 bp, Homo sapiens
cagaactggcctttcatcagtc

SEQ ID NO: 8420297 - DNA, 22 bp, Homo sapiens
cagaactgagtctcatggccat

SEQ ID NO: 8420298 - DNA, 22 bp, Homo sapiens
cagaactgttataacagctgtt

SEQ ID NO: 8420299 - DNA, 22 bp, Homo sapiens
cagaactgggctcgctctggtt

SEQ ID NO: 8420300 - DNA, 22 bp, Homo sapiens
agcacagaggtggaagtgtata

SEQ ID NO: 8420301 - DNA, 22 bp, Homo sapiens
agcactgtggtggaagcatcaa

SEQ ID NO: 8420302 - DNA, 22 bp, Homo sapiens
caaattaatgtgtctcaaaata

SEQ ID NO: 8420303 - DNA, 22 bp, Homo sapiens
caactgccatacagctccatgg

SEQ ID NO: 8420304 - DNA, 19 bp, Homo sapiens
caactgccccctcaaacat

SEQ ID NO: 8420305 - DNA, 22 bp, Homo sapiens
caactggtggtcaaccttctgt

SEQ ID NO: 8420306 - DNA, 22 bp, Homo sapiens
caactggtaatctccacggtca

SEQ ID NO: 8420307 - DNA, 19 bp, Homo sapiens
agcagctgtagatagacac

SEQ ID NO: 8420308 - DNA, 23 bp, Homo sapiens
agcagctgtggtttaccttagta

SEQ ID NO: 8420309 - DNA, 22 bp, Homo sapiens
agcagctgtggggacaagggta

SEQ ID NO: 8420310 - DNA, 22 bp, Homo sapiens
agggctgtgtccctaggggagc

SEQ ID NO: 8420311 - DNA, 22 bp, Homo sapiens
actattagcatatcatgaatgg

SEQ ID NO: 8420312 - DNA, 22 bp, Homo sapiens
actaaagtatctcctatttcat

SEQ ID NO: 8420313 - DNA, 22 bp, Homo sapiens
actgaagtccacacatgtagga

SEQ ID NO: 8420314 - DNA, 22 bp, Homo sapiens
agtctgggagaaggtgagatta

SEQ ID NO: 8420315 - DNA, 22 bp, Homo sapiens
acttccaaataccatcacattg

SEQ ID NO: 8420316 - DNA, 20 bp, Homo sapiens
actgttagtatacttgtgcc

SEQ ID NO: 8420317 - DNA, 22 bp, Homo sapiens
acagtaacacctactctgtccc

SEQ ID NO: 8420318 - DNA, 22 bp, Homo sapiens
acagtaacaaatggcctgagga

SEQ ID NO: 8420319 - DNA, 22 bp, Homo sapiens
acagtaactcttttaccctcct

SEQ ID NO: 8420320 - DNA, 22 bp, Homo sapiens
acagtaacctctcctctgaagg

SEQ ID NO: 8420321 - DNA, 22 bp, Homo sapiens
acagtaattgtgaacttaacgt

SEQ ID NO: 8420322 - DNA, 22 bp, Homo sapiens
acagctaacttaaactaaccta

SEQ ID NO: 8420323 - DNA, 22 bp, Homo sapiens
acagctgcacactgaacttggt

SEQ ID NO: 8420324 - DNA, 22 bp, Homo sapiens
agctgccatctgaagaactgca

SEQ ID NO: 8420325 - DNA, 22 bp, Homo sapiens
aacactttttatatattgtatc

SEQ ID NO: 8420326 - DNA, 22 bp, Homo sapiens
aacactttctattattatggtt

SEQ ID NO: 8420327 - DNA, 22 bp, Homo sapiens
aacactttcttccttgctcagg

SEQ ID NO: 8420328 - DNA, 22 bp, Homo sapiens
aacataaatttgaagtggcaaa

SEQ ID NO: 8420329 - DNA, 22 bp, Homo sapiens
aacatgaaaactacctgtgatt

SEQ ID NO: 8420330 - DNA, 22 bp, Homo sapiens
aacatgaaaacctccacagcaa

SEQ ID NO: 8420331 - DNA, 22 bp, Homo sapiens
aacatgttgagttgaaagtagc

SEQ ID NO: 8420332 - DNA, 22 bp, Homo sapiens
aatgaattgcagtactgacttg

SEQ ID NO: 8420333 - DNA, 22 bp, Homo sapiens
aactagttttagctctagcaac

SEQ ID NO: 8420334 - DNA, 22 bp, Homo sapiens
acacattatctcattaaatact

SEQ ID NO: 8420335 - DNA, 22 bp, Homo sapiens
aagatgactatttatctgtaag

SEQ ID NO: 8420336 - DNA, 22 bp, Homo sapiens
aagatgaccctgagggcaattg

SEQ ID NO: 8420337 - DNA, 22 bp, Homo sapiens
aagcaagagttggagtgatgtt

SEQ ID NO: 8420338 - DNA, 22 bp, Homo sapiens
aagcaagaggaaatgtggacct

SEQ ID NO: 8420339 - DNA, 22 bp, Homo sapiens
aagcaagacagaagttactgcc

SEQ ID NO: 8420340 - DNA, 22 bp, Homo sapiens
acacaaaatcaaagtcctaggc

SEQ ID NO: 8420341 - DNA, 22 bp, Homo sapiens
aattcctagttgtacttagtga

SEQ ID NO: 8420342 - DNA, 22 bp, Homo sapiens
aactggattttgatgagcagtt

SEQ ID NO: 8420343 - DNA, 22 bp, Homo sapiens
aactggatttaggaacagagaa

SEQ ID NO: 8420344 - DNA, 22 bp, Homo sapiens
aactggatcagttgagggaggc

SEQ ID NO: 8420345 - DNA, 22 bp, Homo sapiens
aactggtgagataaattattta

SEQ ID NO: 8420346 - DNA, 22 bp, Homo sapiens
aactttctgttacgtccccaga

SEQ ID NO: 8420347 - DNA, 22 bp, Homo sapiens
aactggtatggtgagaagagag

SEQ ID NO: 8420348 - DNA, 22 bp, Homo sapiens
aactggtatctcttcagtgtaa

SEQ ID NO: 8420349 - DNA, 22 bp, Homo sapiens
aactggtagaaagcagtaagtg

SEQ ID NO: 8420350 - DNA, 22 bp, Homo sapiens
aactggtagctgattaagtata

SEQ ID NO: 8420351 - DNA, 22 bp, Homo sapiens
aaactgccaaaagaccttggat

SEQ ID NO: 8420352 - DNA, 22 bp, Homo sapiens
aaactgccacaagagggacatc

SEQ ID NO: 8420353 - DNA, 22 bp, Homo sapiens
aaactgcctcctgggcaactaa

SEQ ID NO: 8420354 - DNA, 22 bp, Homo sapiens
aaactggtagcaatttaagggt

SEQ ID NO: 8420355 - DNA, 22 bp, Homo sapiens
aaactggtaatcggcaagtgag

SEQ ID NO: 8420356 - DNA, 22 bp, Homo sapiens
aaactggtaataaaatggatta

SEQ ID NO: 8420357 - DNA, 22 bp, Homo sapiens
aaaatactgtggagtgttgaaa

SEQ ID NO: 8420358 - DNA, 22 bp, Homo sapiens
aaacaggcatcactcagcaaag

SEQ ID NO: 8420359 - DNA, 22 bp, Homo sapiens
aaaattaagtgtctgggaagcc

SEQ ID NO: 8420360 - DNA, 22 bp, Homo sapiens
aaaaactgcaattacttttgtc

SEQ ID NO: 8420361 - DNA, 22 bp, Homo sapiens
aaaaatacttcacttctgggtg

SEQ ID NO: 8420362 - DNA, 22 bp, Homo sapiens
aaaacctgattgaattctattt

SEQ ID NO: 8420363 - DNA, 22 bp, Homo sapiens
aaatagtttagctctcatttca

SEQ ID NO: 8420364 - DNA, 22 bp, Homo sapiens
aaagaaatagatggcatttaaa

SEQ ID NO: 8420365 - DNA, 22 bp, Homo sapiens
aaagattaggcggcaactgggc

SEQ ID NO: 8420366 - DNA, 22 bp, Homo sapiens
aaagattaaatcaaattggtca

SEQ ID NO: 8420367 - DNA, 22 bp, Homo sapiens
aacatagagacaggaagtgctt

SEQ ID NO: 8420368 - DNA, 22 bp, Homo sapiens
aacactttcctgcctttctgat

SEQ ID NO: 8420369 - DNA, 22 bp, Homo sapiens
aaagtaacaataaggttctatt

SEQ ID NO: 8420370 - DNA, 22 bp, Homo sapiens
aactgtaatttttacatagtaa

SEQ ID NO: 8420371 - DNA, 22 bp, Homo sapiens
aactgtaagagaataaatgtgt

SEQ ID NO: 8420372 - DNA, 21 bp, Homo sapiens
aaatactgggcagtgacttga

SEQ ID NO: 8420373 - DNA, 22 bp, Homo sapiens
aaatactggcaagtgctaattc

SEQ ID NO: 8420374 - DNA, 22 bp, Homo sapiens
aagattatttaagacaggaacc

SEQ ID NO: 8420375 - DNA, 22 bp, Homo sapiens
aagattatggcagataacaatt

SEQ ID NO: 8420376 - DNA, 22 bp, Homo sapiens
aagcaggatggaggttgagtta

SEQ ID NO: 8420377 - DNA, 22 bp, Homo sapiens
acacagaagatctcttaatgct

SEQ ID NO: 8420378 - DNA, 22 bp, Homo sapiens
agcagctggtaggagtggccac

SEQ ID NO: 8420379 - DNA, 22 bp, Homo sapiens
acactagtatttctataagtga

SEQ ID NO: 8420380 - DNA, 22 bp, Homo sapiens
acagagctaatgttgcataggc

SEQ ID NO: 8420381 - DNA, 22 bp, Homo sapiens
acagagctgggatctgaaccca

SEQ ID NO: 8420382 - DNA, 19 bp, Homo sapiens
acagagctctctgcttctg

SEQ ID NO: 8420383 - DNA, 23 bp, Homo sapiens
acactttcaaatatgcacagagc

SEQ ID NO: 8420384 - DNA, 22 bp, Homo sapiens
acactttctggagctgcacata

SEQ ID NO: 8420385 - DNA, 22 bp, Homo sapiens
agataactcattttgtatatcc

SEQ ID NO: 8420386 - DNA, 22 bp, Homo sapiens
agataagatagtccagcacaat

SEQ ID NO: 8420387 - DNA, 22 bp, Homo sapiens
agaaatgaagcaggagttatta

SEQ ID NO: 8420388 - DNA, 22 bp, Homo sapiens
agaaattcaattctaattagct

SEQ ID NO: 8420389 - DNA, 23 bp, Homo sapiens
actttattgaccccaggtcagtt

SEQ ID NO: 8420390 - DNA, 22 bp, Homo sapiens
actttcttaggctgtataaatg

SEQ ID NO: 8420391 - DNA, 22 bp, Homo sapiens
aataccacctcattctggaggc

SEQ ID NO: 8420392 - DNA, 22 bp, Homo sapiens
actatacagtatgtacgtgcac

SEQ ID NO: 8420393 - DNA, 22 bp, Homo sapiens
actatacaccaaaatattaagg

SEQ ID NO: 8420394 - DNA, 22 bp, Homo sapiens
acggtaacagataccacagact

SEQ ID NO: 8420395 - DNA, 20 bp, Homo sapiens
acctacatgtatagtgaggg

SEQ ID NO: 8420396 - DNA, 22 bp, Homo sapiens
acctacatgttccacatagttg

SEQ ID NO: 8420397 - DNA, 22 bp, Homo sapiens
acctacatcaagggagtggtag

SEQ ID NO: 8420398 - DNA, 22 bp, Homo sapiens
actacactgccctggggatcaa

SEQ ID NO: 8420399 - DNA, 21 bp, Homo sapiens
acattttctgttttaggaagt

SEQ ID NO: 8420400 - DNA, 22 bp, Homo sapiens
aagggctgttatgtttttatac

SEQ ID NO: 8420401 - DNA, 22 bp, Homo sapiens
aagggctgtagtttgttgatca

SEQ ID NO: 8420402 - DNA, 22 bp, Homo sapiens
aagggctgtagacaagattgct

SEQ ID NO: 8420403 - DNA, 19 bp, Homo sapiens
acccagagccctttgcagg

SEQ ID NO: 8420404 - DNA, 22 bp, Homo sapiens
aagggctggtctagaaagggag

SEQ ID NO: 8420405 - DNA, 22 bp, Homo sapiens
aagggctgtaagccaagtaaag

SEQ ID NO: 8420406 - DNA, 22 bp, Homo sapiens
aagggctgggtctggttaaccc

SEQ ID NO: 8420407 - DNA, 22 bp, Homo sapiens
acccagagtcatggcacttagc

SEQ ID NO: 8420408 - DNA, 22 bp, Homo sapiens
acccagaggtgtctagcaagct

SEQ ID NO: 8420409 - DNA, 22 bp, Homo sapiens
acccagagctgggcttggcaaa

SEQ ID NO: 8420410 - DNA, 22 bp, Homo sapiens
acccagaggcggaggttgcagt

SEQ ID NO: 8420411 - DNA, 22 bp, Homo sapiens
gtatatcttcagaaattatagg

SEQ ID NO: 8420412 - DNA, 22 bp, Homo sapiens
gtccatctagaatttatttcta

SEQ ID NO: 8420413 - DNA, 22 bp, Homo sapiens
gtcagctgggcatctgcagatg

SEQ ID NO: 8420414 - DNA, 22 bp, Homo sapiens
gtggcacaaggcttacacagca

SEQ ID NO: 8420415 - DNA, 22 bp, Homo sapiens
gtgacagagctgggatttgaag

SEQ ID NO: 8420416 - DNA, 22 bp, Homo sapiens
taaatacttttactccactgat

SEQ ID NO: 8420417 - DNA, 22 bp, Homo sapiens
taaatgaagaaatggagattgt

SEQ ID NO: 8420418 - DNA, 22 bp, Homo sapiens
taaatgaaagggtttaatttat

SEQ ID NO: 8420419 - DNA, 22 bp, Homo sapiens
taaatgaagctcatgggccaca

SEQ ID NO: 8420420 - DNA, 22 bp, Homo sapiens
taaatactttacaggatgtctc

SEQ ID NO: 8420421 - DNA, 17 bp, Homo sapiens
gtgtaactatgagccat

SEQ ID NO: 8420422 - DNA, 22 bp, Homo sapiens
gtggtcagcagcagtgggagtg

SEQ ID NO: 8420423 - DNA, 22 bp, Homo sapiens
gtggggtagatctttctcagga

SEQ ID NO: 8420424 - DNA, 19 bp, Homo sapiens
gtgtcaggatgtgcagggg

SEQ ID NO: 8420425 - DNA, 22 bp, Homo sapiens
gtgtgcagggatgagtgcaggt

SEQ ID NO: 8420426 - DNA, 22 bp, Homo sapiens
gtgtgcaggggcttggtggagc

SEQ ID NO: 8420427 - DNA, 22 bp, Homo sapiens
gtgtgcaggtgtcagtgcagct

SEQ ID NO: 8420428 - DNA, 22 bp, Homo sapiens
gcttagtccccaagagagacca

SEQ ID NO: 8420429 - DNA, 22 bp, Homo sapiens
ggccttctgcctttcagcaatg

SEQ ID NO: 8420430 - DNA, 22 bp, Homo sapiens
gatacagtatttaaagagcaac

SEQ ID NO: 8420431 - DNA, 23 bp, Homo sapiens
gatacactccctgctgggcactg

SEQ ID NO: 8420432 - DNA, 22 bp, Homo sapiens
gatacactggagcttcctgaca

SEQ ID NO: 8420433 - DNA, 22 bp, Homo sapiens
gatacactggccaagtggagga

SEQ ID NO: 8420434 - DNA, 22 bp, Homo sapiens
gatagataaaactatattttca

SEQ ID NO: 8420435 - DNA, 22 bp, Homo sapiens
gagtgtcagtgcttggggctac

SEQ ID NO: 8420436 - DNA, 22 bp, Homo sapiens
gagtgtcagcagggcagagcac

SEQ ID NO: 8420437 - DNA, 22 bp, Homo sapiens
gagtgtcagtgcctggcttgtt

SEQ ID NO: 8420438 - DNA, 22 bp, Homo sapiens
gagtgtcacttgatgcagggca

SEQ ID NO: 8420439 - DNA, 22 bp, Homo sapiens
gagtgtcaaggctctctttggc

SEQ ID NO: 8420440 - DNA, 22 bp, Homo sapiens
gagtgcagtatgagaggctgct

SEQ ID NO: 8420441 - DNA, 22 bp, Homo sapiens
gaactatatgtcttaaagcttt

SEQ ID NO: 8420442 - DNA, 22 bp, Homo sapiens
gaactggtcagtttagcccact

SEQ ID NO: 8420443 - DNA, 22 bp, Homo sapiens
gaactggtgaagtgaagggcag

SEQ ID NO: 8420444 - DNA, 22 bp, Homo sapiens
gaactggtcttttaggttttct

SEQ ID NO: 8420445 - DNA, 22 bp, Homo sapiens
gaactggttacagagggatgtt

SEQ ID NO: 8420446 - DNA, 22 bp, Homo sapiens
gaactggtgagagttcacggga

SEQ ID NO: 8420447 - DNA, 22 bp, Homo sapiens
gactttatttccttatttgtga

SEQ ID NO: 8420448 - DNA, 22 bp, Homo sapiens
gacttctgttaacttgtaagag

SEQ ID NO: 8420449 - DNA, 22 bp, Homo sapiens
gactggtaaggaaattcactaa

SEQ ID NO: 8420450 - DNA, 22 bp, Homo sapiens
gactggtaaggtattggaattc

SEQ ID NO: 8420451 - DNA, 22 bp, Homo sapiens
gaagttactctcgttaaatatg

SEQ ID NO: 8420452 - DNA, 22 bp, Homo sapiens
gaactgttccctcacaggctgg

SEQ ID NO: 8420453 - DNA, 22 bp, Homo sapiens
gacagctgtgcaggagaagggg

SEQ ID NO: 8420454 - DNA, 22 bp, Homo sapiens
gaatttaagaggatgaatctgt

SEQ ID NO: 8420455 - DNA, 22 bp, Homo sapiens
gaattataggtttgcatgctaa

SEQ ID NO: 8420456 - DNA, 22 bp, Homo sapiens
gaattccttaggctcttgactg

SEQ ID NO: 8420457 - DNA, 22 bp, Homo sapiens
gaattataggcaaagcagtcat

SEQ ID NO: 8420458 - DNA, 22 bp, Homo sapiens
gaattataaactagtgacttca

SEQ ID NO: 8420459 - DNA, 22 bp, Homo sapiens
gattaagtaactgaacactttg

SEQ ID NO: 8420460 - DNA, 22 bp, Homo sapiens
gcacctggctgcccaggtggag

SEQ ID NO: 8420461 - DNA, 22 bp, Homo sapiens
gcactttcagcaggcagacaga

SEQ ID NO: 8420462 - DNA, 22 bp, Homo sapiens
gctgggagtgggcaagatgaga

SEQ ID NO: 8420463 - DNA, 22 bp, Homo sapiens
ttgacttcagcctgtacttgta

SEQ ID NO: 8420464 - DNA, 22 bp, Homo sapiens
ttgacttcccagacttgtgttt

SEQ ID NO: 8420465 - DNA, 22 bp, Homo sapiens
ttcagaaaaaacttcaataagt

SEQ ID NO: 8420466 - DNA, 22 bp, Homo sapiens
ttcagaaacagagtgagtgagt

SEQ ID NO: 8420467 - DNA, 22 bp, Homo sapiens
ctaagaaaatagaagcatgcta

SEQ ID NO: 8420468 - DNA, 22 bp, Homo sapiens
ttccaaagaagttcacatttac

SEQ ID NO: 8420469 - DNA, 22 bp, Homo sapiens
ctaatagagcttcggaactctg

SEQ ID NO: 8420470 - DNA, 22 bp, Homo sapiens
ttggtaaaatcatagtggtaac

SEQ ID NO: 8420471 - DNA, 22 bp, Homo sapiens
ttggtacatgcagatatttagt

SEQ ID NO: 8420472 - DNA, 22 bp, Homo sapiens
ttggaaaagcgttctctgtagc

SEQ ID NO: 8420473 - DNA, 22 bp, Homo sapiens
tgtattaggttgatgcgaaagt

SEQ ID NO: 8420474 - DNA, 20 bp, Homo sapiens
cctggctgcattcaggacgg

SEQ ID NO: 8420475 - DNA, 22 bp, Homo sapiens
cctgggtgacagagtgagacct

SEQ ID NO: 8420476 - DNA, 22 bp, Homo sapiens
cctgggtggcagaggttgcagt

SEQ ID NO: 8420477 - DNA, 22 bp, Homo sapiens
tacagtaaccttatttgtcatt

SEQ ID NO: 8420478 - DNA, 22 bp, Homo sapiens
taacattatacagagaggacag

SEQ ID NO: 8420479 - DNA, 22 bp, Homo sapiens
taacattaggtagacataagcc

SEQ ID NO: 8420480 - DNA, 22 bp, Homo sapiens
taagattatacttaaagagaaa

SEQ ID NO: 8420481 - DNA, 22 bp, Homo sapiens
taagattacagtgagaaataaa

SEQ ID NO: 8420482 - DNA, 22 bp, Homo sapiens
gtgtacagtgatttgagttcac

SEQ ID NO: 8420483 - DNA, 17 bp, Homo sapiens
cagctgtgagagcctta

SEQ ID NO: 8420484 - DNA, 22 bp, Homo sapiens
gttacacagctaagcttctcct

SEQ ID NO: 8420485 - DNA, 22 bp, Homo sapiens
caggaaatggggtttagttatt

SEQ ID NO: 8420486 - DNA, 22 bp, Homo sapiens
ccacagtagaattcatctccct

SEQ ID NO: 8420487 - DNA, 22 bp, Homo sapiens
ccacagtacaggaaatcttgtt

SEQ ID NO: 8420488 - DNA, 22 bp, Homo sapiens
ccagagcttgacgtgcaacgga

SEQ ID NO: 8420489 - DNA, 22 bp, Homo sapiens
ccagagcttcggggcggctgta

SEQ ID NO: 8420490 - DNA, 19 bp, Homo sapiens
ccagagttggcagagcagg

SEQ ID NO: 8420491 - DNA, 22 bp, Homo sapiens
catttagttttgcagtagcagg

SEQ ID NO: 8420492 - DNA, 22 bp, Homo sapiens
catacattacctaacttaatgc

SEQ ID NO: 8420493 - DNA, 22 bp, Homo sapiens
catatattctggttttcactgg

SEQ ID NO: 8420494 - DNA, 22 bp, Homo sapiens
tcaggtggtcctaagtgccatc

SEQ ID NO: 8420495 - DNA, 22 bp, Homo sapiens
tatacagtcttttgctatattc

SEQ ID NO: 8420496 - DNA, 22 bp, Homo sapiens
ttacacttttgacaaacctgag

SEQ ID NO: 8420497 - DNA, 22 bp, Homo sapiens
ttacagcagtgggaaggagtca

SEQ ID NO: 8420498 - DNA, 22 bp, Homo sapiens
ttagataaattgcaacttgatt

SEQ ID NO: 8420499 - DNA, 22 bp, Homo sapiens
ttagaaaggagcttatttcttt

SEQ ID NO: 8420500 - DNA, 22 bp, Homo sapiens
ttagaaagggtgtctgaatctg

SEQ ID NO: 8420501 - DNA, 22 bp, Homo sapiens
ttagaaaggttttgctctgaaa

SEQ ID NO: 8420502 - DNA, 22 bp, Homo sapiens
ttagcagctaaactgacagacc

SEQ ID NO: 8420503 - DNA, 22 bp, Homo sapiens
ttaggaaattccacctgtattc

SEQ ID NO: 8420504 - DNA, 22 bp, Homo sapiens
ttaggtaagtaggatcaaaaaa

SEQ ID NO: 8420505 - DNA, 22 bp, Homo sapiens
ttagtaaataaagtctactttc

SEQ ID NO: 8420506 - DNA, 22 bp, Homo sapiens
ttatgaagttcctgttacagtg

SEQ ID NO: 8420507 - DNA, 22 bp, Homo sapiens
ttattccagtaatctctgtaat

SEQ ID NO: 8420508 - DNA, 22 bp, Homo sapiens
tgtctagaggccaacaggaaag

SEQ ID NO: 8420509 - DNA, 22 bp, Homo sapiens
tgttacagtgactaatgtttta

SEQ ID NO: 8420510 - DNA, 22 bp, Homo sapiens
tgttaagaagaggcagtactta

SEQ ID NO: 8420511 - DNA, 22 bp, Homo sapiens
tgttagcagagcagctgacaga

SEQ ID NO: 8420512 - DNA, 22 bp, Homo sapiens
tggtaactttcagcatggtgac

SEQ ID NO: 8420513 - DNA, 22 bp, Homo sapiens
tggtaacacaggcattaaagtt

SEQ ID NO: 8420514 - DNA, 22 bp, Homo sapiens
tgtcaggttggttttcagagaa

SEQ ID NO: 8420515 - DNA, 22 bp, Homo sapiens
tgtccaggctaaagtgcagtgg

SEQ ID NO: 8420516 - DNA, 22 bp, Homo sapiens
tgtccaggctggagtgcagtgg

SEQ ID NO: 8420517 - DNA, 22 bp, Homo sapiens
tgtagataagtaaaagcccagt

SEQ ID NO: 8420518 - DNA, 22 bp, Homo sapiens
tggtggcatcaattgacttctc

SEQ ID NO: 8420519 - DNA, 22 bp, Homo sapiens
tgctcagtatagaaaatgatat

SEQ ID NO: 8420520 - DNA, 22 bp, Homo sapiens
tggcacatggttaatcataatt

SEQ ID NO: 8420521 - DNA, 22 bp, Homo sapiens
tggccagtagagctcagatagt

SEQ ID NO: 8420522 - DNA, 22 bp, Homo sapiens
tggcttctgggacttgtgagca

SEQ ID NO: 8420523 - DNA, 22 bp, Homo sapiens
tggcttctgtccctgctacatt

SEQ ID NO: 8420524 - DNA, 22 bp, Homo sapiens
tggcttctggtttatccttata

SEQ ID NO: 8420525 - DNA, 22 bp, Homo sapiens
tggcttctgcatatttttagag

SEQ ID NO: 8420526 - DNA, 21 bp, Homo sapiens
tggcttctgccaatgttaaga

SEQ ID NO: 8420527 - DNA, 22 bp, Homo sapiens
tggcttctctgttttagtattt

SEQ ID NO: 8420528 - DNA, 22 bp, Homo sapiens
tggcttctgagcattgaaacgt

SEQ ID NO: 8420529 - DNA, 22 bp, Homo sapiens
tggcttctcgcctgtcatcccg

SEQ ID NO: 8420530 - DNA, 22 bp, Homo sapiens
tggcttctagtttgaggaaaaa

SEQ ID NO: 8420531 - DNA, 22 bp, Homo sapiens
tggcttctagcagtgttgattt

SEQ ID NO: 8420532 - DNA, 18 bp, Homo sapiens
tggcttctattttactca

SEQ ID NO: 8420533 - DNA, 22 bp, Homo sapiens
tggcttctcaaaataactggtt

SEQ ID NO: 8420534 - DNA, 22 bp, Homo sapiens
tggcttctcagaatactctgga

SEQ ID NO: 8420535 - DNA, 22 bp, Homo sapiens
tggcttctcagtttcataatga

SEQ ID NO: 8420536 - DNA, 22 bp, Homo sapiens
tggcttctccagaaatcttggt

SEQ ID NO: 8420537 - DNA, 22 bp, Homo sapiens
tggcttcttgatcttggacttg

SEQ ID NO: 8420538 - DNA, 22 bp, Homo sapiens
tggcttcttgacttcttggctg

SEQ ID NO: 8420539 - DNA, 22 bp, Homo sapiens
tggcttcttcatatgtgatctt

SEQ ID NO: 8420540 - DNA, 22 bp, Homo sapiens
tggcttcttgtctaatttgtta

SEQ ID NO: 8420541 - DNA, 18 bp, Homo sapiens
tgaactggcatcagaatc

SEQ ID NO: 8420542 - DNA, 22 bp, Homo sapiens
tgaaaaaacaagttggcccatt

SEQ ID NO: 8420543 - DNA, 22 bp, Homo sapiens
tgacagaaatagttcttaattt

SEQ ID NO: 8420544 - DNA, 22 bp, Homo sapiens
tgacagaaagaatatgtcaatc

SEQ ID NO: 8420545 - DNA, 22 bp, Homo sapiens
tgacaggttcgttagtcatgtt

SEQ ID NO: 8420546 - DNA, 22 bp, Homo sapiens
tgacaggtgctgggggcagtgt

SEQ ID NO: 8420547 - DNA, 22 bp, Homo sapiens
tgacagtattgatggcaggatt

SEQ ID NO: 8420548 - DNA, 20 bp, Homo sapiens
tgacttctgggatttgtggt

SEQ ID NO: 8420549 - DNA, 20 bp, Homo sapiens
tgacttcttcatgctgtact

SEQ ID NO: 8420550 - DNA, 22 bp, Homo sapiens
tgacattattatcatgtcacca

SEQ ID NO: 8420551 - DNA, 22 bp, Homo sapiens
tgaatagactggggctgtgaag

SEQ ID NO: 8420552 - DNA, 22 bp, Homo sapiens
tgaattagcagtagacagactg

SEQ ID NO: 8420553 - DNA, 22 bp, Homo sapiens
tgcaggtgtctccagggcaggt

SEQ ID NO: 8420554 - DNA, 23 bp, Homo sapiens
tctagaaaatgaaagaatgcagt

SEQ ID NO: 8420555 - DNA, 22 bp, Homo sapiens
tctataaagggccagatagtag

SEQ ID NO: 8420556 - DNA, 22 bp, Homo sapiens
tctgggtatgacctatttttcc

SEQ ID NO: 8420557 - DNA, 22 bp, Homo sapiens
tcttagtcacagaggtgagaaa

SEQ ID NO: 8420558 - DNA, 22 bp, Homo sapiens
tctttccagaggaatttttaga

SEQ ID NO: 8420559 - DNA, 22 bp, Homo sapiens
tctttccaaggactctgtagca

SEQ ID NO: 8420560 - DNA, 22 bp, Homo sapiens
tctttattgctactggtttgtc

SEQ ID NO: 8420561 - DNA, 22 bp, Homo sapiens
tcttctagtaggccaagaagct

SEQ ID NO: 8420562 - DNA, 22 bp, Homo sapiens
tctgggagttagaatacatggg

SEQ ID NO: 8420563 - DNA, 22 bp, Homo sapiens
tctggagaggaggatgtggaca

SEQ ID NO: 8420564 - DNA, 22 bp, Homo sapiens
tctggagaggggcctagaattt

SEQ ID NO: 8420565 - DNA, 22 bp, Homo sapiens
tctggagaagcccagggagctg

SEQ ID NO: 8420566 - DNA, 22 bp, Homo sapiens
tctggagaagcagtgagagtca

SEQ ID NO: 8420567 - DNA, 22 bp, Homo sapiens
tctgagcttctgcatttccaac

SEQ ID NO: 8420568 - DNA, 21 bp, Homo sapiens
tctgacttgatctattctccc

SEQ ID NO: 8420569 - DNA, 22 bp, Homo sapiens
acccagaggcggaggttgcagt

SEQ ID NO: 8420570 - DNA, 22 bp, Homo sapiens
acccagaggcggaggttgcagt

SEQ ID NO: 8420571 - DNA, 22 bp, Homo sapiens
acccagagctgggcttggcaaa

SEQ ID NO: 8420572 - DNA, 22 bp, Homo sapiens
acccagagctgggcttggcaaa

SEQ ID NO: 8420573 - DNA, 22 bp, Homo sapiens
acccagaggtgtctagcaagct

SEQ ID NO: 8420574 - DNA, 22 bp, Homo sapiens
acccagaggtgtctagcaagct

SEQ ID NO: 8420575 - DNA, 22 bp, Homo sapiens
acccagaggtgtctagcaagct

SEQ ID NO: 8420576 - DNA, 22 bp, Homo sapiens
acccagagtcatggcacttagc

SEQ ID NO: 8420577 - DNA, 22 bp, Homo sapiens
acccagagtcatggcacttagc

SEQ ID NO: 8420578 - DNA, 22 bp, Homo sapiens
acccagagtcagacagccatgg

SEQ ID NO: 8420579 - DNA, 22 bp, Homo sapiens
acccagagtaacagatggattc

SEQ ID NO: 8420580 - DNA, 22 bp, Homo sapiens
acccagagtgtctgtctcagtc

SEQ ID NO: 8420581 - DNA, 22 bp, Homo sapiens
acccaggaggtggaggctgcag

SEQ ID NO: 8420582 - DNA, 22 bp, Homo sapiens
accctgagaaagtcacatgcat

SEQ ID NO: 8420583 - DNA, 22 bp, Homo sapiens
acccaggatgataatgttcaca

SEQ ID NO: 8420584 - DNA, 22 bp, Homo sapiens
accctgccctctccagctcagg

SEQ ID NO: 8420585 - DNA, 22 bp, Homo sapiens
accctgccaaggatggccccga

SEQ ID NO: 8420586 - DNA, 22 bp, Homo sapiens
accctgagtcagacagcctgac

SEQ ID NO: 8420587 - DNA, 22 bp, Homo sapiens
accctgaggggtatagcagaag

SEQ ID NO: 8420588 - DNA, 22 bp, Homo sapiens
aagggctgggtctggttaaccc

SEQ ID NO: 8420589 - DNA, 22 bp, Homo sapiens
aagggctgtaagccaagtaaag

SEQ ID NO: 8420590 - DNA, 22 bp, Homo sapiens
aagggctggtctagaaagggag

SEQ ID NO: 8420591 - DNA, 22 bp, Homo sapiens
aagggctggtctagaaagggag

SEQ ID NO: 8420592 - DNA, 22 bp, Homo sapiens
accaggcttgatgatttgctta

SEQ ID NO: 8420593 - DNA, 21 bp, Homo sapiens
accaggcttgtgggagggagc

SEQ ID NO: 8420594 - DNA, 19 bp, Homo sapiens
acccagagccctttgcagg

SEQ ID NO: 8420595 - DNA, 19 bp, Homo sapiens
acccagagccctttgcagg

SEQ ID NO: 8420596 - DNA, 22 bp, Homo sapiens
acccagagcccttagcacagac

SEQ ID NO: 8420597 - DNA, 22 bp, Homo sapiens
acccagagcccttagcacagac

SEQ ID NO: 8420598 - DNA, 22 bp, Homo sapiens
aagggctgtagacaagattgct

SEQ ID NO: 8420599 - DNA, 22 bp, Homo sapiens
aagggctgtagtttgttgatca

SEQ ID NO: 8420600 - DNA, 22 bp, Homo sapiens
aagggctgttatgtttttatac

SEQ ID NO: 8420601 - DNA, 21 bp, Homo sapiens
acattttctgttttaggaagt

SEQ ID NO: 8420602 - DNA, 22 bp, Homo sapiens
acattttacagttgtctggcta

SEQ ID NO: 8420603 - DNA, 22 bp, Homo sapiens
acattttacagttgtctggcta

SEQ ID NO: 8420604 - DNA, 22 bp, Homo sapiens
acattttacaccaagacttctt

SEQ ID NO: 8420605 - DNA, 22 bp, Homo sapiens
acattttaatatgcttagtgtg

SEQ ID NO: 8420606 - DNA, 22 bp, Homo sapiens
acattttacaccaagacttctt

SEQ ID NO: 8420607 - DNA, 22 bp, Homo sapiens
acattttaatatgcttagtgtg

SEQ ID NO: 8420608 - DNA, 22 bp, Homo sapiens
accaggcttaatcctttgctat

SEQ ID NO: 8420609 - DNA, 19 bp, Homo sapiens
accaggcttatggtcagtg

SEQ ID NO: 8420610 - DNA, 19 bp, Homo sapiens
accaggcttatggtcagtg

SEQ ID NO: 8420611 - DNA, 22 bp, Homo sapiens
accaggcttgataccaagaaat

SEQ ID NO: 8420612 - DNA, 22 bp, Homo sapiens
aaggccttgccgaaggatgcca

SEQ ID NO: 8420613 - DNA, 22 bp, Homo sapiens
aaggccttggttctgagcaata

SEQ ID NO: 8420614 - DNA, 22 bp, Homo sapiens
aaggcctgctcagctgtctgtg

SEQ ID NO: 8420615 - DNA, 22 bp, Homo sapiens
aaggcctgggaggcctctcttc

SEQ ID NO: 8420616 - DNA, 22 bp, Homo sapiens
aaggcctccgccaatggcagag

SEQ ID NO: 8420617 - DNA, 22 bp, Homo sapiens
aaggccaggggctggcgcctcc

SEQ ID NO: 8420618 - DNA, 22 bp, Homo sapiens
aaggccagggatgccagctcgg

SEQ ID NO: 8420619 - DNA, 22 bp, Homo sapiens
aaggccagggatgccagctcgg

SEQ ID NO: 8420620 - DNA, 20 bp, Homo sapiens
aaggcagagtgggttggagc

SEQ ID NO: 8420621 - DNA, 22 bp, Homo sapiens
aaggctccgtgactggggctga

SEQ ID NO: 8420622 - DNA, 21 bp, Homo sapiens
aaggctcctcctctaggcctc

SEQ ID NO: 8420623 - DNA, 22 bp, Homo sapiens
aaggctcctttgtagttctttt

SEQ ID NO: 8420624 - DNA, 22 bp, Homo sapiens
acattcttcttgtgaatttact

SEQ ID NO: 8420625 - DNA, 22 bp, Homo sapiens
aaggctctgggtttcataggtg

SEQ ID NO: 8420626 - DNA, 22 bp, Homo sapiens
aaggctccctcttctcgagtgt

SEQ ID NO: 8420627 - DNA, 22 bp, Homo sapiens
aaggctccagtgaatgctggca

SEQ ID NO: 8420628 - DNA, 22 bp, Homo sapiens
aaggctccaccctcatggatgc

SEQ ID NO: 8420629 - DNA, 22 bp, Homo sapiens
aaggcctttgccccgatacagg

SEQ ID NO: 8420630 - DNA, 22 bp, Homo sapiens
aaggctatatctcaatactatt

SEQ ID NO: 8420631 - DNA, 22 bp, Homo sapiens
aaggctagagaggtattcaagt

SEQ ID NO: 8420632 - DNA, 22 bp, Homo sapiens
acatttctggagtttctcaaca

SEQ ID NO: 8420633 - DNA, 22 bp, Homo sapiens
acatttctggagtttctcaaca

SEQ ID NO: 8420634 - DNA, 22 bp, Homo sapiens
acatttcttcctaattatccct

SEQ ID NO: 8420635 - DNA, 22 bp, Homo sapiens
acatttctcttgatgtctctat

SEQ ID NO: 8420636 - DNA, 22 bp, Homo sapiens
acatttctgcatctcagagcta

SEQ ID NO: 8420637 - DNA, 22 bp, Homo sapiens
aaggctggagatggttggaatg

SEQ ID NO: 8420638 - DNA, 22 bp, Homo sapiens
aaggctggcaatatatttgtta

SEQ ID NO: 8420639 - DNA, 22 bp, Homo sapiens
aaggctgggaaacatgcaggcc

SEQ ID NO: 8420640 - DNA, 19 bp, Homo sapiens
acatttaaattcagatctc

SEQ ID NO: 8420641 - DNA, 22 bp, Homo sapiens
aaggctggacctggatgaatct

SEQ ID NO: 8420642 - DNA, 19 bp, Homo sapiens
aaggctggagaaggcctct

SEQ ID NO: 8420643 - DNA, 21 bp, Homo sapiens
aaggctggagatgcaggtctg

SEQ ID NO: 8420644 - DNA, 22 bp, Homo sapiens
acatttaaatatgccttatatt

SEQ ID NO: 8420645 - DNA, 22 bp, Homo sapiens
acatttaaatatgccttatatt

SEQ ID NO: 8420646 - DNA, 22 bp, Homo sapiens
acatttaaatacctatgtttct

SEQ ID NO: 8420647 - DNA, 22 bp, Homo sapiens
aagccctgggatgttcagcagt

SEQ ID NO: 8420648 - DNA, 22 bp, Homo sapiens
aagccttccctttttgagctca

SEQ ID NO: 8420649 - DNA, 22 bp, Homo sapiens
aagccttcctgagtgcaaggcc

SEQ ID NO: 8420650 - DNA, 22 bp, Homo sapiens
aagccttccctttttgagctca

SEQ ID NO: 8420651 - DNA, 22 bp, Homo sapiens
aagccctggggttgcacaaggc

SEQ ID NO: 8420652 - DNA, 22 bp, Homo sapiens
aagccttgctcttgaaaaagtt

SEQ ID NO: 8420653 - DNA, 22 bp, Homo sapiens
aagccctgggatgttcagcagt

SEQ ID NO: 8420654 - DNA, 22 bp, Homo sapiens
aagccaaggttttggtcacagc

SEQ ID NO: 8420655 - DNA, 22 bp, Homo sapiens
aagccctggctcagctcaccag

SEQ ID NO: 8420656 - DNA, 22 bp, Homo sapiens
aagccaaggcctgtctggggct

SEQ ID NO: 8420657 - DNA, 22 bp, Homo sapiens
aagcatttttcacagcaacagc

SEQ ID NO: 8420658 - DNA, 22 bp, Homo sapiens
aagccaaaggctccagtgacct

SEQ ID NO: 8420659 - DNA, 22 bp, Homo sapiens
aagccaaggagaatggcctcag

SEQ ID NO: 8420660 - DNA, 22 bp, Homo sapiens
aagcgccatggttcctgcgcag

SEQ ID NO: 8420661 - DNA, 22 bp, Homo sapiens
aagcgccatggttcctgcgcag

SEQ ID NO: 8420662 - DNA, 22 bp, Homo sapiens
aagctacaatgtgtttttgaaa

SEQ ID NO: 8420663 - DNA, 22 bp, Homo sapiens
aagctacaatgtgtttttgaaa

SEQ ID NO: 8420664 - DNA, 22 bp, Homo sapiens
aagctacattaagcagatttac

SEQ ID NO: 8420665 - DNA, 22 bp, Homo sapiens
aagctacattaagcagatttac

SEQ ID NO: 8420666 - DNA, 22 bp, Homo sapiens
aagctacagtttacccatggtt

SEQ ID NO: 8420667 - DNA, 21 bp, Homo sapiens
aagctacagaaaataatttga

SEQ ID NO: 8420668 - DNA, 19 bp, Homo sapiens
aagctacagcccaggtctg

SEQ ID NO: 8420669 - DNA, 22 bp, Homo sapiens
aagcattttgttttaagaatga

SEQ ID NO: 8420670 - DNA, 22 bp, Homo sapiens
aagcattttagtaatgaacttg

SEQ ID NO: 8420671 - DNA, 22 bp, Homo sapiens
aagcattttagataaagcatca

SEQ ID NO: 8420672 - DNA, 22 bp, Homo sapiens
aagcattttagataaagcatca

SEQ ID NO: 8420673 - DNA, 22 bp, Homo sapiens
acagccttattctttagtttac

SEQ ID NO: 8420674 - DNA, 22 bp, Homo sapiens
aagcattttagataaagcatca

SEQ ID NO: 8420675 - DNA, 22 bp, Homo sapiens
acagcctgtttgatctggtgct

SEQ ID NO: 8420676 - DNA, 22 bp, Homo sapiens
acagcctgtttgatctggtgct

SEQ ID NO: 8420677 - DNA, 19 bp, Homo sapiens
acagcctgttggtggggct

SEQ ID NO: 8420678 - DNA, 19 bp, Homo sapiens
acagcctgttggtggggct

SEQ ID NO: 8420679 - DNA, 22 bp, Homo sapiens
acagcctggcctgagttaaggc

SEQ ID NO: 8420680 - DNA, 22 bp, Homo sapiens
acagcctggactggctctctgc

SEQ ID NO: 8420681 - DNA, 21 bp, Homo sapiens
acagcctgtcatctcatggtc

SEQ ID NO: 8420682 - DNA, 21 bp, Homo sapiens
acagcctgtcatctcatggtc

SEQ ID NO: 8420683 - DNA, 21 bp, Homo sapiens
acagcctgtcatctcatggtc

SEQ ID NO: 8420684 - DNA, 21 bp, Homo sapiens
acagcctgtcatctcatggtc

SEQ ID NO: 8420685 - DNA, 22 bp, Homo sapiens
aagctcaggctggacctggctt

SEQ ID NO: 8420686 - DNA, 22 bp, Homo sapiens
aagctcagtgatgcctccaggg

SEQ ID NO: 8420687 - DNA, 22 bp, Homo sapiens
aagctcctttggctcgagatct

SEQ ID NO: 8420688 - DNA, 19 bp, Homo sapiens
aagctccagcagatccttt

SEQ ID NO: 8420689 - DNA, 22 bp, Homo sapiens
aagctcagagtctcggagggaa

SEQ ID NO: 8420690 - DNA, 22 bp, Homo sapiens
aagctcagcagccaggccctgt

SEQ ID NO: 8420691 - DNA, 22 bp, Homo sapiens
aagctcaggaaagagtctggtt

SEQ ID NO: 8420692 - DNA, 22 bp, Homo sapiens
aagctcagcatgtctcctagaa

SEQ ID NO: 8420693 - DNA, 22 bp, Homo sapiens
aagctcagagtagctcagcgtc

SEQ ID NO: 8420694 - DNA, 22 bp, Homo sapiens
aagctattgaatttatagcata

SEQ ID NO: 8420695 - DNA, 22 bp, Homo sapiens
aagctcagaggtagataatgtt

SEQ ID NO: 8420696 - DNA, 22 bp, Homo sapiens
aagctcttatgatatttattta

SEQ ID NO: 8420697 - DNA, 17 bp, Homo sapiens
acagggcagaaacagct

SEQ ID NO: 8420698 - DNA, 22 bp, Homo sapiens
aagctctggttaaaaggcctgg

SEQ ID NO: 8420699 - DNA, 17 bp, Homo sapiens
acagggcagaaacagct

SEQ ID NO: 8420700 - DNA, 22 bp, Homo sapiens
aagctgccttccatgtgaggaa

SEQ ID NO: 8420701 - DNA, 22 bp, Homo sapiens
aagctgctggtgactgggctga

SEQ ID NO: 8420702 - DNA, 22 bp, Homo sapiens
aagctgccttgctgaggagaaa

SEQ ID NO: 8420703 - DNA, 22 bp, Homo sapiens
aagctggaacatcttgaggaag

SEQ ID NO: 8420704 - DNA, 19 bp, Homo sapiens
acagggcagcaataggata

SEQ ID NO: 8420705 - DNA, 22 bp, Homo sapiens
acagtcttgagcatcagccaga

SEQ ID NO: 8420706 - DNA, 22 bp, Homo sapiens
acagtcttgagcatcagccaga

SEQ ID NO: 8420707 - DNA, 22 bp, Homo sapiens
acagtcttcatgctagaatggc

SEQ ID NO: 8420708 - DNA, 22 bp, Homo sapiens
acagtcttcatgctagaatggc

SEQ ID NO: 8420709 - DNA, 22 bp, Homo sapiens
acagtctttaatttctttgtgg

SEQ ID NO: 8420710 - DNA, 22 bp, Homo sapiens
acagtctttaatttctttgtgg

SEQ ID NO: 8420711 - DNA, 22 bp, Homo sapiens
aaggaggaataaagaggtggtg

SEQ ID NO: 8420712 - DNA, 22 bp, Homo sapiens
aaggaggaataaagaggtggtg

SEQ ID NO: 8420713 - DNA, 22 bp, Homo sapiens
aaggaggaataaagaggtggtg

SEQ ID NO: 8420714 - DNA, 22 bp, Homo sapiens
acagtcttatgcatacactatt

SEQ ID NO: 8420715 - DNA, 22 bp, Homo sapiens
acagtctttaatttctttgtgg

SEQ ID NO: 8420716 - DNA, 22 bp, Homo sapiens
aaggagaggttgtccgtgttgt

SEQ ID NO: 8420717 - DNA, 22 bp, Homo sapiens
aaggagagtacaggagttggta

SEQ ID NO: 8420718 - DNA, 21 bp, Homo sapiens
aaggagcctaggaggctcagg

SEQ ID NO: 8420719 - DNA, 22 bp, Homo sapiens
aaggagctgggagggacacatg

SEQ ID NO: 8420720 - DNA, 17 bp, Homo sapiens
aaggagctgagagatgg

SEQ ID NO: 8420721 - DNA, 22 bp, Homo sapiens
aaggagctcttaaaatcagaga

SEQ ID NO: 8420722 - DNA, 22 bp, Homo sapiens
aaggagctcccggcagaccagg

SEQ ID NO: 8420723 - DNA, 22 bp, Homo sapiens
aaggagagagctttgctggaac

SEQ ID NO: 8420724 - DNA, 22 bp, Homo sapiens
aaggagaatttggcttgtgatg

SEQ ID NO: 8420725 - DNA, 22 bp, Homo sapiens
aaggacaggctaacctgacatt

SEQ ID NO: 8420726 - DNA, 22 bp, Homo sapiens
aagctggactctgccatttact

SEQ ID NO: 8420727 - DNA, 22 bp, Homo sapiens
aaggaggcagaactcacatgga

SEQ ID NO: 8420728 - DNA, 22 bp, Homo sapiens
aaggaggcactcgctctcaggg

SEQ ID NO: 8420729 - DNA, 22 bp, Homo sapiens
acatatctgttagacacagcag

SEQ ID NO: 8420730 - DNA, 22 bp, Homo sapiens
acatatctgttagacacagcag

SEQ ID NO: 8420731 - DNA, 22 bp, Homo sapiens
acatatctttactcatcatctc

SEQ ID NO: 8420732 - DNA, 20 bp, Homo sapiens
acatatgaatgatagagcca

SEQ ID NO: 8420733 - DNA, 22 bp, Homo sapiens
acagtgtttggcaatgcatgca

SEQ ID NO: 8420734 - DNA, 22 bp, Homo sapiens
aaggaggaatgtagccagctcc

SEQ ID NO: 8420735 - DNA, 22 bp, Homo sapiens
acagtgtttatgtacagattgt

SEQ ID NO: 8420736 - DNA, 22 bp, Homo sapiens
aaggaggaattctgagttcatg

SEQ ID NO: 8420737 - DNA, 22 bp, Homo sapiens
aaggaggaattctgagttcatg

SEQ ID NO: 8420738 - DNA, 22 bp, Homo sapiens
aaggaggacacccaggactggg

SEQ ID NO: 8420739 - DNA, 22 bp, Homo sapiens
aaggcagagggctggatcagag

SEQ ID NO: 8420740 - DNA, 22 bp, Homo sapiens
aaggcagagggctggatcagag

SEQ ID NO: 8420741 - DNA, 22 bp, Homo sapiens
aaggcagagattagcagaatga

SEQ ID NO: 8420742 - DNA, 22 bp, Homo sapiens
acatatgtgttgtacatgcatg

SEQ ID NO: 8420743 - DNA, 22 bp, Homo sapiens
acatatgtatatgtacacagtc

SEQ ID NO: 8420744 - DNA, 22 bp, Homo sapiens
acatatgtgcttatatccatga

SEQ ID NO: 8420745 - DNA, 19 bp, Homo sapiens
acatatgtggatatacatg

SEQ ID NO: 8420746 - DNA, 22 bp, Homo sapiens
acatatgtctatttcatgtaaa

SEQ ID NO: 8420747 - DNA, 22 bp, Homo sapiens
acatatgtgtctgcacatgccc

SEQ ID NO: 8420748 - DNA, 22 bp, Homo sapiens
actacactgccctggggatcaa

SEQ ID NO: 8420749 - DNA, 22 bp, Homo sapiens
aagtctctttacctctccaggc

SEQ ID NO: 8420750 - DNA, 22 bp, Homo sapiens
aagtctcttagtaatatccaac

SEQ ID NO: 8420751 - DNA, 22 bp, Homo sapiens
aagtctcttcctctgccaaaga

SEQ ID NO: 8420752 - DNA, 22 bp, Homo sapiens
aagtctctggtgatgcaggaaa

SEQ ID NO: 8420753 - DNA, 22 bp, Homo sapiens
aagtctctggtgatgcaggaaa

SEQ ID NO: 8420754 - DNA, 22 bp, Homo sapiens
aagtctctggttgcttgcatgg

SEQ ID NO: 8420755 - DNA, 22 bp, Homo sapiens
aagtctctgactcacacaatgt

SEQ ID NO: 8420756 - DNA, 18 bp, Homo sapiens
aagtctctgaaagctttt

SEQ ID NO: 8420757 - DNA, 22 bp, Homo sapiens
aagtctctggcaaatgatcttg

SEQ ID NO: 8420758 - DNA, 22 bp, Homo sapiens
aagtctctgatgtgtgttaggt

SEQ ID NO: 8420759 - DNA, 22 bp, Homo sapiens
aagtctctcacatatctggtcc

SEQ ID NO: 8420760 - DNA, 22 bp, Homo sapiens
aagtctctaagactgtgccatc

SEQ ID NO: 8420761 - DNA, 22 bp, Homo sapiens
aagtctctcatggctgacagca

SEQ ID NO: 8420762 - DNA, 22 bp, Homo sapiens
aagtctctcatggctgacagca

SEQ ID NO: 8420763 - DNA, 22 bp, Homo sapiens
aagtctctctgtgtgggataag

SEQ ID NO: 8420764 - DNA, 22 bp, Homo sapiens
aagtctaggacaggaagtctat

SEQ ID NO: 8420765 - DNA, 22 bp, Homo sapiens
aagtctagtatccttcttgact

SEQ ID NO: 8420766 - DNA, 22 bp, Homo sapiens
aagtctaaacacatatttaaaa

SEQ ID NO: 8420767 - DNA, 20 bp, Homo sapiens
acgtggccaccagtggctta

SEQ ID NO: 8420768 - DNA, 22 bp, Homo sapiens
acctacatcaagggagtggtag

SEQ ID NO: 8420769 - DNA, 22 bp, Homo sapiens
accgggaagtcctgcactgggc

SEQ ID NO: 8420770 - DNA, 22 bp, Homo sapiens
acctaaattctggctgattagg

SEQ ID NO: 8420771 - DNA, 22 bp, Homo sapiens
acctacatgttccacatagttg

SEQ ID NO: 8420772 - DNA, 20 bp, Homo sapiens
acctacatgtatagtgaggg

SEQ ID NO: 8420773 - DNA, 22 bp, Homo sapiens
acctagaaactgacagaatatt

SEQ ID NO: 8420774 - DNA, 22 bp, Homo sapiens
acctagaaactgacagaatatt

SEQ ID NO: 8420775 - DNA, 22 bp, Homo sapiens
acctagagtagtcaaattcata

SEQ ID NO: 8420776 - DNA, 22 bp, Homo sapiens
acctagaatttaaaacattgct

SEQ ID NO: 8420777 - DNA, 22 bp, Homo sapiens
acctagaatttaaaacattgct

SEQ ID NO: 8420778 - DNA, 22 bp, Homo sapiens
acctagaatgaagcaatgctgt

SEQ ID NO: 8420779 - DNA, 23 bp, Homo sapiens
acctagaaatacgttttacatgg

SEQ ID NO: 8420780 - DNA, 22 bp, Homo sapiens
acctagaatccatctgcttatt

SEQ ID NO: 8420781 - DNA, 22 bp, Homo sapiens
acctagaactgcaggctatttt

SEQ ID NO: 8420782 - DNA, 22 bp, Homo sapiens
acctagaatgaagcaatgctgt

SEQ ID NO: 8420783 - DNA, 22 bp, Homo sapiens
acggtaacagataccacagact

SEQ ID NO: 8420784 - DNA, 22 bp, Homo sapiens
acgtcttcgttggcagagattt

SEQ ID NO: 8420785 - DNA, 22 bp, Homo sapiens
acgtgcatatgtatacacacat

SEQ ID NO: 8420786 - DNA, 22 bp, Homo sapiens
acgtaatataagaaagtgtggt

SEQ ID NO: 8420787 - DNA, 22 bp, Homo sapiens
acgtagcactgagagatgcagg

SEQ ID NO: 8420788 - DNA, 22 bp, Homo sapiens
actatacaccaaaatattaagg

SEQ ID NO: 8420789 - DNA, 22 bp, Homo sapiens
actacactccaattttctaggt

SEQ ID NO: 8420790 - DNA, 22 bp, Homo sapiens
actataaaaggataaaccagaa

SEQ ID NO: 8420791 - DNA, 22 bp, Homo sapiens
actagtttgaaaatatctgatt

SEQ ID NO: 8420792 - DNA, 22 bp, Homo sapiens
actatacagtatgtacgtgcac

SEQ ID NO: 8420793 - DNA, 22 bp, Homo sapiens
actatacataaaacatttgggt

SEQ ID NO: 8420794 - DNA, 22 bp, Homo sapiens
actcactgcactttgaaatgtg

SEQ ID NO: 8420795 - DNA, 22 bp, Homo sapiens
actcagaatgactgatgctgtg

SEQ ID NO: 8420796 - DNA, 22 bp, Homo sapiens
actcagagaactggattagagg

SEQ ID NO: 8420797 - DNA, 22 bp, Homo sapiens
actcagagaatatctagaagga

SEQ ID NO: 8420798 - DNA, 22 bp, Homo sapiens
actcagagaatatctagaagga

SEQ ID NO: 8420799 - DNA, 22 bp, Homo sapiens
actcagagaatatctagaagga

SEQ ID NO: 8420800 - DNA, 22 bp, Homo sapiens
actcagagaatatctagaagga

SEQ ID NO: 8420801 - DNA, 23 bp, Homo sapiens
actcagagaccccgggaagtgac

SEQ ID NO: 8420802 - DNA, 23 bp, Homo sapiens
actcagagaccccgggaagtgac

SEQ ID NO: 8420803 - DNA, 23 bp, Homo sapiens
actcagagaccccgggaagtgac

SEQ ID NO: 8420804 - DNA, 22 bp, Homo sapiens
actcagagaatatctagaagga

SEQ ID NO: 8420805 - DNA, 22 bp, Homo sapiens
actcagagaaacagcagggtgt

SEQ ID NO: 8420806 - DNA, 22 bp, Homo sapiens
actcagagaaacagcagggtgt

SEQ ID NO: 8420807 - DNA, 22 bp, Homo sapiens
actcagagaacattcccagtct

SEQ ID NO: 8420808 - DNA, 22 bp, Homo sapiens
actccctccaaatctgcacagt

SEQ ID NO: 8420809 - DNA, 22 bp, Homo sapiens
actctcactgcttggctcctgc

SEQ ID NO: 8420810 - DNA, 22 bp, Homo sapiens
actctcactagctctgtgacct

SEQ ID NO: 8420811 - DNA, 22 bp, Homo sapiens
aataccacctcattctggaggc

SEQ ID NO: 8420812 - DNA, 22 bp, Homo sapiens
aatacatgttttctactattct

SEQ ID NO: 8420813 - DNA, 22 bp, Homo sapiens
actggctgaggaagttgccact

SEQ ID NO: 8420814 - DNA, 22 bp, Homo sapiens
aataccttttcagtgcacaaaa

SEQ ID NO: 8420815 - DNA, 22 bp, Homo sapiens
aatacctttcctgccattcact

SEQ ID NO: 8420816 - DNA, 22 bp, Homo sapiens
aataccttccaacatcaagaca

SEQ ID NO: 8420817 - DNA, 22 bp, Homo sapiens
aataccatgcagaaataacata

SEQ ID NO: 8420818 - DNA, 22 bp, Homo sapiens
actggccaggcagcagtagctt

SEQ ID NO: 8420819 - DNA, 22 bp, Homo sapiens
actgcactccagcctgggtgac

SEQ ID NO: 8420820 - DNA, 22 bp, Homo sapiens
actgcactccagcctgggtgac

SEQ ID NO: 8420821 - DNA, 22 bp, Homo sapiens
actgcgctccagcctgggtgac

SEQ ID NO: 8420822 - DNA, 18 bp, Homo sapiens
actggagcattagcagct

SEQ ID NO: 8420823 - DNA, 23 bp, Homo sapiens
actggacagagtggacgaggctg

SEQ ID NO: 8420824 - DNA, 22 bp, Homo sapiens
actggaggattcctggaaggcg

SEQ ID NO: 8420825 - DNA, 22 bp, Homo sapiens
actgcactccaacctgggtgac

SEQ ID NO: 8420826 - DNA, 22 bp, Homo sapiens
actgcactccaacctgggtgac

SEQ ID NO: 8420827 - DNA, 22 bp, Homo sapiens
actgcactccaacctgggtgac

SEQ ID NO: 8420828 - DNA, 22 bp, Homo sapiens
actgcactccagcctgggtaac

SEQ ID NO: 8420829 - DNA, 22 bp, Homo sapiens
actgcactccagcctgggtaac

SEQ ID NO: 8420830 - DNA, 22 bp, Homo sapiens
actgaggtttacttgaaggaga

SEQ ID NO: 8420831 - DNA, 22 bp, Homo sapiens
actgaggtttacttgaaggaga

SEQ ID NO: 8420832 - DNA, 22 bp, Homo sapiens
actgaggtctcaggtggggaag

SEQ ID NO: 8420833 - DNA, 20 bp, Homo sapiens
actgaggttagataacaggt

SEQ ID NO: 8420834 - DNA, 22 bp, Homo sapiens
actctggctgccttgtgagcat

SEQ ID NO: 8420835 - DNA, 22 bp, Homo sapiens
actctggcgggcgggcgagcca

SEQ ID NO: 8420836 - DNA, 22 bp, Homo sapiens
actctggcgggcgggcgagcca

SEQ ID NO: 8420837 - DNA, 22 bp, Homo sapiens
actctggctattcactataata

SEQ ID NO: 8420838 - DNA, 22 bp, Homo sapiens
actctggccctcctgctgccag

SEQ ID NO: 8420839 - DNA, 22 bp, Homo sapiens
actctggccccaggatctgtgt

SEQ ID NO: 8420840 - DNA, 22 bp, Homo sapiens
actctggccatcttggaccttg

SEQ ID NO: 8420841 - DNA, 22 bp, Homo sapiens
actctggccaggtgcggtatgt

SEQ ID NO: 8420842 - DNA, 22 bp, Homo sapiens
actctggagatggatgtcagga

SEQ ID NO: 8420843 - DNA, 22 bp, Homo sapiens
actctggcaagcttccacttcc

SEQ ID NO: 8420844 - DNA, 22 bp, Homo sapiens
actctggcactgggtacctcag

SEQ ID NO: 8420845 - DNA, 22 bp, Homo sapiens
actctggcagcagaaccagtgt

SEQ ID NO: 8420846 - DNA, 22 bp, Homo sapiens
actttcttaggctgtataaatg

SEQ ID NO: 8420847 - DNA, 22 bp, Homo sapiens
actttctgttagatgaatggat

SEQ ID NO: 8420848 - DNA, 21 bp, Homo sapiens
actttctgtgggttcaagcat

SEQ ID NO: 8420849 - DNA, 22 bp, Homo sapiens
actttctgtggttaccagggag

SEQ ID NO: 8420850 - DNA, 22 bp, Homo sapiens
actttcttcttatgcattaagg

SEQ ID NO: 8420851 - DNA, 22 bp, Homo sapiens
aatcacatctcattcaacagcc

SEQ ID NO: 8420852 - DNA, 22 bp, Homo sapiens
actttcttggtcccatgtttga

SEQ ID NO: 8420853 - DNA, 22 bp, Homo sapiens
aatcagaaattctacatcacaa

SEQ ID NO: 8420854 - DNA, 23 bp, Homo sapiens
actttattgaccccaggtcagtt

SEQ ID NO: 8420855 - DNA, 18 bp, Homo sapiens
actgttctctcctgccct

SEQ ID NO: 8420856 - DNA, 22 bp, Homo sapiens
actgttctgccaactttggtta

SEQ ID NO: 8420857 - DNA, 19 bp, Homo sapiens
actgttctaacttgcagct

SEQ ID NO: 8420858 - DNA, 22 bp, Homo sapiens
actgttctccagcatggctgta

SEQ ID NO: 8420859 - DNA, 22 bp, Homo sapiens
actgttcatcctttttgaacaa

SEQ ID NO: 8420860 - DNA, 22 bp, Homo sapiens
actgttgaagtgccagcttgat

SEQ ID NO: 8420861 - DNA, 22 bp, Homo sapiens
actttaaaactgatcatcagag

SEQ ID NO: 8420862 - DNA, 22 bp, Homo sapiens
actttaaaactgatcatcagag

SEQ ID NO: 8420863 - DNA, 22 bp, Homo sapiens
actgttcttcccatttatattg

SEQ ID NO: 8420864 - DNA, 22 bp, Homo sapiens
actgttcttgtaacacttaaat

SEQ ID NO: 8420865 - DNA, 22 bp, Homo sapiens
actgggcttcacttggcacatc

SEQ ID NO: 8420866 - DNA, 19 bp, Homo sapiens
actgggcttgtcctcgtgg

SEQ ID NO: 8420867 - DNA, 22 bp, Homo sapiens
aatatactatactactttctgg

SEQ ID NO: 8420868 - DNA, 22 bp, Homo sapiens
aatatagatttactcaagagaa

SEQ ID NO: 8420869 - DNA, 22 bp, Homo sapiens
aatatagttctagaaatatttt

SEQ ID NO: 8420870 - DNA, 22 bp, Homo sapiens
actgttcacagattagtcgatg

SEQ ID NO: 8420871 - DNA, 22 bp, Homo sapiens
actgttcaagcaaatgacattg

SEQ ID NO: 8420872 - DNA, 22 bp, Homo sapiens
actgttcaagttttatgctgga

SEQ ID NO: 8420873 - DNA, 22 bp, Homo sapiens
aatatagttctggtattgttaa

SEQ ID NO: 8420874 - DNA, 22 bp, Homo sapiens
actgttcactagtgagggttga

SEQ ID NO: 8420875 - DNA, 22 bp, Homo sapiens
actgttcatattcttagaaatt

SEQ ID NO: 8420876 - DNA, 22 bp, Homo sapiens
actgttcatcctttttgaacaa

SEQ ID NO: 8420877 - DNA, 22 bp, Homo sapiens
actgttcatctcttagaaagta

SEQ ID NO: 8420878 - DNA, 22 bp, Homo sapiens
actgttcatctcttagaaagta

SEQ ID NO: 8420879 - DNA, 21 bp, Homo sapiens
actgttcatttgatgaactgg

SEQ ID NO: 8420880 - DNA, 22 bp, Homo sapiens
aatactatgtagccaaaataat

SEQ ID NO: 8420881 - DNA, 22 bp, Homo sapiens
aatactatgtagccaaaataat

SEQ ID NO: 8420882 - DNA, 22 bp, Homo sapiens
aatactatgtagccaaaataat

SEQ ID NO: 8420883 - DNA, 23 bp, Homo sapiens
actgggcttatgaggaggcttgt

SEQ ID NO: 8420884 - DNA, 22 bp, Homo sapiens
actgggctgttttttgagtgga

SEQ ID NO: 8420885 - DNA, 22 bp, Homo sapiens
actgggcttatttcttgtgaac

SEQ ID NO: 8420886 - DNA, 22 bp, Homo sapiens
actgggcttatgctgtggagta

SEQ ID NO: 8420887 - DNA, 22 bp, Homo sapiens
actgggcttatgctgtggagta

SEQ ID NO: 8420888 - DNA, 22 bp, Homo sapiens
actgggctggttagttttacta

SEQ ID NO: 8420889 - DNA, 22 bp, Homo sapiens
actgggctgcttgagtgccttc

SEQ ID NO: 8420890 - DNA, 22 bp, Homo sapiens
actgggctggggctcattctcc

SEQ ID NO: 8420891 - DNA, 22 bp, Homo sapiens
actgggctgcttgagtgccttc

SEQ ID NO: 8420892 - DNA, 22 bp, Homo sapiens
actgggctgtaaagagaggcaa

SEQ ID NO: 8420893 - DNA, 22 bp, Homo sapiens
actgggctgtggacacccagcg

SEQ ID NO: 8420894 - DNA, 22 bp, Homo sapiens
actgggctgttccttatttcta

SEQ ID NO: 8420895 - DNA, 22 bp, Homo sapiens
actgggctgtggacacccagcg

SEQ ID NO: 8420896 - DNA, 22 bp, Homo sapiens
agaaattcaattctaattagct

SEQ ID NO: 8420897 - DNA, 22 bp, Homo sapiens
agaaattcctaaggtacacaag

SEQ ID NO: 8420898 - DNA, 22 bp, Homo sapiens
agaaatgacacacatgagacat

SEQ ID NO: 8420899 - DNA, 22 bp, Homo sapiens
agaacaaaattagaggagtgca

SEQ ID NO: 8420900 - DNA, 22 bp, Homo sapiens
agaacaaatcgatggaagcctg

SEQ ID NO: 8420901 - DNA, 22 bp, Homo sapiens
agaacaaggctgtttccaatgc

SEQ ID NO: 8420902 - DNA, 22 bp, Homo sapiens
aatgataagacatgagtagagg

SEQ ID NO: 8420903 - DNA, 22 bp, Homo sapiens
aatgatgagaactggagtaatt

SEQ ID NO: 8420904 - DNA, 22 bp, Homo sapiens
agaacaatgttaaattattaag

SEQ ID NO: 8420905 - DNA, 22 bp, Homo sapiens
aatgcaaacagcccagaatcca

SEQ ID NO: 8420906 - DNA, 22 bp, Homo sapiens
aatgatttcccctacacagaag

SEQ ID NO: 8420907 - DNA, 22 bp, Homo sapiens
agaagcagaaggaagcagggcc

SEQ ID NO: 8420908 - DNA, 22 bp, Homo sapiens
agaagcagaaggaagcagggcc

SEQ ID NO: 8420909 - DNA, 22 bp, Homo sapiens
agaagcagaaggaagcagggcc

SEQ ID NO: 8420910 - DNA, 22 bp, Homo sapiens
aatgatggttaaacactggagg

SEQ ID NO: 8420911 - DNA, 22 bp, Homo sapiens
agaaatgaagcaggagttatta

SEQ ID NO: 8420912 - DNA, 22 bp, Homo sapiens
agaaatgaatatgtagtggtta

SEQ ID NO: 8420913 - DNA, 22 bp, Homo sapiens
agaaatgacaagactgatcagg

SEQ ID NO: 8420914 - DNA, 22 bp, Homo sapiens
agaaatgacaagactgatcagg

SEQ ID NO: 8420915 - DNA, 22 bp, Homo sapiens
agaaatgaagcaggagttatta

SEQ ID NO: 8420916 - DNA, 22 bp, Homo sapiens
agaaatgaagagagtcaaggtt

SEQ ID NO: 8420917 - DNA, 22 bp, Homo sapiens
agaaatgaagagagtcaaggtt

SEQ ID NO: 8420918 - DNA, 22 bp, Homo sapiens
agaaatgaaaccaaagcctaga

SEQ ID NO: 8420919 - DNA, 21 bp, Homo sapiens
aatcagtacatactgcacatc

SEQ ID NO: 8420920 - DNA, 22 bp, Homo sapiens
aatcaggacccactctacagtt

SEQ ID NO: 8420921 - DNA, 22 bp, Homo sapiens
aatcagcaaatgcttactcagg

SEQ ID NO: 8420922 - DNA, 22 bp, Homo sapiens
aatcagaatcagttgacacagc

SEQ ID NO: 8420923 - DNA, 22 bp, Homo sapiens
aatcagaaccttgggtcataac

SEQ ID NO: 8420924 - DNA, 22 bp, Homo sapiens
aatcagaacttctcagggtggg

SEQ ID NO: 8420925 - DNA, 22 bp, Homo sapiens
aatcagaactcctaccacagag

SEQ ID NO: 8420926 - DNA, 17 bp, Homo sapiens
aatcagatttctgagga

SEQ ID NO: 8420927 - DNA, 22 bp, Homo sapiens
agataagatagtccagcacaat

SEQ ID NO: 8420928 - DNA, 22 bp, Homo sapiens
agataacttttgggtattcatg

SEQ ID NO: 8420929 - DNA, 22 bp, Homo sapiens
agataactggtttacattattg

SEQ ID NO: 8420930 - DNA, 22 bp, Homo sapiens
agataatggagggatttgcatt

SEQ ID NO: 8420931 - DNA, 22 bp, Homo sapiens
acaagaatgtagattagttaag

SEQ ID NO: 8420932 - DNA, 22 bp, Homo sapiens
acaagaattatttctagttaac

SEQ ID NO: 8420933 - DNA, 22 bp, Homo sapiens
acaagactgtgctctaagagtg

SEQ ID NO: 8420934 - DNA, 22 bp, Homo sapiens
acaagagattatctacagatga

SEQ ID NO: 8420935 - DNA, 22 bp, Homo sapiens
agataactcattttgtatatcc

SEQ ID NO: 8420936 - DNA, 22 bp, Homo sapiens
acaacagagctggactgagagg

SEQ ID NO: 8420937 - DNA, 22 bp, Homo sapiens
acaacagagctggactgagagg

SEQ ID NO: 8420938 - DNA, 22 bp, Homo sapiens
acaacacatgtgtatatgtgtg

SEQ ID NO: 8420939 - DNA, 22 bp, Homo sapiens
acaacacatgtgtatatgtgtg

SEQ ID NO: 8420940 - DNA, 22 bp, Homo sapiens
acaacacatgtgtatatgtgtg

SEQ ID NO: 8420941 - DNA, 22 bp, Homo sapiens
acaacacagctttcctcaagtt

SEQ ID NO: 8420942 - DNA, 22 bp, Homo sapiens
acaacacatgtgtatatgtgtg

SEQ ID NO: 8420943 - DNA, 17 bp, Homo sapiens
acaacagaaatgtattc

SEQ ID NO: 8420944 - DNA, 22 bp, Homo sapiens
acaacacagcaaaaccccatct

SEQ ID NO: 8420945 - DNA, 22 bp, Homo sapiens
acaacaatctaccctagcttct

SEQ ID NO: 8420946 - DNA, 22 bp, Homo sapiens
acaacaatctaccctagcttct

SEQ ID NO: 8420947 - DNA, 22 bp, Homo sapiens
acaacacagcaaaaccccatct

SEQ ID NO: 8420948 - DNA, 22 bp, Homo sapiens
acaacacagctttcctcaagtt

SEQ ID NO: 8420949 - DNA, 22 bp, Homo sapiens
acaacaaagacacttgaaatga

SEQ ID NO: 8420950 - DNA, 22 bp, Homo sapiens
acaacaaggcttttcattcata

SEQ ID NO: 8420951 - DNA, 19 bp, Homo sapiens
acaaattggcaaaatgcaa

SEQ ID NO: 8420952 - DNA, 22 bp, Homo sapiens
agaggggttaagtgctagtccg

SEQ ID NO: 8420953 - DNA, 20 bp, Homo sapiens
acaacaaacttgcttaagga

SEQ ID NO: 8420954 - DNA, 20 bp, Homo sapiens
acaacaaacttgcttaagga

SEQ ID NO: 8420955 - DNA, 22 bp, Homo sapiens
acaatcttattagtagtataga

SEQ ID NO: 8420956 - DNA, 22 bp, Homo sapiens
acaatgatgcagatgagtaaga

SEQ ID NO: 8420957 - DNA, 22 bp, Homo sapiens
acaatgcaattgtaaggtgtgt

SEQ ID NO: 8420958 - DNA, 22 bp, Homo sapiens
acaatgcaataggagctagaaa

SEQ ID NO: 8420959 - DNA, 22 bp, Homo sapiens
acaatgaatatcatgaagtact

SEQ ID NO: 8420960 - DNA, 22 bp, Homo sapiens
acaagcagtaaaggccacagtc

SEQ ID NO: 8420961 - DNA, 22 bp, Homo sapiens
acaagcgggccacagtgctggt

SEQ ID NO: 8420962 - DNA, 22 bp, Homo sapiens
acaagctcagatccctgtctct

SEQ ID NO: 8420963 - DNA, 22 bp, Homo sapiens
acaagctgtggtgggacaagag

SEQ ID NO: 8420964 - DNA, 22 bp, Homo sapiens
acaagctgtggtgggacaagag

SEQ ID NO: 8420965 - DNA, 22 bp, Homo sapiens
acaatcacacatgcaattatac

SEQ ID NO: 8420966 - DNA, 22 bp, Homo sapiens
acaatcacacatgcaattatac

SEQ ID NO: 8420967 - DNA, 22 bp, Homo sapiens
acaagatttggctgaaactcca

SEQ ID NO: 8420968 - DNA, 22 bp, Homo sapiens
acaagatttagcttaaagggct

SEQ ID NO: 8420969 - DNA, 22 bp, Homo sapiens
acaagatttaatgcaacccaag

SEQ ID NO: 8420970 - DNA, 22 bp, Homo sapiens
acaagattgataagtctgccct

SEQ ID NO: 8420971 - DNA, 22 bp, Homo sapiens
acaagattttatgactcttttt

SEQ ID NO: 8420972 - DNA, 22 bp, Homo sapiens
acaagattttgtctggtagggt

SEQ ID NO: 8420973 - DNA, 23 bp, Homo sapiens
acaagcagcccagtgctctgcct

SEQ ID NO: 8420974 - DNA, 22 bp, Homo sapiens
acaagattcaatgaattgattg

SEQ ID NO: 8420975 - DNA, 22 bp, Homo sapiens
agaggctgttacactcccagat

SEQ ID NO: 8420976 - DNA, 22 bp, Homo sapiens
agaggctgttacactcccagat

SEQ ID NO: 8420977 - DNA, 22 bp, Homo sapiens
agaggctgtgcccaccaggcaa

SEQ ID NO: 8420978 - DNA, 22 bp, Homo sapiens
agaggctgtgcagagggagtgc

SEQ ID NO: 8420979 - DNA, 19 bp, Homo sapiens
acaaagctgtgagcagctt

SEQ ID NO: 8420980 - DNA, 22 bp, Homo sapiens
acaaagcttagacctaagagat

SEQ ID NO: 8420981 - DNA, 20 bp, Homo sapiens
agaggcttccttgggaggag

SEQ ID NO: 8420982 - DNA, 20 bp, Homo sapiens
agaggcttccttgggaggag

SEQ ID NO: 8420983 - DNA, 23 bp, Homo sapiens
acaaagtaattcctgcttccaaa

SEQ ID NO: 8420984 - DNA, 22 bp, Homo sapiens
agagggggtgttccagaagcat

SEQ ID NO: 8420985 - DNA, 22 bp, Homo sapiens
agagggggtgtcagcactgcag

SEQ ID NO: 8420986 - DNA, 22 bp, Homo sapiens
agagggggtgtcagcactgcag

SEQ ID NO: 8420987 - DNA, 22 bp, Homo sapiens
agagggggaaaatagaggtgtt

SEQ ID NO: 8420988 - DNA, 22 bp, Homo sapiens
agagggggaaaatagaggtgtt

SEQ ID NO: 8420989 - DNA, 22 bp, Homo sapiens
agagggggcagcggaccagtga

SEQ ID NO: 8420990 - DNA, 22 bp, Homo sapiens
agagggggcagcggaccagtga

SEQ ID NO: 8420991 - DNA, 22 bp, Homo sapiens
agaggctctgccgcctcaggta

SEQ ID NO: 8420992 - DNA, 22 bp, Homo sapiens
agaggctgaatgatgtcatcat

SEQ ID NO: 8420993 - DNA, 22 bp, Homo sapiens
agaggccctctctctcctgatg

SEQ ID NO: 8420994 - DNA, 22 bp, Homo sapiens
aattgcttgtttctttaactga

SEQ ID NO: 8420995 - DNA, 22 bp, Homo sapiens
aattgcttcattaacatttagg

SEQ ID NO: 8420996 - DNA, 22 bp, Homo sapiens
aattgcttatcttgttgaatag

SEQ ID NO: 8420997 - DNA, 22 bp, Homo sapiens
aattgcttagttgcaactatgc

SEQ ID NO: 8420998 - DNA, 22 bp, Homo sapiens
aattgatgattcttatgtgaaa

SEQ ID NO: 8420999 - DNA, 22 bp, Homo sapiens
aattgcaacaggtagacttttc

SEQ ID NO: 8421000 - DNA, 22 bp, Homo sapiens
aattgcaacaggtagacttttc

SEQ ID NO: 8421001 - DNA, 22 bp, Homo sapiens
aattcttggaaacattactgga

SEQ ID NO: 8421002 - DNA, 22 bp, Homo sapiens
aattgacaaatcatacttgtat

SEQ ID NO: 8421003 - DNA, 22 bp, Homo sapiens
aattcttggaaacattactgga

SEQ ID NO: 8421004 - DNA, 22 bp, Homo sapiens
aattcttaatcccataaagtga

SEQ ID NO: 8421005 - DNA, 22 bp, Homo sapiens
aattcttaatcccataaagtga

SEQ ID NO: 8421006 - DNA, 22 bp, Homo sapiens
agagacagatctgagggacctc

SEQ ID NO: 8421007 - DNA, 22 bp, Homo sapiens
agagacagaggcaatatagctt

SEQ ID NO: 8421008 - DNA, 22 bp, Homo sapiens
aattaacagagggcttattact

SEQ ID NO: 8421009 - DNA, 22 bp, Homo sapiens
aattaacaaatgtagctgtgat

SEQ ID NO: 8421010 - DNA, 22 bp, Homo sapiens
agagacagatctgagggacctc

SEQ ID NO: 8421011 - DNA, 22 bp, Homo sapiens
agagacagatctgagggacctc

SEQ ID NO: 8421012 - DNA, 22 bp, Homo sapiens
agagacaggaatggcattaaga

SEQ ID NO: 8421013 - DNA, 18 bp, Homo sapiens
agagacagcagcaaaaga

SEQ ID NO: 8421014 - DNA, 18 bp, Homo sapiens
agagacagcagcaaaaga

SEQ ID NO: 8421015 - DNA, 18 bp, Homo sapiens
agagacagcagcaaaaga

SEQ ID NO: 8421016 - DNA, 18 bp, Homo sapiens
agagacagcagcaaaaga

SEQ ID NO: 8421017 - DNA, 22 bp, Homo sapiens
agagacaggaatggcattaaga

SEQ ID NO: 8421018 - DNA, 22 bp, Homo sapiens
agagacaggagttctgtttcca

SEQ ID NO: 8421019 - DNA, 22 bp, Homo sapiens
aattaaaagataacccatgagt

SEQ ID NO: 8421020 - DNA, 22 bp, Homo sapiens
aattaaaaaaggagagcttgct

SEQ ID NO: 8421021 - DNA, 22 bp, Homo sapiens
aattaaaaaaggagagcttgct

SEQ ID NO: 8421022 - DNA, 22 bp, Homo sapiens
aattaaaagataacccatgagt

SEQ ID NO: 8421023 - DNA, 22 bp, Homo sapiens
aattaaaagataacccatgagt

SEQ ID NO: 8421024 - DNA, 22 bp, Homo sapiens
aattaaaagataacccatgagt

SEQ ID NO: 8421025 - DNA, 22 bp, Homo sapiens
aattaaaagataacccatgagt

SEQ ID NO: 8421026 - DNA, 22 bp, Homo sapiens
agaccctggggaaagtcacttc

SEQ ID NO: 8421027 - DNA, 22 bp, Homo sapiens
agaccctggggaaagtcacttc

SEQ ID NO: 8421028 - DNA, 22 bp, Homo sapiens
agaccctctcctcatggacatg

SEQ ID NO: 8421029 - DNA, 22 bp, Homo sapiens
agaccccatacctcagcaggta

SEQ ID NO: 8421030 - DNA, 22 bp, Homo sapiens
agaccctggtaaacactccagg

SEQ ID NO: 8421031 - DNA, 22 bp, Homo sapiens
agaccctggtaaacactccagg

SEQ ID NO: 8421032 - DNA, 22 bp, Homo sapiens
agacccttgcagtctggttgtc

SEQ ID NO: 8421033 - DNA, 22 bp, Homo sapiens
agacctcaataccaggcaccac

SEQ ID NO: 8421034 - DNA, 22 bp, Homo sapiens
aattaaaaaaggagagcttgct

SEQ ID NO: 8421035 - DNA, 22 bp, Homo sapiens
aattaaaaaaggagagcttgct

SEQ ID NO: 8421036 - DNA, 22 bp, Homo sapiens
agagccaggctcccatggggca

SEQ ID NO: 8421037 - DNA, 22 bp, Homo sapiens
agagccagttacaactgtggag

SEQ ID NO: 8421038 - DNA, 22 bp, Homo sapiens
agagccaggtgtagtctcggag

SEQ ID NO: 8421039 - DNA, 22 bp, Homo sapiens
agagcagtcaggctaggacact

SEQ ID NO: 8421040 - DNA, 22 bp, Homo sapiens
agagccaggcggctgggcacct

SEQ ID NO: 8421041 - DNA, 22 bp, Homo sapiens
agagccaggcggctgggcacct

SEQ ID NO: 8421042 - DNA, 22 bp, Homo sapiens
agagacaggatatctgctcatg

SEQ ID NO: 8421043 - DNA, 22 bp, Homo sapiens
agagacaggatatctgctcatg

SEQ ID NO: 8421044 - DNA, 22 bp, Homo sapiens
agagacaggatatctgctcatg

SEQ ID NO: 8421045 - DNA, 22 bp, Homo sapiens
agagacagggttttgccatgtt

SEQ ID NO: 8421046 - DNA, 22 bp, Homo sapiens
agagcctggacctgagctacaa

SEQ ID NO: 8421047 - DNA, 22 bp, Homo sapiens
agagccagttgttaagcactta

SEQ ID NO: 8421048 - DNA, 22 bp, Homo sapiens
agagccagttacaactgtggag

SEQ ID NO: 8421049 - DNA, 22 bp, Homo sapiens
agagcctggacctgagctacaa

SEQ ID NO: 8421050 - DNA, 22 bp, Homo sapiens
agagcctggacttttctgagcc

SEQ ID NO: 8421051 - DNA, 22 bp, Homo sapiens
aattctgatgaataaatcatcc

SEQ ID NO: 8421052 - DNA, 22 bp, Homo sapiens
aattctgatgaataaatcatcc

SEQ ID NO: 8421053 - DNA, 22 bp, Homo sapiens
aattccatccatttgtttcaac

SEQ ID NO: 8421054 - DNA, 21 bp, Homo sapiens
agacaatgctgtaaaattcag

SEQ ID NO: 8421055 - DNA, 20 bp, Homo sapiens
agacaatgagtgacagagtt

SEQ ID NO: 8421056 - DNA, 22 bp, Homo sapiens
agacaatggagagcagagtact

SEQ ID NO: 8421057 - DNA, 22 bp, Homo sapiens
agacaatggagggaaatacttc

SEQ ID NO: 8421058 - DNA, 23 bp, Homo sapiens
agaagcagcttctggagtatcgg

SEQ ID NO: 8421059 - DNA, 20 bp, Homo sapiens
agacaaaatgacttcatgca

SEQ ID NO: 8421060 - DNA, 23 bp, Homo sapiens
agacaaaagcctcagtcttaggc

SEQ ID NO: 8421061 - DNA, 23 bp, Homo sapiens
agaagcagcttctggagtatcgg

SEQ ID NO: 8421062 - DNA, 22 bp, Homo sapiens
agaagcagactctgaggcaagg

SEQ ID NO: 8421063 - DNA, 22 bp, Homo sapiens
agaagcagaaggaagcagggcc

SEQ ID NO: 8421064 - DNA, 22 bp, Homo sapiens
agaagcagactctgaggcaagg

SEQ ID NO: 8421065 - DNA, 22 bp, Homo sapiens
aatggaggtgtctggcctggta

SEQ ID NO: 8421066 - DNA, 22 bp, Homo sapiens
aatggcaaaaggataacaagga

SEQ ID NO: 8421067 - DNA, 22 bp, Homo sapiens
aatggcaagctgaactcagaag

SEQ ID NO: 8421068 - DNA, 22 bp, Homo sapiens
aatggcaaggaaaccgttacca

SEQ ID NO: 8421069 - DNA, 22 bp, Homo sapiens
agacaatttcaaagtaatatta

SEQ ID NO: 8421070 - DNA, 22 bp, Homo sapiens
aatggagacttcaaaatggatt

SEQ ID NO: 8421071 - DNA, 22 bp, Homo sapiens
agacaattgttctaagtaaaaa

SEQ ID NO: 8421072 - DNA, 22 bp, Homo sapiens
agacaattaaaaaattatgctt

SEQ ID NO: 8421073 - DNA, 22 bp, Homo sapiens
aatgggaggtagtatgggaggt

SEQ ID NO: 8421074 - DNA, 22 bp, Homo sapiens
aatgggaagtcactactgttac

SEQ ID NO: 8421075 - DNA, 22 bp, Homo sapiens
aatggccagcaacaggagtgaa

SEQ ID NO: 8421076 - DNA, 22 bp, Homo sapiens
aatggcagtagttgcatgagag

SEQ ID NO: 8421077 - DNA, 22 bp, Homo sapiens
aatggcagaggcaaagatggta

SEQ ID NO: 8421078 - DNA, 22 bp, Homo sapiens
aatggcagaatgggccagaagc

SEQ ID NO: 8421079 - DNA, 22 bp, Homo sapiens
aatggcagaggcaaagatggta

SEQ ID NO: 8421080 - DNA, 22 bp, Homo sapiens
aatggtttaacatatgcttgag

SEQ ID NO: 8421081 - DNA, 22 bp, Homo sapiens
aatggtttgtacctgtccttgg

SEQ ID NO: 8421082 - DNA, 22 bp, Homo sapiens
aatggtatcacctcacagaatt

SEQ ID NO: 8421083 - DNA, 22 bp, Homo sapiens
aatggtatttgtcaagcatagt

SEQ ID NO: 8421084 - DNA, 22 bp, Homo sapiens
aatgggctcacaagacctgaat

SEQ ID NO: 8421085 - DNA, 22 bp, Homo sapiens
aatgggctttcttggacaggag

SEQ ID NO: 8421086 - DNA, 22 bp, Homo sapiens
aatgtcttccctggcaggccaa

SEQ ID NO: 8421087 - DNA, 22 bp, Homo sapiens
aatgtgactgaatatttactct

SEQ ID NO: 8421088 - DNA, 22 bp, Homo sapiens
aatgtcttcagtgtatacatgg

SEQ ID NO: 8421089 - DNA, 22 bp, Homo sapiens
aatgtgcagatgaataaacaaa

SEQ ID NO: 8421090 - DNA, 22 bp, Homo sapiens
acactttctggagctgcacata

SEQ ID NO: 8421091 - DNA, 23 bp, Homo sapiens
acactttcaaatatgcacagagc

SEQ ID NO: 8421092 - DNA, 22 bp, Homo sapiens
acactttatgtctagatctggg

SEQ ID NO: 8421093 - DNA, 22 bp, Homo sapiens
acactttatctcatctcagaca

SEQ ID NO: 8421094 - DNA, 22 bp, Homo sapiens
acactttatctcatctcagaca

SEQ ID NO: 8421095 - DNA, 22 bp, Homo sapiens
acactttatcaatattcaaaaa

SEQ ID NO: 8421096 - DNA, 22 bp, Homo sapiens
acacttttaagactttaatgaa

SEQ ID NO: 8421097 - DNA, 22 bp, Homo sapiens
acactttgggctggataattat

SEQ ID NO: 8421098 - DNA, 22 bp, Homo sapiens
acagaaaagtttacttttgctc

SEQ ID NO: 8421099 - DNA, 22 bp, Homo sapiens
acagaaaaatgagggagctgga

SEQ ID NO: 8421100 - DNA, 22 bp, Homo sapiens
acagaaaatgccagaagggtgg

SEQ ID NO: 8421101 - DNA, 22 bp, Homo sapiens
acagaaaagtttacttttgctc

SEQ ID NO: 8421102 - DNA, 22 bp, Homo sapiens
acagaaacccagaaaacctctc

SEQ ID NO: 8421103 - DNA, 22 bp, Homo sapiens
acagaaagaaggtgtatttgag

SEQ ID NO: 8421104 - DNA, 20 bp, Homo sapiens
acagaaagagagaatgtcag

SEQ ID NO: 8421105 - DNA, 22 bp, Homo sapiens
acagacacaggcgtggagtcgc

SEQ ID NO: 8421106 - DNA, 22 bp, Homo sapiens
acagacaagtagttcagacaag

SEQ ID NO: 8421107 - DNA, 22 bp, Homo sapiens
acagacaagtagttcagacaag

SEQ ID NO: 8421108 - DNA, 22 bp, Homo sapiens
acagacagacagattgcatatg

SEQ ID NO: 8421109 - DNA, 22 bp, Homo sapiens
acagacagacagattgcatatg

SEQ ID NO: 8421110 - DNA, 22 bp, Homo sapiens
acagacagacagagaactattc

SEQ ID NO: 8421111 - DNA, 22 bp, Homo sapiens
acagagacttggagcaggctga

SEQ ID NO: 8421112 - DNA, 23 bp, Homo sapiens
acagagactgccaagatattctc

SEQ ID NO: 8421113 - DNA, 22 bp, Homo sapiens
acagagactcatgaaagatgac

SEQ ID NO: 8421114 - DNA, 20 bp, Homo sapiens
acagagactgagacacttgc

SEQ ID NO: 8421115 - DNA, 22 bp, Homo sapiens
acagagactgggagcaagaggc

SEQ ID NO: 8421116 - DNA, 22 bp, Homo sapiens
acagagactgggagcaagaggc

SEQ ID NO: 8421117 - DNA, 22 bp, Homo sapiens
acagagactaagcttttcatca

SEQ ID NO: 8421118 - DNA, 22 bp, Homo sapiens
acagagaccagcatcttctgcc

SEQ ID NO: 8421119 - DNA, 22 bp, Homo sapiens
acagagaaagttcctctcaggc

SEQ ID NO: 8421120 - DNA, 23 bp, Homo sapiens
acagagacaatggtttcatcttg

SEQ ID NO: 8421121 - DNA, 23 bp, Homo sapiens
acagacattccataatgtacacc

SEQ ID NO: 8421122 - DNA, 22 bp, Homo sapiens
acagacattcatatcctcggta

SEQ ID NO: 8421123 - DNA, 22 bp, Homo sapiens
agccagggtgagagggctttgt

SEQ ID NO: 8421124 - DNA, 22 bp, Homo sapiens
acagactgtgagtatgcatagt

SEQ ID NO: 8421125 - DNA, 22 bp, Homo sapiens
acagactgtgagtatgcatagt

SEQ ID NO: 8421126 - DNA, 22 bp, Homo sapiens
acagactgtcccaccacatgga

SEQ ID NO: 8421127 - DNA, 22 bp, Homo sapiens
acagactgtttggttcatgtct

SEQ ID NO: 8421128 - DNA, 22 bp, Homo sapiens
acagactgtgagtctcattttc

SEQ ID NO: 8421129 - DNA, 19 bp, Homo sapiens
acagagctctctgcttctg

SEQ ID NO: 8421130 - DNA, 19 bp, Homo sapiens
acagagctctctgcttctg

SEQ ID NO: 8421131 - DNA, 22 bp, Homo sapiens
acagagctgggatctgaaccca

SEQ ID NO: 8421132 - DNA, 22 bp, Homo sapiens
acagagctgggatctgaaccca

SEQ ID NO: 8421133 - DNA, 22 bp, Homo sapiens
acagagctgggatctgaaccca

SEQ ID NO: 8421134 - DNA, 22 bp, Homo sapiens
acagagctgggtgccccctgga

SEQ ID NO: 8421135 - DNA, 22 bp, Homo sapiens
acagagctgggtgccccctgga

SEQ ID NO: 8421136 - DNA, 22 bp, Homo sapiens
acagagctaatgttgcataggc

SEQ ID NO: 8421137 - DNA, 22 bp, Homo sapiens
acagagctaaatttcaatccca

SEQ ID NO: 8421138 - DNA, 17 bp, Homo sapiens
acagagctacatattct

SEQ ID NO: 8421139 - DNA, 22 bp, Homo sapiens
acagagctcccagccatctcct

SEQ ID NO: 8421140 - DNA, 22 bp, Homo sapiens
acagagctcccagccatctcct

SEQ ID NO: 8421141 - DNA, 22 bp, Homo sapiens
acagatgatttttatgaaaaca

SEQ ID NO: 8421142 - DNA, 22 bp, Homo sapiens
acagatgatttttatgaaaaca

SEQ ID NO: 8421143 - DNA, 22 bp, Homo sapiens
acagatgatgtgcacagataga

SEQ ID NO: 8421144 - DNA, 22 bp, Homo sapiens
acagatgagttagaataggcag

SEQ ID NO: 8421145 - DNA, 22 bp, Homo sapiens
acagatgatgtgcacagataga

SEQ ID NO: 8421146 - DNA, 22 bp, Homo sapiens
acagagccactttggtgcctac

SEQ ID NO: 8421147 - DNA, 22 bp, Homo sapiens
acagagccactttggtgcctac

SEQ ID NO: 8421148 - DNA, 22 bp, Homo sapiens
acagagccactttggtgcctac

SEQ ID NO: 8421149 - DNA, 22 bp, Homo sapiens
agcctctgatgatcacaggggg

SEQ ID NO: 8421150 - DNA, 22 bp, Homo sapiens
agcctctgatggctcccaagga

SEQ ID NO: 8421151 - DNA, 22 bp, Homo sapiens
agcctctgatgatcacaggggg

SEQ ID NO: 8421152 - DNA, 22 bp, Homo sapiens
agcctctgactgtcagcaaggt

SEQ ID NO: 8421153 - DNA, 22 bp, Homo sapiens
agcctctgactgtcagcaaggt

SEQ ID NO: 8421154 - DNA, 22 bp, Homo sapiens
agcctcctgtagccctcaccca

SEQ ID NO: 8421155 - DNA, 20 bp, Homo sapiens
agccctgtttcctggagaga

SEQ ID NO: 8421156 - DNA, 20 bp, Homo sapiens
agccctgtttcctggagaga

SEQ ID NO: 8421157 - DNA, 17 bp, Homo sapiens
agctcctgcccatggct

SEQ ID NO: 8421158 - DNA, 22 bp, Homo sapiens
agctcctgcgcacggtgcacac

SEQ ID NO: 8421159 - DNA, 22 bp, Homo sapiens
agctcctgcgcacggtgcacac

SEQ ID NO: 8421160 - DNA, 22 bp, Homo sapiens
agctcctgcgcacggtgcacac

SEQ ID NO: 8421161 - DNA, 22 bp, Homo sapiens
agctcctgcccaggaaggctct

SEQ ID NO: 8421162 - DNA, 22 bp, Homo sapiens
agctcctgccaacactgatggg

SEQ ID NO: 8421163 - DNA, 22 bp, Homo sapiens
agctcctgccaacactgatggg

SEQ ID NO: 8421164 - DNA, 22 bp, Homo sapiens
agctcctgcagactcctgctca

SEQ ID NO: 8421165 - DNA, 22 bp, Homo sapiens
agctcctgcagactcctgctca

SEQ ID NO: 8421166 - DNA, 22 bp, Homo sapiens
agctcctgcacccagccttgag

SEQ ID NO: 8421167 - DNA, 22 bp, Homo sapiens
agctcctgcaccaggggcccct

SEQ ID NO: 8421168 - DNA, 22 bp, Homo sapiens
agctcctgcaccaggggcccct

SEQ ID NO: 8421169 - DNA, 22 bp, Homo sapiens
agctcctgctctttgtccctaa

SEQ ID NO: 8421170 - DNA, 22 bp, Homo sapiens
agctcctgctctttgtccctaa

SEQ ID NO: 8421171 - DNA, 22 bp, Homo sapiens
agctcctgctctttgtccctaa

SEQ ID NO: 8421172 - DNA, 22 bp, Homo sapiens
agctcctgctctttgtccctaa

SEQ ID NO: 8421173 - DNA, 22 bp, Homo sapiens
agctcctgcttgacagaagagg

SEQ ID NO: 8421174 - DNA, 22 bp, Homo sapiens
acagcacagagtggtatggctg

SEQ ID NO: 8421175 - DNA, 22 bp, Homo sapiens
acagcacagagtggtatggctg

SEQ ID NO: 8421176 - DNA, 22 bp, Homo sapiens
acagcacaatctgagtcccaga

SEQ ID NO: 8421177 - DNA, 22 bp, Homo sapiens
acagatggagctactaggtaaa

SEQ ID NO: 8421178 - DNA, 22 bp, Homo sapiens
acagatggagctactaggtaaa

SEQ ID NO: 8421179 - DNA, 22 bp, Homo sapiens
acagatggccatattactatat

SEQ ID NO: 8421180 - DNA, 22 bp, Homo sapiens
acagatggcacctttttgctgt

SEQ ID NO: 8421181 - DNA, 22 bp, Homo sapiens
acagatggtagcattatgttgg

SEQ ID NO: 8421182 - DNA, 22 bp, Homo sapiens
acagatggttattgtcatttct

SEQ ID NO: 8421183 - DNA, 22 bp, Homo sapiens
acagattatggatatatgtgga

SEQ ID NO: 8421184 - DNA, 22 bp, Homo sapiens
acagatgtacactcatatataa

SEQ ID NO: 8421185 - DNA, 22 bp, Homo sapiens
acagatgttagcaatgatgatg

SEQ ID NO: 8421186 - DNA, 22 bp, Homo sapiens
acactagtatttctataagtga

SEQ ID NO: 8421187 - DNA, 22 bp, Homo sapiens
acacccaggctggcgtgcagtg

SEQ ID NO: 8421188 - DNA, 22 bp, Homo sapiens
acacattataggcaatcaaaag

SEQ ID NO: 8421189 - DNA, 22 bp, Homo sapiens
acacattataggcaatcaaaag

SEQ ID NO: 8421190 - DNA, 22 bp, Homo sapiens
acacattaggcagtgcttaaat

SEQ ID NO: 8421191 - DNA, 22 bp, Homo sapiens
acacattatagagagtataata

SEQ ID NO: 8421192 - DNA, 22 bp, Homo sapiens
acactctgctctgagcttcagg

SEQ ID NO: 8421193 - DNA, 22 bp, Homo sapiens
acactcagtaaacgacaatggg

SEQ ID NO: 8421194 - DNA, 22 bp, Homo sapiens
acactcaccctcccactgcctg

SEQ ID NO: 8421195 - DNA, 22 bp, Homo sapiens
acactgaatatacaatgaatat

SEQ ID NO: 8421196 - DNA, 22 bp, Homo sapiens
acactttactcttacaccattg

SEQ ID NO: 8421197 - DNA, 22 bp, Homo sapiens
acactttagatattcccttctg

SEQ ID NO: 8421198 - DNA, 22 bp, Homo sapiens
acactttactcttacaccattg

SEQ ID NO: 8421199 - DNA, 22 bp, Homo sapiens
acactttactcttacaccattg

SEQ ID NO: 8421200 - DNA, 22 bp, Homo sapiens
acactgagttttaccaggcaca

SEQ ID NO: 8421201 - DNA, 22 bp, Homo sapiens
acactgcagatgaaagcataag

SEQ ID NO: 8421202 - DNA, 22 bp, Homo sapiens
acactgagattttcctgacacc

SEQ ID NO: 8421203 - DNA, 22 bp, Homo sapiens
acactgagcatctctagaggca

SEQ ID NO: 8421204 - DNA, 22 bp, Homo sapiens
acactgaatgctgtttagaaat

SEQ ID NO: 8421205 - DNA, 19 bp, Homo sapiens
acactgaatgtagaattgg

SEQ ID NO: 8421206 - DNA, 22 bp, Homo sapiens
acactgaatgtttaagaacttg

SEQ ID NO: 8421207 - DNA, 17 bp, Homo sapiens
acacagggagagggagc

SEQ ID NO: 8421208 - DNA, 17 bp, Homo sapiens
acacagggagagggagc

SEQ ID NO: 8421209 - DNA, 22 bp, Homo sapiens
agcagctggttcccgagggcgt

SEQ ID NO: 8421210 - DNA, 22 bp, Homo sapiens
acacaggcatagccatacatgt

SEQ ID NO: 8421211 - DNA, 22 bp, Homo sapiens
acacaggcatagccatacatgt

SEQ ID NO: 8421212 - DNA, 18 bp, Homo sapiens
acacaggctgacagcacc

SEQ ID NO: 8421213 - DNA, 22 bp, Homo sapiens
acacagggcagagagctggctc

SEQ ID NO: 8421214 - DNA, 22 bp, Homo sapiens
acacatcttagactgaaatatg

SEQ ID NO: 8421215 - DNA, 22 bp, Homo sapiens
acacatcttagactgaaatatg

SEQ ID NO: 8421216 - DNA, 22 bp, Homo sapiens
acacatctctctttgaggagtg

SEQ ID NO: 8421217 - DNA, 22 bp, Homo sapiens
acacatctgcaagagccagacc

SEQ ID NO: 8421218 - DNA, 22 bp, Homo sapiens
acacatctccagccagcaggag

SEQ ID NO: 8421219 - DNA, 22 bp, Homo sapiens
acacatgtgtctgcatgcagtg

SEQ ID NO: 8421220 - DNA, 22 bp, Homo sapiens
acacatgtttacagtcttcagt

SEQ ID NO: 8421221 - DNA, 22 bp, Homo sapiens
acacattaacctttgaaattct

SEQ ID NO: 8421222 - DNA, 22 bp, Homo sapiens
acacattaaaacgtctacaatg

SEQ ID NO: 8421223 - DNA, 22 bp, Homo sapiens
acacatgtttgtgtagtcagtt

SEQ ID NO: 8421224 - DNA, 22 bp, Homo sapiens
acacatgtttccaaaagcaccc

SEQ ID NO: 8421225 - DNA, 22 bp, Homo sapiens
acacatgtttacagtcttcagt

SEQ ID NO: 8421226 - DNA, 22 bp, Homo sapiens
acacatgtgattctaagacagc

SEQ ID NO: 8421227 - DNA, 22 bp, Homo sapiens
acacatgtatggcacttacatt

SEQ ID NO: 8421228 - DNA, 22 bp, Homo sapiens
acacatgtatggcacttacatt

SEQ ID NO: 8421229 - DNA, 22 bp, Homo sapiens
acacatgtatggcacttacatt

SEQ ID NO: 8421230 - DNA, 22 bp, Homo sapiens
agcagctggtaggagtggccac

SEQ ID NO: 8421231 - DNA, 22 bp, Homo sapiens
agcagctggtaggagtggccac

SEQ ID NO: 8421232 - DNA, 22 bp, Homo sapiens
agcagctggtaggagtggccac

SEQ ID NO: 8421233 - DNA, 22 bp, Homo sapiens
agcagctggggcctgtgacgat

SEQ ID NO: 8421234 - DNA, 22 bp, Homo sapiens
agcagctgggtccggcggagca

SEQ ID NO: 8421235 - DNA, 17 bp, Homo sapiens
agcagctgggttgatct

SEQ ID NO: 8421236 - DNA, 22 bp, Homo sapiens
acacagatgcattacacatcta

SEQ ID NO: 8421237 - DNA, 22 bp, Homo sapiens
acacagatgatgttccaggaac

SEQ ID NO: 8421238 - DNA, 22 bp, Homo sapiens
acacagatattttgaatacata

SEQ ID NO: 8421239 - DNA, 22 bp, Homo sapiens
agcagctgggctcagagctggg

SEQ ID NO: 8421240 - DNA, 22 bp, Homo sapiens
acacagaagatctcttaatgct

SEQ ID NO: 8421241 - DNA, 22 bp, Homo sapiens
acacagagcttctcaactggga

SEQ ID NO: 8421242 - DNA, 22 bp, Homo sapiens
acacagaggaaagtgtgaaggg

SEQ ID NO: 8421243 - DNA, 22 bp, Homo sapiens
acacagaggcatgacagtggct

SEQ ID NO: 8421244 - DNA, 22 bp, Homo sapiens
acacagagggcagaagatacat

SEQ ID NO: 8421245 - DNA, 22 bp, Homo sapiens
acacagagggcagaagatacat

SEQ ID NO: 8421246 - DNA, 22 bp, Homo sapiens
acacagagtatttagaaggggt

SEQ ID NO: 8421247 - DNA, 22 bp, Homo sapiens
acacagagtccttactgaggta

SEQ ID NO: 8421248 - DNA, 22 bp, Homo sapiens
acacagagtccttactgaggta

SEQ ID NO: 8421249 - DNA, 22 bp, Homo sapiens
acacagagtttgacacatggga

SEQ ID NO: 8421250 - DNA, 22 bp, Homo sapiens
acacagagtttgacacatggga

SEQ ID NO: 8421251 - DNA, 22 bp, Homo sapiens
acaatgcaccagcatcttcacc

SEQ ID NO: 8421252 - DNA, 22 bp, Homo sapiens
acaatgcaccagcatcttcacc

SEQ ID NO: 8421253 - DNA, 22 bp, Homo sapiens
acaatgcatacctagcagctca

SEQ ID NO: 8421254 - DNA, 23 bp, Homo sapiens
acaatgcactttaaatggttccc

SEQ ID NO: 8421255 - DNA, 22 bp, Homo sapiens
acaatgcacctattttaaaact

SEQ ID NO: 8421256 - DNA, 22 bp, Homo sapiens
agcagagcaaagctcagaaatg

SEQ ID NO: 8421257 - DNA, 22 bp, Homo sapiens
agcagagcatggtgggaagggc

SEQ ID NO: 8421258 - DNA, 23 bp, Homo sapiens
agcagcaaaaatttatctttctg

SEQ ID NO: 8421259 - DNA, 22 bp, Homo sapiens
acacagaagatctcttaatgct

SEQ ID NO: 8421260 - DNA, 22 bp, Homo sapiens
acacagaagatctcttaatgct

SEQ ID NO: 8421261 - DNA, 22 bp, Homo sapiens
agcagatgggagatggagctgc

SEQ ID NO: 8421262 - DNA, 22 bp, Homo sapiens
agcagatgcgtctgagtgggag

SEQ ID NO: 8421263 - DNA, 22 bp, Homo sapiens
agcagatggtgtcatgggatgg

SEQ ID NO: 8421264 - DNA, 22 bp, Homo sapiens
agcagagtttctcaacatcagc

SEQ ID NO: 8421265 - DNA, 22 bp, Homo sapiens
agcagatgaatcccagataaag

SEQ ID NO: 8421266 - DNA, 22 bp, Homo sapiens
agcagagccaggtctctctgta

SEQ ID NO: 8421267 - DNA, 22 bp, Homo sapiens
aagcaggatggaggttgagtta

SEQ ID NO: 8421268 - DNA, 22 bp, Homo sapiens
aagcaggatggaggttgagtta

SEQ ID NO: 8421269 - DNA, 22 bp, Homo sapiens
aagcaggagatgcaggaatgta

SEQ ID NO: 8421270 - DNA, 22 bp, Homo sapiens
aagcaggagatgcaggaatgta

SEQ ID NO: 8421271 - DNA, 22 bp, Homo sapiens
aagcaggagagcctgggtgagc

SEQ ID NO: 8421272 - DNA, 22 bp, Homo sapiens
aagcaggagagcctgggtgagc

SEQ ID NO: 8421273 - DNA, 22 bp, Homo sapiens
aagcaggcatgggaggccatcc

SEQ ID NO: 8421274 - DNA, 22 bp, Homo sapiens
aagcaggcatcttggaggtcaa

SEQ ID NO: 8421275 - DNA, 22 bp, Homo sapiens
aagcaggcaaggttgtggggca

SEQ ID NO: 8421276 - DNA, 22 bp, Homo sapiens
aagattatggcagataacaatt

SEQ ID NO: 8421277 - DNA, 22 bp, Homo sapiens
aagattatttaagacaggaacc

SEQ ID NO: 8421278 - DNA, 22 bp, Homo sapiens
aagattcacagagtgaatgaaa

SEQ ID NO: 8421279 - DNA, 20 bp, Homo sapiens
aagattcattgtaattaggg

SEQ ID NO: 8421280 - DNA, 22 bp, Homo sapiens
aagcaggagagcctgggcgagc

SEQ ID NO: 8421281 - DNA, 22 bp, Homo sapiens
aagatattcaaagatttattag

SEQ ID NO: 8421282 - DNA, 22 bp, Homo sapiens
aagatatattttggtgatttca

SEQ ID NO: 8421283 - DNA, 22 bp, Homo sapiens
aagatcagaactttatacagga

SEQ ID NO: 8421284 - DNA, 22 bp, Homo sapiens
aagatgttgtcgttagtgatga

SEQ ID NO: 8421285 - DNA, 22 bp, Homo sapiens
aagatccatgggaatgtttggc

SEQ ID NO: 8421286 - DNA, 23 bp, Homo sapiens
aagatccattcaaattatgtatc

SEQ ID NO: 8421287 - DNA, 22 bp, Homo sapiens
aagccttcagtccgttgcagag

SEQ ID NO: 8421288 - DNA, 22 bp, Homo sapiens
aagcctggcacattggagtctg

SEQ ID NO: 8421289 - DNA, 22 bp, Homo sapiens
aagcctggactatcgcgtgtgc

SEQ ID NO: 8421290 - DNA, 22 bp, Homo sapiens
aagcctgctttgttccacagca

SEQ ID NO: 8421291 - DNA, 22 bp, Homo sapiens
aagccttaaatgtttctaatat

SEQ ID NO: 8421292 - DNA, 22 bp, Homo sapiens
aagccttcagtccgttgcagag

SEQ ID NO: 8421293 - DNA, 22 bp, Homo sapiens
aagccttcagagttggctggtc

SEQ ID NO: 8421294 - DNA, 22 bp, Homo sapiens
aagcctgagggtgttgctagat

SEQ ID NO: 8421295 - DNA, 22 bp, Homo sapiens
aagcctccttattaaaggatat

SEQ ID NO: 8421296 - DNA, 22 bp, Homo sapiens
aagccctggggttgcacaaggc

SEQ ID NO: 8421297 - DNA, 22 bp, Homo sapiens
aagccctgtaaattgcccttaa

SEQ ID NO: 8421298 - DNA, 22 bp, Homo sapiens
aagccctgtcaccctgacttca

SEQ ID NO: 8421299 - DNA, 22 bp, Homo sapiens
aagccctgttctttctctcacc

SEQ ID NO: 8421300 - DNA, 22 bp, Homo sapiens
aagccctgttaggcactgggga

SEQ ID NO: 8421301 - DNA, 22 bp, Homo sapiens
aagccctgtccggggggaagaa

SEQ ID NO: 8421302 - DNA, 22 bp, Homo sapiens
aagcccttttcaagatacaaca

SEQ ID NO: 8421303 - DNA, 22 bp, Homo sapiens
aagcccttggcgcacaccgggc

SEQ ID NO: 8421304 - DNA, 16 bp, Homo sapiens
aagcctaaattacaga

SEQ ID NO: 8421305 - DNA, 22 bp, Homo sapiens
aaatctttccctttactatcca

SEQ ID NO: 8421306 - DNA, 22 bp, Homo sapiens
aaatctgaaatagtgtgaagta

SEQ ID NO: 8421307 - DNA, 22 bp, Homo sapiens
aaatctgttgtaatgtttttta

SEQ ID NO: 8421308 - DNA, 22 bp, Homo sapiens
aaatctcattatttataccata

SEQ ID NO: 8421309 - DNA, 22 bp, Homo sapiens
aagcaggccctgggccagggga

SEQ ID NO: 8421310 - DNA, 22 bp, Homo sapiens
aagcaggcattccagagacaat

SEQ ID NO: 8421311 - DNA, 22 bp, Homo sapiens
aaatactggcaagtgctaattc

SEQ ID NO: 8421312 - DNA, 22 bp, Homo sapiens
aaatactggcaagtgctaattc

SEQ ID NO: 8421313 - DNA, 22 bp, Homo sapiens
aaatactattgaccaggtctct

SEQ ID NO: 8421314 - DNA, 21 bp, Homo sapiens
aaatactgggcagtgacttga

SEQ ID NO: 8421315 - DNA, 22 bp, Homo sapiens
aagataaactcttgatttctga

SEQ ID NO: 8421316 - DNA, 22 bp, Homo sapiens
aagataacaggaggagtttgta

SEQ ID NO: 8421317 - DNA, 22 bp, Homo sapiens
aaatactagaattcagagttga

SEQ ID NO: 8421318 - DNA, 22 bp, Homo sapiens
aaatacgtgcacatacatacat

SEQ ID NO: 8421319 - DNA, 23 bp, Homo sapiens
aaatacctgaattagatattatc

SEQ ID NO: 8421320 - DNA, 22 bp, Homo sapiens
aaatacatttacagtcgtggct

SEQ ID NO: 8421321 - DNA, 22 bp, Homo sapiens
aaatacatttacagtcgtggct

SEQ ID NO: 8421322 - DNA, 22 bp, Homo sapiens
aaatacattagacggagagtta

SEQ ID NO: 8421323 - DNA, 22 bp, Homo sapiens
aagaggggtggtctgtgaggat

SEQ ID NO: 8421324 - DNA, 22 bp, Homo sapiens
aagaggggtggtctgtgaggat

SEQ ID NO: 8421325 - DNA, 22 bp, Homo sapiens
aagagggagggcaaaggcactg

SEQ ID NO: 8421326 - DNA, 22 bp, Homo sapiens
aagagggagggcaaaggcactg

SEQ ID NO: 8421327 - DNA, 22 bp, Homo sapiens
aagagggcagcacaggtgggtc

SEQ ID NO: 8421328 - DNA, 22 bp, Homo sapiens
aagagggaggtgcgggtgcaga

SEQ ID NO: 8421329 - DNA, 22 bp, Homo sapiens
aagagggaggtgcgggtgcaga

SEQ ID NO: 8421330 - DNA, 22 bp, Homo sapiens
aaagttttagaactaggaagca

SEQ ID NO: 8421331 - DNA, 22 bp, Homo sapiens
aaagttttagctgtccagttcc

SEQ ID NO: 8421332 - DNA, 22 bp, Homo sapiens
aaagtttggatccagcaaaaga

SEQ ID NO: 8421333 - DNA, 22 bp, Homo sapiens
aaagtttattttccctggttag

SEQ ID NO: 8421334 - DNA, 22 bp, Homo sapiens
aaagtgcagctgaaaacatcct

SEQ ID NO: 8421335 - DNA, 22 bp, Homo sapiens
aaagtgcagaactgttctcact

SEQ ID NO: 8421336 - DNA, 22 bp, Homo sapiens
aaagtgcactctcagtgctgct

SEQ ID NO: 8421337 - DNA, 22 bp, Homo sapiens
aagacagagggaagcaatgatg

SEQ ID NO: 8421338 - DNA, 22 bp, Homo sapiens
aagacagagggaagcaatgatg

SEQ ID NO: 8421339 - DNA, 15 bp, Homo sapiens
aaagtgcacccaata

SEQ ID NO: 8421340 - DNA, 20 bp, Homo sapiens
aaagtgcacagatacagctc

SEQ ID NO: 8421341 - DNA, 22 bp, Homo sapiens
aaagtgcacctgcttcttcttg

SEQ ID NO: 8421342 - DNA, 22 bp, Homo sapiens
aaagtgcactagaatccagatt

SEQ ID NO: 8421343 - DNA, 22 bp, Homo sapiens
aaagtgcacctgcttcttcttg

SEQ ID NO: 8421344 - DNA, 22 bp, Homo sapiens
aaagtgcaatcagttagaccat

SEQ ID NO: 8421345 - DNA, 22 bp, Homo sapiens
aaagtgcaaggattacaggcat

SEQ ID NO: 8421346 - DNA, 22 bp, Homo sapiens
aagaacatgatggccatgtgca

SEQ ID NO: 8421347 - DNA, 22 bp, Homo sapiens
aagaacatggtaggataacaaa

SEQ ID NO: 8421348 - DNA, 22 bp, Homo sapiens
aagaacatggtaggataacaaa

SEQ ID NO: 8421349 - DNA, 22 bp, Homo sapiens
aaagtgaggacttgagtactgt

SEQ ID NO: 8421350 - DNA, 22 bp, Homo sapiens
aaagtgacaaccatttattaag

SEQ ID NO: 8421351 - DNA, 22 bp, Homo sapiens
aaagtgacaaccatttattaag

SEQ ID NO: 8421352 - DNA, 22 bp, Homo sapiens
aaagtttaggctttgaaaccag

SEQ ID NO: 8421353 - DNA, 22 bp, Homo sapiens
aagactctatctttagagatca

SEQ ID NO: 8421354 - DNA, 22 bp, Homo sapiens
aagactctgtatcatgagggag

SEQ ID NO: 8421355 - DNA, 22 bp, Homo sapiens
aagacccttctctgaggaggaa

SEQ ID NO: 8421356 - DNA, 22 bp, Homo sapiens
aagacctaaaattccctcagat

SEQ ID NO: 8421357 - DNA, 22 bp, Homo sapiens
aagaccctacccctggagagga

SEQ ID NO: 8421358 - DNA, 22 bp, Homo sapiens
aagaccctatactcagtgaccc

SEQ ID NO: 8421359 - DNA, 17 bp, Homo sapiens
aagaccctagtctaccc

SEQ ID NO: 8421360 - DNA, 22 bp, Homo sapiens
aagaccctacccctggagagga

SEQ ID NO: 8421361 - DNA, 17 bp, Homo sapiens
aagaccctagtctaccc

SEQ ID NO: 8421362 - DNA, 22 bp, Homo sapiens
aagactcaaggaacaacacagt

SEQ ID NO: 8421363 - DNA, 22 bp, Homo sapiens
aagactacttttggcagtgtgt

SEQ ID NO: 8421364 - DNA, 22 bp, Homo sapiens
aagacgcaccctttgagggcac

SEQ ID NO: 8421365 - DNA, 22 bp, Homo sapiens
aactgtaagagaataaatgtgt

SEQ ID NO: 8421366 - DNA, 22 bp, Homo sapiens
aactgtaatttttacatagtaa

SEQ ID NO: 8421367 - DNA, 22 bp, Homo sapiens
aactgtacgataataaatttgt

SEQ ID NO: 8421368 - DNA, 22 bp, Homo sapiens
aaaggttttggtaaggctttaa

SEQ ID NO: 8421369 - DNA, 22 bp, Homo sapiens
aactgtcttaataacaaaagct

SEQ ID NO: 8421370 - DNA, 22 bp, Homo sapiens
aactgtcttatttatatttctg

SEQ ID NO: 8421371 - DNA, 23 bp, Homo sapiens
aactgtcttgcaagtgtgatacc

SEQ ID NO: 8421372 - DNA, 22 bp, Homo sapiens
aactgtcttgcctactcagcat

SEQ ID NO: 8421373 - DNA, 22 bp, Homo sapiens
aactgtctaaggagaatatgaa

SEQ ID NO: 8421374 - DNA, 22 bp, Homo sapiens
aactgtctgaaactggggtttc

SEQ ID NO: 8421375 - DNA, 22 bp, Homo sapiens
aactgtctaaggagaatatgaa

SEQ ID NO: 8421376 - DNA, 22 bp, Homo sapiens
aactgtcatctttcaaggaaga

SEQ ID NO: 8421377 - DNA, 22 bp, Homo sapiens
aactgtagcaaagaacagctct

SEQ ID NO: 8421378 - DNA, 22 bp, Homo sapiens
aactgtagggatctgtcttagt

SEQ ID NO: 8421379 - DNA, 22 bp, Homo sapiens
aactgtagtgcttatagactct

SEQ ID NO: 8421380 - DNA, 22 bp, Homo sapiens
aaagtaacaataaggttctatt

SEQ ID NO: 8421381 - DNA, 22 bp, Homo sapiens
aaagtaacctagtaatagtgtc

SEQ ID NO: 8421382 - DNA, 22 bp, Homo sapiens
aagaacatgagttatgatgatt

SEQ ID NO: 8421383 - DNA, 22 bp, Homo sapiens
aagaacatgaagtcacaaatgc

SEQ ID NO: 8421384 - DNA, 22 bp, Homo sapiens
aagaacataacagaagctgtgt

SEQ ID NO: 8421385 - DNA, 22 bp, Homo sapiens
aagaacataacagaagctgtgt

SEQ ID NO: 8421386 - DNA, 22 bp, Homo sapiens
aagaacatgaacacaatgttta

SEQ ID NO: 8421387 - DNA, 22 bp, Homo sapiens
aagaacagttgggaggtgagcc

SEQ ID NO: 8421388 - DNA, 22 bp, Homo sapiens
aacccagagctggaggagagta

SEQ ID NO: 8421389 - DNA, 22 bp, Homo sapiens
aacccaggtctttggcttccag

SEQ ID NO: 8421390 - DNA, 22 bp, Homo sapiens
aaagccttcaagtagatgtaag

SEQ ID NO: 8421391 - DNA, 22 bp, Homo sapiens
aaagcctgtctggtcatagcta

SEQ ID NO: 8421392 - DNA, 22 bp, Homo sapiens
aaagccttctgtctagcagata

SEQ ID NO: 8421393 - DNA, 22 bp, Homo sapiens
aaagccttgagatcctatagtt

SEQ ID NO: 8421394 - DNA, 22 bp, Homo sapiens
aaagccttcttgtatcgagcca

SEQ ID NO: 8421395 - DNA, 22 bp, Homo sapiens
aaagccttcttcggtctgtgat

SEQ ID NO: 8421396 - DNA, 22 bp, Homo sapiens
aacatttgtttcgttatgtgaa

SEQ ID NO: 8421397 - DNA, 22 bp, Homo sapiens
aacccacaagcagctgtagccc

SEQ ID NO: 8421398 - DNA, 22 bp, Homo sapiens
aaagccttgggatttgtgatca

SEQ ID NO: 8421399 - DNA, 22 bp, Homo sapiens
aaagcctttgtctcaggctctg

SEQ ID NO: 8421400 - DNA, 22 bp, Homo sapiens
aaagccttttatgatcagttaa

SEQ ID NO: 8421401 - DNA, 22 bp, Homo sapiens
aaagccttttatgatcagttaa

SEQ ID NO: 8421402 - DNA, 22 bp, Homo sapiens
aaagccttttctgtttaacaca

SEQ ID NO: 8421403 - DNA, 22 bp, Homo sapiens
aacccgggaggcagaggttgtg

SEQ ID NO: 8421404 - DNA, 22 bp, Homo sapiens
aaccccaaaacctctgaagtgg

SEQ ID NO: 8421405 - DNA, 22 bp, Homo sapiens
aaccccaggctggaggagtctc

SEQ ID NO: 8421406 - DNA, 22 bp, Homo sapiens
aaaggcagagttgttggaggca

SEQ ID NO: 8421407 - DNA, 22 bp, Homo sapiens
aactgcaaaataatcaagttgt

SEQ ID NO: 8421408 - DNA, 21 bp, Homo sapiens
aactgcaaatgatgctggaga

SEQ ID NO: 8421409 - DNA, 21 bp, Homo sapiens
aactgcaaatcttagactgca

SEQ ID NO: 8421410 - DNA, 21 bp, Homo sapiens
aactgcaaatcttagactgca

SEQ ID NO: 8421411 - DNA, 22 bp, Homo sapiens
aactgcaaagccaatctcagga

SEQ ID NO: 8421412 - DNA, 23 bp, Homo sapiens
aaaggcaggcctaggacatattg

SEQ ID NO: 8421413 - DNA, 22 bp, Homo sapiens
aaaggcagtgggtatgtggatc

SEQ ID NO: 8421414 - DNA, 22 bp, Homo sapiens
aaaggcagtgggtatgtggatc

SEQ ID NO: 8421415 - DNA, 22 bp, Homo sapiens
aaaggcagtgggtatgtggatc

SEQ ID NO: 8421416 - DNA, 22 bp, Homo sapiens
aacactttcctgcctttctgat

SEQ ID NO: 8421417 - DNA, 22 bp, Homo sapiens
aaagcacttcaggagcagtttg

SEQ ID NO: 8421418 - DNA, 22 bp, Homo sapiens
aaagcactgcacatatatttgc

SEQ ID NO: 8421419 - DNA, 22 bp, Homo sapiens
aaagcactgcacatatatttgc

SEQ ID NO: 8421420 - DNA, 22 bp, Homo sapiens
aaagcagactgatttgcatcac

SEQ ID NO: 8421421 - DNA, 22 bp, Homo sapiens
aaagcagactgatttgcatcac

SEQ ID NO: 8421422 - DNA, 22 bp, Homo sapiens
aaagcagagcagggcacttatg

SEQ ID NO: 8421423 - DNA, 22 bp, Homo sapiens
aaagcagagatcatggcttgta

SEQ ID NO: 8421424 - DNA, 22 bp, Homo sapiens
aaagcactttgagactgacagg

SEQ ID NO: 8421425 - DNA, 22 bp, Homo sapiens
aaagcagaggtgatatgactta

SEQ ID NO: 8421426 - DNA, 19 bp, Homo sapiens
aaagcagaggagcatctga

SEQ ID NO: 8421427 - DNA, 22 bp, Homo sapiens
aaagcagattctgatgcagtag

SEQ ID NO: 8421428 - DNA, 22 bp, Homo sapiens
aacagtgaggtgaatatgctcc

SEQ ID NO: 8421429 - DNA, 22 bp, Homo sapiens
aaagcagcaaatacttttgcac

SEQ ID NO: 8421430 - DNA, 22 bp, Homo sapiens
aacataaatttgaagtggcaaa

SEQ ID NO: 8421431 - DNA, 22 bp, Homo sapiens
aacatagagacaggaagtgctt

SEQ ID NO: 8421432 - DNA, 22 bp, Homo sapiens
aaagccattgcagagcaggatt

SEQ ID NO: 8421433 - DNA, 22 bp, Homo sapiens
aaagccattgaactgtacttta

SEQ ID NO: 8421434 - DNA, 22 bp, Homo sapiens
aaagccattacaaaatttcata

SEQ ID NO: 8421435 - DNA, 22 bp, Homo sapiens
aacatacttatactaaataatg

SEQ ID NO: 8421436 - DNA, 22 bp, Homo sapiens
aaagattaaatcaaattggtca

SEQ ID NO: 8421437 - DNA, 21 bp, Homo sapiens
aaagatgtttcttttcctcac

SEQ ID NO: 8421438 - DNA, 22 bp, Homo sapiens
aaagattaggcggcaactgggc

SEQ ID NO: 8421439 - DNA, 22 bp, Homo sapiens
aaagattatggaacacacatga

SEQ ID NO: 8421440 - DNA, 22 bp, Homo sapiens
aaagattgaaagagaatttgtc

SEQ ID NO: 8421441 - DNA, 22 bp, Homo sapiens
aaagatttaagaataatttgtg

SEQ ID NO: 8421442 - DNA, 22 bp, Homo sapiens
aaagatttatgaagttcaatta

SEQ ID NO: 8421443 - DNA, 22 bp, Homo sapiens
aacacttctcatcactgcaagc

SEQ ID NO: 8421444 - DNA, 22 bp, Homo sapiens
aacactgtcttatacttcaatg

SEQ ID NO: 8421445 - DNA, 23 bp, Homo sapiens
aacaccaaggctcagagagataa

SEQ ID NO: 8421446 - DNA, 22 bp, Homo sapiens
aaagcaagtctctacaaagtac

SEQ ID NO: 8421447 - DNA, 23 bp, Homo sapiens
aaagcaaggaattggcaacagag

SEQ ID NO: 8421448 - DNA, 23 bp, Homo sapiens
aaagcaaggaattggcaacagag

SEQ ID NO: 8421449 - DNA, 22 bp, Homo sapiens
aaagcaagatgcatccgtcaag

SEQ ID NO: 8421450 - DNA, 23 bp, Homo sapiens
aaagcaaggaattggcaacagag

SEQ ID NO: 8421451 - DNA, 22 bp, Homo sapiens
aaagcaagatgcatccgtcaag

SEQ ID NO: 8421452 - DNA, 22 bp, Homo sapiens
aaagaaatagatggcatttaaa

SEQ ID NO: 8421453 - DNA, 22 bp, Homo sapiens
aaagaaatagatggcatttaaa

SEQ ID NO: 8421454 - DNA, 22 bp, Homo sapiens
aaagaaatagatggcatttaaa

SEQ ID NO: 8421455 - DNA, 22 bp, Homo sapiens
aaagaaatacctttctcagctt

SEQ ID NO: 8421456 - DNA, 21 bp, Homo sapiens
aaagaaatctcccattggtag

SEQ ID NO: 8421457 - DNA, 22 bp, Homo sapiens
aaagaacaaattagctgtttta

SEQ ID NO: 8421458 - DNA, 22 bp, Homo sapiens
aaagaacaaatgatatatggtt

SEQ ID NO: 8421459 - DNA, 22 bp, Homo sapiens
aaagaaatacctttctcagctt

SEQ ID NO: 8421460 - DNA, 22 bp, Homo sapiens
aaagaaacctatcagccacatg

SEQ ID NO: 8421461 - DNA, 22 bp, Homo sapiens
aaagaaacctatcagccacatg

SEQ ID NO: 8421462 - DNA, 22 bp, Homo sapiens
aaagaaacctatcagccacatg

SEQ ID NO: 8421463 - DNA, 22 bp, Homo sapiens
aaactttttattctaatgtcta

SEQ ID NO: 8421464 - DNA, 22 bp, Homo sapiens
aaacttttttaggttcataggc

SEQ ID NO: 8421465 - DNA, 22 bp, Homo sapiens
aaatagtttagctctcatttca

SEQ ID NO: 8421466 - DNA, 22 bp, Homo sapiens
aaatagtttagctctcatttca

SEQ ID NO: 8421467 - DNA, 22 bp, Homo sapiens
aaacttttcctgctcttgtcct

SEQ ID NO: 8421468 - DNA, 22 bp, Homo sapiens
aaacttttcctgctcttgtcct

SEQ ID NO: 8421469 - DNA, 22 bp, Homo sapiens
aaactttgttcgtccagactca

SEQ ID NO: 8421470 - DNA, 22 bp, Homo sapiens
aaatagttagccctgcatatat

SEQ ID NO: 8421471 - DNA, 22 bp, Homo sapiens
aaatagttcagcttgtaaaccc

SEQ ID NO: 8421472 - DNA, 22 bp, Homo sapiens
aaatagttcagcttgtaaaccc

SEQ ID NO: 8421473 - DNA, 22 bp, Homo sapiens
aaagagaaaatgatctgtacat

SEQ ID NO: 8421474 - DNA, 21 bp, Homo sapiens
aaagagacaaatggcatatac

SEQ ID NO: 8421475 - DNA, 22 bp, Homo sapiens
aaagagacaccaaagactctag

SEQ ID NO: 8421476 - DNA, 23 bp, Homo sapiens
aaagagactgatacggaagttcc

SEQ ID NO: 8421477 - DNA, 22 bp, Homo sapiens
aaagagcaagctgagatttgaa

SEQ ID NO: 8421478 - DNA, 22 bp, Homo sapiens
aaagagcaagggctttgaggct

SEQ ID NO: 8421479 - DNA, 23 bp, Homo sapiens
aaagatgttcccaaagttcacgt

SEQ ID NO: 8421480 - DNA, 21 bp, Homo sapiens
aaagatgtttcatctgagaaa

SEQ ID NO: 8421481 - DNA, 22 bp, Homo sapiens
aaagagcaagggctttgaggct

SEQ ID NO: 8421482 - DNA, 22 bp, Homo sapiens
aaagacttgggagcagtatgct

SEQ ID NO: 8421483 - DNA, 22 bp, Homo sapiens
aaagactttcacctagcaaaga

SEQ ID NO: 8421484 - DNA, 22 bp, Homo sapiens
aaagactttcacctagcaaaga

SEQ ID NO: 8421485 - DNA, 22 bp, Homo sapiens
aaagactttaggttagaggcat

SEQ ID NO: 8421486 - DNA, 22 bp, Homo sapiens
aaagactttcacctagcaaaga

SEQ ID NO: 8421487 - DNA, 23 bp, Homo sapiens
aaagactgctgagaattttagga

SEQ ID NO: 8421488 - DNA, 22 bp, Homo sapiens
aaagactgaggggaaagtgatg

SEQ ID NO: 8421489 - DNA, 23 bp, Homo sapiens
aaagactctccagagggaagtag

SEQ ID NO: 8421490 - DNA, 22 bp, Homo sapiens
aaagactagcatttatatgtac

SEQ ID NO: 8421491 - DNA, 22 bp, Homo sapiens
aaagactcaattgttccctaat

SEQ ID NO: 8421492 - DNA, 22 bp, Homo sapiens
aaagacatgacacattggagag

SEQ ID NO: 8421493 - DNA, 22 bp, Homo sapiens
aaagaacaaatgatatatggtt

SEQ ID NO: 8421494 - DNA, 22 bp, Homo sapiens
aaagaacaaattagctgtttta

SEQ ID NO: 8421495 - DNA, 22 bp, Homo sapiens
aaagaacaaattagctgtttta

SEQ ID NO: 8421496 - DNA, 22 bp, Homo sapiens
aaagaacaatgtggaatctcct

SEQ ID NO: 8421497 - DNA, 22 bp, Homo sapiens
aaagaacagatgtgtggtgcat

SEQ ID NO: 8421498 - DNA, 21 bp, Homo sapiens
aaagaacaggcagatgttctt

SEQ ID NO: 8421499 - DNA, 22 bp, Homo sapiens
aaagaacaatgtggaatctcct

SEQ ID NO: 8421500 - DNA, 22 bp, Homo sapiens
aaagccagcaaggtgagtttca

SEQ ID NO: 8421501 - DNA, 22 bp, Homo sapiens
aaagccagagtgtgttagagac

SEQ ID NO: 8421502 - DNA, 22 bp, Homo sapiens
aaagccagaattcgtccagcct

SEQ ID NO: 8421503 - DNA, 22 bp, Homo sapiens
aaagccagagcaagctgtcaca

SEQ ID NO: 8421504 - DNA, 22 bp, Homo sapiens
aaagccactgcatgtgtagtat

SEQ ID NO: 8421505 - DNA, 22 bp, Homo sapiens
aaacagataatgctataaatgg

SEQ ID NO: 8421506 - DNA, 22 bp, Homo sapiens
aaacagataagggacaatttca

SEQ ID NO: 8421507 - DNA, 22 bp, Homo sapiens
aaacagagggccactgaggctc

SEQ ID NO: 8421508 - DNA, 22 bp, Homo sapiens
aaacagagtttggtaaatagcc

SEQ ID NO: 8421509 - DNA, 22 bp, Homo sapiens
aaacactgtgggacatcttact

SEQ ID NO: 8421510 - DNA, 22 bp, Homo sapiens
aaagccaggctggcctggggtt

SEQ ID NO: 8421511 - DNA, 22 bp, Homo sapiens
aaagccaggcagccaagccagt

SEQ ID NO: 8421512 - DNA, 22 bp, Homo sapiens
aaagccaggaggagggcgctcg

SEQ ID NO: 8421513 - DNA, 22 bp, Homo sapiens
aaagccagctctgagctgcacc

SEQ ID NO: 8421514 - DNA, 22 bp, Homo sapiens
aaacagatgagttataatagcc

SEQ ID NO: 8421515 - DNA, 22 bp, Homo sapiens
aaacagattgaaattcgtagta

SEQ ID NO: 8421516 - DNA, 22 bp, Homo sapiens
aaacagcagctgtttaatttgc

SEQ ID NO: 8421517 - DNA, 22 bp, Homo sapiens
aaacagctaagtacattcaagg

SEQ ID NO: 8421518 - DNA, 22 bp, Homo sapiens
aaacatctcaaagaggtatttg

SEQ ID NO: 8421519 - DNA, 22 bp, Homo sapiens
aaacagctcaagaagttactct

SEQ ID NO: 8421520 - DNA, 22 bp, Homo sapiens
aaacagctggtctcaaatgttc

SEQ ID NO: 8421521 - DNA, 22 bp, Homo sapiens
aaacattgagcacttgctattt

SEQ ID NO: 8421522 - DNA, 22 bp, Homo sapiens
aaactgcaattatgtttgcaga

SEQ ID NO: 8421523 - DNA, 22 bp, Homo sapiens
aaactgcaattacttttgcagc

SEQ ID NO: 8421524 - DNA, 22 bp, Homo sapiens
aaactgcaattacttttgcacc

SEQ ID NO: 8421525 - DNA, 22 bp, Homo sapiens
aaactgtatatttatggcatgt

SEQ ID NO: 8421526 - DNA, 22 bp, Homo sapiens
aaactgtatatttatggcatgt

SEQ ID NO: 8421527 - DNA, 22 bp, Homo sapiens
aaactgtaagagaataaactac

SEQ ID NO: 8421528 - DNA, 22 bp, Homo sapiens
aaactgtatagggaaaagtaga

SEQ ID NO: 8421529 - DNA, 22 bp, Homo sapiens
aaacattagacaccatatgctc

SEQ ID NO: 8421530 - DNA, 22 bp, Homo sapiens
aaacattagacaccatatgctc

SEQ ID NO: 8421531 - DNA, 22 bp, Homo sapiens
aaacattcacatttgctagtaa

SEQ ID NO: 8421532 - DNA, 22 bp, Homo sapiens
aaacattcaaagcaggatgtgt

SEQ ID NO: 8421533 - DNA, 20 bp, Homo sapiens
aaacattcatgtacaagtga

SEQ ID NO: 8421534 - DNA, 20 bp, Homo sapiens
aaacattcatgtacaagtga

SEQ ID NO: 8421535 - DNA, 22 bp, Homo sapiens
aaacatgctggatttagaatat

SEQ ID NO: 8421536 - DNA, 22 bp, Homo sapiens
aaacatgtaagttcagatcacc

SEQ ID NO: 8421537 - DNA, 22 bp, Homo sapiens
aaacatgtaattctgcttaaga

SEQ ID NO: 8421538 - DNA, 22 bp, Homo sapiens
aaaacctgattgaattctattt

SEQ ID NO: 8421539 - DNA, 22 bp, Homo sapiens
aaaacataaactgacagcccat

SEQ ID NO: 8421540 - DNA, 22 bp, Homo sapiens
aaaaccatgtatctatttcctt

SEQ ID NO: 8421541 - DNA, 22 bp, Homo sapiens
aaaactcctgaaattgtttccc

SEQ ID NO: 8421542 - DNA, 22 bp, Homo sapiens
aaaaccttctagactttatatt

SEQ ID NO: 8421543 - DNA, 22 bp, Homo sapiens
aaaaggctaatccagagcaact

SEQ ID NO: 8421544 - DNA, 22 bp, Homo sapiens
aaaaggctaattaagttttgga

SEQ ID NO: 8421545 - DNA, 22 bp, Homo sapiens
aaaaggctagctagtaacagaa

SEQ ID NO: 8421546 - DNA, 22 bp, Homo sapiens
aaaacagtttttgctaactgct

SEQ ID NO: 8421547 - DNA, 22 bp, Homo sapiens
aaaaggctcttcaaaatggaag

SEQ ID NO: 8421548 - DNA, 22 bp, Homo sapiens
aaaaggcagtgcaagagagggt

SEQ ID NO: 8421549 - DNA, 22 bp, Homo sapiens
aaaaggcagtgcaagagagggt

SEQ ID NO: 8421550 - DNA, 22 bp, Homo sapiens
aaaaggatgttttcatgaaaca

SEQ ID NO: 8421551 - DNA, 22 bp, Homo sapiens
aaaaggcatggaggttgatagt

SEQ ID NO: 8421552 - DNA, 22 bp, Homo sapiens
aaaaatacttcacttctgggtg

SEQ ID NO: 8421553 - DNA, 22 bp, Homo sapiens
aaaaatacttcacttctgggtg

SEQ ID NO: 8421554 - DNA, 22 bp, Homo sapiens
aaaaatacttcacttctgggtg

SEQ ID NO: 8421555 - DNA, 21 bp, Homo sapiens
aaaaggaggcaggtgaacagc

SEQ ID NO: 8421556 - DNA, 22 bp, Homo sapiens
aaaaactgcaattacttttgtc

SEQ ID NO: 8421557 - DNA, 22 bp, Homo sapiens
aaaaactgcaattacttttgtc

SEQ ID NO: 8421558 - DNA, 22 bp, Homo sapiens
aaaaagatgtcctgaagtttag

SEQ ID NO: 8421559 - DNA, 22 bp, Homo sapiens
aaaaagcttaaatgagcagttc

SEQ ID NO: 8421560 - DNA, 21 bp, Homo sapiens
aaaaagctggggcatgcatgc

SEQ ID NO: 8421561 - DNA, 21 bp, Homo sapiens
aaaaagctggggcatgcatgc

SEQ ID NO: 8421562 - DNA, 22 bp, Homo sapiens
aaaaagtattggccatggttga

SEQ ID NO: 8421563 - DNA, 22 bp, Homo sapiens
aaaaagggatttgtgatccagg

SEQ ID NO: 8421564 - DNA, 22 bp, Homo sapiens
aaaaaggctaagcatcttgtgc

SEQ ID NO: 8421565 - DNA, 22 bp, Homo sapiens
aaaattaagtgtctgggaagcc

SEQ ID NO: 8421566 - DNA, 22 bp, Homo sapiens
aaaattactattgttcctgggc

SEQ ID NO: 8421567 - DNA, 22 bp, Homo sapiens
aaaattatggagtatcccaaag

SEQ ID NO: 8421568 - DNA, 22 bp, Homo sapiens
aaaattcatggcttgggaaaag

SEQ ID NO: 8421569 - DNA, 22 bp, Homo sapiens
aaaattcatagaactgtacgct

SEQ ID NO: 8421570 - DNA, 22 bp, Homo sapiens
aaaactttcagggatacagaaa

SEQ ID NO: 8421571 - DNA, 22 bp, Homo sapiens
aaaacttagctaggcaagtttt

SEQ ID NO: 8421572 - DNA, 22 bp, Homo sapiens
aaaagaacctagctcctcagtc

SEQ ID NO: 8421573 - DNA, 22 bp, Homo sapiens
aaaatgtgtttatgcatttcgt

SEQ ID NO: 8421574 - DNA, 22 bp, Homo sapiens
aaaatgttcaagcatgctggtt

SEQ ID NO: 8421575 - DNA, 22 bp, Homo sapiens
aaaagtaattgcagttttgtca

SEQ ID NO: 8421576 - DNA, 22 bp, Homo sapiens
aaacaggcatcactcagcaaag

SEQ ID NO: 8421577 - DNA, 22 bp, Homo sapiens
aaacaggcacatagtaacattt

SEQ ID NO: 8421578 - DNA, 22 bp, Homo sapiens
aaacaggcacatagtaacattt

SEQ ID NO: 8421579 - DNA, 22 bp, Homo sapiens
aaacaggcttatattttgctct

SEQ ID NO: 8421580 - DNA, 22 bp, Homo sapiens
aaacaggcgcttactaagaaaa

SEQ ID NO: 8421581 - DNA, 22 bp, Homo sapiens
aaacaggcttgcaacatgtttt

SEQ ID NO: 8421582 - DNA, 22 bp, Homo sapiens
aaacagtaagttctagtattat

SEQ ID NO: 8421583 - DNA, 22 bp, Homo sapiens
aaacagtactcgatttttgtag

SEQ ID NO: 8421584 - DNA, 22 bp, Homo sapiens
aaacagtattatcaatatattt

SEQ ID NO: 8421585 - DNA, 22 bp, Homo sapiens
aaacagtattatcaatatattt

SEQ ID NO: 8421586 - DNA, 22 bp, Homo sapiens
aaacagtagaagtgtattttat

SEQ ID NO: 8421587 - DNA, 22 bp, Homo sapiens
aaaatactgtggagtgttgaaa

SEQ ID NO: 8421588 - DNA, 22 bp, Homo sapiens
aaaatactgtggagtgttgaaa

SEQ ID NO: 8421589 - DNA, 22 bp, Homo sapiens
aaaatactgtggagtgttgaaa

SEQ ID NO: 8421590 - DNA, 22 bp, Homo sapiens
aaaatatgactgtgctccttaa

SEQ ID NO: 8421591 - DNA, 20 bp, Homo sapiens
aaaatatgtataactcttct

SEQ ID NO: 8421592 - DNA, 22 bp, Homo sapiens
aaactggtaataaaatggatta

SEQ ID NO: 8421593 - DNA, 22 bp, Homo sapiens
aaactgggttgtggtcagtggt

SEQ ID NO: 8421594 - DNA, 22 bp, Homo sapiens
aaactggtaatcggcaagtgag

SEQ ID NO: 8421595 - DNA, 22 bp, Homo sapiens
aaactggtagcaatttaagggt

SEQ ID NO: 8421596 - DNA, 22 bp, Homo sapiens
aaactgggattcttcacaaggt

SEQ ID NO: 8421597 - DNA, 22 bp, Homo sapiens
aaactgggattcttcacaaggt

SEQ ID NO: 8421598 - DNA, 22 bp, Homo sapiens
aaactgggattcttcacaaggt

SEQ ID NO: 8421599 - DNA, 17 bp, Homo sapiens
aaactggggtcaggagc

SEQ ID NO: 8421600 - DNA, 17 bp, Homo sapiens
aaactggggtcaggagc

SEQ ID NO: 8421601 - DNA, 22 bp, Homo sapiens
aaactggattaccaggctggtg

SEQ ID NO: 8421602 - DNA, 22 bp, Homo sapiens
aaactgcctcctgggcaactaa

SEQ ID NO: 8421603 - DNA, 22 bp, Homo sapiens
aaactgccacaagagggacatc

SEQ ID NO: 8421604 - DNA, 22 bp, Homo sapiens
aaactgccaaaagaccttggat

SEQ ID NO: 8421605 - DNA, 22 bp, Homo sapiens
aaactgcatgaagctgatttta

SEQ ID NO: 8421606 - DNA, 23 bp, Homo sapiens
aaactgcatctctgagcctcagc

SEQ ID NO: 8421607 - DNA, 22 bp, Homo sapiens
aaactgcagccttgagttcagg

SEQ ID NO: 8421608 - DNA, 22 bp, Homo sapiens
aaactgcaggtcatgacccatt

SEQ ID NO: 8421609 - DNA, 22 bp, Homo sapiens
aaaatattttagggccaggaga

SEQ ID NO: 8421610 - DNA, 22 bp, Homo sapiens
aaactgcacacgatgtgcctga

SEQ ID NO: 8421611 - DNA, 22 bp, Homo sapiens
aaactgcacatgaggctggtgc

SEQ ID NO: 8421612 - DNA, 22 bp, Homo sapiens
aaactgcactttattttgtcaa

SEQ ID NO: 8421613 - DNA, 22 bp, Homo sapiens
aaactgcagagccatggttcaa

SEQ ID NO: 8421614 - DNA, 22 bp, Homo sapiens
aaactgcacaagggtgcatagc

SEQ ID NO: 8421615 - DNA, 22 bp, Homo sapiens
aaactgcaattatttttgcaat

SEQ ID NO: 8421616 - DNA, 22 bp, Homo sapiens
aaaatattttagggccaggaga

SEQ ID NO: 8421617 - DNA, 22 bp, Homo sapiens
aaacaccagcactgtttacaaa

SEQ ID NO: 8421618 - DNA, 22 bp, Homo sapiens
aaacaccagcactgtttacaaa

SEQ ID NO: 8421619 - DNA, 22 bp, Homo sapiens
aaacacattttaggaaaatcta

SEQ ID NO: 8421620 - DNA, 22 bp, Homo sapiens
aaacaccaagagctagctatta

SEQ ID NO: 8421621 - DNA, 22 bp, Homo sapiens
aaagagctgggacttaaagtgc

SEQ ID NO: 8421622 - DNA, 22 bp, Homo sapiens
aaagagctgggacttaaagtgc

SEQ ID NO: 8421623 - DNA, 22 bp, Homo sapiens
aaacacatcattcatgtcgtca

SEQ ID NO: 8421624 - DNA, 22 bp, Homo sapiens
aaacacaagatggcctcttctg

SEQ ID NO: 8421625 - DNA, 22 bp, Homo sapiens
aaagagctcttactctagtgta

SEQ ID NO: 8421626 - DNA, 22 bp, Homo sapiens
aaaattcattcctcagactgcc

SEQ ID NO: 8421627 - DNA, 17 bp, Homo sapiens
aaaattctgtaaagagg

SEQ ID NO: 8421628 - DNA, 22 bp, Homo sapiens
aaagagcccttccatgactctt

SEQ ID NO: 8421629 - DNA, 22 bp, Homo sapiens
aactggtagctgattaagtata

SEQ ID NO: 8421630 - DNA, 22 bp, Homo sapiens
aactggtagaaagcagtaagtg

SEQ ID NO: 8421631 - DNA, 22 bp, Homo sapiens
aactggtatctcttcagtgtaa

SEQ ID NO: 8421632 - DNA, 22 bp, Homo sapiens
aactggtagaaagcagtaagtg

SEQ ID NO: 8421633 - DNA, 22 bp, Homo sapiens
aactggtatggtgagaagagag

SEQ ID NO: 8421634 - DNA, 22 bp, Homo sapiens
aactggtatggtgagaagagag

SEQ ID NO: 8421635 - DNA, 22 bp, Homo sapiens
aactttctgttacgtccccaga

SEQ ID NO: 8421636 - DNA, 22 bp, Homo sapiens
aactggtgagataaattattta

SEQ ID NO: 8421637 - DNA, 22 bp, Homo sapiens
aactttctggctttggggagag

SEQ ID NO: 8421638 - DNA, 22 bp, Homo sapiens
aactttctgtctgagctgcaga

SEQ ID NO: 8421639 - DNA, 22 bp, Homo sapiens
aactggatcagttgagggaggc

SEQ ID NO: 8421640 - DNA, 22 bp, Homo sapiens
aactggatttaggaacagagaa

SEQ ID NO: 8421641 - DNA, 22 bp, Homo sapiens
aactggattttgatgagcagtt

SEQ ID NO: 8421642 - DNA, 22 bp, Homo sapiens
aatggctttgacattttcaaat

SEQ ID NO: 8421643 - DNA, 22 bp, Homo sapiens
aatggcttttaaaaatagcatt

SEQ ID NO: 8421644 - DNA, 22 bp, Homo sapiens
aatgggaaaagagtatgattta

SEQ ID NO: 8421645 - DNA, 22 bp, Homo sapiens
aactggaaagatcagtaggaag

SEQ ID NO: 8421646 - DNA, 22 bp, Homo sapiens
aactggaagagtgaatataact

SEQ ID NO: 8421647 - DNA, 22 bp, Homo sapiens
aactggaaggattgcagatgtc

SEQ ID NO: 8421648 - DNA, 22 bp, Homo sapiens
aactggaatagcacaggaaaag

SEQ ID NO: 8421649 - DNA, 22 bp, Homo sapiens
aagaaaacatgatctaatttaa

SEQ ID NO: 8421650 - DNA, 22 bp, Homo sapiens
aagaaaacatgatctaatttaa

SEQ ID NO: 8421651 - DNA, 22 bp, Homo sapiens
aagaaaacaatgacttgccagc

SEQ ID NO: 8421652 - DNA, 22 bp, Homo sapiens
aagaaaacaatgacttgccagc

SEQ ID NO: 8421653 - DNA, 22 bp, Homo sapiens
aagaaaatcagttctggtcagt

SEQ ID NO: 8421654 - DNA, 22 bp, Homo sapiens
aagaaaccaaccctgccagcac

SEQ ID NO: 8421655 - DNA, 22 bp, Homo sapiens
aagaaaccaaccctgccagcac

SEQ ID NO: 8421656 - DNA, 22 bp, Homo sapiens
aagaaacaaccactgctctcct

SEQ ID NO: 8421657 - DNA, 22 bp, Homo sapiens
aagaaactgttgcgtgacagcg

SEQ ID NO: 8421658 - DNA, 22 bp, Homo sapiens
aagaaactgttgcgtgacagcg

SEQ ID NO: 8421659 - DNA, 22 bp, Homo sapiens
aagaaacctagtctggagcagc

SEQ ID NO: 8421660 - DNA, 22 bp, Homo sapiens
aagaaacctagtctggagcagc

SEQ ID NO: 8421661 - DNA, 22 bp, Homo sapiens
aagaaactgaaagtggcttcat

SEQ ID NO: 8421662 - DNA, 22 bp, Homo sapiens
aagaaactggaatatagagagc

SEQ ID NO: 8421663 - DNA, 22 bp, Homo sapiens
aagaaactggaatatagagagc

SEQ ID NO: 8421664 - DNA, 22 bp, Homo sapiens
aattcctagttgtacttagtga

SEQ ID NO: 8421665 - DNA, 22 bp, Homo sapiens
aattctaaatgtaatttagaat

SEQ ID NO: 8421666 - DNA, 22 bp, Homo sapiens
aattctataggcaagctatttt

SEQ ID NO: 8421667 - DNA, 22 bp, Homo sapiens
aattctcaggaatttcatctgt

SEQ ID NO: 8421668 - DNA, 21 bp, Homo sapiens
aagaaagataattaaggaccc

SEQ ID NO: 8421669 - DNA, 22 bp, Homo sapiens
aagaaatgtagagcctagtaaa

SEQ ID NO: 8421670 - DNA, 22 bp, Homo sapiens
aattctgagaacaaaaggtact

SEQ ID NO: 8421671 - DNA, 22 bp, Homo sapiens
aagaaatgtgaatattgaatag

SEQ ID NO: 8421672 - DNA, 22 bp, Homo sapiens
aagaaatgtgaatattgaatag

SEQ ID NO: 8421673 - DNA, 22 bp, Homo sapiens
aagaacaactgctttaaaagca

SEQ ID NO: 8421674 - DNA, 22 bp, Homo sapiens
aagaacaactgctttaaaagca

SEQ ID NO: 8421675 - DNA, 22 bp, Homo sapiens
aagaacaactgctttaaaagca

SEQ ID NO: 8421676 - DNA, 22 bp, Homo sapiens
aatttacacttcatttggaggg

SEQ ID NO: 8421677 - DNA, 22 bp, Homo sapiens
aatttaagagcatagctccaac

SEQ ID NO: 8421678 - DNA, 22 bp, Homo sapiens
aagaacagattcagcctgaact

SEQ ID NO: 8421679 - DNA, 17 bp, Homo sapiens
aagaacactcaatagca

SEQ ID NO: 8421680 - DNA, 22 bp, Homo sapiens
aagaacaactgctttaaaagca

SEQ ID NO: 8421681 - DNA, 22 bp, Homo sapiens
acacaaaatcaaagtcctaggc

SEQ ID NO: 8421682 - DNA, 21 bp, Homo sapiens
acacaaacctcctcagcctgg

SEQ ID NO: 8421683 - DNA, 21 bp, Homo sapiens
acacaaacctcctcagcctgg

SEQ ID NO: 8421684 - DNA, 21 bp, Homo sapiens
acacaaacctcctcagcctgg

SEQ ID NO: 8421685 - DNA, 22 bp, Homo sapiens
acacaaacagtctatagcacca

SEQ ID NO: 8421686 - DNA, 22 bp, Homo sapiens
acacaaagttggatgacaaaat

SEQ ID NO: 8421687 - DNA, 22 bp, Homo sapiens
acacaaagttggatgacaaaat

SEQ ID NO: 8421688 - DNA, 22 bp, Homo sapiens
acacaaactgctagaaaattgg

SEQ ID NO: 8421689 - DNA, 20 bp, Homo sapiens
acacaaagcaatggagtaca

SEQ ID NO: 8421690 - DNA, 22 bp, Homo sapiens
acacaaagttggatgacaaaat

SEQ ID NO: 8421691 - DNA, 22 bp, Homo sapiens
aagagcagcctccaggggtgga

SEQ ID NO: 8421692 - DNA, 22 bp, Homo sapiens
aagagaatacaagcaggcagga

SEQ ID NO: 8421693 - DNA, 22 bp, Homo sapiens
aagagacagagccatgtttcta

SEQ ID NO: 8421694 - DNA, 22 bp, Homo sapiens
aagagaatgacaaggagaacct

SEQ ID NO: 8421695 - DNA, 22 bp, Homo sapiens
aagagacaagaattccaacgct

SEQ ID NO: 8421696 - DNA, 22 bp, Homo sapiens
acacaaaatcaaagtcctaggc

SEQ ID NO: 8421697 - DNA, 22 bp, Homo sapiens
acacaaaatcaaagtcctaggc

SEQ ID NO: 8421698 - DNA, 21 bp, Homo sapiens
aagagacatttctcatcagca

SEQ ID NO: 8421699 - DNA, 22 bp, Homo sapiens
aagagacatgaatactcgaagg

SEQ ID NO: 8421700 - DNA, 22 bp, Homo sapiens
aagagacatgaatactcgaagg

SEQ ID NO: 8421701 - DNA, 22 bp, Homo sapiens
aagagactggaaactagggtca

SEQ ID NO: 8421702 - DNA, 22 bp, Homo sapiens
aagagactatggtgtctatgaa

SEQ ID NO: 8421703 - DNA, 21 bp, Homo sapiens
aagagacatttctcatcagca

SEQ ID NO: 8421704 - DNA, 21 bp, Homo sapiens
aagagacatttctcatcagca

SEQ ID NO: 8421705 - DNA, 22 bp, Homo sapiens
aattttactaatctgagtgtga

SEQ ID NO: 8421706 - DNA, 22 bp, Homo sapiens
aattttacataggggatatggg

SEQ ID NO: 8421707 - DNA, 20 bp, Homo sapiens
aattttactgtcctatagag

SEQ ID NO: 8421708 - DNA, 22 bp, Homo sapiens
aattttacaaaatacctccgat

SEQ ID NO: 8421709 - DNA, 22 bp, Homo sapiens
aattttacaagaaggcctcgta

SEQ ID NO: 8421710 - DNA, 22 bp, Homo sapiens
aatttccagatcagatgactca

SEQ ID NO: 8421711 - DNA, 22 bp, Homo sapiens
aatttcagaggtagagattcta

SEQ ID NO: 8421712 - DNA, 22 bp, Homo sapiens
aatttccaaatttctgtcacac

SEQ ID NO: 8421713 - DNA, 22 bp, Homo sapiens
aattttacttccctcagtgtag

SEQ ID NO: 8421714 - DNA, 20 bp, Homo sapiens
aattttatctccatcctttg

SEQ ID NO: 8421715 - DNA, 22 bp, Homo sapiens
aattttatctctaagcaggctt

SEQ ID NO: 8421716 - DNA, 22 bp, Homo sapiens
aattttatctctaagcaggctt

SEQ ID NO: 8421717 - DNA, 22 bp, Homo sapiens
aagacttgaccaggttgaaggc

SEQ ID NO: 8421718 - DNA, 22 bp, Homo sapiens
aagagaacagtcaccatgcaca

SEQ ID NO: 8421719 - DNA, 22 bp, Homo sapiens
aagcaagacagaagttactgcc

SEQ ID NO: 8421720 - DNA, 22 bp, Homo sapiens
aagcaagaggaaatgtggacct

SEQ ID NO: 8421721 - DNA, 22 bp, Homo sapiens
aagcaagagttggagtgatgtt

SEQ ID NO: 8421722 - DNA, 22 bp, Homo sapiens
aagatgtgctgtcttgccactc

SEQ ID NO: 8421723 - DNA, 22 bp, Homo sapiens
aagcaaggcccagagcatcagc

SEQ ID NO: 8421724 - DNA, 19 bp, Homo sapiens
aagcaagctttgagtgggt

SEQ ID NO: 8421725 - DNA, 22 bp, Homo sapiens
aagcaagcccaggctcagtcaa

SEQ ID NO: 8421726 - DNA, 22 bp, Homo sapiens
aagcaagccaatctgttttgtt

SEQ ID NO: 8421727 - DNA, 22 bp, Homo sapiens
aagcaagctgttggcaataggg

SEQ ID NO: 8421728 - DNA, 22 bp, Homo sapiens
aagcaagcaaggtgttacatat

SEQ ID NO: 8421729 - DNA, 22 bp, Homo sapiens
aagcaagcagtgtggaatttta

SEQ ID NO: 8421730 - DNA, 22 bp, Homo sapiens
aagcaagagttggagtgatgtt

SEQ ID NO: 8421731 - DNA, 22 bp, Homo sapiens
aagatgaccctgagggcaattg

SEQ ID NO: 8421732 - DNA, 22 bp, Homo sapiens
aagatgacagatgcttagagtc

SEQ ID NO: 8421733 - DNA, 22 bp, Homo sapiens
aagatgactatttatctgtaag

SEQ ID NO: 8421734 - DNA, 21 bp, Homo sapiens
aagatgatattttatctgtag

SEQ ID NO: 8421735 - DNA, 22 bp, Homo sapiens
aagatgatgttgtgttttcact

SEQ ID NO: 8421736 - DNA, 22 bp, Homo sapiens
aagatgcttccactgcagtggc

SEQ ID NO: 8421737 - DNA, 22 bp, Homo sapiens
aagatggctgcagcaattccaa

SEQ ID NO: 8421738 - DNA, 22 bp, Homo sapiens
aagatgtgaacagaaccacagg

SEQ ID NO: 8421739 - DNA, 22 bp, Homo sapiens
aagatgtgcagttcatggcagg

SEQ ID NO: 8421740 - DNA, 22 bp, Homo sapiens
aagatgtaaaggcaatataaag

SEQ ID NO: 8421741 - DNA, 22 bp, Homo sapiens
acacattatctcattaaatact

SEQ ID NO: 8421742 - DNA, 22 bp, Homo sapiens
acacatgctccagtctccagga

SEQ ID NO: 8421743 - DNA, 22 bp, Homo sapiens
acacattcatgagtgcatgcac

SEQ ID NO: 8421744 - DNA, 22 bp, Homo sapiens
acacattatgagcagttgtctt

SEQ ID NO: 8421745 - DNA, 22 bp, Homo sapiens
acacattctttaaatgtctgtt

SEQ ID NO: 8421746 - DNA, 22 bp, Homo sapiens
acacattcctgcagacatgatg

SEQ ID NO: 8421747 - DNA, 22 bp, Homo sapiens
acacattcctgcagacatgatg

SEQ ID NO: 8421748 - DNA, 22 bp, Homo sapiens
acacatttattacatgcatgtg

SEQ ID NO: 8421749 - DNA, 22 bp, Homo sapiens
acacatttatggatcgcagaaa

SEQ ID NO: 8421750 - DNA, 22 bp, Homo sapiens
acacatttattacatgcatgtg

SEQ ID NO: 8421751 - DNA, 22 bp, Homo sapiens
aagatgaagaacatgagcacac

SEQ ID NO: 8421752 - DNA, 22 bp, Homo sapiens
aagatatagatggtggtataaa

SEQ ID NO: 8421753 - DNA, 22 bp, Homo sapiens
acacatgattaatgccaagcat

SEQ ID NO: 8421754 - DNA, 22 bp, Homo sapiens
acacatgcacaacagttctttc

SEQ ID NO: 8421755 - DNA, 22 bp, Homo sapiens
acacatgcgatagagaggtagg

SEQ ID NO: 8421756 - DNA, 22 bp, Homo sapiens
acacatgcaggtatacatgttc

SEQ ID NO: 8421757 - DNA, 22 bp, Homo sapiens
acacatgcaggtatacatgttc

SEQ ID NO: 8421758 - DNA, 22 bp, Homo sapiens
acacatgcaggtatacatgttc

SEQ ID NO: 8421759 - DNA, 22 bp, Homo sapiens
acacatgaggatgaggggatca

SEQ ID NO: 8421760 - DNA, 22 bp, Homo sapiens
acacatgagttctcatcttgtg

SEQ ID NO: 8421761 - DNA, 22 bp, Homo sapiens
acacatgaggaaggcctcaccc

SEQ ID NO: 8421762 - DNA, 19 bp, Homo sapiens
acacatgaggagggacccc

SEQ ID NO: 8421763 - DNA, 22 bp, Homo sapiens
acacatgataagaaagtttaaa

SEQ ID NO: 8421764 - DNA, 22 bp, Homo sapiens
acacatgagttctcatcttgtg

SEQ ID NO: 8421765 - DNA, 22 bp, Homo sapiens
acacatgacctccgcagcagca

SEQ ID NO: 8421766 - DNA, 22 bp, Homo sapiens
acacatgagaaacatcagttgt

SEQ ID NO: 8421767 - DNA, 22 bp, Homo sapiens
acacatgaatcactggtggaag

SEQ ID NO: 8421768 - DNA, 22 bp, Homo sapiens
acacatgaaataatattatgca

SEQ ID NO: 8421769 - DNA, 22 bp, Homo sapiens
acacatgaaagacattaaggtg

SEQ ID NO: 8421770 - DNA, 17 bp, Homo sapiens
acacatcttggctttgc

SEQ ID NO: 8421771 - DNA, 22 bp, Homo sapiens
aagagcaggacagaatcagaac

SEQ ID NO: 8421772 - DNA, 22 bp, Homo sapiens
aagagcaggctgctgtggagta

SEQ ID NO: 8421773 - DNA, 22 bp, Homo sapiens
aagcacccaatttacagcagtt

SEQ ID NO: 8421774 - DNA, 22 bp, Homo sapiens
aagcaccaccctcccaacctgt

SEQ ID NO: 8421775 - DNA, 22 bp, Homo sapiens
aagcaattgtcctgtctctaca

SEQ ID NO: 8421776 - DNA, 22 bp, Homo sapiens
aagcaattggttttagtaaaat

SEQ ID NO: 8421777 - DNA, 22 bp, Homo sapiens
aagcaattcacagttcacttaa

SEQ ID NO: 8421778 - DNA, 22 bp, Homo sapiens
aagcaatttgacagtacatatc

SEQ ID NO: 8421779 - DNA, 22 bp, Homo sapiens
aagcacaatttaggactgaaat

SEQ ID NO: 8421780 - DNA, 22 bp, Homo sapiens
aagcacaatttaggactgaaat

SEQ ID NO: 8421781 - DNA, 20 bp, Homo sapiens
aagcaatatagtgcaaatgt

SEQ ID NO: 8421782 - DNA, 22 bp, Homo sapiens
aagcaatatactgatatgatta

SEQ ID NO: 8421783 - DNA, 22 bp, Homo sapiens
aagcaatagggtaatctactca

SEQ ID NO: 8421784 - DNA, 22 bp, Homo sapiens
aagcaatagcaacaactttaca

SEQ ID NO: 8421785 - DNA, 22 bp, Homo sapiens
aagcagaatttcccactagttg

SEQ ID NO: 8421786 - DNA, 22 bp, Homo sapiens
aagcagaatttaatagaaaggt

SEQ ID NO: 8421787 - DNA, 22 bp, Homo sapiens
aagcagaactgggaagtagtgg

SEQ ID NO: 8421788 - DNA, 20 bp, Homo sapiens
aagcagaagctgctctcagc

SEQ ID NO: 8421789 - DNA, 22 bp, Homo sapiens
aagcagaaggggaataatattt

SEQ ID NO: 8421790 - DNA, 22 bp, Homo sapiens
aagcagaagttgatctaccata

SEQ ID NO: 8421791 - DNA, 22 bp, Homo sapiens
aagcagagcaagcgtatttatt

SEQ ID NO: 8421792 - DNA, 22 bp, Homo sapiens
acagcagagacactcaggaggc

SEQ ID NO: 8421793 - DNA, 22 bp, Homo sapiens
acagcagagacactcaggaggc

SEQ ID NO: 8421794 - DNA, 22 bp, Homo sapiens
acagcagagacactcaggaggc

SEQ ID NO: 8421795 - DNA, 22 bp, Homo sapiens
acagcagagaactttagagggt

SEQ ID NO: 8421796 - DNA, 22 bp, Homo sapiens
acagcagagacactcaggaggc

SEQ ID NO: 8421797 - DNA, 22 bp, Homo sapiens
aagcagaggaccgacggaggga

SEQ ID NO: 8421798 - DNA, 22 bp, Homo sapiens
aagcagaggccacagagtgggc

SEQ ID NO: 8421799 - DNA, 22 bp, Homo sapiens
aagcagaggccacagagtgggc

SEQ ID NO: 8421800 - DNA, 22 bp, Homo sapiens
aagcagaggccacagagtgggc

SEQ ID NO: 8421801 - DNA, 22 bp, Homo sapiens
acagcagaccccagtgccatgg

SEQ ID NO: 8421802 - DNA, 22 bp, Homo sapiens
acagcagaccccagtgccatgg

SEQ ID NO: 8421803 - DNA, 22 bp, Homo sapiens
acagcaaaagacaagaacttaa

SEQ ID NO: 8421804 - DNA, 22 bp, Homo sapiens
aagcagaggtagggtgtgcagt

SEQ ID NO: 8421805 - DNA, 22 bp, Homo sapiens
aagcagaggtagggtgtgcagt

SEQ ID NO: 8421806 - DNA, 22 bp, Homo sapiens
acagcctggactggctctctgc

SEQ ID NO: 8421807 - DNA, 22 bp, Homo sapiens
aagcaggaaggagcccagggca

SEQ ID NO: 8421808 - DNA, 22 bp, Homo sapiens
aagcaggaagctcaggtccttg

SEQ ID NO: 8421809 - DNA, 22 bp, Homo sapiens
acagcagagtggagatgagcac

SEQ ID NO: 8421810 - DNA, 22 bp, Homo sapiens
acagcagagtggagatgagcac

SEQ ID NO: 8421811 - DNA, 22 bp, Homo sapiens
acagcagagtggagatgagcac

SEQ ID NO: 8421812 - DNA, 22 bp, Homo sapiens
acagcagagtagttttccaact

SEQ ID NO: 8421813 - DNA, 22 bp, Homo sapiens
acagcagagtagttttccaact

SEQ ID NO: 8421814 - DNA, 22 bp, Homo sapiens
acagcagaggaaaagtctgata

SEQ ID NO: 8421815 - DNA, 22 bp, Homo sapiens
acagcagagcctggtacttact

SEQ ID NO: 8421816 - DNA, 22 bp, Homo sapiens
acagcagagcctagcttaatct

SEQ ID NO: 8421817 - DNA, 22 bp, Homo sapiens
aagcagctggaagagtaagatg

SEQ ID NO: 8421818 - DNA, 22 bp, Homo sapiens
aagcagcttaaattagagcctg

SEQ ID NO: 8421819 - DNA, 22 bp, Homo sapiens
aactagttttagctctagcaac

SEQ ID NO: 8421820 - DNA, 22 bp, Homo sapiens
aactagaacgagaaagctgaac

SEQ ID NO: 8421821 - DNA, 22 bp, Homo sapiens
aactagcagctaagacataatt

SEQ ID NO: 8421822 - DNA, 22 bp, Homo sapiens
aactagtaaaagcaacagtata

SEQ ID NO: 8421823 - DNA, 22 bp, Homo sapiens
aatggctctgatgttgttgtga

SEQ ID NO: 8421824 - DNA, 22 bp, Homo sapiens
aatggctctgatgttgttgtga

SEQ ID NO: 8421825 - DNA, 22 bp, Homo sapiens
aatggcttagcagagttagaag

SEQ ID NO: 8421826 - DNA, 22 bp, Homo sapiens
aatggcttctgaagcacacttt

SEQ ID NO: 8421827 - DNA, 22 bp, Homo sapiens
aatggctttaagtagtctcaca

SEQ ID NO: 8421828 - DNA, 22 bp, Homo sapiens
aatgaattgcagtactgacttg

SEQ ID NO: 8421829 - DNA, 22 bp, Homo sapiens
aatgacaagacatagtctctga

SEQ ID NO: 8421830 - DNA, 22 bp, Homo sapiens
aatgacaagacatagtctctga

SEQ ID NO: 8421831 - DNA, 22 bp, Homo sapiens
aatgacaataatcattaacttt

SEQ ID NO: 8421832 - DNA, 22 bp, Homo sapiens
aactagaaagaacatatttcca

SEQ ID NO: 8421833 - DNA, 22 bp, Homo sapiens
aactagaaatcactacaggtat

SEQ ID NO: 8421834 - DNA, 22 bp, Homo sapiens
aacatgttgagttgaaagtagc

SEQ ID NO: 8421835 - DNA, 22 bp, Homo sapiens
aaccatttgcagttactgagac

SEQ ID NO: 8421836 - DNA, 22 bp, Homo sapiens
aaccatttgccattatcttaag

SEQ ID NO: 8421837 - DNA, 22 bp, Homo sapiens
aacccgggaggcggaggttgtg

SEQ ID NO: 8421838 - DNA, 22 bp, Homo sapiens
aacctatgaactcttggtgtgc

SEQ ID NO: 8421839 - DNA, 23 bp, Homo sapiens
aacctagactacttactatgtgg

SEQ ID NO: 8421840 - DNA, 22 bp, Homo sapiens
aacctagaagttagagtatcat

SEQ ID NO: 8421841 - DNA, 22 bp, Homo sapiens
aaccctggggcagctgctaggg

SEQ ID NO: 8421842 - DNA, 22 bp, Homo sapiens
aaccctggggctgctctgcctg

SEQ ID NO: 8421843 - DNA, 22 bp, Homo sapiens
aaccctggagaaggctttggat

SEQ ID NO: 8421844 - DNA, 22 bp, Homo sapiens
aacctgcagtttttattctgag

SEQ ID NO: 8421845 - DNA, 21 bp, Homo sapiens
aacctgagacccacgggacta

SEQ ID NO: 8421846 - DNA, 22 bp, Homo sapiens
aacctggaggctgtgtagtctt

SEQ ID NO: 8421847 - DNA, 22 bp, Homo sapiens
aacctggctgcaaagaagggga

SEQ ID NO: 8421848 - DNA, 19 bp, Homo sapiens
aaccttagcttctcaggcc

SEQ ID NO: 8421849 - DNA, 22 bp, Homo sapiens
aacctgttccctggtccttgac

SEQ ID NO: 8421850 - DNA, 22 bp, Homo sapiens
aacctttgaggggagctctttc

SEQ ID NO: 8421851 - DNA, 22 bp, Homo sapiens
aaccttgaatacttaaatacat

SEQ ID NO: 8421852 - DNA, 22 bp, Homo sapiens
aatgaattcgagtgaaggaaag

SEQ ID NO: 8421853 - DNA, 22 bp, Homo sapiens
aatgaattctgaagtcttccaa

SEQ ID NO: 8421854 - DNA, 22 bp, Homo sapiens
aatgaattgcagtactgacttg

SEQ ID NO: 8421855 - DNA, 22 bp, Homo sapiens
aacgcccagccttgatcaaatg

SEQ ID NO: 8421856 - DNA, 22 bp, Homo sapiens
aacgaagcttaacttttctgag

SEQ ID NO: 8421857 - DNA, 22 bp, Homo sapiens
aacatgaaaacctccacagcaa

SEQ ID NO: 8421858 - DNA, 22 bp, Homo sapiens
aacatgaaaactacctgtgatt

SEQ ID NO: 8421859 - DNA, 22 bp, Homo sapiens
aatagaatttgtactgtgtttt

SEQ ID NO: 8421860 - DNA, 22 bp, Homo sapiens
aatagacaagcaccctggtaaa

SEQ ID NO: 8421861 - DNA, 22 bp, Homo sapiens
aacatctctgtattttatagac

SEQ ID NO: 8421862 - DNA, 22 bp, Homo sapiens
aacatctccaacctacatccac

SEQ ID NO: 8421863 - DNA, 22 bp, Homo sapiens
aacatctaggttctcatcgata

SEQ ID NO: 8421864 - DNA, 22 bp, Homo sapiens
aacatctcatggactacattct

SEQ ID NO: 8421865 - DNA, 22 bp, Homo sapiens
aacatctcagaagtgaccctga

SEQ ID NO: 8421866 - DNA, 22 bp, Homo sapiens
aacatctcagaagtgaccctga

SEQ ID NO: 8421867 - DNA, 22 bp, Homo sapiens
aacatcttcagagaagctaagt

SEQ ID NO: 8421868 - DNA, 22 bp, Homo sapiens
aacatgtaaccagcattcatct

SEQ ID NO: 8421869 - DNA, 22 bp, Homo sapiens
aacatgtaaccagcattcatct

SEQ ID NO: 8421870 - DNA, 22 bp, Homo sapiens
aacatgtacctacaatcagaat

SEQ ID NO: 8421871 - DNA, 22 bp, Homo sapiens
aacatgtagcagaaacgactaa

SEQ ID NO: 8421872 - DNA, 22 bp, Homo sapiens
aatagatactacttagatgtag

SEQ ID NO: 8421873 - DNA, 22 bp, Homo sapiens
aatagatgggttaaacagcaaa

SEQ ID NO: 8421874 - DNA, 22 bp, Homo sapiens
aatagatactacttagatgtag

SEQ ID NO: 8421875 - DNA, 22 bp, Homo sapiens
aatagatctgtgtgcacatttg

SEQ ID NO: 8421876 - DNA, 22 bp, Homo sapiens
aatagacaattctagccaacat

SEQ ID NO: 8421877 - DNA, 22 bp, Homo sapiens
aatagacattatttctctatga

SEQ ID NO: 8421878 - DNA, 22 bp, Homo sapiens
aatagactccagggtctatttt

SEQ ID NO: 8421879 - DNA, 22 bp, Homo sapiens
aacataaatttgaagtggcaaa

SEQ ID NO: 8421880 - DNA, 22 bp, Homo sapiens
aacagcttcatcacatggcata

SEQ ID NO: 8421881 - DNA, 22 bp, Homo sapiens
aacagctgttcgcagatgtagg

SEQ ID NO: 8421882 - DNA, 22 bp, Homo sapiens
aacagctgtatactgtagctgt

SEQ ID NO: 8421883 - DNA, 22 bp, Homo sapiens
aacagctgtatactgtagctgt

SEQ ID NO: 8421884 - DNA, 22 bp, Homo sapiens
aacagctgtctgcctatctctg

SEQ ID NO: 8421885 - DNA, 22 bp, Homo sapiens
aacagctgtctgcctatctctg

SEQ ID NO: 8421886 - DNA, 22 bp, Homo sapiens
aacagctgttcgcagatgtagg

SEQ ID NO: 8421887 - DNA, 22 bp, Homo sapiens
aacatcagaatatccatgttgg

SEQ ID NO: 8421888 - DNA, 22 bp, Homo sapiens
aacatcacaatttcatttatgc

SEQ ID NO: 8421889 - DNA, 22 bp, Homo sapiens
aacatcatcatgaacaactaat

SEQ ID NO: 8421890 - DNA, 22 bp, Homo sapiens
aacatctacagtgagatgttag

SEQ ID NO: 8421891 - DNA, 22 bp, Homo sapiens
aacagctgcaaaaggttgcctg

SEQ ID NO: 8421892 - DNA, 22 bp, Homo sapiens
aacagctgcaaaaggttgcctg

SEQ ID NO: 8421893 - DNA, 22 bp, Homo sapiens
aacagctgcttcagtacttgaa

SEQ ID NO: 8421894 - DNA, 22 bp, Homo sapiens
aacagctattagaacttcatgg

SEQ ID NO: 8421895 - DNA, 22 bp, Homo sapiens
aacagctagtaccaatccacta

SEQ ID NO: 8421896 - DNA, 22 bp, Homo sapiens
aacagctagtaccaatccacta

SEQ ID NO: 8421897 - DNA, 22 bp, Homo sapiens
aagtgtatatatgacttataaa

SEQ ID NO: 8421898 - DNA, 22 bp, Homo sapiens
aagtgtcctcattcaacatgca

SEQ ID NO: 8421899 - DNA, 22 bp, Homo sapiens
aagtgcttgatcatagttctca

SEQ ID NO: 8421900 - DNA, 22 bp, Homo sapiens
aagtgtataacgacctacagga

SEQ ID NO: 8421901 - DNA, 22 bp, Homo sapiens
aacactttcttccttgctcagg

SEQ ID NO: 8421902 - DNA, 22 bp, Homo sapiens
aacactttctattattatggtt

SEQ ID NO: 8421903 - DNA, 22 bp, Homo sapiens
aacactttcttccttgctcagg

SEQ ID NO: 8421904 - DNA, 22 bp, Homo sapiens
aacactttttatatattgtatc

SEQ ID NO: 8421905 - DNA, 22 bp, Homo sapiens
aacactgtatcagtcttcaata

SEQ ID NO: 8421906 - DNA, 22 bp, Homo sapiens
aacacagttttccaaaatagag

SEQ ID NO: 8421907 - DNA, 22 bp, Homo sapiens
aacacagggggttacaaattgt

SEQ ID NO: 8421908 - DNA, 20 bp, Homo sapiens
aacacagggttaccatcaga

SEQ ID NO: 8421909 - DNA, 22 bp, Homo sapiens
aacacaggttcattctgtgagg

SEQ ID NO: 8421910 - DNA, 22 bp, Homo sapiens
aacacaggttcattctgtgagg

SEQ ID NO: 8421911 - DNA, 22 bp, Homo sapiens
aacacaggttgctgggcctcac

SEQ ID NO: 8421912 - DNA, 22 bp, Homo sapiens
aacacaggttgctgggcctcac

SEQ ID NO: 8421913 - DNA, 22 bp, Homo sapiens
aacagaatagttgatgtacagt

SEQ ID NO: 8421914 - DNA, 22 bp, Homo sapiens
aacagaatagttgatgtacagt

SEQ ID NO: 8421915 - DNA, 22 bp, Homo sapiens
aacagaaatcatttagggctct

SEQ ID NO: 8421916 - DNA, 22 bp, Homo sapiens
aacagaaaaggtaggtggcttt

SEQ ID NO: 8421917 - DNA, 22 bp, Homo sapiens
aacagaacccgagtgtgaatct

SEQ ID NO: 8421918 - DNA, 22 bp, Homo sapiens
aacagacttagagcatcccaat

SEQ ID NO: 8421919 - DNA, 22 bp, Homo sapiens
aacagagatcttaattcctgta

SEQ ID NO: 8421920 - DNA, 22 bp, Homo sapiens
aacagagcattctgcactacaa

SEQ ID NO: 8421921 - DNA, 22 bp, Homo sapiens
aacagaattgtacaccagggag

SEQ ID NO: 8421922 - DNA, 22 bp, Homo sapiens
aaatttgttcaatgtctatttg

SEQ ID NO: 8421923 - DNA, 22 bp, Homo sapiens
aaattttaaggctggaacttaa

SEQ ID NO: 8421924 - DNA, 23 bp, Homo sapiens
aacacaaagctgattccagtggc

SEQ ID NO: 8421925 - DNA, 22 bp, Homo sapiens
aaatttctggaagtgtcagagt

SEQ ID NO: 8421926 - DNA, 22 bp, Homo sapiens
aaatttctaagtcaagaagaac

SEQ ID NO: 8421927 - DNA, 22 bp, Homo sapiens
aaggctggttccatccctggtg

SEQ ID NO: 8421928 - DNA, 22 bp, Homo sapiens
aaatttctaagtcaagaagaac

SEQ ID NO: 8421929 - DNA, 22 bp, Homo sapiens
aaggctggtcagatgtggtgaa

SEQ ID NO: 8421930 - DNA, 22 bp, Homo sapiens
aaggctgggtttgggatgtgat

SEQ ID NO: 8421931 - DNA, 22 bp, Homo sapiens
aaggctggtggattatgaggtc

SEQ ID NO: 8421932 - DNA, 22 bp, Homo sapiens
aaggctggttccatccctggtg

SEQ ID NO: 8421933 - DNA, 20 bp, Homo sapiens
aacacagataccaaaggttg

SEQ ID NO: 8421934 - DNA, 22 bp, Homo sapiens
aacacagatcaaaatatttcct

SEQ ID NO: 8421935 - DNA, 22 bp, Homo sapiens
aacacagctaatttctgtcaat

SEQ ID NO: 8421936 - DNA, 22 bp, Homo sapiens
aacacagctaatttctgtcaat

SEQ ID NO: 8421937 - DNA, 22 bp, Homo sapiens
aacacaggcatactggctccag

SEQ ID NO: 8421938 - DNA, 22 bp, Homo sapiens
aacacaggccagcctgtgcagt

SEQ ID NO: 8421939 - DNA, 22 bp, Homo sapiens
aacacaggccagcctgtgcagt

SEQ ID NO: 8421940 - DNA, 22 bp, Homo sapiens
aacacaggccagcctgtgcagt

SEQ ID NO: 8421941 - DNA, 22 bp, Homo sapiens
aacacagggcagctgctgggaa

SEQ ID NO: 8421942 - DNA, 22 bp, Homo sapiens
aacacaggggcgtggctcttac

SEQ ID NO: 8421943 - DNA, 22 bp, Homo sapiens
aacacagggggttacaaattgt

SEQ ID NO: 8421944 - DNA, 20 bp, Homo sapiens
aacacagataccaaaggttg

SEQ ID NO: 8421945 - DNA, 20 bp, Homo sapiens
aacacagataccaaaggttg

SEQ ID NO: 8421946 - DNA, 22 bp, Homo sapiens
aacacagacatagtgattacag

SEQ ID NO: 8421947 - DNA, 22 bp, Homo sapiens
aacacagagtatttgaagcatt

SEQ ID NO: 8421948 - DNA, 22 bp, Homo sapiens
aacacagagtatttgaagcatt

SEQ ID NO: 8421949 - DNA, 22 bp, Homo sapiens
aacacagaagtgccaagagcca

SEQ ID NO: 8421950 - DNA, 22 bp, Homo sapiens
aacacagaagtgccaagagcca

SEQ ID NO: 8421951 - DNA, 23 bp, Homo sapiens
aacacaaagctgattccagtggc

SEQ ID NO: 8421952 - DNA, 22 bp, Homo sapiens
aacacagaagtgccaagagcca

SEQ ID NO: 8421953 - DNA, 22 bp, Homo sapiens
aacacacgcctcctccatgggg

SEQ ID NO: 8421954 - DNA, 22 bp, Homo sapiens
aaatgtcagaaaacatggagtg

SEQ ID NO: 8421955 - DNA, 22 bp, Homo sapiens
aaatgtcagaaaacatggagtg

SEQ ID NO: 8421956 - DNA, 22 bp, Homo sapiens
aaatgtcagaaaacatggagtg

SEQ ID NO: 8421957 - DNA, 22 bp, Homo sapiens
aaatgtcagaagctttacttct

SEQ ID NO: 8421958 - DNA, 22 bp, Homo sapiens
aaatgtcagaggaacatattga

SEQ ID NO: 8421959 - DNA, 22 bp, Homo sapiens
aaatgtcagaggaacatattga

SEQ ID NO: 8421960 - DNA, 22 bp, Homo sapiens
aaatgtcagaagctttacttct

SEQ ID NO: 8421961 - DNA, 22 bp, Homo sapiens
aaatgtcatatttaagtaggaa

SEQ ID NO: 8421962 - DNA, 22 bp, Homo sapiens
aaatgtcaaggtgatagatgca

SEQ ID NO: 8421963 - DNA, 22 bp, Homo sapiens
aaatgtcaaggtgatagatgca

SEQ ID NO: 8421964 - DNA, 22 bp, Homo sapiens
aaatgtcaaggtgatagatgca

SEQ ID NO: 8421965 - DNA, 22 bp, Homo sapiens
aaatgtcaaggtgatagatgca

SEQ ID NO: 8421966 - DNA, 22 bp, Homo sapiens
aaggaaagacaggacggaattc

SEQ ID NO: 8421967 - DNA, 22 bp, Homo sapiens
aaggaaacagaggatgaccttg

SEQ ID NO: 8421968 - DNA, 22 bp, Homo sapiens
aaatgcatttcactaatgtttc

SEQ ID NO: 8421969 - DNA, 22 bp, Homo sapiens
aaggaagagcaaagaattatgt

SEQ ID NO: 8421970 - DNA, 18 bp, Homo sapiens
aaattattcttccttttc

SEQ ID NO: 8421971 - DNA, 23 bp, Homo sapiens
aaattattgctcttcaattgcct

SEQ ID NO: 8421972 - DNA, 22 bp, Homo sapiens
aaattattcaaaaagctgtgtt

SEQ ID NO: 8421973 - DNA, 22 bp, Homo sapiens
aaattattctcatgtgtttctt

SEQ ID NO: 8421974 - DNA, 22 bp, Homo sapiens
aaattcaattaactttcatgct

SEQ ID NO: 8421975 - DNA, 22 bp, Homo sapiens
aaattcaatgatcactggctca

SEQ ID NO: 8421976 - DNA, 22 bp, Homo sapiens
aaattcaattaactttcatgct

SEQ ID NO: 8421977 - DNA, 22 bp, Homo sapiens
aaattattttcagaatggagaa

SEQ ID NO: 8421978 - DNA, 22 bp, Homo sapiens
aaattattttcagaatggagaa

SEQ ID NO: 8421979 - DNA, 22 bp, Homo sapiens
aaattattttcagaatggagaa

SEQ ID NO: 8421980 - DNA, 23 bp, Homo sapiens
aaattattgctcttcaattgcct

SEQ ID NO: 8421981 - DNA, 19 bp, Homo sapiens
aaggctggtaccataggtt

SEQ ID NO: 8421982 - DNA, 22 bp, Homo sapiens
aaggctgggtaacctgtccact

SEQ ID NO: 8421983 - DNA, 22 bp, Homo sapiens
aaggctggggtgcagacggcct

SEQ ID NO: 8421984 - DNA, 22 bp, Homo sapiens
aaggctgagccagggcccctat

SEQ ID NO: 8421985 - DNA, 22 bp, Homo sapiens
aaggctgagccagggcccctat

SEQ ID NO: 8421986 - DNA, 22 bp, Homo sapiens
aaggcagccctggctcagcctg

SEQ ID NO: 8421987 - DNA, 22 bp, Homo sapiens
aaggcagccctggctcagcctg

SEQ ID NO: 8421988 - DNA, 22 bp, Homo sapiens
aaggcagccctggctcagcctg

SEQ ID NO: 8421989 - DNA, 22 bp, Homo sapiens
aaggcagccatagcaccatcca

SEQ ID NO: 8421990 - DNA, 19 bp, Homo sapiens
aaggcagcagtagcatcca

SEQ ID NO: 8421991 - DNA, 22 bp, Homo sapiens
aaggcagccagatcctttgggt

SEQ ID NO: 8421992 - DNA, 22 bp, Homo sapiens
aaggcagatataaagactagag

SEQ ID NO: 8421993 - DNA, 22 bp, Homo sapiens
aaggcagcaagaattccaggtt

SEQ ID NO: 8421994 - DNA, 22 bp, Homo sapiens
aaggcagcaagaattccaggtt

SEQ ID NO: 8421995 - DNA, 22 bp, Homo sapiens
aaggcagcacagcaactgctca

SEQ ID NO: 8421996 - DNA, 22 bp, Homo sapiens
aaggcagcaccgcctcctgaaa

SEQ ID NO: 8421997 - DNA, 22 bp, Homo sapiens
agctgccatctgaagaactgca

SEQ ID NO: 8421998 - DNA, 22 bp, Homo sapiens
agctgccatctgaagaactgca

SEQ ID NO: 8421999 - DNA, 22 bp, Homo sapiens
agctgccatccgaggtgtcaga

SEQ ID NO: 8422000 - DNA, 22 bp, Homo sapiens
agctgccaggcccctgagaacc

SEQ ID NO: 8422001 - DNA, 22 bp, Homo sapiens
agctgcaggcccatgctcagtc

SEQ ID NO: 8422002 - DNA, 22 bp, Homo sapiens
agctgccagcatcccggaaggg

SEQ ID NO: 8422003 - DNA, 21 bp, Homo sapiens
acagcagacaggcttaggacc

SEQ ID NO: 8422004 - DNA, 22 bp, Homo sapiens
acagcactttacttctcagtga

SEQ ID NO: 8422005 - DNA, 22 bp, Homo sapiens
agctgcctgtcctaggccatca

SEQ ID NO: 8422006 - DNA, 22 bp, Homo sapiens
agctgcctgtcctaggccatca

SEQ ID NO: 8422007 - DNA, 22 bp, Homo sapiens
agctgcctgtgctgggagccca

SEQ ID NO: 8422008 - DNA, 22 bp, Homo sapiens
agctgccttccctctcattagg

SEQ ID NO: 8422009 - DNA, 22 bp, Homo sapiens
acagcctgctgcctgcttcttg

SEQ ID NO: 8422010 - DNA, 22 bp, Homo sapiens
acagctgcacactgaacttggt

SEQ ID NO: 8422011 - DNA, 22 bp, Homo sapiens
acagctgcacttgaagcaggtt

SEQ ID NO: 8422012 - DNA, 22 bp, Homo sapiens
acagctgcattcttaacaggaa

SEQ ID NO: 8422013 - DNA, 22 bp, Homo sapiens
agctggggctgcagagaacagg

SEQ ID NO: 8422014 - DNA, 22 bp, Homo sapiens
agctggggttgcacacattttg

SEQ ID NO: 8422015 - DNA, 22 bp, Homo sapiens
agctgggtactgatgtcttcag

SEQ ID NO: 8422016 - DNA, 22 bp, Homo sapiens
agctgggtacagcctgtgccta

SEQ ID NO: 8422017 - DNA, 22 bp, Homo sapiens
agctgggggtagtgagaaataa

SEQ ID NO: 8422018 - DNA, 22 bp, Homo sapiens
acagctaacttaaactaaccta

SEQ ID NO: 8422019 - DNA, 22 bp, Homo sapiens
acagcctttaaccatttcttcc

SEQ ID NO: 8422020 - DNA, 22 bp, Homo sapiens
acagctactctgcagataaatc

SEQ ID NO: 8422021 - DNA, 22 bp, Homo sapiens
acagctcttaggcagaaccaac

SEQ ID NO: 8422022 - DNA, 22 bp, Homo sapiens
acagctctgttgccagatctgc

SEQ ID NO: 8422023 - DNA, 22 bp, Homo sapiens
acagctcttcttcaagcctggc

SEQ ID NO: 8422024 - DNA, 22 bp, Homo sapiens
acagctcttcttcaagcctggc

SEQ ID NO: 8422025 - DNA, 22 bp, Homo sapiens
acagctgatagttacctctgtc

SEQ ID NO: 8422026 - DNA, 22 bp, Homo sapiens
acagctgacattggcagctatt

SEQ ID NO: 8422027 - DNA, 22 bp, Homo sapiens
acagctcctaacaaaggctctc

SEQ ID NO: 8422028 - DNA, 22 bp, Homo sapiens
acagctctccctcagagaaatg

SEQ ID NO: 8422029 - DNA, 22 bp, Homo sapiens
acagctctccctcagagaaatg

SEQ ID NO: 8422030 - DNA, 22 bp, Homo sapiens
acagctcctggggctttaatgg

SEQ ID NO: 8422031 - DNA, 22 bp, Homo sapiens
acaggcctgatgccttggctgg

SEQ ID NO: 8422032 - DNA, 18 bp, Homo sapiens
acaggcctcagtcctgca

SEQ ID NO: 8422033 - DNA, 22 bp, Homo sapiens
acaggcctagctaatgctttcc

SEQ ID NO: 8422034 - DNA, 22 bp, Homo sapiens
acaggcctggggtacaagttct

SEQ ID NO: 8422035 - DNA, 22 bp, Homo sapiens
acaggcctgggttcaaatttgg

SEQ ID NO: 8422036 - DNA, 22 bp, Homo sapiens
acaggccataaaggcaggccct

SEQ ID NO: 8422037 - DNA, 22 bp, Homo sapiens
acaggccataaaggcaggccct

SEQ ID NO: 8422038 - DNA, 22 bp, Homo sapiens
acaggcaggtaatttacatatt

SEQ ID NO: 8422039 - DNA, 22 bp, Homo sapiens
acaggcaggtaatttacatatt

SEQ ID NO: 8422040 - DNA, 22 bp, Homo sapiens
acagctgtgttttataatcagc

SEQ ID NO: 8422041 - DNA, 22 bp, Homo sapiens
acagctgtggtctccttagtgt

SEQ ID NO: 8422042 - DNA, 23 bp, Homo sapiens
acagctgttgaaatttcagtggg

SEQ ID NO: 8422043 - DNA, 22 bp, Homo sapiens
acagctgtgagggtcacttgta

SEQ ID NO: 8422044 - DNA, 22 bp, Homo sapiens
acagctgtgaagcaagcactct

SEQ ID NO: 8422045 - DNA, 22 bp, Homo sapiens
acagctgtgacttagagaagtt

SEQ ID NO: 8422046 - DNA, 22 bp, Homo sapiens
acagctgtgacttagagaagtt

SEQ ID NO: 8422047 - DNA, 22 bp, Homo sapiens
acagctgtggccacttgcatcc

SEQ ID NO: 8422048 - DNA, 22 bp, Homo sapiens
acagctgtgatttctatcatga

SEQ ID NO: 8422049 - DNA, 22 bp, Homo sapiens
acagctgtgaaaatccacagga

SEQ ID NO: 8422050 - DNA, 21 bp, Homo sapiens
acagctgtcttagcttgggct

SEQ ID NO: 8422051 - DNA, 22 bp, Homo sapiens
acagctgtgaagcaagcactct

SEQ ID NO: 8422052 - DNA, 22 bp, Homo sapiens
agctgggtgaaggcagatggct

SEQ ID NO: 8422053 - DNA, 22 bp, Homo sapiens
agctgggtcttgggccaggaga

SEQ ID NO: 8422054 - DNA, 22 bp, Homo sapiens
agctgggtcttgggccaggaga

SEQ ID NO: 8422055 - DNA, 22 bp, Homo sapiens
acaggctgctgagccatttgct

SEQ ID NO: 8422056 - DNA, 22 bp, Homo sapiens
acaggctgcctaccaagtatca

SEQ ID NO: 8422057 - DNA, 22 bp, Homo sapiens
acaggctgcccgctccccacct

SEQ ID NO: 8422058 - DNA, 22 bp, Homo sapiens
acaggctgcctaccaagtatca

SEQ ID NO: 8422059 - DNA, 22 bp, Homo sapiens
acaggctgcccgctccccacct

SEQ ID NO: 8422060 - DNA, 22 bp, Homo sapiens
acaggctggtggtcctggccat

SEQ ID NO: 8422061 - DNA, 22 bp, Homo sapiens
acaggctggtggtcctggccat

SEQ ID NO: 8422062 - DNA, 22 bp, Homo sapiens
acaggctgggcgcttcctgcgg

SEQ ID NO: 8422063 - DNA, 22 bp, Homo sapiens
acaggctgggcgcttcctgcgg

SEQ ID NO: 8422064 - DNA, 22 bp, Homo sapiens
acaggctgggcgcttcctgcgg

SEQ ID NO: 8422065 - DNA, 22 bp, Homo sapiens
acaggctgctgggctccgtgct

SEQ ID NO: 8422066 - DNA, 22 bp, Homo sapiens
acaggctgctgggctccgtgct

SEQ ID NO: 8422067 - DNA, 22 bp, Homo sapiens
acaggctgctgggctccgtgct

SEQ ID NO: 8422068 - DNA, 22 bp, Homo sapiens
acaggctgctgagccatttgct

SEQ ID NO: 8422069 - DNA, 22 bp, Homo sapiens
acaggctggaggaggaccaaga

SEQ ID NO: 8422070 - DNA, 22 bp, Homo sapiens
acaggctggaggaggaccaaga

SEQ ID NO: 8422071 - DNA, 22 bp, Homo sapiens
aggaatgtcatagaataatcat

SEQ ID NO: 8422072 - DNA, 22 bp, Homo sapiens
aggaatgtcaagtagatgtgcg

SEQ ID NO: 8422073 - DNA, 22 bp, Homo sapiens
aggaatgtattgacctgttgca

SEQ ID NO: 8422074 - DNA, 22 bp, Homo sapiens
aggaatgtattattccttctgg

SEQ ID NO: 8422075 - DNA, 22 bp, Homo sapiens
aggaatgtagtttgagtagaaa

SEQ ID NO: 8422076 - DNA, 22 bp, Homo sapiens
aggaatgtaatagtgtggctca

SEQ ID NO: 8422077 - DNA, 22 bp, Homo sapiens
aggaatgtaacaggagtaaaaa

SEQ ID NO: 8422078 - DNA, 22 bp, Homo sapiens
aggaatgtaaatctagatttta

SEQ ID NO: 8422079 - DNA, 22 bp, Homo sapiens
aggaagggctgtttctccaaga

SEQ ID NO: 8422080 - DNA, 18 bp, Homo sapiens
acaggctgtgggaatggt

SEQ ID NO: 8422081 - DNA, 18 bp, Homo sapiens
acaggctgtgggaatggt

SEQ ID NO: 8422082 - DNA, 22 bp, Homo sapiens
acaggctgtacttctaatcatc

SEQ ID NO: 8422083 - DNA, 22 bp, Homo sapiens
acaggctgtacttctaatcatc

SEQ ID NO: 8422084 - DNA, 22 bp, Homo sapiens
acaggctggtttgtaaaagatg

SEQ ID NO: 8422085 - DNA, 22 bp, Homo sapiens
acaggctggtttgtaaaagatg

SEQ ID NO: 8422086 - DNA, 18 bp, Homo sapiens
acaggctgtgggaatggt

SEQ ID NO: 8422087 - DNA, 22 bp, Homo sapiens
acagtaattgtgaacttaacgt

SEQ ID NO: 8422088 - DNA, 22 bp, Homo sapiens
acagtaatgataaccagcattt

SEQ ID NO: 8422089 - DNA, 22 bp, Homo sapiens
acagtaatattgatgctcgtca

SEQ ID NO: 8422090 - DNA, 22 bp, Homo sapiens
acagtaacctctcctctgaagg

SEQ ID NO: 8422091 - DNA, 22 bp, Homo sapiens
acagtaactcttttaccctcct

SEQ ID NO: 8422092 - DNA, 22 bp, Homo sapiens
acagtaactcttttaccctcct

SEQ ID NO: 8422093 - DNA, 22 bp, Homo sapiens
acagtaacaaatggcctgagga

SEQ ID NO: 8422094 - DNA, 21 bp, Homo sapiens
acagtaaattccctgcaaaga

SEQ ID NO: 8422095 - DNA, 22 bp, Homo sapiens
acagtaacacctactctgtccc

SEQ ID NO: 8422096 - DNA, 22 bp, Homo sapiens
acagtaacagtctatttctcag

SEQ ID NO: 8422097 - DNA, 22 bp, Homo sapiens
acagtaacacctactctgtccc

SEQ ID NO: 8422098 - DNA, 22 bp, Homo sapiens
aggaggaaaaaggccacagcaa

SEQ ID NO: 8422099 - DNA, 20 bp, Homo sapiens
aggaggaaaaaatgacgagc

SEQ ID NO: 8422100 - DNA, 22 bp, Homo sapiens
aggaggaaagaaggcccccagc

SEQ ID NO: 8422101 - DNA, 22 bp, Homo sapiens
aggaggaactcagaaagaaggt

SEQ ID NO: 8422102 - DNA, 22 bp, Homo sapiens
acagtaaatcaacagaatatct

SEQ ID NO: 8422103 - DNA, 22 bp, Homo sapiens
aggaggaactcagaaagaaggt

SEQ ID NO: 8422104 - DNA, 20 bp, Homo sapiens
aggaggaagaaagcacactg

SEQ ID NO: 8422105 - DNA, 22 bp, Homo sapiens
aggagtcctcatgtctgtgcga

SEQ ID NO: 8422106 - DNA, 20 bp, Homo sapiens
aggagtccctgtgctctctc

SEQ ID NO: 8422107 - DNA, 22 bp, Homo sapiens
aggagtgagctttggggtcaga

SEQ ID NO: 8422108 - DNA, 22 bp, Homo sapiens
acagtacaccactgtgtacagt

SEQ ID NO: 8422109 - DNA, 22 bp, Homo sapiens
acagtacaagcatgatacataa

SEQ ID NO: 8422110 - DNA, 22 bp, Homo sapiens
acagtacaagcaatgcattttt

SEQ ID NO: 8422111 - DNA, 22 bp, Homo sapiens
acagtacaaaacccaccagagg

SEQ ID NO: 8422112 - DNA, 22 bp, Homo sapiens
acagtaatttattgaacacctt

SEQ ID NO: 8422113 - DNA, 22 bp, Homo sapiens
aggagggtgatccgggctggtc

SEQ ID NO: 8422114 - DNA, 22 bp, Homo sapiens
aggagcttcagagagaacctgg

SEQ ID NO: 8422115 - DNA, 21 bp, Homo sapiens
aggagctgtgttagctggtcg

SEQ ID NO: 8422116 - DNA, 22 bp, Homo sapiens
acaggtggcttattggctgatt

SEQ ID NO: 8422117 - DNA, 22 bp, Homo sapiens
acaggtggtaaaatggactgtc

SEQ ID NO: 8422118 - DNA, 22 bp, Homo sapiens
acagggagtctgaggggatagt

SEQ ID NO: 8422119 - DNA, 22 bp, Homo sapiens
acagggagtctgaggggatagt

SEQ ID NO: 8422120 - DNA, 22 bp, Homo sapiens
acagggagtctgaggggatagt

SEQ ID NO: 8422121 - DNA, 22 bp, Homo sapiens
acagggagtgcaattcatattg

SEQ ID NO: 8422122 - DNA, 22 bp, Homo sapiens
acagggagtgcaattcatattg

SEQ ID NO: 8422123 - DNA, 18 bp, Homo sapiens
acagggagggcgctgggg

SEQ ID NO: 8422124 - DNA, 18 bp, Homo sapiens
acagggagggcgctgggg

SEQ ID NO: 8422125 - DNA, 22 bp, Homo sapiens
acagggcaacctctgggagact

SEQ ID NO: 8422126 - DNA, 22 bp, Homo sapiens
acagggattttccaggctaccc

SEQ ID NO: 8422127 - DNA, 22 bp, Homo sapiens
acagggattatgactgacagcc

SEQ ID NO: 8422128 - DNA, 18 bp, Homo sapiens
acagggatggggtaagtg

SEQ ID NO: 8422129 - DNA, 22 bp, Homo sapiens
acagggcacctgaggtaggaag

SEQ ID NO: 8422130 - DNA, 22 bp, Homo sapiens
acaggtggaaacatggtgttgg

SEQ ID NO: 8422131 - DNA, 22 bp, Homo sapiens
acaggtgcatgctaccatgtct

SEQ ID NO: 8422132 - DNA, 22 bp, Homo sapiens
acagtgcaaaccctcgggaaag

SEQ ID NO: 8422133 - DNA, 22 bp, Homo sapiens
acagtgcaaaccctcgggaaag

SEQ ID NO: 8422134 - DNA, 22 bp, Homo sapiens
acagtgcaaacttttgtctcct

SEQ ID NO: 8422135 - DNA, 22 bp, Homo sapiens
acagtgcaaacttttgtctcct

SEQ ID NO: 8422136 - DNA, 22 bp, Homo sapiens
acagtgcaaataggactgtctt

SEQ ID NO: 8422137 - DNA, 22 bp, Homo sapiens
acagtgcacatcctgagtgatt

SEQ ID NO: 8422138 - DNA, 22 bp, Homo sapiens
acagtgcacatcctgagtgatt

SEQ ID NO: 8422139 - DNA, 22 bp, Homo sapiens
acagtgcaaataggactgtctt

SEQ ID NO: 8422140 - DNA, 22 bp, Homo sapiens
acagtgttttcttaaggagaaa

SEQ ID NO: 8422141 - DNA, 22 bp, Homo sapiens
acagttaactggagagcgagtt

SEQ ID NO: 8422142 - DNA, 22 bp, Homo sapiens
acagttcaagtcttagacaaca

SEQ ID NO: 8422143 - DNA, 22 bp, Homo sapiens
acagttcactttttatatcaaa

SEQ ID NO: 8422144 - DNA, 22 bp, Homo sapiens
acagttattctttatgcaacca

SEQ ID NO: 8422145 - DNA, 22 bp, Homo sapiens
acagttatctttgaaatagaga

SEQ ID NO: 8422146 - DNA, 22 bp, Homo sapiens
acagttatctttgaaatagaga

SEQ ID NO: 8422147 - DNA, 23 bp, Homo sapiens
acagttatagctgtgaataacat

SEQ ID NO: 8422148 - DNA, 23 bp, Homo sapiens
acagttatagctgtgaataacat

SEQ ID NO: 8422149 - DNA, 22 bp, Homo sapiens
acagttaattgttgttgggtgt

SEQ ID NO: 8422150 - DNA, 22 bp, Homo sapiens
acagttaaggaaatggaggttc

SEQ ID NO: 8422151 - DNA, 22 bp, Homo sapiens
acagttaataagtagtaagtca

SEQ ID NO: 8422152 - DNA, 22 bp, Homo sapiens
acagttaattaacattaagggg

SEQ ID NO: 8422153 - DNA, 22 bp, Homo sapiens
acagttaatatgtgacagaact

SEQ ID NO: 8422154 - DNA, 22 bp, Homo sapiens
acagttaatcaaatggcatatg

SEQ ID NO: 8422155 - DNA, 22 bp, Homo sapiens
acagtttgtgttggccatgggc

SEQ ID NO: 8422156 - DNA, 22 bp, Homo sapiens
acagttttttcaacattggaat

SEQ ID NO: 8422157 - DNA, 23 bp, Homo sapiens
acataaacagaaggtgtgcttcc

SEQ ID NO: 8422158 - DNA, 22 bp, Homo sapiens
aggcaggattgctgacaacaat

SEQ ID NO: 8422159 - DNA, 22 bp, Homo sapiens
aggcaggattgctgacaacaat

SEQ ID NO: 8422160 - DNA, 22 bp, Homo sapiens
aggcaggcaaccacctgggaag

SEQ ID NO: 8422161 - DNA, 22 bp, Homo sapiens
aggcaggcaaccacctgggaag

SEQ ID NO: 8422162 - DNA, 22 bp, Homo sapiens
aggcaggcaagttcatatgagg

SEQ ID NO: 8422163 - DNA, 22 bp, Homo sapiens
aggcaggcacacttcctccagg

SEQ ID NO: 8422164 - DNA, 22 bp, Homo sapiens
aggcaggcacacttcctccagg

SEQ ID NO: 8422165 - DNA, 22 bp, Homo sapiens
aggcaggcacacttcctccagg

SEQ ID NO: 8422166 - DNA, 22 bp, Homo sapiens
aggcaggcactccggaagtgtc

SEQ ID NO: 8422167 - DNA, 22 bp, Homo sapiens
aggcagcatccagaggagaatg

SEQ ID NO: 8422168 - DNA, 22 bp, Homo sapiens
aggcagcatgggcccagagtcc

SEQ ID NO: 8422169 - DNA, 22 bp, Homo sapiens
agggaagccaagccttagagaa

SEQ ID NO: 8422170 - DNA, 22 bp, Homo sapiens
agggaagccccgaggaggcacc

SEQ ID NO: 8422171 - DNA, 22 bp, Homo sapiens
agggaagccccgaggaggcacc

SEQ ID NO: 8422172 - DNA, 17 bp, Homo sapiens
agggacagcagtttagg

SEQ ID NO: 8422173 - DNA, 17 bp, Homo sapiens
agggacagcagtttagg

SEQ ID NO: 8422174 - DNA, 22 bp, Homo sapiens
agggacagatgaatgactgagt

SEQ ID NO: 8422175 - DNA, 22 bp, Homo sapiens
agggacagatgaatgactgagt

SEQ ID NO: 8422176 - DNA, 22 bp, Homo sapiens
agggacacgaggtcctgctggg

SEQ ID NO: 8422177 - DNA, 22 bp, Homo sapiens
agggagccttcctggctgtggt

SEQ ID NO: 8422178 - DNA, 22 bp, Homo sapiens
agggagccttcctggctgtggt

SEQ ID NO: 8422179 - DNA, 23 bp, Homo sapiens
agggagctaaaaggctggagcag

SEQ ID NO: 8422180 - DNA, 22 bp, Homo sapiens
agggagctaggatcctgaaggt

SEQ ID NO: 8422181 - DNA, 22 bp, Homo sapiens
accaggcctagcaagtacatta

SEQ ID NO: 8422182 - DNA, 22 bp, Homo sapiens
accaggcctagcaagtacatta

SEQ ID NO: 8422183 - DNA, 22 bp, Homo sapiens
accaggcctagcaagtacatta

SEQ ID NO: 8422184 - DNA, 19 bp, Homo sapiens
accaggcctcagaggccct

SEQ ID NO: 8422185 - DNA, 19 bp, Homo sapiens
accaggcctcagaggccct

SEQ ID NO: 8422186 - DNA, 22 bp, Homo sapiens
accaggccctccagctgcgtgg

SEQ ID NO: 8422187 - DNA, 22 bp, Homo sapiens
accaggccctccagctgcgtgg

SEQ ID NO: 8422188 - DNA, 22 bp, Homo sapiens
agggacagtatccatctcacag

SEQ ID NO: 8422189 - DNA, 22 bp, Homo sapiens
accaggagttgggggtgggacc

SEQ ID NO: 8422190 - DNA, 22 bp, Homo sapiens
agggacagatgaatgactgagt

SEQ ID NO: 8422191 - DNA, 22 bp, Homo sapiens
accaggcccatgtggattacta

SEQ ID NO: 8422192 - DNA, 22 bp, Homo sapiens
accaggcccaccgcatgctcct

SEQ ID NO: 8422193 - DNA, 22 bp, Homo sapiens
accaggcccaccgcatgctcct

SEQ ID NO: 8422194 - DNA, 20 bp, Homo sapiens
accaggccccgggccctgca

SEQ ID NO: 8422195 - DNA, 20 bp, Homo sapiens
accaggccccgggccctgca

SEQ ID NO: 8422196 - DNA, 20 bp, Homo sapiens
accaggcccggtgtctcctc

SEQ ID NO: 8422197 - DNA, 20 bp, Homo sapiens
accaggcccggtgtctcctc

SEQ ID NO: 8422198 - DNA, 22 bp, Homo sapiens
accaggcccgctgctatggtgg

SEQ ID NO: 8422199 - DNA, 22 bp, Homo sapiens
accaggcccgctgctatggtgg

SEQ ID NO: 8422200 - DNA, 22 bp, Homo sapiens
accaggcccgctgctatggtgg

SEQ ID NO: 8422201 - DNA, 22 bp, Homo sapiens
acatttgtcttctttcagatta

SEQ ID NO: 8422202 - DNA, 22 bp, Homo sapiens
acatttgtcttctttcagatta

SEQ ID NO: 8422203 - DNA, 22 bp, Homo sapiens
acatttgtcttctttcagatta

SEQ ID NO: 8422204 - DNA, 21 bp, Homo sapiens
accaaaacctatactttctgt

SEQ ID NO: 8422205 - DNA, 22 bp, Homo sapiens
accaaaaattgtggggctgaat

SEQ ID NO: 8422206 - DNA, 22 bp, Homo sapiens
aggctggcagccacctcagcag

SEQ ID NO: 8422207 - DNA, 22 bp, Homo sapiens
aggctggcagccacctcagcag

SEQ ID NO: 8422208 - DNA, 22 bp, Homo sapiens
agggaagaatcactgggatgtt

SEQ ID NO: 8422209 - DNA, 22 bp, Homo sapiens
agggaagaggaccagagtctct

SEQ ID NO: 8422210 - DNA, 22 bp, Homo sapiens
agggaagaggaccagagtctct

SEQ ID NO: 8422211 - DNA, 22 bp, Homo sapiens
agggaagaggaccagagtctct

SEQ ID NO: 8422212 - DNA, 22 bp, Homo sapiens
agggaagaatcactgggatgtt

SEQ ID NO: 8422213 - DNA, 22 bp, Homo sapiens
aggctggatttatggggacttc

SEQ ID NO: 8422214 - DNA, 20 bp, Homo sapiens
aggctggcactcctggccag

SEQ ID NO: 8422215 - DNA, 20 bp, Homo sapiens
aggctggcactcctggccag

SEQ ID NO: 8422216 - DNA, 19 bp, Homo sapiens
aggctggatgcccatctta

SEQ ID NO: 8422217 - DNA, 22 bp, Homo sapiens
aggctggatttatggggacttc

SEQ ID NO: 8422218 - DNA, 22 bp, Homo sapiens
aggctggatgtgcctcaccgag

SEQ ID NO: 8422219 - DNA, 22 bp, Homo sapiens
aggctggagtgtgcagtggcgc

SEQ ID NO: 8422220 - DNA, 22 bp, Homo sapiens
aggctggagtgtgcagtggcgc

SEQ ID NO: 8422221 - DNA, 22 bp, Homo sapiens
aggctggagtgtgcagtggcgc

SEQ ID NO: 8422222 - DNA, 22 bp, Homo sapiens
accattctgtctctttacaaat

SEQ ID NO: 8422223 - DNA, 22 bp, Homo sapiens
accattctggtccatactgttc

SEQ ID NO: 8422224 - DNA, 21 bp, Homo sapiens
accattctgcacatgctgtca

SEQ ID NO: 8422225 - DNA, 22 bp, Homo sapiens
accattacatgatccttaccca

SEQ ID NO: 8422226 - DNA, 22 bp, Homo sapiens
agggagctctaagtagagggac

SEQ ID NO: 8422227 - DNA, 22 bp, Homo sapiens
agggagctctaagtagagggac

SEQ ID NO: 8422228 - DNA, 22 bp, Homo sapiens
agggagctctttggtcttgccg

SEQ ID NO: 8422229 - DNA, 22 bp, Homo sapiens
agggagctctttggtcttgccg

SEQ ID NO: 8422230 - DNA, 22 bp, Homo sapiens
agggagctctgggggcacacgg

SEQ ID NO: 8422231 - DNA, 22 bp, Homo sapiens
agggagctcgatgcctgagtgt

SEQ ID NO: 8422232 - DNA, 20 bp, Homo sapiens
agggcagcttgaggagccgg

SEQ ID NO: 8422233 - DNA, 22 bp, Homo sapiens
agggcagtgggaaagcctgctc

SEQ ID NO: 8422234 - DNA, 22 bp, Homo sapiens
acccaggcctgagagacaggag

SEQ ID NO: 8422235 - DNA, 22 bp, Homo sapiens
agggcatgaagcagtggacagc

SEQ ID NO: 8422236 - DNA, 23 bp, Homo sapiens
agggcatgaagcagaggacgtgg

SEQ ID NO: 8422237 - DNA, 22 bp, Homo sapiens
agggcctgggatgtcctcctag

SEQ ID NO: 8422238 - DNA, 22 bp, Homo sapiens
agggcctgggccagcacccttt

SEQ ID NO: 8422239 - DNA, 22 bp, Homo sapiens
acccaggctgcttctcagtggc

SEQ ID NO: 8422240 - DNA, 22 bp, Homo sapiens
acccaggctggagtgcagtagc

SEQ ID NO: 8422241 - DNA, 22 bp, Homo sapiens
acccaggctgcttctcagtggc

SEQ ID NO: 8422242 - DNA, 22 bp, Homo sapiens
acccaggctggagtgcagtagc

SEQ ID NO: 8422243 - DNA, 22 bp, Homo sapiens
acccaggcctgagagacaggag

SEQ ID NO: 8422244 - DNA, 22 bp, Homo sapiens
acccaggcgggagtgcagtgtc

SEQ ID NO: 8422245 - DNA, 22 bp, Homo sapiens
acccaggcgggagtgcagtgtc

SEQ ID NO: 8422246 - DNA, 22 bp, Homo sapiens
acccaggctagaagtgaattat

SEQ ID NO: 8422247 - DNA, 22 bp, Homo sapiens
acccaggcgggagtgcagtgtc

SEQ ID NO: 8422248 - DNA, 22 bp, Homo sapiens
acccaggctagagtgcagtggt

SEQ ID NO: 8422249 - DNA, 22 bp, Homo sapiens
acccaggctagagtgcagtggt

SEQ ID NO: 8422250 - DNA, 22 bp, Homo sapiens
acccaggctagggtgcagtggc

SEQ ID NO: 8422251 - DNA, 22 bp, Homo sapiens
acccaggctagggtgcagtggc

SEQ ID NO: 8422252 - DNA, 22 bp, Homo sapiens
acccaggctagggtgcagtggc

SEQ ID NO: 8422253 - DNA, 22 bp, Homo sapiens
acccaggctagagtgcagtggt

SEQ ID NO: 8422254 - DNA, 18 bp, Homo sapiens
acccaggctcatggtcct

SEQ ID NO: 8422255 - DNA, 17 bp, Homo sapiens
acccaggctctatcttg

SEQ ID NO: 8422256 - DNA, 22 bp, Homo sapiens
acccggagtcggaggttgcagt

SEQ ID NO: 8422257 - DNA, 22 bp, Homo sapiens
accctaataatcacagactagt

SEQ ID NO: 8422258 - DNA, 22 bp, Homo sapiens
accctaataatcacagactagt

SEQ ID NO: 8422259 - DNA, 22 bp, Homo sapiens
accctcagagtaggcactgctg

SEQ ID NO: 8422260 - DNA, 22 bp, Homo sapiens
accctcagacatattccatcat

SEQ ID NO: 8422261 - DNA, 22 bp, Homo sapiens
accctcagacagctgtggccag

SEQ ID NO: 8422262 - DNA, 16 bp, Homo sapiens
accctcagaaactgct

SEQ ID NO: 8422263 - DNA, 22 bp, Homo sapiens
accctcaacaaattcactctat

SEQ ID NO: 8422264 - DNA, 22 bp, Homo sapiens
accccaggaagtggaggtcatg

SEQ ID NO: 8422265 - DNA, 22 bp, Homo sapiens
accccttggagtccgcgcccag

SEQ ID NO: 8422266 - DNA, 22 bp, Homo sapiens
agggcctggtgacctgggtcct

SEQ ID NO: 8422267 - DNA, 22 bp, Homo sapiens
acatttaatgatcctactgtga

SEQ ID NO: 8422268 - DNA, 22 bp, Homo sapiens
acatttaaccctcaggtttctg

SEQ ID NO: 8422269 - DNA, 22 bp, Homo sapiens
acatttaaccaaactgtttaat

SEQ ID NO: 8422270 - DNA, 22 bp, Homo sapiens
acattgtgatccgactgattaa

SEQ ID NO: 8422271 - DNA, 22 bp, Homo sapiens
aggctaggggcagtgccagcat

SEQ ID NO: 8422272 - DNA, 19 bp, Homo sapiens
aggctagtgttacacctgc

SEQ ID NO: 8422273 - DNA, 22 bp, Homo sapiens
aggctaggctgatgcctcttcc

SEQ ID NO: 8422274 - DNA, 22 bp, Homo sapiens
aggctagggccatggctggtga

SEQ ID NO: 8422275 - DNA, 22 bp, Homo sapiens
aggctagctgtttcagggctag

SEQ ID NO: 8422276 - DNA, 22 bp, Homo sapiens
aggctaggcatgtgctaccaca

SEQ ID NO: 8422277 - DNA, 22 bp, Homo sapiens
aggctaggcatgtgctaccaca

SEQ ID NO: 8422278 - DNA, 22 bp, Homo sapiens
aggctaggccttgccctggaac

SEQ ID NO: 8422279 - DNA, 22 bp, Homo sapiens
aggccttaccatagctgtagca

SEQ ID NO: 8422280 - DNA, 22 bp, Homo sapiens
aggccttaccatagctgtagca

SEQ ID NO: 8422281 - DNA, 22 bp, Homo sapiens
aggccttaccatagctgtagca

SEQ ID NO: 8422282 - DNA, 22 bp, Homo sapiens
aggcctgcctggatcacacaga

SEQ ID NO: 8422283 - DNA, 22 bp, Homo sapiens
aggcctgttccttcctgggcac

SEQ ID NO: 8422284 - DNA, 22 bp, Homo sapiens
aggccttgccaatgagagaact

SEQ ID NO: 8422285 - DNA, 22 bp, Homo sapiens
aggccttggaagccagggagcc

SEQ ID NO: 8422286 - DNA, 22 bp, Homo sapiens
aggccttgggccatagtctcct

SEQ ID NO: 8422287 - DNA, 22 bp, Homo sapiens
aggcgaagggaccagacggtag

SEQ ID NO: 8422288 - DNA, 22 bp, Homo sapiens
aggcgcagacatacagggtctg

SEQ ID NO: 8422289 - DNA, 22 bp, Homo sapiens
aggcgcagacatacagggtctg

SEQ ID NO: 8422290 - DNA, 22 bp, Homo sapiens
aggcgcagaaggccaggggcct

SEQ ID NO: 8422291 - DNA, 22 bp, Homo sapiens
aggcgcagaaggccaggggcct

SEQ ID NO: 8422292 - DNA, 22 bp, Homo sapiens
acatttatataactcactagga

SEQ ID NO: 8422293 - DNA, 22 bp, Homo sapiens
acatttatataactcactagga

SEQ ID NO: 8422294 - DNA, 22 bp, Homo sapiens
aggctgagggctcctgagggca

SEQ ID NO: 8422295 - DNA, 22 bp, Homo sapiens
aggctgagggctcctgagggca

SEQ ID NO: 8422296 - DNA, 22 bp, Homo sapiens
aggctgaggctttccttggaga

SEQ ID NO: 8422297 - DNA, 22 bp, Homo sapiens
aggctgagggctcctgagggca

SEQ ID NO: 8422298 - DNA, 22 bp, Homo sapiens
aggctgaggctttccttggaga

SEQ ID NO: 8422299 - DNA, 22 bp, Homo sapiens
aggctgaggctggcagctccag

SEQ ID NO: 8422300 - DNA, 22 bp, Homo sapiens
aggctgaggctggcagctccag

SEQ ID NO: 8422301 - DNA, 22 bp, Homo sapiens
aggctgagtttctcattctcgc

SEQ ID NO: 8422302 - DNA, 22 bp, Homo sapiens
aggctgaggggcgagggaccct

SEQ ID NO: 8422303 - DNA, 22 bp, Homo sapiens
aggctgagtgctcccctagatg

SEQ ID NO: 8422304 - DNA, 22 bp, Homo sapiens
aggctgagtttctcattctcgc

SEQ ID NO: 8422305 - DNA, 20 bp, Homo sapiens
aggctgagttctatgcactt

SEQ ID NO: 8422306 - DNA, 22 bp, Homo sapiens
aggctgagtttctcattctcgc

SEQ ID NO: 8422307 - DNA, 19 bp, Homo sapiens
aggctgcaaggtggtgggc

SEQ ID NO: 8422308 - DNA, 20 bp, Homo sapiens
acatgcagtggtcatttcag

SEQ ID NO: 8422309 - DNA, 20 bp, Homo sapiens
aggccctgccagggacggag

SEQ ID NO: 8422310 - DNA, 22 bp, Homo sapiens
aggccctgtaaggtgtggagat

SEQ ID NO: 8422311 - DNA, 22 bp, Homo sapiens
aggccctggtcaggtctggctg

SEQ ID NO: 8422312 - DNA, 22 bp, Homo sapiens
aggccctggtcaggtctggctg

SEQ ID NO: 8422313 - DNA, 22 bp, Homo sapiens
aggccctgttatgagccactgt

SEQ ID NO: 8422314 - DNA, 22 bp, Homo sapiens
aggccctgttatgagccactgt

SEQ ID NO: 8422315 - DNA, 22 bp, Homo sapiens
aggccctgtccatggtgctgaa

SEQ ID NO: 8422316 - DNA, 22 bp, Homo sapiens
aggccctgtccatggtgctgaa

SEQ ID NO: 8422317 - DNA, 22 bp, Homo sapiens
aggccctgtccatggtgctgaa

SEQ ID NO: 8422318 - DNA, 22 bp, Homo sapiens
acatggcacccagatctcaaaa

SEQ ID NO: 8422319 - DNA, 22 bp, Homo sapiens
aggcctgcctggagcctggctg

SEQ ID NO: 8422320 - DNA, 22 bp, Homo sapiens
aggcctgcctggagcctggctg

SEQ ID NO: 8422321 - DNA, 19 bp, Homo sapiens
acatggcatcccaggaggt

SEQ ID NO: 8422322 - DNA, 22 bp, Homo sapiens
acatggagaccagatggaagta

SEQ ID NO: 8422323 - DNA, 22 bp, Homo sapiens
acatggcaaaagggactttaca

SEQ ID NO: 8422324 - DNA, 22 bp, Homo sapiens
aggcccttgggtcctctccaca

SEQ ID NO: 8422325 - DNA, 22 bp, Homo sapiens
acatggaaaactaactgctttt

SEQ ID NO: 8422326 - DNA, 22 bp, Homo sapiens
aggccctgttatgagccactgt

SEQ ID NO: 8422327 - DNA, 22 bp, Homo sapiens
aggccctgttatgagccactgt

SEQ ID NO: 8422328 - DNA, 22 bp, Homo sapiens
acatggaagcaaagttctattt

SEQ ID NO: 8422329 - DNA, 22 bp, Homo sapiens
acatggaagcaaagttctattt

SEQ ID NO: 8422330 - DNA, 22 bp, Homo sapiens
acatgcaaaaatatatttatga

SEQ ID NO: 8422331 - DNA, 23 bp, Homo sapiens
acatgcaaaaatcacagtctcct

SEQ ID NO: 8422332 - DNA, 22 bp, Homo sapiens
acatgcaaagccacaggacccg

SEQ ID NO: 8422333 - DNA, 22 bp, Homo sapiens
acatgcaaagccacaggacccg

SEQ ID NO: 8422334 - DNA, 22 bp, Homo sapiens
acatgcaaagggatgcaattat

SEQ ID NO: 8422335 - DNA, 22 bp, Homo sapiens
acatgcaagcccctgaacacat

SEQ ID NO: 8422336 - DNA, 19 bp, Homo sapiens
acatgcaaggcacctgcag

SEQ ID NO: 8422337 - DNA, 22 bp, Homo sapiens
acatgcaatattgagactttct

SEQ ID NO: 8422338 - DNA, 22 bp, Homo sapiens
acatgagattagctcacccact

SEQ ID NO: 8422339 - DNA, 22 bp, Homo sapiens
acatgagaggctgtggagtaca

SEQ ID NO: 8422340 - DNA, 22 bp, Homo sapiens
acatgattaaaagattttaaag

SEQ ID NO: 8422341 - DNA, 22 bp, Homo sapiens
acatgagagaaaagtattctga

SEQ ID NO: 8422342 - DNA, 22 bp, Homo sapiens
aggcaggggagctggaagggta

SEQ ID NO: 8422343 - DNA, 22 bp, Homo sapiens
aggcagggctgggattagactc

SEQ ID NO: 8422344 - DNA, 22 bp, Homo sapiens
aggcagggaccagttgttttct

SEQ ID NO: 8422345 - DNA, 20 bp, Homo sapiens
actgttagtatacttgtgcc

SEQ ID NO: 8422346 - DNA, 22 bp, Homo sapiens
actgttacagagcaggaaattg

SEQ ID NO: 8422347 - DNA, 22 bp, Homo sapiens
actgtgtggaccactctgaggc

SEQ ID NO: 8422348 - DNA, 22 bp, Homo sapiens
actgtgttgccttcccccagcc

SEQ ID NO: 8422349 - DNA, 22 bp, Homo sapiens
actgtgttaaatacagagatgg

SEQ ID NO: 8422350 - DNA, 22 bp, Homo sapiens
actgtgtgctggacatgatgtt

SEQ ID NO: 8422351 - DNA, 22 bp, Homo sapiens
actgtgtgctggacatgatgtt

SEQ ID NO: 8422352 - DNA, 20 bp, Homo sapiens
actgtgtgatctggaaagct

SEQ ID NO: 8422353 - DNA, 20 bp, Homo sapiens
actgtgtgatctggaaagct

SEQ ID NO: 8422354 - DNA, 22 bp, Homo sapiens
acttcacttgtaaatgcagcct

SEQ ID NO: 8422355 - DNA, 22 bp, Homo sapiens
acttcagaaaatgttgaatgtt

SEQ ID NO: 8422356 - DNA, 22 bp, Homo sapiens
acttcagagttagttatagacc

SEQ ID NO: 8422357 - DNA, 22 bp, Homo sapiens
acttcagagttagttatagacc

SEQ ID NO: 8422358 - DNA, 22 bp, Homo sapiens
acttcaaacaattaacagagaa

SEQ ID NO: 8422359 - DNA, 22 bp, Homo sapiens
acttatttcatggatcataatg

SEQ ID NO: 8422360 - DNA, 22 bp, Homo sapiens
acttagaatatgttcaagattt

SEQ ID NO: 8422361 - DNA, 20 bp, Homo sapiens
actgttagtatacttgtgcc

SEQ ID NO: 8422362 - DNA, 22 bp, Homo sapiens
acttccaaataccatcacattg

SEQ ID NO: 8422363 - DNA, 22 bp, Homo sapiens
acttccaaataccatcacattg

SEQ ID NO: 8422364 - DNA, 22 bp, Homo sapiens
acttctttcacaatgtttctag

SEQ ID NO: 8422365 - DNA, 22 bp, Homo sapiens
acttccagagggtgtggaaata

SEQ ID NO: 8422366 - DNA, 22 bp, Homo sapiens
acttccagaattagaatttaag

SEQ ID NO: 8422367 - DNA, 22 bp, Homo sapiens
acttgatttttataataaatgg

SEQ ID NO: 8422368 - DNA, 22 bp, Homo sapiens
acttctttcacaatgtttctag

SEQ ID NO: 8422369 - DNA, 22 bp, Homo sapiens
acttgcaaggttgcagttagaa

SEQ ID NO: 8422370 - DNA, 22 bp, Homo sapiens
acttcatgttgtttacaactta

SEQ ID NO: 8422371 - DNA, 22 bp, Homo sapiens
acttcatgttgtttacaactta

SEQ ID NO: 8422372 - DNA, 22 bp, Homo sapiens
acttcatgtagtccatcaggtt

SEQ ID NO: 8422373 - DNA, 22 bp, Homo sapiens
acttccaaagaagtgattacag

SEQ ID NO: 8422374 - DNA, 22 bp, Homo sapiens
acttccaaaacacagcatggca

SEQ ID NO: 8422375 - DNA, 22 bp, Homo sapiens
acttcatgaacatgtggcctgt

SEQ ID NO: 8422376 - DNA, 22 bp, Homo sapiens
acttggaaagatgcaacacagt

SEQ ID NO: 8422377 - DNA, 21 bp, Homo sapiens
acttggcagaacgcagaaggc

SEQ ID NO: 8422378 - DNA, 21 bp, Homo sapiens
acttggccaggcccccacctg

SEQ ID NO: 8422379 - DNA, 22 bp, Homo sapiens
acttggccttatttccacagaa

SEQ ID NO: 8422380 - DNA, 22 bp, Homo sapiens
acttggctgggagagttgaaga

SEQ ID NO: 8422381 - DNA, 22 bp, Homo sapiens
acttggctgggagagttgaaga

SEQ ID NO: 8422382 - DNA, 22 bp, Homo sapiens
acttggcttaaagtagtgatcg

SEQ ID NO: 8422383 - DNA, 22 bp, Homo sapiens
acttggctttagtagtaactga

SEQ ID NO: 8422384 - DNA, 22 bp, Homo sapiens
acttggcttcaaggttaaggtc

SEQ ID NO: 8422385 - DNA, 22 bp, Homo sapiens
agtttccttggattcaatttgg

SEQ ID NO: 8422386 - DNA, 22 bp, Homo sapiens
agtttccttgggcatttgttta

SEQ ID NO: 8422387 - DNA, 22 bp, Homo sapiens
actgtcttcaaatgaatatatt

SEQ ID NO: 8422388 - DNA, 22 bp, Homo sapiens
actgtctgtgccagatgctggg

SEQ ID NO: 8422389 - DNA, 22 bp, Homo sapiens
actgtctgtcctgctctccgtg

SEQ ID NO: 8422390 - DNA, 22 bp, Homo sapiens
actgtctgctggcccctggtta

SEQ ID NO: 8422391 - DNA, 22 bp, Homo sapiens
actgtcatgatcgaagatgtca

SEQ ID NO: 8422392 - DNA, 22 bp, Homo sapiens
actgtctgctggcccctggtta

SEQ ID NO: 8422393 - DNA, 22 bp, Homo sapiens
actgtctgtacttcttgcaagg

SEQ ID NO: 8422394 - DNA, 22 bp, Homo sapiens
actgtaaagaagtaagtatggg

SEQ ID NO: 8422395 - DNA, 22 bp, Homo sapiens
actgtaaagcttttctcatgcg

SEQ ID NO: 8422396 - DNA, 22 bp, Homo sapiens
actgtaaagaggtgtatcttta

SEQ ID NO: 8422397 - DNA, 22 bp, Homo sapiens
actgtcttgctatgagctccca

SEQ ID NO: 8422398 - DNA, 22 bp, Homo sapiens
actgtcttcatatctgtgtctc

SEQ ID NO: 8422399 - DNA, 22 bp, Homo sapiens
actgtcttccaggtctggaggt

SEQ ID NO: 8422400 - DNA, 22 bp, Homo sapiens
actgtcttgtgttaaagaacca

SEQ ID NO: 8422401 - DNA, 22 bp, Homo sapiens
actgtcttgttccaagactaaa

SEQ ID NO: 8422402 - DNA, 22 bp, Homo sapiens
actgtctttgagctggaggagg

SEQ ID NO: 8422403 - DNA, 22 bp, Homo sapiens
actgtctttattagaatcttat

SEQ ID NO: 8422404 - DNA, 17 bp, Homo sapiens
actgtcttttacaccct

SEQ ID NO: 8422405 - DNA, 22 bp, Homo sapiens
actgtgaacggactgaagccca

SEQ ID NO: 8422406 - DNA, 22 bp, Homo sapiens
agtttactctggtgacaattta

SEQ ID NO: 8422407 - DNA, 22 bp, Homo sapiens
agtttactctggtgacaattta

SEQ ID NO: 8422408 - DNA, 22 bp, Homo sapiens
agtttacatatttgtcggagtc

SEQ ID NO: 8422409 - DNA, 22 bp, Homo sapiens
agtttacataaaaaggcagagg

SEQ ID NO: 8422410 - DNA, 22 bp, Homo sapiens
agtttacatcttcaatctcatt

SEQ ID NO: 8422411 - DNA, 19 bp, Homo sapiens
agtttagagagactctaaa

SEQ ID NO: 8422412 - DNA, 22 bp, Homo sapiens
agtttagacaaagtcttgcatt

SEQ ID NO: 8422413 - DNA, 22 bp, Homo sapiens
actggtttgtctattgtcattc

SEQ ID NO: 8422414 - DNA, 22 bp, Homo sapiens
actggttttggaaatcagtaca

SEQ ID NO: 8422415 - DNA, 22 bp, Homo sapiens
actggttttccaggttacttct

SEQ ID NO: 8422416 - DNA, 22 bp, Homo sapiens
actgtaaaatgagatatgtata

SEQ ID NO: 8422417 - DNA, 22 bp, Homo sapiens
actgtaaaatgagatatgtata

SEQ ID NO: 8422418 - DNA, 22 bp, Homo sapiens
actgtaaaatacataagtattg

SEQ ID NO: 8422419 - DNA, 22 bp, Homo sapiens
agtttacagatgctacaggagc

SEQ ID NO: 8422420 - DNA, 22 bp, Homo sapiens
actggcagtttgagaatgcatt

SEQ ID NO: 8422421 - DNA, 22 bp, Homo sapiens
actggcagtttgagaatgcatt

SEQ ID NO: 8422422 - DNA, 22 bp, Homo sapiens
actggcagtgtcgtttacatga

SEQ ID NO: 8422423 - DNA, 22 bp, Homo sapiens
actggcagtgtcgtttacatga

SEQ ID NO: 8422424 - DNA, 19 bp, Homo sapiens
actggcagtttctgcatgg

SEQ ID NO: 8422425 - DNA, 22 bp, Homo sapiens
actggcagtttgagaatgcatt

SEQ ID NO: 8422426 - DNA, 22 bp, Homo sapiens
actggcagctgtaggatgcatg

SEQ ID NO: 8422427 - DNA, 20 bp, Homo sapiens
actggcagcctgcctgctgt

SEQ ID NO: 8422428 - DNA, 20 bp, Homo sapiens
actggcagcctgcctgctgt

SEQ ID NO: 8422429 - DNA, 22 bp, Homo sapiens
actggcagccacaactggcagg

SEQ ID NO: 8422430 - DNA, 22 bp, Homo sapiens
actggcaggctgctggccggcg

SEQ ID NO: 8422431 - DNA, 22 bp, Homo sapiens
actggcaggctgctggccggcg

SEQ ID NO: 8422432 - DNA, 22 bp, Homo sapiens
actggcaggtccatcgcccttt

SEQ ID NO: 8422433 - DNA, 22 bp, Homo sapiens
actggcagtagagggagcgcat

SEQ ID NO: 8422434 - DNA, 22 bp, Homo sapiens
actggcagtggcagcagaaaga

SEQ ID NO: 8422435 - DNA, 22 bp, Homo sapiens
actggcagtggcagcagaaaga

SEQ ID NO: 8422436 - DNA, 22 bp, Homo sapiens
actggcagtagagggagcgcat

SEQ ID NO: 8422437 - DNA, 22 bp, Homo sapiens
actggcagggggagccccgaga

SEQ ID NO: 8422438 - DNA, 22 bp, Homo sapiens
actggcagtagagggagcgcat

SEQ ID NO: 8422439 - DNA, 19 bp, Homo sapiens
actggcagggctgcggtgg

SEQ ID NO: 8422440 - DNA, 19 bp, Homo sapiens
actggcagctgtagtctgt

SEQ ID NO: 8422441 - DNA, 19 bp, Homo sapiens
actggcagggctgcggtgg

SEQ ID NO: 8422442 - DNA, 22 bp, Homo sapiens
atatgaaaagaagtcaccattg

SEQ ID NO: 8422443 - DNA, 22 bp, Homo sapiens
atatgaaaagaagtcaccattg

SEQ ID NO: 8422444 - DNA, 22 bp, Homo sapiens
atatgaaaagaagtcaccattg

SEQ ID NO: 8422445 - DNA, 22 bp, Homo sapiens
atatgaaaatgttttagctgta

SEQ ID NO: 8422446 - DNA, 22 bp, Homo sapiens
atatgaaagtaagcatgtgtgt

SEQ ID NO: 8422447 - DNA, 22 bp, Homo sapiens
agaaaataaattgatggtggaa

SEQ ID NO: 8422448 - DNA, 22 bp, Homo sapiens
agaaacaaggtgtaggttgacc

SEQ ID NO: 8422449 - DNA, 22 bp, Homo sapiens
agaaacaaggtgtaggttgacc

SEQ ID NO: 8422450 - DNA, 22 bp, Homo sapiens
atatatttgagaatattcatga

SEQ ID NO: 8422451 - DNA, 22 bp, Homo sapiens
atatatttgagaatattcatga

SEQ ID NO: 8422452 - DNA, 22 bp, Homo sapiens
atatatttactctcctgttgca

SEQ ID NO: 8422453 - DNA, 22 bp, Homo sapiens
atatctgtgtttcccttttgct

SEQ ID NO: 8422454 - DNA, 22 bp, Homo sapiens
atatcttggccccaggatttta

SEQ ID NO: 8422455 - DNA, 22 bp, Homo sapiens
atatctaggctgaatgtaaaat

SEQ ID NO: 8422456 - DNA, 22 bp, Homo sapiens
atatctggggactgaatttaga

SEQ ID NO: 8422457 - DNA, 22 bp, Homo sapiens
atatctggttggtaatataaca

SEQ ID NO: 8422458 - DNA, 22 bp, Homo sapiens
atatctggttggtaatataaca

SEQ ID NO: 8422459 - DNA, 22 bp, Homo sapiens
atatatttgagaatattcatga

SEQ ID NO: 8422460 - DNA, 22 bp, Homo sapiens
atatccaccattctgcaccttc

SEQ ID NO: 8422461 - DNA, 22 bp, Homo sapiens
acttgggagggtgtgggcagct

SEQ ID NO: 8422462 - DNA, 22 bp, Homo sapiens
atataatagtttcataaaggct

SEQ ID NO: 8422463 - DNA, 22 bp, Homo sapiens
atataattctcaggtttgacta

SEQ ID NO: 8422464 - DNA, 22 bp, Homo sapiens
atataatagtttcataaaggct

SEQ ID NO: 8422465 - DNA, 22 bp, Homo sapiens
atataattctcaggtttgacta

SEQ ID NO: 8422466 - DNA, 22 bp, Homo sapiens
atatacaaagggcaacctcgct

SEQ ID NO: 8422467 - DNA, 22 bp, Homo sapiens
atataatttttggttagctcaa

SEQ ID NO: 8422468 - DNA, 22 bp, Homo sapiens
atatacacagagcttatggtga

SEQ ID NO: 8422469 - DNA, 22 bp, Homo sapiens
atatacacatctttttaaatat

SEQ ID NO: 8422470 - DNA, 22 bp, Homo sapiens
atatacacatctttttaaatat

SEQ ID NO: 8422471 - DNA, 22 bp, Homo sapiens
atatattggtgtcagaaagagt

SEQ ID NO: 8422472 - DNA, 22 bp, Homo sapiens
atatattgtatctttcatgggg

SEQ ID NO: 8422473 - DNA, 22 bp, Homo sapiens
atatataacctggataaggctt

SEQ ID NO: 8422474 - DNA, 22 bp, Homo sapiens
atatacacatctttttaaatat

SEQ ID NO: 8422475 - DNA, 22 bp, Homo sapiens
atatacacatctttttaaatat

SEQ ID NO: 8422476 - DNA, 22 bp, Homo sapiens
atatacacatgtgtatacattt

SEQ ID NO: 8422477 - DNA, 22 bp, Homo sapiens
agaaacatcattggaacacaag

SEQ ID NO: 8422478 - DNA, 21 bp, Homo sapiens
agaaacatgatcaaaggaacc

SEQ ID NO: 8422479 - DNA, 22 bp, Homo sapiens
agaaacatcctgctttccattt

SEQ ID NO: 8422480 - DNA, 22 bp, Homo sapiens
agaaacatcgcttagtcctcat

SEQ ID NO: 8422481 - DNA, 22 bp, Homo sapiens
atcacgtggtttgagagtacgc

SEQ ID NO: 8422482 - DNA, 21 bp, Homo sapiens
atcactgaatgccttcaagga

SEQ ID NO: 8422483 - DNA, 22 bp, Homo sapiens
atcaccagtaagttttcagttt

SEQ ID NO: 8422484 - DNA, 22 bp, Homo sapiens
atcaccaggcaaaatgtcagag

SEQ ID NO: 8422485 - DNA, 22 bp, Homo sapiens
atcagagtgtaagttctttcct

SEQ ID NO: 8422486 - DNA, 22 bp, Homo sapiens
atcagagtgggtctggcatgag

SEQ ID NO: 8422487 - DNA, 22 bp, Homo sapiens
atcagagctgtgattcccactc

SEQ ID NO: 8422488 - DNA, 22 bp, Homo sapiens
atcagagctgtgattcccactc

SEQ ID NO: 8422489 - DNA, 22 bp, Homo sapiens
atcagagctgcattttagagcc

SEQ ID NO: 8422490 - DNA, 22 bp, Homo sapiens
atcagagctgcattttagagcc

SEQ ID NO: 8422491 - DNA, 19 bp, Homo sapiens
atcagcaaggtaggatgtg

SEQ ID NO: 8422492 - DNA, 22 bp, Homo sapiens
atcagcaaggcaatcactgcag

SEQ ID NO: 8422493 - DNA, 22 bp, Homo sapiens
atcagcaagtcctgttaattct

SEQ ID NO: 8422494 - DNA, 22 bp, Homo sapiens
atcatcttgctttctgtttact

SEQ ID NO: 8422495 - DNA, 20 bp, Homo sapiens
atcatctttacaatgtcagt

SEQ ID NO: 8422496 - DNA, 22 bp, Homo sapiens
atcagcaagcatggttaggtgt

SEQ ID NO: 8422497 - DNA, 20 bp, Homo sapiens
atcagcaactgccactcagt

SEQ ID NO: 8422498 - DNA, 22 bp, Homo sapiens
atcagcaaaaatgccttcagaa

SEQ ID NO: 8422499 - DNA, 22 bp, Homo sapiens
agaaccttggtgagtctaacct

SEQ ID NO: 8422500 - DNA, 22 bp, Homo sapiens
agaacctttctttagaaattca

SEQ ID NO: 8422501 - DNA, 22 bp, Homo sapiens
agaaccttcagcttgcaacaag

SEQ ID NO: 8422502 - DNA, 22 bp, Homo sapiens
agaaccttccatcactccctac

SEQ ID NO: 8422503 - DNA, 21 bp, Homo sapiens
agaaccttggatgccattgca

SEQ ID NO: 8422504 - DNA, 22 bp, Homo sapiens
agaaccttgatcttggacttct

SEQ ID NO: 8422505 - DNA, 23 bp, Homo sapiens
atccagcctgggggtttaaccac

SEQ ID NO: 8422506 - DNA, 22 bp, Homo sapiens
atccagccagtgtggatgactt

SEQ ID NO: 8422507 - DNA, 22 bp, Homo sapiens
atccagagaggttaggtgacat

SEQ ID NO: 8422508 - DNA, 22 bp, Homo sapiens
atccagagactggggctgggat

SEQ ID NO: 8422509 - DNA, 22 bp, Homo sapiens
atcatttgaacagaatttgttt

SEQ ID NO: 8422510 - DNA, 22 bp, Homo sapiens
atccacttggctggttgttcta

SEQ ID NO: 8422511 - DNA, 22 bp, Homo sapiens
agtctgggagaaggtgagatta

SEQ ID NO: 8422512 - DNA, 22 bp, Homo sapiens
agtctcttacccaagcagaatg

SEQ ID NO: 8422513 - DNA, 22 bp, Homo sapiens
agtctcttgctagaatcagcca

SEQ ID NO: 8422514 - DNA, 22 bp, Homo sapiens
agtctggtgtatgaaagtgaat

SEQ ID NO: 8422515 - DNA, 22 bp, Homo sapiens
agtctggtgttctcacactagt

SEQ ID NO: 8422516 - DNA, 22 bp, Homo sapiens
agtctggtagaggaagaggcct

SEQ ID NO: 8422517 - DNA, 22 bp, Homo sapiens
agtctggtattggtctttaatc

SEQ ID NO: 8422518 - DNA, 22 bp, Homo sapiens
agtctggtcatctgattctttt

SEQ ID NO: 8422519 - DNA, 22 bp, Homo sapiens
agtctggtctgttcatgggtca

SEQ ID NO: 8422520 - DNA, 22 bp, Homo sapiens
agtctggtgagaacataaatag

SEQ ID NO: 8422521 - DNA, 22 bp, Homo sapiens
agtctggtgctcgctctgcttc

SEQ ID NO: 8422522 - DNA, 19 bp, Homo sapiens
agtctggtggcgtgcatgt

SEQ ID NO: 8422523 - DNA, 22 bp, Homo sapiens
agtctggtggtattttgtagtg

SEQ ID NO: 8422524 - DNA, 22 bp, Homo sapiens
agtctgggtgtgaatgaacttg

SEQ ID NO: 8422525 - DNA, 22 bp, Homo sapiens
agtctggtaaactgaaaaatat

SEQ ID NO: 8422526 - DNA, 22 bp, Homo sapiens
agtctggtaatgtagctcaacc

SEQ ID NO: 8422527 - DNA, 22 bp, Homo sapiens
agtctggtaatgtagctcaacc

SEQ ID NO: 8422528 - DNA, 22 bp, Homo sapiens
agtctggggtctggtagaacga

SEQ ID NO: 8422529 - DNA, 21 bp, Homo sapiens
agtctggggaagggatcccag

SEQ ID NO: 8422530 - DNA, 22 bp, Homo sapiens
agtctgggcatttaggatgttg

SEQ ID NO: 8422531 - DNA, 22 bp, Homo sapiens
agtctgggcatttaggatgttg

SEQ ID NO: 8422532 - DNA, 22 bp, Homo sapiens
agtctgggagggatgccagtgt

SEQ ID NO: 8422533 - DNA, 22 bp, Homo sapiens
actgaaatatttagaagtgaag

SEQ ID NO: 8422534 - DNA, 22 bp, Homo sapiens
actgaaagataaatcagttagc

SEQ ID NO: 8422535 - DNA, 22 bp, Homo sapiens
actgaaagaaccttcctgttgc

SEQ ID NO: 8422536 - DNA, 23 bp, Homo sapiens
actgaaaggatcctagcagagac

SEQ ID NO: 8422537 - DNA, 22 bp, Homo sapiens
actgaaagtccagcatggtaca

SEQ ID NO: 8422538 - DNA, 23 bp, Homo sapiens
actgaaaggatcctagcagagac

SEQ ID NO: 8422539 - DNA, 22 bp, Homo sapiens
actcttcattcaagtatgcaaa

SEQ ID NO: 8422540 - DNA, 22 bp, Homo sapiens
actgaacatatgcaagaccatt

SEQ ID NO: 8422541 - DNA, 22 bp, Homo sapiens
actgaacttggtgaatgccaca

SEQ ID NO: 8422542 - DNA, 22 bp, Homo sapiens
actgaaggcttaactctttcat

SEQ ID NO: 8422543 - DNA, 22 bp, Homo sapiens
agtcgcagacatggtccccttt

SEQ ID NO: 8422544 - DNA, 23 bp, Homo sapiens
agtcctttttataaaattgagga

SEQ ID NO: 8422545 - DNA, 22 bp, Homo sapiens
agtctctcttgggtgtggtttg

SEQ ID NO: 8422546 - DNA, 22 bp, Homo sapiens
agtctctgaggttcagatgcct

SEQ ID NO: 8422547 - DNA, 22 bp, Homo sapiens
actccagggctgaacgaggccc

SEQ ID NO: 8422548 - DNA, 22 bp, Homo sapiens
actccaggggttgctatttaca

SEQ ID NO: 8422549 - DNA, 22 bp, Homo sapiens
agtctcttaatgggcagaaagt

SEQ ID NO: 8422550 - DNA, 20 bp, Homo sapiens
agtctctgtagtgcctgaga

SEQ ID NO: 8422551 - DNA, 22 bp, Homo sapiens
agtctctgcatgatgcagcaca

SEQ ID NO: 8422552 - DNA, 22 bp, Homo sapiens
actccaggcatctgcttctgct

SEQ ID NO: 8422553 - DNA, 22 bp, Homo sapiens
actccaggcatctgcttctgct

SEQ ID NO: 8422554 - DNA, 22 bp, Homo sapiens
actccagggctccaccccagat

SEQ ID NO: 8422555 - DNA, 19 bp, Homo sapiens
actccagggatgacagaag

SEQ ID NO: 8422556 - DNA, 22 bp, Homo sapiens
actccaggatgtagaatcagag

SEQ ID NO: 8422557 - DNA, 21 bp, Homo sapiens
actcatttgtctgcatctaat

SEQ ID NO: 8422558 - DNA, 22 bp, Homo sapiens
actccaaaacctgcggcttggt

SEQ ID NO: 8422559 - DNA, 21 bp, Homo sapiens
actccaaacaagttaagctgt

SEQ ID NO: 8422560 - DNA, 22 bp, Homo sapiens
actgaagtccacacatgtagga

SEQ ID NO: 8422561 - DNA, 22 bp, Homo sapiens
actgaataatggtctgtgatct

SEQ ID NO: 8422562 - DNA, 22 bp, Homo sapiens
actgaattagggaacactgaac

SEQ ID NO: 8422563 - DNA, 22 bp, Homo sapiens
actgagggtgcacaggcaggca

SEQ ID NO: 8422564 - DNA, 22 bp, Homo sapiens
actgaatagtgctgcattgtac

SEQ ID NO: 8422565 - DNA, 22 bp, Homo sapiens
actgaatatattccattgcatg

SEQ ID NO: 8422566 - DNA, 22 bp, Homo sapiens
actgaattacagtctgcatttt

SEQ ID NO: 8422567 - DNA, 22 bp, Homo sapiens
actgaattagggaacactgaac

SEQ ID NO: 8422568 - DNA, 22 bp, Homo sapiens
actgatgaaaactaataaatta

SEQ ID NO: 8422569 - DNA, 22 bp, Homo sapiens
actgatgatctgggagtagagt

SEQ ID NO: 8422570 - DNA, 22 bp, Homo sapiens
actgatgagtaggcagacaagg

SEQ ID NO: 8422571 - DNA, 22 bp, Homo sapiens
actgaggtaattgtgaggatta

SEQ ID NO: 8422572 - DNA, 22 bp, Homo sapiens
actgcaaagggaagccctttct

SEQ ID NO: 8422573 - DNA, 22 bp, Homo sapiens
actgcaaaaatgggtgcattca

SEQ ID NO: 8422574 - DNA, 22 bp, Homo sapiens
actgcaattatttgttcaccaa

SEQ ID NO: 8422575 - DNA, 22 bp, Homo sapiens
actgcaatctggatcctagaag

SEQ ID NO: 8422576 - DNA, 22 bp, Homo sapiens
actgcctgtagctcttcatctc

SEQ ID NO: 8422577 - DNA, 20 bp, Homo sapiens
actgctgtagaccatctgca

SEQ ID NO: 8422578 - DNA, 20 bp, Homo sapiens
actgctgtagaccatctgca

SEQ ID NO: 8422579 - DNA, 23 bp, Homo sapiens
actgctgtctttgaagtgcttga

SEQ ID NO: 8422580 - DNA, 22 bp, Homo sapiens
actgctgattattgaagtagag

SEQ ID NO: 8422581 - DNA, 22 bp, Homo sapiens
actgctgattttaggactgtta

SEQ ID NO: 8422582 - DNA, 23 bp, Homo sapiens
agtggctgagagtgtttcatatg

SEQ ID NO: 8422583 - DNA, 22 bp, Homo sapiens
actgctttagacctagagctct

SEQ ID NO: 8422584 - DNA, 20 bp, Homo sapiens
agtggctgatggaaagaagc

SEQ ID NO: 8422585 - DNA, 22 bp, Homo sapiens
agtggctgagtgactgtgactc

SEQ ID NO: 8422586 - DNA, 22 bp, Homo sapiens
agtggctgatgtaggcagtggg

SEQ ID NO: 8422587 - DNA, 22 bp, Homo sapiens
agtggctgatgtaggcagtggg

SEQ ID NO: 8422588 - DNA, 22 bp, Homo sapiens
agtggctgatgtaggcagtggg

SEQ ID NO: 8422589 - DNA, 22 bp, Homo sapiens
actggcagaacgtgatgcgggt

SEQ ID NO: 8422590 - DNA, 22 bp, Homo sapiens
actggcagaattgaatagttgt

SEQ ID NO: 8422591 - DNA, 22 bp, Homo sapiens
actggcagaactggtgattgtc

SEQ ID NO: 8422592 - DNA, 22 bp, Homo sapiens
actggcagagaccctgatggcc

SEQ ID NO: 8422593 - DNA, 22 bp, Homo sapiens
actggcagagaccctgatggcc

SEQ ID NO: 8422594 - DNA, 22 bp, Homo sapiens
actggcagaggatagcactaat

SEQ ID NO: 8422595 - DNA, 22 bp, Homo sapiens
actggcagagggaaaaccattc

SEQ ID NO: 8422596 - DNA, 22 bp, Homo sapiens
actggcagaggttggacaccat

SEQ ID NO: 8422597 - DNA, 22 bp, Homo sapiens
actggcagcagcagcccttggg

SEQ ID NO: 8422598 - DNA, 22 bp, Homo sapiens
agtggctgcttctggttgctcc

SEQ ID NO: 8422599 - DNA, 22 bp, Homo sapiens
agtggctgcttctggttgctcc

SEQ ID NO: 8422600 - DNA, 22 bp, Homo sapiens
agtggctgctggagtggagatg

SEQ ID NO: 8422601 - DNA, 22 bp, Homo sapiens
agtggctgctggagtggagatg

SEQ ID NO: 8422602 - DNA, 22 bp, Homo sapiens
agtggctgctgactttaataca

SEQ ID NO: 8422603 - DNA, 22 bp, Homo sapiens
agtggctgattacaaactgagt

SEQ ID NO: 8422604 - DNA, 22 bp, Homo sapiens
agtggctgccaagagcaatgct

SEQ ID NO: 8422605 - DNA, 22 bp, Homo sapiens
agtggctgctatgatcaggaca

SEQ ID NO: 8422606 - DNA, 22 bp, Homo sapiens
agtggctgctatgatcaggaca

SEQ ID NO: 8422607 - DNA, 22 bp, Homo sapiens
agtggctgccaagatataattc

SEQ ID NO: 8422608 - DNA, 22 bp, Homo sapiens
actaaagtatctcctatttcat

SEQ ID NO: 8422609 - DNA, 22 bp, Homo sapiens
actaaagtatctcctatttcat

SEQ ID NO: 8422610 - DNA, 22 bp, Homo sapiens
actaaagatgtctaaatatatt

SEQ ID NO: 8422611 - DNA, 22 bp, Homo sapiens
actaaaacagtggctagtagac

SEQ ID NO: 8422612 - DNA, 19 bp, Homo sapiens
actaaaaatgatgtttgag

SEQ ID NO: 8422613 - DNA, 19 bp, Homo sapiens
actaaaaatgatgtttgag

SEQ ID NO: 8422614 - DNA, 22 bp, Homo sapiens
actaaaaactactgccaatagc

SEQ ID NO: 8422615 - DNA, 22 bp, Homo sapiens
actaaaaactactgccaatagc

SEQ ID NO: 8422616 - DNA, 22 bp, Homo sapiens
actaaaaactactgccaatagc

SEQ ID NO: 8422617 - DNA, 22 bp, Homo sapiens
acgttttattcccatgcagcat

SEQ ID NO: 8422618 - DNA, 22 bp, Homo sapiens
acgttagaaaagcaggagctca

SEQ ID NO: 8422619 - DNA, 22 bp, Homo sapiens
acgttcaatgtcagtcaacttt

SEQ ID NO: 8422620 - DNA, 22 bp, Homo sapiens
acgtttgctttctttggcctgg

SEQ ID NO: 8422621 - DNA, 20 bp, Homo sapiens
acgggctgggacccatgcac

SEQ ID NO: 8422622 - DNA, 22 bp, Homo sapiens
acgggccttctcttcaggcgag

SEQ ID NO: 8422623 - DNA, 22 bp, Homo sapiens
acgtgtaatgatcaccacaatc

SEQ ID NO: 8422624 - DNA, 21 bp, Homo sapiens
accttagagagaaagccatca

SEQ ID NO: 8422625 - DNA, 22 bp, Homo sapiens
accttagaaaatcaaaattaga

SEQ ID NO: 8422626 - DNA, 22 bp, Homo sapiens
accttagaccagcaagatattt

SEQ ID NO: 8422627 - DNA, 22 bp, Homo sapiens
accttagaaagtgacaaacgaa

SEQ ID NO: 8422628 - DNA, 22 bp, Homo sapiens
acctgtttagaaagcttatgag

SEQ ID NO: 8422629 - DNA, 22 bp, Homo sapiens
acctgtttacctgcacctgttt

SEQ ID NO: 8422630 - DNA, 22 bp, Homo sapiens
acctgtttagaaagcttatgag

SEQ ID NO: 8422631 - DNA, 22 bp, Homo sapiens
acctgtttgtgtttggactgca

SEQ ID NO: 8422632 - DNA, 22 bp, Homo sapiens
acctgtttgtgtccattagtga

SEQ ID NO: 8422633 - DNA, 22 bp, Homo sapiens
acctgtttctctctgagttact

SEQ ID NO: 8422634 - DNA, 22 bp, Homo sapiens
acctgtttggaggaggtgttag

SEQ ID NO: 8422635 - DNA, 22 bp, Homo sapiens
acctgttttcctatctagattg

SEQ ID NO: 8422636 - DNA, 22 bp, Homo sapiens
acctgttttcagaaaatgcaga

SEQ ID NO: 8422637 - DNA, 22 bp, Homo sapiens
acctgttttcagaaaatgcaga

SEQ ID NO: 8422638 - DNA, 22 bp, Homo sapiens
acctgtttgttaagaaagcttc

SEQ ID NO: 8422639 - DNA, 22 bp, Homo sapiens
acctgttttagtctttaatcat

SEQ ID NO: 8422640 - DNA, 22 bp, Homo sapiens
acctgttttagtctttaatcat

SEQ ID NO: 8422641 - DNA, 22 bp, Homo sapiens
accttcaattatttttgttcca

SEQ ID NO: 8422642 - DNA, 22 bp, Homo sapiens
accttcaactcaaagtgtccca

SEQ ID NO: 8422643 - DNA, 22 bp, Homo sapiens
accttcaactcaaagtgtccca

SEQ ID NO: 8422644 - DNA, 22 bp, Homo sapiens
accttcaaactagatagaagtt

SEQ ID NO: 8422645 - DNA, 22 bp, Homo sapiens
accttcaagtatgtgggctgaa

SEQ ID NO: 8422646 - DNA, 22 bp, Homo sapiens
accttcaatgaaaataatagtc

SEQ ID NO: 8422647 - DNA, 22 bp, Homo sapiens
accttcaagaaacatttccttg

SEQ ID NO: 8422648 - DNA, 22 bp, Homo sapiens
accttcaagattgtgggtcaat

SEQ ID NO: 8422649 - DNA, 22 bp, Homo sapiens
accttcaagaaacatttccttg

SEQ ID NO: 8422650 - DNA, 21 bp, Homo sapiens
accttcaagccagaggtggtc

SEQ ID NO: 8422651 - DNA, 21 bp, Homo sapiens
accttcaagccagaggtggtc

SEQ ID NO: 8422652 - DNA, 22 bp, Homo sapiens
actattagcatatcatgaatgg

SEQ ID NO: 8422653 - DNA, 22 bp, Homo sapiens
actatgatgtattttgcatcta

SEQ ID NO: 8422654 - DNA, 22 bp, Homo sapiens
actatctcttttgtctgcagct

SEQ ID NO: 8422655 - DNA, 22 bp, Homo sapiens
actatatacacattatcttgtt

SEQ ID NO: 8422656 - DNA, 22 bp, Homo sapiens
actaaagtgcacccctttgaga

SEQ ID NO: 8422657 - DNA, 22 bp, Homo sapiens
actaaagtcctgttgtagcata

SEQ ID NO: 8422658 - DNA, 22 bp, Homo sapiens
actatttactcaaatgaggttg

SEQ ID NO: 8422659 - DNA, 22 bp, Homo sapiens
actcaaatagcaacggtgagaa

SEQ ID NO: 8422660 - DNA, 22 bp, Homo sapiens
actcaaatttgtcaactgaagc

SEQ ID NO: 8422661 - DNA, 22 bp, Homo sapiens
actcaaatttgtcaactgaagc

SEQ ID NO: 8422662 - DNA, 23 bp, Homo sapiens
actcaaatttcgcttggagttca

SEQ ID NO: 8422663 - DNA, 20 bp, Homo sapiens
actcaaatcacctgcctcaa

SEQ ID NO: 8422664 - DNA, 22 bp, Homo sapiens
actcaaatagctgcccctagtg

SEQ ID NO: 8422665 - DNA, 22 bp, Homo sapiens
agggctgtgtccctaggggagc

SEQ ID NO: 8422666 - DNA, 22 bp, Homo sapiens
accctcagctggagattgaatt

SEQ ID NO: 8422667 - DNA, 22 bp, Homo sapiens
accctcaggcagaatgtattct

SEQ ID NO: 8422668 - DNA, 22 bp, Homo sapiens
accctcagcttcttggattaat

SEQ ID NO: 8422669 - DNA, 20 bp, Homo sapiens
agggtggggacgttctgact

SEQ ID NO: 8422670 - DNA, 20 bp, Homo sapiens
agggtggggacgttctgact

SEQ ID NO: 8422671 - DNA, 20 bp, Homo sapiens
agggtggggacgttctgact

SEQ ID NO: 8422672 - DNA, 22 bp, Homo sapiens
agggtgcgttctatgagaatct

SEQ ID NO: 8422673 - DNA, 22 bp, Homo sapiens
agggtgggctagactcttcccc

SEQ ID NO: 8422674 - DNA, 22 bp, Homo sapiens
agggtgtgttctcctatgagaa

SEQ ID NO: 8422675 - DNA, 19 bp, Homo sapiens
agggttacccgctgccacc

SEQ ID NO: 8422676 - DNA, 22 bp, Homo sapiens
agggtggggtgctacatcttta

SEQ ID NO: 8422677 - DNA, 22 bp, Homo sapiens
agggtggggtgctacatcttta

SEQ ID NO: 8422678 - DNA, 22 bp, Homo sapiens
agggtggggtgctacatcttta

SEQ ID NO: 8422679 - DNA, 18 bp, Homo sapiens
acctccccattttctgaa

SEQ ID NO: 8422680 - DNA, 22 bp, Homo sapiens
acctccccattaggtcacccac

SEQ ID NO: 8422681 - DNA, 22 bp, Homo sapiens
acctccccacatggtagtgagt

SEQ ID NO: 8422682 - DNA, 22 bp, Homo sapiens
acctccccgggagcagcctcct

SEQ ID NO: 8422683 - DNA, 22 bp, Homo sapiens
acctccctaagggtccagctta

SEQ ID NO: 8422684 - DNA, 22 bp, Homo sapiens
acctcccctgactcgaaaccca

SEQ ID NO: 8422685 - DNA, 22 bp, Homo sapiens
acctcccctcaccaatctggtt

SEQ ID NO: 8422686 - DNA, 23 bp, Homo sapiens
acctgtctgcctcccaccatcaa

SEQ ID NO: 8422687 - DNA, 22 bp, Homo sapiens
acctgtctgcatgatctaaaac

SEQ ID NO: 8422688 - DNA, 22 bp, Homo sapiens
acctgtttaccctgggctcccc

SEQ ID NO: 8422689 - DNA, 22 bp, Homo sapiens
aggtagaaggaccagaatttat

SEQ ID NO: 8422690 - DNA, 22 bp, Homo sapiens
aggtagatcaactggggaggga

SEQ ID NO: 8422691 - DNA, 22 bp, Homo sapiens
acctggacacctgctgtcatct

SEQ ID NO: 8422692 - DNA, 22 bp, Homo sapiens
acctggaatggggttgagagct

SEQ ID NO: 8422693 - DNA, 22 bp, Homo sapiens
acctggaagtgggtgctatggc

SEQ ID NO: 8422694 - DNA, 22 bp, Homo sapiens
acctgctttgtagtgtttgctg

SEQ ID NO: 8422695 - DNA, 22 bp, Homo sapiens
acctgctttattcctcctgcct

SEQ ID NO: 8422696 - DNA, 22 bp, Homo sapiens
acctgctgtgattctaattggc

SEQ ID NO: 8422697 - DNA, 22 bp, Homo sapiens
acctgccttctcaaggacatga

SEQ ID NO: 8422698 - DNA, 22 bp, Homo sapiens
acctgcccacacttccttccca

SEQ ID NO: 8422699 - DNA, 22 bp, Homo sapiens
acctgcccggggacattccttt

SEQ ID NO: 8422700 - DNA, 22 bp, Homo sapiens
agcagctgtggggacaagggta

SEQ ID NO: 8422701 - DNA, 23 bp, Homo sapiens
agcagctgtggtttaccttagta

SEQ ID NO: 8422702 - DNA, 22 bp, Homo sapiens
agcagctgtttgttgaattggt

SEQ ID NO: 8422703 - DNA, 22 bp, Homo sapiens
agcagctgttagaaacaggaag

SEQ ID NO: 8422704 - DNA, 22 bp, Homo sapiens
agcagcttatcttggagaggca

SEQ ID NO: 8422705 - DNA, 22 bp, Homo sapiens
cacaggaagctgactgctggca

SEQ ID NO: 8422706 - DNA, 22 bp, Homo sapiens
cacaggagctgtggggcagtgt

SEQ ID NO: 8422707 - DNA, 22 bp, Homo sapiens
cacaggagctgtggggcagtgt

SEQ ID NO: 8422708 - DNA, 22 bp, Homo sapiens
cacaggagccctgaggcctccc

SEQ ID NO: 8422709 - DNA, 22 bp, Homo sapiens
cacaggagccctgaggcctccc

SEQ ID NO: 8422710 - DNA, 19 bp, Homo sapiens
agcagctgtagatagacac

SEQ ID NO: 8422711 - DNA, 19 bp, Homo sapiens
agcagctgtagatagacac

SEQ ID NO: 8422712 - DNA, 22 bp, Homo sapiens
agcagctgtactttcatctgtt

SEQ ID NO: 8422713 - DNA, 22 bp, Homo sapiens
agcagctgggctcagagctggg

SEQ ID NO: 8422714 - DNA, 22 bp, Homo sapiens
caatgacactctgcacagtgct

SEQ ID NO: 8422715 - DNA, 22 bp, Homo sapiens
caatgacatggataatcatatt

SEQ ID NO: 8422716 - DNA, 22 bp, Homo sapiens
caatgacatggataatcatatt

SEQ ID NO: 8422717 - DNA, 22 bp, Homo sapiens
agcagctgtcccttaacatcag

SEQ ID NO: 8422718 - DNA, 18 bp, Homo sapiens
agcagctgtcagaatgcc

SEQ ID NO: 8422719 - DNA, 18 bp, Homo sapiens
agcagctgtcagaatgcc

SEQ ID NO: 8422720 - DNA, 19 bp, Homo sapiens
agcagctgtagatagacac

SEQ ID NO: 8422721 - DNA, 23 bp, Homo sapiens
agcagctgtggagttttgcattt

SEQ ID NO: 8422722 - DNA, 22 bp, Homo sapiens
cacaggaggaggccagagcgta

SEQ ID NO: 8422723 - DNA, 22 bp, Homo sapiens
cacaggagggagcgggcagcca

SEQ ID NO: 8422724 - DNA, 22 bp, Homo sapiens
cacaggagggagcgggcagcca

SEQ ID NO: 8422725 - DNA, 22 bp, Homo sapiens
cacaggagggagcgggcagcca

SEQ ID NO: 8422726 - DNA, 22 bp, Homo sapiens
cacaggaggttaggaagtggtc

SEQ ID NO: 8422727 - DNA, 22 bp, Homo sapiens
agcaggagacatgggggtggtg

SEQ ID NO: 8422728 - DNA, 22 bp, Homo sapiens
agcaggagagcagtgcgtggtc

SEQ ID NO: 8422729 - DNA, 22 bp, Homo sapiens
agcaggagagcagtgcgtggtc

SEQ ID NO: 8422730 - DNA, 22 bp, Homo sapiens
agcaggagcatttccatgattc

SEQ ID NO: 8422731 - DNA, 22 bp, Homo sapiens
cacaggctgcccgcagctggga

SEQ ID NO: 8422732 - DNA, 22 bp, Homo sapiens
cacaggctgcccgcagctggga

SEQ ID NO: 8422733 - DNA, 23 bp, Homo sapiens
cacaggctgcgcataagcttctc

SEQ ID NO: 8422734 - DNA, 22 bp, Homo sapiens
cacagggcctggggcagctgct

SEQ ID NO: 8422735 - DNA, 22 bp, Homo sapiens
cacagggcctggggcagctgct

SEQ ID NO: 8422736 - DNA, 22 bp, Homo sapiens
cacagggccttgtgtgactgca

SEQ ID NO: 8422737 - DNA, 22 bp, Homo sapiens
cacagggctaaatgaagggttg

SEQ ID NO: 8422738 - DNA, 22 bp, Homo sapiens
cacagtattcactgggcagatt

SEQ ID NO: 8422739 - DNA, 22 bp, Homo sapiens
cacagtatcttttgagtaagca

SEQ ID NO: 8422740 - DNA, 22 bp, Homo sapiens
cacatcatagagactcaatcca

SEQ ID NO: 8422741 - DNA, 22 bp, Homo sapiens
cacatccttcatactcagctct

SEQ ID NO: 8422742 - DNA, 22 bp, Homo sapiens
cacatctactgaatgagcagtg

SEQ ID NO: 8422743 - DNA, 22 bp, Homo sapiens
cacatctactgaatgagcagtg

SEQ ID NO: 8422744 - DNA, 22 bp, Homo sapiens
cacatctatagggacagcaaca

SEQ ID NO: 8422745 - DNA, 22 bp, Homo sapiens
cacatctactgatattccagga

SEQ ID NO: 8422746 - DNA, 22 bp, Homo sapiens
cacatctgaaaagatgcacaag

SEQ ID NO: 8422747 - DNA, 22 bp, Homo sapiens
cacatctcagggctacaggcag

SEQ ID NO: 8422748 - DNA, 22 bp, Homo sapiens
cacatctgaaaagatgcacaag

SEQ ID NO: 8422749 - DNA, 22 bp, Homo sapiens
cacatctatggagacagagagt

SEQ ID NO: 8422750 - DNA, 22 bp, Homo sapiens
agcaggtgatgtgagtctggaa

SEQ ID NO: 8422751 - DNA, 21 bp, Homo sapiens
agcaggtctacaggttcatag

SEQ ID NO: 8422752 - DNA, 22 bp, Homo sapiens
agcaggtcgccgaagatagctc

SEQ ID NO: 8422753 - DNA, 22 bp, Homo sapiens
cacatctgacttccagtgcagg

SEQ ID NO: 8422754 - DNA, 22 bp, Homo sapiens
cacagtccagactcctggagtt

SEQ ID NO: 8422755 - DNA, 22 bp, Homo sapiens
agcataagttggtacagccact

SEQ ID NO: 8422756 - DNA, 20 bp, Homo sapiens
cactctgagggagtccatgt

SEQ ID NO: 8422757 - DNA, 22 bp, Homo sapiens
cactctgagcccaagcaggctg

SEQ ID NO: 8422758 - DNA, 22 bp, Homo sapiens
cactctggggatgcaaggagag

SEQ ID NO: 8422759 - DNA, 22 bp, Homo sapiens
cactctgggggctgccgctgcc

SEQ ID NO: 8422760 - DNA, 22 bp, Homo sapiens
cactctgattccacaaggctcc

SEQ ID NO: 8422761 - DNA, 20 bp, Homo sapiens
agcagtttcctaactcagct

SEQ ID NO: 8422762 - DNA, 22 bp, Homo sapiens
agcagtttgaatcaatggccag

SEQ ID NO: 8422763 - DNA, 22 bp, Homo sapiens
agcagtttgaatcaatggccag

SEQ ID NO: 8422764 - DNA, 22 bp, Homo sapiens
agcagttttagggagacacatt

SEQ ID NO: 8422765 - DNA, 22 bp, Homo sapiens
agcagtttggaaaatactagaa

SEQ ID NO: 8422766 - DNA, 22 bp, Homo sapiens
agcataaaggcactagaaagag

SEQ ID NO: 8422767 - DNA, 22 bp, Homo sapiens
agcagtttttataacactggaa

SEQ ID NO: 8422768 - DNA, 22 bp, Homo sapiens
agcagttatgttctataaagtc

SEQ ID NO: 8422769 - DNA, 22 bp, Homo sapiens
agcaggtggacagaggaagaaa

SEQ ID NO: 8422770 - DNA, 22 bp, Homo sapiens
caactggtaatctccacggtca

SEQ ID NO: 8422771 - DNA, 22 bp, Homo sapiens
caactggtggtcaaccttctgt

SEQ ID NO: 8422772 - DNA, 22 bp, Homo sapiens
caactgggataaagagctaaag

SEQ ID NO: 8422773 - DNA, 19 bp, Homo sapiens
caactgccccctcaaacat

SEQ ID NO: 8422774 - DNA, 22 bp, Homo sapiens
caactgttataaatcaacagag

SEQ ID NO: 8422775 - DNA, 22 bp, Homo sapiens
caactgccatacagctccatgg

SEQ ID NO: 8422776 - DNA, 22 bp, Homo sapiens
caactgaactgatatcaactat

SEQ ID NO: 8422777 - DNA, 21 bp, Homo sapiens
agcagacacttgtgaccttcc

SEQ ID NO: 8422778 - DNA, 22 bp, Homo sapiens
caactatatagaaattgattgt

SEQ ID NO: 8422779 - DNA, 22 bp, Homo sapiens
agcagacaattgcctggatgga

SEQ ID NO: 8422780 - DNA, 22 bp, Homo sapiens
agcagacaccaggagtaaagaa

SEQ ID NO: 8422781 - DNA, 22 bp, Homo sapiens
agcagaatctgtccttggaaga

SEQ ID NO: 8422782 - DNA, 22 bp, Homo sapiens
agcagaagtgccttagcaatca

SEQ ID NO: 8422783 - DNA, 22 bp, Homo sapiens
agcagcaataataaagtaatac

SEQ ID NO: 8422784 - DNA, 22 bp, Homo sapiens
agcagcaagtgtaactgaatat

SEQ ID NO: 8422785 - DNA, 22 bp, Homo sapiens
caacttcttggcttcctaatgg

SEQ ID NO: 8422786 - DNA, 21 bp, Homo sapiens
agcagagtgctttgactttgt

SEQ ID NO: 8422787 - DNA, 22 bp, Homo sapiens
agcagcaacttatttttcttat

SEQ ID NO: 8422788 - DNA, 22 bp, Homo sapiens
agcagcagaaggtttgcaccca

SEQ ID NO: 8422789 - DNA, 22 bp, Homo sapiens
caaggcaggcagttcacttgag

SEQ ID NO: 8422790 - DNA, 22 bp, Homo sapiens
caaggcaggcagttcacttgag

SEQ ID NO: 8422791 - DNA, 22 bp, Homo sapiens
agcagcagaagggagacccagg

SEQ ID NO: 8422792 - DNA, 22 bp, Homo sapiens
agcagcacctgtcctcgctgct

SEQ ID NO: 8422793 - DNA, 22 bp, Homo sapiens
caatgaaattgagatccagaga

SEQ ID NO: 8422794 - DNA, 22 bp, Homo sapiens
caatgaaaatttaagttgcagc

SEQ ID NO: 8422795 - DNA, 22 bp, Homo sapiens
caatgaaaatgaggactcctgt

SEQ ID NO: 8422796 - DNA, 20 bp, Homo sapiens
agcagcattgttctagagca

SEQ ID NO: 8422797 - DNA, 22 bp, Homo sapiens
agcagcatttaaggatccaagt

SEQ ID NO: 8422798 - DNA, 22 bp, Homo sapiens
agcagcatgatgacagagtctc

SEQ ID NO: 8422799 - DNA, 22 bp, Homo sapiens
agcagcatctggttctgatgtg

SEQ ID NO: 8422800 - DNA, 22 bp, Homo sapiens
caaggcagttccccagagggct

SEQ ID NO: 8422801 - DNA, 22 bp, Homo sapiens
caaggcagttccccagagggct

SEQ ID NO: 8422802 - DNA, 22 bp, Homo sapiens
caaggcagtgggctaggaacct

SEQ ID NO: 8422803 - DNA, 22 bp, Homo sapiens
caaggcagtccctactccctgc

SEQ ID NO: 8422804 - DNA, 22 bp, Homo sapiens
caaggcaggtctgaggaggttg

SEQ ID NO: 8422805 - DNA, 22 bp, Homo sapiens
caaggcaggccagtttcaaggc

SEQ ID NO: 8422806 - DNA, 22 bp, Homo sapiens
agcagcagggtgtaattgggca

SEQ ID NO: 8422807 - DNA, 22 bp, Homo sapiens
caaggcatactcctttctcagc

SEQ ID NO: 8422808 - DNA, 22 bp, Homo sapiens
caaattaatgtgtctcaaaata

SEQ ID NO: 8422809 - DNA, 22 bp, Homo sapiens
caaattaatgtgtctcaaaata

SEQ ID NO: 8422810 - DNA, 22 bp, Homo sapiens
caaattaatgtgtctcaaaata

SEQ ID NO: 8422811 - DNA, 22 bp, Homo sapiens
agcactgtggtggaagcatcaa

SEQ ID NO: 8422812 - DNA, 22 bp, Homo sapiens
agcactgtggggaactcacaga

SEQ ID NO: 8422813 - DNA, 22 bp, Homo sapiens
agcagaagaaagccacatgact

SEQ ID NO: 8422814 - DNA, 17 bp, Homo sapiens
agcagaagtcagaggga

SEQ ID NO: 8422815 - DNA, 22 bp, Homo sapiens
caaatgtttttattctacaaca

SEQ ID NO: 8422816 - DNA, 22 bp, Homo sapiens
caaatgtttcttgaacaccaac

SEQ ID NO: 8422817 - DNA, 22 bp, Homo sapiens
caaatgcaaaatataaccctgt

SEQ ID NO: 8422818 - DNA, 22 bp, Homo sapiens
caaatgatgcatggctagtgag

SEQ ID NO: 8422819 - DNA, 22 bp, Homo sapiens
caaatgcaggtcagcaggtgtc

SEQ ID NO: 8422820 - DNA, 22 bp, Homo sapiens
caaatgttaaatgtgttaagac

SEQ ID NO: 8422821 - DNA, 22 bp, Homo sapiens
caaatgatactgtttttagtct

SEQ ID NO: 8422822 - DNA, 22 bp, Homo sapiens
caaatgatagagccgattatca

SEQ ID NO: 8422823 - DNA, 22 bp, Homo sapiens
caaatgatccttgcaagctgtg

SEQ ID NO: 8422824 - DNA, 20 bp, Homo sapiens
agcacagcgcggtgttcctt

SEQ ID NO: 8422825 - DNA, 21 bp, Homo sapiens
agcacagcatatccaatgtca

SEQ ID NO: 8422826 - DNA, 22 bp, Homo sapiens
agcacagaggtggaagtgtata

SEQ ID NO: 8422827 - DNA, 22 bp, Homo sapiens
agcacagagctcggggaatgga

SEQ ID NO: 8422828 - DNA, 22 bp, Homo sapiens
agcacagattctgaagagtcct

SEQ ID NO: 8422829 - DNA, 22 bp, Homo sapiens
agcacagagttgcagagagcgt

SEQ ID NO: 8422830 - DNA, 22 bp, Homo sapiens
agcacagataacatggagtgga

SEQ ID NO: 8422831 - DNA, 22 bp, Homo sapiens
attttctctcaaaccttaaaat

SEQ ID NO: 8422832 - DNA, 22 bp, Homo sapiens
agcacagactggtcccaggtct

SEQ ID NO: 8422833 - DNA, 22 bp, Homo sapiens
agcacagagaaactaagacatt

SEQ ID NO: 8422834 - DNA, 19 bp, Homo sapiens
agcacagacaagaccagca

SEQ ID NO: 8422835 - DNA, 23 bp, Homo sapiens
agcacagactagaaaggtctttc

SEQ ID NO: 8422836 - DNA, 23 bp, Homo sapiens
agcacagactagaaaggtctttc

SEQ ID NO: 8422837 - DNA, 22 bp, Homo sapiens
cagaactgggctcgctctggtt

SEQ ID NO: 8422838 - DNA, 22 bp, Homo sapiens
cagaactgttataacagctgtt

SEQ ID NO: 8422839 - DNA, 22 bp, Homo sapiens
cagaagaaatcattatctggac

SEQ ID NO: 8422840 - DNA, 22 bp, Homo sapiens
cagaagagatgaaatagtatta

SEQ ID NO: 8422841 - DNA, 22 bp, Homo sapiens
cagaagaatggtgtctgagctc

SEQ ID NO: 8422842 - DNA, 22 bp, Homo sapiens
cagaagcattgactccttgctc

SEQ ID NO: 8422843 - DNA, 22 bp, Homo sapiens
cagaagcattccagcaaatagt

SEQ ID NO: 8422844 - DNA, 22 bp, Homo sapiens
cagaagctgcagtgatctggga

SEQ ID NO: 8422845 - DNA, 22 bp, Homo sapiens
cagaagctagcaggaaagtttt

SEQ ID NO: 8422846 - DNA, 22 bp, Homo sapiens
cagaagcctgcctcagatgcac

SEQ ID NO: 8422847 - DNA, 22 bp, Homo sapiens
agccaggacatctctagctgct

SEQ ID NO: 8422848 - DNA, 22 bp, Homo sapiens
agccagctgcctttcacatctg

SEQ ID NO: 8422849 - DNA, 22 bp, Homo sapiens
agccaggatcacccggggctgt

SEQ ID NO: 8422850 - DNA, 22 bp, Homo sapiens
agccaggatggtctcgatcggc

SEQ ID NO: 8422851 - DNA, 22 bp, Homo sapiens
cagaagctttgtctagtcttga

SEQ ID NO: 8422852 - DNA, 22 bp, Homo sapiens
agccaggattggctgagcctta

SEQ ID NO: 8422853 - DNA, 22 bp, Homo sapiens
agccaggcagggctctcgctct

SEQ ID NO: 8422854 - DNA, 22 bp, Homo sapiens
cagacagaaggctccttgaggt

SEQ ID NO: 8422855 - DNA, 22 bp, Homo sapiens
cagacagacagccgtggccacc

SEQ ID NO: 8422856 - DNA, 22 bp, Homo sapiens
cagaactgagtctcatggccat

SEQ ID NO: 8422857 - DNA, 22 bp, Homo sapiens
cagaactggcctttcatcagtc

SEQ ID NO: 8422858 - DNA, 22 bp, Homo sapiens
cagaactgggcagggagcagag

SEQ ID NO: 8422859 - DNA, 22 bp, Homo sapiens
cagaactgacctctgattctag

SEQ ID NO: 8422860 - DNA, 22 bp, Homo sapiens
cagaaccttggtggtagggaca

SEQ ID NO: 8422861 - DNA, 22 bp, Homo sapiens
cagaacctgtgaatgtgttatc

SEQ ID NO: 8422862 - DNA, 22 bp, Homo sapiens
cagaacctgaacgtgaggtgga

SEQ ID NO: 8422863 - DNA, 22 bp, Homo sapiens
cagaacctgagagcacaatcct

SEQ ID NO: 8422864 - DNA, 22 bp, Homo sapiens
cagaacctgaacgtgaggtgga

SEQ ID NO: 8422865 - DNA, 22 bp, Homo sapiens
agccacagcaacaagtgcaatt

SEQ ID NO: 8422866 - DNA, 22 bp, Homo sapiens
agccacagcacattgtaagaaa

SEQ ID NO: 8422867 - DNA, 23 bp, Homo sapiens
agccacagccagagctatctcca

SEQ ID NO: 8422868 - DNA, 22 bp, Homo sapiens
cactgaaaggaaaccagagcat

SEQ ID NO: 8422869 - DNA, 22 bp, Homo sapiens
cactgaaacaggtattgctggt

SEQ ID NO: 8422870 - DNA, 22 bp, Homo sapiens
cactgaaatattaatatcttat

SEQ ID NO: 8422871 - DNA, 22 bp, Homo sapiens
agccacaatgccaacctctact

SEQ ID NO: 8422872 - DNA, 22 bp, Homo sapiens
agccacacctgtcctgccagct

SEQ ID NO: 8422873 - DNA, 21 bp, Homo sapiens
agccaagccttgggagccagg

SEQ ID NO: 8422874 - DNA, 22 bp, Homo sapiens
agccacagagcaggagaccttt

SEQ ID NO: 8422875 - DNA, 22 bp, Homo sapiens
agccacagagagggagctgcaa

SEQ ID NO: 8422876 - DNA, 22 bp, Homo sapiens
agccctagagaaccagcctgtg

SEQ ID NO: 8422877 - DNA, 22 bp, Homo sapiens
agcccggcttccccggttgcta

SEQ ID NO: 8422878 - DNA, 19 bp, Homo sapiens
agcccccagacagcaggcc

SEQ ID NO: 8422879 - DNA, 19 bp, Homo sapiens
agcccccagacagcaggcc

SEQ ID NO: 8422880 - DNA, 23 bp, Homo sapiens
cagagctggctcagagctgcctg

SEQ ID NO: 8422881 - DNA, 22 bp, Homo sapiens
cagagctggcctgtgatttttg

SEQ ID NO: 8422882 - DNA, 22 bp, Homo sapiens
agcccagcctgattctacaccc

SEQ ID NO: 8422883 - DNA, 22 bp, Homo sapiens
agcccaggaagttgaggcttgc

SEQ ID NO: 8422884 - DNA, 22 bp, Homo sapiens
agcccaggaagttgaggcttgc

SEQ ID NO: 8422885 - DNA, 22 bp, Homo sapiens
agcccaggaggtggaggttgca

SEQ ID NO: 8422886 - DNA, 22 bp, Homo sapiens
agcccaggaggtggaggttgca

SEQ ID NO: 8422887 - DNA, 22 bp, Homo sapiens
agcccaggagcctttggagggt

SEQ ID NO: 8422888 - DNA, 22 bp, Homo sapiens
agcccaggagcctttggagggt

SEQ ID NO: 8422889 - DNA, 22 bp, Homo sapiens
cagagctgcttcccagtttgtg

SEQ ID NO: 8422890 - DNA, 22 bp, Homo sapiens
cagagctggacttaaatatatt

SEQ ID NO: 8422891 - DNA, 22 bp, Homo sapiens
agcccaggagtttgaggctgtg

SEQ ID NO: 8422892 - DNA, 22 bp, Homo sapiens
agcccaggagtttgaggctgtg

SEQ ID NO: 8422893 - DNA, 22 bp, Homo sapiens
agcccaggagtttgaggctgtg

SEQ ID NO: 8422894 - DNA, 20 bp, Homo sapiens
agccagggttctggatgcac

SEQ ID NO: 8422895 - DNA, 22 bp, Homo sapiens
agccaggtcagctcaccctgct

SEQ ID NO: 8422896 - DNA, 17 bp, Homo sapiens
agccaggtacaagtcca

SEQ ID NO: 8422897 - DNA, 22 bp, Homo sapiens
agccaggtcagctcaccctgct

SEQ ID NO: 8422898 - DNA, 20 bp, Homo sapiens
cagagattttacttcctcac

SEQ ID NO: 8422899 - DNA, 22 bp, Homo sapiens
cagagcacacatgcatagagtg

SEQ ID NO: 8422900 - DNA, 22 bp, Homo sapiens
cagagatgggtcgcagagatgg

SEQ ID NO: 8422901 - DNA, 22 bp, Homo sapiens
cagagatgtgatccagctgtct

SEQ ID NO: 8422902 - DNA, 22 bp, Homo sapiens
cagagatgtgatccagctgtct

SEQ ID NO: 8422903 - DNA, 22 bp, Homo sapiens
cagagagggcggccctggcttc

SEQ ID NO: 8422904 - DNA, 22 bp, Homo sapiens
cagagatggggccagctgctcc

SEQ ID NO: 8422905 - DNA, 22 bp, Homo sapiens
cagagaggatggattccatagc

SEQ ID NO: 8422906 - DNA, 21 bp, Homo sapiens
agccagtctgttttctagtgc

SEQ ID NO: 8422907 - DNA, 21 bp, Homo sapiens
agccagtctgttttctagtgc

SEQ ID NO: 8422908 - DNA, 21 bp, Homo sapiens
agccagtctcagtactgtact

SEQ ID NO: 8422909 - DNA, 21 bp, Homo sapiens
agccagtctgccagagaagcc

SEQ ID NO: 8422910 - DNA, 22 bp, Homo sapiens
agccagtctctctccctggaga

SEQ ID NO: 8422911 - DNA, 22 bp, Homo sapiens
agccagtctctctccctggaga

SEQ ID NO: 8422912 - DNA, 19 bp, Homo sapiens
agccagtgagcctctgggt

SEQ ID NO: 8422913 - DNA, 22 bp, Homo sapiens
agccagtcggggccatgctggg

SEQ ID NO: 8422914 - DNA, 22 bp, Homo sapiens
agccagtccatcactaatgggt

SEQ ID NO: 8422915 - DNA, 22 bp, Homo sapiens
agccagtcccttgagcgtgccc

SEQ ID NO: 8422916 - DNA, 22 bp, Homo sapiens
agccagtcccttgagcgtgccc

SEQ ID NO: 8422917 - DNA, 19 bp, Homo sapiens
agccagtccaagttctgtc

SEQ ID NO: 8422918 - DNA, 21 bp, Homo sapiens
agccagtcattatgagcggga

SEQ ID NO: 8422919 - DNA, 19 bp, Homo sapiens
cagcaagaatgaaggcata

SEQ ID NO: 8422920 - DNA, 22 bp, Homo sapiens
cagcaagaatcagacaacctca

SEQ ID NO: 8422921 - DNA, 22 bp, Homo sapiens
cagcaagaatcagacaacctca

SEQ ID NO: 8422922 - DNA, 22 bp, Homo sapiens
cagaggctcaccagcctttcac

SEQ ID NO: 8422923 - DNA, 22 bp, Homo sapiens
cagcacacagtgactcgcacct

SEQ ID NO: 8422924 - DNA, 22 bp, Homo sapiens
cagaggctaagatgagtgggtg

SEQ ID NO: 8422925 - DNA, 22 bp, Homo sapiens
cagaggctaagagtgtccaaag

SEQ ID NO: 8422926 - DNA, 22 bp, Homo sapiens
cagaggctagactgtgcttcct

SEQ ID NO: 8422927 - DNA, 22 bp, Homo sapiens
agccctccaaaggttgggggag

SEQ ID NO: 8422928 - DNA, 22 bp, Homo sapiens
agcctcagcacgcagctctgtg

SEQ ID NO: 8422929 - DNA, 23 bp, Homo sapiens
agcctcagccggtggcagaagtg

SEQ ID NO: 8422930 - DNA, 23 bp, Homo sapiens
agcctcagccggtggcagaagtg

SEQ ID NO: 8422931 - DNA, 21 bp, Homo sapiens
agcctcaggttgttggttctt

SEQ ID NO: 8422932 - DNA, 22 bp, Homo sapiens
agcctcagggctctgcgcagac

SEQ ID NO: 8422933 - DNA, 22 bp, Homo sapiens
agcctcagcacgcagctctgtg

SEQ ID NO: 8422934 - DNA, 22 bp, Homo sapiens
cagcacaggaatatggtggaca

SEQ ID NO: 8422935 - DNA, 22 bp, Homo sapiens
cagcagcatgaattcgagccac

SEQ ID NO: 8422936 - DNA, 22 bp, Homo sapiens
cagcagcagtgttctagaatct

SEQ ID NO: 8422937 - DNA, 22 bp, Homo sapiens
agcctggtttaagcattttata

SEQ ID NO: 8422938 - DNA, 22 bp, Homo sapiens
agcctgtccagaggacagggct

SEQ ID NO: 8422939 - DNA, 22 bp, Homo sapiens
agcctgtccagaggacagggct

SEQ ID NO: 8422940 - DNA, 22 bp, Homo sapiens
agccttcagcagttcaggtgcc

SEQ ID NO: 8422941 - DNA, 22 bp, Homo sapiens
agccttcagtaaatccactgtg

SEQ ID NO: 8422942 - DNA, 23 bp, Homo sapiens
agccttcaggcaatgtcagtaga

SEQ ID NO: 8422943 - DNA, 22 bp, Homo sapiens
agccttcataatcttgggcttt

SEQ ID NO: 8422944 - DNA, 22 bp, Homo sapiens
agccttcagtaagggcttagca

SEQ ID NO: 8422945 - DNA, 22 bp, Homo sapiens
agccttccacccagatcccctt

SEQ ID NO: 8422946 - DNA, 22 bp, Homo sapiens
cagcagaggttttgctccatga

SEQ ID NO: 8422947 - DNA, 22 bp, Homo sapiens
cagcagcagtggctgcagaaca

SEQ ID NO: 8422948 - DNA, 22 bp, Homo sapiens
cagcagcagtggctgcagaaca

SEQ ID NO: 8422949 - DNA, 22 bp, Homo sapiens
agcctccacagatgcaaagggc

SEQ ID NO: 8422950 - DNA, 22 bp, Homo sapiens
agcctccatcccatgcacaaag

SEQ ID NO: 8422951 - DNA, 22 bp, Homo sapiens
agcctccagtagctgaagagac

SEQ ID NO: 8422952 - DNA, 22 bp, Homo sapiens
agcctccaaatgtcaggtcccg

SEQ ID NO: 8422953 - DNA, 22 bp, Homo sapiens
agcctcagtttcaggcctcctc

SEQ ID NO: 8422954 - DNA, 22 bp, Homo sapiens
agcctccaaatgtcaggtcccg

SEQ ID NO: 8422955 - DNA, 22 bp, Homo sapiens
agcctcagtttcaggcctcctc

SEQ ID NO: 8422956 - DNA, 22 bp, Homo sapiens
agcctcagtgtcaccatctacc

SEQ ID NO: 8422957 - DNA, 22 bp, Homo sapiens
agcctcagtgtcaccatctacc

SEQ ID NO: 8422958 - DNA, 22 bp, Homo sapiens
cagcagaaatggattttgagat

SEQ ID NO: 8422959 - DNA, 22 bp, Homo sapiens
cagcagaggtggttcacattgt

SEQ ID NO: 8422960 - DNA, 22 bp, Homo sapiens
cagcagaggaaagcaaatctaa

SEQ ID NO: 8422961 - DNA, 22 bp, Homo sapiens
cagcagagcttattaactaaaa

SEQ ID NO: 8422962 - DNA, 20 bp, Homo sapiens
agctcctcatcactggaggt

SEQ ID NO: 8422963 - DNA, 22 bp, Homo sapiens
agctcctcctgtgccaggccag

SEQ ID NO: 8422964 - DNA, 22 bp, Homo sapiens
agctcctcctgagtgtctggga

SEQ ID NO: 8422965 - DNA, 21 bp, Homo sapiens
agctccctgtttcctcactct

SEQ ID NO: 8422966 - DNA, 22 bp, Homo sapiens
agctccctgagatgccacagca

SEQ ID NO: 8422967 - DNA, 22 bp, Homo sapiens
agctccctgcacgaccctgccc

SEQ ID NO: 8422968 - DNA, 22 bp, Homo sapiens
cagccctggcgcccccagatct

SEQ ID NO: 8422969 - DNA, 22 bp, Homo sapiens
cagccctggcctcttcgctttc

SEQ ID NO: 8422970 - DNA, 22 bp, Homo sapiens
cagccctggccccaggtggtct

SEQ ID NO: 8422971 - DNA, 22 bp, Homo sapiens
agctcctgaaaagcgcttgctt

SEQ ID NO: 8422972 - DNA, 22 bp, Homo sapiens
agctcctgaaaagcgcttgctt

SEQ ID NO: 8422973 - DNA, 22 bp, Homo sapiens
agctcctctagatctgccactt

SEQ ID NO: 8422974 - DNA, 22 bp, Homo sapiens
cagccctgggtccctgccctgg

SEQ ID NO: 8422975 - DNA, 22 bp, Homo sapiens
cagccctgggtccctgccctgg

SEQ ID NO: 8422976 - DNA, 22 bp, Homo sapiens
cagccctgggtccctgccctgg

SEQ ID NO: 8422977 - DNA, 22 bp, Homo sapiens
agctcctgtgtgaagcctccct

SEQ ID NO: 8422978 - DNA, 22 bp, Homo sapiens
cagccctgggagttggggccga

SEQ ID NO: 8422979 - DNA, 22 bp, Homo sapiens
cagccctggctagggcgagggc

SEQ ID NO: 8422980 - DNA, 22 bp, Homo sapiens
cagccctggctagggcgagggc

SEQ ID NO: 8422981 - DNA, 22 bp, Homo sapiens
cagccctggcgcccccagatct

SEQ ID NO: 8422982 - DNA, 22 bp, Homo sapiens
cagccctggcgcccccagatct

SEQ ID NO: 8422983 - DNA, 22 bp, Homo sapiens
cagccagagaaagggcactgcc

SEQ ID NO: 8422984 - DNA, 22 bp, Homo sapiens
cagccagatcaaactcagatgt

SEQ ID NO: 8422985 - DNA, 22 bp, Homo sapiens
cagccagctgaatgtaccatga

SEQ ID NO: 8422986 - DNA, 22 bp, Homo sapiens
agctcccagggctgggcaagtt

SEQ ID NO: 8422987 - DNA, 22 bp, Homo sapiens
agctcccagcagagctggccac

SEQ ID NO: 8422988 - DNA, 23 bp, Homo sapiens
agctccagggaacaggcagtagg

SEQ ID NO: 8422989 - DNA, 22 bp, Homo sapiens
cagcaggacgtccaagtgctat

SEQ ID NO: 8422990 - DNA, 22 bp, Homo sapiens
cagcaggacgtccaagtgctat

SEQ ID NO: 8422991 - DNA, 22 bp, Homo sapiens
cagcaggagcagtcagactcct

SEQ ID NO: 8422992 - DNA, 22 bp, Homo sapiens
cagcaggaggcatggcttccct

SEQ ID NO: 8422993 - DNA, 22 bp, Homo sapiens
agccttgtagaccattttaagg

SEQ ID NO: 8422994 - DNA, 22 bp, Homo sapiens
agccttgctttttcagtagcac

SEQ ID NO: 8422995 - DNA, 22 bp, Homo sapiens
agccttgaacactgactgaagg

SEQ ID NO: 8422996 - DNA, 22 bp, Homo sapiens
agccttccaggtagatggcaca

SEQ ID NO: 8422997 - DNA, 22 bp, Homo sapiens
agccttctaggatgtcatctgc

SEQ ID NO: 8422998 - DNA, 22 bp, Homo sapiens
agccttctaggatgtcatctgc

SEQ ID NO: 8422999 - DNA, 22 bp, Homo sapiens
agccttgatcttggtaacagga

SEQ ID NO: 8423000 - DNA, 22 bp, Homo sapiens
agccttgcctgggaaactgggt

SEQ ID NO: 8423001 - DNA, 22 bp, Homo sapiens
agccttgctttttcagtagcac

SEQ ID NO: 8423002 - DNA, 22 bp, Homo sapiens
agccttgcatgatttcattcat

SEQ ID NO: 8423003 - DNA, 22 bp, Homo sapiens
agccttgaaccaattgtttagc

SEQ ID NO: 8423004 - DNA, 22 bp, Homo sapiens
agccttgagttcaagtgctggc

SEQ ID NO: 8423005 - DNA, 22 bp, Homo sapiens
agccttgacactggggaaactg

SEQ ID NO: 8423006 - DNA, 22 bp, Homo sapiens
agccttgagcagttcacttggt

SEQ ID NO: 8423007 - DNA, 22 bp, Homo sapiens
agctcagaaatgccagtaggta

SEQ ID NO: 8423008 - DNA, 22 bp, Homo sapiens
agctcagaactgcagacatgtg

SEQ ID NO: 8423009 - DNA, 22 bp, Homo sapiens
cagcaggaggtgagtagcaggt

SEQ ID NO: 8423010 - DNA, 22 bp, Homo sapiens
agctcaatgcaacctccgcctc

SEQ ID NO: 8423011 - DNA, 22 bp, Homo sapiens
agcaaaagatagattaacaaga

SEQ ID NO: 8423012 - DNA, 17 bp, Homo sapiens
agcaaaagtatcaaagc

SEQ ID NO: 8423013 - DNA, 17 bp, Homo sapiens
agcaaaagtatcaaagc

SEQ ID NO: 8423014 - DNA, 20 bp, Homo sapiens
agcaaaatgcaagattttca

SEQ ID NO: 8423015 - DNA, 20 bp, Homo sapiens
agcaaaatgcaagattttca

SEQ ID NO: 8423016 - DNA, 22 bp, Homo sapiens
agcaaaataaggtaatttattg

SEQ ID NO: 8423017 - DNA, 22 bp, Homo sapiens
agcaaaataaggtaatttattg

SEQ ID NO: 8423018 - DNA, 22 bp, Homo sapiens
agcaaaataaggtaatttattg

SEQ ID NO: 8423019 - DNA, 20 bp, Homo sapiens
agcaaaatgcaagattttca

SEQ ID NO: 8423020 - DNA, 22 bp, Homo sapiens
agcaaacagtgtgctaagaaat

SEQ ID NO: 8423021 - DNA, 22 bp, Homo sapiens
agcaaacagtgtgctaagaaat

SEQ ID NO: 8423022 - DNA, 22 bp, Homo sapiens
agatgtggatcctagggtagaa

SEQ ID NO: 8423023 - DNA, 22 bp, Homo sapiens
agatgtggaaagaagttagaag

SEQ ID NO: 8423024 - DNA, 22 bp, Homo sapiens
agatgtggaacactagactgct

SEQ ID NO: 8423025 - DNA, 22 bp, Homo sapiens
atttgcttgactatggcttgca

SEQ ID NO: 8423026 - DNA, 19 bp, Homo sapiens
atttgcttgtctgctctgc

SEQ ID NO: 8423027 - DNA, 22 bp, Homo sapiens
atttgcttgtcctggtgactgt

SEQ ID NO: 8423028 - DNA, 22 bp, Homo sapiens
atttgcttctgtgaaatcaagt

SEQ ID NO: 8423029 - DNA, 22 bp, Homo sapiens
atttgcttctgctaaacaactt

SEQ ID NO: 8423030 - DNA, 22 bp, Homo sapiens
atttgcttcatagatctgtgga

SEQ ID NO: 8423031 - DNA, 22 bp, Homo sapiens
agatgaagatgccactaagacc

SEQ ID NO: 8423032 - DNA, 22 bp, Homo sapiens
agatgaatccacacatggcaaa

SEQ ID NO: 8423033 - DNA, 23 bp, Homo sapiens
agatgaaagcttcccatcacagt

SEQ ID NO: 8423034 - DNA, 23 bp, Homo sapiens
agatgaaagcttcccatcacagt

SEQ ID NO: 8423035 - DNA, 22 bp, Homo sapiens
agatgaaatttgtgttgagttg

SEQ ID NO: 8423036 - DNA, 18 bp, Homo sapiens
agatgaaagcaaatgaca

SEQ ID NO: 8423037 - DNA, 18 bp, Homo sapiens
agatgaaagcaaatgaca

SEQ ID NO: 8423038 - DNA, 22 bp, Homo sapiens
agatgaaagatttttatagaga

SEQ ID NO: 8423039 - DNA, 22 bp, Homo sapiens
agatgaaaatacgtgactttaa

SEQ ID NO: 8423040 - DNA, 22 bp, Homo sapiens
agatcttttggttattataaga

SEQ ID NO: 8423041 - DNA, 22 bp, Homo sapiens
agatgaaaagataagcagcaat

SEQ ID NO: 8423042 - DNA, 21 bp, Homo sapiens
agatccagtgccataaggccc

SEQ ID NO: 8423043 - DNA, 22 bp, Homo sapiens
agatggttttgtctttatgatt

SEQ ID NO: 8423044 - DNA, 22 bp, Homo sapiens
agatgtaaactctcatgtcatt

SEQ ID NO: 8423045 - DNA, 22 bp, Homo sapiens
agatgtaccaggtattacagga

SEQ ID NO: 8423046 - DNA, 22 bp, Homo sapiens
agatggtgtttccccaggtgga

SEQ ID NO: 8423047 - DNA, 22 bp, Homo sapiens
agatggtggactatctgacttg

SEQ ID NO: 8423048 - DNA, 22 bp, Homo sapiens
agatggttatcttttctttgta

SEQ ID NO: 8423049 - DNA, 22 bp, Homo sapiens
agatggttcagaattataaaga

SEQ ID NO: 8423050 - DNA, 20 bp, Homo sapiens
agatggtgaaggccagggag

SEQ ID NO: 8423051 - DNA, 22 bp, Homo sapiens
agatggtgatagagctgggatt

SEQ ID NO: 8423052 - DNA, 22 bp, Homo sapiens
agatggtgagggcagaagtaac

SEQ ID NO: 8423053 - DNA, 19 bp, Homo sapiens
agatggggaagagtgtgag

SEQ ID NO: 8423054 - DNA, 22 bp, Homo sapiens
atttccaaggtaattttgagta

SEQ ID NO: 8423055 - DNA, 21 bp, Homo sapiens
atttccacataatcataagac

SEQ ID NO: 8423056 - DNA, 22 bp, Homo sapiens
atttccaagaaagctttaggat

SEQ ID NO: 8423057 - DNA, 22 bp, Homo sapiens
atttccaactacccctccattt

SEQ ID NO: 8423058 - DNA, 22 bp, Homo sapiens
attcttcatggctgtgagtcct

SEQ ID NO: 8423059 - DNA, 22 bp, Homo sapiens
agaggtagaggttgcagtgagc

SEQ ID NO: 8423060 - DNA, 22 bp, Homo sapiens
agagggtgggcacgtgatggat

SEQ ID NO: 8423061 - DNA, 22 bp, Homo sapiens
atttaacaagacagagaactgg

SEQ ID NO: 8423062 - DNA, 22 bp, Homo sapiens
atttaaattttctgatggagag

SEQ ID NO: 8423063 - DNA, 22 bp, Homo sapiens
attgttaataactattacattg

SEQ ID NO: 8423064 - DNA, 22 bp, Homo sapiens
atttaagactgacttcaccagt

SEQ ID NO: 8423065 - DNA, 22 bp, Homo sapiens
atttaagactgacttcaccagt

SEQ ID NO: 8423066 - DNA, 22 bp, Homo sapiens
atttaataccacttggtgcttt

SEQ ID NO: 8423067 - DNA, 22 bp, Homo sapiens
agagtggcccgttggcctgaac

SEQ ID NO: 8423068 - DNA, 22 bp, Homo sapiens
agagtggctctgctgggcacag

SEQ ID NO: 8423069 - DNA, 22 bp, Homo sapiens
agagtggcttctttgacatgct

SEQ ID NO: 8423070 - DNA, 23 bp, Homo sapiens
agagtggcctactcacactcatt

SEQ ID NO: 8423071 - DNA, 23 bp, Homo sapiens
agagtggcctactcacactcatt

SEQ ID NO: 8423072 - DNA, 17 bp, Homo sapiens
atttagcaagtagacag

SEQ ID NO: 8423073 - DNA, 22 bp, Homo sapiens
atttagcaaaaaatgatgaagc

SEQ ID NO: 8423074 - DNA, 22 bp, Homo sapiens
atttagagtgaaacattatgca

SEQ ID NO: 8423075 - DNA, 23 bp, Homo sapiens
atttacaggttaaatgaaatcag

SEQ ID NO: 8423076 - DNA, 23 bp, Homo sapiens
atttacaggttaaatgaaatcag

SEQ ID NO: 8423077 - DNA, 22 bp, Homo sapiens
atttagaagttggagggcaaga

SEQ ID NO: 8423078 - DNA, 22 bp, Homo sapiens
atttagaagttggagggcaaga

SEQ ID NO: 8423079 - DNA, 22 bp, Homo sapiens
agagtgggcctctgagtcccag

SEQ ID NO: 8423080 - DNA, 22 bp, Homo sapiens
agagtgggcctctgagtcccag

SEQ ID NO: 8423081 - DNA, 22 bp, Homo sapiens
agagtgggcctagctgtaaaag

SEQ ID NO: 8423082 - DNA, 22 bp, Homo sapiens
agagtggggaaggtgttgagaa

SEQ ID NO: 8423083 - DNA, 22 bp, Homo sapiens
agagtggggaaggtgttgagaa

SEQ ID NO: 8423084 - DNA, 22 bp, Homo sapiens
agagtggcttgctcagctagca

SEQ ID NO: 8423085 - DNA, 22 bp, Homo sapiens
agagtggcttctttgacatgct

SEQ ID NO: 8423086 - DNA, 22 bp, Homo sapiens
agagtggcttctttgacatgct

SEQ ID NO: 8423087 - DNA, 22 bp, Homo sapiens
agagtggcttgctcagctagca

SEQ ID NO: 8423088 - DNA, 22 bp, Homo sapiens
agagtgggacacgggcgctgtc

SEQ ID NO: 8423089 - DNA, 22 bp, Homo sapiens
agagtgggacacgggcgctgtc

SEQ ID NO: 8423090 - DNA, 22 bp, Homo sapiens
atttattcctgattcctggctt

SEQ ID NO: 8423091 - DNA, 22 bp, Homo sapiens
atttattcctttatggctggag

SEQ ID NO: 8423092 - DNA, 22 bp, Homo sapiens
atttattctccagatggcgaga

SEQ ID NO: 8423093 - DNA, 22 bp, Homo sapiens
attatacattttgtgtagagat

SEQ ID NO: 8423094 - DNA, 22 bp, Homo sapiens
attatacattttgtgtagagat

SEQ ID NO: 8423095 - DNA, 22 bp, Homo sapiens
attataaatattttctaggggt

SEQ ID NO: 8423096 - DNA, 22 bp, Homo sapiens
attataaagaacatgtgtgtgg

SEQ ID NO: 8423097 - DNA, 22 bp, Homo sapiens
attataaagaacatgtgtgtgg

SEQ ID NO: 8423098 - DNA, 22 bp, Homo sapiens
attatagagggttacagttaat

SEQ ID NO: 8423099 - DNA, 22 bp, Homo sapiens
attcacaattagaagtagataa

SEQ ID NO: 8423100 - DNA, 22 bp, Homo sapiens
attcacactgtatacacaggat

SEQ ID NO: 8423101 - DNA, 22 bp, Homo sapiens
attcagcataatcagtagcttg

SEQ ID NO: 8423102 - DNA, 22 bp, Homo sapiens
attcacagttcattagctgtaa

SEQ ID NO: 8423103 - DNA, 22 bp, Homo sapiens
attcagagtctgcacaacagca

SEQ ID NO: 8423104 - DNA, 22 bp, Homo sapiens
attctgggttcatgagtgagct

SEQ ID NO: 8423105 - DNA, 22 bp, Homo sapiens
attctgggtgactacgtgatca

SEQ ID NO: 8423106 - DNA, 22 bp, Homo sapiens
attctgggtctgggtgtgatca

SEQ ID NO: 8423107 - DNA, 22 bp, Homo sapiens
attctggggctggttattttga

SEQ ID NO: 8423108 - DNA, 22 bp, Homo sapiens
attctgggtttgctgtacaaag

SEQ ID NO: 8423109 - DNA, 21 bp, Homo sapiens
agagggagagtggcccttcca

SEQ ID NO: 8423110 - DNA, 22 bp, Homo sapiens
attctgggagtgtaggatggtt

SEQ ID NO: 8423111 - DNA, 22 bp, Homo sapiens
attctgggaggtagaactgaaa

SEQ ID NO: 8423112 - DNA, 22 bp, Homo sapiens
attctggacaatgagaaactgg

SEQ ID NO: 8423113 - DNA, 22 bp, Homo sapiens
attctctgtggtgatgctggtg

SEQ ID NO: 8423114 - DNA, 22 bp, Homo sapiens
attctctgtggtgatgctggtg

SEQ ID NO: 8423115 - DNA, 22 bp, Homo sapiens
attctctgtgcagatttaagac

SEQ ID NO: 8423116 - DNA, 22 bp, Homo sapiens
attctctgtgtctgctttccca

SEQ ID NO: 8423117 - DNA, 22 bp, Homo sapiens
attctctgtgtctgctttccca

SEQ ID NO: 8423118 - DNA, 22 bp, Homo sapiens
attctctgtttccaagatgaaa

SEQ ID NO: 8423119 - DNA, 22 bp, Homo sapiens
attctctgtttccaagatgaaa

SEQ ID NO: 8423120 - DNA, 22 bp, Homo sapiens
attctctgttcaaggatggtga

SEQ ID NO: 8423121 - DNA, 22 bp, Homo sapiens
agagggatcaccctgtttctgg

SEQ ID NO: 8423122 - DNA, 22 bp, Homo sapiens
agagggcaagtgtagtccagta

SEQ ID NO: 8423123 - DNA, 22 bp, Homo sapiens
agagggatcaccctgtttctgg

SEQ ID NO: 8423124 - DNA, 21 bp, Homo sapiens
agagggagagtggcccttcca

SEQ ID NO: 8423125 - DNA, 22 bp, Homo sapiens
agagggagcccagtcatagctg

SEQ ID NO: 8423126 - DNA, 22 bp, Homo sapiens
agagggtgagcaggtacacatg

SEQ ID NO: 8423127 - DNA, 22 bp, Homo sapiens
agagggtagaagacagggttgc

SEQ ID NO: 8423128 - DNA, 22 bp, Homo sapiens
agagggtgaatgagatagaaaa

SEQ ID NO: 8423129 - DNA, 22 bp, Homo sapiens
agagggtgaatgagatagaaaa

SEQ ID NO: 8423130 - DNA, 22 bp, Homo sapiens
agaggggctcatatcctgtcat

SEQ ID NO: 8423131 - DNA, 22 bp, Homo sapiens
atgttttaaatatgtgtgtaaa

SEQ ID NO: 8423132 - DNA, 22 bp, Homo sapiens
atgtttgttgaacatctactgc

SEQ ID NO: 8423133 - DNA, 22 bp, Homo sapiens
atgtttgtgtttcccattcagg

SEQ ID NO: 8423134 - DNA, 22 bp, Homo sapiens
atgtttgtaggtaagtgacact

SEQ ID NO: 8423135 - DNA, 22 bp, Homo sapiens
atgtttgtgttacactctgcag

SEQ ID NO: 8423136 - DNA, 22 bp, Homo sapiens
attaaagaaacccagcatgtga

SEQ ID NO: 8423137 - DNA, 22 bp, Homo sapiens
attaaagaaacccagcatgtga

SEQ ID NO: 8423138 - DNA, 22 bp, Homo sapiens
attaaagtgaagttctcagatg

SEQ ID NO: 8423139 - DNA, 22 bp, Homo sapiens
attaaacaatgtaaagttcttg

SEQ ID NO: 8423140 - DNA, 22 bp, Homo sapiens
attaaacaatgtaaagttcttg

SEQ ID NO: 8423141 - DNA, 22 bp, Homo sapiens
attagcaattgccctgtgcaat

SEQ ID NO: 8423142 - DNA, 22 bp, Homo sapiens
attagcaattgccctgtgcaat

SEQ ID NO: 8423143 - DNA, 22 bp, Homo sapiens
attagcagtgccttgcctgtct

SEQ ID NO: 8423144 - DNA, 22 bp, Homo sapiens
attagcagctttctggtctcta

SEQ ID NO: 8423145 - DNA, 22 bp, Homo sapiens
attagcatattaaatagtcatt

SEQ ID NO: 8423146 - DNA, 22 bp, Homo sapiens
attagcatgccaagcttttaga

SEQ ID NO: 8423147 - DNA, 22 bp, Homo sapiens
attagctgtgacgaggcattgt

SEQ ID NO: 8423148 - DNA, 22 bp, Homo sapiens
attataaacctttgagggtggg

SEQ ID NO: 8423149 - DNA, 22 bp, Homo sapiens
attagcattgctactctcaaga

SEQ ID NO: 8423150 - DNA, 22 bp, Homo sapiens
attagattgtaaatgttttcac

SEQ ID NO: 8423151 - DNA, 22 bp, Homo sapiens
attacagtggacagctatgcac

SEQ ID NO: 8423152 - DNA, 22 bp, Homo sapiens
atgttaaatagccatttgtttg

SEQ ID NO: 8423153 - DNA, 20 bp, Homo sapiens
atgttaaatagcatttagag

SEQ ID NO: 8423154 - DNA, 20 bp, Homo sapiens
atgttaaatagcatttagag

SEQ ID NO: 8423155 - DNA, 22 bp, Homo sapiens
atgttaaatggtttattattaa

SEQ ID NO: 8423156 - DNA, 22 bp, Homo sapiens
atgttaaatagccatttgtttg

SEQ ID NO: 8423157 - DNA, 22 bp, Homo sapiens
atgttacaaatcctacaggtag

SEQ ID NO: 8423158 - DNA, 22 bp, Homo sapiens
atgttacaaccctgaggagccg

SEQ ID NO: 8423159 - DNA, 22 bp, Homo sapiens
atgttaacagctgcttctggtg

SEQ ID NO: 8423160 - DNA, 22 bp, Homo sapiens
atgttaactgaagccattctcg

SEQ ID NO: 8423161 - DNA, 22 bp, Homo sapiens
atgttacacataggcataaatg

SEQ ID NO: 8423162 - DNA, 22 bp, Homo sapiens
atgtttctgaagtttacagata

SEQ ID NO: 8423163 - DNA, 22 bp, Homo sapiens
atgtttctgaagtttacagata

SEQ ID NO: 8423164 - DNA, 22 bp, Homo sapiens
atgtttatgttgggctatattt

SEQ ID NO: 8423165 - DNA, 22 bp, Homo sapiens
atgtttatgttgggctatattt

SEQ ID NO: 8423166 - DNA, 22 bp, Homo sapiens
atgtttctgtcctacgagataa

SEQ ID NO: 8423167 - DNA, 22 bp, Homo sapiens
atgtttctgagtgtatatacat

SEQ ID NO: 8423168 - DNA, 22 bp, Homo sapiens
atgttaaagatggtgggaaatt

SEQ ID NO: 8423169 - DNA, 23 bp, Homo sapiens
atgttaaacataactgaagagcc

SEQ ID NO: 8423170 - DNA, 22 bp, Homo sapiens
atgttaaataatcccttaaagc

SEQ ID NO: 8423171 - DNA, 22 bp, Homo sapiens
atgttaaagatggtgggaaatt

SEQ ID NO: 8423172 - DNA, 23 bp, Homo sapiens
atgtgtgggaggtcagagagcca

SEQ ID NO: 8423173 - DNA, 22 bp, Homo sapiens
atgtgtggtttgtaaatgattt

SEQ ID NO: 8423174 - DNA, 21 bp, Homo sapiens
atgtgtgctagaggactactg

SEQ ID NO: 8423175 - DNA, 22 bp, Homo sapiens
atgtgtcttggagttttaatgt

SEQ ID NO: 8423176 - DNA, 22 bp, Homo sapiens
atgtgtgcatgttagagagagt

SEQ ID NO: 8423177 - DNA, 22 bp, Homo sapiens
atgtgtgcatcaatgatagatc

SEQ ID NO: 8423178 - DNA, 19 bp, Homo sapiens
atggaaaattgtactcaat

SEQ ID NO: 8423179 - DNA, 19 bp, Homo sapiens
atggaaaattgtactcaat

SEQ ID NO: 8423180 - DNA, 19 bp, Homo sapiens
atggaaaatgccagactga

SEQ ID NO: 8423181 - DNA, 19 bp, Homo sapiens
atggaaaatgccagactga

SEQ ID NO: 8423182 - DNA, 19 bp, Homo sapiens
atggaaaatgccagactga

SEQ ID NO: 8423183 - DNA, 22 bp, Homo sapiens
atggaaatacagccagagcaga

SEQ ID NO: 8423184 - DNA, 22 bp, Homo sapiens
atggaaatacacaagaggtttc

SEQ ID NO: 8423185 - DNA, 22 bp, Homo sapiens
atggaaagtgcatggaagtcat

SEQ ID NO: 8423186 - DNA, 22 bp, Homo sapiens
atggaaagccagtgttccatca

SEQ ID NO: 8423187 - DNA, 22 bp, Homo sapiens
atgcagggtctccgtgtgacga

SEQ ID NO: 8423188 - DNA, 23 bp, Homo sapiens
atgcagggttacagggctgactt

SEQ ID NO: 8423189 - DNA, 22 bp, Homo sapiens
atgcagggtctccgtgtgacga

SEQ ID NO: 8423190 - DNA, 22 bp, Homo sapiens
atgcagggttatttcaaaaata

SEQ ID NO: 8423191 - DNA, 22 bp, Homo sapiens
atgcttggatgctgccatggga

SEQ ID NO: 8423192 - DNA, 22 bp, Homo sapiens
atgcaggggccgcctggccagg

SEQ ID NO: 8423193 - DNA, 22 bp, Homo sapiens
atgcaggggccgcctggccagg

SEQ ID NO: 8423194 - DNA, 22 bp, Homo sapiens
atgcaggggctgtgttttgggt

SEQ ID NO: 8423195 - DNA, 22 bp, Homo sapiens
atgcaggggcagcagagcctgg

SEQ ID NO: 8423196 - DNA, 22 bp, Homo sapiens
atgcaggggcagcagagcctgg

SEQ ID NO: 8423197 - DNA, 22 bp, Homo sapiens
atgcagggcagagtacgttagc

SEQ ID NO: 8423198 - DNA, 22 bp, Homo sapiens
atgcagggattaaatgactgcc

SEQ ID NO: 8423199 - DNA, 23 bp, Homo sapiens
atggaaatagcatgtgtcattta

SEQ ID NO: 8423200 - DNA, 22 bp, Homo sapiens
atggaaatatctttagagctta

SEQ ID NO: 8423201 - DNA, 22 bp, Homo sapiens
atggaaatcaggttcatccaag

SEQ ID NO: 8423202 - DNA, 22 bp, Homo sapiens
agacgctattttgaggggtcta

SEQ ID NO: 8423203 - DNA, 22 bp, Homo sapiens
atggaaatcgatgtctaagtta

SEQ ID NO: 8423204 - DNA, 22 bp, Homo sapiens
atggaaatcgatgtctaagtta

SEQ ID NO: 8423205 - DNA, 22 bp, Homo sapiens
agactccaaatgaaagaggggg

SEQ ID NO: 8423206 - DNA, 22 bp, Homo sapiens
agactccaaaagtttggtggaa

SEQ ID NO: 8423207 - DNA, 22 bp, Homo sapiens
agactccaggagggaggctgct

SEQ ID NO: 8423208 - DNA, 22 bp, Homo sapiens
agactccttctcactgcctgta

SEQ ID NO: 8423209 - DNA, 22 bp, Homo sapiens
agactcctcggaccaatcagcg

SEQ ID NO: 8423210 - DNA, 22 bp, Homo sapiens
agactctaactcatgccattgc

SEQ ID NO: 8423211 - DNA, 22 bp, Homo sapiens
agactccttctcactgcctgta

SEQ ID NO: 8423212 - DNA, 22 bp, Homo sapiens
agactctaactcatgccattgc

SEQ ID NO: 8423213 - DNA, 22 bp, Homo sapiens
agactacattatgacagcattt

SEQ ID NO: 8423214 - DNA, 22 bp, Homo sapiens
agactacagaatggcattgttt

SEQ ID NO: 8423215 - DNA, 20 bp, Homo sapiens
agactcagtttctatgctct

SEQ ID NO: 8423216 - DNA, 20 bp, Homo sapiens
agactcagtttctatgctct

SEQ ID NO: 8423217 - DNA, 22 bp, Homo sapiens
atggcagcccacgatggcaatg

SEQ ID NO: 8423218 - DNA, 22 bp, Homo sapiens
atggcagcctgaacacttcctg

SEQ ID NO: 8423219 - DNA, 22 bp, Homo sapiens
atggctggcatgtgcataacgg

SEQ ID NO: 8423220 - DNA, 22 bp, Homo sapiens
atggcagcatagtggcaagtta

SEQ ID NO: 8423221 - DNA, 22 bp, Homo sapiens
atggcagcatagtggcaagtta

SEQ ID NO: 8423222 - DNA, 22 bp, Homo sapiens
atggcagcagtccattgcctca

SEQ ID NO: 8423223 - DNA, 22 bp, Homo sapiens
atggcagcagggcttgattatg

SEQ ID NO: 8423224 - DNA, 19 bp, Homo sapiens
atggcagcagcagctctcc

SEQ ID NO: 8423225 - DNA, 22 bp, Homo sapiens
atggcagcagctttagctgtgg

SEQ ID NO: 8423226 - DNA, 22 bp, Homo sapiens
atggctgggtcaccatcagggt

SEQ ID NO: 8423227 - DNA, 22 bp, Homo sapiens
atggctgggtcaccatcagggt

SEQ ID NO: 8423228 - DNA, 22 bp, Homo sapiens
atggctgggatggggtagagaa

SEQ ID NO: 8423229 - DNA, 22 bp, Homo sapiens
atggctggtgatactggagtga

SEQ ID NO: 8423230 - DNA, 21 bp, Homo sapiens
atggctggtggctcagcctcc

SEQ ID NO: 8423231 - DNA, 22 bp, Homo sapiens
atggctggtctcccatggaaaa

SEQ ID NO: 8423232 - DNA, 22 bp, Homo sapiens
atggagtaatattaacatgtta

SEQ ID NO: 8423233 - DNA, 22 bp, Homo sapiens
atggagtggggactgcagtgga

SEQ ID NO: 8423234 - DNA, 22 bp, Homo sapiens
atggagttctgccagcgctgct

SEQ ID NO: 8423235 - DNA, 22 bp, Homo sapiens
atggcagcaaatgtctggctgg

SEQ ID NO: 8423236 - DNA, 22 bp, Homo sapiens
atggcagcaaagaggccttctt

SEQ ID NO: 8423237 - DNA, 22 bp, Homo sapiens
atggcagatggctggagcaggt

SEQ ID NO: 8423238 - DNA, 18 bp, Homo sapiens
atggcagatgataagtgc

SEQ ID NO: 8423239 - DNA, 22 bp, Homo sapiens
atggcagatccacagtttgaag

SEQ ID NO: 8423240 - DNA, 22 bp, Homo sapiens
atggcagagtcctaagccttta

SEQ ID NO: 8423241 - DNA, 22 bp, Homo sapiens
atggataatcatgaactttgag

SEQ ID NO: 8423242 - DNA, 22 bp, Homo sapiens
atggataagtcaaagagtatcc

SEQ ID NO: 8423243 - DNA, 22 bp, Homo sapiens
atggataaatacttggtggtat

SEQ ID NO: 8423244 - DNA, 23 bp, Homo sapiens
atgtccagtttacttcaggatga

SEQ ID NO: 8423245 - DNA, 22 bp, Homo sapiens
atgtctgtacgagttacaatgg

SEQ ID NO: 8423246 - DNA, 22 bp, Homo sapiens
atgtctgtggcaattgttgatg

SEQ ID NO: 8423247 - DNA, 22 bp, Homo sapiens
atgtctgtctttgtactccaca

SEQ ID NO: 8423248 - DNA, 22 bp, Homo sapiens
atgtctgttttcatatcagata

SEQ ID NO: 8423249 - DNA, 19 bp, Homo sapiens
atgtctgttgaatttcata

SEQ ID NO: 8423250 - DNA, 22 bp, Homo sapiens
atgtctgttcattattaactgc

SEQ ID NO: 8423251 - DNA, 22 bp, Homo sapiens
atgtccagaggtgagtcagagc

SEQ ID NO: 8423252 - DNA, 22 bp, Homo sapiens
atgtcaaatgctgcaaactcat

SEQ ID NO: 8423253 - DNA, 22 bp, Homo sapiens
atgtcaaatcagttttatcaga

SEQ ID NO: 8423254 - DNA, 22 bp, Homo sapiens
atgtccaatttcagagtctcat

SEQ ID NO: 8423255 - DNA, 22 bp, Homo sapiens
atgtccaagtcacagattttca

SEQ ID NO: 8423256 - DNA, 22 bp, Homo sapiens
atgtacagccacttcacagtta

SEQ ID NO: 8423257 - DNA, 22 bp, Homo sapiens
atgtacagccacttcacagtta

SEQ ID NO: 8423258 - DNA, 22 bp, Homo sapiens
atgtacaggatggtgctcatct

SEQ ID NO: 8423259 - DNA, 22 bp, Homo sapiens
atgtacaggatggtgctcatct

SEQ ID NO: 8423260 - DNA, 22 bp, Homo sapiens
atgtacagtgataagagggcag

SEQ ID NO: 8423261 - DNA, 22 bp, Homo sapiens
atgtacaggtcttggcaaaggg

SEQ ID NO: 8423262 - DNA, 22 bp, Homo sapiens
atgtacagtttctagactcaaa

SEQ ID NO: 8423263 - DNA, 22 bp, Homo sapiens
atgtacagtttctagactcaaa

SEQ ID NO: 8423264 - DNA, 22 bp, Homo sapiens
atgtacagtttctagactcaaa

SEQ ID NO: 8423265 - DNA, 22 bp, Homo sapiens
atgtacagtggaaactaacaaa

SEQ ID NO: 8423266 - DNA, 22 bp, Homo sapiens
atgtacagtggaaactaacaaa

SEQ ID NO: 8423267 - DNA, 22 bp, Homo sapiens
atgtacagtttctagactcaaa

SEQ ID NO: 8423268 - DNA, 22 bp, Homo sapiens
atgtacagtttctagactcaaa

SEQ ID NO: 8423269 - DNA, 22 bp, Homo sapiens
atgtacatactgcattttcaaa

SEQ ID NO: 8423270 - DNA, 22 bp, Homo sapiens
atggtttagcaacttagggaaa

SEQ ID NO: 8423271 - DNA, 22 bp, Homo sapiens
atggtttacttcatccaatcta

SEQ ID NO: 8423272 - DNA, 22 bp, Homo sapiens
atggtttagttagggcttttca

SEQ ID NO: 8423273 - DNA, 22 bp, Homo sapiens
atggtttactgatctttttggt

SEQ ID NO: 8423274 - DNA, 22 bp, Homo sapiens
atggtttacagaactcctagca

SEQ ID NO: 8423275 - DNA, 22 bp, Homo sapiens
atggtttattgctttaatgaaa

SEQ ID NO: 8423276 - DNA, 22 bp, Homo sapiens
atggtttattagctgcacaggc

SEQ ID NO: 8423277 - DNA, 23 bp, Homo sapiens
atggtttatgtcacacttttgat

SEQ ID NO: 8423278 - DNA, 22 bp, Homo sapiens
atggtttatcctttaccagtcg

SEQ ID NO: 8423279 - DNA, 23 bp, Homo sapiens
atggtttatgttgttgtgaagca

SEQ ID NO: 8423280 - DNA, 22 bp, Homo sapiens
atggtttataatctaggtgtga

SEQ ID NO: 8423281 - DNA, 22 bp, Homo sapiens
atggtttataggacagctctgt

SEQ ID NO: 8423282 - DNA, 22 bp, Homo sapiens
atggttttagaatcaggaaaaa

SEQ ID NO: 8423283 - DNA, 20 bp, Homo sapiens
atgtaaaagacagggagtag

SEQ ID NO: 8423284 - DNA, 22 bp, Homo sapiens
atggtttttcaagtattcagaa

SEQ ID NO: 8423285 - DNA, 22 bp, Homo sapiens
atgtaaaagattattttcctgt

SEQ ID NO: 8423286 - DNA, 20 bp, Homo sapiens
atgtaaaagacagggagtag

SEQ ID NO: 8423287 - DNA, 20 bp, Homo sapiens
atgtaaaattataaggctga

SEQ ID NO: 8423288 - DNA, 20 bp, Homo sapiens
atgtaaaattataaggctga

SEQ ID NO: 8423289 - DNA, 20 bp, Homo sapiens
atgtaaaattataaggctga

SEQ ID NO: 8423290 - DNA, 22 bp, Homo sapiens
atgtaaagggcatggtattggg

SEQ ID NO: 8423291 - DNA, 22 bp, Homo sapiens
atgtaaagtaatctgtcgatca

SEQ ID NO: 8423292 - DNA, 22 bp, Homo sapiens
atgtaaaggcagactttaattt

SEQ ID NO: 8423293 - DNA, 23 bp, Homo sapiens
atgtaaacttcagagtcattgcc

SEQ ID NO: 8423294 - DNA, 22 bp, Homo sapiens
atggctggtgatactggagtga

SEQ ID NO: 8423295 - DNA, 22 bp, Homo sapiens
atgggaggcaaagatcgcagaa

SEQ ID NO: 8423296 - DNA, 22 bp, Homo sapiens
atgggaggcagcagagcccagc

SEQ ID NO: 8423297 - DNA, 22 bp, Homo sapiens
agaattagtcacaattatagga

SEQ ID NO: 8423298 - DNA, 18 bp, Homo sapiens
agaattattcttgtcctc

SEQ ID NO: 8423299 - DNA, 22 bp, Homo sapiens
agaattacataaatacatgaat

SEQ ID NO: 8423300 - DNA, 22 bp, Homo sapiens
agaattacagcttttagaatag

SEQ ID NO: 8423301 - DNA, 18 bp, Homo sapiens
agaattaccaaagtgctt

SEQ ID NO: 8423302 - DNA, 22 bp, Homo sapiens
agaattacataaatacatgaat

SEQ ID NO: 8423303 - DNA, 22 bp, Homo sapiens
agacaatatataattttagttg

SEQ ID NO: 8423304 - DNA, 22 bp, Homo sapiens
agaattctgacaatagaattgg

SEQ ID NO: 8423305 - DNA, 22 bp, Homo sapiens
agacaatttcaaagtaatatta

SEQ ID NO: 8423306 - DNA, 19 bp, Homo sapiens
agacacacttgatatgtgt

SEQ ID NO: 8423307 - DNA, 22 bp, Homo sapiens
agacacagaacacaaaagcata

SEQ ID NO: 8423308 - DNA, 19 bp, Homo sapiens
agacacacttacgtggaat

SEQ ID NO: 8423309 - DNA, 22 bp, Homo sapiens
agacacagattttggaaaagat

SEQ ID NO: 8423310 - DNA, 22 bp, Homo sapiens
agacacagcaataactactgtt

SEQ ID NO: 8423311 - DNA, 22 bp, Homo sapiens
agacacagcagtgcctgcctca

SEQ ID NO: 8423312 - DNA, 22 bp, Homo sapiens
agacacagatggtacctgagcc

SEQ ID NO: 8423313 - DNA, 22 bp, Homo sapiens
agacacagaagttgctgttggg

SEQ ID NO: 8423314 - DNA, 22 bp, Homo sapiens
agacacagaagttgctgttggg

SEQ ID NO: 8423315 - DNA, 22 bp, Homo sapiens
agaatgcaagataaactttatt

SEQ ID NO: 8423316 - DNA, 22 bp, Homo sapiens
agaatgcagtttgaaataaggt

SEQ ID NO: 8423317 - DNA, 22 bp, Homo sapiens
agaatgcagtttgaaataaggt

SEQ ID NO: 8423318 - DNA, 22 bp, Homo sapiens
agaatgataatgccatgatgga

SEQ ID NO: 8423319 - DNA, 22 bp, Homo sapiens
agaatctttctgaatgactgtg

SEQ ID NO: 8423320 - DNA, 22 bp, Homo sapiens
agaatcttgtttcttgtgtgtt

SEQ ID NO: 8423321 - DNA, 22 bp, Homo sapiens
agaatgctcttcaaaatctagc

SEQ ID NO: 8423322 - DNA, 22 bp, Homo sapiens
agaatgcttgtacctttgtttt

SEQ ID NO: 8423323 - DNA, 19 bp, Homo sapiens
agacacatcacatttctcc

SEQ ID NO: 8423324 - DNA, 22 bp, Homo sapiens
agacacatcttaggttgtcagg

SEQ ID NO: 8423325 - DNA, 19 bp, Homo sapiens
agacacatcacatttctcc

SEQ ID NO: 8423326 - DNA, 23 bp, Homo sapiens
agacacataggagcagctattgg

SEQ ID NO: 8423327 - DNA, 23 bp, Homo sapiens
agacacataggagcagctattgg

SEQ ID NO: 8423328 - DNA, 22 bp, Homo sapiens
agacacagtttgggatgggttg

SEQ ID NO: 8423329 - DNA, 22 bp, Homo sapiens
agacacagctaccataatacca

SEQ ID NO: 8423330 - DNA, 21 bp, Homo sapiens
agacacaggggttgctggggt

SEQ ID NO: 8423331 - DNA, 22 bp, Homo sapiens
agacacaggattctgcatttct

SEQ ID NO: 8423332 - DNA, 22 bp, Homo sapiens
agacacagtataagcacaacaa

SEQ ID NO: 8423333 - DNA, 22 bp, Homo sapiens
agacacagtacttgccctcatg

SEQ ID NO: 8423334 - DNA, 22 bp, Homo sapiens
atgcagggaggtaagaggtgcc

SEQ ID NO: 8423335 - DNA, 22 bp, Homo sapiens
atgcagggacctttgctttggt

SEQ ID NO: 8423336 - DNA, 22 bp, Homo sapiens
atgcagggaaaagagatattat

SEQ ID NO: 8423337 - DNA, 21 bp, Homo sapiens
atgcaggctgctcagaagcaa

SEQ ID NO: 8423338 - DNA, 22 bp, Homo sapiens
atgcaggagttcgaggctgtat

SEQ ID NO: 8423339 - DNA, 22 bp, Homo sapiens
agacagtgcaagaagagcaggc

SEQ ID NO: 8423340 - DNA, 21 bp, Homo sapiens
agacagtaactcttctactcc

SEQ ID NO: 8423341 - DNA, 22 bp, Homo sapiens
agacaggtgttttacaacttcg

SEQ ID NO: 8423342 - DNA, 22 bp, Homo sapiens
agacagtgatggacaggcagac

SEQ ID NO: 8423343 - DNA, 22 bp, Homo sapiens
agacagtgagaatgagttgaaa

SEQ ID NO: 8423344 - DNA, 22 bp, Homo sapiens
atctttacagtgtaagtgcaga

SEQ ID NO: 8423345 - DNA, 18 bp, Homo sapiens
atcttgtttttggattaa

SEQ ID NO: 8423346 - DNA, 22 bp, Homo sapiens
atctttaaagacatgtgaactt

SEQ ID NO: 8423347 - DNA, 22 bp, Homo sapiens
atcttgttctcccttgttctta

SEQ ID NO: 8423348 - DNA, 19 bp, Homo sapiens
atctttagcaactttcaaa

SEQ ID NO: 8423349 - DNA, 19 bp, Homo sapiens
atctttagcaactttcaaa

SEQ ID NO: 8423350 - DNA, 22 bp, Homo sapiens
atctttagattagaaactctaa

SEQ ID NO: 8423351 - DNA, 22 bp, Homo sapiens
atctttagacaggaagcaatca

SEQ ID NO: 8423352 - DNA, 22 bp, Homo sapiens
atctttagacaggaagcaatca

SEQ ID NO: 8423353 - DNA, 22 bp, Homo sapiens
atctttagagtcatctgagtgt

SEQ ID NO: 8423354 - DNA, 22 bp, Homo sapiens
atctttaggaacctaacctatt

SEQ ID NO: 8423355 - DNA, 22 bp, Homo sapiens
atctttaggaacctaacctatt

SEQ ID NO: 8423356 - DNA, 21 bp, Homo sapiens
atctttagccatccaatcaga

SEQ ID NO: 8423357 - DNA, 22 bp, Homo sapiens
atctttagcattactttattca

SEQ ID NO: 8423358 - DNA, 22 bp, Homo sapiens
atctttagcattactttattca

SEQ ID NO: 8423359 - DNA, 22 bp, Homo sapiens
atctttaggcaagttacttaac

SEQ ID NO: 8423360 - DNA, 19 bp, Homo sapiens
atctttagggatgtggctt

SEQ ID NO: 8423361 - DNA, 22 bp, Homo sapiens
atctttaggcaagttacttaac

SEQ ID NO: 8423362 - DNA, 22 bp, Homo sapiens
atctttagtagaggaatatatt

SEQ ID NO: 8423363 - DNA, 22 bp, Homo sapiens
atcttggggaatcctctgtgta

SEQ ID NO: 8423364 - DNA, 22 bp, Homo sapiens
agaagcaaggtctgtcagtata

SEQ ID NO: 8423365 - DNA, 22 bp, Homo sapiens
agaagcaaggtctgtcagtata

SEQ ID NO: 8423366 - DNA, 22 bp, Homo sapiens
agaagcacaccagtagacaggg

SEQ ID NO: 8423367 - DNA, 22 bp, Homo sapiens
agaagaacttagctttctatct

SEQ ID NO: 8423368 - DNA, 22 bp, Homo sapiens
agaagaatacttgatgttcatg

SEQ ID NO: 8423369 - DNA, 22 bp, Homo sapiens
agaagaaatgtgaaggccactg

SEQ ID NO: 8423370 - DNA, 22 bp, Homo sapiens
agaagaatttctctcatgattt

SEQ ID NO: 8423371 - DNA, 22 bp, Homo sapiens
agaagaatacttgatgttcatg

SEQ ID NO: 8423372 - DNA, 22 bp, Homo sapiens
agaagaatacttgatgttcatg

SEQ ID NO: 8423373 - DNA, 22 bp, Homo sapiens
agaagacagagtctacattcta

SEQ ID NO: 8423374 - DNA, 22 bp, Homo sapiens
agaagagaactgccaaacactt

SEQ ID NO: 8423375 - DNA, 22 bp, Homo sapiens
agaagagaaatagtgccactgt

SEQ ID NO: 8423376 - DNA, 22 bp, Homo sapiens
agaagagaaatagtgccactgt

SEQ ID NO: 8423377 - DNA, 22 bp, Homo sapiens
agaagatgtcactgcagacagc

SEQ ID NO: 8423378 - DNA, 22 bp, Homo sapiens
agaagagtagtaacagaaatta

SEQ ID NO: 8423379 - DNA, 22 bp, Homo sapiens
agaagattattagagactttgt

SEQ ID NO: 8423380 - DNA, 22 bp, Homo sapiens
agaagaggggtgtccctgtggc

SEQ ID NO: 8423381 - DNA, 21 bp, Homo sapiens
agaagagaagcaggaccctct

SEQ ID NO: 8423382 - DNA, 22 bp, Homo sapiens
agaagagagtcctaccccatac

SEQ ID NO: 8423383 - DNA, 22 bp, Homo sapiens
agaatacagttcagtaatggat

SEQ ID NO: 8423384 - DNA, 22 bp, Homo sapiens
agaatacagtatgcaaaaagat

SEQ ID NO: 8423385 - DNA, 22 bp, Homo sapiens
agaatagaattctcatagaatt

SEQ ID NO: 8423386 - DNA, 22 bp, Homo sapiens
agaatagaattctcatagaatt

SEQ ID NO: 8423387 - DNA, 22 bp, Homo sapiens
agaatactaggcttcagaaagg

SEQ ID NO: 8423388 - DNA, 22 bp, Homo sapiens
agaatactaggcttcagaaagg

SEQ ID NO: 8423389 - DNA, 22 bp, Homo sapiens
atctttgtgaatctcaacttgg

SEQ ID NO: 8423390 - DNA, 20 bp, Homo sapiens
atctttgtctctgtagttgt

SEQ ID NO: 8423391 - DNA, 22 bp, Homo sapiens
agaatcaattcactgctgcagc

SEQ ID NO: 8423392 - DNA, 22 bp, Homo sapiens
atctttggtgcttggtgctccc

SEQ ID NO: 8423393 - DNA, 22 bp, Homo sapiens
atctttgtcactctactgtcta

SEQ ID NO: 8423394 - DNA, 22 bp, Homo sapiens
atctttggtactattcttatca

SEQ ID NO: 8423395 - DNA, 22 bp, Homo sapiens
atctttggtcttgagtgcatct

SEQ ID NO: 8423396 - DNA, 22 bp, Homo sapiens
atctttggtgcatgatactttg

SEQ ID NO: 8423397 - DNA, 22 bp, Homo sapiens
atctttggggcatccaggaaaa

SEQ ID NO: 8423398 - DNA, 22 bp, Homo sapiens
atctttgggtacaaacttgcct

SEQ ID NO: 8423399 - DNA, 19 bp, Homo sapiens
atctttgggtcctgaaggg

SEQ ID NO: 8423400 - DNA, 22 bp, Homo sapiens
atctttatatatctcctctgaa

SEQ ID NO: 8423401 - DNA, 22 bp, Homo sapiens
atctttagtagaggaatatatt

SEQ ID NO: 8423402 - DNA, 22 bp, Homo sapiens
atctttagtcaggcgtgggtat

SEQ ID NO: 8423403 - DNA, 22 bp, Homo sapiens
atctttagtgtgaatttattga

SEQ ID NO: 8423404 - DNA, 22 bp, Homo sapiens
atctttagtgtgaatttattga

SEQ ID NO: 8423405 - DNA, 22 bp, Homo sapiens
agaaggccaatagggtgcactg

SEQ ID NO: 8423406 - DNA, 22 bp, Homo sapiens
agaaggctagagacttgcccaa

SEQ ID NO: 8423407 - DNA, 22 bp, Homo sapiens
agaaggctaaagtaacttagta

SEQ ID NO: 8423408 - DNA, 22 bp, Homo sapiens
agaaggctcatttgactgcatt

SEQ ID NO: 8423409 - DNA, 22 bp, Homo sapiens
agaaggctcatccctcacccca

SEQ ID NO: 8423410 - DNA, 22 bp, Homo sapiens
agaaggctaaagaaacagattg

SEQ ID NO: 8423411 - DNA, 22 bp, Homo sapiens
agaaggcctaacttgggggcaa

SEQ ID NO: 8423412 - DNA, 22 bp, Homo sapiens
agaaggccatgtcttggtactt

SEQ ID NO: 8423413 - DNA, 22 bp, Homo sapiens
agaaggccagatggacggggct

SEQ ID NO: 8423414 - DNA, 22 bp, Homo sapiens
agaatacaattgttcagtaata

SEQ ID NO: 8423415 - DNA, 22 bp, Homo sapiens
agaatacaattgttcagtaata

SEQ ID NO: 8423416 - DNA, 22 bp, Homo sapiens
agaaggctgagactgggatgaa

SEQ ID NO: 8423417 - DNA, 22 bp, Homo sapiens
agaaggctgaagaagatccgtt

SEQ ID NO: 8423418 - DNA, 20 bp, Homo sapiens
agaaggctccttttgccaag

SEQ ID NO: 8423419 - DNA, 22 bp, Homo sapiens
agaaggctcactaagagtgact

SEQ ID NO: 8423420 - DNA, 19 bp, Homo sapiens
agaaggctcctgttggaga

SEQ ID NO: 8423421 - DNA, 22 bp, Homo sapiens
agaaggctccaagtagagtttg

SEQ ID NO: 8423422 - DNA, 19 bp, Homo sapiens
agaaggctcctgttggaga

SEQ ID NO: 8423423 - DNA, 22 bp, Homo sapiens
agaaggctggccatggtgccct

SEQ ID NO: 8423424 - DNA, 22 bp, Homo sapiens
agcttgacagacagatggtagc

SEQ ID NO: 8423425 - DNA, 22 bp, Homo sapiens
agcttgaacctaaaacaataat

SEQ ID NO: 8423426 - DNA, 22 bp, Homo sapiens
agcttgaagccttggcgagatt

SEQ ID NO: 8423427 - DNA, 22 bp, Homo sapiens
agcttgaaccacatgaaattgc

SEQ ID NO: 8423428 - DNA, 22 bp, Homo sapiens
agcttcttaagttcctgcagca

SEQ ID NO: 8423429 - DNA, 22 bp, Homo sapiens
agcttaaagccgccatctagta

SEQ ID NO: 8423430 - DNA, 22 bp, Homo sapiens
agctgtttttgtctgctgatcc

SEQ ID NO: 8423431 - DNA, 22 bp, Homo sapiens
agcttaaactctttgaagttat

SEQ ID NO: 8423432 - DNA, 22 bp, Homo sapiens
agcttgatagtggctatcaagc

SEQ ID NO: 8423433 - DNA, 22 bp, Homo sapiens
agcttgaattattctgctctta

SEQ ID NO: 8423434 - DNA, 23 bp, Homo sapiens
agcttggaacaatgcaaatacag

SEQ ID NO: 8423435 - DNA, 22 bp, Homo sapiens
agcttgggcaacacagcaagac

SEQ ID NO: 8423436 - DNA, 22 bp, Homo sapiens
agcttggtggccctcctggctg

SEQ ID NO: 8423437 - DNA, 22 bp, Homo sapiens
agcttgggtgtgcctgcgagct

SEQ ID NO: 8423438 - DNA, 22 bp, Homo sapiens
agctgtgttattagaaacctgc

SEQ ID NO: 8423439 - DNA, 22 bp, Homo sapiens
agctgttccaggcctcattgct

SEQ ID NO: 8423440 - DNA, 22 bp, Homo sapiens
agctgtgtggtgtctgacagct

SEQ ID NO: 8423441 - DNA, 22 bp, Homo sapiens
agctgtgtgtttccactgagct

SEQ ID NO: 8423442 - DNA, 22 bp, Homo sapiens
agctgttgtctgcaggagaagc

SEQ ID NO: 8423443 - DNA, 22 bp, Homo sapiens
agctgtttccataaatgagaca

SEQ ID NO: 8423444 - DNA, 20 bp, Homo sapiens
agctgtttacatggatttct

SEQ ID NO: 8423445 - DNA, 22 bp, Homo sapiens
agctgtttgtacttagatagta

SEQ ID NO: 8423446 - DNA, 22 bp, Homo sapiens
agctgttttctaatgcatttga

SEQ ID NO: 8423447 - DNA, 22 bp, Homo sapiens
caggcctccactccacgcagac

SEQ ID NO: 8423448 - DNA, 22 bp, Homo sapiens
caggcctcatggtgtgtccttc

SEQ ID NO: 8423449 - DNA, 22 bp, Homo sapiens
caggcctcaggggctcaggctg

SEQ ID NO: 8423450 - DNA, 22 bp, Homo sapiens
caggcctcagggctgtccgtag

SEQ ID NO: 8423451 - DNA, 22 bp, Homo sapiens
caggcctcagagagtggcgggg

SEQ ID NO: 8423452 - DNA, 23 bp, Homo sapiens
agctgggaattttctgaagcttt

SEQ ID NO: 8423453 - DNA, 21 bp, Homo sapiens
caggccccaggcctggggtgc

SEQ ID NO: 8423454 - DNA, 21 bp, Homo sapiens
caggccccaggcctggggtgc

SEQ ID NO: 8423455 - DNA, 22 bp, Homo sapiens
agctggcttttgtgaaggtttt

SEQ ID NO: 8423456 - DNA, 22 bp, Homo sapiens
agctgtggcagcagccgtggca

SEQ ID NO: 8423457 - DNA, 22 bp, Homo sapiens
agctgtgtgacctagggcaagc

SEQ ID NO: 8423458 - DNA, 22 bp, Homo sapiens
agctgtgtcctgaagacactgc

SEQ ID NO: 8423459 - DNA, 22 bp, Homo sapiens
caggcctggttgagccctgaga

SEQ ID NO: 8423460 - DNA, 22 bp, Homo sapiens
caggcctggttgagccctgaga

SEQ ID NO: 8423461 - DNA, 22 bp, Homo sapiens
caggcctggggctggcttccag

SEQ ID NO: 8423462 - DNA, 22 bp, Homo sapiens
caggcctggggctggcttccag

SEQ ID NO: 8423463 - DNA, 22 bp, Homo sapiens
caggcctggctgcagctcgcct

SEQ ID NO: 8423464 - DNA, 22 bp, Homo sapiens
caggcctggctgcagctcgcct

SEQ ID NO: 8423465 - DNA, 22 bp, Homo sapiens
caggcctggctgcagctcgcct

SEQ ID NO: 8423466 - DNA, 22 bp, Homo sapiens
caggcctggcccccggcacacc

SEQ ID NO: 8423467 - DNA, 22 bp, Homo sapiens
caggcctgggcttcggggctga

SEQ ID NO: 8423468 - DNA, 22 bp, Homo sapiens
caggcctggcccccggcacacc

SEQ ID NO: 8423469 - DNA, 22 bp, Homo sapiens
caggcctggcccccggcacacc

SEQ ID NO: 8423470 - DNA, 22 bp, Homo sapiens
caggcctggagtgcaatggcac

SEQ ID NO: 8423471 - DNA, 22 bp, Homo sapiens
agctttacatcgaagttcagtc

SEQ ID NO: 8423472 - DNA, 22 bp, Homo sapiens
agctttagaattgttcagcaag

SEQ ID NO: 8423473 - DNA, 22 bp, Homo sapiens
agctttagaattgttcagcaag

SEQ ID NO: 8423474 - DNA, 22 bp, Homo sapiens
agctttaaaaatccaatatcca

SEQ ID NO: 8423475 - DNA, 22 bp, Homo sapiens
agcttgttaaacagcctccact

SEQ ID NO: 8423476 - DNA, 21 bp, Homo sapiens
agcttgttattaattcagaac

SEQ ID NO: 8423477 - DNA, 22 bp, Homo sapiens
agcttgttctcatccattcttc

SEQ ID NO: 8423478 - DNA, 22 bp, Homo sapiens
aggaaactaacttatctttata

SEQ ID NO: 8423479 - DNA, 22 bp, Homo sapiens
aggaaactaaagcccagagagg

SEQ ID NO: 8423480 - DNA, 22 bp, Homo sapiens
aggaaagactggggccccagaa

SEQ ID NO: 8423481 - DNA, 18 bp, Homo sapiens
aggaaagacgaagagggc

SEQ ID NO: 8423482 - DNA, 22 bp, Homo sapiens
cagggccagccatcctgctggg

SEQ ID NO: 8423483 - DNA, 21 bp, Homo sapiens
aggaaaggaagtccccagggt

SEQ ID NO: 8423484 - DNA, 20 bp, Homo sapiens
aggaaagcctgtgtgagtct

SEQ ID NO: 8423485 - DNA, 22 bp, Homo sapiens
aggaaagatggaaggaggataa

SEQ ID NO: 8423486 - DNA, 22 bp, Homo sapiens
aggaaagccaatctctcttgac

SEQ ID NO: 8423487 - DNA, 22 bp, Homo sapiens
aggaaatgtagtcctcatctcc

SEQ ID NO: 8423488 - DNA, 22 bp, Homo sapiens
aggaacacaacttcctgagagc

SEQ ID NO: 8423489 - DNA, 22 bp, Homo sapiens
aggaacacccccttcctaccag

SEQ ID NO: 8423490 - DNA, 22 bp, Homo sapiens
aggaaatgctgatgctcctgga

SEQ ID NO: 8423491 - DNA, 22 bp, Homo sapiens
aggaaatgcaggcaaatactct

SEQ ID NO: 8423492 - DNA, 22 bp, Homo sapiens
aggaaataggaccagacaaagc

SEQ ID NO: 8423493 - DNA, 22 bp, Homo sapiens
aggaaataggaccagacaaagc

SEQ ID NO: 8423494 - DNA, 22 bp, Homo sapiens
cagggccagccgcagcatccac

SEQ ID NO: 8423495 - DNA, 22 bp, Homo sapiens
aggaaaggggtaggtgtggacg

SEQ ID NO: 8423496 - DNA, 22 bp, Homo sapiens
aggaaaggggtaggtgtggacg

SEQ ID NO: 8423497 - DNA, 22 bp, Homo sapiens
aggaacagaagagcaatgcagg

SEQ ID NO: 8423498 - DNA, 22 bp, Homo sapiens
aggaacaggcctcgttttctat

SEQ ID NO: 8423499 - DNA, 22 bp, Homo sapiens
aggaaccagacagaactgaatg

SEQ ID NO: 8423500 - DNA, 22 bp, Homo sapiens
aggaacctaagagcctgcagtc

SEQ ID NO: 8423501 - DNA, 22 bp, Homo sapiens
aggaactgatttataactttag

SEQ ID NO: 8423502 - DNA, 22 bp, Homo sapiens
aggaagctcaaagccatgatgt

SEQ ID NO: 8423503 - DNA, 18 bp, Homo sapiens
aggaagcaggaggaaggc

SEQ ID NO: 8423504 - DNA, 22 bp, Homo sapiens
agctcctgtgtgaagcctccct

SEQ ID NO: 8423505 - DNA, 22 bp, Homo sapiens
cagctcctgggccatctcctag

SEQ ID NO: 8423506 - DNA, 22 bp, Homo sapiens
cagctcctgcctgggcagctgt

SEQ ID NO: 8423507 - DNA, 22 bp, Homo sapiens
cagctcctgcctgggcagctgt

SEQ ID NO: 8423508 - DNA, 23 bp, Homo sapiens
agctctgctcgggcatgccctgc

SEQ ID NO: 8423509 - DNA, 23 bp, Homo sapiens
agctctgctcgggcatgccctgc

SEQ ID NO: 8423510 - DNA, 22 bp, Homo sapiens
agctctggaactcccggctgct

SEQ ID NO: 8423511 - DNA, 22 bp, Homo sapiens
agctctgccttgacaccttctc

SEQ ID NO: 8423512 - DNA, 22 bp, Homo sapiens
agctctgccttgacaccttctc

SEQ ID NO: 8423513 - DNA, 22 bp, Homo sapiens
cagcttcttacgagctggtact

SEQ ID NO: 8423514 - DNA, 22 bp, Homo sapiens
cagcttctgtttctagcccctg

SEQ ID NO: 8423515 - DNA, 21 bp, Homo sapiens
cagcttcttctgtgacctggt

SEQ ID NO: 8423516 - DNA, 22 bp, Homo sapiens
cagcttcttcagtcctggagct

SEQ ID NO: 8423517 - DNA, 22 bp, Homo sapiens
cagcttctggcgtggagcctga

SEQ ID NO: 8423518 - DNA, 22 bp, Homo sapiens
cagcttctgctcatggaggggt

SEQ ID NO: 8423519 - DNA, 22 bp, Homo sapiens
cagcttctgtttctagcccctg

SEQ ID NO: 8423520 - DNA, 22 bp, Homo sapiens
cagcttctgtttattgtgtgcc

SEQ ID NO: 8423521 - DNA, 22 bp, Homo sapiens
cagctctccaccctcctggttc

SEQ ID NO: 8423522 - DNA, 22 bp, Homo sapiens
cagctctccaccctcctggttc

SEQ ID NO: 8423523 - DNA, 22 bp, Homo sapiens
cagctctacgtttctatgaatc

SEQ ID NO: 8423524 - DNA, 22 bp, Homo sapiens
cagctcctgttggtcttgagga

SEQ ID NO: 8423525 - DNA, 22 bp, Homo sapiens
cagcttttaggactgtgagaaa

SEQ ID NO: 8423526 - DNA, 22 bp, Homo sapiens
cagcttttggcaggatgaccag

SEQ ID NO: 8423527 - DNA, 22 bp, Homo sapiens
agctgcagtcaagctgggccac

SEQ ID NO: 8423528 - DNA, 21 bp, Homo sapiens
agctgcagtcaagccagaggt

SEQ ID NO: 8423529 - DNA, 22 bp, Homo sapiens
agctgcagtatgaggctggtgg

SEQ ID NO: 8423530 - DNA, 22 bp, Homo sapiens
agctgcagtatgaggctggtgg

SEQ ID NO: 8423531 - DNA, 21 bp, Homo sapiens
agctgcagtcaagccagaggt

SEQ ID NO: 8423532 - DNA, 21 bp, Homo sapiens
agctgcagtcaagccagaggt

SEQ ID NO: 8423533 - DNA, 22 bp, Homo sapiens
agctgcaggcgccggggccgat

SEQ ID NO: 8423534 - DNA, 22 bp, Homo sapiens
agctgcaggcgccggggccgat

SEQ ID NO: 8423535 - DNA, 22 bp, Homo sapiens
agctgcaggttcagcattccac

SEQ ID NO: 8423536 - DNA, 22 bp, Homo sapiens
agctgcagtaaagctctccagg

SEQ ID NO: 8423537 - DNA, 22 bp, Homo sapiens
cagcttgaaatattaggagatg

SEQ ID NO: 8423538 - DNA, 22 bp, Homo sapiens
agctgaggcatgatgctatcag

SEQ ID NO: 8423539 - DNA, 22 bp, Homo sapiens
agctgaggcatggacaggctgc

SEQ ID NO: 8423540 - DNA, 22 bp, Homo sapiens
agctgaggccacgagtgaaggg

SEQ ID NO: 8423541 - DNA, 22 bp, Homo sapiens
agctgaggcctgatttcgccgt

SEQ ID NO: 8423542 - DNA, 22 bp, Homo sapiens
agctgaggctctgagagggaag

SEQ ID NO: 8423543 - DNA, 23 bp, Homo sapiens
agctgaggctgtgggtgtcagag

SEQ ID NO: 8423544 - DNA, 21 bp, Homo sapiens
agctgcagccatgtacatggc

SEQ ID NO: 8423545 - DNA, 22 bp, Homo sapiens
agctgcaggcctctcctgggga

SEQ ID NO: 8423546 - DNA, 21 bp, Homo sapiens
agctgcaggcctcccagggat

SEQ ID NO: 8423547 - DNA, 21 bp, Homo sapiens
agctgcagcccaaaggcctgt

SEQ ID NO: 8423548 - DNA, 22 bp, Homo sapiens
caggagtccctctggccagcat

SEQ ID NO: 8423549 - DNA, 22 bp, Homo sapiens
caggagtctctcttgagcccag

SEQ ID NO: 8423550 - DNA, 22 bp, Homo sapiens
caggagtctgttcctcatttgt

SEQ ID NO: 8423551 - DNA, 19 bp, Homo sapiens
agctggctcttctttgtct

SEQ ID NO: 8423552 - DNA, 22 bp, Homo sapiens
agctggctgccttctccttagg

SEQ ID NO: 8423553 - DNA, 19 bp, Homo sapiens
agctggctcttctttgtct

SEQ ID NO: 8423554 - DNA, 22 bp, Homo sapiens
agctggctgccttctccttagg

SEQ ID NO: 8423555 - DNA, 22 bp, Homo sapiens
agctggctggccccttcctgcc

SEQ ID NO: 8423556 - DNA, 22 bp, Homo sapiens
agctggctttgagctgggaggt

SEQ ID NO: 8423557 - DNA, 22 bp, Homo sapiens
agctggctttatggttggctaa

SEQ ID NO: 8423558 - DNA, 22 bp, Homo sapiens
agctggcttctctgcagacatt

SEQ ID NO: 8423559 - DNA, 22 bp, Homo sapiens
agctggctgggtgccagtctcc

SEQ ID NO: 8423560 - DNA, 22 bp, Homo sapiens
agctggcattgcagggagctgc

SEQ ID NO: 8423561 - DNA, 22 bp, Homo sapiens
agctggcattgcagggagctgc

SEQ ID NO: 8423562 - DNA, 22 bp, Homo sapiens
agctggccagcacctccaggtc

SEQ ID NO: 8423563 - DNA, 22 bp, Homo sapiens
agctggcattacaggagcatgc

SEQ ID NO: 8423564 - DNA, 22 bp, Homo sapiens
agctggcatctgaagtcagggc

SEQ ID NO: 8423565 - DNA, 22 bp, Homo sapiens
agctggcatctgaagtcagggc

SEQ ID NO: 8423566 - DNA, 22 bp, Homo sapiens
agctggcatactttgctaggaa

SEQ ID NO: 8423567 - DNA, 22 bp, Homo sapiens
agctggcatactttgctaggaa

SEQ ID NO: 8423568 - DNA, 22 bp, Homo sapiens
caggaggtgacttccaggggtt

SEQ ID NO: 8423569 - DNA, 22 bp, Homo sapiens
caggaggttgtaagagcaggcc

SEQ ID NO: 8423570 - DNA, 22 bp, Homo sapiens
caggaggttggtagcagtagat

SEQ ID NO: 8423571 - DNA, 22 bp, Homo sapiens
caggacagaccaagatcgtgct

SEQ ID NO: 8423572 - DNA, 22 bp, Homo sapiens
caggacagaccaagatcgtgct

SEQ ID NO: 8423573 - DNA, 22 bp, Homo sapiens
caggacagaccaagatcgtgct

SEQ ID NO: 8423574 - DNA, 22 bp, Homo sapiens
caggacagaaataaggaatata

SEQ ID NO: 8423575 - DNA, 22 bp, Homo sapiens
caggacagacagaatgcctaac

SEQ ID NO: 8423576 - DNA, 19 bp, Homo sapiens
caggacagacttcaaagcc

SEQ ID NO: 8423577 - DNA, 19 bp, Homo sapiens
caggacagacttcaaagcc

SEQ ID NO: 8423578 - DNA, 19 bp, Homo sapiens
caggacagacttcaaagcc

SEQ ID NO: 8423579 - DNA, 22 bp, Homo sapiens
caggacagaaataaggaatata

SEQ ID NO: 8423580 - DNA, 22 bp, Homo sapiens
agctgctgagccaggctgatgt

SEQ ID NO: 8423581 - DNA, 22 bp, Homo sapiens
caggacagacagaatgcctaac

SEQ ID NO: 8423582 - DNA, 21 bp, Homo sapiens
agctggcagtgcctggacctc

SEQ ID NO: 8423583 - DNA, 22 bp, Homo sapiens
caggacagagcccagactgtgt

SEQ ID NO: 8423584 - DNA, 22 bp, Homo sapiens
caggacagagcccagactgtgt

SEQ ID NO: 8423585 - DNA, 22 bp, Homo sapiens
agctgctcctttcctgcaggcg

SEQ ID NO: 8423586 - DNA, 22 bp, Homo sapiens
agctgctccaacccagcgggct

SEQ ID NO: 8423587 - DNA, 22 bp, Homo sapiens
agctgcctggccggagccactg

SEQ ID NO: 8423588 - DNA, 22 bp, Homo sapiens
agctgcctggccggagccactg

SEQ ID NO: 8423589 - DNA, 22 bp, Homo sapiens
caggaaaaatgccaggagtcag

SEQ ID NO: 8423590 - DNA, 22 bp, Homo sapiens
caggaaaaatgccaggagtcag

SEQ ID NO: 8423591 - DNA, 22 bp, Homo sapiens
caggaaaaggagactttagcac

SEQ ID NO: 8423592 - DNA, 21 bp, Homo sapiens
cattaagtaccagggcactgt

SEQ ID NO: 8423593 - DNA, 22 bp, Homo sapiens
cattaagatttttttctactgg

SEQ ID NO: 8423594 - DNA, 22 bp, Homo sapiens
catggctcacaggatgggctag

SEQ ID NO: 8423595 - DNA, 22 bp, Homo sapiens
catggctcacaggatgggctag

SEQ ID NO: 8423596 - DNA, 22 bp, Homo sapiens
catggctcggggacaggaggta

SEQ ID NO: 8423597 - DNA, 22 bp, Homo sapiens
catggctcggggacaggaggta

SEQ ID NO: 8423598 - DNA, 22 bp, Homo sapiens
catggcggtcaggatgtaggtg

SEQ ID NO: 8423599 - DNA, 22 bp, Homo sapiens
catggccttgagtgactgcact

SEQ ID NO: 8423600 - DNA, 22 bp, Homo sapiens
catggcctgcctcctcctggtg

SEQ ID NO: 8423601 - DNA, 22 bp, Homo sapiens
catggcctgcctcctcctggtg

SEQ ID NO: 8423602 - DNA, 22 bp, Homo sapiens
catggcctcaaaggactgcaga

SEQ ID NO: 8423603 - DNA, 22 bp, Homo sapiens
catggccctcttctggagcaat

SEQ ID NO: 8423604 - DNA, 22 bp, Homo sapiens
catggccccaaatcccatgcat

SEQ ID NO: 8423605 - DNA, 22 bp, Homo sapiens
cattatctgagagtgtcctaca

SEQ ID NO: 8423606 - DNA, 22 bp, Homo sapiens
cattcaaaagctccatgtttgt

SEQ ID NO: 8423607 - DNA, 22 bp, Homo sapiens
cattcaaacattaatttattca

SEQ ID NO: 8423608 - DNA, 22 bp, Homo sapiens
cattccaagtatatacatgata

SEQ ID NO: 8423609 - DNA, 22 bp, Homo sapiens
cattccctgtctcttcaatcct

SEQ ID NO: 8423610 - DNA, 22 bp, Homo sapiens
cattcccttggggagttcatgc

SEQ ID NO: 8423611 - DNA, 22 bp, Homo sapiens
cattcctgagggccccctactt

SEQ ID NO: 8423612 - DNA, 19 bp, Homo sapiens
aggcagcacccagtccttg

SEQ ID NO: 8423613 - DNA, 19 bp, Homo sapiens
aggcagcacccagtccttg

SEQ ID NO: 8423614 - DNA, 22 bp, Homo sapiens
cattccttaacgtggggagtct

SEQ ID NO: 8423615 - DNA, 19 bp, Homo sapiens
aggcagcacccagtccttg

SEQ ID NO: 8423616 - DNA, 21 bp, Homo sapiens
catttacatgacagattggtt

SEQ ID NO: 8423617 - DNA, 22 bp, Homo sapiens
catttacataacagtaacgctg

SEQ ID NO: 8423618 - DNA, 21 bp, Homo sapiens
catttacatgacagattggtt

SEQ ID NO: 8423619 - DNA, 21 bp, Homo sapiens
catttacatgacagattggtt

SEQ ID NO: 8423620 - DNA, 22 bp, Homo sapiens
catttacagtgagagtttttac

SEQ ID NO: 8423621 - DNA, 21 bp, Homo sapiens
aggcagcaggatccagggaca

SEQ ID NO: 8423622 - DNA, 18 bp, Homo sapiens
aggcagcagcatcttctc

SEQ ID NO: 8423623 - DNA, 22 bp, Homo sapiens
aggcagcatttgaatccaggtc

SEQ ID NO: 8423624 - DNA, 22 bp, Homo sapiens
aggcagcatttgaatccaggtc

SEQ ID NO: 8423625 - DNA, 22 bp, Homo sapiens
catttacatttaaggttaatat

SEQ ID NO: 8423626 - DNA, 22 bp, Homo sapiens
catttacatttaaggttaatat

SEQ ID NO: 8423627 - DNA, 22 bp, Homo sapiens
aggcagcagtcatgaggaaaga

SEQ ID NO: 8423628 - DNA, 19 bp, Homo sapiens
aggcagcattctggggctt

SEQ ID NO: 8423629 - DNA, 19 bp, Homo sapiens
aggcagcattctggggctt

SEQ ID NO: 8423630 - DNA, 22 bp, Homo sapiens
catgcaggaggaaaaagcagct

SEQ ID NO: 8423631 - DNA, 18 bp, Homo sapiens
catgcagagggatctgtg

SEQ ID NO: 8423632 - DNA, 22 bp, Homo sapiens
catgcagatgtcatgaggcatg

SEQ ID NO: 8423633 - DNA, 20 bp, Homo sapiens
catgcctgctggtatctggc

SEQ ID NO: 8423634 - DNA, 22 bp, Homo sapiens
catgcctgcctggtgggcgtgg

SEQ ID NO: 8423635 - DNA, 22 bp, Homo sapiens
catgccatttggtggattgaga

SEQ ID NO: 8423636 - DNA, 22 bp, Homo sapiens
catgcccattgagaagggcctc

SEQ ID NO: 8423637 - DNA, 22 bp, Homo sapiens
catgccatttttctagattgag

SEQ ID NO: 8423638 - DNA, 22 bp, Homo sapiens
catgccatttggtggattgaga

SEQ ID NO: 8423639 - DNA, 22 bp, Homo sapiens
catgccatttcttctctttatg

SEQ ID NO: 8423640 - DNA, 22 bp, Homo sapiens
catgccatttacttggaggaga

SEQ ID NO: 8423641 - DNA, 22 bp, Homo sapiens
catgccattaacattagctagc

SEQ ID NO: 8423642 - DNA, 22 bp, Homo sapiens
catgccattccctgatcctaac

SEQ ID NO: 8423643 - DNA, 20 bp, Homo sapiens
catgccatgtctactgaggc

SEQ ID NO: 8423644 - DNA, 20 bp, Homo sapiens
catgccatgtctactgaggc

SEQ ID NO: 8423645 - DNA, 22 bp, Homo sapiens
catgccagttttgagatgcacc

SEQ ID NO: 8423646 - DNA, 23 bp, Homo sapiens
catgccagtttgtgcaggcagat

SEQ ID NO: 8423647 - DNA, 22 bp, Homo sapiens
catgccaggtttgagtatcttg

SEQ ID NO: 8423648 - DNA, 22 bp, Homo sapiens
catgccaggtttgagtatcttg

SEQ ID NO: 8423649 - DNA, 22 bp, Homo sapiens
aggcacaggaatgtcatccagt

SEQ ID NO: 8423650 - DNA, 22 bp, Homo sapiens
aggcacaggaatgtcatccagt

SEQ ID NO: 8423651 - DNA, 22 bp, Homo sapiens
aggcacaggaggtggtaagaag

SEQ ID NO: 8423652 - DNA, 22 bp, Homo sapiens
aggcacaggaacaggaaaagag

SEQ ID NO: 8423653 - DNA, 22 bp, Homo sapiens
aggcacaggaacaggaaaagag

SEQ ID NO: 8423654 - DNA, 22 bp, Homo sapiens
aggcacagcctcccttcacatg

SEQ ID NO: 8423655 - DNA, 22 bp, Homo sapiens
aggcacagcctcccttcacatg

SEQ ID NO: 8423656 - DNA, 22 bp, Homo sapiens
aggcacagcctcccccaactcc

SEQ ID NO: 8423657 - DNA, 22 bp, Homo sapiens
aggcaattgtttgtgtaatagg

SEQ ID NO: 8423658 - DNA, 22 bp, Homo sapiens
catgcctgtatttctgatctat

SEQ ID NO: 8423659 - DNA, 21 bp, Homo sapiens
aggcaattcgaagttgcagac

SEQ ID NO: 8423660 - DNA, 22 bp, Homo sapiens
aggaggtgtagatttcctgtca

SEQ ID NO: 8423661 - DNA, 22 bp, Homo sapiens
aggaggtggcaactgtcgacag

SEQ ID NO: 8423662 - DNA, 22 bp, Homo sapiens
aggaggtgctgtttgtcctgga

SEQ ID NO: 8423663 - DNA, 22 bp, Homo sapiens
aggaggtgctagagaagatgtt

SEQ ID NO: 8423664 - DNA, 22 bp, Homo sapiens
catgcacactgcaacaaggact

SEQ ID NO: 8423665 - DNA, 22 bp, Homo sapiens
aggaggtgttgatagaaggttt

SEQ ID NO: 8423666 - DNA, 22 bp, Homo sapiens
catgagtgagtatctcaagata

SEQ ID NO: 8423667 - DNA, 16 bp, Homo sapiens
catgagtcagtaagca

SEQ ID NO: 8423668 - DNA, 22 bp, Homo sapiens
catgagtcatagtgaagcagga

SEQ ID NO: 8423669 - DNA, 22 bp, Homo sapiens
catgaaaatgtcaagttctgct

SEQ ID NO: 8423670 - DNA, 22 bp, Homo sapiens
catgaaacatcagagatttctc

SEQ ID NO: 8423671 - DNA, 22 bp, Homo sapiens
catgaaacttccaaagctgacc

SEQ ID NO: 8423672 - DNA, 22 bp, Homo sapiens
catgaaaatgtcaagttctgct

SEQ ID NO: 8423673 - DNA, 22 bp, Homo sapiens
catgaaaatgtcaagttctgct

SEQ ID NO: 8423674 - DNA, 22 bp, Homo sapiens
catctttaaaatgggaacaaca

SEQ ID NO: 8423675 - DNA, 22 bp, Homo sapiens
catgaaatatgctacctgtctt

SEQ ID NO: 8423676 - DNA, 17 bp, Homo sapiens
catctttaaaatcctga

SEQ ID NO: 8423677 - DNA, 22 bp, Homo sapiens
catgaaaataacattgttgtga

SEQ ID NO: 8423678 - DNA, 22 bp, Homo sapiens
aggaggcactcactctcagggt

SEQ ID NO: 8423679 - DNA, 22 bp, Homo sapiens
catgaaatctgagtatgtttcc

SEQ ID NO: 8423680 - DNA, 22 bp, Homo sapiens
aggaggtgcgtggtgatcccct

SEQ ID NO: 8423681 - DNA, 22 bp, Homo sapiens
catgaaatgttagaattagaca

SEQ ID NO: 8423682 - DNA, 22 bp, Homo sapiens
cagtcctgaggaagagctgctg

SEQ ID NO: 8423683 - DNA, 22 bp, Homo sapiens
cagtcctgaggaagagctgctg

SEQ ID NO: 8423684 - DNA, 18 bp, Homo sapiens
cagtcccaaaccttagga

SEQ ID NO: 8423685 - DNA, 22 bp, Homo sapiens
cagtcctgggcacagccctggg

SEQ ID NO: 8423686 - DNA, 22 bp, Homo sapiens
aggacagcagccattggcagtc

SEQ ID NO: 8423687 - DNA, 22 bp, Homo sapiens
aggacagcagccattggcagtc

SEQ ID NO: 8423688 - DNA, 20 bp, Homo sapiens
aggacagcagctgccacttg

SEQ ID NO: 8423689 - DNA, 22 bp, Homo sapiens
cagtcctgggagacttacccag

SEQ ID NO: 8423690 - DNA, 22 bp, Homo sapiens
cagtcctgctggccttccctgg

SEQ ID NO: 8423691 - DNA, 19 bp, Homo sapiens
aggaaggaacctgagtctg

SEQ ID NO: 8423692 - DNA, 22 bp, Homo sapiens
aggaaggaagagacaccatttg

SEQ ID NO: 8423693 - DNA, 22 bp, Homo sapiens
aggaagcttgtgtgtattggtc

SEQ ID NO: 8423694 - DNA, 22 bp, Homo sapiens
aggaagctttatgaccagctaa

SEQ ID NO: 8423695 - DNA, 22 bp, Homo sapiens
aggaaggactccatggtccgtc

SEQ ID NO: 8423696 - DNA, 22 bp, Homo sapiens
aggaaggactgcagcatttggt

SEQ ID NO: 8423697 - DNA, 20 bp, Homo sapiens
aggaaggaagtttgcatgga

SEQ ID NO: 8423698 - DNA, 22 bp, Homo sapiens
aggaagctggtgtgaggatgaa

SEQ ID NO: 8423699 - DNA, 22 bp, Homo sapiens
aggaagcttggggcagggctac

SEQ ID NO: 8423700 - DNA, 22 bp, Homo sapiens
aggaagcttagtgaaaggacca

SEQ ID NO: 8423701 - DNA, 20 bp, Homo sapiens
aggaagctgagatgtagagg

SEQ ID NO: 8423702 - DNA, 22 bp, Homo sapiens
aggacttttcatcagctatcct

SEQ ID NO: 8423703 - DNA, 22 bp, Homo sapiens
aggacagcagtgctggcacttg

SEQ ID NO: 8423704 - DNA, 22 bp, Homo sapiens
aggacagcagttggtgaggttc

SEQ ID NO: 8423705 - DNA, 22 bp, Homo sapiens
aggacagcattttcagcatctc

SEQ ID NO: 8423706 - DNA, 22 bp, Homo sapiens
aggacagcccccaacagcaaca

SEQ ID NO: 8423707 - DNA, 22 bp, Homo sapiens
aggacagcccttgagagcacat

SEQ ID NO: 8423708 - DNA, 22 bp, Homo sapiens
cagtctctcttgtagtgcagct

SEQ ID NO: 8423709 - DNA, 22 bp, Homo sapiens
cagtctctgccacttctaagct

SEQ ID NO: 8423710 - DNA, 22 bp, Homo sapiens
cagtctctctccttgcaggcgt

SEQ ID NO: 8423711 - DNA, 22 bp, Homo sapiens
cagtctctctccttgcaggcgt

SEQ ID NO: 8423712 - DNA, 22 bp, Homo sapiens
cagtctctgtgccagatcctgg

SEQ ID NO: 8423713 - DNA, 22 bp, Homo sapiens
cagtctctgtgccagatcctgg

SEQ ID NO: 8423714 - DNA, 22 bp, Homo sapiens
cagtctctgtgccagatcctgg

SEQ ID NO: 8423715 - DNA, 22 bp, Homo sapiens
cagtctctggtgagttgacagt

SEQ ID NO: 8423716 - DNA, 22 bp, Homo sapiens
aggagaggcatcaagaaaatcg

SEQ ID NO: 8423717 - DNA, 22 bp, Homo sapiens
aggagaggcatcaagaaaatcg

SEQ ID NO: 8423718 - DNA, 22 bp, Homo sapiens
aggagaggaatcattattacaa

SEQ ID NO: 8423719 - DNA, 22 bp, Homo sapiens
aggagaggctctaactctgtgt

SEQ ID NO: 8423720 - DNA, 22 bp, Homo sapiens
aggagagaatgttccaggcttg

SEQ ID NO: 8423721 - DNA, 22 bp, Homo sapiens
aggagagaatgttccaggcttg

SEQ ID NO: 8423722 - DNA, 22 bp, Homo sapiens
aggagagaattactgggtgtca

SEQ ID NO: 8423723 - DNA, 22 bp, Homo sapiens
aggagagaattactgggtgtca

SEQ ID NO: 8423724 - DNA, 22 bp, Homo sapiens
aggagagagctgagctttgctg

SEQ ID NO: 8423725 - DNA, 22 bp, Homo sapiens
aggagagagaacacttgggtcc

SEQ ID NO: 8423726 - DNA, 22 bp, Homo sapiens
aggagagaggttttaaatgggg

SEQ ID NO: 8423727 - DNA, 22 bp, Homo sapiens
aggagagcaggccagccgtccc

SEQ ID NO: 8423728 - DNA, 18 bp, Homo sapiens
aggagcctttgcactgga

SEQ ID NO: 8423729 - DNA, 22 bp, Homo sapiens
aggagctcaaagatgccaggag

SEQ ID NO: 8423730 - DNA, 22 bp, Homo sapiens
aggagctcaaagatgccaggag

SEQ ID NO: 8423731 - DNA, 22 bp, Homo sapiens
aggagcctgtgcctggcactcc

SEQ ID NO: 8423732 - DNA, 22 bp, Homo sapiens
aggagcctgtgcctggcactcc

SEQ ID NO: 8423733 - DNA, 19 bp, Homo sapiens
aggagccttgagcagtgag

SEQ ID NO: 8423734 - DNA, 19 bp, Homo sapiens
aggagccttgagcagtgag

SEQ ID NO: 8423735 - DNA, 22 bp, Homo sapiens
aggagctccagcccagggaagt

SEQ ID NO: 8423736 - DNA, 22 bp, Homo sapiens
aggagctccagcccagggaagt

SEQ ID NO: 8423737 - DNA, 22 bp, Homo sapiens
aggagctccagcccagggaagt

SEQ ID NO: 8423738 - DNA, 22 bp, Homo sapiens
aggagctcattgaagtggatga

SEQ ID NO: 8423739 - DNA, 22 bp, Homo sapiens
aggagctcccgtgaggagacca

SEQ ID NO: 8423740 - DNA, 22 bp, Homo sapiens
aggagctcccgtgaggagacca

SEQ ID NO: 8423741 - DNA, 21 bp, Homo sapiens
aggagctctccaaggacaaag

SEQ ID NO: 8423742 - DNA, 21 bp, Homo sapiens
aggagctctccaaggacaaag

SEQ ID NO: 8423743 - DNA, 22 bp, Homo sapiens
aggagctcatgtggctgcctgt

SEQ ID NO: 8423744 - DNA, 22 bp, Homo sapiens
aggagctcatgtggctgcctgt

SEQ ID NO: 8423745 - DNA, 22 bp, Homo sapiens
aggagctcagctaagttggaga

SEQ ID NO: 8423746 - DNA, 22 bp, Homo sapiens
aggagctcacatctttatttct

SEQ ID NO: 8423747 - DNA, 22 bp, Homo sapiens
aggagctcagccattcatttga

SEQ ID NO: 8423748 - DNA, 22 bp, Homo sapiens
aggagctcagcctgcagggagc

SEQ ID NO: 8423749 - DNA, 22 bp, Homo sapiens
aggagctcagcctgcagggagc

SEQ ID NO: 8423750 - DNA, 22 bp, Homo sapiens
aggagcctggctggcccacagg

SEQ ID NO: 8423751 - DNA, 22 bp, Homo sapiens
aggagccatgagcaggaggcaa

SEQ ID NO: 8423752 - DNA, 22 bp, Homo sapiens
aggagatagtcaaagcttcttg

SEQ ID NO: 8423753 - DNA, 22 bp, Homo sapiens
aggagaggtctcccttccccag

SEQ ID NO: 8423754 - DNA, 22 bp, Homo sapiens
aggagctgataaaagggggtca

SEQ ID NO: 8423755 - DNA, 20 bp, Homo sapiens
aggagctgaattagagggtt

SEQ ID NO: 8423756 - DNA, 20 bp, Homo sapiens
aggagctgaattagagggtt

SEQ ID NO: 8423757 - DNA, 22 bp, Homo sapiens
aggagctcccgtgaggagacca

SEQ ID NO: 8423758 - DNA, 20 bp, Homo sapiens
aggagctctgtgctgggaag

SEQ ID NO: 8423759 - DNA, 20 bp, Homo sapiens
aggagctctgtgctgggaag

SEQ ID NO: 8423760 - DNA, 22 bp, Homo sapiens
aggagctctgggcagggcctcc

SEQ ID NO: 8423761 - DNA, 22 bp, Homo sapiens
aggagctctgggcagggcctcc

SEQ ID NO: 8423762 - DNA, 22 bp, Homo sapiens
aggagctctgggcagggcctcc

SEQ ID NO: 8423763 - DNA, 22 bp, Homo sapiens
aggagctctcccatgctgcaga

SEQ ID NO: 8423764 - DNA, 22 bp, Homo sapiens
aggagctctcccatgctgcaga

SEQ ID NO: 8423765 - DNA, 22 bp, Homo sapiens
aggagctgaagtctctgcactc

SEQ ID NO: 8423766 - DNA, 22 bp, Homo sapiens
aggagctcttgatgcttgaggg

SEQ ID NO: 8423767 - DNA, 22 bp, Homo sapiens
aggaggaatacaatccagcagc

SEQ ID NO: 8423768 - DNA, 22 bp, Homo sapiens
aggaggaattgacacagaagcc

SEQ ID NO: 8423769 - DNA, 21 bp, Homo sapiens
aggaggagagcttggcctacc

SEQ ID NO: 8423770 - DNA, 22 bp, Homo sapiens
aggaggactctctgagccagcc

SEQ ID NO: 8423771 - DNA, 21 bp, Homo sapiens
aggaggagagcttggcctacc

SEQ ID NO: 8423772 - DNA, 22 bp, Homo sapiens
aggaggaggctggagtacaccc

SEQ ID NO: 8423773 - DNA, 20 bp, Homo sapiens
aggaggcaatgtagataagc

SEQ ID NO: 8423774 - DNA, 22 bp, Homo sapiens
aggaggaggtaagaaaagcata

SEQ ID NO: 8423775 - DNA, 22 bp, Homo sapiens
aggaggaggtgggacacagtga

SEQ ID NO: 8423776 - DNA, 22 bp, Homo sapiens
aggaggaggtaagaaaagcata

SEQ ID NO: 8423777 - DNA, 22 bp, Homo sapiens
agggaagcttgttactgagaag

SEQ ID NO: 8423778 - DNA, 22 bp, Homo sapiens
agggaaggaggccatgtgtccc

SEQ ID NO: 8423779 - DNA, 22 bp, Homo sapiens
agggaaggcttttgacatttcc

SEQ ID NO: 8423780 - DNA, 22 bp, Homo sapiens
agggaagggaaaaacactcgtc

SEQ ID NO: 8423781 - DNA, 19 bp, Homo sapiens
agggaaggattctgtcatt

SEQ ID NO: 8423782 - DNA, 19 bp, Homo sapiens
agggaaggattctgtcatt

SEQ ID NO: 8423783 - DNA, 22 bp, Homo sapiens
agggaagggcagggtctatgca

SEQ ID NO: 8423784 - DNA, 19 bp, Homo sapiens
agggaatccggctgaggga

SEQ ID NO: 8423785 - DNA, 22 bp, Homo sapiens
agggagagtagatatcaggtgt

SEQ ID NO: 8423786 - DNA, 19 bp, Homo sapiens
agggaatccggctgaggga

SEQ ID NO: 8423787 - DNA, 22 bp, Homo sapiens
agggagaggctgaactatccta

SEQ ID NO: 8423788 - DNA, 22 bp, Homo sapiens
agggagaggctgaactatccta

SEQ ID NO: 8423789 - DNA, 22 bp, Homo sapiens
agggagaatgaccaaggtatat

SEQ ID NO: 8423790 - DNA, 22 bp, Homo sapiens
agggagccagagttgggagctc

SEQ ID NO: 8423791 - DNA, 22 bp, Homo sapiens
agggagccagagttgggagctc

SEQ ID NO: 8423792 - DNA, 22 bp, Homo sapiens
agggagccaggggccagctatt

SEQ ID NO: 8423793 - DNA, 22 bp, Homo sapiens
agggagccaggaacgcaggtcg

SEQ ID NO: 8423794 - DNA, 22 bp, Homo sapiens
agggagccaggaacgcaggtcg

SEQ ID NO: 8423795 - DNA, 22 bp, Homo sapiens
agggagccaggaacgcaggtcg

SEQ ID NO: 8423796 - DNA, 22 bp, Homo sapiens
agggagccaggggccagctatt

SEQ ID NO: 8423797 - DNA, 22 bp, Homo sapiens
agggagcaaaggtttcagggtt

SEQ ID NO: 8423798 - DNA, 22 bp, Homo sapiens
agggagagtttgatgtttcctc

SEQ ID NO: 8423799 - DNA, 18 bp, Homo sapiens
agggagcatctggttgcc

SEQ ID NO: 8423800 - DNA, 22 bp, Homo sapiens
agggagcagggctcctttgggt

SEQ ID NO: 8423801 - DNA, 22 bp, Homo sapiens
agggagcagcagccacaggatg

SEQ ID NO: 8423802 - DNA, 22 bp, Homo sapiens
agggagcagcagccacaggatg

SEQ ID NO: 8423803 - DNA, 22 bp, Homo sapiens
ccccagcagactcagggcaggt

SEQ ID NO: 8423804 - DNA, 22 bp, Homo sapiens
ccccagggactggtttcatgga

SEQ ID NO: 8423805 - DNA, 22 bp, Homo sapiens
ccccagggactggtttcatgga

SEQ ID NO: 8423806 - DNA, 19 bp, Homo sapiens
ccccagggtaggctagggg

SEQ ID NO: 8423807 - DNA, 19 bp, Homo sapiens
ccccagggtaggctagggg

SEQ ID NO: 8423808 - DNA, 22 bp, Homo sapiens
ccccagggtcagtgtgtggagg

SEQ ID NO: 8423809 - DNA, 22 bp, Homo sapiens
ccccagggtcagtgtgtggagg

SEQ ID NO: 8423810 - DNA, 22 bp, Homo sapiens
ccccatcttccctgagggattt

SEQ ID NO: 8423811 - DNA, 22 bp, Homo sapiens
ccccagtggttgcaacagcaga

SEQ ID NO: 8423812 - DNA, 22 bp, Homo sapiens
ccccatgaagtagggtctctga

SEQ ID NO: 8423813 - DNA, 22 bp, Homo sapiens
ccccatgaagtagggtctctga

SEQ ID NO: 8423814 - DNA, 22 bp, Homo sapiens
agggaggaaggaactccttcta

SEQ ID NO: 8423815 - DNA, 22 bp, Homo sapiens
aggctgtgtggtcatggtggct

SEQ ID NO: 8423816 - DNA, 22 bp, Homo sapiens
aggctgtgtggtcatggtggct

SEQ ID NO: 8423817 - DNA, 22 bp, Homo sapiens
aggctgtgttctgccctctccc

SEQ ID NO: 8423818 - DNA, 22 bp, Homo sapiens
aggctgtgtttaagtggtaatg

SEQ ID NO: 8423819 - DNA, 22 bp, Homo sapiens
aggctgtgtttcccctggagct

SEQ ID NO: 8423820 - DNA, 22 bp, Homo sapiens
cccagctctgcagacctgccct

SEQ ID NO: 8423821 - DNA, 18 bp, Homo sapiens
cccagcctctcctttcta

SEQ ID NO: 8423822 - DNA, 18 bp, Homo sapiens
cccagcctctcctttcta

SEQ ID NO: 8423823 - DNA, 22 bp, Homo sapiens
cccagcctctggattctgccct

SEQ ID NO: 8423824 - DNA, 22 bp, Homo sapiens
cccagcctctgtttgctcctct

SEQ ID NO: 8423825 - DNA, 22 bp, Homo sapiens
cccagcctctgggctcacccaa

SEQ ID NO: 8423826 - DNA, 22 bp, Homo sapiens
cccagcctctgggttctgccgg

SEQ ID NO: 8423827 - DNA, 22 bp, Homo sapiens
cccagcctgatctcggccagct

SEQ ID NO: 8423828 - DNA, 22 bp, Homo sapiens
ccataatcgtgtgttaaataat

SEQ ID NO: 8423829 - DNA, 22 bp, Homo sapiens
ccataatctggctttgagagag

SEQ ID NO: 8423830 - DNA, 23 bp, Homo sapiens
ccataatcagggttgtggggtcc

SEQ ID NO: 8423831 - DNA, 22 bp, Homo sapiens
ccataatcatgtaagtaaattc

SEQ ID NO: 8423832 - DNA, 22 bp, Homo sapiens
ccagtttgaggaagaagtagat

SEQ ID NO: 8423833 - DNA, 22 bp, Homo sapiens
ccagtttcttaagtaggaagaa

SEQ ID NO: 8423834 - DNA, 21 bp, Homo sapiens
ccataatcttaggatcaaaat

SEQ ID NO: 8423835 - DNA, 22 bp, Homo sapiens
ccatctccaaataccatcacat

SEQ ID NO: 8423836 - DNA, 22 bp, Homo sapiens
ccatcctgtctgtggcctcagg

SEQ ID NO: 8423837 - DNA, 22 bp, Homo sapiens
ccatccttggctcgctctctgt

SEQ ID NO: 8423838 - DNA, 22 bp, Homo sapiens
ccatctccactgtccctgtcaa

SEQ ID NO: 8423839 - DNA, 22 bp, Homo sapiens
ccatctccaaataccatcacat

SEQ ID NO: 8423840 - DNA, 22 bp, Homo sapiens
ccatgacattttaattttcact

SEQ ID NO: 8423841 - DNA, 22 bp, Homo sapiens
ccatgacccctggcatccaggg

SEQ ID NO: 8423842 - DNA, 22 bp, Homo sapiens
ccatgagtagcgatttcatttt

SEQ ID NO: 8423843 - DNA, 22 bp, Homo sapiens
ccatgaattcactccatgctag

SEQ ID NO: 8423844 - DNA, 22 bp, Homo sapiens
ccatcttgggtcactgcccccc

SEQ ID NO: 8423845 - DNA, 22 bp, Homo sapiens
cccagcagtacccaagcccttg

SEQ ID NO: 8423846 - DNA, 22 bp, Homo sapiens
cccagcagtgacccagtgatac

SEQ ID NO: 8423847 - DNA, 22 bp, Homo sapiens
cccagcagtgacccagtgatac

SEQ ID NO: 8423848 - DNA, 22 bp, Homo sapiens
cccagcagtgacccagtgatac

SEQ ID NO: 8423849 - DNA, 22 bp, Homo sapiens
cccagcctcagctttacttcca

SEQ ID NO: 8423850 - DNA, 22 bp, Homo sapiens
cccagcatcctcagggagcggg

SEQ ID NO: 8423851 - DNA, 22 bp, Homo sapiens
cccagcctactctgccatagca

SEQ ID NO: 8423852 - DNA, 22 bp, Homo sapiens
cccagcatcccagtgggcagca

SEQ ID NO: 8423853 - DNA, 21 bp, Homo sapiens
cctccaggagcagagccctga

SEQ ID NO: 8423854 - DNA, 22 bp, Homo sapiens
cctccaggaggaaatggaacac

SEQ ID NO: 8423855 - DNA, 22 bp, Homo sapiens
cctccagctgcctcagtctctt

SEQ ID NO: 8423856 - DNA, 22 bp, Homo sapiens
cctccaggaacttgagagacac

SEQ ID NO: 8423857 - DNA, 22 bp, Homo sapiens
cctcagtcttgaattagccaga

SEQ ID NO: 8423858 - DNA, 22 bp, Homo sapiens
cctcagtctgtctgatctgcca

SEQ ID NO: 8423859 - DNA, 22 bp, Homo sapiens
cctcagtctccgtgctcacctt

SEQ ID NO: 8423860 - DNA, 21 bp, Homo sapiens
cctcagtctccctgctccact

SEQ ID NO: 8423861 - DNA, 22 bp, Homo sapiens
cctccaggccttgcaggttaac

SEQ ID NO: 8423862 - DNA, 23 bp, Homo sapiens
cctcccaggctgcgagtcccgag

SEQ ID NO: 8423863 - DNA, 22 bp, Homo sapiens
cctccaggataagtcagggcct

SEQ ID NO: 8423864 - DNA, 20 bp, Homo sapiens
cctccaggcacacccatgtg

SEQ ID NO: 8423865 - DNA, 22 bp, Homo sapiens
cctccccacagcccaggagact

SEQ ID NO: 8423866 - DNA, 23 bp, Homo sapiens
cctccccaccagactctaacata

SEQ ID NO: 8423867 - DNA, 22 bp, Homo sapiens
cctccccacagcccaggagact

SEQ ID NO: 8423868 - DNA, 22 bp, Homo sapiens
cctcccatggagctctgtccat

SEQ ID NO: 8423869 - DNA, 22 bp, Homo sapiens
cctcccagtgcctccagagcag

SEQ ID NO: 8423870 - DNA, 22 bp, Homo sapiens
cctcccagtgcctccagagcag

SEQ ID NO: 8423871 - DNA, 22 bp, Homo sapiens
cctccccacccacggctggtgg

SEQ ID NO: 8423872 - DNA, 22 bp, Homo sapiens
cctcgagcagcgacccctccac

SEQ ID NO: 8423873 - DNA, 22 bp, Homo sapiens
cctagaatgtgcagacttaggg

SEQ ID NO: 8423874 - DNA, 22 bp, Homo sapiens
cctagaattataaacttattag

SEQ ID NO: 8423875 - DNA, 20 bp, Homo sapiens
cctcaaataagtgccagcat

SEQ ID NO: 8423876 - DNA, 22 bp, Homo sapiens
cctcaaaggcctggcaccagaa

SEQ ID NO: 8423877 - DNA, 22 bp, Homo sapiens
cctcaaatagcccccagtctag

SEQ ID NO: 8423878 - DNA, 22 bp, Homo sapiens
cctcaaataagttttatttatc

SEQ ID NO: 8423879 - DNA, 22 bp, Homo sapiens
cccttcaagctctctgggtttt

SEQ ID NO: 8423880 - DNA, 22 bp, Homo sapiens
cccttcaagctctctgggtttt

SEQ ID NO: 8423881 - DNA, 22 bp, Homo sapiens
cccttcagggttaagtagaggg

SEQ ID NO: 8423882 - DNA, 22 bp, Homo sapiens
cccttcagctgagtgggacagc

SEQ ID NO: 8423883 - DNA, 22 bp, Homo sapiens
ccctgtttggatggggacccag

SEQ ID NO: 8423884 - DNA, 22 bp, Homo sapiens
ccctgtttatttttggagagaa

SEQ ID NO: 8423885 - DNA, 22 bp, Homo sapiens
ccctgtttaagaaacctgtaaa

SEQ ID NO: 8423886 - DNA, 22 bp, Homo sapiens
ccctgttttaagttgatattga

SEQ ID NO: 8423887 - DNA, 22 bp, Homo sapiens
ccctgttttaagttgatattga

SEQ ID NO: 8423888 - DNA, 22 bp, Homo sapiens
cccttagagattctgtcagagt

SEQ ID NO: 8423889 - DNA, 22 bp, Homo sapiens
cccttagaattttgtagttatt

SEQ ID NO: 8423890 - DNA, 18 bp, Homo sapiens
cccttagcctttcctctc

SEQ ID NO: 8423891 - DNA, 17 bp, Homo sapiens
cccttagagcaaaagat

SEQ ID NO: 8423892 - DNA, 22 bp, Homo sapiens
cctcagagcctccagaaggaat

SEQ ID NO: 8423893 - DNA, 22 bp, Homo sapiens
cctcagagcctccagaaggaat

SEQ ID NO: 8423894 - DNA, 22 bp, Homo sapiens
cctcagagcagcacccagatga

SEQ ID NO: 8423895 - DNA, 22 bp, Homo sapiens
cctcagagcctccagaaggaat

SEQ ID NO: 8423896 - DNA, 22 bp, Homo sapiens
cctcagagccatgcctgagttc

SEQ ID NO: 8423897 - DNA, 22 bp, Homo sapiens
cctcagagcagcacccagatga

SEQ ID NO: 8423898 - DNA, 22 bp, Homo sapiens
cctcagagccatgcctgagttc

SEQ ID NO: 8423899 - DNA, 22 bp, Homo sapiens
cctcagagactgcatcttccct

SEQ ID NO: 8423900 - DNA, 22 bp, Homo sapiens
cctcagagacagtaactggaat

SEQ ID NO: 8423901 - DNA, 22 bp, Homo sapiens
cctcagagacagtaactggaat

SEQ ID NO: 8423902 - DNA, 23 bp, Homo sapiens
cctcagagaggcagagccacatg

SEQ ID NO: 8423903 - DNA, 22 bp, Homo sapiens
cctcagagcagcacccagatga

SEQ ID NO: 8423904 - DNA, 23 bp, Homo sapiens
cctcagagaggcagagccacatg

SEQ ID NO: 8423905 - DNA, 21 bp, Homo sapiens
cctcagagacagatacgggtg

SEQ ID NO: 8423906 - DNA, 21 bp, Homo sapiens
cctcagagacagatacgggtg

SEQ ID NO: 8423907 - DNA, 22 bp, Homo sapiens
cctcagagaaatgtctattcaa

SEQ ID NO: 8423908 - DNA, 22 bp, Homo sapiens
cctcagagaaaggtatggctga

SEQ ID NO: 8423909 - DNA, 22 bp, Homo sapiens
cctcagagaaatgtctattcaa

SEQ ID NO: 8423910 - DNA, 22 bp, Homo sapiens
cctcagaccccacagggcctgt

SEQ ID NO: 8423911 - DNA, 22 bp, Homo sapiens
cctcagacccctgctgagcttc

SEQ ID NO: 8423912 - DNA, 20 bp, Homo sapiens
cctcaagcagactgacagct

SEQ ID NO: 8423913 - DNA, 22 bp, Homo sapiens
cctcaaattgtcaaataagaat

SEQ ID NO: 8423914 - DNA, 22 bp, Homo sapiens
cctcaaattggcattaattaag

SEQ ID NO: 8423915 - DNA, 22 bp, Homo sapiens
cctcaagaacaatccaccatta

SEQ ID NO: 8423916 - DNA, 22 bp, Homo sapiens
cctcaaattgctcagcgtctag

SEQ ID NO: 8423917 - DNA, 23 bp, Homo sapiens
cctcaaatgtagcctttttccca

SEQ ID NO: 8423918 - DNA, 22 bp, Homo sapiens
cctcaaatctttagagttattt

SEQ ID NO: 8423919 - DNA, 22 bp, Homo sapiens
agggcagccattgagggattct

SEQ ID NO: 8423920 - DNA, 22 bp, Homo sapiens
agggcagcccttctgggagggc

SEQ ID NO: 8423921 - DNA, 22 bp, Homo sapiens
agggcagccattgagggattct

SEQ ID NO: 8423922 - DNA, 22 bp, Homo sapiens
agggcagcagctcctcctagct

SEQ ID NO: 8423923 - DNA, 22 bp, Homo sapiens
agggaggagtcctcaaagtcat

SEQ ID NO: 8423924 - DNA, 22 bp, Homo sapiens
agggcagcagctcctcctagct

SEQ ID NO: 8423925 - DNA, 22 bp, Homo sapiens
agggcagcattgcctttctcca

SEQ ID NO: 8423926 - DNA, 22 bp, Homo sapiens
agggcagcattgcctttctcca

SEQ ID NO: 8423927 - DNA, 22 bp, Homo sapiens
agggcagcagctgtccctgaga

SEQ ID NO: 8423928 - DNA, 22 bp, Homo sapiens
agggcagcagctgtccctgaga

SEQ ID NO: 8423929 - DNA, 22 bp, Homo sapiens
agggcagcagctgtccctgaga

SEQ ID NO: 8423930 - DNA, 22 bp, Homo sapiens
agggaggagtcctcaaagtcat

SEQ ID NO: 8423931 - DNA, 22 bp, Homo sapiens
agggaggagaatggactccttc

SEQ ID NO: 8423932 - DNA, 22 bp, Homo sapiens
agggaggaaggatgttccaaag

SEQ ID NO: 8423933 - DNA, 22 bp, Homo sapiens
agggaggaccaatgtgtggtta

SEQ ID NO: 8423934 - DNA, 22 bp, Homo sapiens
agggcagctagctgtagaaaga

SEQ ID NO: 8423935 - DNA, 22 bp, Homo sapiens
agggcagcggtgcttgtgttat

SEQ ID NO: 8423936 - DNA, 22 bp, Homo sapiens
agggcagcctctcagcctaggt

SEQ ID NO: 8423937 - DNA, 22 bp, Homo sapiens
agggcagctctcacctctggcc

SEQ ID NO: 8423938 - DNA, 22 bp, Homo sapiens
agggcagctggaaggtggcttc

SEQ ID NO: 8423939 - DNA, 22 bp, Homo sapiens
agggcagctctcacctctggcc

SEQ ID NO: 8423940 - DNA, 22 bp, Homo sapiens
agggcagctctcacctctggcc

SEQ ID NO: 8423941 - DNA, 22 bp, Homo sapiens
agggccagccccaccctctctg

SEQ ID NO: 8423942 - DNA, 22 bp, Homo sapiens
agggcagctgtgagccactgtg

SEQ ID NO: 8423943 - DNA, 22 bp, Homo sapiens
ccctgggatggattggcaggaa

SEQ ID NO: 8423944 - DNA, 22 bp, Homo sapiens
ccctgggatggattggcaggaa

SEQ ID NO: 8423945 - DNA, 21 bp, Homo sapiens
ccctgggatgggcttggactt

SEQ ID NO: 8423946 - DNA, 22 bp, Homo sapiens
ccctgggattcaatttcactct

SEQ ID NO: 8423947 - DNA, 22 bp, Homo sapiens
agggccagggaagctgtatttt

SEQ ID NO: 8423948 - DNA, 22 bp, Homo sapiens
agggccagggaagctgtatttt

SEQ ID NO: 8423949 - DNA, 22 bp, Homo sapiens
agggccagggaagctgtatttt

SEQ ID NO: 8423950 - DNA, 22 bp, Homo sapiens
ccctggcccctcactccgaggc

SEQ ID NO: 8423951 - DNA, 22 bp, Homo sapiens
agggccaggctcccatgtcagg

SEQ ID NO: 8423952 - DNA, 22 bp, Homo sapiens
agggccagggaaacgatcagca

SEQ ID NO: 8423953 - DNA, 22 bp, Homo sapiens
agggccagggaaacgatcagca

SEQ ID NO: 8423954 - DNA, 22 bp, Homo sapiens
ccctgggcaccaggcctggtaa

SEQ ID NO: 8423955 - DNA, 22 bp, Homo sapiens
ccctgggcaccaggcctggtaa

SEQ ID NO: 8423956 - DNA, 22 bp, Homo sapiens
ccctgggcagtctgcacttcag

SEQ ID NO: 8423957 - DNA, 22 bp, Homo sapiens
ccctgggcaagccctattttcc

SEQ ID NO: 8423958 - DNA, 22 bp, Homo sapiens
ccctgggattgccttggccttg

SEQ ID NO: 8423959 - DNA, 22 bp, Homo sapiens
agggccagctagagccctcgcc

SEQ ID NO: 8423960 - DNA, 22 bp, Homo sapiens
agggccagctagagccctcgcc

SEQ ID NO: 8423961 - DNA, 22 bp, Homo sapiens
agggccagctagagccctcgcc

SEQ ID NO: 8423962 - DNA, 22 bp, Homo sapiens
agggccagccgacttccagcct

SEQ ID NO: 8423963 - DNA, 22 bp, Homo sapiens
agggccagccgacttccagcct

SEQ ID NO: 8423964 - DNA, 22 bp, Homo sapiens
agggccagctgatgagaatgag

SEQ ID NO: 8423965 - DNA, 22 bp, Homo sapiens
agggccagctgatgagaatgag

SEQ ID NO: 8423966 - DNA, 22 bp, Homo sapiens
agggccaggaacacctgaaggg

SEQ ID NO: 8423967 - DNA, 22 bp, Homo sapiens
agggccaggaacacctgaaggg

SEQ ID NO: 8423968 - DNA, 18 bp, Homo sapiens
agggccagctgtgagtag

SEQ ID NO: 8423969 - DNA, 22 bp, Homo sapiens
agggccaggatcacagccaaga

SEQ ID NO: 8423970 - DNA, 22 bp, Homo sapiens
agggccaggatcacagccaaga

SEQ ID NO: 8423971 - DNA, 22 bp, Homo sapiens
agggccaggatcacagccaaga

SEQ ID NO: 8423972 - DNA, 19 bp, Homo sapiens
agggccaggattctggaac

SEQ ID NO: 8423973 - DNA, 22 bp, Homo sapiens
aggccaagattttggatcagct

SEQ ID NO: 8423974 - DNA, 22 bp, Homo sapiens
aggccaaatgtgtataaaacat

SEQ ID NO: 8423975 - DNA, 22 bp, Homo sapiens
aggccaagattttggatcagct

SEQ ID NO: 8423976 - DNA, 22 bp, Homo sapiens
aggccaagtagctagcattgaa

SEQ ID NO: 8423977 - DNA, 22 bp, Homo sapiens
aggccaagtagctagcattgaa

SEQ ID NO: 8423978 - DNA, 22 bp, Homo sapiens
aggccaagtagctagcattgaa

SEQ ID NO: 8423979 - DNA, 21 bp, Homo sapiens
aggccaagttggatttcttca

SEQ ID NO: 8423980 - DNA, 22 bp, Homo sapiens
aggccacaaccaccctgtgccc

SEQ ID NO: 8423981 - DNA, 22 bp, Homo sapiens
aggccagctgttactagagcca

SEQ ID NO: 8423982 - DNA, 22 bp, Homo sapiens
aggccagctgttactagagcca

SEQ ID NO: 8423983 - DNA, 22 bp, Homo sapiens
aggccagctgccacccggtccg

SEQ ID NO: 8423984 - DNA, 22 bp, Homo sapiens
aggccagcttccagaggggcag

SEQ ID NO: 8423985 - DNA, 22 bp, Homo sapiens
aggccagctctacccttggact

SEQ ID NO: 8423986 - DNA, 22 bp, Homo sapiens
aggccagatgtcgggctagaag

SEQ ID NO: 8423987 - DNA, 22 bp, Homo sapiens
aggccagcgctgctagctcccg

SEQ ID NO: 8423988 - DNA, 23 bp, Homo sapiens
aggccagcgcagacaccgagcac

SEQ ID NO: 8423989 - DNA, 22 bp, Homo sapiens
aggccaggatagcatggatcag

SEQ ID NO: 8423990 - DNA, 22 bp, Homo sapiens
aggccaggatagcatggatcag

SEQ ID NO: 8423991 - DNA, 22 bp, Homo sapiens
aggcccagctgggccaggaaca

SEQ ID NO: 8423992 - DNA, 22 bp, Homo sapiens
aggcccagtagtcgacggcgct

SEQ ID NO: 8423993 - DNA, 22 bp, Homo sapiens
aggcccagtagtgctgccttta

SEQ ID NO: 8423994 - DNA, 22 bp, Homo sapiens
aggcccagtagtgctgccttta

SEQ ID NO: 8423995 - DNA, 22 bp, Homo sapiens
aggcccagtagtgctgccttta

SEQ ID NO: 8423996 - DNA, 22 bp, Homo sapiens
aggcccagtcctctgccgtctg

SEQ ID NO: 8423997 - DNA, 22 bp, Homo sapiens
aggcccagtcctctgccgtctg

SEQ ID NO: 8423998 - DNA, 20 bp, Homo sapiens
aggcccagtgaatatattgc

SEQ ID NO: 8423999 - DNA, 22 bp, Homo sapiens
aggcccagtgccattagttttg

SEQ ID NO: 8424000 - DNA, 22 bp, Homo sapiens
aggccaggaccattagcccaga

SEQ ID NO: 8424001 - DNA, 22 bp, Homo sapiens
aggccaggaccattagcccaga

SEQ ID NO: 8424002 - DNA, 22 bp, Homo sapiens
aggccaggacacttaagtaaga

SEQ ID NO: 8424003 - DNA, 22 bp, Homo sapiens
aggccaggaatccttgtcccag

SEQ ID NO: 8424004 - DNA, 22 bp, Homo sapiens
aggccaggaatccttgtcccag

SEQ ID NO: 8424005 - DNA, 22 bp, Homo sapiens
aggccaggaatccttgtcccag

SEQ ID NO: 8424006 - DNA, 20 bp, Homo sapiens
aggccaggaaatgtagttct

SEQ ID NO: 8424007 - DNA, 20 bp, Homo sapiens
aggccaggaaatgtagttct

SEQ ID NO: 8424008 - DNA, 20 bp, Homo sapiens
aggccaggaaatgtagttct

SEQ ID NO: 8424009 - DNA, 22 bp, Homo sapiens
aggccagcttctaccctctgtt

SEQ ID NO: 8424010 - DNA, 22 bp, Homo sapiens
aggcccatgttcacttgctcag

SEQ ID NO: 8424011 - DNA, 20 bp, Homo sapiens
aggccccaggtggacactag

SEQ ID NO: 8424012 - DNA, 22 bp, Homo sapiens
aggccccatcaggaaggaggcc

SEQ ID NO: 8424013 - DNA, 22 bp, Homo sapiens
aggcccagtgtggcttcctgga

SEQ ID NO: 8424014 - DNA, 22 bp, Homo sapiens
aggcccagtgtggcttcctgga

SEQ ID NO: 8424015 - DNA, 22 bp, Homo sapiens
aggcccagttatcctacttgtt

SEQ ID NO: 8424016 - DNA, 22 bp, Homo sapiens
aggcccagttatcctacttgtt

SEQ ID NO: 8424017 - DNA, 22 bp, Homo sapiens
aggccctattcaatggggccca

SEQ ID NO: 8424018 - DNA, 22 bp, Homo sapiens
aggccctctcattccagaggca

SEQ ID NO: 8424019 - DNA, 22 bp, Homo sapiens
aggccctctcattccagaggca

SEQ ID NO: 8424020 - DNA, 22 bp, Homo sapiens
aggccctgggttagggcccact

SEQ ID NO: 8424021 - DNA, 21 bp, Homo sapiens
aggcatgagccctgcatggac

SEQ ID NO: 8424022 - DNA, 21 bp, Homo sapiens
aggcatgagccctgcatggac

SEQ ID NO: 8424023 - DNA, 22 bp, Homo sapiens
aggcatgactttggctgaagaa

SEQ ID NO: 8424024 - DNA, 17 bp, Homo sapiens
aggcatgaggcatcact

SEQ ID NO: 8424025 - DNA, 22 bp, Homo sapiens
aggcatgatgtgcagtggcaaa

SEQ ID NO: 8424026 - DNA, 22 bp, Homo sapiens
aggcatctaacagagatcttta

SEQ ID NO: 8424027 - DNA, 22 bp, Homo sapiens
aggcatctatacattatgttca

SEQ ID NO: 8424028 - DNA, 22 bp, Homo sapiens
aggcagttggtcattgctcttt

SEQ ID NO: 8424029 - DNA, 22 bp, Homo sapiens
aggcagttgttgctgagcagct

SEQ ID NO: 8424030 - DNA, 22 bp, Homo sapiens
aggcagtttatccccagagcct

SEQ ID NO: 8424031 - DNA, 22 bp, Homo sapiens
aggcagtttaggcagcgattta

SEQ ID NO: 8424032 - DNA, 22 bp, Homo sapiens
aggcagtttaggcagcgattta

SEQ ID NO: 8424033 - DNA, 23 bp, Homo sapiens
aggcagtggtggtaacatgtcaa

SEQ ID NO: 8424034 - DNA, 21 bp, Homo sapiens
aggcattataaatttcacctg

SEQ ID NO: 8424035 - DNA, 22 bp, Homo sapiens
ccactgggcgtttctgtccaat

SEQ ID NO: 8424036 - DNA, 22 bp, Homo sapiens
ccactggagactggtctctgtg

SEQ ID NO: 8424037 - DNA, 23 bp, Homo sapiens
ccactggagaaagtggcaggtgg

SEQ ID NO: 8424038 - DNA, 22 bp, Homo sapiens
ccactggcagttggctagcctt

SEQ ID NO: 8424039 - DNA, 22 bp, Homo sapiens
ccactgctctgccaggagctgg

SEQ ID NO: 8424040 - DNA, 22 bp, Homo sapiens
aggcagtgcctggaccccagct

SEQ ID NO: 8424041 - DNA, 22 bp, Homo sapiens
aggcagtgcagagtcctcttct

SEQ ID NO: 8424042 - DNA, 22 bp, Homo sapiens
aggcagtggctgagaccagggg

SEQ ID NO: 8424043 - DNA, 22 bp, Homo sapiens
aggcagtggagctggaataggc

SEQ ID NO: 8424044 - DNA, 22 bp, Homo sapiens
aggcagccctgtgctggatgct

SEQ ID NO: 8424045 - DNA, 22 bp, Homo sapiens
aggcagccctgtgctggatgct

SEQ ID NO: 8424046 - DNA, 22 bp, Homo sapiens
aggcagcctatggggagctcag

SEQ ID NO: 8424047 - DNA, 22 bp, Homo sapiens
aggcagccctgtgctggatgct

SEQ ID NO: 8424048 - DNA, 19 bp, Homo sapiens
aggcagtcattggaatata

SEQ ID NO: 8424049 - DNA, 22 bp, Homo sapiens
ccaggcctagcccctgagggta

SEQ ID NO: 8424050 - DNA, 22 bp, Homo sapiens
ccaggcccttgcaagtcccacc

SEQ ID NO: 8424051 - DNA, 22 bp, Homo sapiens
ccaggcccttgcaagtcccacc

SEQ ID NO: 8424052 - DNA, 22 bp, Homo sapiens
ccaggccctgctcctcacacca

SEQ ID NO: 8424053 - DNA, 22 bp, Homo sapiens
ccaggccctgcctgtggttcct

SEQ ID NO: 8424054 - DNA, 22 bp, Homo sapiens
ccaggcccgttcccttctccag

SEQ ID NO: 8424055 - DNA, 22 bp, Homo sapiens
ccaggcccgttcccttctccag

SEQ ID NO: 8424056 - DNA, 22 bp, Homo sapiens
ccaggcctcacctgcccaccta

SEQ ID NO: 8424057 - DNA, 22 bp, Homo sapiens
ccaggcctcacctgcccaccta

SEQ ID NO: 8424058 - DNA, 22 bp, Homo sapiens
aggctccacggcaggatgctgt

SEQ ID NO: 8424059 - DNA, 22 bp, Homo sapiens
aggctccacggcaggatgctgt

SEQ ID NO: 8424060 - DNA, 22 bp, Homo sapiens
aggctccattcatgtgaaggca

SEQ ID NO: 8424061 - DNA, 22 bp, Homo sapiens
aggctcccaagcactgacccca

SEQ ID NO: 8424062 - DNA, 21 bp, Homo sapiens
aggctcccagaaatgggcatc

SEQ ID NO: 8424063 - DNA, 22 bp, Homo sapiens
ccaggctctatccctccttctt

SEQ ID NO: 8424064 - DNA, 22 bp, Homo sapiens
aggctcccatggtgtggcagga

SEQ ID NO: 8424065 - DNA, 22 bp, Homo sapiens
aggctcccatggtgtggcagga

SEQ ID NO: 8424066 - DNA, 21 bp, Homo sapiens
aggctcccagaaatgggcatc

SEQ ID NO: 8424067 - DNA, 22 bp, Homo sapiens
ccaggctctgacatagatggga

SEQ ID NO: 8424068 - DNA, 22 bp, Homo sapiens
ccaggctctgagaggaatgtga

SEQ ID NO: 8424069 - DNA, 22 bp, Homo sapiens
ccaggctctgagcctcactctt

SEQ ID NO: 8424070 - DNA, 22 bp, Homo sapiens
ccaggctctgcaaaatcaggct

SEQ ID NO: 8424071 - DNA, 22 bp, Homo sapiens
ccaggctctgcaaaatcaggct

SEQ ID NO: 8424072 - DNA, 22 bp, Homo sapiens
ccaggctctgccaggcccttga

SEQ ID NO: 8424073 - DNA, 22 bp, Homo sapiens
ccaggctctgccaggcccttga

SEQ ID NO: 8424074 - DNA, 22 bp, Homo sapiens
aggctccttgctcacaggctca

SEQ ID NO: 8424075 - DNA, 22 bp, Homo sapiens
ccaggctctgccaggcccttga

SEQ ID NO: 8424076 - DNA, 22 bp, Homo sapiens
ccaggctctgccaggcccttga

SEQ ID NO: 8424077 - DNA, 15 bp, Homo sapiens
ccaggctctgcactc

SEQ ID NO: 8424078 - DNA, 22 bp, Homo sapiens
aggcctccagccacatgccagt

SEQ ID NO: 8424079 - DNA, 17 bp, Homo sapiens
aggcctccctccaggcc

SEQ ID NO: 8424080 - DNA, 17 bp, Homo sapiens
aggcctccctccaggcc

SEQ ID NO: 8424081 - DNA, 22 bp, Homo sapiens
aggcctcatagtagacctgccc

SEQ ID NO: 8424082 - DNA, 22 bp, Homo sapiens
aggcctcatagtagacctgccc

SEQ ID NO: 8424083 - DNA, 22 bp, Homo sapiens
aggcctcatgtcaaagcagcaa

SEQ ID NO: 8424084 - DNA, 22 bp, Homo sapiens
aggcctcatgtcaaagcagcaa

SEQ ID NO: 8424085 - DNA, 17 bp, Homo sapiens
aggcctcaggtgaaacc

SEQ ID NO: 8424086 - DNA, 22 bp, Homo sapiens
aggcctcagctcagtgtgacag

SEQ ID NO: 8424087 - DNA, 22 bp, Homo sapiens
aggcctcagttcttgccaggtg

SEQ ID NO: 8424088 - DNA, 22 bp, Homo sapiens
aggcctcagttcttgccaggtg

SEQ ID NO: 8424089 - DNA, 22 bp, Homo sapiens
aggcctcactctcagagcttct

SEQ ID NO: 8424090 - DNA, 22 bp, Homo sapiens
aggcctcagcctgccaggcctg

SEQ ID NO: 8424091 - DNA, 22 bp, Homo sapiens
aggcctcagcctgccaggcctg

SEQ ID NO: 8424092 - DNA, 22 bp, Homo sapiens
aggcctcacacaacagatgcat

SEQ ID NO: 8424093 - DNA, 22 bp, Homo sapiens
aggcctcacacaacagatgcat

SEQ ID NO: 8424094 - DNA, 22 bp, Homo sapiens
aggcctctctgcttagcttgta

SEQ ID NO: 8424095 - DNA, 22 bp, Homo sapiens
aggcctctctccttggcttgta

SEQ ID NO: 8424096 - DNA, 22 bp, Homo sapiens
aggcctcctggctccaggcctt

SEQ ID NO: 8424097 - DNA, 22 bp, Homo sapiens
ccaggcacttcatcattagggt

SEQ ID NO: 8424098 - DNA, 22 bp, Homo sapiens
aggcctctgagcagcactcatg

SEQ ID NO: 8424099 - DNA, 22 bp, Homo sapiens
aggcctctgagcagcactcatg

SEQ ID NO: 8424100 - DNA, 22 bp, Homo sapiens
ccaggcagggctcaaggaacct

SEQ ID NO: 8424101 - DNA, 22 bp, Homo sapiens
ccaggcagggctcaaggaacct

SEQ ID NO: 8424102 - DNA, 23 bp, Homo sapiens
ccaggcagtagctattgaagtga

SEQ ID NO: 8424103 - DNA, 22 bp, Homo sapiens
ccaggcattgtgagtgggcagg

SEQ ID NO: 8424104 - DNA, 22 bp, Homo sapiens
ccaggcatggggagagccagat

SEQ ID NO: 8424105 - DNA, 22 bp, Homo sapiens
ccaggcatggggagagccagat

SEQ ID NO: 8424106 - DNA, 22 bp, Homo sapiens
ccaggccaaattcagtcagcag

SEQ ID NO: 8424107 - DNA, 22 bp, Homo sapiens
ccaggcatccattgcttcctct

SEQ ID NO: 8424108 - DNA, 22 bp, Homo sapiens
ccaggcagtggaagctaaaatt

SEQ ID NO: 8424109 - DNA, 22 bp, Homo sapiens
ccaggcatcacgggcatgtggc

SEQ ID NO: 8424110 - DNA, 22 bp, Homo sapiens
ccaggcagtcagggttgtgtgt

SEQ ID NO: 8424111 - DNA, 22 bp, Homo sapiens
aggctctgcagtgctggaggac

SEQ ID NO: 8424112 - DNA, 22 bp, Homo sapiens
aggctctgcagaccccagctgt

SEQ ID NO: 8424113 - DNA, 22 bp, Homo sapiens
aggctctgatgcaagcccaggg

SEQ ID NO: 8424114 - DNA, 22 bp, Homo sapiens
aggctctgatgcaagcccaggg

SEQ ID NO: 8424115 - DNA, 22 bp, Homo sapiens
aggctctgatcaggtggctgtg

SEQ ID NO: 8424116 - DNA, 22 bp, Homo sapiens
aggctctgatcaggtggctgtg

SEQ ID NO: 8424117 - DNA, 22 bp, Homo sapiens
aggctctgagtagagctgccag

SEQ ID NO: 8424118 - DNA, 22 bp, Homo sapiens
aggctctgagtagagctgccag

SEQ ID NO: 8424119 - DNA, 19 bp, Homo sapiens
aggctctgagctcctggag

SEQ ID NO: 8424120 - DNA, 22 bp, Homo sapiens
aggctgagccacggggctggct

SEQ ID NO: 8424121 - DNA, 22 bp, Homo sapiens
aggctgagccacggggctggct

SEQ ID NO: 8424122 - DNA, 22 bp, Homo sapiens
aggctgagcctgggcgtggtgg

SEQ ID NO: 8424123 - DNA, 22 bp, Homo sapiens
aggctgagcctgggcgtggtgg

SEQ ID NO: 8424124 - DNA, 22 bp, Homo sapiens
aggctgagcaaagggccttacc

SEQ ID NO: 8424125 - DNA, 22 bp, Homo sapiens
aggctgagcaaagggccttacc

SEQ ID NO: 8424126 - DNA, 22 bp, Homo sapiens
aggctgagccacggggctggct

SEQ ID NO: 8424127 - DNA, 22 bp, Homo sapiens
aggctgagagcaacgtgtcaga

SEQ ID NO: 8424128 - DNA, 22 bp, Homo sapiens
aggctgagataggtggatcatt

SEQ ID NO: 8424129 - DNA, 22 bp, Homo sapiens
aggctctgccaattccttcctc

SEQ ID NO: 8424130 - DNA, 22 bp, Homo sapiens
aggctctgccaattccttcctc

SEQ ID NO: 8424131 - DNA, 20 bp, Homo sapiens
aggctctgccattgtccctg

SEQ ID NO: 8424132 - DNA, 22 bp, Homo sapiens
aggctctgttattctagagggc

SEQ ID NO: 8424133 - DNA, 20 bp, Homo sapiens
aggctctgcctgcaggccca

SEQ ID NO: 8424134 - DNA, 22 bp, Homo sapiens
aggctgagactgtgcattagtg

SEQ ID NO: 8424135 - DNA, 22 bp, Homo sapiens
ccagtttaggtactaggctcta

SEQ ID NO: 8424136 - DNA, 22 bp, Homo sapiens
ccagttctgacacaagcacagt

SEQ ID NO: 8424137 - DNA, 22 bp, Homo sapiens
ccagttccagtgctcacatcca

SEQ ID NO: 8424138 - DNA, 22 bp, Homo sapiens
ccagttagttaaaggcgcagta

SEQ ID NO: 8424139 - DNA, 22 bp, Homo sapiens
aggctgaggcgggaggatcact

SEQ ID NO: 8424140 - DNA, 22 bp, Homo sapiens
aggctgaggcgggaggatcact

SEQ ID NO: 8424141 - DNA, 22 bp, Homo sapiens
aggctgaggcaggtggatcatt

SEQ ID NO: 8424142 - DNA, 22 bp, Homo sapiens
aggctgaggcaggtggatcact

SEQ ID NO: 8424143 - DNA, 22 bp, Homo sapiens
ccagtgcaccaagaggcctaga

SEQ ID NO: 8424144 - DNA, 22 bp, Homo sapiens
ccagtgcaccatttccctctgt

SEQ ID NO: 8424145 - DNA, 22 bp, Homo sapiens
aggctgagcggggtcccagagc

SEQ ID NO: 8424146 - DNA, 22 bp, Homo sapiens
aggctgagcggggtcccagagc

SEQ ID NO: 8424147 - DNA, 23 bp, Homo sapiens
aggctgagctctcccagcttcag

SEQ ID NO: 8424148 - DNA, 23 bp, Homo sapiens
aggctgagctctcccagcttcag

SEQ ID NO: 8424149 - DNA, 21 bp, Homo sapiens
ccagtctgtaaaatggggaca

SEQ ID NO: 8424150 - DNA, 22 bp, Homo sapiens
ccagtgactggctttctggtgt

SEQ ID NO: 8424151 - DNA, 22 bp, Homo sapiens
ccagtctgttctcacctctgag

SEQ ID NO: 8424152 - DNA, 23 bp, Homo sapiens
ccagtgattgcctggaaggaggt

SEQ ID NO: 8424153 - DNA, 22 bp, Homo sapiens
ccagtgcacagccaggcaggtg

SEQ ID NO: 8424154 - DNA, 22 bp, Homo sapiens
ccagtgcacagccaggcaggtg

SEQ ID NO: 8424155 - DNA, 19 bp, Homo sapiens
ccagtgcaaggtaagatag

SEQ ID NO: 8424156 - DNA, 22 bp, Homo sapiens
ccagtgcacaatggaacaactc

SEQ ID NO: 8424157 - DNA, 22 bp, Homo sapiens
agtgacagggaaggataggatt

SEQ ID NO: 8424158 - DNA, 22 bp, Homo sapiens
agtgacagggaaaatgacactg

SEQ ID NO: 8424159 - DNA, 22 bp, Homo sapiens
agtgacagggaaggataggatt

SEQ ID NO: 8424160 - DNA, 21 bp, Homo sapiens
agtgacagaggaaggtgcata

SEQ ID NO: 8424161 - DNA, 22 bp, Homo sapiens
ctccagaattgtccattggaaa

SEQ ID NO: 8424162 - DNA, 22 bp, Homo sapiens
ctcagtgttaaatataaggtat

SEQ ID NO: 8424163 - DNA, 20 bp, Homo sapiens
agtgaatttaaataatattc

SEQ ID NO: 8424164 - DNA, 22 bp, Homo sapiens
agtgaatttaaaacactgagga

SEQ ID NO: 8424165 - DNA, 22 bp, Homo sapiens
agtgaattctaaatgctaaaga

SEQ ID NO: 8424166 - DNA, 22 bp, Homo sapiens
agtgaattctccacccagtagg

SEQ ID NO: 8424167 - DNA, 22 bp, Homo sapiens
ctcagtggttgagagcctgggc

SEQ ID NO: 8424168 - DNA, 22 bp, Homo sapiens
ctcagtgtcacgttttgcctta

SEQ ID NO: 8424169 - DNA, 23 bp, Homo sapiens
ctcagtgtgtgacccatggcctc

SEQ ID NO: 8424170 - DNA, 22 bp, Homo sapiens
ctcagtgtcttattgtacacat

SEQ ID NO: 8424171 - DNA, 22 bp, Homo sapiens
ctcagtgtgagtgagaagtgca

SEQ ID NO: 8424172 - DNA, 22 bp, Homo sapiens
ctcagtgtgagtgagaagtgca

SEQ ID NO: 8424173 - DNA, 22 bp, Homo sapiens
agtctcagccacacagacctat

SEQ ID NO: 8424174 - DNA, 22 bp, Homo sapiens
ctcagctctgacaggaggcatc

SEQ ID NO: 8424175 - DNA, 22 bp, Homo sapiens
ctcagctccaggtgtgcatctt

SEQ ID NO: 8424176 - DNA, 22 bp, Homo sapiens
ctcagctccagccctcagcagc

SEQ ID NO: 8424177 - DNA, 22 bp, Homo sapiens
ctcagctagtaacgtacatgtc

SEQ ID NO: 8424178 - DNA, 22 bp, Homo sapiens
ctcagctcaaaattcacctttg

SEQ ID NO: 8424179 - DNA, 22 bp, Homo sapiens
ctcagcctgtgaagagcagagg

SEQ ID NO: 8424180 - DNA, 22 bp, Homo sapiens
ctcagcacattcctaagggatg

SEQ ID NO: 8424181 - DNA, 22 bp, Homo sapiens
ctcagcccggtgctcgtgccac

SEQ ID NO: 8424182 - DNA, 22 bp, Homo sapiens
agtctccacttgacatcagcag

SEQ ID NO: 8424183 - DNA, 22 bp, Homo sapiens
agtctccacccatgacagtaca

SEQ ID NO: 8424184 - DNA, 22 bp, Homo sapiens
agtctccagaaatatagcagtg

SEQ ID NO: 8424185 - DNA, 19 bp, Homo sapiens
agtctcagtgtacagaggc

SEQ ID NO: 8424186 - DNA, 22 bp, Homo sapiens
agtctccacttgacatcagcag

SEQ ID NO: 8424187 - DNA, 22 bp, Homo sapiens
agtctccacaacagccctgata

SEQ ID NO: 8424188 - DNA, 22 bp, Homo sapiens
agtctccacactggcagatgcc

SEQ ID NO: 8424189 - DNA, 22 bp, Homo sapiens
ctcagagtccccacatctgggt

SEQ ID NO: 8424190 - DNA, 22 bp, Homo sapiens
ctcagataatctttgagtcttc

SEQ ID NO: 8424191 - DNA, 23 bp, Homo sapiens
ctcagaggtgtttttcacttact

SEQ ID NO: 8424192 - DNA, 23 bp, Homo sapiens
ctcagaggtgtttttcacttact

SEQ ID NO: 8424193 - DNA, 22 bp, Homo sapiens
ctcagaggtggatgccttgtgg

SEQ ID NO: 8424194 - DNA, 22 bp, Homo sapiens
ctcagaggtcaagagcagagct

SEQ ID NO: 8424195 - DNA, 22 bp, Homo sapiens
ctcagaggtcaagagcagagct

SEQ ID NO: 8424196 - DNA, 22 bp, Homo sapiens
ctcagagggtacaggtgaaccc

SEQ ID NO: 8424197 - DNA, 22 bp, Homo sapiens
ctcagagggtctcctccagaat

SEQ ID NO: 8424198 - DNA, 22 bp, Homo sapiens
ctcagaggtcaagagcagagct

SEQ ID NO: 8424199 - DNA, 21 bp, Homo sapiens
ctcagacagggaggctctggg

SEQ ID NO: 8424200 - DNA, 22 bp, Homo sapiens
ctcagacccccagagctgctaa

SEQ ID NO: 8424201 - DNA, 22 bp, Homo sapiens
agtcccagagaggtcggggcca

SEQ ID NO: 8424202 - DNA, 22 bp, Homo sapiens
agtcccagatctacaggaggga

SEQ ID NO: 8424203 - DNA, 22 bp, Homo sapiens
agtcccagatctacaggaggga

SEQ ID NO: 8424204 - DNA, 22 bp, Homo sapiens
agtcccagatctacaggaggga

SEQ ID NO: 8424205 - DNA, 22 bp, Homo sapiens
ctcagaagaatcagcagctatt

SEQ ID NO: 8424206 - DNA, 22 bp, Homo sapiens
ctcagaagaacaaaggctctac

SEQ ID NO: 8424207 - DNA, 22 bp, Homo sapiens
ctcagaagaatcagcagctatt

SEQ ID NO: 8424208 - DNA, 22 bp, Homo sapiens
ctcagaagaatcagcagctatt

SEQ ID NO: 8424209 - DNA, 22 bp, Homo sapiens
ctcagaagaacaaaggctctac

SEQ ID NO: 8424210 - DNA, 22 bp, Homo sapiens
ctcagaagaacaaaggctctac

SEQ ID NO: 8424211 - DNA, 22 bp, Homo sapiens
cggggtccgggcagtaggctgc

SEQ ID NO: 8424212 - DNA, 22 bp, Homo sapiens
agtatgaatacagattttctct

SEQ ID NO: 8424213 - DNA, 22 bp, Homo sapiens
agtatcaatcaccctttgaagt

SEQ ID NO: 8424214 - DNA, 22 bp, Homo sapiens
agtatcatgttggaattaatca

SEQ ID NO: 8424215 - DNA, 22 bp, Homo sapiens
cgggttcacgccattctcctgc

SEQ ID NO: 8424216 - DNA, 22 bp, Homo sapiens
cgggttcacgccattctcctgc

SEQ ID NO: 8424217 - DNA, 22 bp, Homo sapiens
cggggttcatccatgctgtggc

SEQ ID NO: 8424218 - DNA, 22 bp, Homo sapiens
ctcaaagaagggaggtatttgg

SEQ ID NO: 8424219 - DNA, 22 bp, Homo sapiens
ctcaaaatggttaattttaata

SEQ ID NO: 8424220 - DNA, 22 bp, Homo sapiens
ctcaaatagaactgatctataa

SEQ ID NO: 8424221 - DNA, 22 bp, Homo sapiens
ctcaaatacctctccatgtgac

SEQ ID NO: 8424222 - DNA, 23 bp, Homo sapiens
ctcaaccctagtaagggagtagg

SEQ ID NO: 8424223 - DNA, 23 bp, Homo sapiens
ctcaaccctagtaagggagtagg

SEQ ID NO: 8424224 - DNA, 23 bp, Homo sapiens
ctcaaccctagtaagggagtagg

SEQ ID NO: 8424225 - DNA, 22 bp, Homo sapiens
ctcaaatgtttccacttctgct

SEQ ID NO: 8424226 - DNA, 22 bp, Homo sapiens
ctcaacatgcctactcagtctg

SEQ ID NO: 8424227 - DNA, 22 bp, Homo sapiens
ctcaacatttaacagtgaaaaa

SEQ ID NO: 8424228 - DNA, 21 bp, Homo sapiens
ctcaaatgccagttttattta

SEQ ID NO: 8424229 - DNA, 22 bp, Homo sapiens
ctcaaatatgtggtcagaaagc

SEQ ID NO: 8424230 - DNA, 22 bp, Homo sapiens
agtggcttatgtttagaatcat

SEQ ID NO: 8424231 - DNA, 22 bp, Homo sapiens
agtggctgtttataggtgggta

SEQ ID NO: 8424232 - DNA, 22 bp, Homo sapiens
agtggctgtgaaatacatggga

SEQ ID NO: 8424233 - DNA, 22 bp, Homo sapiens
agtggctgttcattttacacaa

SEQ ID NO: 8424234 - DNA, 22 bp, Homo sapiens
agtggctgttccaggtgaggac

SEQ ID NO: 8424235 - DNA, 22 bp, Homo sapiens
agtggctgttccaggtgaggac

SEQ ID NO: 8424236 - DNA, 22 bp, Homo sapiens
agtgggacagtgtagagcgtca

SEQ ID NO: 8424237 - DNA, 22 bp, Homo sapiens
agtgggaatttcagtgctaaaa

SEQ ID NO: 8424238 - DNA, 22 bp, Homo sapiens
agtggctttttagtggcagatg

SEQ ID NO: 8424239 - DNA, 22 bp, Homo sapiens
ctctgggtcaccatcggggatt

SEQ ID NO: 8424240 - DNA, 22 bp, Homo sapiens
agtgggagaatgaataagggcc

SEQ ID NO: 8424241 - DNA, 22 bp, Homo sapiens
ctctgtagaaacagggcagaag

SEQ ID NO: 8424242 - DNA, 22 bp, Homo sapiens
ctctgtagaaagagcccaggtg

SEQ ID NO: 8424243 - DNA, 22 bp, Homo sapiens
ctctgtagactccacctttgag

SEQ ID NO: 8424244 - DNA, 22 bp, Homo sapiens
ctctgtacaggagacatctcta

SEQ ID NO: 8424245 - DNA, 22 bp, Homo sapiens
ctctgtacctggcatagcaacc

SEQ ID NO: 8424246 - DNA, 22 bp, Homo sapiens
ctctgtaccttaaaagggcttt

SEQ ID NO: 8424247 - DNA, 17 bp, Homo sapiens
ctctgtacaggaaagag

SEQ ID NO: 8424248 - DNA, 22 bp, Homo sapiens
ctctgtcacttctccagctgag

SEQ ID NO: 8424249 - DNA, 22 bp, Homo sapiens
ctctgtagccatgggtatattc

SEQ ID NO: 8424250 - DNA, 22 bp, Homo sapiens
ctctggacctcagctacagact

SEQ ID NO: 8424251 - DNA, 22 bp, Homo sapiens
ctctggacagcaggtgctgtgg

SEQ ID NO: 8424252 - DNA, 19 bp, Homo sapiens
ctctctccagtggctggct

SEQ ID NO: 8424253 - DNA, 20 bp, Homo sapiens
ctctctccatctcagtggcc

SEQ ID NO: 8424254 - DNA, 22 bp, Homo sapiens
ctctgctgcaggaaggcgtgca

SEQ ID NO: 8424255 - DNA, 22 bp, Homo sapiens
ctctgctgcaggaaggcgtgca

SEQ ID NO: 8424256 - DNA, 22 bp, Homo sapiens
ctctggagaactccttgtgtct

SEQ ID NO: 8424257 - DNA, 22 bp, Homo sapiens
ctctggagaggttcccatggga

SEQ ID NO: 8424258 - DNA, 22 bp, Homo sapiens
ctctttggcgttggcagagcca

SEQ ID NO: 8424259 - DNA, 22 bp, Homo sapiens
ctctttggctttgactcccatt

SEQ ID NO: 8424260 - DNA, 16 bp, Homo sapiens
ctctttggcttccaag

SEQ ID NO: 8424261 - DNA, 22 bp, Homo sapiens
ctcttgggtgggcagtgggcct

SEQ ID NO: 8424262 - DNA, 22 bp, Homo sapiens
ctcttgggagtgctctggagaa

SEQ ID NO: 8424263 - DNA, 19 bp, Homo sapiens
ctcttgggtggcagaggcc

SEQ ID NO: 8424264 - DNA, 19 bp, Homo sapiens
ctcttgggtggcagaggcc

SEQ ID NO: 8424265 - DNA, 22 bp, Homo sapiens
ctcttgcatgagatccaggagt

SEQ ID NO: 8424266 - DNA, 22 bp, Homo sapiens
ctcttctttccatccctagcca

SEQ ID NO: 8424267 - DNA, 22 bp, Homo sapiens
ctcttcttggcccccatgaggg

SEQ ID NO: 8424268 - DNA, 22 bp, Homo sapiens
ctcttagtaatgccatgaagca

SEQ ID NO: 8424269 - DNA, 22 bp, Homo sapiens
ctcttagtaatgccatgaagca

SEQ ID NO: 8424270 - DNA, 22 bp, Homo sapiens
agtggtggagccaggaaatgtg

SEQ ID NO: 8424271 - DNA, 22 bp, Homo sapiens
ctcttagatatggagaattacc

SEQ ID NO: 8424272 - DNA, 22 bp, Homo sapiens
agtggtgatgacagcagtttct

SEQ ID NO: 8424273 - DNA, 22 bp, Homo sapiens
ctctgtgattctcatgtaccac

SEQ ID NO: 8424274 - DNA, 22 bp, Homo sapiens
ctctgtgaacccctcctttctt

SEQ ID NO: 8424275 - DNA, 22 bp, Homo sapiens
ctctgtcccagacccacctctc

SEQ ID NO: 8424276 - DNA, 22 bp, Homo sapiens
ctctgtcctatgcttgatagaa

SEQ ID NO: 8424277 - DNA, 23 bp, Homo sapiens
ctctccaccttcccacccaggga

SEQ ID NO: 8424278 - DNA, 23 bp, Homo sapiens
ctctccaccttcccacccaggga

SEQ ID NO: 8424279 - DNA, 19 bp, Homo sapiens
ctctccacctaacaggtat

SEQ ID NO: 8424280 - DNA, 22 bp, Homo sapiens
agtgctgggattgcaggcatga

SEQ ID NO: 8424281 - DNA, 22 bp, Homo sapiens
agtgctgggctatctactgcta

SEQ ID NO: 8424282 - DNA, 22 bp, Homo sapiens
ctctccagttatagctgatttg

SEQ ID NO: 8424283 - DNA, 22 bp, Homo sapiens
agtgctggcccatagctgctgg

SEQ ID NO: 8424284 - DNA, 22 bp, Homo sapiens
agtgctggcccatagctgctgg

SEQ ID NO: 8424285 - DNA, 22 bp, Homo sapiens
agtgctgggattacaggcataa

SEQ ID NO: 8424286 - DNA, 22 bp, Homo sapiens
ctctcgccagcggggctgcgct

SEQ ID NO: 8424287 - DNA, 22 bp, Homo sapiens
ctctcgcgtgtgcctttccgct

SEQ ID NO: 8424288 - DNA, 22 bp, Homo sapiens
ctctccccacaccctctgcatg

SEQ ID NO: 8424289 - DNA, 22 bp, Homo sapiens
ctctccccacaccctctgcatg

SEQ ID NO: 8424290 - DNA, 22 bp, Homo sapiens
ctctcccagtcaggctcaggat

SEQ ID NO: 8424291 - DNA, 20 bp, Homo sapiens
ctctcccagcacagcttcct

SEQ ID NO: 8424292 - DNA, 22 bp, Homo sapiens
agtgctggattacaggcgtgag

SEQ ID NO: 8424293 - DNA, 22 bp, Homo sapiens
ctcctgaggaaaagcttggtca

SEQ ID NO: 8424294 - DNA, 22 bp, Homo sapiens
ctcctgagggatgcttaggctt

SEQ ID NO: 8424295 - DNA, 22 bp, Homo sapiens
ctcctgaggacttctattgggt

SEQ ID NO: 8424296 - DNA, 22 bp, Homo sapiens
agtgctggaaagggacggagga

SEQ ID NO: 8424297 - DNA, 22 bp, Homo sapiens
agtgctgagtgattgcaaagga

SEQ ID NO: 8424298 - DNA, 22 bp, Homo sapiens
agtgctgaggccatactccata

SEQ ID NO: 8424299 - DNA, 22 bp, Homo sapiens
agtgctgactctgggcacagtg

SEQ ID NO: 8424300 - DNA, 22 bp, Homo sapiens
agtgctgaggaaggggcccatt

SEQ ID NO: 8424301 - DNA, 22 bp, Homo sapiens
agtgctatcgagttctaatgct

SEQ ID NO: 8424302 - DNA, 22 bp, Homo sapiens
ctccagagagaaaggaggccgc

SEQ ID NO: 8424303 - DNA, 22 bp, Homo sapiens
agtgctataaaggtagaccaca

SEQ ID NO: 8424304 - DNA, 22 bp, Homo sapiens
ctcctgaggggacaggactcat

SEQ ID NO: 8424305 - DNA, 22 bp, Homo sapiens
ctcctgagtagtagcattgtca

SEQ ID NO: 8424306 - DNA, 22 bp, Homo sapiens
ctcctgagtagtagcattgtca

SEQ ID NO: 8424307 - DNA, 22 bp, Homo sapiens
ctcctgcaagcctccccaagca

SEQ ID NO: 8424308 - DNA, 22 bp, Homo sapiens
ctcctgcaagcctccccaagca

SEQ ID NO: 8424309 - DNA, 22 bp, Homo sapiens
ctcctggttcagagagctgaga

SEQ ID NO: 8424310 - DNA, 22 bp, Homo sapiens
ctccttctgggcctggcagtgg

SEQ ID NO: 8424311 - DNA, 22 bp, Homo sapiens
ctcctgcatggttgtgctattg

SEQ ID NO: 8424312 - DNA, 22 bp, Homo sapiens
ctcctggtgctggggctgccgc

SEQ ID NO: 8424313 - DNA, 23 bp, Homo sapiens
ctccttggtatgccatgcccagc

SEQ ID NO: 8424314 - DNA, 23 bp, Homo sapiens
ctccttggtatgccatgcccagc

SEQ ID NO: 8424315 - DNA, 22 bp, Homo sapiens
ctccttggtgtagtactgagca

SEQ ID NO: 8424316 - DNA, 22 bp, Homo sapiens
ctcggaatggaacaacagcggt

SEQ ID NO: 8424317 - DNA, 22 bp, Homo sapiens
ctcgcaggacagtgctaggact

SEQ ID NO: 8424318 - DNA, 22 bp, Homo sapiens
ctcgcaggacagtgctaggact

SEQ ID NO: 8424319 - DNA, 22 bp, Homo sapiens
cctttattcaattagtcctaat

SEQ ID NO: 8424320 - DNA, 22 bp, Homo sapiens
aggtgggggctgtgtccttgac

SEQ ID NO: 8424321 - DNA, 22 bp, Homo sapiens
aggtgggggctgtgtccttgac

SEQ ID NO: 8424322 - DNA, 22 bp, Homo sapiens
aggtgggggctgtgtccttgac

SEQ ID NO: 8424323 - DNA, 22 bp, Homo sapiens
aggtgggggctgtgtccttgac

SEQ ID NO: 8424324 - DNA, 22 bp, Homo sapiens
ccttttaagggagactagagat

SEQ ID NO: 8424325 - DNA, 22 bp, Homo sapiens
cctttgttcactggagagtgga

SEQ ID NO: 8424326 - DNA, 22 bp, Homo sapiens
cctttgtggtggcccagtgtgg

SEQ ID NO: 8424327 - DNA, 22 bp, Homo sapiens
cgagcatgatgacggctgtggc

SEQ ID NO: 8424328 - DNA, 22 bp, Homo sapiens
ccttttatactcagtgatatca

SEQ ID NO: 8424329 - DNA, 22 bp, Homo sapiens
cgaggcaggcaggcggaggata

SEQ ID NO: 8424330 - DNA, 22 bp, Homo sapiens
agtatatatgaggaaccacaaa

SEQ ID NO: 8424331 - DNA, 22 bp, Homo sapiens
agtatatatgaggaaccacaaa

SEQ ID NO: 8424332 - DNA, 22 bp, Homo sapiens
cggccgcagcagtgtcggccca

SEQ ID NO: 8424333 - DNA, 22 bp, Homo sapiens
cggctcactgcagctccgcctc

SEQ ID NO: 8424334 - DNA, 22 bp, Homo sapiens
cggctcactgcagctccgcctc

SEQ ID NO: 8424335 - DNA, 22 bp, Homo sapiens
cggctcagacttcccaagaaca

SEQ ID NO: 8424336 - DNA, 22 bp, Homo sapiens
agtagggtgttgctataacaag

SEQ ID NO: 8424337 - DNA, 22 bp, Homo sapiens
cggaggggtttgaacagaggag

SEQ ID NO: 8424338 - DNA, 22 bp, Homo sapiens
cggaggttgaggctgcagtgag

SEQ ID NO: 8424339 - DNA, 22 bp, Homo sapiens
cggccaagccggggccccgaag

SEQ ID NO: 8424340 - DNA, 22 bp, Homo sapiens
cggccaggcacagtggcccacg

SEQ ID NO: 8424341 - DNA, 22 bp, Homo sapiens
cggagctgcctgccaagcctgc

SEQ ID NO: 8424342 - DNA, 22 bp, Homo sapiens
cggagctggcgtctgtgtggac

SEQ ID NO: 8424343 - DNA, 22 bp, Homo sapiens
cggagctgcgccgggacacggg

SEQ ID NO: 8424344 - DNA, 21 bp, Homo sapiens
cggagctgggcagggcatccc

SEQ ID NO: 8424345 - DNA, 22 bp, Homo sapiens
ccttggctgaggagggagctga

SEQ ID NO: 8424346 - DNA, 22 bp, Homo sapiens
ccttggctaggcagcggctgtc

SEQ ID NO: 8424347 - DNA, 22 bp, Homo sapiens
ccttggccctagcctcaggcaa

SEQ ID NO: 8424348 - DNA, 22 bp, Homo sapiens
ccttggccctagcctcaggcaa

SEQ ID NO: 8424349 - DNA, 22 bp, Homo sapiens
ccttggattttgtgcccacgcc

SEQ ID NO: 8424350 - DNA, 22 bp, Homo sapiens
ccttgccttggtccttcgcagg

SEQ ID NO: 8424351 - DNA, 22 bp, Homo sapiens
ccttctctgcaggtagttggct

SEQ ID NO: 8424352 - DNA, 22 bp, Homo sapiens
ccttgctcggggagctgcagga

SEQ ID NO: 8424353 - DNA, 22 bp, Homo sapiens
ccttggagacctgggtctgtgc

SEQ ID NO: 8424354 - DNA, 22 bp, Homo sapiens
aggtggctgtattcagctgtaa

SEQ ID NO: 8424355 - DNA, 22 bp, Homo sapiens
aggtggctgtggcttcccttgt

SEQ ID NO: 8424356 - DNA, 22 bp, Homo sapiens
aggtggctggtccaggctgcag

SEQ ID NO: 8424357 - DNA, 22 bp, Homo sapiens
aggtggctgagctgtgcccctg

SEQ ID NO: 8424358 - DNA, 22 bp, Homo sapiens
aggtggctgaagagtgggtgag

SEQ ID NO: 8424359 - DNA, 22 bp, Homo sapiens
aggtggctgaagagtgggtgag

SEQ ID NO: 8424360 - DNA, 22 bp, Homo sapiens
aggtggctgcctccccgcgcgg

SEQ ID NO: 8424361 - DNA, 17 bp, Homo sapiens
aggtggctgctgcgcct

SEQ ID NO: 8424362 - DNA, 22 bp, Homo sapiens
aggtggcttctggccaggtgtg

SEQ ID NO: 8424363 - DNA, 22 bp, Homo sapiens
cctgggactcggccaggacaga

SEQ ID NO: 8424364 - DNA, 22 bp, Homo sapiens
cctgggaatctgcattgtcagc

SEQ ID NO: 8424365 - DNA, 22 bp, Homo sapiens
aggtgcctatctggtctctgca

SEQ ID NO: 8424366 - DNA, 22 bp, Homo sapiens
aggtgccaggagggaatttagg

SEQ ID NO: 8424367 - DNA, 22 bp, Homo sapiens
aggtgccattgcttgccagttt

SEQ ID NO: 8424368 - DNA, 22 bp, Homo sapiens
aggtgcaggagctgtgcaggga

SEQ ID NO: 8424369 - DNA, 21 bp, Homo sapiens
aggtgctggcgccccaggaga

SEQ ID NO: 8424370 - DNA, 22 bp, Homo sapiens
aggtgctggagtctgggcagga

SEQ ID NO: 8424371 - DNA, 17 bp, Homo sapiens
aggtgctggagcatcag

SEQ ID NO: 8424372 - DNA, 22 bp, Homo sapiens
aggtgctggcgccccaggagac

SEQ ID NO: 8424373 - DNA, 22 bp, Homo sapiens
aggtgctggagtctgggcagga

SEQ ID NO: 8424374 - DNA, 22 bp, Homo sapiens
aggtgctgaactggtgaggtct

SEQ ID NO: 8424375 - DNA, 22 bp, Homo sapiens
aggtgctgccccgagaaggatg

SEQ ID NO: 8424376 - DNA, 22 bp, Homo sapiens
aggtgctgttaacatatgaggt

SEQ ID NO: 8424377 - DNA, 22 bp, Homo sapiens
aggtgctgtgctatgcacttgt

SEQ ID NO: 8424378 - DNA, 22 bp, Homo sapiens
aggtgctgggcagcagtcattg

SEQ ID NO: 8424379 - DNA, 19 bp, Homo sapiens
aggtgctggtgagggtgtt

SEQ ID NO: 8424380 - DNA, 19 bp, Homo sapiens
aggtgctggtgagggtgtt

SEQ ID NO: 8424381 - DNA, 20 bp, Homo sapiens
aggtggctcttcctgggctt

SEQ ID NO: 8424382 - DNA, 22 bp, Homo sapiens
aggtggctctgacagctctggt

SEQ ID NO: 8424383 - DNA, 22 bp, Homo sapiens
aggtggcatgagactgtaccag

SEQ ID NO: 8424384 - DNA, 22 bp, Homo sapiens
aggtgctgtttgtcagcagttt

SEQ ID NO: 8424385 - DNA, 22 bp, Homo sapiens
aggtggcagttgtggaaccatc

SEQ ID NO: 8424386 - DNA, 22 bp, Homo sapiens
cctggctggactggaccgtggc

SEQ ID NO: 8424387 - DNA, 22 bp, Homo sapiens
cctggctgctttcactatggag

SEQ ID NO: 8424388 - DNA, 22 bp, Homo sapiens
cctggctgcttcctctgccatg

SEQ ID NO: 8424389 - DNA, 22 bp, Homo sapiens
cctggctggactggaccgtggc

SEQ ID NO: 8424390 - DNA, 22 bp, Homo sapiens
cctggctggatggagcccctgg

SEQ ID NO: 8424391 - DNA, 22 bp, Homo sapiens
cctggctgcttcctctgccatg

SEQ ID NO: 8424392 - DNA, 22 bp, Homo sapiens
cctggctgcttcctctgccatg

SEQ ID NO: 8424393 - DNA, 22 bp, Homo sapiens
cctggctgcttcctctgccatg

SEQ ID NO: 8424394 - DNA, 19 bp, Homo sapiens
cctggctgctgtgggatgc

SEQ ID NO: 8424395 - DNA, 22 bp, Homo sapiens
cctggctcttcagaggttccta

SEQ ID NO: 8424396 - DNA, 22 bp, Homo sapiens
cctggctctgtcctcgcgcaaa

SEQ ID NO: 8424397 - DNA, 23 bp, Homo sapiens
cctggctggattctctgcattca

SEQ ID NO: 8424398 - DNA, 23 bp, Homo sapiens
cctggctggattctctgcattca

SEQ ID NO: 8424399 - DNA, 17 bp, Homo sapiens
cctggctgggaatctga

SEQ ID NO: 8424400 - DNA, 23 bp, Homo sapiens
cctggctggattctctgcattca

SEQ ID NO: 8424401 - DNA, 22 bp, Homo sapiens
cctggctggggtagaagtgagg

SEQ ID NO: 8424402 - DNA, 20 bp, Homo sapiens
cctggctggtggaggaaagg

SEQ ID NO: 8424403 - DNA, 22 bp, Homo sapiens
cctgggaagtcagccaaggacg

SEQ ID NO: 8424404 - DNA, 22 bp, Homo sapiens
cctgggaaggggaagagaattc

SEQ ID NO: 8424405 - DNA, 22 bp, Homo sapiens
cctggctggttgtctgattcta

SEQ ID NO: 8424406 - DNA, 22 bp, Homo sapiens
cctggctggtggcagcgacaag

SEQ ID NO: 8424407 - DNA, 20 bp, Homo sapiens
cctggccaatgagataggaa

SEQ ID NO: 8424408 - DNA, 20 bp, Homo sapiens
cctggccaatgagataggaa

SEQ ID NO: 8424409 - DNA, 21 bp, Homo sapiens
cctggccaatctgatagggtt

SEQ ID NO: 8424410 - DNA, 22 bp, Homo sapiens
cctggccacagggctctgcatt

SEQ ID NO: 8424411 - DNA, 22 bp, Homo sapiens
cctggccacagggctctgcatt

SEQ ID NO: 8424412 - DNA, 22 bp, Homo sapiens
cctggccagaggcgtgcctgtg

SEQ ID NO: 8424413 - DNA, 19 bp, Homo sapiens
cctggccagacttctgccc

SEQ ID NO: 8424414 - DNA, 22 bp, Homo sapiens
cctggccacccagccttggcca

SEQ ID NO: 8424415 - DNA, 22 bp, Homo sapiens
cctggccaatctagggctgtta

SEQ ID NO: 8424416 - DNA, 22 bp, Homo sapiens
cctggcagctgtttggcttggc

SEQ ID NO: 8424417 - DNA, 22 bp, Homo sapiens
cctggcagctgtttggcttggc

SEQ ID NO: 8424418 - DNA, 22 bp, Homo sapiens
cctggcattctctccagagaga

SEQ ID NO: 8424419 - DNA, 22 bp, Homo sapiens
cctggcagctccgtggccttcc

SEQ ID NO: 8424420 - DNA, 22 bp, Homo sapiens
cctggcagctcctccccggcgg

SEQ ID NO: 8424421 - DNA, 22 bp, Homo sapiens
cctggcagctcctccccggcgg

SEQ ID NO: 8424422 - DNA, 22 bp, Homo sapiens
cctggcagctaagtgctttgag

SEQ ID NO: 8424423 - DNA, 22 bp, Homo sapiens
cctgctcttatagctgtttcca

SEQ ID NO: 8424424 - DNA, 22 bp, Homo sapiens
cctgctctagactctgggaagg

SEQ ID NO: 8424425 - DNA, 22 bp, Homo sapiens
cctgctctccatacactttcta

SEQ ID NO: 8424426 - DNA, 22 bp, Homo sapiens
cctgcctggcttccagaagaga

SEQ ID NO: 8424427 - DNA, 22 bp, Homo sapiens
cctgctctgccaagtcctcttt

SEQ ID NO: 8424428 - DNA, 22 bp, Homo sapiens
cctgcctggcttccagaagaga

SEQ ID NO: 8424429 - DNA, 22 bp, Homo sapiens
cctggcacagatccttcataca

SEQ ID NO: 8424430 - DNA, 22 bp, Homo sapiens
cctggcagcccagagcgccgct

SEQ ID NO: 8424431 - DNA, 22 bp, Homo sapiens
cctggcagcctcagccaattct

SEQ ID NO: 8424432 - DNA, 22 bp, Homo sapiens
cctggcagcgccgaagctggcc

SEQ ID NO: 8424433 - DNA, 22 bp, Homo sapiens
cctggcagcgtgccgagctgcg

SEQ ID NO: 8424434 - DNA, 22 bp, Homo sapiens
cctggcagcgtgccgagctgcg

SEQ ID NO: 8424435 - DNA, 22 bp, Homo sapiens
cctggacaatgagatgtcaggg

SEQ ID NO: 8424436 - DNA, 22 bp, Homo sapiens
cctggaatctggagttggaatc

SEQ ID NO: 8424437 - DNA, 22 bp, Homo sapiens
cctggaagtcattcctcgttcc

SEQ ID NO: 8424438 - DNA, 22 bp, Homo sapiens
cctggaaggcaggcatggattg

SEQ ID NO: 8424439 - DNA, 22 bp, Homo sapiens
cctggaagagctgaatcaggca

SEQ ID NO: 8424440 - DNA, 22 bp, Homo sapiens
cctggaagagctgaatcaggca

SEQ ID NO: 8424441 - DNA, 21 bp, Homo sapiens
agggtcaggaaccagggtacc

SEQ ID NO: 8424442 - DNA, 22 bp, Homo sapiens
agggtcagagtcaggtgcagta

SEQ ID NO: 8424443 - DNA, 20 bp, Homo sapiens
agggtcagagagcgtgagtg

SEQ ID NO: 8424444 - DNA, 22 bp, Homo sapiens
cctgccctgctcactgtcggta

SEQ ID NO: 8424445 - DNA, 17 bp, Homo sapiens
agggtcaggtgaagttc

SEQ ID NO: 8424446 - DNA, 22 bp, Homo sapiens
agggtcaggttaagggagtcat

SEQ ID NO: 8424447 - DNA, 21 bp, Homo sapiens
agggtcctacagggctcagga

SEQ ID NO: 8424448 - DNA, 21 bp, Homo sapiens
agggtcctacagggctcagga

SEQ ID NO: 8424449 - DNA, 20 bp, Homo sapiens
agggtcagtagcacagagct

SEQ ID NO: 8424450 - DNA, 22 bp, Homo sapiens
agggtcctgagcctggggcgca

SEQ ID NO: 8424451 - DNA, 22 bp, Homo sapiens
agggtccttctgttcctgagca

SEQ ID NO: 8424452 - DNA, 22 bp, Homo sapiens
agggtccttctgttcctgagca

SEQ ID NO: 8424453 - DNA, 22 bp, Homo sapiens
agggtcctgggtgcagttgctt

SEQ ID NO: 8424454 - DNA, 22 bp, Homo sapiens
agggtctgttgtttgttctgga

SEQ ID NO: 8424455 - DNA, 22 bp, Homo sapiens
agggtctgtatttctggcaagc

SEQ ID NO: 8424456 - DNA, 22 bp, Homo sapiens
agggtctgtatttctggcaagc

SEQ ID NO: 8424457 - DNA, 22 bp, Homo sapiens
agggtctgtggatgcatctggg

SEQ ID NO: 8424458 - DNA, 23 bp, Homo sapiens
agggtgagcaagctatggagacc

SEQ ID NO: 8424459 - DNA, 20 bp, Homo sapiens
agggtctgatgtggtggccc

SEQ ID NO: 8424460 - DNA, 22 bp, Homo sapiens
agggtctgactcctctggcaag

SEQ ID NO: 8424461 - DNA, 23 bp, Homo sapiens
agggtctgctcagtgtcgttcaa

SEQ ID NO: 8424462 - DNA, 22 bp, Homo sapiens
agggtctctggagagctgagga

SEQ ID NO: 8424463 - DNA, 22 bp, Homo sapiens
agggtctctacgcactagaggg

SEQ ID NO: 8424464 - DNA, 22 bp, Homo sapiens
agggtctgaccaccagtaggga

SEQ ID NO: 8424465 - DNA, 22 bp, Homo sapiens
agggtctcttgccatgcctcag

SEQ ID NO: 8424466 - DNA, 22 bp, Homo sapiens
cctctgcacttcaccttagctc

SEQ ID NO: 8424467 - DNA, 22 bp, Homo sapiens
cctctgcacttcaccttagctc

SEQ ID NO: 8424468 - DNA, 22 bp, Homo sapiens
cctctgcagcagagagccagag

SEQ ID NO: 8424469 - DNA, 22 bp, Homo sapiens
cctctgagtgctttgagggaga

SEQ ID NO: 8424470 - DNA, 22 bp, Homo sapiens
cctctgagttggcctgtcttgt

SEQ ID NO: 8424471 - DNA, 22 bp, Homo sapiens
cctctgagtgacagcctcctct

SEQ ID NO: 8424472 - DNA, 22 bp, Homo sapiens
cctgccaggacattgcttgaag

SEQ ID NO: 8424473 - DNA, 22 bp, Homo sapiens
cctctgccacctcccacgaggc

SEQ ID NO: 8424474 - DNA, 22 bp, Homo sapiens
cctgcccagcttcccgagtgca

SEQ ID NO: 8424475 - DNA, 22 bp, Homo sapiens
cctgcccaggagtctctctgtg

SEQ ID NO: 8424476 - DNA, 22 bp, Homo sapiens
cctgcccccgtcagaggtgatg

SEQ ID NO: 8424477 - DNA, 22 bp, Homo sapiens
cctgcccatcccgtccttggcc

SEQ ID NO: 8424478 - DNA, 22 bp, Homo sapiens
cctgccctatgaccagcttcac

SEQ ID NO: 8424479 - DNA, 22 bp, Homo sapiens
cctgccctatgaccagcttcac

SEQ ID NO: 8424480 - DNA, 22 bp, Homo sapiens
cctgccctatgaccagcttcac

SEQ ID NO: 8424481 - DNA, 22 bp, Homo sapiens
cctgccctatgaccagcttcac

SEQ ID NO: 8424482 - DNA, 22 bp, Homo sapiens
cctgccctaatccagagactag

SEQ ID NO: 8424483 - DNA, 22 bp, Homo sapiens
cctgccctagagatgacacaat

SEQ ID NO: 8424484 - DNA, 22 bp, Homo sapiens
cctgccctagagatgacacaat

SEQ ID NO: 8424485 - DNA, 22 bp, Homo sapiens
cctgcccatcccgtccttggcc

SEQ ID NO: 8424486 - DNA, 22 bp, Homo sapiens
cctgccctagagatgacacaat

SEQ ID NO: 8424487 - DNA, 22 bp, Homo sapiens
ataaaagtaggaccaacttaca

SEQ ID NO: 8424488 - DNA, 22 bp, Homo sapiens
ataaaagtaggaccaacttaca

SEQ ID NO: 8424489 - DNA, 22 bp, Homo sapiens
ctgccaggcactgggctctgca

SEQ ID NO: 8424490 - DNA, 22 bp, Homo sapiens
ctgccaggcagcagagggagaa

SEQ ID NO: 8424491 - DNA, 22 bp, Homo sapiens
ctgccaggcagggagatggctg

SEQ ID NO: 8424492 - DNA, 22 bp, Homo sapiens
ctgccaggcactgggctctgca

SEQ ID NO: 8424493 - DNA, 21 bp, Homo sapiens
ctgccaggatagcatgcaggc

SEQ ID NO: 8424494 - DNA, 21 bp, Homo sapiens
ctgccaggatagcatgcaggc

SEQ ID NO: 8424495 - DNA, 22 bp, Homo sapiens
ctgccaaaaggtgcacctgctg

SEQ ID NO: 8424496 - DNA, 22 bp, Homo sapiens
ataaatagtgtgtcataaagtc

SEQ ID NO: 8424497 - DNA, 22 bp, Homo sapiens
ataaatagtgtgtcataaagtc

SEQ ID NO: 8424498 - DNA, 22 bp, Homo sapiens
ataaaagtttccaatcatgcct

SEQ ID NO: 8424499 - DNA, 20 bp, Homo sapiens
ataaaataactgccacaaga

SEQ ID NO: 8424500 - DNA, 20 bp, Homo sapiens
ataaaataactgccacaaga

SEQ ID NO: 8424501 - DNA, 22 bp, Homo sapiens
agtttggaaaatgagacaagga

SEQ ID NO: 8424502 - DNA, 22 bp, Homo sapiens
agtttggaagaatttggtctgt

SEQ ID NO: 8424503 - DNA, 22 bp, Homo sapiens
agtttgccccgtcaccctggtg

SEQ ID NO: 8424504 - DNA, 22 bp, Homo sapiens
agtttgtaaaatgtggcctgga

SEQ ID NO: 8424505 - DNA, 22 bp, Homo sapiens
agtttgaaggagttgaatcacc

SEQ ID NO: 8424506 - DNA, 22 bp, Homo sapiens
agtttgaagcacatgaatggca

SEQ ID NO: 8424507 - DNA, 22 bp, Homo sapiens
agtttgaattgaaatgcagatg

SEQ ID NO: 8424508 - DNA, 22 bp, Homo sapiens
agtttgaaagtattgacagaag

SEQ ID NO: 8424509 - DNA, 18 bp, Homo sapiens
agtttgaacaaggaagaa

SEQ ID NO: 8424510 - DNA, 22 bp, Homo sapiens
agtttgaagaaggtgagatgca

SEQ ID NO: 8424511 - DNA, 23 bp, Homo sapiens
agtttctttgagacttgccctgt

SEQ ID NO: 8424512 - DNA, 22 bp, Homo sapiens
agtttgaaagcttaacagtaca

SEQ ID NO: 8424513 - DNA, 22 bp, Homo sapiens
agtttgaaagcttaacagtaca

SEQ ID NO: 8424514 - DNA, 22 bp, Homo sapiens
agttgtgctgtgatgcaggata

SEQ ID NO: 8424515 - DNA, 22 bp, Homo sapiens
agtttaaatcatgttttgtaac

SEQ ID NO: 8424516 - DNA, 22 bp, Homo sapiens
agtttaaatcatgttttgtaac

SEQ ID NO: 8424517 - DNA, 22 bp, Homo sapiens
ctgcagctcctgagctcagaga

SEQ ID NO: 8424518 - DNA, 22 bp, Homo sapiens
ctgcagctccttctggcatgtg

SEQ ID NO: 8424519 - DNA, 22 bp, Homo sapiens
agttgtaagagacagatataaa

SEQ ID NO: 8424520 - DNA, 21 bp, Homo sapiens
ctgaggcagcacagctagtca

SEQ ID NO: 8424521 - DNA, 22 bp, Homo sapiens
agttggttcactccttcatgcc

SEQ ID NO: 8424522 - DNA, 22 bp, Homo sapiens
agttggtgggtgtgagctggac

SEQ ID NO: 8424523 - DNA, 22 bp, Homo sapiens
ctgaggcaggggcagctggaga

SEQ ID NO: 8424524 - DNA, 22 bp, Homo sapiens
ctgaggcaggatggcctggctg

SEQ ID NO: 8424525 - DNA, 22 bp, Homo sapiens
ctgaggcaggatggcctggctg

SEQ ID NO: 8424526 - DNA, 22 bp, Homo sapiens
ctgaggcaggcagatcacttga

SEQ ID NO: 8424527 - DNA, 22 bp, Homo sapiens
ctgaggcaggagagttgcttga

SEQ ID NO: 8424528 - DNA, 22 bp, Homo sapiens
ctgaggcaggagaattgctgga

SEQ ID NO: 8424529 - DNA, 22 bp, Homo sapiens
ctgaggcatcatggagaacagt

SEQ ID NO: 8424530 - DNA, 22 bp, Homo sapiens
ctgaggcagtttaatttttgaa

SEQ ID NO: 8424531 - DNA, 22 bp, Homo sapiens
ctgaggcatgaatgtgggcttt

SEQ ID NO: 8424532 - DNA, 22 bp, Homo sapiens
ctgaggcctaagacatgaatga

SEQ ID NO: 8424533 - DNA, 22 bp, Homo sapiens
ctgaggcctaagacatgaatga

SEQ ID NO: 8424534 - DNA, 22 bp, Homo sapiens
ctgaggcctcactgtagtccct

SEQ ID NO: 8424535 - DNA, 22 bp, Homo sapiens
ctgaggcatgaatgtgggcttt

SEQ ID NO: 8424536 - DNA, 21 bp, Homo sapiens
agttggaggcagtttggcaat

SEQ ID NO: 8424537 - DNA, 23 bp, Homo sapiens
agttggacctgggtaagaaaatg

SEQ ID NO: 8424538 - DNA, 22 bp, Homo sapiens
agttggcaaggtctggccagcg

SEQ ID NO: 8424539 - DNA, 22 bp, Homo sapiens
ctctttggtcgcatcatccatt

SEQ ID NO: 8424540 - DNA, 22 bp, Homo sapiens
ctctttggggtgccccactggt

SEQ ID NO: 8424541 - DNA, 22 bp, Homo sapiens
ctctttggggctggaagcctag

SEQ ID NO: 8424542 - DNA, 16 bp, Homo sapiens
ctctttgggcttccag

SEQ ID NO: 8424543 - DNA, 22 bp, Homo sapiens
ctctttgggatgggctctgctg

SEQ ID NO: 8424544 - DNA, 21 bp, Homo sapiens
ctctttgggatctttggaaag

SEQ ID NO: 8424545 - DNA, 19 bp, Homo sapiens
agttcttgtcctgtctgtt

SEQ ID NO: 8424546 - DNA, 22 bp, Homo sapiens
ctgaggtagccatggcccaagt

SEQ ID NO: 8424547 - DNA, 22 bp, Homo sapiens
ctgaggtagccatggcccaagt

SEQ ID NO: 8424548 - DNA, 22 bp, Homo sapiens
ctgaggtacctggagcaggtcc

SEQ ID NO: 8424549 - DNA, 22 bp, Homo sapiens
agttgtacattgtgaacattca

SEQ ID NO: 8424550 - DNA, 22 bp, Homo sapiens
agttgtatacacttaggcagat

SEQ ID NO: 8424551 - DNA, 22 bp, Homo sapiens
agttgtatctgaatgcatgtag

SEQ ID NO: 8424552 - DNA, 22 bp, Homo sapiens
ctgaggtcagagtttagtctgg

SEQ ID NO: 8424553 - DNA, 22 bp, Homo sapiens
ctgaggggtatccaaggggtaa

SEQ ID NO: 8424554 - DNA, 20 bp, Homo sapiens
ctgaggggtctgacttggac

SEQ ID NO: 8424555 - DNA, 22 bp, Homo sapiens
ctgagggaacttgggcaagtct

SEQ ID NO: 8424556 - DNA, 22 bp, Homo sapiens
ctgaggggatgtttttgacgga

SEQ ID NO: 8424557 - DNA, 18 bp, Homo sapiens
ctgaggcttagagaggtt

SEQ ID NO: 8424558 - DNA, 22 bp, Homo sapiens
ctgaggcttgtcctctcagctt

SEQ ID NO: 8424559 - DNA, 22 bp, Homo sapiens
ctgaggcttggaggggtctggt

SEQ ID NO: 8424560 - DNA, 22 bp, Homo sapiens
ctgaggcctctcccactccagc

SEQ ID NO: 8424561 - DNA, 22 bp, Homo sapiens
ctgaggcctctgttcaccagaa

SEQ ID NO: 8424562 - DNA, 22 bp, Homo sapiens
ctgaggcctctgttcaccagaa

SEQ ID NO: 8424563 - DNA, 22 bp, Homo sapiens
ctgaggcctctgttcaccagaa

SEQ ID NO: 8424564 - DNA, 22 bp, Homo sapiens
ataatacatggttaacctcttt

SEQ ID NO: 8424565 - DNA, 22 bp, Homo sapiens
ctgctctggtctcttcatgttt

SEQ ID NO: 8424566 - DNA, 22 bp, Homo sapiens
ataatacatggttgatcttttc

SEQ ID NO: 8424567 - DNA, 22 bp, Homo sapiens
ctgctctggcgtactcggcatc

SEQ ID NO: 8424568 - DNA, 22 bp, Homo sapiens
ctgctctggctgtgtacttcag

SEQ ID NO: 8424569 - DNA, 22 bp, Homo sapiens
ctgctctggggaagccagatgt

SEQ ID NO: 8424570 - DNA, 22 bp, Homo sapiens
ctgcccacagttctctgccatg

SEQ ID NO: 8424571 - DNA, 22 bp, Homo sapiens
ataaatatcactgttgtccctc

SEQ ID NO: 8424572 - DNA, 20 bp, Homo sapiens
ctgcccactagaactacctg

SEQ ID NO: 8424573 - DNA, 22 bp, Homo sapiens
ctgcccaccacacctgctcctg

SEQ ID NO: 8424574 - DNA, 22 bp, Homo sapiens
ctgctctgagaggctcttccta

SEQ ID NO: 8424575 - DNA, 22 bp, Homo sapiens
ctgctctgagaggctcttccta

SEQ ID NO: 8424576 - DNA, 22 bp, Homo sapiens
ctgctcagtcatgttggattgt

SEQ ID NO: 8424577 - DNA, 22 bp, Homo sapiens
ctgctcagtaatagtcctatct

SEQ ID NO: 8424578 - DNA, 18 bp, Homo sapiens
ctgcccagagcacttgtg

SEQ ID NO: 8424579 - DNA, 22 bp, Homo sapiens
ctgctcagtaatagtcctatct

SEQ ID NO: 8424580 - DNA, 22 bp, Homo sapiens
ctgcccagaagcttagagctta

SEQ ID NO: 8424581 - DNA, 22 bp, Homo sapiens
ctgcccagaatcactcactcga

SEQ ID NO: 8424582 - DNA, 22 bp, Homo sapiens
ctgcccagaagcttagagctta

SEQ ID NO: 8424583 - DNA, 22 bp, Homo sapiens
ctgcccagaagccagatgggca

SEQ ID NO: 8424584 - DNA, 22 bp, Homo sapiens
atacaagtcaatccatgtgatt

SEQ ID NO: 8424585 - DNA, 22 bp, Homo sapiens
atacaagacagtaggaaactga

SEQ ID NO: 8424586 - DNA, 22 bp, Homo sapiens
ctgctttaatttagacaaggca

SEQ ID NO: 8424587 - DNA, 22 bp, Homo sapiens
ctgctttaatgtaagatatacc

SEQ ID NO: 8424588 - DNA, 22 bp, Homo sapiens
ctgctttaatccctgcctggaa

SEQ ID NO: 8424589 - DNA, 22 bp, Homo sapiens
ctgctttaacagatgatggtgt

SEQ ID NO: 8424590 - DNA, 22 bp, Homo sapiens
ctgctttaaaactgatacatga

SEQ ID NO: 8424591 - DNA, 22 bp, Homo sapiens
ctgctttaactctgggaagcca

SEQ ID NO: 8424592 - DNA, 22 bp, Homo sapiens
ctgctttaagtattcaacaaag

SEQ ID NO: 8424593 - DNA, 22 bp, Homo sapiens
ataatcaaagtcctatgacatc

SEQ ID NO: 8424594 - DNA, 22 bp, Homo sapiens
ataatcaaagtcctatgacatc

SEQ ID NO: 8424595 - DNA, 22 bp, Homo sapiens
ataatatttggataggacagta

SEQ ID NO: 8424596 - DNA, 22 bp, Homo sapiens
ataatatttgcattactgtgat

SEQ ID NO: 8424597 - DNA, 22 bp, Homo sapiens
ataatcaaagtcctatgacatc

SEQ ID NO: 8424598 - DNA, 22 bp, Homo sapiens
ataatatcgctcctttttttga

SEQ ID NO: 8424599 - DNA, 22 bp, Homo sapiens
ataatagctaacacagagtgct

SEQ ID NO: 8424600 - DNA, 22 bp, Homo sapiens
ctgcttgggtcctggcatgggt

SEQ ID NO: 8424601 - DNA, 20 bp, Homo sapiens
ctgcttgggcccctctggcc

SEQ ID NO: 8424602 - DNA, 20 bp, Homo sapiens
ctgcttgggacactgccaga

SEQ ID NO: 8424603 - DNA, 17 bp, Homo sapiens
ctgcttggcctctgggg

SEQ ID NO: 8424604 - DNA, 22 bp, Homo sapiens
ctgcttgacctgttgttctcac

SEQ ID NO: 8424605 - DNA, 22 bp, Homo sapiens
ctgcttctccaaagtaggactt

SEQ ID NO: 8424606 - DNA, 22 bp, Homo sapiens
ctggcagctctactcagagcct

SEQ ID NO: 8424607 - DNA, 22 bp, Homo sapiens
ctggcagctctactcagagcct

SEQ ID NO: 8424608 - DNA, 22 bp, Homo sapiens
ctggcagctctactcagagcct

SEQ ID NO: 8424609 - DNA, 22 bp, Homo sapiens
ctggcagcggtttgcagcctgg

SEQ ID NO: 8424610 - DNA, 22 bp, Homo sapiens
ctggcagcgtgagcagcatcca

SEQ ID NO: 8424611 - DNA, 22 bp, Homo sapiens
ctggcagcgtgagcagcatcca

SEQ ID NO: 8424612 - DNA, 22 bp, Homo sapiens
ctggcagcggtttgcagcctgg

SEQ ID NO: 8424613 - DNA, 22 bp, Homo sapiens
ctggcagcggtttgcagcctgg

SEQ ID NO: 8424614 - DNA, 19 bp, Homo sapiens
ctggcagcctgtctgtgtc

SEQ ID NO: 8424615 - DNA, 22 bp, Homo sapiens
atacttctagaaatactatgca

SEQ ID NO: 8424616 - DNA, 22 bp, Homo sapiens
atacttctagaaatactatgca

SEQ ID NO: 8424617 - DNA, 22 bp, Homo sapiens
atacttctcatgggctctgagc

SEQ ID NO: 8424618 - DNA, 22 bp, Homo sapiens
atacttctggtgacaaagtctt

SEQ ID NO: 8424619 - DNA, 22 bp, Homo sapiens
atacttctttaagagtaagtct

SEQ ID NO: 8424620 - DNA, 22 bp, Homo sapiens
atacttctttagcatattgaac

SEQ ID NO: 8424621 - DNA, 22 bp, Homo sapiens
atactttagagctagattgcct

SEQ ID NO: 8424622 - DNA, 22 bp, Homo sapiens
atacttatgataaataattgct

SEQ ID NO: 8424623 - DNA, 22 bp, Homo sapiens
atactctttatgacattccagc

SEQ ID NO: 8424624 - DNA, 22 bp, Homo sapiens
ctggagggctgcagcgaggctg

SEQ ID NO: 8424625 - DNA, 22 bp, Homo sapiens
ctggagggctgcagcgaggctg

SEQ ID NO: 8424626 - DNA, 22 bp, Homo sapiens
ctggagtcttaggttatggtga

SEQ ID NO: 8424627 - DNA, 22 bp, Homo sapiens
ctggagagaccgaaagaggctg

SEQ ID NO: 8424628 - DNA, 22 bp, Homo sapiens
ctggagagaccgaaagaggctg

SEQ ID NO: 8424629 - DNA, 22 bp, Homo sapiens
atacaagttaatgagaatgaca

SEQ ID NO: 8424630 - DNA, 22 bp, Homo sapiens
atacaagttaatgagaatgaca

SEQ ID NO: 8424631 - DNA, 22 bp, Homo sapiens
atacaagtggccacttgaattc

SEQ ID NO: 8424632 - DNA, 22 bp, Homo sapiens
ctggagccccagacagggagag

SEQ ID NO: 8424633 - DNA, 22 bp, Homo sapiens
atacagaagttttccacttatt

SEQ ID NO: 8424634 - DNA, 22 bp, Homo sapiens
ctggagccccagacagggagag

SEQ ID NO: 8424635 - DNA, 22 bp, Homo sapiens
ctggagggagattcaaaggagg

SEQ ID NO: 8424636 - DNA, 22 bp, Homo sapiens
ctggagggagattcaaaggagg

SEQ ID NO: 8424637 - DNA, 22 bp, Homo sapiens
ctggagggagattcaaaggagg

SEQ ID NO: 8424638 - DNA, 22 bp, Homo sapiens
ctggaggaaaacaactgcagac

SEQ ID NO: 8424639 - DNA, 22 bp, Homo sapiens
ctggaggaaaacaactgcagac

SEQ ID NO: 8424640 - DNA, 22 bp, Homo sapiens
atacagagcagtaatagaggag

SEQ ID NO: 8424641 - DNA, 22 bp, Homo sapiens
atacagagacacttgagactgg

SEQ ID NO: 8424642 - DNA, 18 bp, Homo sapiens
atacagagacctcaagga

SEQ ID NO: 8424643 - DNA, 22 bp, Homo sapiens
atacagagaaggggtagaggat

SEQ ID NO: 8424644 - DNA, 22 bp, Homo sapiens
atatgttactctttcaagcaga

SEQ ID NO: 8424645 - DNA, 22 bp, Homo sapiens
atatgttactctttcaagcaga

SEQ ID NO: 8424646 - DNA, 22 bp, Homo sapiens
atatttactgctgtggtgaagg

SEQ ID NO: 8424647 - DNA, 22 bp, Homo sapiens
atatttagataaaaatgggctt

SEQ ID NO: 8424648 - DNA, 22 bp, Homo sapiens
atatttctgggggtgtgtttct

SEQ ID NO: 8424649 - DNA, 22 bp, Homo sapiens
atatttctgggggtgtgtttct

SEQ ID NO: 8424650 - DNA, 22 bp, Homo sapiens
atatttctctcagacatggaag

SEQ ID NO: 8424651 - DNA, 22 bp, Homo sapiens
atatgtatgtacgcacatattc

SEQ ID NO: 8424652 - DNA, 22 bp, Homo sapiens
atatgtgtgatgcatggactaa

SEQ ID NO: 8424653 - DNA, 22 bp, Homo sapiens
atatgtgtgccatttcagcagt

SEQ ID NO: 8424654 - DNA, 22 bp, Homo sapiens
atatcattctgatgtatatctt

SEQ ID NO: 8424655 - DNA, 19 bp, Homo sapiens
atatatgtatacaatgtgg

SEQ ID NO: 8424656 - DNA, 22 bp, Homo sapiens
atatatcttcattaggtcgaga

SEQ ID NO: 8424657 - DNA, 22 bp, Homo sapiens
atatatcatgagtaaaacttga

SEQ ID NO: 8424658 - DNA, 22 bp, Homo sapiens
atatatcatgagtaaaacttga

SEQ ID NO: 8424659 - DNA, 22 bp, Homo sapiens
atatgaagttacaggtaagaaa

SEQ ID NO: 8424660 - DNA, 22 bp, Homo sapiens
atatgacagcggattcacatat

SEQ ID NO: 8424661 - DNA, 22 bp, Homo sapiens
atatgacataaaatcatttttg

SEQ ID NO: 8424662 - DNA, 20 bp, Homo sapiens
ctgggcaggtgtttgatctc

SEQ ID NO: 8424663 - DNA, 22 bp, Homo sapiens
ctgggcaggatacttcatggga

SEQ ID NO: 8424664 - DNA, 22 bp, Homo sapiens
ctgggcagtggtggcatctttg

SEQ ID NO: 8424665 - DNA, 22 bp, Homo sapiens
ctgggcagtggtggcatctttg

SEQ ID NO: 8424666 - DNA, 22 bp, Homo sapiens
ctgggcagtggtggcccttccc

SEQ ID NO: 8424667 - DNA, 22 bp, Homo sapiens
atatggcagaccaattagaagc

SEQ ID NO: 8424668 - DNA, 22 bp, Homo sapiens
atatggcattctttttaagggt

SEQ ID NO: 8424669 - DNA, 22 bp, Homo sapiens
atataacatacatacagaaaag

SEQ ID NO: 8424670 - DNA, 22 bp, Homo sapiens
atataacatacatacagaaaag

SEQ ID NO: 8424671 - DNA, 19 bp, Homo sapiens
ctgggacaatgaaagcatc

SEQ ID NO: 8424672 - DNA, 19 bp, Homo sapiens
ctgggacaatgaaagcatc

SEQ ID NO: 8424673 - DNA, 22 bp, Homo sapiens
atataagttagtggtcatgttt

SEQ ID NO: 8424674 - DNA, 20 bp, Homo sapiens
atataataaattttggttac

SEQ ID NO: 8424675 - DNA, 22 bp, Homo sapiens
atataactcttgttcttatagt

SEQ ID NO: 8424676 - DNA, 22 bp, Homo sapiens
atataactctccattaagggcc

SEQ ID NO: 8424677 - DNA, 22 bp, Homo sapiens
atatataagctgatgagccaca

SEQ ID NO: 8424678 - DNA, 22 bp, Homo sapiens
atatataacctggataaggctt

SEQ ID NO: 8424679 - DNA, 22 bp, Homo sapiens
atatataagctgatgagccaca

SEQ ID NO: 8424680 - DNA, 22 bp, Homo sapiens
atatatacaactagattaaaag

SEQ ID NO: 8424681 - DNA, 22 bp, Homo sapiens
atatataatacttgctgtgggc

SEQ ID NO: 8424682 - DNA, 22 bp, Homo sapiens
atatataatacttgctgtgggc

SEQ ID NO: 8424683 - DNA, 22 bp, Homo sapiens
atataatacaacctgctaagtg

SEQ ID NO: 8424684 - DNA, 20 bp, Homo sapiens
atataataaattttggttac

SEQ ID NO: 8424685 - DNA, 22 bp, Homo sapiens
ctggcagctgtgtgaagaactg

SEQ ID NO: 8424686 - DNA, 22 bp, Homo sapiens
ctggcagctggaggctagaggc

SEQ ID NO: 8424687 - DNA, 22 bp, Homo sapiens
ctggcagctggaggctagaggc

SEQ ID NO: 8424688 - DNA, 22 bp, Homo sapiens
ctggcagctgcccgagatgccc

SEQ ID NO: 8424689 - DNA, 22 bp, Homo sapiens
ctggcttctgggccagggcaga

SEQ ID NO: 8424690 - DNA, 23 bp, Homo sapiens
ctggcttctggggcctctgtttc

SEQ ID NO: 8424691 - DNA, 23 bp, Homo sapiens
ctggcttctggggcctctgtttc

SEQ ID NO: 8424692 - DNA, 22 bp, Homo sapiens
ctgggaagcttcgagcaggaaa

SEQ ID NO: 8424693 - DNA, 22 bp, Homo sapiens
ctgggaagcttcgagcaggaaa

SEQ ID NO: 8424694 - DNA, 22 bp, Homo sapiens
ctgggaaggggaaggtcctctc

SEQ ID NO: 8424695 - DNA, 22 bp, Homo sapiens
atatatatcgagttcatgtctc

SEQ ID NO: 8424696 - DNA, 22 bp, Homo sapiens
ctgggcacaggggagcagagtc

SEQ ID NO: 8424697 - DNA, 22 bp, Homo sapiens
ctgggcacagaccccctgggcc

SEQ ID NO: 8424698 - DNA, 22 bp, Homo sapiens
ctgggcacacagtgactctgca

SEQ ID NO: 8424699 - DNA, 22 bp, Homo sapiens
ctgggcacaagtggccctggat

SEQ ID NO: 8424700 - DNA, 19 bp, Homo sapiens
ctgggaggtgttcagagaa

SEQ ID NO: 8424701 - DNA, 22 bp, Homo sapiens
ctgggcaatatgctgggcctgg

SEQ ID NO: 8424702 - DNA, 22 bp, Homo sapiens
atatatacaactagattaaaag

SEQ ID NO: 8424703 - DNA, 22 bp, Homo sapiens
atatatactttgacacattctg

SEQ ID NO: 8424704 - DNA, 22 bp, Homo sapiens
atatatactttgacacattctg

SEQ ID NO: 8424705 - DNA, 22 bp, Homo sapiens
ctgggagagcctttcctgagtc

SEQ ID NO: 8424706 - DNA, 22 bp, Homo sapiens
ctgggagagcctttcctgagtc

SEQ ID NO: 8424707 - DNA, 22 bp, Homo sapiens
ctgggagagcctttcctgagtc

SEQ ID NO: 8424708 - DNA, 22 bp, Homo sapiens
ctgggagaggaacctcgagggt

SEQ ID NO: 8424709 - DNA, 22 bp, Homo sapiens
ctgggagagaagcgaagctggg

SEQ ID NO: 8424710 - DNA, 22 bp, Homo sapiens
ctgggagacaagagagggctga

SEQ ID NO: 8424711 - DNA, 22 bp, Homo sapiens
ctgggactttgtaggccagttg

SEQ ID NO: 8424712 - DNA, 22 bp, Homo sapiens
ctgggagacgcagctggggatc

SEQ ID NO: 8424713 - DNA, 22 bp, Homo sapiens
ctgggagacgcagctggggatc

SEQ ID NO: 8424714 - DNA, 22 bp, Homo sapiens
atcatggaagcctatcttgaga

SEQ ID NO: 8424715 - DNA, 22 bp, Homo sapiens
atcatgcattgtattgagttga

SEQ ID NO: 8424716 - DNA, 22 bp, Homo sapiens
atcatgaatcttgtgttctatg

SEQ ID NO: 8424717 - DNA, 22 bp, Homo sapiens
atcatcatgcccacttgagact

SEQ ID NO: 8424718 - DNA, 22 bp, Homo sapiens
ctgtgcaaataaagagcaacat

SEQ ID NO: 8424719 - DNA, 22 bp, Homo sapiens
ctgtgcaagcccaagataaaac

SEQ ID NO: 8424720 - DNA, 22 bp, Homo sapiens
ctgtgatggtcaggccctatct

SEQ ID NO: 8424721 - DNA, 22 bp, Homo sapiens
ctgtgcaatgcctaatcacaaa

SEQ ID NO: 8424722 - DNA, 22 bp, Homo sapiens
ctgtgcaatattataaaggcca

SEQ ID NO: 8424723 - DNA, 18 bp, Homo sapiens
ctgtgcagcaaactgagc

SEQ ID NO: 8424724 - DNA, 22 bp, Homo sapiens
ctgtcttcccgaggccctggag

SEQ ID NO: 8424725 - DNA, 22 bp, Homo sapiens
ctgtctgttttgtatacaggcc

SEQ ID NO: 8424726 - DNA, 20 bp, Homo sapiens
ctgtcttgtgggcttcccct

SEQ ID NO: 8424727 - DNA, 22 bp, Homo sapiens
ctgtgatgacaggcagggccaa

SEQ ID NO: 8424728 - DNA, 22 bp, Homo sapiens
ctgtccagtcagaacgtcatta

SEQ ID NO: 8424729 - DNA, 18 bp, Homo sapiens
ctgggtctccaggctgcc

SEQ ID NO: 8424730 - DNA, 18 bp, Homo sapiens
ctgggtctccaggctgcc

SEQ ID NO: 8424731 - DNA, 22 bp, Homo sapiens
ctgggtctaaaaattctcagat

SEQ ID NO: 8424732 - DNA, 22 bp, Homo sapiens
ctgggtctcaggagttctgagg

SEQ ID NO: 8424733 - DNA, 22 bp, Homo sapiens
ctgggtctcaggagttctgagg

SEQ ID NO: 8424734 - DNA, 22 bp, Homo sapiens
ctgggtcccggcttctatccac

SEQ ID NO: 8424735 - DNA, 22 bp, Homo sapiens
ctgggtcccggcttctatccac

SEQ ID NO: 8424736 - DNA, 22 bp, Homo sapiens
ctgggtacctcaccgctgctgc

SEQ ID NO: 8424737 - DNA, 22 bp, Homo sapiens
ctgggtcccacagcctgctggg

SEQ ID NO: 8424738 - DNA, 20 bp, Homo sapiens
ctgggtcacttggctgctct

SEQ ID NO: 8424739 - DNA, 22 bp, Homo sapiens
ctgggtcaaggaatgctggtgg

SEQ ID NO: 8424740 - DNA, 22 bp, Homo sapiens
ctgtcctcaccttggcaggggg

SEQ ID NO: 8424741 - DNA, 22 bp, Homo sapiens
ctgtcctcaacccatccttctc

SEQ ID NO: 8424742 - DNA, 22 bp, Homo sapiens
ctgtcctctgtcctcagcagga

SEQ ID NO: 8424743 - DNA, 22 bp, Homo sapiens
ctgtcctccggccacctacagt

SEQ ID NO: 8424744 - DNA, 22 bp, Homo sapiens
atcacatctcaccactgcaacc

SEQ ID NO: 8424745 - DNA, 22 bp, Homo sapiens
atcacatcgaggagcaatcaga

SEQ ID NO: 8424746 - DNA, 22 bp, Homo sapiens
atcctagaatcagcccttgctg

SEQ ID NO: 8424747 - DNA, 22 bp, Homo sapiens
atcctagaatcagcccttgctg

SEQ ID NO: 8424748 - DNA, 18 bp, Homo sapiens
atcctagaccatacacag

SEQ ID NO: 8424749 - DNA, 22 bp, Homo sapiens
atcctcagacctcagcaaagcc

SEQ ID NO: 8424750 - DNA, 22 bp, Homo sapiens
atccctgtgacgagcatcccta

SEQ ID NO: 8424751 - DNA, 22 bp, Homo sapiens
atccctggacggcgcctcccca

SEQ ID NO: 8424752 - DNA, 22 bp, Homo sapiens
atccctggacggcgcctcccca

SEQ ID NO: 8424753 - DNA, 22 bp, Homo sapiens
atctaattttcactcatttgct

SEQ ID NO: 8424754 - DNA, 22 bp, Homo sapiens
atctacaacatcacatggcatt

SEQ ID NO: 8424755 - DNA, 22 bp, Homo sapiens
atcctcagcatctagcatgaag

SEQ ID NO: 8424756 - DNA, 22 bp, Homo sapiens
atccacagtgggggtggcggaa

SEQ ID NO: 8424757 - DNA, 22 bp, Homo sapiens
atccacagtgcagcaagggccc

SEQ ID NO: 8424758 - DNA, 22 bp, Homo sapiens
atccacaggtcatgtaatgtgg

SEQ ID NO: 8424759 - DNA, 22 bp, Homo sapiens
atccacagggtgtgttaagatg

SEQ ID NO: 8424760 - DNA, 22 bp, Homo sapiens
atccacagagaggaagaatagt

SEQ ID NO: 8424761 - DNA, 22 bp, Homo sapiens
atccacaggagggtttggaaaa

SEQ ID NO: 8424762 - DNA, 22 bp, Homo sapiens
atccacagagaggaagaatagt

SEQ ID NO: 8424763 - DNA, 22 bp, Homo sapiens
atccacagaaggaacttgaaag

SEQ ID NO: 8424764 - DNA, 22 bp, Homo sapiens
atccatttgccgtgctatgtgc

SEQ ID NO: 8424765 - DNA, 23 bp, Homo sapiens
atccacattacagtatcatacaa

SEQ ID NO: 8424766 - DNA, 22 bp, Homo sapiens
atccccagactttagatttctc

SEQ ID NO: 8424767 - DNA, 22 bp, Homo sapiens
atccccctcttggatggcggca

SEQ ID NO: 8424768 - DNA, 22 bp, Homo sapiens
atccccttatcccaggctgagc

SEQ ID NO: 8424769 - DNA, 22 bp, Homo sapiens
atccaaaatttactgtagcatt

SEQ ID NO: 8424770 - DNA, 22 bp, Homo sapiens
atccaaaatttactgtagcatt

SEQ ID NO: 8424771 - DNA, 18 bp, Homo sapiens
atccaaaaagatggaagt

SEQ ID NO: 8424772 - DNA, 22 bp, Homo sapiens
atccaaaaccagtgcattttcc

SEQ ID NO: 8424773 - DNA, 22 bp, Homo sapiens
atccaaaaccagtgcattttcc

SEQ ID NO: 8424774 - DNA, 22 bp, Homo sapiens
atcattttatggctgagaggac

SEQ ID NO: 8424775 - DNA, 22 bp, Homo sapiens
atcatttttaagagactcttct

SEQ ID NO: 8424776 - DNA, 22 bp, Homo sapiens
atccaagcttcaccctaggatg

SEQ ID NO: 8424777 - DNA, 22 bp, Homo sapiens
atccaattctaatattgtgttt

SEQ ID NO: 8424778 - DNA, 22 bp, Homo sapiens
atccaattacgttttttgtcat

SEQ ID NO: 8424779 - DNA, 22 bp, Homo sapiens
atccaagtcagggatagtttga

SEQ ID NO: 8424780 - DNA, 22 bp, Homo sapiens
atccaaaggtgacacagaatac

SEQ ID NO: 8424781 - DNA, 22 bp, Homo sapiens
atccaaaggtgacacagaatac

SEQ ID NO: 8424782 - DNA, 22 bp, Homo sapiens
atccaaagccctaagttaactg

SEQ ID NO: 8424783 - DNA, 22 bp, Homo sapiens
atccaaagaatgcttagacctg

SEQ ID NO: 8424784 - DNA, 22 bp, Homo sapiens
atccaaagtagattaagtcaca

SEQ ID NO: 8424785 - DNA, 23 bp, Homo sapiens
ctgtggagccctttgttgggaga

SEQ ID NO: 8424786 - DNA, 22 bp, Homo sapiens
ctgtggagcttgtggcagtggg

SEQ ID NO: 8424787 - DNA, 22 bp, Homo sapiens
ctgtggagcttgtggcagtggg

SEQ ID NO: 8424788 - DNA, 22 bp, Homo sapiens
cagaagttagacttcaactaat

SEQ ID NO: 8424789 - DNA, 22 bp, Homo sapiens
cagaagtgaatgtgataaacca

SEQ ID NO: 8424790 - DNA, 22 bp, Homo sapiens
cagaagtgatgttgagctagtc

SEQ ID NO: 8424791 - DNA, 22 bp, Homo sapiens
cagaagttcctatttacctcct

SEQ ID NO: 8424792 - DNA, 22 bp, Homo sapiens
cagaagttggagctttccatca

SEQ ID NO: 8424793 - DNA, 22 bp, Homo sapiens
cagaagttgatcctgcgtttcc

SEQ ID NO: 8424794 - DNA, 22 bp, Homo sapiens
cagaagtttgacatgtttagct

SEQ ID NO: 8424795 - DNA, 22 bp, Homo sapiens
cagaagtttgcaattgtttatt

SEQ ID NO: 8424796 - DNA, 22 bp, Homo sapiens
cagacaggaattctggcgtggt

SEQ ID NO: 8424797 - DNA, 22 bp, Homo sapiens
cagacaggagactggatcatgg

SEQ ID NO: 8424798 - DNA, 22 bp, Homo sapiens
cagacaggcaggtgagagctcc

SEQ ID NO: 8424799 - DNA, 22 bp, Homo sapiens
cagacaggagactggatcatgg

SEQ ID NO: 8424800 - DNA, 22 bp, Homo sapiens
cagacaggctagccagactcac

SEQ ID NO: 8424801 - DNA, 22 bp, Homo sapiens
gggagcagcctgcctcccacct

SEQ ID NO: 8424802 - DNA, 19 bp, Homo sapiens
gggagcaggaaagctgtgg

SEQ ID NO: 8424803 - DNA, 22 bp, Homo sapiens
gggagcaggacataatagcaat

SEQ ID NO: 8424804 - DNA, 19 bp, Homo sapiens
gggagcaggaaagctgtgg

SEQ ID NO: 8424805 - DNA, 22 bp, Homo sapiens
gggagggtctgagagctgcacc

SEQ ID NO: 8424806 - DNA, 22 bp, Homo sapiens
gggagggtctgagagctgcacc

SEQ ID NO: 8424807 - DNA, 22 bp, Homo sapiens
gggaggtaaagatgagctcagt

SEQ ID NO: 8424808 - DNA, 22 bp, Homo sapiens
gggaggtagcaagcctgcagct

SEQ ID NO: 8424809 - DNA, 22 bp, Homo sapiens
gggaggtgaaaggtcatgtgtg

SEQ ID NO: 8424810 - DNA, 22 bp, Homo sapiens
gggagggccagtgctctctaga

SEQ ID NO: 8424811 - DNA, 20 bp, Homo sapiens
gggaggccagcctcagagaa

SEQ ID NO: 8424812 - DNA, 22 bp, Homo sapiens
gggaggggttgcatgtttgagt

SEQ ID NO: 8424813 - DNA, 22 bp, Homo sapiens
gggaggggttgcatgtttgagt

SEQ ID NO: 8424814 - DNA, 22 bp, Homo sapiens
gggcacaccttgtctgagcaca

SEQ ID NO: 8424815 - DNA, 22 bp, Homo sapiens
gggcacagaagtctaagacatc

SEQ ID NO: 8424816 - DNA, 22 bp, Homo sapiens
gggcaattcacagggttgttat

SEQ ID NO: 8424817 - DNA, 22 bp, Homo sapiens
gggcaattaaggtcccgtttcc

SEQ ID NO: 8424818 - DNA, 20 bp, Homo sapiens
gggcaaggaaacagccccca

SEQ ID NO: 8424819 - DNA, 17 bp, Homo sapiens
cagacaggctgtcaccc

SEQ ID NO: 8424820 - DNA, 17 bp, Homo sapiens
cagacaggctgtcaccc

SEQ ID NO: 8424821 - DNA, 22 bp, Homo sapiens
cagacagggacctcgctccaga

SEQ ID NO: 8424822 - DNA, 22 bp, Homo sapiens
cagacagggccctgtgatggta

SEQ ID NO: 8424823 - DNA, 22 bp, Homo sapiens
cagacagggacctcgctccaga

SEQ ID NO: 8424824 - DNA, 22 bp, Homo sapiens
gggatgagagtagggtgtgaaa

SEQ ID NO: 8424825 - DNA, 22 bp, Homo sapiens
cagacagggtcctgtccgtcac

SEQ ID NO: 8424826 - DNA, 22 bp, Homo sapiens
cagaagggcagcactgggaagg

SEQ ID NO: 8424827 - DNA, 22 bp, Homo sapiens
cagaaggcaaggcctgccacgc

SEQ ID NO: 8424828 - DNA, 22 bp, Homo sapiens
cactggcttgatgggtaatgcc

SEQ ID NO: 8424829 - DNA, 22 bp, Homo sapiens
cactgggaatctgggaaagaga

SEQ ID NO: 8424830 - DNA, 22 bp, Homo sapiens
cactgggacctaggactgagct

SEQ ID NO: 8424831 - DNA, 22 bp, Homo sapiens
cactggcccagccaggcctgtt

SEQ ID NO: 8424832 - DNA, 22 bp, Homo sapiens
cactggcccataaaggcctggg

SEQ ID NO: 8424833 - DNA, 22 bp, Homo sapiens
cagaagtcaccctcagaataac

SEQ ID NO: 8424834 - DNA, 18 bp, Homo sapiens
cagaagtccttcaaggcc

SEQ ID NO: 8424835 - DNA, 22 bp, Homo sapiens
cagaagtctttctgtttcacct

SEQ ID NO: 8424836 - DNA, 22 bp, Homo sapiens
cagaagtctttctgtttcacct

SEQ ID NO: 8424837 - DNA, 22 bp, Homo sapiens
gggaaaatattaagcaggactt

SEQ ID NO: 8424838 - DNA, 22 bp, Homo sapiens
gggaaaaataatgcacagatat

SEQ ID NO: 8424839 - DNA, 22 bp, Homo sapiens
gggaaactcaggcatttccact

SEQ ID NO: 8424840 - DNA, 22 bp, Homo sapiens
gggaaactcacaggtgcagggg

SEQ ID NO: 8424841 - DNA, 22 bp, Homo sapiens
gggaaactagaagcagggttat

SEQ ID NO: 8424842 - DNA, 22 bp, Homo sapiens
cagaaggtttgaaagatgtctt

SEQ ID NO: 8424843 - DNA, 22 bp, Homo sapiens
cagaagtcaccctcagaataac

SEQ ID NO: 8424844 - DNA, 21 bp, Homo sapiens
cagaagtaagggtaacttctc

SEQ ID NO: 8424845 - DNA, 22 bp, Homo sapiens
gggaaagaagaagagccatttt

SEQ ID NO: 8424846 - DNA, 22 bp, Homo sapiens
gggaaactttcacaatgtccag

SEQ ID NO: 8424847 - DNA, 22 bp, Homo sapiens
gggaaacttctgctaaaaccag

SEQ ID NO: 8424848 - DNA, 22 bp, Homo sapiens
gggaaactgtccagttctcccc

SEQ ID NO: 8424849 - DNA, 22 bp, Homo sapiens
gggaaactggggactgaatctg

SEQ ID NO: 8424850 - DNA, 22 bp, Homo sapiens
gggaaactgcaactcagagagg

SEQ ID NO: 8424851 - DNA, 22 bp, Homo sapiens
gggaaactgaattcaggactct

SEQ ID NO: 8424852 - DNA, 21 bp, Homo sapiens
gggaaactctgcttaacagag

SEQ ID NO: 8424853 - DNA, 22 bp, Homo sapiens
gggaaagaccctgagtcttatt

SEQ ID NO: 8424854 - DNA, 22 bp, Homo sapiens
gggactctgagagcctgagggt

SEQ ID NO: 8424855 - DNA, 22 bp, Homo sapiens
gggacagaaggaagtgagcaca

SEQ ID NO: 8424856 - DNA, 22 bp, Homo sapiens
gggacagaggcaaactagcaga

SEQ ID NO: 8424857 - DNA, 22 bp, Homo sapiens
gggacacagagaaactggagaa

SEQ ID NO: 8424858 - DNA, 22 bp, Homo sapiens
gggaaggacattctgggctcag

SEQ ID NO: 8424859 - DNA, 22 bp, Homo sapiens
gggaaggacattctgggctcag

SEQ ID NO: 8424860 - DNA, 23 bp, Homo sapiens
gggaaaggatatgatcctagggg

SEQ ID NO: 8424861 - DNA, 18 bp, Homo sapiens
gggaagccgggaagccgg

SEQ ID NO: 8424862 - DNA, 23 bp, Homo sapiens
gggaagctccatggaggtgctgg

SEQ ID NO: 8424863 - DNA, 23 bp, Homo sapiens
gggaagctccatggaggtgctgg

SEQ ID NO: 8424864 - DNA, 18 bp, Homo sapiens
gggaagccgggaagccgg

SEQ ID NO: 8424865 - DNA, 20 bp, Homo sapiens
ggggaagaaaaggatgtgat

SEQ ID NO: 8424866 - DNA, 22 bp, Homo sapiens
ggggaacaccgggcagaggcgc

SEQ ID NO: 8424867 - DNA, 22 bp, Homo sapiens
ggggaacaccgggcagaggcgc

SEQ ID NO: 8424868 - DNA, 22 bp, Homo sapiens
ggggaaagtgaattgtgtagtg

SEQ ID NO: 8424869 - DNA, 22 bp, Homo sapiens
gggctgtgtatcagttatctat

SEQ ID NO: 8424870 - DNA, 19 bp, Homo sapiens
cagagctgctggcctcgtc

SEQ ID NO: 8424871 - DNA, 22 bp, Homo sapiens
cagagctgctcatggtggccag

SEQ ID NO: 8424872 - DNA, 22 bp, Homo sapiens
cagagctgcgctttttcctggt

SEQ ID NO: 8424873 - DNA, 22 bp, Homo sapiens
cagagctgagtcttcaaggttg

SEQ ID NO: 8424874 - DNA, 22 bp, Homo sapiens
cagagctgcagattgaaggcat

SEQ ID NO: 8424875 - DNA, 22 bp, Homo sapiens
cagagctgacccaaggattgaa

SEQ ID NO: 8424876 - DNA, 22 bp, Homo sapiens
cagagctctgacagctacagcc

SEQ ID NO: 8424877 - DNA, 21 bp, Homo sapiens
cagagctctttctgcttgctg

SEQ ID NO: 8424878 - DNA, 21 bp, Homo sapiens
cagagctctttctgcttgctg

SEQ ID NO: 8424879 - DNA, 21 bp, Homo sapiens
cagagctgaagggtgtagtgt

SEQ ID NO: 8424880 - DNA, 22 bp, Homo sapiens
cagagcctgctgccttctgaag

SEQ ID NO: 8424881 - DNA, 22 bp, Homo sapiens
cagagcctgctgccttctgaag

SEQ ID NO: 8424882 - DNA, 22 bp, Homo sapiens
gggcgcagccaatcctggccct

SEQ ID NO: 8424883 - DNA, 21 bp, Homo sapiens
gggcgaggcctgatgtggctc

SEQ ID NO: 8424884 - DNA, 21 bp, Homo sapiens
gggcgaggcctgatgtggctc

SEQ ID NO: 8424885 - DNA, 22 bp, Homo sapiens
cagagccctgggcacatggtag

SEQ ID NO: 8424886 - DNA, 22 bp, Homo sapiens
cagagccctgcatgctccatct

SEQ ID NO: 8424887 - DNA, 22 bp, Homo sapiens
cagagccctagtcctgatggcc

SEQ ID NO: 8424888 - DNA, 22 bp, Homo sapiens
cagagccctgcatgctccatct

SEQ ID NO: 8424889 - DNA, 22 bp, Homo sapiens
cagagcccctcagctctctccc

SEQ ID NO: 8424890 - DNA, 22 bp, Homo sapiens
cagagccccccttctgatcaca

SEQ ID NO: 8424891 - DNA, 22 bp, Homo sapiens
cagagccctagtcctgatggcc

SEQ ID NO: 8424892 - DNA, 22 bp, Homo sapiens
cagagcccctcgtctccaccac

SEQ ID NO: 8424893 - DNA, 22 bp, Homo sapiens
cagagcccctcgtctccaccac

SEQ ID NO: 8424894 - DNA, 22 bp, Homo sapiens
cagagcccctcgtctccaccac

SEQ ID NO: 8424895 - DNA, 22 bp, Homo sapiens
gggcacagagggtcttgaagaa

SEQ ID NO: 8424896 - DNA, 22 bp, Homo sapiens
gggcacagagggtcttgaagaa

SEQ ID NO: 8424897 - DNA, 22 bp, Homo sapiens
gggcacagaagtctaagacatc

SEQ ID NO: 8424898 - DNA, 22 bp, Homo sapiens
gggcacagagaaggttttagtg

SEQ ID NO: 8424899 - DNA, 22 bp, Homo sapiens
gggcacagagaaggttttagtg

SEQ ID NO: 8424900 - DNA, 22 bp, Homo sapiens
cagagccagctgtccttggcat

SEQ ID NO: 8424901 - DNA, 22 bp, Homo sapiens
gggcagagaaatggacagttgg

SEQ ID NO: 8424902 - DNA, 22 bp, Homo sapiens
cagagcccatcctatactctcc

SEQ ID NO: 8424903 - DNA, 22 bp, Homo sapiens
cagagcccatcctatactctcc

SEQ ID NO: 8424904 - DNA, 22 bp, Homo sapiens
gggtcgagggtctcgcccttcc

SEQ ID NO: 8424905 - DNA, 22 bp, Homo sapiens
cagaggcctggcttggacacct

SEQ ID NO: 8424906 - DNA, 22 bp, Homo sapiens
cagaggcctggcttggacacct

SEQ ID NO: 8424907 - DNA, 22 bp, Homo sapiens
gggtgcagggtctccagcagct

SEQ ID NO: 8424908 - DNA, 22 bp, Homo sapiens
gggtgcaggggaccctagggac

SEQ ID NO: 8424909 - DNA, 22 bp, Homo sapiens
gggtctccatgttaacatcact

SEQ ID NO: 8424910 - DNA, 22 bp, Homo sapiens
gggtgctgaggaagacagcagg

SEQ ID NO: 8424911 - DNA, 22 bp, Homo sapiens
gggtgctgaggaagacagcagg

SEQ ID NO: 8424912 - DNA, 22 bp, Homo sapiens
cagaggctggatggacttgcct

SEQ ID NO: 8424913 - DNA, 22 bp, Homo sapiens
gggtgcagtggttcacgcctgt

SEQ ID NO: 8424914 - DNA, 22 bp, Homo sapiens
cagaggtgtacagagggaggcc

SEQ ID NO: 8424915 - DNA, 23 bp, Homo sapiens
cagaggtgtcagtgcccagtgtc

SEQ ID NO: 8424916 - DNA, 22 bp, Homo sapiens
cagaggtgtacagagggaggcc

SEQ ID NO: 8424917 - DNA, 21 bp, Homo sapiens
cagaggtggcctgacctctga

SEQ ID NO: 8424918 - DNA, 23 bp, Homo sapiens
cagaggtgtcagtgcccagtgtc

SEQ ID NO: 8424919 - DNA, 22 bp, Homo sapiens
cagaggtttgatcgagtaggtc

SEQ ID NO: 8424920 - DNA, 22 bp, Homo sapiens
cagaggctgggacctcaggcat

SEQ ID NO: 8424921 - DNA, 22 bp, Homo sapiens
cagaggctgtgtaggcagactg

SEQ ID NO: 8424922 - DNA, 22 bp, Homo sapiens
cagagctggtgtgtcctggcat

SEQ ID NO: 8424923 - DNA, 22 bp, Homo sapiens
cagagctggtgtgtcctggcat

SEQ ID NO: 8424924 - DNA, 22 bp, Homo sapiens
cagagctggtaagtggtagagg

SEQ ID NO: 8424925 - DNA, 22 bp, Homo sapiens
cagagctggtgttacaagtcca

SEQ ID NO: 8424926 - DNA, 22 bp, Homo sapiens
cagagctggtgttacaagtcca

SEQ ID NO: 8424927 - DNA, 22 bp, Homo sapiens
cagagctggtgtgtcctggcat

SEQ ID NO: 8424928 - DNA, 22 bp, Homo sapiens
cagaggccacctgtggccactg

SEQ ID NO: 8424929 - DNA, 20 bp, Homo sapiens
cagaggcattttcagactct

SEQ ID NO: 8424930 - DNA, 22 bp, Homo sapiens
cagagctgtcatttgccagtga

SEQ ID NO: 8424931 - DNA, 22 bp, Homo sapiens
cagaggcaggataagaactgcg

SEQ ID NO: 8424932 - DNA, 22 bp, Homo sapiens
cagagctgtcatttgccagtga

SEQ ID NO: 8424933 - DNA, 19 bp, Homo sapiens
cagaggccagaagcacagg

SEQ ID NO: 8424934 - DNA, 22 bp, Homo sapiens
cagaggccacctgtggccactg

SEQ ID NO: 8424935 - DNA, 22 bp, Homo sapiens
cagaggccagggggctcacaaa

SEQ ID NO: 8424936 - DNA, 22 bp, Homo sapiens
cagaggccaggctgcctgactg

SEQ ID NO: 8424937 - DNA, 22 bp, Homo sapiens
cagaggccaggctgcctgactg

SEQ ID NO: 8424938 - DNA, 22 bp, Homo sapiens
cagaggccaggctgcctgactg

SEQ ID NO: 8424939 - DNA, 22 bp, Homo sapiens
cagaggccatatttcttcactc

SEQ ID NO: 8424940 - DNA, 22 bp, Homo sapiens
cagaggcccagtgagagggctg

SEQ ID NO: 8424941 - DNA, 22 bp, Homo sapiens
cagaggcccagtgagagggctg

SEQ ID NO: 8424942 - DNA, 22 bp, Homo sapiens
cagaggccccagaactagctct

SEQ ID NO: 8424943 - DNA, 21 bp, Homo sapiens
cagaggcctatcacagactcc

SEQ ID NO: 8424944 - DNA, 22 bp, Homo sapiens
cagaggcctcacttccagccag

SEQ ID NO: 8424945 - DNA, 21 bp, Homo sapiens
cagaggcctcatgctctgtgc

SEQ ID NO: 8424946 - DNA, 21 bp, Homo sapiens
cagaggcctcatgctctgtgc

SEQ ID NO: 8424947 - DNA, 21 bp, Homo sapiens
cagaggcctcatgctctgtgc

SEQ ID NO: 8424948 - DNA, 22 bp, Homo sapiens
cagagtcaatgtccaagaagct

SEQ ID NO: 8424949 - DNA, 22 bp, Homo sapiens
cagagtcaatgtccaagaagct

SEQ ID NO: 8424950 - DNA, 22 bp, Homo sapiens
gggtgggaaggctaagggattg

SEQ ID NO: 8424951 - DNA, 20 bp, Homo sapiens
cagagtaattattacccttt

SEQ ID NO: 8424952 - DNA, 22 bp, Homo sapiens
gggtgggagaaatgagtatcta

SEQ ID NO: 8424953 - DNA, 20 bp, Homo sapiens
gggtgggagagtctgagggt

SEQ ID NO: 8424954 - DNA, 22 bp, Homo sapiens
gggtgggagtctggccctcaaa

SEQ ID NO: 8424955 - DNA, 22 bp, Homo sapiens
ggtggggctaggacctcaggat

SEQ ID NO: 8424956 - DNA, 22 bp, Homo sapiens
ggtgggtcttgtggggcagctt

SEQ ID NO: 8424957 - DNA, 22 bp, Homo sapiens
ggtgggtcttgcggggcagctt

SEQ ID NO: 8424958 - DNA, 22 bp, Homo sapiens
cagcaaggccattggatgcagt

SEQ ID NO: 8424959 - DNA, 22 bp, Homo sapiens
ggtgggggagacttggtcaaga

SEQ ID NO: 8424960 - DNA, 22 bp, Homo sapiens
cagcaagtcatccaggatgatg

SEQ ID NO: 8424961 - DNA, 22 bp, Homo sapiens
ggttctcttcctcctgactgag

SEQ ID NO: 8424962 - DNA, 22 bp, Homo sapiens
ggttctctaactttgactggag

SEQ ID NO: 8424963 - DNA, 22 bp, Homo sapiens
ggttccagagtatttcatttca

SEQ ID NO: 8424964 - DNA, 22 bp, Homo sapiens
gtaaaatagaataacgtggcta

SEQ ID NO: 8424965 - DNA, 20 bp, Homo sapiens
gtaaaatatggtctttgggt

SEQ ID NO: 8424966 - DNA, 18 bp, Homo sapiens
ggttgataacttgtgatt

SEQ ID NO: 8424967 - DNA, 22 bp, Homo sapiens
ggttgcaaactcctgggatcaa

SEQ ID NO: 8424968 - DNA, 22 bp, Homo sapiens
gtatgaaagcatcattcctgct

SEQ ID NO: 8424969 - DNA, 22 bp, Homo sapiens
gtatctttccacatcttcagta

SEQ ID NO: 8424970 - DNA, 22 bp, Homo sapiens
gtatgaaaattgtaaagttctt

SEQ ID NO: 8424971 - DNA, 22 bp, Homo sapiens
gtatgcatcgactcaagtctga

SEQ ID NO: 8424972 - DNA, 22 bp, Homo sapiens
cagcagcctcttgtgcctgtgg

SEQ ID NO: 8424973 - DNA, 22 bp, Homo sapiens
cagcagcctcttgtgcctgtgg

SEQ ID NO: 8424974 - DNA, 22 bp, Homo sapiens
cagcagcctcttgtgcctgtgg

SEQ ID NO: 8424975 - DNA, 22 bp, Homo sapiens
cagcaggaccattgaggcatca

SEQ ID NO: 8424976 - DNA, 22 bp, Homo sapiens
cagcagctacttggagcagcag

SEQ ID NO: 8424977 - DNA, 22 bp, Homo sapiens
cagcaggacatggaggagtaaa

SEQ ID NO: 8424978 - DNA, 22 bp, Homo sapiens
cagcagcctgccttgggagctt

SEQ ID NO: 8424979 - DNA, 22 bp, Homo sapiens
cagcagcctgccttgggagctt

SEQ ID NO: 8424980 - DNA, 22 bp, Homo sapiens
cagcagcctggcccctcctcgg

SEQ ID NO: 8424981 - DNA, 22 bp, Homo sapiens
cagcagcctggcccctcctcgg

SEQ ID NO: 8424982 - DNA, 22 bp, Homo sapiens
cagcaggcaggtgggccaagtc

SEQ ID NO: 8424983 - DNA, 22 bp, Homo sapiens
cagcaggcccagagtttcatgg

SEQ ID NO: 8424984 - DNA, 22 bp, Homo sapiens
cagcaggaccattgaggcatca

SEQ ID NO: 8424985 - DNA, 22 bp, Homo sapiens
cagcaggatatggtggagagag

SEQ ID NO: 8424986 - DNA, 22 bp, Homo sapiens
cagcaggcagccatttcactgt

SEQ ID NO: 8424987 - DNA, 22 bp, Homo sapiens
cagcaggcccaggtgctggtga

SEQ ID NO: 8424988 - DNA, 22 bp, Homo sapiens
cagcagcaaggtgagggtggag

SEQ ID NO: 8424989 - DNA, 22 bp, Homo sapiens
cagcagcagacatttgatcttc

SEQ ID NO: 8424990 - DNA, 22 bp, Homo sapiens
cagcagcagacatttgatcttc

SEQ ID NO: 8424991 - DNA, 22 bp, Homo sapiens
cagcagcagattcagcgtctgg

SEQ ID NO: 8424992 - DNA, 22 bp, Homo sapiens
gtagggcaacatgggcactagg

SEQ ID NO: 8424993 - DNA, 22 bp, Homo sapiens
gtatcctcacctatacaatgga

SEQ ID NO: 8424994 - DNA, 22 bp, Homo sapiens
gtatcctccccgctggccttca

SEQ ID NO: 8424995 - DNA, 22 bp, Homo sapiens
gtatccatgggggattggttcc

SEQ ID NO: 8424996 - DNA, 22 bp, Homo sapiens
gtatctttatccctcgttggag

SEQ ID NO: 8424997 - DNA, 22 bp, Homo sapiens
gtatctggtgagggttcccctg

SEQ ID NO: 8424998 - DNA, 22 bp, Homo sapiens
gtatctatgatcctttatatct

SEQ ID NO: 8424999 - DNA, 22 bp, Homo sapiens
cagcagagcttatgttgggtca

SEQ ID NO: 8425000 - DNA, 21 bp, Homo sapiens
cagcagagtaatgcattcgta

SEQ ID NO: 8425001 - DNA, 22 bp, Homo sapiens
cagcagagtaggtgctacttct

SEQ ID NO: 8425002 - DNA, 22 bp, Homo sapiens
cagcagcaaatctagaagagga

SEQ ID NO: 8425003 - DNA, 22 bp, Homo sapiens
cagcagcaaatctagaagagga

SEQ ID NO: 8425004 - DNA, 22 bp, Homo sapiens
cagccactggtgccaggctgtt

SEQ ID NO: 8425005 - DNA, 22 bp, Homo sapiens
cagccactgtggtctagctgca

SEQ ID NO: 8425006 - DNA, 22 bp, Homo sapiens
cagccactgtggaatagccccc

SEQ ID NO: 8425007 - DNA, 22 bp, Homo sapiens
cagccaggttcaagtccttata

SEQ ID NO: 8425008 - DNA, 22 bp, Homo sapiens
cagccacttcgagcttcctgat

SEQ ID NO: 8425009 - DNA, 21 bp, Homo sapiens
cagcccagagcagtggggcca

SEQ ID NO: 8425010 - DNA, 22 bp, Homo sapiens
cagcattttcttaatgtaggtg

SEQ ID NO: 8425011 - DNA, 22 bp, Homo sapiens
cagccaagaaagcagtgctcca

SEQ ID NO: 8425012 - DNA, 22 bp, Homo sapiens
cagccaaatgagtcataaatgt

SEQ ID NO: 8425013 - DNA, 22 bp, Homo sapiens
cagccactgaactcctggctat

SEQ ID NO: 8425014 - DNA, 22 bp, Homo sapiens
cagccactcggccataaaggct

SEQ ID NO: 8425015 - DNA, 22 bp, Homo sapiens
gtattttaagtgactactaggt

SEQ ID NO: 8425016 - DNA, 22 bp, Homo sapiens
gtattttactgctcaaagctct

SEQ ID NO: 8425017 - DNA, 22 bp, Homo sapiens
cagcattctactttgtgaactg

SEQ ID NO: 8425018 - DNA, 22 bp, Homo sapiens
cagcatgcttgggggagggagc

SEQ ID NO: 8425019 - DNA, 22 bp, Homo sapiens
cagcatgcctgggctgcctgcc

SEQ ID NO: 8425020 - DNA, 22 bp, Homo sapiens
cagcatttcaggaggctgaggt

SEQ ID NO: 8425021 - DNA, 22 bp, Homo sapiens
cagcatttcaggaggctgaggt

SEQ ID NO: 8425022 - DNA, 22 bp, Homo sapiens
cagcatttggaggagaggcttt

SEQ ID NO: 8425023 - DNA, 21 bp, Homo sapiens
cagcccagcccattgacagtg

SEQ ID NO: 8425024 - DNA, 22 bp, Homo sapiens
cagcccagcagactgttaccac

SEQ ID NO: 8425025 - DNA, 22 bp, Homo sapiens
cagcccagcagtcttagcctgc

SEQ ID NO: 8425026 - DNA, 22 bp, Homo sapiens
caagatgaaattgtgatatttt

SEQ ID NO: 8425027 - DNA, 22 bp, Homo sapiens
caagatcttcctcaatagacct

SEQ ID NO: 8425028 - DNA, 22 bp, Homo sapiens
caagatgaaattgtgatatttt

SEQ ID NO: 8425029 - DNA, 22 bp, Homo sapiens
caagataatttattctgagttt

SEQ ID NO: 8425030 - DNA, 22 bp, Homo sapiens
caagatactcagaaaggcattg

SEQ ID NO: 8425031 - DNA, 22 bp, Homo sapiens
caagatatcaatgacatagtat

SEQ ID NO: 8425032 - DNA, 22 bp, Homo sapiens
caagatcaaggtatcagcagat

SEQ ID NO: 8425033 - DNA, 22 bp, Homo sapiens
caagatcaaggtgtcagcaggt

SEQ ID NO: 8425034 - DNA, 22 bp, Homo sapiens
caagataagatcatttacacta

SEQ ID NO: 8425035 - DNA, 22 bp, Homo sapiens
caagaggcaaattgtctagaag

SEQ ID NO: 8425036 - DNA, 22 bp, Homo sapiens
caagaggctaaactgggctatt

SEQ ID NO: 8425037 - DNA, 22 bp, Homo sapiens
caagagctttagaaatgctcat

SEQ ID NO: 8425038 - DNA, 22 bp, Homo sapiens
caagagctgggtggcaagctag

SEQ ID NO: 8425039 - DNA, 22 bp, Homo sapiens
caagagcttctgctcttcatgg

SEQ ID NO: 8425040 - DNA, 22 bp, Homo sapiens
caagagctgggtggcaagctag

SEQ ID NO: 8425041 - DNA, 22 bp, Homo sapiens
caagaggagcaggcaggtgtgc

SEQ ID NO: 8425042 - DNA, 22 bp, Homo sapiens
caaggagagtaattgaatgaga

SEQ ID NO: 8425043 - DNA, 22 bp, Homo sapiens
caaggacactgatgttcatcct

SEQ ID NO: 8425044 - DNA, 22 bp, Homo sapiens
caaggacactgatgttcatcct

SEQ ID NO: 8425045 - DNA, 22 bp, Homo sapiens
caaggacactgatgttcatcct

SEQ ID NO: 8425046 - DNA, 22 bp, Homo sapiens
caaggacactgagctttgtaaa

SEQ ID NO: 8425047 - DNA, 22 bp, Homo sapiens
caaggacactgagctttgtaaa

SEQ ID NO: 8425048 - DNA, 22 bp, Homo sapiens
caagctgcttattctctgctct

SEQ ID NO: 8425049 - DNA, 22 bp, Homo sapiens
caagctgctataggttgctggg

SEQ ID NO: 8425050 - DNA, 21 bp, Homo sapiens
caagctgcctgagggtggttg

SEQ ID NO: 8425051 - DNA, 22 bp, Homo sapiens
caagatgtggtgggctgagttt

SEQ ID NO: 8425052 - DNA, 22 bp, Homo sapiens
caagatgttaaaaccacccttg

SEQ ID NO: 8425053 - DNA, 22 bp, Homo sapiens
gctgctggagctttgcagaagg

SEQ ID NO: 8425054 - DNA, 22 bp, Homo sapiens
gctgctggcactggagtgagcc

SEQ ID NO: 8425055 - DNA, 22 bp, Homo sapiens
caagagctgaggctggagaggt

SEQ ID NO: 8425056 - DNA, 22 bp, Homo sapiens
caagagctcaccggagagcatt

SEQ ID NO: 8425057 - DNA, 22 bp, Homo sapiens
gctgctggcatctagggggtgg

SEQ ID NO: 8425058 - DNA, 22 bp, Homo sapiens
caactaatcctttgaaaagaag

SEQ ID NO: 8425059 - DNA, 22 bp, Homo sapiens
caactaatatagggcatgagaa

SEQ ID NO: 8425060 - DNA, 22 bp, Homo sapiens
caacctgatgtgcatgccacgg

SEQ ID NO: 8425061 - DNA, 22 bp, Homo sapiens
gctgcctgccttgcctggagga

SEQ ID NO: 8425062 - DNA, 22 bp, Homo sapiens
gctgcctgccttgcctggagga

SEQ ID NO: 8425063 - DNA, 22 bp, Homo sapiens
gctgccttccataatgtacgta

SEQ ID NO: 8425064 - DNA, 22 bp, Homo sapiens
gctgccttccaaagagttttat

SEQ ID NO: 8425065 - DNA, 22 bp, Homo sapiens
gctgccttccataatgtacgta

SEQ ID NO: 8425066 - DNA, 22 bp, Homo sapiens
caacctgatgaattgaatttaa

SEQ ID NO: 8425067 - DNA, 22 bp, Homo sapiens
caacctgagactccaggcacct

SEQ ID NO: 8425068 - DNA, 21 bp, Homo sapiens
caacctgagctgaacccgtgc

SEQ ID NO: 8425069 - DNA, 22 bp, Homo sapiens
caacctgaattctgctttggca

SEQ ID NO: 8425070 - DNA, 22 bp, Homo sapiens
caacctgacaagactatgagta

SEQ ID NO: 8425071 - DNA, 22 bp, Homo sapiens
caacctgacaaggttaatgaat

SEQ ID NO: 8425072 - DNA, 22 bp, Homo sapiens
gctgcctttagggggtgctcag

SEQ ID NO: 8425073 - DNA, 22 bp, Homo sapiens
gctgcctttgtgagccaagggg

SEQ ID NO: 8425074 - DNA, 20 bp, Homo sapiens
gctgccttgtcctgcttggt

SEQ ID NO: 8425075 - DNA, 20 bp, Homo sapiens
gctgccttgtcctgcttggt

SEQ ID NO: 8425076 - DNA, 22 bp, Homo sapiens
gctgccttgccaggggcagaaa

SEQ ID NO: 8425077 - DNA, 22 bp, Homo sapiens
gctgccttggtagtgaccatct

SEQ ID NO: 8425078 - DNA, 20 bp, Homo sapiens
gctgccttggatggctacac

SEQ ID NO: 8425079 - DNA, 22 bp, Homo sapiens
gctgccttgcttactccactgc

SEQ ID NO: 8425080 - DNA, 22 bp, Homo sapiens
gctgccttgaacttggcctggg

SEQ ID NO: 8425081 - DNA, 22 bp, Homo sapiens
gctgccttgaacatcctaagta

SEQ ID NO: 8425082 - DNA, 22 bp, Homo sapiens
gctgccttcttctgactctatt

SEQ ID NO: 8425083 - DNA, 22 bp, Homo sapiens
gctgccttctgagaagttaaat

SEQ ID NO: 8425084 - DNA, 22 bp, Homo sapiens
gctgccttctggaggaagtgaa

SEQ ID NO: 8425085 - DNA, 22 bp, Homo sapiens
gctgccttcccggaatgtcatc

SEQ ID NO: 8425086 - DNA, 18 bp, Homo sapiens
gctgccttcccagtcaag

SEQ ID NO: 8425087 - DNA, 18 bp, Homo sapiens
gctgccttcccagtcaag

SEQ ID NO: 8425088 - DNA, 22 bp, Homo sapiens
gctcctggagagattgagaaag

SEQ ID NO: 8425089 - DNA, 22 bp, Homo sapiens
gctcctggagagattgagaaag

SEQ ID NO: 8425090 - DNA, 18 bp, Homo sapiens
gctcctggagtctgactc

SEQ ID NO: 8425091 - DNA, 18 bp, Homo sapiens
gctcctggagtctgactc

SEQ ID NO: 8425092 - DNA, 18 bp, Homo sapiens
gctcctggagtctgactc

SEQ ID NO: 8425093 - DNA, 19 bp, Homo sapiens
gctcctggatgacctgtgg

SEQ ID NO: 8425094 - DNA, 19 bp, Homo sapiens
gctcctggatgacctgtgg

SEQ ID NO: 8425095 - DNA, 22 bp, Homo sapiens
gctgcagagtgatgaagtgggg

SEQ ID NO: 8425096 - DNA, 22 bp, Homo sapiens
gctgcagagtgatgaagtgggg

SEQ ID NO: 8425097 - DNA, 22 bp, Homo sapiens
gctgcagagggaggggctcgca

SEQ ID NO: 8425098 - DNA, 22 bp, Homo sapiens
gctgcagagggaggggctcgca

SEQ ID NO: 8425099 - DNA, 22 bp, Homo sapiens
gctgcagagacagctgccgatg

SEQ ID NO: 8425100 - DNA, 22 bp, Homo sapiens
gctgcagagggtcttagagagg

SEQ ID NO: 8425101 - DNA, 19 bp, Homo sapiens
gctgcagaggtgaagaaga

SEQ ID NO: 8425102 - DNA, 22 bp, Homo sapiens
gctgcagcaagccctccagggg

SEQ ID NO: 8425103 - DNA, 22 bp, Homo sapiens
gctgcagcccggcgcgcctgag

SEQ ID NO: 8425104 - DNA, 22 bp, Homo sapiens
gctcaggcaggagtgcagtggc

SEQ ID NO: 8425105 - DNA, 22 bp, Homo sapiens
caaagtatagtgtaggatggca

SEQ ID NO: 8425106 - DNA, 22 bp, Homo sapiens
caaagtatagtgtaggatggca

SEQ ID NO: 8425107 - DNA, 22 bp, Homo sapiens
caaagtatattggattgaatgg

SEQ ID NO: 8425108 - DNA, 22 bp, Homo sapiens
caaagtatattggattgaatgg

SEQ ID NO: 8425109 - DNA, 22 bp, Homo sapiens
caaagtatatttcatagtctca

SEQ ID NO: 8425110 - DNA, 22 bp, Homo sapiens
caaagtatgaaccagtttctct

SEQ ID NO: 8425111 - DNA, 22 bp, Homo sapiens
caaagtatgaaccagtttctct

SEQ ID NO: 8425112 - DNA, 22 bp, Homo sapiens
caaagtatgaaccagtttctct

SEQ ID NO: 8425113 - DNA, 22 bp, Homo sapiens
caaagtatcaactcccacactg

SEQ ID NO: 8425114 - DNA, 22 bp, Homo sapiens
caaagtatatttcatagtctca

SEQ ID NO: 8425115 - DNA, 22 bp, Homo sapiens
caaagtatcaactcccacactg

SEQ ID NO: 8425116 - DNA, 18 bp, Homo sapiens
gctcctggaccaggtcac

SEQ ID NO: 8425117 - DNA, 18 bp, Homo sapiens
gctcctggaccaggtcac

SEQ ID NO: 8425118 - DNA, 22 bp, Homo sapiens
gctcctgcagagatgttccatg

SEQ ID NO: 8425119 - DNA, 22 bp, Homo sapiens
gctcctgcaggacccaggagac

SEQ ID NO: 8425120 - DNA, 22 bp, Homo sapiens
caacagttctcatagcagattc

SEQ ID NO: 8425121 - DNA, 22 bp, Homo sapiens
caacagttcctccatcctctct

SEQ ID NO: 8425122 - DNA, 19 bp, Homo sapiens
caacagttgcaacactgtc

SEQ ID NO: 8425123 - DNA, 22 bp, Homo sapiens
caacatataatatttgagttct

SEQ ID NO: 8425124 - DNA, 22 bp, Homo sapiens
caacatcagtcctcatgagaca

SEQ ID NO: 8425125 - DNA, 22 bp, Homo sapiens
caacatatgattttgtatataa

SEQ ID NO: 8425126 - DNA, 22 bp, Homo sapiens
caacattcttatcactataagc

SEQ ID NO: 8425127 - DNA, 22 bp, Homo sapiens
caacattcaaccaacatttatg

SEQ ID NO: 8425128 - DNA, 22 bp, Homo sapiens
caacattatatagccacatgcc

SEQ ID NO: 8425129 - DNA, 22 bp, Homo sapiens
caacatgtgttagacaatagac

SEQ ID NO: 8425130 - DNA, 22 bp, Homo sapiens
caacatttgagtaaagaaatgg

SEQ ID NO: 8425131 - DNA, 22 bp, Homo sapiens
caacatttcaaggtctttagga

SEQ ID NO: 8425132 - DNA, 22 bp, Homo sapiens
caacatttgagtaaagaaatgg

SEQ ID NO: 8425133 - DNA, 22 bp, Homo sapiens
caacagtctctatagctccttg

SEQ ID NO: 8425134 - DNA, 22 bp, Homo sapiens
caacagtatagcttttgactgc

SEQ ID NO: 8425135 - DNA, 22 bp, Homo sapiens
caacagtattgtgggccaggta

SEQ ID NO: 8425136 - DNA, 19 bp, Homo sapiens
caacagtactggtttgtcc

SEQ ID NO: 8425137 - DNA, 19 bp, Homo sapiens
caacagtactggtttgtcc

SEQ ID NO: 8425138 - DNA, 22 bp, Homo sapiens
gctgcagtgagccaagatcgtg

SEQ ID NO: 8425139 - DNA, 22 bp, Homo sapiens
gctgcaggtttgtctagtctgg

SEQ ID NO: 8425140 - DNA, 22 bp, Homo sapiens
gctgcaggtttgtctagtctgg

SEQ ID NO: 8425141 - DNA, 22 bp, Homo sapiens
gctgcaggtttgtctagtctgg

SEQ ID NO: 8425142 - DNA, 22 bp, Homo sapiens
gctgcagccctgcggatcactt

SEQ ID NO: 8425143 - DNA, 19 bp, Homo sapiens
cacaattatgagacactta

SEQ ID NO: 8425144 - DNA, 19 bp, Homo sapiens
cacaattatgagacactta

SEQ ID NO: 8425145 - DNA, 22 bp, Homo sapiens
cacaattattatctctttctac

SEQ ID NO: 8425146 - DNA, 22 bp, Homo sapiens
cacaattattatctctttctac

SEQ ID NO: 8425147 - DNA, 22 bp, Homo sapiens
cacaattccatggcattctttg

SEQ ID NO: 8425148 - DNA, 22 bp, Homo sapiens
cacaattagcagctctttattt

SEQ ID NO: 8425149 - DNA, 22 bp, Homo sapiens
cacaattatagaagaaagcata

SEQ ID NO: 8425150 - DNA, 22 bp, Homo sapiens
cacaattatagaagaaagcata

SEQ ID NO: 8425151 - DNA, 22 bp, Homo sapiens
cacaatttccaagtcatgttat

SEQ ID NO: 8425152 - DNA, 18 bp, Homo sapiens
cacaatttacagatgaca

SEQ ID NO: 8425153 - DNA, 18 bp, Homo sapiens
cacaatttacagatgaca

SEQ ID NO: 8425154 - DNA, 22 bp, Homo sapiens
cacacagtgggaaaacctgaag

SEQ ID NO: 8425155 - DNA, 22 bp, Homo sapiens
cacacattaatatcaaaggctc

SEQ ID NO: 8425156 - DNA, 22 bp, Homo sapiens
cacacattagagccaatgtcag

SEQ ID NO: 8425157 - DNA, 22 bp, Homo sapiens
cacacattagagccaatgtcag

SEQ ID NO: 8425158 - DNA, 22 bp, Homo sapiens
cacacatcaacctagacattgt

SEQ ID NO: 8425159 - DNA, 22 bp, Homo sapiens
cacaatttggacttcactggtt

SEQ ID NO: 8425160 - DNA, 22 bp, Homo sapiens
cacaatttccttgcttcacttt

SEQ ID NO: 8425161 - DNA, 22 bp, Homo sapiens
cacacgagccctggagccagca

SEQ ID NO: 8425162 - DNA, 22 bp, Homo sapiens
cacacgtgtgagagctgtggca

SEQ ID NO: 8425163 - DNA, 22 bp, Homo sapiens
cacacgatgtgaattcttgccc

SEQ ID NO: 8425164 - DNA, 22 bp, Homo sapiens
cacacctcacacctcgcatgct

SEQ ID NO: 8425165 - DNA, 22 bp, Homo sapiens
cacacctgtaatcctagcactt

SEQ ID NO: 8425166 - DNA, 22 bp, Homo sapiens
cacacctgtaataccagctact

SEQ ID NO: 8425167 - DNA, 22 bp, Homo sapiens
cacaccagaggttacctgcaaa

SEQ ID NO: 8425168 - DNA, 22 bp, Homo sapiens
cacaccagatggcagcgtggga

SEQ ID NO: 8425169 - DNA, 22 bp, Homo sapiens
cacacatttcagatgctacaat

SEQ ID NO: 8425170 - DNA, 22 bp, Homo sapiens
cacaccagcatggtctcagtgt

SEQ ID NO: 8425171 - DNA, 23 bp, Homo sapiens
cacaccaggagccgtctgggcca

SEQ ID NO: 8425172 - DNA, 21 bp, Homo sapiens
cacaccaggcatgtcttgagc

SEQ ID NO: 8425173 - DNA, 23 bp, Homo sapiens
cacaccaggagccgtctgggcca

SEQ ID NO: 8425174 - DNA, 22 bp, Homo sapiens
cacacattggttttactccttt

SEQ ID NO: 8425175 - DNA, 22 bp, Homo sapiens
ggaaaagacaggttaactgtga

SEQ ID NO: 8425176 - DNA, 18 bp, Homo sapiens
ggaaaaggagtgtctagc

SEQ ID NO: 8425177 - DNA, 22 bp, Homo sapiens
ggaaaagacaggttaactgtga

SEQ ID NO: 8425178 - DNA, 22 bp, Homo sapiens
ggaaaagacagaattctagaat

SEQ ID NO: 8425179 - DNA, 17 bp, Homo sapiens
ggaaaaggatgatacag

SEQ ID NO: 8425180 - DNA, 22 bp, Homo sapiens
ggaaaaggccattgtttctctg

SEQ ID NO: 8425181 - DNA, 19 bp, Homo sapiens
cacaacttcgcttgattcc

SEQ ID NO: 8425182 - DNA, 22 bp, Homo sapiens
ggaaaagtgttaaggtgttgat

SEQ ID NO: 8425183 - DNA, 22 bp, Homo sapiens
ggaaaatactgattcatgccat

SEQ ID NO: 8425184 - DNA, 22 bp, Homo sapiens
cacaatgtatatgtatatcaaa

SEQ ID NO: 8425185 - DNA, 22 bp, Homo sapiens
cacaattagcagctctttattt

SEQ ID NO: 8425186 - DNA, 22 bp, Homo sapiens
cacaagtctgtggtctccaaca

SEQ ID NO: 8425187 - DNA, 22 bp, Homo sapiens
cacaagtcattttcagcaggct

SEQ ID NO: 8425188 - DNA, 22 bp, Homo sapiens
cacaagtcattttcagcaggct

SEQ ID NO: 8425189 - DNA, 22 bp, Homo sapiens
cacaagtctgtggtctccaaca

SEQ ID NO: 8425190 - DNA, 22 bp, Homo sapiens
cacaatctcaactgccttttag

SEQ ID NO: 8425191 - DNA, 22 bp, Homo sapiens
cacaatgatttggttcaaaaat

SEQ ID NO: 8425192 - DNA, 22 bp, Homo sapiens
cacaaagtgttagatgccactc

SEQ ID NO: 8425193 - DNA, 22 bp, Homo sapiens
cacaaagtataacttgatggaa

SEQ ID NO: 8425194 - DNA, 22 bp, Homo sapiens
ggaaaagaaagggactgattgg

SEQ ID NO: 8425195 - DNA, 21 bp, Homo sapiens
ggaaaactttccttgtctgaa

SEQ ID NO: 8425196 - DNA, 22 bp, Homo sapiens
cacaaagttggacaacgcaccc

SEQ ID NO: 8425197 - DNA, 22 bp, Homo sapiens
cacaaagttggacaacgcaccc

SEQ ID NO: 8425198 - DNA, 22 bp, Homo sapiens
cacaaagtgggtggaaaactaa

SEQ ID NO: 8425199 - DNA, 22 bp, Homo sapiens
cacaaagtgttagatgccactc

SEQ ID NO: 8425200 - DNA, 17 bp, Homo sapiens
ggaaaagaagagtagga

SEQ ID NO: 8425201 - DNA, 22 bp, Homo sapiens
ggaaaagaaagggactgattgg

SEQ ID NO: 8425202 - DNA, 22 bp, Homo sapiens
cacaaaatatcaagcactttta

SEQ ID NO: 8425203 - DNA, 22 bp, Homo sapiens
cacaaaatatcaagcactttta

SEQ ID NO: 8425204 - DNA, 22 bp, Homo sapiens
cacaaaatctttctcgattatt

SEQ ID NO: 8425205 - DNA, 22 bp, Homo sapiens
cacaaaatctttctcgattatt

SEQ ID NO: 8425206 - DNA, 22 bp, Homo sapiens
gcttctgaggaaggctcagcct

SEQ ID NO: 8425207 - DNA, 22 bp, Homo sapiens
gcttctcttcgcctaggtcctt

SEQ ID NO: 8425208 - DNA, 22 bp, Homo sapiens
gcttctcttgtccaagggcagg

SEQ ID NO: 8425209 - DNA, 22 bp, Homo sapiens
gcttctctttctcccctggcgg

SEQ ID NO: 8425210 - DNA, 20 bp, Homo sapiens
gcttggcataggccacttga

SEQ ID NO: 8425211 - DNA, 22 bp, Homo sapiens
gcttggctggaaataggttgag

SEQ ID NO: 8425212 - DNA, 22 bp, Homo sapiens
gcttggctcctggctcacaggt

SEQ ID NO: 8425213 - DNA, 22 bp, Homo sapiens
gcttggctctaagacacctatt

SEQ ID NO: 8425214 - DNA, 22 bp, Homo sapiens
gcttgggagagggtccccagga

SEQ ID NO: 8425215 - DNA, 22 bp, Homo sapiens
gcttgggaggcaagcattccat

SEQ ID NO: 8425216 - DNA, 19 bp, Homo sapiens
gcttgggagagggagctaa

SEQ ID NO: 8425217 - DNA, 22 bp, Homo sapiens
cacaaaagtaggaggcaggcgg

SEQ ID NO: 8425218 - DNA, 22 bp, Homo sapiens
gcttgggaaacgtagttcctag

SEQ ID NO: 8425219 - DNA, 22 bp, Homo sapiens
gcttgggaagggccctgtgtac

SEQ ID NO: 8425220 - DNA, 22 bp, Homo sapiens
gcttgggactggagaatagggt

SEQ ID NO: 8425221 - DNA, 19 bp, Homo sapiens
gcttgggagagggagctaa

SEQ ID NO: 8425222 - DNA, 22 bp, Homo sapiens
gcttgggagaggcttcctcttt

SEQ ID NO: 8425223 - DNA, 22 bp, Homo sapiens
gcttggcttgggctcagaggcc

SEQ ID NO: 8425224 - DNA, 18 bp, Homo sapiens
gcttggctgcagagagag

SEQ ID NO: 8425225 - DNA, 22 bp, Homo sapiens
gcttggctggagaaagttacct

SEQ ID NO: 8425226 - DNA, 20 bp, Homo sapiens
gctgtggccgtgccagactc

SEQ ID NO: 8425227 - DNA, 20 bp, Homo sapiens
gcttctcagggcttctctga

SEQ ID NO: 8425228 - DNA, 22 bp, Homo sapiens
gcttccaggtcattctcaccct

SEQ ID NO: 8425229 - DNA, 18 bp, Homo sapiens
gcttctcatttctaagca

SEQ ID NO: 8425230 - DNA, 22 bp, Homo sapiens
gcttctcttaatgcctggcttt

SEQ ID NO: 8425231 - DNA, 22 bp, Homo sapiens
gcttctcttaatgcctggcttt

SEQ ID NO: 8425232 - DNA, 22 bp, Homo sapiens
gcttctcggggaggttagccag

SEQ ID NO: 8425233 - DNA, 22 bp, Homo sapiens
gcttctctcaggagcatcagcc

SEQ ID NO: 8425234 - DNA, 22 bp, Homo sapiens
gcttctctctcagactgcaagc

SEQ ID NO: 8425235 - DNA, 22 bp, Homo sapiens
gcttctctggcctgcagggcat

SEQ ID NO: 8425236 - DNA, 22 bp, Homo sapiens
gcttctctggctggtctgccac

SEQ ID NO: 8425237 - DNA, 22 bp, Homo sapiens
gcttctctcaggagcatcagcc

SEQ ID NO: 8425238 - DNA, 22 bp, Homo sapiens
gcttctcctcccgctcccaggc

SEQ ID NO: 8425239 - DNA, 22 bp, Homo sapiens
gctgtctgactccaagttggag

SEQ ID NO: 8425240 - DNA, 20 bp, Homo sapiens
gctgtctgacagttcccaga

SEQ ID NO: 8425241 - DNA, 22 bp, Homo sapiens
gctgtctctcccaggatccatg

SEQ ID NO: 8425242 - DNA, 22 bp, Homo sapiens
gctgtctgcatctctagagctt

SEQ ID NO: 8425243 - DNA, 22 bp, Homo sapiens
gctgtctgcatctctagagctt

SEQ ID NO: 8425244 - DNA, 22 bp, Homo sapiens
gctgtggagtacagagctggtt

SEQ ID NO: 8425245 - DNA, 22 bp, Homo sapiens
gctgtggagtacagagctggtt

SEQ ID NO: 8425246 - DNA, 22 bp, Homo sapiens
gctgtctgccgcaggctgccac

SEQ ID NO: 8425247 - DNA, 22 bp, Homo sapiens
gctgtgctgcgggaggattccg

SEQ ID NO: 8425248 - DNA, 22 bp, Homo sapiens
gctgtgcttttggtagatccca

SEQ ID NO: 8425249 - DNA, 22 bp, Homo sapiens
gctgtgcttgcatgagtgtctg

SEQ ID NO: 8425250 - DNA, 22 bp, Homo sapiens
caaggcagaattcagactcagg

SEQ ID NO: 8425251 - DNA, 20 bp, Homo sapiens
caaggcagaccagagtgagt

SEQ ID NO: 8425252 - DNA, 20 bp, Homo sapiens
caaggcagaccagagtgagt

SEQ ID NO: 8425253 - DNA, 20 bp, Homo sapiens
caaggcagaccagagtgagt

SEQ ID NO: 8425254 - DNA, 22 bp, Homo sapiens
caaggcagcccgctgaaccaca

SEQ ID NO: 8425255 - DNA, 22 bp, Homo sapiens
caaggcagcgttcctttctgga

SEQ ID NO: 8425256 - DNA, 22 bp, Homo sapiens
gctgtctcgcctgacactggct

SEQ ID NO: 8425257 - DNA, 22 bp, Homo sapiens
gctgtacaaattccacaagaga

SEQ ID NO: 8425258 - DNA, 22 bp, Homo sapiens
cacagcttccattagaatgaga

SEQ ID NO: 8425259 - DNA, 22 bp, Homo sapiens
cacagcttagaaaagaagccat

SEQ ID NO: 8425260 - DNA, 22 bp, Homo sapiens
cacagctggtgcactagctctg

SEQ ID NO: 8425261 - DNA, 22 bp, Homo sapiens
cacagctgttttctccaggcag

SEQ ID NO: 8425262 - DNA, 22 bp, Homo sapiens
cacagctgtgagaagggagcct

SEQ ID NO: 8425263 - DNA, 22 bp, Homo sapiens
cacagctgtgagaagggagcct

SEQ ID NO: 8425264 - DNA, 22 bp, Homo sapiens
cacactatcttcctatcctggc

SEQ ID NO: 8425265 - DNA, 22 bp, Homo sapiens
cacagctggtgcactagctctg

SEQ ID NO: 8425266 - DNA, 22 bp, Homo sapiens
cacagctggtgcactagctctg

SEQ ID NO: 8425267 - DNA, 22 bp, Homo sapiens
cacagctggtgcactagctctg

SEQ ID NO: 8425268 - DNA, 22 bp, Homo sapiens
cacagctgaagtagccatgtgg

SEQ ID NO: 8425269 - DNA, 22 bp, Homo sapiens
cacagctgaagtagccatgtgg

SEQ ID NO: 8425270 - DNA, 22 bp, Homo sapiens
ggaggccaaggcaggtggatcg

SEQ ID NO: 8425271 - DNA, 22 bp, Homo sapiens
ggaggccttgcctgcaggcaca

SEQ ID NO: 8425272 - DNA, 22 bp, Homo sapiens
ggatgtgaatctgggctgagac

SEQ ID NO: 8425273 - DNA, 22 bp, Homo sapiens
ggatgttctggggttctcttgt

SEQ ID NO: 8425274 - DNA, 22 bp, Homo sapiens
ggatgtgaatctgggctgagac

SEQ ID NO: 8425275 - DNA, 22 bp, Homo sapiens
ggatgtcgaggatggggtagca

SEQ ID NO: 8425276 - DNA, 22 bp, Homo sapiens
ggatgtagtgcaaggagtgaat

SEQ ID NO: 8425277 - DNA, 22 bp, Homo sapiens
ggatgtagtgcaaggagtgaat

SEQ ID NO: 8425278 - DNA, 22 bp, Homo sapiens
cacagggaggacatcaacagtg

SEQ ID NO: 8425279 - DNA, 22 bp, Homo sapiens
cacagggaggacatcaacagtg

SEQ ID NO: 8425280 - DNA, 22 bp, Homo sapiens
cacagggaggcagccatgctcc

SEQ ID NO: 8425281 - DNA, 19 bp, Homo sapiens
cacagggagaccacatgtc

SEQ ID NO: 8425282 - DNA, 22 bp, Homo sapiens
cacagggagaggaacagcgcag

SEQ ID NO: 8425283 - DNA, 22 bp, Homo sapiens
cacagggagaggaacagcgcag

SEQ ID NO: 8425284 - DNA, 19 bp, Homo sapiens
cacagggagaccacatgtc

SEQ ID NO: 8425285 - DNA, 22 bp, Homo sapiens
ggatgttctggggttctcttgt

SEQ ID NO: 8425286 - DNA, 22 bp, Homo sapiens
cacagggaggcggtcactggct

SEQ ID NO: 8425287 - DNA, 22 bp, Homo sapiens
ggatgggagcagaggacgacca

SEQ ID NO: 8425288 - DNA, 22 bp, Homo sapiens
ggatctgggctctgccaatcag

SEQ ID NO: 8425289 - DNA, 22 bp, Homo sapiens
ggatgggagcagaggacgacca

SEQ ID NO: 8425290 - DNA, 22 bp, Homo sapiens
ggagggagtttcattcctgccc

SEQ ID NO: 8425291 - DNA, 22 bp, Homo sapiens
ggagggagtcagctgattagaa

SEQ ID NO: 8425292 - DNA, 22 bp, Homo sapiens
ggagggagcatccccttgctga

SEQ ID NO: 8425293 - DNA, 22 bp, Homo sapiens
ggagggaggttagattcaagct

SEQ ID NO: 8425294 - DNA, 22 bp, Homo sapiens
ggagggagggctagaccaaaga

SEQ ID NO: 8425295 - DNA, 22 bp, Homo sapiens
ggcactgggaatgcagtgatga

SEQ ID NO: 8425296 - DNA, 22 bp, Homo sapiens
ggcagagcctcagccctccacc

SEQ ID NO: 8425297 - DNA, 22 bp, Homo sapiens
ggcactggaaggatcatgtgag

SEQ ID NO: 8425298 - DNA, 18 bp, Homo sapiens
ggcactgctgttcccctt

SEQ ID NO: 8425299 - DNA, 22 bp, Homo sapiens
ggcacagggagaggcggatttt

SEQ ID NO: 8425300 - DNA, 22 bp, Homo sapiens
cacagggcagagacctgggtgc

SEQ ID NO: 8425301 - DNA, 22 bp, Homo sapiens
ggcacagggggctgaggactag

SEQ ID NO: 8425302 - DNA, 22 bp, Homo sapiens
ggcacagggtgatgttgcagtt

SEQ ID NO: 8425303 - DNA, 22 bp, Homo sapiens
ggcacagggtgatgttgcagtt

SEQ ID NO: 8425304 - DNA, 22 bp, Homo sapiens
ggcacagggaggccctggtgtg

SEQ ID NO: 8425305 - DNA, 22 bp, Homo sapiens
ggcacagggggctgaggactag

SEQ ID NO: 8425306 - DNA, 22 bp, Homo sapiens
ggcacagggggctgaggactag

SEQ ID NO: 8425307 - DNA, 22 bp, Homo sapiens
ggcacagggagccgcagttgca

SEQ ID NO: 8425308 - DNA, 22 bp, Homo sapiens
ggcacagggagccgcagttgca

SEQ ID NO: 8425309 - DNA, 22 bp, Homo sapiens
ggcagcatgggtgcctttgtga

SEQ ID NO: 8425310 - DNA, 22 bp, Homo sapiens
ggcagcatcacttgtctccagc

SEQ ID NO: 8425311 - DNA, 22 bp, Homo sapiens
cacagtggtccccgaagcccct

SEQ ID NO: 8425312 - DNA, 22 bp, Homo sapiens
cacagtgtgactgaccttcagc

SEQ ID NO: 8425313 - DNA, 22 bp, Homo sapiens
cacagtggattgggtgatgccc

SEQ ID NO: 8425314 - DNA, 22 bp, Homo sapiens
cacagtggcaaaggggcttggg

SEQ ID NO: 8425315 - DNA, 22 bp, Homo sapiens
cacagtgctcaaacacaagtgc

SEQ ID NO: 8425316 - DNA, 22 bp, Homo sapiens
cacagtgctttatgagagatct

SEQ ID NO: 8425317 - DNA, 21 bp, Homo sapiens
ggcagagctggggcctccagc

SEQ ID NO: 8425318 - DNA, 22 bp, Homo sapiens
ggcagagcgcatgcgtcgcaga

SEQ ID NO: 8425319 - DNA, 22 bp, Homo sapiens
ggcctctctagcatccagcctg

SEQ ID NO: 8425320 - DNA, 22 bp, Homo sapiens
ggcctctctagcatccagcctg

SEQ ID NO: 8425321 - DNA, 22 bp, Homo sapiens
ggcctcctcaccctgctcaggc

SEQ ID NO: 8425322 - DNA, 22 bp, Homo sapiens
ggcctcgcggcttctggtggct

SEQ ID NO: 8425323 - DNA, 22 bp, Homo sapiens
cactgcaggtctgagatggggg

SEQ ID NO: 8425324 - DNA, 22 bp, Homo sapiens
cactgcaggtctgagatggggg

SEQ ID NO: 8425325 - DNA, 23 bp, Homo sapiens
cactgcagcgtggtctggcagga

SEQ ID NO: 8425326 - DNA, 22 bp, Homo sapiens
cactgcagcaccatgcagggct

SEQ ID NO: 8425327 - DNA, 22 bp, Homo sapiens
cactgcagcaccatgcagggct

SEQ ID NO: 8425328 - DNA, 22 bp, Homo sapiens
cactgagccttgccagcttggt

SEQ ID NO: 8425329 - DNA, 22 bp, Homo sapiens
cactgagctgatttcaggtgcc

SEQ ID NO: 8425330 - DNA, 22 bp, Homo sapiens
cactgagcaagtcagtacagca

SEQ ID NO: 8425331 - DNA, 22 bp, Homo sapiens
cactgagcatgagtgggctgtg

SEQ ID NO: 8425332 - DNA, 22 bp, Homo sapiens
cactgagcaagtcagtacagca

SEQ ID NO: 8425333 - DNA, 22 bp, Homo sapiens
cactgagagtagggcacaagtg

SEQ ID NO: 8425334 - DNA, 22 bp, Homo sapiens
cactgagaggtctcatttccaa

SEQ ID NO: 8425335 - DNA, 22 bp, Homo sapiens
cactgagagatgtgtcacagca

SEQ ID NO: 8425336 - DNA, 22 bp, Homo sapiens
cactgagaaagtgacctgccaa

SEQ ID NO: 8425337 - DNA, 22 bp, Homo sapiens
cactgagaccagagtccctgac

SEQ ID NO: 8425338 - DNA, 22 bp, Homo sapiens
cactggaatggatagagcagag

SEQ ID NO: 8425339 - DNA, 22 bp, Homo sapiens
cactggaatggatagagcagag

SEQ ID NO: 8425340 - DNA, 22 bp, Homo sapiens
cactggaatagcattgattctt

SEQ ID NO: 8425341 - DNA, 22 bp, Homo sapiens
cactggaaccatccacatagtg

SEQ ID NO: 8425342 - DNA, 18 bp, Homo sapiens
cactggaagattagggtc

SEQ ID NO: 8425343 - DNA, 22 bp, Homo sapiens
cactgcctggaaggagagacat

SEQ ID NO: 8425344 - DNA, 21 bp, Homo sapiens
cactggaattttctgtgacat

SEQ ID NO: 8425345 - DNA, 22 bp, Homo sapiens
cactggaatgttgaggagacaa

SEQ ID NO: 8425346 - DNA, 22 bp, Homo sapiens
cactggaattcaagatactgag

SEQ ID NO: 8425347 - DNA, 22 bp, Homo sapiens
cactggaatgttgaggagacaa

SEQ ID NO: 8425348 - DNA, 22 bp, Homo sapiens
cactggcattagtcacgaggca

SEQ ID NO: 8425349 - DNA, 22 bp, Homo sapiens
cactggcaaatggagagaatgt

SEQ ID NO: 8425350 - DNA, 22 bp, Homo sapiens
cactgcagttccccagtgcgca

SEQ ID NO: 8425351 - DNA, 22 bp, Homo sapiens
ggctagggagacagagggcatg

SEQ ID NO: 8425352 - DNA, 22 bp, Homo sapiens
cactgcccaccaagtggctggt

SEQ ID NO: 8425353 - DNA, 22 bp, Homo sapiens
ggctagggatctagaccaggac

SEQ ID NO: 8425354 - DNA, 22 bp, Homo sapiens
ggctagggatctagaccaggac

SEQ ID NO: 8425355 - DNA, 22 bp, Homo sapiens
ggctagggatctagaccaggac

SEQ ID NO: 8425356 - DNA, 22 bp, Homo sapiens
ggctatttcatttagtactagg

SEQ ID NO: 8425357 - DNA, 19 bp, Homo sapiens
ggctcaagcatccaggtag

SEQ ID NO: 8425358 - DNA, 19 bp, Homo sapiens
ggctcaagcatccaggtag

SEQ ID NO: 8425359 - DNA, 22 bp, Homo sapiens
caccatttagtagcaagagctc

SEQ ID NO: 8425360 - DNA, 22 bp, Homo sapiens
caccattttctaaaaatatgac

SEQ ID NO: 8425361 - DNA, 22 bp, Homo sapiens
caccatttaagaaagccaaatt

SEQ ID NO: 8425362 - DNA, 22 bp, Homo sapiens
cacccacattccatcactctgc

SEQ ID NO: 8425363 - DNA, 22 bp, Homo sapiens
cacccacattcctctagtatgt

SEQ ID NO: 8425364 - DNA, 22 bp, Homo sapiens
ggcagtggttagaaacatgagc

SEQ ID NO: 8425365 - DNA, 22 bp, Homo sapiens
ggcagtgtcaaaataggcagaa

SEQ ID NO: 8425366 - DNA, 22 bp, Homo sapiens
cacccagagcctgagagggata

SEQ ID NO: 8425367 - DNA, 22 bp, Homo sapiens
ggcagttgcgtgcatcagtggt

SEQ ID NO: 8425368 - DNA, 20 bp, Homo sapiens
ggcagttaaggcacagtcat

SEQ ID NO: 8425369 - DNA, 22 bp, Homo sapiens
ggcagctgagcatggctacctt

SEQ ID NO: 8425370 - DNA, 22 bp, Homo sapiens
ggcagctgagcatggctacctt

SEQ ID NO: 8425371 - DNA, 22 bp, Homo sapiens
ggcagctgagatcatgctgttg

SEQ ID NO: 8425372 - DNA, 16 bp, Homo sapiens
caccagtccttcctgc

SEQ ID NO: 8425373 - DNA, 22 bp, Homo sapiens
caccaggctggagtgcagtggc

SEQ ID NO: 8425374 - DNA, 22 bp, Homo sapiens
ggcagctgacctagcaccatcc

SEQ ID NO: 8425375 - DNA, 19 bp, Homo sapiens
ggcagctcttgtcttctgc

SEQ ID NO: 8425376 - DNA, 23 bp, Homo sapiens
caccccaccctgaggaggaggga

SEQ ID NO: 8425377 - DNA, 22 bp, Homo sapiens
caccccagcttctcaggataga

SEQ ID NO: 8425378 - DNA, 19 bp, Homo sapiens
caccccagtcctctttccc

SEQ ID NO: 8425379 - DNA, 22 bp, Homo sapiens
ggcatcagaggtgtgttctgct

SEQ ID NO: 8425380 - DNA, 22 bp, Homo sapiens
ggcatcagaggtgtgttctgct

SEQ ID NO: 8425381 - DNA, 22 bp, Homo sapiens
ggcatcagcccggtcctgggct

SEQ ID NO: 8425382 - DNA, 22 bp, Homo sapiens
ggcatatgtagcgtgtgttctg

SEQ ID NO: 8425383 - DNA, 22 bp, Homo sapiens
ggcatagcggctcagcgtccag

SEQ ID NO: 8425384 - DNA, 22 bp, Homo sapiens
ggcagttttaacagaggtagta

SEQ ID NO: 8425385 - DNA, 22 bp, Homo sapiens
ggcagtttggcaggatggaggg

SEQ ID NO: 8425386 - DNA, 22 bp, Homo sapiens
ggcagtttcatcaggagaaaag

SEQ ID NO: 8425387 - DNA, 22 bp, Homo sapiens
ggcagtttctcaggcaggggta

SEQ ID NO: 8425388 - DNA, 22 bp, Homo sapiens
cacccccagcagggaaaggagg

SEQ ID NO: 8425389 - DNA, 22 bp, Homo sapiens
cacccccacctgtgggctcctg

SEQ ID NO: 8425390 - DNA, 22 bp, Homo sapiens
cacccccacctgtgggctcctg

SEQ ID NO: 8425391 - DNA, 22 bp, Homo sapiens
cacccccaggagctccagggac

SEQ ID NO: 8425392 - DNA, 22 bp, Homo sapiens
caccctcccgtcagcccctggg

SEQ ID NO: 8425393 - DNA, 20 bp, Homo sapiens
caccctcccagcacctatgc

SEQ ID NO: 8425394 - DNA, 20 bp, Homo sapiens
caccctacggcctcacctcc

SEQ ID NO: 8425395 - DNA, 22 bp, Homo sapiens
caccctggctggaggtgcagtg

SEQ ID NO: 8425396 - DNA, 22 bp, Homo sapiens
caccctggaaagaaggtctggg

SEQ ID NO: 8425397 - DNA, 22 bp, Homo sapiens
atggacatttgagttatttcca

SEQ ID NO: 8425398 - DNA, 22 bp, Homo sapiens
atggacttaagagtcagaagct

SEQ ID NO: 8425399 - DNA, 22 bp, Homo sapiens
atggaagacagataaggcagaa

SEQ ID NO: 8425400 - DNA, 22 bp, Homo sapiens
gagaaatgctagcttaggaatc

SEQ ID NO: 8425401 - DNA, 22 bp, Homo sapiens
gagaaatgcatgcatgtcatca

SEQ ID NO: 8425402 - DNA, 20 bp, Homo sapiens
atggaggaagggcaagagaa

SEQ ID NO: 8425403 - DNA, 22 bp, Homo sapiens
atggagctgtagggagcagtgg

SEQ ID NO: 8425404 - DNA, 22 bp, Homo sapiens
atggagccattcctgaagactt

SEQ ID NO: 8425405 - DNA, 22 bp, Homo sapiens
atggagactgcgtctgccatcc

SEQ ID NO: 8425406 - DNA, 22 bp, Homo sapiens
gacagaggctggagcacctcct

SEQ ID NO: 8425407 - DNA, 22 bp, Homo sapiens
gacagagttgttgatgtatgct

SEQ ID NO: 8425408 - DNA, 22 bp, Homo sapiens
gacagatgagggagtattctca

SEQ ID NO: 8425409 - DNA, 22 bp, Homo sapiens
gacagatggtcagtgttgaagt

SEQ ID NO: 8425410 - DNA, 22 bp, Homo sapiens
atgccactgcacttcagcttgg

SEQ ID NO: 8425411 - DNA, 22 bp, Homo sapiens
atgccactgcgctccagcctgg

SEQ ID NO: 8425412 - DNA, 22 bp, Homo sapiens
atgccactgcgctccagcctgg

SEQ ID NO: 8425413 - DNA, 22 bp, Homo sapiens
atgccactgcacttcagcttgg

SEQ ID NO: 8425414 - DNA, 22 bp, Homo sapiens
gacagcaacctcatgagaaact

SEQ ID NO: 8425415 - DNA, 22 bp, Homo sapiens
gacagcaaagcagagccaaggc

SEQ ID NO: 8425416 - DNA, 22 bp, Homo sapiens
atggaaaaggctgatttcatta

SEQ ID NO: 8425417 - DNA, 22 bp, Homo sapiens
atggaaaaggctgatttcatta

SEQ ID NO: 8425418 - DNA, 22 bp, Homo sapiens
atgccacttcattccagcctcg

SEQ ID NO: 8425419 - DNA, 22 bp, Homo sapiens
atgccactgcgctctagcctgg

SEQ ID NO: 8425420 - DNA, 21 bp, Homo sapiens
atggaaattggcaaatgctac

SEQ ID NO: 8425421 - DNA, 22 bp, Homo sapiens
atggaacaagaactcagattta

SEQ ID NO: 8425422 - DNA, 22 bp, Homo sapiens
atggaacagacagctgagacaa

SEQ ID NO: 8425423 - DNA, 22 bp, Homo sapiens
atggaacatcaggttaagaaat

SEQ ID NO: 8425424 - DNA, 22 bp, Homo sapiens
atggaacatcaggttaagaaat

SEQ ID NO: 8425425 - DNA, 22 bp, Homo sapiens
atggaacatgaattaatatggt

SEQ ID NO: 8425426 - DNA, 22 bp, Homo sapiens
atggaacaggctcagagatgct

SEQ ID NO: 8425427 - DNA, 22 bp, Homo sapiens
atggaaatgtaacttctgattc

SEQ ID NO: 8425428 - DNA, 22 bp, Homo sapiens
atggaaatgtaacttctgattc

SEQ ID NO: 8425429 - DNA, 22 bp, Homo sapiens
atggaaatggagtgtgcttgct

SEQ ID NO: 8425430 - DNA, 22 bp, Homo sapiens
atggccatgccagtttacagcc

SEQ ID NO: 8425431 - DNA, 22 bp, Homo sapiens
atggcccaaaacctcctccctc

SEQ ID NO: 8425432 - DNA, 22 bp, Homo sapiens
atggcccaaactgcaattactt

SEQ ID NO: 8425433 - DNA, 22 bp, Homo sapiens
atggcccaagtgccctgacctg

SEQ ID NO: 8425434 - DNA, 22 bp, Homo sapiens
atggcccagactcagactggtg

SEQ ID NO: 8425435 - DNA, 22 bp, Homo sapiens
atggcccactctggtcccggca

SEQ ID NO: 8425436 - DNA, 22 bp, Homo sapiens
atggcccagaagtttggaaagg

SEQ ID NO: 8425437 - DNA, 22 bp, Homo sapiens
atggcccaggcaggctggtact

SEQ ID NO: 8425438 - DNA, 22 bp, Homo sapiens
atggcccaggccaggatccagc

SEQ ID NO: 8425439 - DNA, 22 bp, Homo sapiens
atggcccaggcctcctgtggct

SEQ ID NO: 8425440 - DNA, 22 bp, Homo sapiens
atggccagtgtttccctcagtt

SEQ ID NO: 8425441 - DNA, 22 bp, Homo sapiens
atggccagtgtttccctcagtt

SEQ ID NO: 8425442 - DNA, 22 bp, Homo sapiens
gagccagccttcttctgaggtc

SEQ ID NO: 8425443 - DNA, 22 bp, Homo sapiens
gagccagccttcttctgaggtc

SEQ ID NO: 8425444 - DNA, 22 bp, Homo sapiens
atggccctggaaagagcttgag

SEQ ID NO: 8425445 - DNA, 22 bp, Homo sapiens
gagccagctgagctgcactgtc

SEQ ID NO: 8425446 - DNA, 22 bp, Homo sapiens
gagccagctatgtagcaagagg

SEQ ID NO: 8425447 - DNA, 22 bp, Homo sapiens
gagccaggagatacctaagggg

SEQ ID NO: 8425448 - DNA, 22 bp, Homo sapiens
gagccaggaggcagagactgca

SEQ ID NO: 8425449 - DNA, 22 bp, Homo sapiens
atggctgccccaaattgttgct

SEQ ID NO: 8425450 - DNA, 22 bp, Homo sapiens
atggctgcccacgttggtgctt

SEQ ID NO: 8425451 - DNA, 22 bp, Homo sapiens
atggctgcccacgttggtgctt

SEQ ID NO: 8425452 - DNA, 22 bp, Homo sapiens
atggctgcatcatcctggttga

SEQ ID NO: 8425453 - DNA, 22 bp, Homo sapiens
atggctgcatcatcctggttga

SEQ ID NO: 8425454 - DNA, 22 bp, Homo sapiens
gagccaggcccgtacttgctgt

SEQ ID NO: 8425455 - DNA, 22 bp, Homo sapiens
atggctgcttcagtaccagttc

SEQ ID NO: 8425456 - DNA, 22 bp, Homo sapiens
atggctgcttacaaaaactgtg

SEQ ID NO: 8425457 - DNA, 22 bp, Homo sapiens
atggctgctgccttcccctgct

SEQ ID NO: 8425458 - DNA, 19 bp, Homo sapiens
atggctgctgattggggat

SEQ ID NO: 8425459 - DNA, 22 bp, Homo sapiens
atggctgctgccttcccctgct

SEQ ID NO: 8425460 - DNA, 19 bp, Homo sapiens
atggctgctgattggggat

SEQ ID NO: 8425461 - DNA, 22 bp, Homo sapiens
atggctgctttcccttagcacc

SEQ ID NO: 8425462 - DNA, 22 bp, Homo sapiens
atggctgctttcccttagcacc

SEQ ID NO: 8425463 - DNA, 22 bp, Homo sapiens
atggctgccccaaattgttgct

SEQ ID NO: 8425464 - DNA, 22 bp, Homo sapiens
atggctgcctgggcgctggccg

SEQ ID NO: 8425465 - DNA, 22 bp, Homo sapiens
atggctgcctagaggtgagatg

SEQ ID NO: 8425466 - DNA, 22 bp, Homo sapiens
atggctgccttaattcttcagc

SEQ ID NO: 8425467 - DNA, 22 bp, Homo sapiens
atggctgcctgggcgctggccg

SEQ ID NO: 8425468 - DNA, 22 bp, Homo sapiens
atggctgcctgggcgctggccg

SEQ ID NO: 8425469 - DNA, 22 bp, Homo sapiens
atggctgctctggatggagtcc

SEQ ID NO: 8425470 - DNA, 22 bp, Homo sapiens
atggctgctctggatggagtcc

SEQ ID NO: 8425471 - DNA, 22 bp, Homo sapiens
atggctgctctggatggagtcc

SEQ ID NO: 8425472 - DNA, 22 bp, Homo sapiens
atggcagttgcccagccaatcc

SEQ ID NO: 8425473 - DNA, 22 bp, Homo sapiens
gagaggaactcccagtgcctgg

SEQ ID NO: 8425474 - DNA, 22 bp, Homo sapiens
gagaggaagccttctgtacttg

SEQ ID NO: 8425475 - DNA, 22 bp, Homo sapiens
atggcagctggcttgggcacct

SEQ ID NO: 8425476 - DNA, 22 bp, Homo sapiens
atggcagcggagctggaaatga

SEQ ID NO: 8425477 - DNA, 22 bp, Homo sapiens
atggcagctggcttgggcacct

SEQ ID NO: 8425478 - DNA, 22 bp, Homo sapiens
atggcagctttcattgtccaca

SEQ ID NO: 8425479 - DNA, 22 bp, Homo sapiens
atggcagggaccaagctgtcat

SEQ ID NO: 8425480 - DNA, 22 bp, Homo sapiens
atggcagctttgaatttcttga

SEQ ID NO: 8425481 - DNA, 22 bp, Homo sapiens
atggcaggatacccagtccggc

SEQ ID NO: 8425482 - DNA, 22 bp, Homo sapiens
atggcagggcacagctctagtt

SEQ ID NO: 8425483 - DNA, 22 bp, Homo sapiens
atggcagggcacagctctagtt

SEQ ID NO: 8425484 - DNA, 22 bp, Homo sapiens
atggcagggactgtggcccttg

SEQ ID NO: 8425485 - DNA, 22 bp, Homo sapiens
atggcagggactgtggcccttg

SEQ ID NO: 8425486 - DNA, 22 bp, Homo sapiens
atggcagggcccttggctccca

SEQ ID NO: 8425487 - DNA, 22 bp, Homo sapiens
atggtaaccagaagactatgac

SEQ ID NO: 8425488 - DNA, 22 bp, Homo sapiens
atggtaatgatttatgtaaatt

SEQ ID NO: 8425489 - DNA, 22 bp, Homo sapiens
atggtacaaaatgtataaagtc

SEQ ID NO: 8425490 - DNA, 22 bp, Homo sapiens
atggtacaatgatggatagtgg

SEQ ID NO: 8425491 - DNA, 22 bp, Homo sapiens
atggtacatagtttaaataagg

SEQ ID NO: 8425492 - DNA, 19 bp, Homo sapiens
atggtacagtgtacacttg

SEQ ID NO: 8425493 - DNA, 22 bp, Homo sapiens
atggtacagataatacatgctg

SEQ ID NO: 8425494 - DNA, 22 bp, Homo sapiens
atggtacagtgcactgaatgga

SEQ ID NO: 8425495 - DNA, 22 bp, Homo sapiens
atggtacaattttcatttgtgg

SEQ ID NO: 8425496 - DNA, 22 bp, Homo sapiens
atggtacagataatacatgctg

SEQ ID NO: 8425497 - DNA, 21 bp, Homo sapiens
atggtaggtggagcaggtgat

SEQ ID NO: 8425498 - DNA, 22 bp, Homo sapiens
atggtatacaattatggactgt

SEQ ID NO: 8425499 - DNA, 22 bp, Homo sapiens
atggtattaagaacaattccaa

SEQ ID NO: 8425500 - DNA, 22 bp, Homo sapiens
atggtattggagtaggacttgc

SEQ ID NO: 8425501 - DNA, 22 bp, Homo sapiens
atggtattcctttatgtagaag

SEQ ID NO: 8425502 - DNA, 22 bp, Homo sapiens
atggtattctctaactcagctt

SEQ ID NO: 8425503 - DNA, 22 bp, Homo sapiens
atggtattctcagcacctagca

SEQ ID NO: 8425504 - DNA, 22 bp, Homo sapiens
atggctggatttgatccatggg

SEQ ID NO: 8425505 - DNA, 22 bp, Homo sapiens
atggctggcactggcctgggtt

SEQ ID NO: 8425506 - DNA, 22 bp, Homo sapiens
atggctggcactggcctgggtt

SEQ ID NO: 8425507 - DNA, 22 bp, Homo sapiens
atggctggatttgatccatggg

SEQ ID NO: 8425508 - DNA, 22 bp, Homo sapiens
atggctggaggccgggcttcct

SEQ ID NO: 8425509 - DNA, 22 bp, Homo sapiens
atgggtttccctctgaaattat

SEQ ID NO: 8425510 - DNA, 22 bp, Homo sapiens
atgggtttataggtggactttt

SEQ ID NO: 8425511 - DNA, 22 bp, Homo sapiens
atggtcagttgcagctaatgtt

SEQ ID NO: 8425512 - DNA, 22 bp, Homo sapiens
atggtccttatggccgtgatat

SEQ ID NO: 8425513 - DNA, 22 bp, Homo sapiens
gagctgggcctgcgagtgctgc

SEQ ID NO: 8425514 - DNA, 22 bp, Homo sapiens
gagctgggcctcagaacacagt

SEQ ID NO: 8425515 - DNA, 22 bp, Homo sapiens
gagctgggcctgcgagtgctgc

SEQ ID NO: 8425516 - DNA, 22 bp, Homo sapiens
gagctgggcctgcgagtgctgc

SEQ ID NO: 8425517 - DNA, 22 bp, Homo sapiens
gagctgggcctgcgagtgctgc

SEQ ID NO: 8425518 - DNA, 21 bp, Homo sapiens
gagctgggcgaggctccgggg

SEQ ID NO: 8425519 - DNA, 21 bp, Homo sapiens
gagctgggcgaggctccgggg

SEQ ID NO: 8425520 - DNA, 22 bp, Homo sapiens
gagctgggctggcttcctccct

SEQ ID NO: 8425521 - DNA, 22 bp, Homo sapiens
gagctggggcagcttaggagtg

SEQ ID NO: 8425522 - DNA, 22 bp, Homo sapiens
atgtacaattctccttggtagg

SEQ ID NO: 8425523 - DNA, 19 bp, Homo sapiens
atgtacccagtgtcaatcc

SEQ ID NO: 8425524 - DNA, 17 bp, Homo sapiens
gaggagctccagtaggt

SEQ ID NO: 8425525 - DNA, 22 bp, Homo sapiens
gaggagctctgctccatccttc

SEQ ID NO: 8425526 - DNA, 22 bp, Homo sapiens
gaggagctctgctccatccttc

SEQ ID NO: 8425527 - DNA, 17 bp, Homo sapiens
gaggagctccagtaggt

SEQ ID NO: 8425528 - DNA, 22 bp, Homo sapiens
gaggagctgaggctgaggcctc

SEQ ID NO: 8425529 - DNA, 22 bp, Homo sapiens
gaggagctgagccacgtcctgg

SEQ ID NO: 8425530 - DNA, 22 bp, Homo sapiens
gaggagctgaggctgaggcctc

SEQ ID NO: 8425531 - DNA, 22 bp, Homo sapiens
gaggccaggggcctggagatga

SEQ ID NO: 8425532 - DNA, 22 bp, Homo sapiens
gaggccaggggcctggagatga

SEQ ID NO: 8425533 - DNA, 22 bp, Homo sapiens
gaggccaggggtcagcaattgg

SEQ ID NO: 8425534 - DNA, 22 bp, Homo sapiens
gaggccagggtaccatcaacat

SEQ ID NO: 8425535 - DNA, 22 bp, Homo sapiens
gaggccagggtaccatcaacat

SEQ ID NO: 8425536 - DNA, 22 bp, Homo sapiens
gaggccagggtaccatcaacat

SEQ ID NO: 8425537 - DNA, 22 bp, Homo sapiens
gaggccagggatgcaatgagag

SEQ ID NO: 8425538 - DNA, 22 bp, Homo sapiens
gaggccagggatgcaatgagag

SEQ ID NO: 8425539 - DNA, 15 bp, Homo sapiens
gaggccaggcatgtg

SEQ ID NO: 8425540 - DNA, 22 bp, Homo sapiens
gaggccaggggagtcagcgtcc

SEQ ID NO: 8425541 - DNA, 22 bp, Homo sapiens
gaggagctgggaccctgtcatc

SEQ ID NO: 8425542 - DNA, 22 bp, Homo sapiens
gaggagctgggaccctgtcatc

SEQ ID NO: 8425543 - DNA, 22 bp, Homo sapiens
gaggagctggcagcgtctccgc

SEQ ID NO: 8425544 - DNA, 22 bp, Homo sapiens
gaggagctggcagcgtctccgc

SEQ ID NO: 8425545 - DNA, 22 bp, Homo sapiens
gaggagctggctgtcgggaggc

SEQ ID NO: 8425546 - DNA, 22 bp, Homo sapiens
gaggccaggagtgctgtaagtt

SEQ ID NO: 8425547 - DNA, 22 bp, Homo sapiens
gaggccaggagtgctgtaagtt

SEQ ID NO: 8425548 - DNA, 22 bp, Homo sapiens
gaggcctggctctgccctcctg

SEQ ID NO: 8425549 - DNA, 22 bp, Homo sapiens
gaggcctggctctgccctcctg

SEQ ID NO: 8425550 - DNA, 22 bp, Homo sapiens
gaggcctggagccgcctaggcg

SEQ ID NO: 8425551 - DNA, 22 bp, Homo sapiens
gaggcctggagccgcctaggcg

SEQ ID NO: 8425552 - DNA, 22 bp, Homo sapiens
gaggccagggtaccatcaacat

SEQ ID NO: 8425553 - DNA, 22 bp, Homo sapiens
gaggcctggctgggaggaggtg

SEQ ID NO: 8425554 - DNA, 22 bp, Homo sapiens
gaggcctggctgggaggaggtg

SEQ ID NO: 8425555 - DNA, 22 bp, Homo sapiens
gaggcctggctgtcagtcccca

SEQ ID NO: 8425556 - DNA, 22 bp, Homo sapiens
atgtctggtggtcgatgctaca

SEQ ID NO: 8425557 - DNA, 22 bp, Homo sapiens
atgtctttcgcatcagtagcta

SEQ ID NO: 8425558 - DNA, 22 bp, Homo sapiens
atgtctttctagttaagagcta

SEQ ID NO: 8425559 - DNA, 22 bp, Homo sapiens
gaggcctgggttacctactcgt

SEQ ID NO: 8425560 - DNA, 22 bp, Homo sapiens
atgtctgctttccttttaatca

SEQ ID NO: 8425561 - DNA, 22 bp, Homo sapiens
gaggcctgggagcctgtcctcc

SEQ ID NO: 8425562 - DNA, 22 bp, Homo sapiens
gaggcctgggagcctgtcctcc

SEQ ID NO: 8425563 - DNA, 22 bp, Homo sapiens
gaggcctgggagcctgtcctcc

SEQ ID NO: 8425564 - DNA, 22 bp, Homo sapiens
gaggcctgggagcctgtcctcc

SEQ ID NO: 8425565 - DNA, 22 bp, Homo sapiens
gaggctgccccttcctcagctg

SEQ ID NO: 8425566 - DNA, 22 bp, Homo sapiens
gaggctgcggggaggagcctgc

SEQ ID NO: 8425567 - DNA, 22 bp, Homo sapiens
atgtgaaaaatttcttattaca

SEQ ID NO: 8425568 - DNA, 22 bp, Homo sapiens
gaggggagacagggaaatcagt

SEQ ID NO: 8425569 - DNA, 22 bp, Homo sapiens
gaggggagaggcttatggatca

SEQ ID NO: 8425570 - DNA, 16 bp, Homo sapiens
gaggggagcagtaggc

SEQ ID NO: 8425571 - DNA, 22 bp, Homo sapiens
gaggctgctgttagccctgggc

SEQ ID NO: 8425572 - DNA, 22 bp, Homo sapiens
gaggggaagacttctggacagt

SEQ ID NO: 8425573 - DNA, 22 bp, Homo sapiens
gaggggaagacttctggacagt

SEQ ID NO: 8425574 - DNA, 22 bp, Homo sapiens
atctaggtttggaagatagagt

SEQ ID NO: 8425575 - DNA, 22 bp, Homo sapiens
atctaggatttgaatgcacagt

SEQ ID NO: 8425576 - DNA, 22 bp, Homo sapiens
atctatcacctttaggtttgtt

SEQ ID NO: 8425577 - DNA, 22 bp, Homo sapiens
atctaggtttggaagatagagt

SEQ ID NO: 8425578 - DNA, 22 bp, Homo sapiens
cttgagttacagctctccaaga

SEQ ID NO: 8425579 - DNA, 22 bp, Homo sapiens
cttgcctgctggagcagggctc

SEQ ID NO: 8425580 - DNA, 22 bp, Homo sapiens
cttgcctgggactgaggcattt

SEQ ID NO: 8425581 - DNA, 22 bp, Homo sapiens
cttgcctgtggctagttggctc

SEQ ID NO: 8425582 - DNA, 22 bp, Homo sapiens
cttgcctttgtcttcaaaggct

SEQ ID NO: 8425583 - DNA, 22 bp, Homo sapiens
cttgcctttgtcttcaaaggct

SEQ ID NO: 8425584 - DNA, 22 bp, Homo sapiens
cttgcctttgtcttcaaaggct

SEQ ID NO: 8425585 - DNA, 22 bp, Homo sapiens
cttgcctttgtcttcaaaggct

SEQ ID NO: 8425586 - DNA, 22 bp, Homo sapiens
cttgccttcagtgtccctttgc

SEQ ID NO: 8425587 - DNA, 22 bp, Homo sapiens
cttgctgagataaatgctgtct

SEQ ID NO: 8425588 - DNA, 22 bp, Homo sapiens
atctacaggatagtttaatatt

SEQ ID NO: 8425589 - DNA, 19 bp, Homo sapiens
atctacaattattctcagt

SEQ ID NO: 8425590 - DNA, 22 bp, Homo sapiens
atctagaaaaggtgactaaaat

SEQ ID NO: 8425591 - DNA, 22 bp, Homo sapiens
atctacataaaacgaatacata

SEQ ID NO: 8425592 - DNA, 22 bp, Homo sapiens
atctacagtgcacaggacagcc

SEQ ID NO: 8425593 - DNA, 23 bp, Homo sapiens
atctagaaacctgatgactctgt

SEQ ID NO: 8425594 - DNA, 22 bp, Homo sapiens
atctagaaagccaggggcctgc

SEQ ID NO: 8425595 - DNA, 22 bp, Homo sapiens
atctagaacaattattgtcaca

SEQ ID NO: 8425596 - DNA, 22 bp, Homo sapiens
atctagaaagtgttgaagatca

SEQ ID NO: 8425597 - DNA, 22 bp, Homo sapiens
atctagaacttaaagtcagtca

SEQ ID NO: 8425598 - DNA, 22 bp, Homo sapiens
atctagaagcctgagccaagat

SEQ ID NO: 8425599 - DNA, 22 bp, Homo sapiens
atctagaagtcatggctttctt

SEQ ID NO: 8425600 - DNA, 19 bp, Homo sapiens
atctagattattgagaagg

SEQ ID NO: 8425601 - DNA, 22 bp, Homo sapiens
atctagattaggtataagagct

SEQ ID NO: 8425602 - DNA, 22 bp, Homo sapiens
atctagaagtggcatgaattac

SEQ ID NO: 8425603 - DNA, 22 bp, Homo sapiens
atctagacatctgaaacattta

SEQ ID NO: 8425604 - DNA, 21 bp, Homo sapiens
atctagaatctctctccccac

SEQ ID NO: 8425605 - DNA, 22 bp, Homo sapiens
atctagaggcaatgaaggaggt

SEQ ID NO: 8425606 - DNA, 22 bp, Homo sapiens
atctagaggagggctgctggat

SEQ ID NO: 8425607 - DNA, 22 bp, Homo sapiens
atcttctgggcagtgaaaattg

SEQ ID NO: 8425608 - DNA, 22 bp, Homo sapiens
atcttcttcaaggatctggagc

SEQ ID NO: 8425609 - DNA, 22 bp, Homo sapiens
cttgtaaatgcagattctgatt

SEQ ID NO: 8425610 - DNA, 22 bp, Homo sapiens
cttggtgcccagcaggtggctg

SEQ ID NO: 8425611 - DNA, 22 bp, Homo sapiens
cttggttatactccaggaacca

SEQ ID NO: 8425612 - DNA, 22 bp, Homo sapiens
cttggtgagactcccacccacc

SEQ ID NO: 8425613 - DNA, 22 bp, Homo sapiens
cttggtcttgggagcagggaca

SEQ ID NO: 8425614 - DNA, 22 bp, Homo sapiens
cttggcccggagccccatgaag

SEQ ID NO: 8425615 - DNA, 22 bp, Homo sapiens
cttggcccagttgccaaggaaa

SEQ ID NO: 8425616 - DNA, 22 bp, Homo sapiens
cttggcatgttcatctgcttgg

SEQ ID NO: 8425617 - DNA, 22 bp, Homo sapiens
cttggcagggtggaggatgcag

SEQ ID NO: 8425618 - DNA, 22 bp, Homo sapiens
cttggcctgcaggcagcagcgc

SEQ ID NO: 8425619 - DNA, 22 bp, Homo sapiens
cttggcctgggccgcagccact

SEQ ID NO: 8425620 - DNA, 22 bp, Homo sapiens
cttggctccaatcccagctctg

SEQ ID NO: 8425621 - DNA, 22 bp, Homo sapiens
atgaaattaatcaacacataca

SEQ ID NO: 8425622 - DNA, 22 bp, Homo sapiens
cttttagctgcaagtgttcaca

SEQ ID NO: 8425623 - DNA, 22 bp, Homo sapiens
cttttactgtgaaaagaaactg

SEQ ID NO: 8425624 - DNA, 22 bp, Homo sapiens
cttttattttgaattaagggct

SEQ ID NO: 8425625 - DNA, 22 bp, Homo sapiens
cttttattttgaattaagggct

SEQ ID NO: 8425626 - DNA, 22 bp, Homo sapiens
atgaaatatcttgaagaaattc

SEQ ID NO: 8425627 - DNA, 23 bp, Homo sapiens
atgaaatgctggctcagggaggt

SEQ ID NO: 8425628 - DNA, 22 bp, Homo sapiens
atgaaatgctgagaggtgcttc

SEQ ID NO: 8425629 - DNA, 22 bp, Homo sapiens
atgaaatgattgaaatctttac

SEQ ID NO: 8425630 - DNA, 22 bp, Homo sapiens
atgaaatgtattcagatatgta

SEQ ID NO: 8425631 - DNA, 22 bp, Homo sapiens
atgaaatgtgaatgcttttcat

SEQ ID NO: 8425632 - DNA, 22 bp, Homo sapiens
atcttttactacaaatcaggtg

SEQ ID NO: 8425633 - DNA, 22 bp, Homo sapiens
atcttttatgagcgttctgaca

SEQ ID NO: 8425634 - DNA, 22 bp, Homo sapiens
atcttttacattactgcccaga

SEQ ID NO: 8425635 - DNA, 22 bp, Homo sapiens
atcttttacattactgcccaga

SEQ ID NO: 8425636 - DNA, 22 bp, Homo sapiens
atctttgggcaatgatgaggga

SEQ ID NO: 8425637 - DNA, 22 bp, Homo sapiens
atctttgttgctctcatttctg

SEQ ID NO: 8425638 - DNA, 22 bp, Homo sapiens
atcttggactacagaagagagg

SEQ ID NO: 8425639 - DNA, 22 bp, Homo sapiens
atcttgattccattatctttgt

SEQ ID NO: 8425640 - DNA, 22 bp, Homo sapiens
atctttttatctgtttggaaca

SEQ ID NO: 8425641 - DNA, 22 bp, Homo sapiens
atctttttactaacactgctta

SEQ ID NO: 8425642 - DNA, 22 bp, Homo sapiens
atctttttactaacactgctta

SEQ ID NO: 8425643 - DNA, 22 bp, Homo sapiens
atctttttactaacactgctta

SEQ ID NO: 8425644 - DNA, 22 bp, Homo sapiens
atctttttgacatggtgatggt

SEQ ID NO: 8425645 - DNA, 22 bp, Homo sapiens
atctttttatctgtttggaaca

SEQ ID NO: 8425646 - DNA, 22 bp, Homo sapiens
atcttttttgtcttggtcactg

SEQ ID NO: 8425647 - DNA, 22 bp, Homo sapiens
atgaaaacggaccagagctatt

SEQ ID NO: 8425648 - DNA, 22 bp, Homo sapiens
atcttttttgtcttggtcactg

SEQ ID NO: 8425649 - DNA, 22 bp, Homo sapiens
atgaaaacggaccagagctatt

SEQ ID NO: 8425650 - DNA, 18 bp, Homo sapiens
cttgttcttctcttggcg

SEQ ID NO: 8425651 - DNA, 21 bp, Homo sapiens
cttgttccaagcatgtctgag

SEQ ID NO: 8425652 - DNA, 22 bp, Homo sapiens
cttgttctgtgcttcttacatt

SEQ ID NO: 8425653 - DNA, 22 bp, Homo sapiens
cttgtttaataataccttagca

SEQ ID NO: 8425654 - DNA, 22 bp, Homo sapiens
cttgtttaagccgctgttaagc

SEQ ID NO: 8425655 - DNA, 22 bp, Homo sapiens
cttgtttaaataagatagcagt

SEQ ID NO: 8425656 - DNA, 22 bp, Homo sapiens
cttgtttattatgcactgtaga

SEQ ID NO: 8425657 - DNA, 22 bp, Homo sapiens
cttgtttaataataccttagca

SEQ ID NO: 8425658 - DNA, 22 bp, Homo sapiens
cttgtttatctctgtagccctg

SEQ ID NO: 8425659 - DNA, 22 bp, Homo sapiens
atgaaacatgagaaatggagag

SEQ ID NO: 8425660 - DNA, 22 bp, Homo sapiens
cttgttaaattatataagcaga

SEQ ID NO: 8425661 - DNA, 22 bp, Homo sapiens
cttgttaaaatgcagattccaa

SEQ ID NO: 8425662 - DNA, 22 bp, Homo sapiens
atgaaaagttcgatctagaagg

SEQ ID NO: 8425663 - DNA, 22 bp, Homo sapiens
atgaaaagcataaacgctgaag

SEQ ID NO: 8425664 - DNA, 22 bp, Homo sapiens
atgaaaagggagtgatatttgt

SEQ ID NO: 8425665 - DNA, 22 bp, Homo sapiens
atgagttcccaggtgatttgtg

SEQ ID NO: 8425666 - DNA, 22 bp, Homo sapiens
atgagtgtttagaaaacactgg

SEQ ID NO: 8425667 - DNA, 22 bp, Homo sapiens
atgagttcaattgtttcagtca

SEQ ID NO: 8425668 - DNA, 22 bp, Homo sapiens
atgagttcatactttcagtacc

SEQ ID NO: 8425669 - DNA, 22 bp, Homo sapiens
atgagtgcaacagatcagcatg

SEQ ID NO: 8425670 - DNA, 22 bp, Homo sapiens
atgagtgtacgtgaaagtagat

SEQ ID NO: 8425671 - DNA, 22 bp, Homo sapiens
atgagtgtcatgtatgagatat

SEQ ID NO: 8425672 - DNA, 22 bp, Homo sapiens
atgattactcccatttgataga

SEQ ID NO: 8425673 - DNA, 20 bp, Homo sapiens
atgagtttaaacattcagag

SEQ ID NO: 8425674 - DNA, 20 bp, Homo sapiens
atgattttgcactaacttca

SEQ ID NO: 8425675 - DNA, 22 bp, Homo sapiens
atgattttttctaacacagtcg

SEQ ID NO: 8425676 - DNA, 22 bp, Homo sapiens
atgcaaaaactgcacttacgct

SEQ ID NO: 8425677 - DNA, 22 bp, Homo sapiens
atgcaaaaactgcacttacgct

SEQ ID NO: 8425678 - DNA, 22 bp, Homo sapiens
atgcaaaaactgcacttacgct

SEQ ID NO: 8425679 - DNA, 22 bp, Homo sapiens
atgcaaaagactatttgttgct

SEQ ID NO: 8425680 - DNA, 22 bp, Homo sapiens
atgcaaaagtaactgtgatttt

SEQ ID NO: 8425681 - DNA, 22 bp, Homo sapiens
atgcaaaagtaactgtgatttt

SEQ ID NO: 8425682 - DNA, 22 bp, Homo sapiens
atgcaaaagtaattgcaatttt

SEQ ID NO: 8425683 - DNA, 22 bp, Homo sapiens
gaaagcagtaaatgggtcccat

SEQ ID NO: 8425684 - DNA, 22 bp, Homo sapiens
gaaagcactgtgagatcttgtt

SEQ ID NO: 8425685 - DNA, 22 bp, Homo sapiens
atgagtcactcagcagaaaagg

SEQ ID NO: 8425686 - DNA, 20 bp, Homo sapiens
atgagtctacacactggctt

SEQ ID NO: 8425687 - DNA, 19 bp, Homo sapiens
atgagtacacttgtacatt

SEQ ID NO: 8425688 - DNA, 22 bp, Homo sapiens
atgagtacattgggatcaaaga

SEQ ID NO: 8425689 - DNA, 22 bp, Homo sapiens
atgaggtcatcttgaagtaggg

SEQ ID NO: 8425690 - DNA, 22 bp, Homo sapiens
atgaggtgatggacatattaac

SEQ ID NO: 8425691 - DNA, 17 bp, Homo sapiens
atgaggtcattaagata

SEQ ID NO: 8425692 - DNA, 22 bp, Homo sapiens
atgaggtctggcaatcagaaac

SEQ ID NO: 8425693 - DNA, 22 bp, Homo sapiens
atgaggcagctggctttctccc

SEQ ID NO: 8425694 - DNA, 22 bp, Homo sapiens
atgaggcagctggctttctccc

SEQ ID NO: 8425695 - DNA, 22 bp, Homo sapiens
atgaggcaggaaaggcgtatct

SEQ ID NO: 8425696 - DNA, 22 bp, Homo sapiens
atgaggcagctgctggagaacg

SEQ ID NO: 8425697 - DNA, 22 bp, Homo sapiens
atgaggcagctgctggagaacg

SEQ ID NO: 8425698 - DNA, 22 bp, Homo sapiens
atgaggcaggagcggggaccct

SEQ ID NO: 8425699 - DNA, 22 bp, Homo sapiens
atgaggcaggagtgcagtggca

SEQ ID NO: 8425700 - DNA, 22 bp, Homo sapiens
atgaggcaggtggaggctgcca

SEQ ID NO: 8425701 - DNA, 22 bp, Homo sapiens
atgaggcaggattaagctatca

SEQ ID NO: 8425702 - DNA, 22 bp, Homo sapiens
atgaggcaggatattaactttt

SEQ ID NO: 8425703 - DNA, 22 bp, Homo sapiens
atgaggcagtacacacaaagcc

SEQ ID NO: 8425704 - DNA, 22 bp, Homo sapiens
atgaggcaggtggaggctgcca

SEQ ID NO: 8425705 - DNA, 22 bp, Homo sapiens
gaaagcacagttctgaccatgt

SEQ ID NO: 8425706 - DNA, 22 bp, Homo sapiens
gaaagcacagttcatgagacaa

SEQ ID NO: 8425707 - DNA, 21 bp, Homo sapiens
gaaagcacagaaaggactctt

SEQ ID NO: 8425708 - DNA, 22 bp, Homo sapiens
gaaagcacccaagatttccttc

SEQ ID NO: 8425709 - DNA, 22 bp, Homo sapiens
atgaagatacaggcagggccat

SEQ ID NO: 8425710 - DNA, 22 bp, Homo sapiens
atgaagagtaagaggacctttt

SEQ ID NO: 8425711 - DNA, 22 bp, Homo sapiens
atgaagagttctgttttggaca

SEQ ID NO: 8425712 - DNA, 22 bp, Homo sapiens
atgaggcagcccttcccttctc

SEQ ID NO: 8425713 - DNA, 22 bp, Homo sapiens
atgaggcagcccttcccttctc

SEQ ID NO: 8425714 - DNA, 22 bp, Homo sapiens
atgaggcagctgacagctgttc

SEQ ID NO: 8425715 - DNA, 22 bp, Homo sapiens
atgaggcagcacatgggattgt

SEQ ID NO: 8425716 - DNA, 22 bp, Homo sapiens
atgaggcagagggctgtgccag

SEQ ID NO: 8425717 - DNA, 22 bp, Homo sapiens
atgaggcagatgttgcatgagg

SEQ ID NO: 8425718 - DNA, 22 bp, Homo sapiens
atgaagcagcgttgtagagtga

SEQ ID NO: 8425719 - DNA, 22 bp, Homo sapiens
atgaagcagactcaggtggtgc

SEQ ID NO: 8425720 - DNA, 22 bp, Homo sapiens
atgcagctgtcagggagaacat

SEQ ID NO: 8425721 - DNA, 22 bp, Homo sapiens
atgcatgagtcactcagtgcag

SEQ ID NO: 8425722 - DNA, 22 bp, Homo sapiens
atgcatgatgaacttgctttca

SEQ ID NO: 8425723 - DNA, 22 bp, Homo sapiens
atgcatcttttcaaggtatttc

SEQ ID NO: 8425724 - DNA, 22 bp, Homo sapiens
atgcatcttatcaaaaattata

SEQ ID NO: 8425725 - DNA, 20 bp, Homo sapiens
atgcatctggtatctttcct

SEQ ID NO: 8425726 - DNA, 22 bp, Homo sapiens
atgcatctgtagtgttatatga

SEQ ID NO: 8425727 - DNA, 22 bp, Homo sapiens
atgcatctatgacttagacatt

SEQ ID NO: 8425728 - DNA, 22 bp, Homo sapiens
atgcatctatgacttagacatt

SEQ ID NO: 8425729 - DNA, 22 bp, Homo sapiens
atgcatgtttatagggtgcttc

SEQ ID NO: 8425730 - DNA, 22 bp, Homo sapiens
atgcatgtgcatggctctatct

SEQ ID NO: 8425731 - DNA, 22 bp, Homo sapiens
atgcatgtctgccagttgctta

SEQ ID NO: 8425732 - DNA, 22 bp, Homo sapiens
gacactgaccccaagctgtcct

SEQ ID NO: 8425733 - DNA, 19 bp, Homo sapiens
atgcagagaatggcagtag

SEQ ID NO: 8425734 - DNA, 22 bp, Homo sapiens
atgcagagacagatgtggcatg

SEQ ID NO: 8425735 - DNA, 22 bp, Homo sapiens
atgcagagcttccagtggcctg

SEQ ID NO: 8425736 - DNA, 22 bp, Homo sapiens
atgcagaattgctaagtatctg

SEQ ID NO: 8425737 - DNA, 22 bp, Homo sapiens
atgcagaattgctaagtatctg

SEQ ID NO: 8425738 - DNA, 21 bp, Homo sapiens
atgcagagaactccagggaag

SEQ ID NO: 8425739 - DNA, 22 bp, Homo sapiens
atgcagaagactgaaaagctga

SEQ ID NO: 8425740 - DNA, 22 bp, Homo sapiens
atgcagaagcagaacttacaca

SEQ ID NO: 8425741 - DNA, 22 bp, Homo sapiens
atgcagaatgagttcacgatct

SEQ ID NO: 8425742 - DNA, 22 bp, Homo sapiens
atgcagaaagcggcaaacaggt

SEQ ID NO: 8425743 - DNA, 22 bp, Homo sapiens
atgcacagtatgtagggtctat

SEQ ID NO: 8425744 - DNA, 22 bp, Homo sapiens
atgcaaatcttaagtatgtgtg

SEQ ID NO: 8425745 - DNA, 22 bp, Homo sapiens
atgcaaataagtgcaggcgtgg

SEQ ID NO: 8425746 - DNA, 22 bp, Homo sapiens
atgcaaagcaccacactaagat

SEQ ID NO: 8425747 - DNA, 22 bp, Homo sapiens
atgcaaagcaccacactaagat

SEQ ID NO: 8425748 - DNA, 22 bp, Homo sapiens
atgcaaagcacacacagaatcc

SEQ ID NO: 8425749 - DNA, 22 bp, Homo sapiens
atgcaaagcaccacactaagat

SEQ ID NO: 8425750 - DNA, 22 bp, Homo sapiens
atgcaaaataaggcagaaacat

SEQ ID NO: 8425751 - DNA, 22 bp, Homo sapiens
atgcaaaagtagttgcagtttt

SEQ ID NO: 8425752 - DNA, 22 bp, Homo sapiens
atgcaaaataaggcagaaacat

SEQ ID NO: 8425753 - DNA, 22 bp, Homo sapiens
atgcaaaagtagttgcagtttt

SEQ ID NO: 8425754 - DNA, 22 bp, Homo sapiens
atgcaaaagtaattgcaatttt

SEQ ID NO: 8425755 - DNA, 22 bp, Homo sapiens
atgcaaaagtaattgcaatttt

SEQ ID NO: 8425756 - DNA, 22 bp, Homo sapiens
atgcaaagcacacacagaatcc

SEQ ID NO: 8425757 - DNA, 22 bp, Homo sapiens
atgcaaaattaccattctgttc

SEQ ID NO: 8425758 - DNA, 22 bp, Homo sapiens
atgcaaaattaccattctgttc

SEQ ID NO: 8425759 - DNA, 22 bp, Homo sapiens
atgcaaaataaggcagaaacat

SEQ ID NO: 8425760 - DNA, 22 bp, Homo sapiens
atgcaaaattaccattctgttc

SEQ ID NO: 8425761 - DNA, 22 bp, Homo sapiens
attaagatcattgtagaagatt

SEQ ID NO: 8425762 - DNA, 22 bp, Homo sapiens
gatgatgagataaggataactt

SEQ ID NO: 8425763 - DNA, 22 bp, Homo sapiens
gatgatgaggccatgaggcagg

SEQ ID NO: 8425764 - DNA, 22 bp, Homo sapiens
gatgatctgcaagaactacatg

SEQ ID NO: 8425765 - DNA, 22 bp, Homo sapiens
gatgatctgaggtacatgaaac

SEQ ID NO: 8425766 - DNA, 22 bp, Homo sapiens
attaatatacactgttagcatg

SEQ ID NO: 8425767 - DNA, 22 bp, Homo sapiens
attaatatacactgttagcatg

SEQ ID NO: 8425768 - DNA, 22 bp, Homo sapiens
attaatattggttcattagctg

SEQ ID NO: 8425769 - DNA, 22 bp, Homo sapiens
attaatgacgcagataataatt

SEQ ID NO: 8425770 - DNA, 22 bp, Homo sapiens
attaatgtgtagccaacttaat

SEQ ID NO: 8425771 - DNA, 22 bp, Homo sapiens
attaatgtctaccagttgtgtg

SEQ ID NO: 8425772 - DNA, 22 bp, Homo sapiens
attacaataatacatgctcatt

SEQ ID NO: 8425773 - DNA, 22 bp, Homo sapiens
gcaacttaggagttagagcatg

SEQ ID NO: 8425774 - DNA, 22 bp, Homo sapiens
gcaactttcaagcaccatgggg

SEQ ID NO: 8425775 - DNA, 22 bp, Homo sapiens
attacaataatacatgctcatt

SEQ ID NO: 8425776 - DNA, 22 bp, Homo sapiens
attacaataatacatgctcatt

SEQ ID NO: 8425777 - DNA, 22 bp, Homo sapiens
attacaataatacatgctcatt

SEQ ID NO: 8425778 - DNA, 22 bp, Homo sapiens
attacaaaagaagggagaaggt

SEQ ID NO: 8425779 - DNA, 22 bp, Homo sapiens
attacaaaagaagggagaaggt

SEQ ID NO: 8425780 - DNA, 22 bp, Homo sapiens
attacaagatgcatccatattt

SEQ ID NO: 8425781 - DNA, 22 bp, Homo sapiens
attacaagtttcagtgttttgc

SEQ ID NO: 8425782 - DNA, 22 bp, Homo sapiens
attacaagtagactaactttca

SEQ ID NO: 8425783 - DNA, 22 bp, Homo sapiens
attacaagtttcagtgttttgc

SEQ ID NO: 8425784 - DNA, 22 bp, Homo sapiens
attacaagtagactaactttca

SEQ ID NO: 8425785 - DNA, 22 bp, Homo sapiens
attacaactacataatctcaga

SEQ ID NO: 8425786 - DNA, 22 bp, Homo sapiens
attacaagatgcatccatattt

SEQ ID NO: 8425787 - DNA, 22 bp, Homo sapiens
attagagctgttagtgaagtgc

SEQ ID NO: 8425788 - DNA, 22 bp, Homo sapiens
attagagcagtgtattatgata

SEQ ID NO: 8425789 - DNA, 22 bp, Homo sapiens
attagagcagtaattgtggcag

SEQ ID NO: 8425790 - DNA, 20 bp, Homo sapiens
attagagctacatggctaca

SEQ ID NO: 8425791 - DNA, 22 bp, Homo sapiens
attattcaatgttatttcagtg

SEQ ID NO: 8425792 - DNA, 22 bp, Homo sapiens
attattcaatcatattaaaagt

SEQ ID NO: 8425793 - DNA, 22 bp, Homo sapiens
attattcattggtaggcaagct

SEQ ID NO: 8425794 - DNA, 22 bp, Homo sapiens
attattcatggtcttccacaat

SEQ ID NO: 8425795 - DNA, 20 bp, Homo sapiens
attattcatacatgtgtgac

SEQ ID NO: 8425796 - DNA, 20 bp, Homo sapiens
attattcatacatgtgtgac

SEQ ID NO: 8425797 - DNA, 22 bp, Homo sapiens
attattcagtcttgtaaggagt

SEQ ID NO: 8425798 - DNA, 22 bp, Homo sapiens
attagaatgcagggttcattgt

SEQ ID NO: 8425799 - DNA, 22 bp, Homo sapiens
attagaatgcagggttcattgt

SEQ ID NO: 8425800 - DNA, 22 bp, Homo sapiens
attagaattatgcttgctaatg

SEQ ID NO: 8425801 - DNA, 22 bp, Homo sapiens
gcaagtttagctaactggccca

SEQ ID NO: 8425802 - DNA, 22 bp, Homo sapiens
attagaactaggctaagtaaaa

SEQ ID NO: 8425803 - DNA, 22 bp, Homo sapiens
attagaagaggctgacgaatgt

SEQ ID NO: 8425804 - DNA, 22 bp, Homo sapiens
attagaagcgtgaatcctttca

SEQ ID NO: 8425805 - DNA, 17 bp, Homo sapiens
gcaagggatgggagatt

SEQ ID NO: 8425806 - DNA, 22 bp, Homo sapiens
gcaaggctgtgcactttgcatt

SEQ ID NO: 8425807 - DNA, 22 bp, Homo sapiens
gcaaggctttgtgaattttaaa

SEQ ID NO: 8425808 - DNA, 22 bp, Homo sapiens
atgtgtttataattactcaatc

SEQ ID NO: 8425809 - DNA, 22 bp, Homo sapiens
atgttaaaaaccagtacagttg

SEQ ID NO: 8425810 - DNA, 22 bp, Homo sapiens
atgtgttcacgtgcacatgtgc

SEQ ID NO: 8425811 - DNA, 22 bp, Homo sapiens
atgtgttcacgtgcacatgtgc

SEQ ID NO: 8425812 - DNA, 23 bp, Homo sapiens
atgttttatgtctctagctgcca

SEQ ID NO: 8425813 - DNA, 22 bp, Homo sapiens
atgttttatgcttcagatgagg

SEQ ID NO: 8425814 - DNA, 22 bp, Homo sapiens
atgttttatgcttcagatgagg

SEQ ID NO: 8425815 - DNA, 19 bp, Homo sapiens
atgttttatgctgatggga

SEQ ID NO: 8425816 - DNA, 20 bp, Homo sapiens
atgttttataaaagaacggg

SEQ ID NO: 8425817 - DNA, 22 bp, Homo sapiens
atgttttatattttgcagcagt

SEQ ID NO: 8425818 - DNA, 22 bp, Homo sapiens
atgttttctagagtttaaaatc

SEQ ID NO: 8425819 - DNA, 22 bp, Homo sapiens
atgttttgctggatgttggcta

SEQ ID NO: 8425820 - DNA, 22 bp, Homo sapiens
attaaatgttggcatattttgt

SEQ ID NO: 8425821 - DNA, 22 bp, Homo sapiens
attaaattaagtggctaattta

SEQ ID NO: 8425822 - DNA, 22 bp, Homo sapiens
attaaattaagtggctaattta

SEQ ID NO: 8425823 - DNA, 22 bp, Homo sapiens
attaaattagcaaactgtgaaa

SEQ ID NO: 8425824 - DNA, 22 bp, Homo sapiens
gatgaggcataaacacagtcac

SEQ ID NO: 8425825 - DNA, 18 bp, Homo sapiens
gatgaggctgtctgagaa

SEQ ID NO: 8425826 - DNA, 22 bp, Homo sapiens
gatgagggcctggtggctgtgc

SEQ ID NO: 8425827 - DNA, 22 bp, Homo sapiens
gatgagggcctggtggctgtgc

SEQ ID NO: 8425828 - DNA, 22 bp, Homo sapiens
gatgaggggtcattggctggga

SEQ ID NO: 8425829 - DNA, 22 bp, Homo sapiens
gatgaggtcatgttttacatat

SEQ ID NO: 8425830 - DNA, 22 bp, Homo sapiens
gatgaggtctacattgttaaaa

SEQ ID NO: 8425831 - DNA, 22 bp, Homo sapiens
gatgaggggtcattggctggga

SEQ ID NO: 8425832 - DNA, 22 bp, Homo sapiens
gatgaggtaagaatgtaacacc

SEQ ID NO: 8425833 - DNA, 22 bp, Homo sapiens
gatgagtgatgttgaagaaggt

SEQ ID NO: 8425834 - DNA, 22 bp, Homo sapiens
gatgagtcactgcaggtgctgg

SEQ ID NO: 8425835 - DNA, 22 bp, Homo sapiens
gatgagtcattcacagtcgtga

SEQ ID NO: 8425836 - DNA, 16 bp, Homo sapiens
gatgagtcttagtggt

SEQ ID NO: 8425837 - DNA, 22 bp, Homo sapiens
gatgagtaatagctaatggttc

SEQ ID NO: 8425838 - DNA, 22 bp, Homo sapiens
gatgagttctttctattctatt

SEQ ID NO: 8425839 - DNA, 22 bp, Homo sapiens
attaaatactgcaggctaagca

SEQ ID NO: 8425840 - DNA, 22 bp, Homo sapiens
attaaaattccaaggtatgcca

SEQ ID NO: 8425841 - DNA, 22 bp, Homo sapiens
attaaaattccaaggtatgcca

SEQ ID NO: 8425842 - DNA, 21 bp, Homo sapiens
attctagacaacactgaaatc

SEQ ID NO: 8425843 - DNA, 21 bp, Homo sapiens
attctagacaacactgaaatc

SEQ ID NO: 8425844 - DNA, 22 bp, Homo sapiens
attctagaaggcaaagcaaggg

SEQ ID NO: 8425845 - DNA, 22 bp, Homo sapiens
attctacatttggagtgatgtc

SEQ ID NO: 8425846 - DNA, 22 bp, Homo sapiens
attctacatttggagtgatgtc

SEQ ID NO: 8425847 - DNA, 22 bp, Homo sapiens
attctacatttggagtgatgtc

SEQ ID NO: 8425848 - DNA, 22 bp, Homo sapiens
attctacatgatagaagggaga

SEQ ID NO: 8425849 - DNA, 22 bp, Homo sapiens
attctacaggactggcaatccc

SEQ ID NO: 8425850 - DNA, 22 bp, Homo sapiens
attctacaggactggcaatccc

SEQ ID NO: 8425851 - DNA, 22 bp, Homo sapiens
attctacacaacatgatgatgg

SEQ ID NO: 8425852 - DNA, 22 bp, Homo sapiens
attctacacaacatgatgatgg

SEQ ID NO: 8425853 - DNA, 22 bp, Homo sapiens
attctacacaaagcaagaagac

SEQ ID NO: 8425854 - DNA, 22 bp, Homo sapiens
attctacacaaagcaagaagac

SEQ ID NO: 8425855 - DNA, 22 bp, Homo sapiens
attctacacaaagcaagaagac

SEQ ID NO: 8425856 - DNA, 22 bp, Homo sapiens
gcagcagggtgccagctttgca

SEQ ID NO: 8425857 - DNA, 22 bp, Homo sapiens
gcagcagggagcaggggtgtca

SEQ ID NO: 8425858 - DNA, 22 bp, Homo sapiens
gcagcagggagcaggggtgtca

SEQ ID NO: 8425859 - DNA, 19 bp, Homo sapiens
attcctcaaggacagaaat

SEQ ID NO: 8425860 - DNA, 22 bp, Homo sapiens
attcctcaaaggtagcccatta

SEQ ID NO: 8425861 - DNA, 22 bp, Homo sapiens
attcctcagcaggccttttgtt

SEQ ID NO: 8425862 - DNA, 20 bp, Homo sapiens
attcctcagccccagcctca

SEQ ID NO: 8425863 - DNA, 22 bp, Homo sapiens
attcctcattatttactgagga

SEQ ID NO: 8425864 - DNA, 20 bp, Homo sapiens
attccacttgtttgaggtac

SEQ ID NO: 8425865 - DNA, 22 bp, Homo sapiens
gcagagcttctgtccttcagga

SEQ ID NO: 8425866 - DNA, 21 bp, Homo sapiens
attccacttttccttcaggga

SEQ ID NO: 8425867 - DNA, 22 bp, Homo sapiens
gcagcaggcacttaccgttgct

SEQ ID NO: 8425868 - DNA, 22 bp, Homo sapiens
gcagcaggcatggccgccctgg

SEQ ID NO: 8425869 - DNA, 22 bp, Homo sapiens
gcagcaggcttttcataccttg

SEQ ID NO: 8425870 - DNA, 22 bp, Homo sapiens
attcctggtggcagaaacatga

SEQ ID NO: 8425871 - DNA, 22 bp, Homo sapiens
attcctcatttgttgagaacca

SEQ ID NO: 8425872 - DNA, 22 bp, Homo sapiens
attcctcatttgttgagaacca

SEQ ID NO: 8425873 - DNA, 22 bp, Homo sapiens
attatttacagtgtgctcgaag

SEQ ID NO: 8425874 - DNA, 22 bp, Homo sapiens
attattggacacttcttctgca

SEQ ID NO: 8425875 - DNA, 22 bp, Homo sapiens
attcagagattgttattcagac

SEQ ID NO: 8425876 - DNA, 22 bp, Homo sapiens
attatttagaaatcgattgaaa

SEQ ID NO: 8425877 - DNA, 22 bp, Homo sapiens
attatttatcctcttggtctat

SEQ ID NO: 8425878 - DNA, 22 bp, Homo sapiens
attcagtgccaaggagaacttg

SEQ ID NO: 8425879 - DNA, 22 bp, Homo sapiens
attcagtggatatcttcacttt

SEQ ID NO: 8425880 - DNA, 22 bp, Homo sapiens
attcagtcaaaaatgatggaga

SEQ ID NO: 8425881 - DNA, 22 bp, Homo sapiens
attcagtgattcatttgtacaa

SEQ ID NO: 8425882 - DNA, 22 bp, Homo sapiens
attcagtgacctaattacttac

SEQ ID NO: 8425883 - DNA, 22 bp, Homo sapiens
attcagtgtttgcagcaacttt

SEQ ID NO: 8425884 - DNA, 22 bp, Homo sapiens
attcagtgtagttattatcttt

SEQ ID NO: 8425885 - DNA, 22 bp, Homo sapiens
attcagtgtagttattatcttt

SEQ ID NO: 8425886 - DNA, 19 bp, Homo sapiens
attcagtgtctctgacttc

SEQ ID NO: 8425887 - DNA, 22 bp, Homo sapiens
attcagtgtctactccattgcc

SEQ ID NO: 8425888 - DNA, 23 bp, Homo sapiens
gcagagctgccctattgccttgg

SEQ ID NO: 8425889 - DNA, 22 bp, Homo sapiens
gcagagctgcagcgaggcctgg

SEQ ID NO: 8425890 - DNA, 21 bp, Homo sapiens
gcagagctggaaccaggaccc

SEQ ID NO: 8425891 - DNA, 21 bp, Homo sapiens
gcagagctggaaccaggaccc

SEQ ID NO: 8425892 - DNA, 22 bp, Homo sapiens
gcagagctggaactggtactca

SEQ ID NO: 8425893 - DNA, 22 bp, Homo sapiens
gcagagctggaactggtactca

SEQ ID NO: 8425894 - DNA, 18 bp, Homo sapiens
gcagagctgggattccca

SEQ ID NO: 8425895 - DNA, 22 bp, Homo sapiens
gcagagctgttaatggagctga

SEQ ID NO: 8425896 - DNA, 22 bp, Homo sapiens
gcagagctgttaatggagctga

SEQ ID NO: 8425897 - DNA, 22 bp, Homo sapiens
gcagagctgttaatggagctga

SEQ ID NO: 8425898 - DNA, 22 bp, Homo sapiens
gcagagctgttaatggagctga

SEQ ID NO: 8425899 - DNA, 20 bp, Homo sapiens
gcagagctgttctgtgggga

SEQ ID NO: 8425900 - DNA, 20 bp, Homo sapiens
gcagagctgttctgtgggga

SEQ ID NO: 8425901 - DNA, 22 bp, Homo sapiens
gcagagctgtctaagtcacttc

SEQ ID NO: 8425902 - DNA, 22 bp, Homo sapiens
gcagagctgtctaagtcacttc

SEQ ID NO: 8425903 - DNA, 22 bp, Homo sapiens
gcagagctggtacttgagcctg

SEQ ID NO: 8425904 - DNA, 22 bp, Homo sapiens
gcagagctgggatttgtactgg

SEQ ID NO: 8425905 - DNA, 22 bp, Homo sapiens
attctagataagaaaagggctg

SEQ ID NO: 8425906 - DNA, 22 bp, Homo sapiens
attctatagacagaaggtcaat

SEQ ID NO: 8425907 - DNA, 22 bp, Homo sapiens
attctattttttaagaagtagt

SEQ ID NO: 8425908 - DNA, 22 bp, Homo sapiens
attctcagatcttagaggaata

SEQ ID NO: 8425909 - DNA, 22 bp, Homo sapiens
attctcaatggctactttcata

SEQ ID NO: 8425910 - DNA, 22 bp, Homo sapiens
attctcaaacaagtggtttgat

SEQ ID NO: 8425911 - DNA, 22 bp, Homo sapiens
attctcagggagtattttctat

SEQ ID NO: 8425912 - DNA, 22 bp, Homo sapiens
attcttcacctgagtcagtcta

SEQ ID NO: 8425913 - DNA, 22 bp, Homo sapiens
attcttatttaaatagagtctg

SEQ ID NO: 8425914 - DNA, 22 bp, Homo sapiens
attcttcaaagagtgtcaaagt

SEQ ID NO: 8425915 - DNA, 22 bp, Homo sapiens
attcttcacaaatatatagaag

SEQ ID NO: 8425916 - DNA, 22 bp, Homo sapiens
attcttaattccaaagactgag

SEQ ID NO: 8425917 - DNA, 22 bp, Homo sapiens
attctgttacttggtgatcttc

SEQ ID NO: 8425918 - DNA, 22 bp, Homo sapiens
attcttaattgccatgctgtat

SEQ ID NO: 8425919 - DNA, 20 bp, Homo sapiens
attgaaatttttctgagatt

SEQ ID NO: 8425920 - DNA, 22 bp, Homo sapiens
attgaaattgatgaaattcttg

SEQ ID NO: 8425921 - DNA, 22 bp, Homo sapiens
attgaatgcttgctaacacttt

SEQ ID NO: 8425922 - DNA, 22 bp, Homo sapiens
attgacaaatctgaacatacgg

SEQ ID NO: 8425923 - DNA, 22 bp, Homo sapiens
attgaagaaacccaaataatgg

SEQ ID NO: 8425924 - DNA, 22 bp, Homo sapiens
attgaagatcagggaaagattc

SEQ ID NO: 8425925 - DNA, 22 bp, Homo sapiens
attgcacttcagcctgggtgac

SEQ ID NO: 8425926 - DNA, 22 bp, Homo sapiens
attgacaatctactatgttctg

SEQ ID NO: 8425927 - DNA, 22 bp, Homo sapiens
attgacaaatctgaacatacgg

SEQ ID NO: 8425928 - DNA, 22 bp, Homo sapiens
attgacaagaaagatattttta

SEQ ID NO: 8425929 - DNA, 22 bp, Homo sapiens
attgacagagctttcaccatga

SEQ ID NO: 8425930 - DNA, 22 bp, Homo sapiens
attgacagaaaattggatggca

SEQ ID NO: 8425931 - DNA, 20 bp, Homo sapiens
attgacagaaagtgttcacc

SEQ ID NO: 8425932 - DNA, 22 bp, Homo sapiens
attgacacacttccaggaccag

SEQ ID NO: 8425933 - DNA, 22 bp, Homo sapiens
attggaaatacagtagaaaaat

SEQ ID NO: 8425934 - DNA, 22 bp, Homo sapiens
attggaaatgctacaagttaga

SEQ ID NO: 8425935 - DNA, 22 bp, Homo sapiens
attggaaatgctacaagttaga

SEQ ID NO: 8425936 - DNA, 22 bp, Homo sapiens
attggaatggctttgcatgtcc

SEQ ID NO: 8425937 - DNA, 22 bp, Homo sapiens
attgcttttgagctagaatttt

SEQ ID NO: 8425938 - DNA, 22 bp, Homo sapiens
attgcttttgagctagaatttt

SEQ ID NO: 8425939 - DNA, 18 bp, Homo sapiens
attgcttttgtaccaacc

SEQ ID NO: 8425940 - DNA, 22 bp, Homo sapiens
attgcttttcagacaatgaggc

SEQ ID NO: 8425941 - DNA, 22 bp, Homo sapiens
attgcttttccttaacacatgc

SEQ ID NO: 8425942 - DNA, 22 bp, Homo sapiens
attgcttttccttaacacatgc

SEQ ID NO: 8425943 - DNA, 22 bp, Homo sapiens
attgcttatctatctttaagtc

SEQ ID NO: 8425944 - DNA, 22 bp, Homo sapiens
attgctttagaaagaaaaatat

SEQ ID NO: 8425945 - DNA, 22 bp, Homo sapiens
attgctttgtacatgcctagca

SEQ ID NO: 8425946 - DNA, 22 bp, Homo sapiens
attgcttttagtgaaattatat

SEQ ID NO: 8425947 - DNA, 22 bp, Homo sapiens
attgcttttagtgaaattatat

SEQ ID NO: 8425948 - DNA, 22 bp, Homo sapiens
atttaatgtcgagctattgtag

SEQ ID NO: 8425949 - DNA, 22 bp, Homo sapiens
atttaaattttctgatggagag

SEQ ID NO: 8425950 - DNA, 22 bp, Homo sapiens
attggcaatagagaataaattg

SEQ ID NO: 8425951 - DNA, 22 bp, Homo sapiens
attggcagagctttacaggcta

SEQ ID NO: 8425952 - DNA, 22 bp, Homo sapiens
atttaattaatcatggtgaatt

SEQ ID NO: 8425953 - DNA, 22 bp, Homo sapiens
atttaatttacatttgacagag

SEQ ID NO: 8425954 - DNA, 22 bp, Homo sapiens
atttaatttacatttgacagag

SEQ ID NO: 8425955 - DNA, 22 bp, Homo sapiens
atttaatttggagagagaaacc

SEQ ID NO: 8425956 - DNA, 22 bp, Homo sapiens
atttaatttatagatgtggata

SEQ ID NO: 8425957 - DNA, 22 bp, Homo sapiens
atttaatttggagagagaaacc

SEQ ID NO: 8425958 - DNA, 22 bp, Homo sapiens
atttaatttggagagagaaacc

SEQ ID NO: 8425959 - DNA, 22 bp, Homo sapiens
atttaattttctcaacagtgct

SEQ ID NO: 8425960 - DNA, 22 bp, Homo sapiens
atttaattttctcaacagtgct

SEQ ID NO: 8425961 - DNA, 22 bp, Homo sapiens
atttacagaagcatgtaatagc

SEQ ID NO: 8425962 - DNA, 22 bp, Homo sapiens
atttacactaaaggaaggagga

SEQ ID NO: 8425963 - DNA, 22 bp, Homo sapiens
atttacagaagcatgtaatagc

SEQ ID NO: 8425964 - DNA, 22 bp, Homo sapiens
gccaggaggcttaactggacag

SEQ ID NO: 8425965 - DNA, 22 bp, Homo sapiens
gccagctggctgcaggtcccag

SEQ ID NO: 8425966 - DNA, 22 bp, Homo sapiens
gccagctggctgcaggtcccag

SEQ ID NO: 8425967 - DNA, 19 bp, Homo sapiens
gccaggagggctctggctg

SEQ ID NO: 8425968 - DNA, 22 bp, Homo sapiens
gccaggaggcttaactggacag

SEQ ID NO: 8425969 - DNA, 22 bp, Homo sapiens
gccaggagtgtcccactcattt

SEQ ID NO: 8425970 - DNA, 22 bp, Homo sapiens
gccaggaggggagagtgtgtca

SEQ ID NO: 8425971 - DNA, 20 bp, Homo sapiens
gccaggagggtgtgatgagc

SEQ ID NO: 8425972 - DNA, 19 bp, Homo sapiens
atttactgcctaaaatctc

SEQ ID NO: 8425973 - DNA, 22 bp, Homo sapiens
atttactggaaaaactatgagc

SEQ ID NO: 8425974 - DNA, 22 bp, Homo sapiens
atttagaagctaatttttcaga

SEQ ID NO: 8425975 - DNA, 22 bp, Homo sapiens
atttagaactttgtttgccaat

SEQ ID NO: 8425976 - DNA, 22 bp, Homo sapiens
atttagaaccccttccaacctg

SEQ ID NO: 8425977 - DNA, 22 bp, Homo sapiens
atttagaaattccaaaagtatt

SEQ ID NO: 8425978 - DNA, 22 bp, Homo sapiens
atttagaaattccaaaagtatt

SEQ ID NO: 8425979 - DNA, 22 bp, Homo sapiens
atttcatactaaggctcaaaaa

SEQ ID NO: 8425980 - DNA, 22 bp, Homo sapiens
atttctataggaggacagtatt

SEQ ID NO: 8425981 - DNA, 23 bp, Homo sapiens
atttctaggggattttctggtgc

SEQ ID NO: 8425982 - DNA, 22 bp, Homo sapiens
atttctagtccttgtgtagtca

SEQ ID NO: 8425983 - DNA, 22 bp, Homo sapiens
atttctaggttcacatgtgttt

SEQ ID NO: 8425984 - DNA, 22 bp, Homo sapiens
atttctagatatggagagtggt

SEQ ID NO: 8425985 - DNA, 22 bp, Homo sapiens
atttctagaggcagcttctagg

SEQ ID NO: 8425986 - DNA, 22 bp, Homo sapiens
atttctagacttagaactctta

SEQ ID NO: 8425987 - DNA, 22 bp, Homo sapiens
atttctaggtagagaagcttag

SEQ ID NO: 8425988 - DNA, 22 bp, Homo sapiens
atttctagcagggcaggaaaga

SEQ ID NO: 8425989 - DNA, 22 bp, Homo sapiens
atttctagcctctgaagtagga

SEQ ID NO: 8425990 - DNA, 22 bp, Homo sapiens
atttctagcaaaggctctgcta

SEQ ID NO: 8425991 - DNA, 22 bp, Homo sapiens
atttctaaagagggtggtttgg

SEQ ID NO: 8425992 - DNA, 22 bp, Homo sapiens
atttcctagggtagatgtcaca

SEQ ID NO: 8425993 - DNA, 22 bp, Homo sapiens
atttcctagcctctcttgcagt

SEQ ID NO: 8425994 - DNA, 22 bp, Homo sapiens
atttccttcccagatttggttc

SEQ ID NO: 8425995 - DNA, 22 bp, Homo sapiens
atttccttgcaagtttctgtaa

SEQ ID NO: 8425996 - DNA, 22 bp, Homo sapiens
atttattgagacttaacaaccc

SEQ ID NO: 8425997 - DNA, 22 bp, Homo sapiens
atttagaagctaatttttcaga

SEQ ID NO: 8425998 - DNA, 22 bp, Homo sapiens
atttcaagtgttgagctcataa

SEQ ID NO: 8425999 - DNA, 19 bp, Homo sapiens
gccaggcctggacctgcag

SEQ ID NO: 8426000 - DNA, 22 bp, Homo sapiens
gccaggcctgcaagtgctggtg

SEQ ID NO: 8426001 - DNA, 22 bp, Homo sapiens
gccaggccctgggcacttcgtg

SEQ ID NO: 8426002 - DNA, 22 bp, Homo sapiens
gccaggccctgggcacttcgtg

SEQ ID NO: 8426003 - DNA, 22 bp, Homo sapiens
gccaggccactcccgggtcctg

SEQ ID NO: 8426004 - DNA, 22 bp, Homo sapiens
gccaggccactcccgggtcctg

SEQ ID NO: 8426005 - DNA, 22 bp, Homo sapiens
atttcagactgtgttggaaaat

SEQ ID NO: 8426006 - DNA, 22 bp, Homo sapiens
atttcagagaatgaacctaatc

SEQ ID NO: 8426007 - DNA, 21 bp, Homo sapiens
atttcagagcacacaagtaaa

SEQ ID NO: 8426008 - DNA, 22 bp, Homo sapiens
atttcagagtagatcgttattt

SEQ ID NO: 8426009 - DNA, 22 bp, Homo sapiens
atttcagagtgagagtgctcaa

SEQ ID NO: 8426010 - DNA, 22 bp, Homo sapiens
caaaactgtctagagagagaag

SEQ ID NO: 8426011 - DNA, 22 bp, Homo sapiens
gcgagcctctggagtcctctgg

SEQ ID NO: 8426012 - DNA, 22 bp, Homo sapiens
gcgagcctctggagtcctctgg

SEQ ID NO: 8426013 - DNA, 22 bp, Homo sapiens
caaaacattcagagagctcact

SEQ ID NO: 8426014 - DNA, 22 bp, Homo sapiens
caaaacattctctgcagcaggg

SEQ ID NO: 8426015 - DNA, 22 bp, Homo sapiens
caaaaccaagaacattcatttc

SEQ ID NO: 8426016 - DNA, 22 bp, Homo sapiens
caaaaaacacctgtgtgagtat

SEQ ID NO: 8426017 - DNA, 22 bp, Homo sapiens
caaaaactgcaattacttttac

SEQ ID NO: 8426018 - DNA, 22 bp, Homo sapiens
caaaacattcagagagctcact

SEQ ID NO: 8426019 - DNA, 22 bp, Homo sapiens
caaaaaacacctgtgtgagtat

SEQ ID NO: 8426020 - DNA, 22 bp, Homo sapiens
caaaaaacacagatgtctgtgt

SEQ ID NO: 8426021 - DNA, 22 bp, Homo sapiens
caaaaaacacctgtgtgagtat

SEQ ID NO: 8426022 - DNA, 22 bp, Homo sapiens
gcctgtgatgcccccataagta

SEQ ID NO: 8426023 - DNA, 22 bp, Homo sapiens
gcctgtgacccagggcccagga

SEQ ID NO: 8426024 - DNA, 22 bp, Homo sapiens
gcctgtgcatagcagcggactc

SEQ ID NO: 8426025 - DNA, 23 bp, Homo sapiens
gcctgtgcctatgcccagctctg

SEQ ID NO: 8426026 - DNA, 23 bp, Homo sapiens
gcctgtgcctatgcccagctctg

SEQ ID NO: 8426027 - DNA, 22 bp, Homo sapiens
gcctgtcctatacaggcggctg

SEQ ID NO: 8426028 - DNA, 22 bp, Homo sapiens
gcctgtccttgtgaggtcccag

SEQ ID NO: 8426029 - DNA, 22 bp, Homo sapiens
gcctgggagggcagcagtgtgg

SEQ ID NO: 8426030 - DNA, 18 bp, Homo sapiens
gcctgggaggaggaaatg

SEQ ID NO: 8426031 - DNA, 18 bp, Homo sapiens
gcctgggaggaggaaatg

SEQ ID NO: 8426032 - DNA, 16 bp, Homo sapiens
gcctgggagggaacag

SEQ ID NO: 8426033 - DNA, 23 bp, Homo sapiens
gcctgggagttgcgatctgcccg

SEQ ID NO: 8426034 - DNA, 22 bp, Homo sapiens
gcctgggagtgcacagtgaggt

SEQ ID NO: 8426035 - DNA, 22 bp, Homo sapiens
gcctgggagtgcacagtgaggt

SEQ ID NO: 8426036 - DNA, 22 bp, Homo sapiens
gcctgtccactaaacagccaag

SEQ ID NO: 8426037 - DNA, 22 bp, Homo sapiens
gcctgtccccaggagagtccgg

SEQ ID NO: 8426038 - DNA, 22 bp, Homo sapiens
caaactctcccactcactctga

SEQ ID NO: 8426039 - DNA, 22 bp, Homo sapiens
caaactctgtaggacagttcaa

SEQ ID NO: 8426040 - DNA, 22 bp, Homo sapiens
caaaccttgttccagtcaactc

SEQ ID NO: 8426041 - DNA, 22 bp, Homo sapiens
caaacctgttagaggtcatcgt

SEQ ID NO: 8426042 - DNA, 22 bp, Homo sapiens
gcgaggctgggccctgcaggcg

SEQ ID NO: 8426043 - DNA, 22 bp, Homo sapiens
gcgagtgccgagagggcagggc

SEQ ID NO: 8426044 - DNA, 22 bp, Homo sapiens
gcgagtgccgagagggcagggc

SEQ ID NO: 8426045 - DNA, 22 bp, Homo sapiens
gctcaggagctgacagcctcaa

SEQ ID NO: 8426046 - DNA, 22 bp, Homo sapiens
gctcaggagctgacagcctcaa

SEQ ID NO: 8426047 - DNA, 22 bp, Homo sapiens
gctcaggagctgacagcctcaa

SEQ ID NO: 8426048 - DNA, 22 bp, Homo sapiens
gctcaggagctcttggtggcgc

SEQ ID NO: 8426049 - DNA, 22 bp, Homo sapiens
gctcaggatttcatccatgtgt

SEQ ID NO: 8426050 - DNA, 22 bp, Homo sapiens
gctcaggatttcatccatgtgt

SEQ ID NO: 8426051 - DNA, 22 bp, Homo sapiens
gctcaggcaaatttctggtgaa

SEQ ID NO: 8426052 - DNA, 22 bp, Homo sapiens
gctcaggcaaatttctggtgaa

SEQ ID NO: 8426053 - DNA, 22 bp, Homo sapiens
gctcaggcaccatatgatgtgt

SEQ ID NO: 8426054 - DNA, 22 bp, Homo sapiens
gctcaggcaggagtgcagtggc

SEQ ID NO: 8426055 - DNA, 22 bp, Homo sapiens
gctcaggcaccatatgatgtgt

SEQ ID NO: 8426056 - DNA, 22 bp, Homo sapiens
caaaggcaatcttgttctctgg

SEQ ID NO: 8426057 - DNA, 22 bp, Homo sapiens
caaacttacgtagtcttactac

SEQ ID NO: 8426058 - DNA, 22 bp, Homo sapiens
caaacttttcctggaaaagatt

SEQ ID NO: 8426059 - DNA, 22 bp, Homo sapiens
caaactttcagttataacatga

SEQ ID NO: 8426060 - DNA, 22 bp, Homo sapiens
gctcaggaaaacagtctagtaa

SEQ ID NO: 8426061 - DNA, 22 bp, Homo sapiens
gctcaggaaacagcagggcttg

SEQ ID NO: 8426062 - DNA, 22 bp, Homo sapiens
gctcaggaaacagcagggcttg

SEQ ID NO: 8426063 - DNA, 22 bp, Homo sapiens
gctcaggaaacagcagggcttg

SEQ ID NO: 8426064 - DNA, 22 bp, Homo sapiens
gctcaggaaggctcaaccagga

SEQ ID NO: 8426065 - DNA, 22 bp, Homo sapiens
gctcaggactggaggagcgggg

SEQ ID NO: 8426066 - DNA, 22 bp, Homo sapiens
gcctccacttttgctggcttct

SEQ ID NO: 8426067 - DNA, 21 bp, Homo sapiens
gcctccagccagatggcctcc

SEQ ID NO: 8426068 - DNA, 22 bp, Homo sapiens
gcctccagcccacgcaggcctg

SEQ ID NO: 8426069 - DNA, 22 bp, Homo sapiens
atttctcagtgtacattatgtt

SEQ ID NO: 8426070 - DNA, 22 bp, Homo sapiens
atttctcagtgaaatgacaggc

SEQ ID NO: 8426071 - DNA, 22 bp, Homo sapiens
atttctcagtaggtgcacagtg

SEQ ID NO: 8426072 - DNA, 22 bp, Homo sapiens
atttctcagtaggtgcacagtg

SEQ ID NO: 8426073 - DNA, 22 bp, Homo sapiens
atttctcactgagcagataaaa

SEQ ID NO: 8426074 - DNA, 22 bp, Homo sapiens
gcctctcctggagaaggcaggg

SEQ ID NO: 8426075 - DNA, 22 bp, Homo sapiens
gcctctctccttggcttgcagt

SEQ ID NO: 8426076 - DNA, 22 bp, Homo sapiens
gcctctccgagccactgcctct

SEQ ID NO: 8426077 - DNA, 22 bp, Homo sapiens
gcctctccgagccactgcctct

SEQ ID NO: 8426078 - DNA, 22 bp, Homo sapiens
gcctctccgagccactgcctct

SEQ ID NO: 8426079 - DNA, 21 bp, Homo sapiens
gcctctccaaatcctgccttc

SEQ ID NO: 8426080 - DNA, 22 bp, Homo sapiens
gcctcctgttatgccatgtgcc

SEQ ID NO: 8426081 - DNA, 22 bp, Homo sapiens
gcctccccaagcagcagggatt

SEQ ID NO: 8426082 - DNA, 22 bp, Homo sapiens
gcctccccaagcagcagggatt

SEQ ID NO: 8426083 - DNA, 22 bp, Homo sapiens
gcctccccaagcagcagggatt

SEQ ID NO: 8426084 - DNA, 22 bp, Homo sapiens
gcctccccaagcagcagggatt

SEQ ID NO: 8426085 - DNA, 22 bp, Homo sapiens
gcctccccaaagtgctgacagc

SEQ ID NO: 8426086 - DNA, 22 bp, Homo sapiens
gcctccccaaagtgctgacagc

SEQ ID NO: 8426087 - DNA, 22 bp, Homo sapiens
gcctccagtttttttctgaact

SEQ ID NO: 8426088 - DNA, 22 bp, Homo sapiens
gcctccagggtagaggaggaag

SEQ ID NO: 8426089 - DNA, 22 bp, Homo sapiens
gcctccagtttttttctgaact

SEQ ID NO: 8426090 - DNA, 22 bp, Homo sapiens
gcctccagggtagaggaggaag

SEQ ID NO: 8426091 - DNA, 22 bp, Homo sapiens
gcctccagggtagaggaggaag

SEQ ID NO: 8426092 - DNA, 22 bp, Homo sapiens
gcctccagggatgattccttcc

SEQ ID NO: 8426093 - DNA, 22 bp, Homo sapiens
gcctccagctggggcatttcag

SEQ ID NO: 8426094 - DNA, 22 bp, Homo sapiens
gcctccagcccacgcaggcctg

SEQ ID NO: 8426095 - DNA, 22 bp, Homo sapiens
gcctctctctacccagtatgat

SEQ ID NO: 8426096 - DNA, 18 bp, Homo sapiens
gcctgcctagagcttgcc

SEQ ID NO: 8426097 - DNA, 22 bp, Homo sapiens
gcctgctgaagccagagtgtgt

SEQ ID NO: 8426098 - DNA, 22 bp, Homo sapiens
gcctgctgaacctcatgcagtc

SEQ ID NO: 8426099 - DNA, 22 bp, Homo sapiens
gcctgctgaacctcatgcagtc

SEQ ID NO: 8426100 - DNA, 22 bp, Homo sapiens
gcctgctgccaccctggctccg

SEQ ID NO: 8426101 - DNA, 22 bp, Homo sapiens
gcctgctggatgtggccaggcc

SEQ ID NO: 8426102 - DNA, 22 bp, Homo sapiens
gcctgctggaggagcctcaggg

SEQ ID NO: 8426103 - DNA, 22 bp, Homo sapiens
gcctggagctcatgtgggcatt

SEQ ID NO: 8426104 - DNA, 22 bp, Homo sapiens
gcctggagctcatgtgggcatt

SEQ ID NO: 8426105 - DNA, 22 bp, Homo sapiens
gcctggagctctccacttgggg

SEQ ID NO: 8426106 - DNA, 22 bp, Homo sapiens
gcctggctgaggtggggaggca

SEQ ID NO: 8426107 - DNA, 22 bp, Homo sapiens
gcctggctgaggcctctgctaa

SEQ ID NO: 8426108 - DNA, 22 bp, Homo sapiens
gcctgggagagggatagtgcag

SEQ ID NO: 8426109 - DNA, 22 bp, Homo sapiens
gcctgggagatgcgttgtggcc

SEQ ID NO: 8426110 - DNA, 22 bp, Homo sapiens
gcctgggagcacatcggggtcc

SEQ ID NO: 8426111 - DNA, 22 bp, Homo sapiens
gcctgggagattaattaggaag

SEQ ID NO: 8426112 - DNA, 22 bp, Homo sapiens
tatacagtcttttgctatattc

SEQ ID NO: 8426113 - DNA, 22 bp, Homo sapiens
tatacagtcttttgctatattc

SEQ ID NO: 8426114 - DNA, 22 bp, Homo sapiens
tatacagattaacagatttaaa

SEQ ID NO: 8426115 - DNA, 22 bp, Homo sapiens
cagggtggcacatcacagcatt

SEQ ID NO: 8426116 - DNA, 22 bp, Homo sapiens
cagggtggcacatcacagcatt

SEQ ID NO: 8426117 - DNA, 22 bp, Homo sapiens
cagggtggcacatcacagcatt

SEQ ID NO: 8426118 - DNA, 22 bp, Homo sapiens
cagggtggaagctgtagagtgg

SEQ ID NO: 8426119 - DNA, 22 bp, Homo sapiens
cagggtggcactcagcgcatct

SEQ ID NO: 8426120 - DNA, 22 bp, Homo sapiens
tatacagatggaaagatacaca

SEQ ID NO: 8426121 - DNA, 22 bp, Homo sapiens
caggtctccagctcagggtcca

SEQ ID NO: 8426122 - DNA, 22 bp, Homo sapiens
caggtctgaagagtcacatgcc

SEQ ID NO: 8426123 - DNA, 22 bp, Homo sapiens
caggtctgaagagtcacatgcc

SEQ ID NO: 8426124 - DNA, 17 bp, Homo sapiens
caggtctgaggccaggc

SEQ ID NO: 8426125 - DNA, 17 bp, Homo sapiens
caggtctgaggccaggc

SEQ ID NO: 8426126 - DNA, 22 bp, Homo sapiens
caggtctcttttgtcacaccac

SEQ ID NO: 8426127 - DNA, 22 bp, Homo sapiens
caggtctgaagagtcacatgcc

SEQ ID NO: 8426128 - DNA, 22 bp, Homo sapiens
caggtctctcccaagctacaat

SEQ ID NO: 8426129 - DNA, 22 bp, Homo sapiens
caggtctcgggttcagcagtga

SEQ ID NO: 8426130 - DNA, 22 bp, Homo sapiens
tatctattccaaatatcagcgt

SEQ ID NO: 8426131 - DNA, 22 bp, Homo sapiens
caggtctggcatcagctgtgtg

SEQ ID NO: 8426132 - DNA, 22 bp, Homo sapiens
caggtctggcatcagctgtgtg

SEQ ID NO: 8426133 - DNA, 22 bp, Homo sapiens
caggtctgggttgatggcctgg

SEQ ID NO: 8426134 - DNA, 22 bp, Homo sapiens
caggtctgggttgatggcctgg

SEQ ID NO: 8426135 - DNA, 22 bp, Homo sapiens
caggtctgcagacagggccatg

SEQ ID NO: 8426136 - DNA, 22 bp, Homo sapiens
caggtctgcagacagggccatg

SEQ ID NO: 8426137 - DNA, 22 bp, Homo sapiens
caggtctgcagacagggccatg

SEQ ID NO: 8426138 - DNA, 22 bp, Homo sapiens
caggtctgcagacagggccatg

SEQ ID NO: 8426139 - DNA, 22 bp, Homo sapiens
caggtctgcagacagggccatg

SEQ ID NO: 8426140 - DNA, 17 bp, Homo sapiens
caggtctgaggccaggc

SEQ ID NO: 8426141 - DNA, 22 bp, Homo sapiens
caggtctgagtcacatgttcat

SEQ ID NO: 8426142 - DNA, 22 bp, Homo sapiens
cagggtggaagctgtagagtgg

SEQ ID NO: 8426143 - DNA, 22 bp, Homo sapiens
cagggtcttataaggccaattt

SEQ ID NO: 8426144 - DNA, 22 bp, Homo sapiens
caggggccaggctgtctgctgt

SEQ ID NO: 8426145 - DNA, 22 bp, Homo sapiens
caggggcagtctgtgtgcgtgg

SEQ ID NO: 8426146 - DNA, 22 bp, Homo sapiens
caggggcaagaatgctgtcagc

SEQ ID NO: 8426147 - DNA, 22 bp, Homo sapiens
tagttttagtcccattttacag

SEQ ID NO: 8426148 - DNA, 22 bp, Homo sapiens
tagttttagtcccattttacag

SEQ ID NO: 8426149 - DNA, 17 bp, Homo sapiens
tacatgtgtatctgatt

SEQ ID NO: 8426150 - DNA, 17 bp, Homo sapiens
tacatgtgtatctgatt

SEQ ID NO: 8426151 - DNA, 22 bp, Homo sapiens
tacatgtggtagggagggcagt

SEQ ID NO: 8426152 - DNA, 22 bp, Homo sapiens
tagttttagtcccattttacag

SEQ ID NO: 8426153 - DNA, 22 bp, Homo sapiens
tataatatgaggcaggagtgat

SEQ ID NO: 8426154 - DNA, 22 bp, Homo sapiens
tataagtgtgtcagcttccaac

SEQ ID NO: 8426155 - DNA, 20 bp, Homo sapiens
tataagcagctccaggcaga

SEQ ID NO: 8426156 - DNA, 22 bp, Homo sapiens
tataagcatgcttcatatggat

SEQ ID NO: 8426157 - DNA, 22 bp, Homo sapiens
tataagcacatccttgactgat

SEQ ID NO: 8426158 - DNA, 22 bp, Homo sapiens
tataagcacatccttgactgat

SEQ ID NO: 8426159 - DNA, 22 bp, Homo sapiens
tataattagtaaatggcagatt

SEQ ID NO: 8426160 - DNA, 22 bp, Homo sapiens
tataatattccttgttgtaggt

SEQ ID NO: 8426161 - DNA, 22 bp, Homo sapiens
tataatctggttttattaagag

SEQ ID NO: 8426162 - DNA, 22 bp, Homo sapiens
tatctcagctggatcagtggaa

SEQ ID NO: 8426163 - DNA, 22 bp, Homo sapiens
tatctctgttccaagccttatc

SEQ ID NO: 8426164 - DNA, 22 bp, Homo sapiens
tatctgatacaacagaataaca

SEQ ID NO: 8426165 - DNA, 22 bp, Homo sapiens
tatctgagaaagaagcaccaga

SEQ ID NO: 8426166 - DNA, 22 bp, Homo sapiens
tatggcagaggagaggcactag

SEQ ID NO: 8426167 - DNA, 22 bp, Homo sapiens
tatggcaagatgacatgttctc

SEQ ID NO: 8426168 - DNA, 22 bp, Homo sapiens
caggtctggtgagagaacagtt

SEQ ID NO: 8426169 - DNA, 21 bp, Homo sapiens
caggtctggtgaacactctca

SEQ ID NO: 8426170 - DNA, 22 bp, Homo sapiens
tatggcttctgctttcttgact

SEQ ID NO: 8426171 - DNA, 22 bp, Homo sapiens
tatggcagttacccttgatgat

SEQ ID NO: 8426172 - DNA, 22 bp, Homo sapiens
caggtctttgttgcagcatgga

SEQ ID NO: 8426173 - DNA, 22 bp, Homo sapiens
caggtcttttctactggtggag

SEQ ID NO: 8426174 - DNA, 20 bp, Homo sapiens
caggtcttcatgtggctgtc

SEQ ID NO: 8426175 - DNA, 18 bp, Homo sapiens
caggtctgtctgcctccc

SEQ ID NO: 8426176 - DNA, 22 bp, Homo sapiens
caggtctgtgtgccatttccaa

SEQ ID NO: 8426177 - DNA, 22 bp, Homo sapiens
caggtctgtattaacagagggt

SEQ ID NO: 8426178 - DNA, 22 bp, Homo sapiens
caggtctgtttccatcagtgct

SEQ ID NO: 8426179 - DNA, 22 bp, Homo sapiens
caggtctgtttccatcagtgct

SEQ ID NO: 8426180 - DNA, 22 bp, Homo sapiens
caggtctgtttccatcagtgct

SEQ ID NO: 8426181 - DNA, 22 bp, Homo sapiens
tatgtttttaagagaatgcatt

SEQ ID NO: 8426182 - DNA, 22 bp, Homo sapiens
tatgttttaggaattaattgtt

SEQ ID NO: 8426183 - DNA, 22 bp, Homo sapiens
tatgttttaggaattaattgtt

SEQ ID NO: 8426184 - DNA, 22 bp, Homo sapiens
tatgtttgttatcacaactagg

SEQ ID NO: 8426185 - DNA, 22 bp, Homo sapiens
tattaaatatatctgttagttg

SEQ ID NO: 8426186 - DNA, 22 bp, Homo sapiens
tatgtttttcagacgtcctaca

SEQ ID NO: 8426187 - DNA, 22 bp, Homo sapiens
tatgtttttcagacgtcctaca

SEQ ID NO: 8426188 - DNA, 22 bp, Homo sapiens
tattaaagggaagttatgcatg

SEQ ID NO: 8426189 - DNA, 22 bp, Homo sapiens
tattaaagagagaatcatcatc

SEQ ID NO: 8426190 - DNA, 22 bp, Homo sapiens
tattaaagagagaatcatcatc

SEQ ID NO: 8426191 - DNA, 20 bp, Homo sapiens
tattgcctaaataccagaat

SEQ ID NO: 8426192 - DNA, 20 bp, Homo sapiens
cagtgaggaggtgctggggg

SEQ ID NO: 8426193 - DNA, 22 bp, Homo sapiens
cagtctctaaatcaatctgaat

SEQ ID NO: 8426194 - DNA, 22 bp, Homo sapiens
cagtctccaaatcagtctgaat

SEQ ID NO: 8426195 - DNA, 22 bp, Homo sapiens
cagtctccgccagctcctcaca

SEQ ID NO: 8426196 - DNA, 22 bp, Homo sapiens
cagtctccaaatcagtctgaat

SEQ ID NO: 8426197 - DNA, 22 bp, Homo sapiens
cagtctccgccagctcctcaca

SEQ ID NO: 8426198 - DNA, 22 bp, Homo sapiens
cagtgaggtggagtagttccca

SEQ ID NO: 8426199 - DNA, 22 bp, Homo sapiens
cagtgaggtgcccagcctgccc

SEQ ID NO: 8426200 - DNA, 22 bp, Homo sapiens
cagtgaggtgcccagcctgccc

SEQ ID NO: 8426201 - DNA, 21 bp, Homo sapiens
cagtgaggtccccagcctagg

SEQ ID NO: 8426202 - DNA, 21 bp, Homo sapiens
cagtgaggtccccagcctagg

SEQ ID NO: 8426203 - DNA, 22 bp, Homo sapiens
cagtgaggtagacagctttttc

SEQ ID NO: 8426204 - DNA, 22 bp, Homo sapiens
cagtgaggtagacagctttttc

SEQ ID NO: 8426205 - DNA, 22 bp, Homo sapiens
cagtgaggtggatggatggcct

SEQ ID NO: 8426206 - DNA, 17 bp, Homo sapiens
cagtgcagagccctttc

SEQ ID NO: 8426207 - DNA, 22 bp, Homo sapiens
cagtgcagaggccagggaggat

SEQ ID NO: 8426208 - DNA, 22 bp, Homo sapiens
cagtgcagacgtggagggggca

SEQ ID NO: 8426209 - DNA, 22 bp, Homo sapiens
cagtgcagacgtggagggggca

SEQ ID NO: 8426210 - DNA, 22 bp, Homo sapiens
cagtgcagaacacatggaaaat

SEQ ID NO: 8426211 - DNA, 22 bp, Homo sapiens
cagtgcagacgtggagggggca

SEQ ID NO: 8426212 - DNA, 20 bp, Homo sapiens
cagtgcaactgaagaactga

SEQ ID NO: 8426213 - DNA, 22 bp, Homo sapiens
cagtgcaagtgactgatcaagg

SEQ ID NO: 8426214 - DNA, 22 bp, Homo sapiens
cagtgcaatgcagatgacacca

SEQ ID NO: 8426215 - DNA, 22 bp, Homo sapiens
cagtgcaattacaagctaattc

SEQ ID NO: 8426216 - DNA, 22 bp, Homo sapiens
cagtgcaacgttgtgcattcaa

SEQ ID NO: 8426217 - DNA, 22 bp, Homo sapiens
cagtcctgggcacagccctggg

SEQ ID NO: 8426218 - DNA, 20 bp, Homo sapiens
cagtcctgtccctgctgccc

SEQ ID NO: 8426219 - DNA, 22 bp, Homo sapiens
cagtcctggggaccaggctgag

SEQ ID NO: 8426220 - DNA, 22 bp, Homo sapiens
cagtcctggggaccaggctgag

SEQ ID NO: 8426221 - DNA, 22 bp, Homo sapiens
cagtccttattcctatattcct

SEQ ID NO: 8426222 - DNA, 22 bp, Homo sapiens
cagtccttggcaagttctcagt

SEQ ID NO: 8426223 - DNA, 22 bp, Homo sapiens
cagtcctgtctttatgacttca

SEQ ID NO: 8426224 - DNA, 22 bp, Homo sapiens
cagtcctgtgtcccttggtggg

SEQ ID NO: 8426225 - DNA, 22 bp, Homo sapiens
cagtccttaaggaaacatttgt

SEQ ID NO: 8426226 - DNA, 22 bp, Homo sapiens
tattggaagtgaacaccaggct

SEQ ID NO: 8426227 - DNA, 20 bp, Homo sapiens
tatttacaacttagagcctc

SEQ ID NO: 8426228 - DNA, 19 bp, Homo sapiens
tatttacttcttgattgca

SEQ ID NO: 8426229 - DNA, 22 bp, Homo sapiens
tatttacttttaaattgagaac

SEQ ID NO: 8426230 - DNA, 22 bp, Homo sapiens
tatttagaacagacaatagaaa

SEQ ID NO: 8426231 - DNA, 22 bp, Homo sapiens
tatttagaacagacaatagaaa

SEQ ID NO: 8426232 - DNA, 22 bp, Homo sapiens
tatttagctggagtcagtgctt

SEQ ID NO: 8426233 - DNA, 22 bp, Homo sapiens
tatttagtgatagaagcaagga

SEQ ID NO: 8426234 - DNA, 22 bp, Homo sapiens
tatttagttatctttcataaaa

SEQ ID NO: 8426235 - DNA, 22 bp, Homo sapiens
tcactcctcaggctagcatcat

SEQ ID NO: 8426236 - DNA, 22 bp, Homo sapiens
tcactcaatatcccagtggggc

SEQ ID NO: 8426237 - DNA, 22 bp, Homo sapiens
tcacccagaaaagacagcagat

SEQ ID NO: 8426238 - DNA, 22 bp, Homo sapiens
tcagaaatgatcgttattcatt

SEQ ID NO: 8426239 - DNA, 21 bp, Homo sapiens
tcagaacaattccatgcctcc

SEQ ID NO: 8426240 - DNA, 23 bp, Homo sapiens
tcagaacaatgccttaggggcat

SEQ ID NO: 8426241 - DNA, 22 bp, Homo sapiens
tcagaacaattcctttataaca

SEQ ID NO: 8426242 - DNA, 22 bp, Homo sapiens
tcagaacaattcctttataaca

SEQ ID NO: 8426243 - DNA, 22 bp, Homo sapiens
tcagaaggaagaagtcatggga

SEQ ID NO: 8426244 - DNA, 22 bp, Homo sapiens
tcagaaggaaacgatgccagct

SEQ ID NO: 8426245 - DNA, 22 bp, Homo sapiens
tcagaagctgggtctcagaagc

SEQ ID NO: 8426246 - DNA, 22 bp, Homo sapiens
tcagaaggatgtgcaggtggca

SEQ ID NO: 8426247 - DNA, 22 bp, Homo sapiens
tcacattctttatttgccatcc

SEQ ID NO: 8426248 - DNA, 22 bp, Homo sapiens
cagtgctgttgggcccagagag

SEQ ID NO: 8426249 - DNA, 22 bp, Homo sapiens
cagtgctgttgtaagctcattg

SEQ ID NO: 8426250 - DNA, 22 bp, Homo sapiens
tcaccaggctagagtgcagtgg

SEQ ID NO: 8426251 - DNA, 22 bp, Homo sapiens
tcaccaggctcctgttaagatg

SEQ ID NO: 8426252 - DNA, 22 bp, Homo sapiens
tcaccaggctggagtgcagtgg

SEQ ID NO: 8426253 - DNA, 22 bp, Homo sapiens
tcaccatacataaattacattg

SEQ ID NO: 8426254 - DNA, 18 bp, Homo sapiens
cagtgctgttaacagtga

SEQ ID NO: 8426255 - DNA, 22 bp, Homo sapiens
cagtgctgtgtttgctgcctgg

SEQ ID NO: 8426256 - DNA, 22 bp, Homo sapiens
cagtgctgttgggcccagagag

SEQ ID NO: 8426257 - DNA, 22 bp, Homo sapiens
cagtgctgttgggcccagagag

SEQ ID NO: 8426258 - DNA, 22 bp, Homo sapiens
cagtgctggtgtaggctgacca

SEQ ID NO: 8426259 - DNA, 23 bp, Homo sapiens
cagtgctggttctgcctgtgggg

SEQ ID NO: 8426260 - DNA, 22 bp, Homo sapiens
cagtgctgagagcctggccagg

SEQ ID NO: 8426261 - DNA, 22 bp, Homo sapiens
cagtgctgacagggaggaacct

SEQ ID NO: 8426262 - DNA, 22 bp, Homo sapiens
cagtgctggtgtaggctgacca

SEQ ID NO: 8426263 - DNA, 22 bp, Homo sapiens
cagtgctgggcagaggagagcg

SEQ ID NO: 8426264 - DNA, 22 bp, Homo sapiens
cagtgctgccaaagggaccttg

SEQ ID NO: 8426265 - DNA, 22 bp, Homo sapiens
cagtgctggaggctggagggaa

SEQ ID NO: 8426266 - DNA, 22 bp, Homo sapiens
cagtgctggaggggtgcttgca

SEQ ID NO: 8426267 - DNA, 22 bp, Homo sapiens
cagtgctggaggggtgcttgca

SEQ ID NO: 8426268 - DNA, 22 bp, Homo sapiens
tcaggtggtcctaagtgccatc

SEQ ID NO: 8426269 - DNA, 22 bp, Homo sapiens
tcaggtgggacctgctaggaca

SEQ ID NO: 8426270 - DNA, 22 bp, Homo sapiens
catctttaaaggggagacaccc

SEQ ID NO: 8426271 - DNA, 22 bp, Homo sapiens
catctttaaaggggagacaccc

SEQ ID NO: 8426272 - DNA, 22 bp, Homo sapiens
catccatagcctcaataaatag

SEQ ID NO: 8426273 - DNA, 22 bp, Homo sapiens
catccctgacttctaggtgaca

SEQ ID NO: 8426274 - DNA, 22 bp, Homo sapiens
catccattcattaattctaaag

SEQ ID NO: 8426275 - DNA, 22 bp, Homo sapiens
catccattcagtgcaaatcaca

SEQ ID NO: 8426276 - DNA, 22 bp, Homo sapiens
catccattaactcatttgtttc

SEQ ID NO: 8426277 - DNA, 22 bp, Homo sapiens
catccctgtcgtcaagtctctg

SEQ ID NO: 8426278 - DNA, 22 bp, Homo sapiens
catccctggttcctgtgtttaa

SEQ ID NO: 8426279 - DNA, 22 bp, Homo sapiens
catccctgccctcatgcctata

SEQ ID NO: 8426280 - DNA, 22 bp, Homo sapiens
catctttgaactctgtataaac

SEQ ID NO: 8426281 - DNA, 22 bp, Homo sapiens
catctttgagacagcattaccc

SEQ ID NO: 8426282 - DNA, 22 bp, Homo sapiens
catctttagtaggttctggaga

SEQ ID NO: 8426283 - DNA, 22 bp, Homo sapiens
catctttagttattgaatatag

SEQ ID NO: 8426284 - DNA, 22 bp, Homo sapiens
catctttagttattgaatatag

SEQ ID NO: 8426285 - DNA, 22 bp, Homo sapiens
catctttaatttgtgacaacta

SEQ ID NO: 8426286 - DNA, 22 bp, Homo sapiens
catctttgcaccctcaaaacct

SEQ ID NO: 8426287 - DNA, 22 bp, Homo sapiens
catctttgccatatgatgtaat

SEQ ID NO: 8426288 - DNA, 22 bp, Homo sapiens
tcagtttaagatgactaacaat

SEQ ID NO: 8426289 - DNA, 22 bp, Homo sapiens
catgagttttttagttcatgca

SEQ ID NO: 8426290 - DNA, 22 bp, Homo sapiens
tcagtttagagttatttaatct

SEQ ID NO: 8426291 - DNA, 22 bp, Homo sapiens
catgataattgttaacaaagta

SEQ ID NO: 8426292 - DNA, 22 bp, Homo sapiens
catgataattgttaacaaagta

SEQ ID NO: 8426293 - DNA, 18 bp, Homo sapiens
tcatgtctcacaggtgat

SEQ ID NO: 8426294 - DNA, 22 bp, Homo sapiens
tcatggggctcttcaagtggag

SEQ ID NO: 8426295 - DNA, 22 bp, Homo sapiens
tcatggggccacagctgccagc

SEQ ID NO: 8426296 - DNA, 22 bp, Homo sapiens
tcatggggtgacagaagggagg

SEQ ID NO: 8426297 - DNA, 22 bp, Homo sapiens
tcatgtaaagtgtaggtttaga

SEQ ID NO: 8426298 - DNA, 22 bp, Homo sapiens
tcatgtattgaaaagcatttta

SEQ ID NO: 8426299 - DNA, 19 bp, Homo sapiens
catgtgcatgagcacagga

SEQ ID NO: 8426300 - DNA, 19 bp, Homo sapiens
catgtgcatgagcacagga

SEQ ID NO: 8426301 - DNA, 19 bp, Homo sapiens
catgtgcatgagcacagga

SEQ ID NO: 8426302 - DNA, 22 bp, Homo sapiens
tccaggcaaagtgctgggctgc

SEQ ID NO: 8426303 - DNA, 22 bp, Homo sapiens
tccaggcaaagtgctgggctgc

SEQ ID NO: 8426304 - DNA, 22 bp, Homo sapiens
catgtgcagacggtgggctgga

SEQ ID NO: 8426305 - DNA, 22 bp, Homo sapiens
catgtgcatccttaatctccct

SEQ ID NO: 8426306 - DNA, 22 bp, Homo sapiens
catgtgaattccaaagctaggt

SEQ ID NO: 8426307 - DNA, 22 bp, Homo sapiens
tccagccacttgcacagttaaa

SEQ ID NO: 8426308 - DNA, 22 bp, Homo sapiens
catggcttttagccctacatga

SEQ ID NO: 8426309 - DNA, 22 bp, Homo sapiens
tccagccaggatggcccaggga

SEQ ID NO: 8426310 - DNA, 22 bp, Homo sapiens
tccagccaggatggcccaggga

SEQ ID NO: 8426311 - DNA, 22 bp, Homo sapiens
tccagccaggatggcccaggga

SEQ ID NO: 8426312 - DNA, 22 bp, Homo sapiens
tccagccacttgcacagttaaa

SEQ ID NO: 8426313 - DNA, 22 bp, Homo sapiens
tccagccatgcatgacaatcac

SEQ ID NO: 8426314 - DNA, 22 bp, Homo sapiens
tccagccattcattatgacacc

SEQ ID NO: 8426315 - DNA, 22 bp, Homo sapiens
tccagcccacacctgaagctgg

SEQ ID NO: 8426316 - DNA, 22 bp, Homo sapiens
tccagccatgcatgacaatcac

SEQ ID NO: 8426317 - DNA, 21 bp, Homo sapiens
tccagccagtaaatgctcagc

SEQ ID NO: 8426318 - DNA, 22 bp, Homo sapiens
tccagccatatcttgtagccct

SEQ ID NO: 8426319 - DNA, 22 bp, Homo sapiens
tccagccatgactcggacagtg

SEQ ID NO: 8426320 - DNA, 18 bp, Homo sapiens
tccagcccacattttctg

SEQ ID NO: 8426321 - DNA, 20 bp, Homo sapiens
tccagcccagcagcctgaca

SEQ ID NO: 8426322 - DNA, 20 bp, Homo sapiens
tccagcccagcagcctgaca

SEQ ID NO: 8426323 - DNA, 22 bp, Homo sapiens
catgtacatgcctactatcaat

SEQ ID NO: 8426324 - DNA, 18 bp, Homo sapiens
catgtctgcgccacaagg

SEQ ID NO: 8426325 - DNA, 22 bp, Homo sapiens
catggccaggcacgcgcatagc

SEQ ID NO: 8426326 - DNA, 23 bp, Homo sapiens
catggctgatttcaagctaccac

SEQ ID NO: 8426327 - DNA, 22 bp, Homo sapiens
catggcttctaagtgataacgt

SEQ ID NO: 8426328 - DNA, 20 bp, Homo sapiens
catggctgtgagcccacagg

SEQ ID NO: 8426329 - DNA, 20 bp, Homo sapiens
catggctgtgagcccacagg

SEQ ID NO: 8426330 - DNA, 22 bp, Homo sapiens
catggctggccagtgggagtgg

SEQ ID NO: 8426331 - DNA, 22 bp, Homo sapiens
catgcaaaggtcaagatcagga

SEQ ID NO: 8426332 - DNA, 22 bp, Homo sapiens
catgcaaagcgttttgaccagc

SEQ ID NO: 8426333 - DNA, 23 bp, Homo sapiens
catgcaaacactattgcatttgg

SEQ ID NO: 8426334 - DNA, 23 bp, Homo sapiens
catgcaaacactattgcatttgg

SEQ ID NO: 8426335 - DNA, 20 bp, Homo sapiens
catgcaacagattatttccc

SEQ ID NO: 8426336 - DNA, 22 bp, Homo sapiens
catgcaaatggtggctaaatgg

SEQ ID NO: 8426337 - DNA, 22 bp, Homo sapiens
catgcaaatggtggctaaatgg

SEQ ID NO: 8426338 - DNA, 22 bp, Homo sapiens
catgatttactaaaatttgttt

SEQ ID NO: 8426339 - DNA, 22 bp, Homo sapiens
catgcaaaatgtattttattag

SEQ ID NO: 8426340 - DNA, 22 bp, Homo sapiens
catgcaaacacgtaaacattca

SEQ ID NO: 8426341 - DNA, 22 bp, Homo sapiens
catatattctggttttcactgg

SEQ ID NO: 8426342 - DNA, 22 bp, Homo sapiens
catatattatggactgcagaat

SEQ ID NO: 8426343 - DNA, 22 bp, Homo sapiens
catatatctacctgcaattgca

SEQ ID NO: 8426344 - DNA, 20 bp, Homo sapiens
catatatacctagaagtgga

SEQ ID NO: 8426345 - DNA, 20 bp, Homo sapiens
catatatacctagaagtgga

SEQ ID NO: 8426346 - DNA, 22 bp, Homo sapiens
catatctggagactcctggtct

SEQ ID NO: 8426347 - DNA, 22 bp, Homo sapiens
catatctcctccagcacaggcc

SEQ ID NO: 8426348 - DNA, 22 bp, Homo sapiens
catatccaatatgactagtgtt

SEQ ID NO: 8426349 - DNA, 22 bp, Homo sapiens
catatccaggtttctttggttt

SEQ ID NO: 8426350 - DNA, 22 bp, Homo sapiens
catatcatttgcttataaatct

SEQ ID NO: 8426351 - DNA, 15 bp, Homo sapiens
catatcactgggaat

SEQ ID NO: 8426352 - DNA, 22 bp, Homo sapiens
catatattctggttttcactgg

SEQ ID NO: 8426353 - DNA, 22 bp, Homo sapiens
catagacaaagatcagaagagt

SEQ ID NO: 8426354 - DNA, 19 bp, Homo sapiens
tcaggaagttgatgaggtg

SEQ ID NO: 8426355 - DNA, 22 bp, Homo sapiens
tcaggaagtgcctaggctggcc

SEQ ID NO: 8426356 - DNA, 22 bp, Homo sapiens
tcaggaagtgctgaggctgctt

SEQ ID NO: 8426357 - DNA, 22 bp, Homo sapiens
tcaggaagtgctgaggctgctt

SEQ ID NO: 8426358 - DNA, 22 bp, Homo sapiens
tcaggaagtctcaattagctac

SEQ ID NO: 8426359 - DNA, 22 bp, Homo sapiens
tcaggaagtgcctaggctggcc

SEQ ID NO: 8426360 - DNA, 22 bp, Homo sapiens
tcaggaagtgcctaggctggcc

SEQ ID NO: 8426361 - DNA, 22 bp, Homo sapiens
tcaggaagtgcctaggctggcc

SEQ ID NO: 8426362 - DNA, 22 bp, Homo sapiens
tcaggaagtggtaaaggatgtt

SEQ ID NO: 8426363 - DNA, 22 bp, Homo sapiens
tcaggaagttgaggcgtagaga

SEQ ID NO: 8426364 - DNA, 22 bp, Homo sapiens
tcaggaagttgaggcgtagaga

SEQ ID NO: 8426365 - DNA, 22 bp, Homo sapiens
tcaggaagtggtaaaggatgtt

SEQ ID NO: 8426366 - DNA, 22 bp, Homo sapiens
tcaggaagtggtaaaggatgtt

SEQ ID NO: 8426367 - DNA, 22 bp, Homo sapiens
tcaggaagtggtaaaggatgtt

SEQ ID NO: 8426368 - DNA, 22 bp, Homo sapiens
catcacatcaaacctactctca

SEQ ID NO: 8426369 - DNA, 22 bp, Homo sapiens
catcacatcagtgtgaacagtt

SEQ ID NO: 8426370 - DNA, 22 bp, Homo sapiens
catcacatgtaggcagcatcac

SEQ ID NO: 8426371 - DNA, 22 bp, Homo sapiens
catcatctctggcccttgaagt

SEQ ID NO: 8426372 - DNA, 22 bp, Homo sapiens
catccaggcaccacaaccagct

SEQ ID NO: 8426373 - DNA, 22 bp, Homo sapiens
catccaggctgaagtgcagtgg

SEQ ID NO: 8426374 - DNA, 23 bp, Homo sapiens
catccaggagctgagtctgactg

SEQ ID NO: 8426375 - DNA, 22 bp, Homo sapiens
catccagggcagccatggcctg

SEQ ID NO: 8426376 - DNA, 22 bp, Homo sapiens
catccagggcagccatggcctg

SEQ ID NO: 8426377 - DNA, 22 bp, Homo sapiens
catccagggcagccatggcctg

SEQ ID NO: 8426378 - DNA, 22 bp, Homo sapiens
catccaggctggagtacagtgg

SEQ ID NO: 8426379 - DNA, 22 bp, Homo sapiens
catccagtgggacagagaaacc

SEQ ID NO: 8426380 - DNA, 22 bp, Homo sapiens
catcatctgtgctggagagcct

SEQ ID NO: 8426381 - DNA, 22 bp, Homo sapiens
catcatctggcttttagaaaaa

SEQ ID NO: 8426382 - DNA, 22 bp, Homo sapiens
catccagagtccaaggctgggc

SEQ ID NO: 8426383 - DNA, 22 bp, Homo sapiens
tcagggattgcaaaattcatcc

SEQ ID NO: 8426384 - DNA, 22 bp, Homo sapiens
catcacagaaataaacatacct

SEQ ID NO: 8426385 - DNA, 22 bp, Homo sapiens
tcagggcccagtctgtgcatct

SEQ ID NO: 8426386 - DNA, 19 bp, Homo sapiens
tcagggccatgagcgccac

SEQ ID NO: 8426387 - DNA, 22 bp, Homo sapiens
tcagggcccagagctcaggcaa

SEQ ID NO: 8426388 - DNA, 22 bp, Homo sapiens
tcagggccatcttttgcctcaa

SEQ ID NO: 8426389 - DNA, 22 bp, Homo sapiens
tcagggccacgcggaggtgacg

SEQ ID NO: 8426390 - DNA, 22 bp, Homo sapiens
catacattacctaacttaatgc

SEQ ID NO: 8426391 - DNA, 22 bp, Homo sapiens
tcagctgcagtttcacaagcac

SEQ ID NO: 8426392 - DNA, 22 bp, Homo sapiens
catacatttatacacatctatg

SEQ ID NO: 8426393 - DNA, 22 bp, Homo sapiens
catactgtaagtgcaaaagtgt

SEQ ID NO: 8426394 - DNA, 22 bp, Homo sapiens
catagaaaagagtaggtaatgt

SEQ ID NO: 8426395 - DNA, 22 bp, Homo sapiens
catagaaaagagtaggtaatgt

SEQ ID NO: 8426396 - DNA, 22 bp, Homo sapiens
tcagccctgggcttcctcatgg

SEQ ID NO: 8426397 - DNA, 22 bp, Homo sapiens
tcagctcttaaccctctggcct

SEQ ID NO: 8426398 - DNA, 22 bp, Homo sapiens
tcagctcttaaccctctggcct

SEQ ID NO: 8426399 - DNA, 22 bp, Homo sapiens
tcagctcttaaccctctggcct

SEQ ID NO: 8426400 - DNA, 22 bp, Homo sapiens
tcagctgaagtggagaagcaga

SEQ ID NO: 8426401 - DNA, 22 bp, Homo sapiens
tcagccctgggacccagggatg

SEQ ID NO: 8426402 - DNA, 22 bp, Homo sapiens
cagtttctgtggtctcttttca

SEQ ID NO: 8426403 - DNA, 22 bp, Homo sapiens
tcagaagtctggactgcttctc

SEQ ID NO: 8426404 - DNA, 22 bp, Homo sapiens
tcagaagtccaattttcgcacc

SEQ ID NO: 8426405 - DNA, 22 bp, Homo sapiens
tcagaagtccccagtcaaggag

SEQ ID NO: 8426406 - DNA, 22 bp, Homo sapiens
tcagaagtccaataccatggga

SEQ ID NO: 8426407 - DNA, 22 bp, Homo sapiens
tcagaagtaggagacattcttg

SEQ ID NO: 8426408 - DNA, 22 bp, Homo sapiens
tcagaagtcacttaggaaaggg

SEQ ID NO: 8426409 - DNA, 22 bp, Homo sapiens
tcagaagtattatgctaaagga

SEQ ID NO: 8426410 - DNA, 22 bp, Homo sapiens
tcagaagtattatgctaaagga

SEQ ID NO: 8426411 - DNA, 22 bp, Homo sapiens
tcagaagtcatgctcagtctgt

SEQ ID NO: 8426412 - DNA, 22 bp, Homo sapiens
tcagaagtcacttaggaaaggg

SEQ ID NO: 8426413 - DNA, 22 bp, Homo sapiens
tcagaagtccaataccatggga

SEQ ID NO: 8426414 - DNA, 22 bp, Homo sapiens
tcagaagtaaggttctcccaag

SEQ ID NO: 8426415 - DNA, 22 bp, Homo sapiens
tcagaagtactgtgctacaata

SEQ ID NO: 8426416 - DNA, 22 bp, Homo sapiens
tcagcagtggctctcatgcagt

SEQ ID NO: 8426417 - DNA, 22 bp, Homo sapiens
cagtttctgttttaaatagcag

SEQ ID NO: 8426418 - DNA, 22 bp, Homo sapiens
cagtttcttagtgacacaaatc

SEQ ID NO: 8426419 - DNA, 22 bp, Homo sapiens
cagtttcttcatcagttaagca

SEQ ID NO: 8426420 - DNA, 22 bp, Homo sapiens
catttagttttgcagtagcagg

SEQ ID NO: 8426421 - DNA, 22 bp, Homo sapiens
catttagaagtcttagaactat

SEQ ID NO: 8426422 - DNA, 22 bp, Homo sapiens
catttagagaagattacaagga

SEQ ID NO: 8426423 - DNA, 22 bp, Homo sapiens
catttagagaagattacaagga

SEQ ID NO: 8426424 - DNA, 22 bp, Homo sapiens
catttagagaagattacaagga

SEQ ID NO: 8426425 - DNA, 22 bp, Homo sapiens
catttagagaagattacaagga

SEQ ID NO: 8426426 - DNA, 22 bp, Homo sapiens
tccaggcacagagttggtcagt

SEQ ID NO: 8426427 - DNA, 17 bp, Homo sapiens
tccaggcagcaactgag

SEQ ID NO: 8426428 - DNA, 22 bp, Homo sapiens
catttacacttctaaccacaag

SEQ ID NO: 8426429 - DNA, 22 bp, Homo sapiens
tcccagggcactcaccctccct

SEQ ID NO: 8426430 - DNA, 22 bp, Homo sapiens
tcccagggcagctgtccagaag

SEQ ID NO: 8426431 - DNA, 21 bp, Homo sapiens
tcccagggccaggtgccatca

SEQ ID NO: 8426432 - DNA, 22 bp, Homo sapiens
catttatataaaatgtccagaa

SEQ ID NO: 8426433 - DNA, 22 bp, Homo sapiens
catttattagttagttcgatgt

SEQ ID NO: 8426434 - DNA, 22 bp, Homo sapiens
tcccagggggatgaacactgcc

SEQ ID NO: 8426435 - DNA, 22 bp, Homo sapiens
tcccagggtatcctgtagtaaa

SEQ ID NO: 8426436 - DNA, 22 bp, Homo sapiens
tcccagggtcagtggtgaggcc

SEQ ID NO: 8426437 - DNA, 22 bp, Homo sapiens
tcccagggccgcaaacgagttt

SEQ ID NO: 8426438 - DNA, 22 bp, Homo sapiens
tcccagggctctagagtgctgg

SEQ ID NO: 8426439 - DNA, 22 bp, Homo sapiens
tcccagggcttttctcatgctt

SEQ ID NO: 8426440 - DNA, 22 bp, Homo sapiens
catttgcagagggtgacactct

SEQ ID NO: 8426441 - DNA, 22 bp, Homo sapiens
catttgcaagagataaatgttt

SEQ ID NO: 8426442 - DNA, 22 bp, Homo sapiens
catttgcaaaccaacaagatga

SEQ ID NO: 8426443 - DNA, 22 bp, Homo sapiens
catttgcaaaccaacaagatga

SEQ ID NO: 8426444 - DNA, 22 bp, Homo sapiens
catttgcatatgaagaagtaag

SEQ ID NO: 8426445 - DNA, 22 bp, Homo sapiens
catttgctgaggccttcagagg

SEQ ID NO: 8426446 - DNA, 17 bp, Homo sapiens
catttgctggttggctc

SEQ ID NO: 8426447 - DNA, 22 bp, Homo sapiens
catttgctgtattttcagattc

SEQ ID NO: 8426448 - DNA, 22 bp, Homo sapiens
catttgaactaataactgtgct

SEQ ID NO: 8426449 - DNA, 22 bp, Homo sapiens
catttgaagacttagaagagga

SEQ ID NO: 8426450 - DNA, 22 bp, Homo sapiens
catttgaacctggatgttctta

SEQ ID NO: 8426451 - DNA, 22 bp, Homo sapiens
catttgaatggcatttcacttt

SEQ ID NO: 8426452 - DNA, 22 bp, Homo sapiens
catttgattactaaagataatt

SEQ ID NO: 8426453 - DNA, 22 bp, Homo sapiens
ccaaaggtgttggccttcagtg

SEQ ID NO: 8426454 - DNA, 22 bp, Homo sapiens
ccaaagtattaaatcttagcaa

SEQ ID NO: 8426455 - DNA, 22 bp, Homo sapiens
ccaaagtccatagtttacataa

SEQ ID NO: 8426456 - DNA, 22 bp, Homo sapiens
ccaaagtccacagtttacatta

SEQ ID NO: 8426457 - DNA, 22 bp, Homo sapiens
ccaaagtccatagtttacttta

SEQ ID NO: 8426458 - DNA, 22 bp, Homo sapiens
ccaaagtccatagtttacatta

SEQ ID NO: 8426459 - DNA, 19 bp, Homo sapiens
ccaaaagcaattccaagta

SEQ ID NO: 8426460 - DNA, 19 bp, Homo sapiens
ccaaaagcaattccaagta

SEQ ID NO: 8426461 - DNA, 22 bp, Homo sapiens
ccaaaagcagctgtctgtgaat

SEQ ID NO: 8426462 - DNA, 23 bp, Homo sapiens
ccaaaagcgagtctgttgttccc

SEQ ID NO: 8426463 - DNA, 22 bp, Homo sapiens
tccctgcttgctctcagccctt

SEQ ID NO: 8426464 - DNA, 22 bp, Homo sapiens
tccctgcttggaatgaccctta

SEQ ID NO: 8426465 - DNA, 22 bp, Homo sapiens
tccctgctgagagtgctctccc

SEQ ID NO: 8426466 - DNA, 22 bp, Homo sapiens
tccctgctgcactcacacctac

SEQ ID NO: 8426467 - DNA, 22 bp, Homo sapiens
tccctgctgagagtgctctccc

SEQ ID NO: 8426468 - DNA, 22 bp, Homo sapiens
ccaaataatatttcagaaccat

SEQ ID NO: 8426469 - DNA, 22 bp, Homo sapiens
tcctcccaacttttccatctca

SEQ ID NO: 8426470 - DNA, 22 bp, Homo sapiens
tcctccccaaagcccagcctgg

SEQ ID NO: 8426471 - DNA, 22 bp, Homo sapiens
tcctccccaaagcccagcctgg

SEQ ID NO: 8426472 - DNA, 22 bp, Homo sapiens
tcctccccaaagcccagcctgg

SEQ ID NO: 8426473 - DNA, 22 bp, Homo sapiens
tcctccccaaagcccagcctgg

SEQ ID NO: 8426474 - DNA, 20 bp, Homo sapiens
tcctcccccacctttgcagc

SEQ ID NO: 8426475 - DNA, 20 bp, Homo sapiens
ccacaagggaatattgttga

SEQ ID NO: 8426476 - DNA, 22 bp, Homo sapiens
ccacaagtgaagtacacctgcc

SEQ ID NO: 8426477 - DNA, 22 bp, Homo sapiens
ccacaattttatgatttaggag

SEQ ID NO: 8426478 - DNA, 21 bp, Homo sapiens
ccacaattctagttacatatg

SEQ ID NO: 8426479 - DNA, 22 bp, Homo sapiens
tcctgcagttacatcccagcca

SEQ ID NO: 8426480 - DNA, 22 bp, Homo sapiens
tcctgcagtgtgtctcctgcac

SEQ ID NO: 8426481 - DNA, 19 bp, Homo sapiens
ccacaaaattattttagtt

SEQ ID NO: 8426482 - DNA, 19 bp, Homo sapiens
ccacaaaattattttagtt

SEQ ID NO: 8426483 - DNA, 22 bp, Homo sapiens
ccacaaaactgtgtgtcaaaga

SEQ ID NO: 8426484 - DNA, 22 bp, Homo sapiens
ccacaaaactgtgtgtcaaaga

SEQ ID NO: 8426485 - DNA, 20 bp, Homo sapiens
tcctgcagttcctaggaggg

SEQ ID NO: 8426486 - DNA, 22 bp, Homo sapiens
tcctgccacctgcacagctccc

SEQ ID NO: 8426487 - DNA, 22 bp, Homo sapiens
tcctgccagctggggctgcttc

SEQ ID NO: 8426488 - DNA, 22 bp, Homo sapiens
tcctgccaggagtgctggccct

SEQ ID NO: 8426489 - DNA, 22 bp, Homo sapiens
ccacagaggacaactgcctggc

SEQ ID NO: 8426490 - DNA, 20 bp, Homo sapiens
ccacagaggacagggctgtg

SEQ ID NO: 8426491 - DNA, 22 bp, Homo sapiens
ccacagagtcttccttctcttc

SEQ ID NO: 8426492 - DNA, 22 bp, Homo sapiens
ccacagagtcttccttctcttc

SEQ ID NO: 8426493 - DNA, 22 bp, Homo sapiens
ccacagaatcgctagtggagca

SEQ ID NO: 8426494 - DNA, 22 bp, Homo sapiens
ccacagaagatggggagagtgg

SEQ ID NO: 8426495 - DNA, 19 bp, Homo sapiens
tcctgcccaccagccaggg

SEQ ID NO: 8426496 - DNA, 22 bp, Homo sapiens
ccacagaggacaactgcctggc

SEQ ID NO: 8426497 - DNA, 22 bp, Homo sapiens
ccacagcaggactggagccgcc

SEQ ID NO: 8426498 - DNA, 22 bp, Homo sapiens
ccacagcatgcaggcctgacac

SEQ ID NO: 8426499 - DNA, 22 bp, Homo sapiens
ccacagcaccgctgccagtccc

SEQ ID NO: 8426500 - DNA, 22 bp, Homo sapiens
ccacagcacctgcagccagttg

SEQ ID NO: 8426501 - DNA, 22 bp, Homo sapiens
ccacagcacctgcagccagttg

SEQ ID NO: 8426502 - DNA, 22 bp, Homo sapiens
ccacagctagggcaatctgatt

SEQ ID NO: 8426503 - DNA, 17 bp, Homo sapiens
ccacagcctggcacttg

SEQ ID NO: 8426504 - DNA, 17 bp, Homo sapiens
ccacagcctggcacttg

SEQ ID NO: 8426505 - DNA, 22 bp, Homo sapiens
ccacagctgaaagcagaggctc

SEQ ID NO: 8426506 - DNA, 22 bp, Homo sapiens
ccacagctgaaagcagaggctc

SEQ ID NO: 8426507 - DNA, 23 bp, Homo sapiens
ccacagctatagggtagtgcagt

SEQ ID NO: 8426508 - DNA, 23 bp, Homo sapiens
ccacagctatagggtagtgcagt

SEQ ID NO: 8426509 - DNA, 22 bp, Homo sapiens
ccacagctagggcaatctgatt

SEQ ID NO: 8426510 - DNA, 19 bp, Homo sapiens
ccagagttggcagagcagg

SEQ ID NO: 8426511 - DNA, 22 bp, Homo sapiens
ccagaggtgccacagaaagagc

SEQ ID NO: 8426512 - DNA, 22 bp, Homo sapiens
ccagatctaagtccaaagtact

SEQ ID NO: 8426513 - DNA, 17 bp, Homo sapiens
ccagatgccctgtctcc

SEQ ID NO: 8426514 - DNA, 22 bp, Homo sapiens
tctctagagcatgtgctgggca

SEQ ID NO: 8426515 - DNA, 22 bp, Homo sapiens
tctctagacatggggaatgtca

SEQ ID NO: 8426516 - DNA, 19 bp, Homo sapiens
ccagaggactgttaatgaa

SEQ ID NO: 8426517 - DNA, 19 bp, Homo sapiens
tctctacactacatttcta

SEQ ID NO: 8426518 - DNA, 22 bp, Homo sapiens
tctctacataacctcaatactc

SEQ ID NO: 8426519 - DNA, 22 bp, Homo sapiens
ccagaggacttgggggctgaat

SEQ ID NO: 8426520 - DNA, 22 bp, Homo sapiens
ccagaggacttgggggctgaat

SEQ ID NO: 8426521 - DNA, 22 bp, Homo sapiens
ccagaggagatgcctcctctgt

SEQ ID NO: 8426522 - DNA, 22 bp, Homo sapiens
ccagaggagcatggccttgaga

SEQ ID NO: 8426523 - DNA, 22 bp, Homo sapiens
ccagaggagcaggctggctcca

SEQ ID NO: 8426524 - DNA, 22 bp, Homo sapiens
ccagaggagggctctgatgagg

SEQ ID NO: 8426525 - DNA, 22 bp, Homo sapiens
ccagaggagcaggctggctcca

SEQ ID NO: 8426526 - DNA, 22 bp, Homo sapiens
ccagaggagggctctgatgagg

SEQ ID NO: 8426527 - DNA, 22 bp, Homo sapiens
ccagaggagggctctgatgagg

SEQ ID NO: 8426528 - DNA, 22 bp, Homo sapiens
ccagaggagttgaggctttggg

SEQ ID NO: 8426529 - DNA, 22 bp, Homo sapiens
ccagaggtgagggggattcttg

SEQ ID NO: 8426530 - DNA, 22 bp, Homo sapiens
ccagagcttcggggcggctgta

SEQ ID NO: 8426531 - DNA, 22 bp, Homo sapiens
ccagagcttgacgtgcaacgga

SEQ ID NO: 8426532 - DNA, 22 bp, Homo sapiens
ccagagcttgacgtgcaacgga

SEQ ID NO: 8426533 - DNA, 18 bp, Homo sapiens
ccagagctggctcctcgc

SEQ ID NO: 8426534 - DNA, 18 bp, Homo sapiens
ccagagctggctcctcgc

SEQ ID NO: 8426535 - DNA, 22 bp, Homo sapiens
ccagagctgcatccagcaggtt

SEQ ID NO: 8426536 - DNA, 22 bp, Homo sapiens
ccagagctgcaggtaaaatgct

SEQ ID NO: 8426537 - DNA, 22 bp, Homo sapiens
ccagagcctgctgagccccatt

SEQ ID NO: 8426538 - DNA, 22 bp, Homo sapiens
ccagagctgatgggcccagggt

SEQ ID NO: 8426539 - DNA, 22 bp, Homo sapiens
ccagagctgatgggcccagggt

SEQ ID NO: 8426540 - DNA, 22 bp, Homo sapiens
ccagagctgatgggcccagggt

SEQ ID NO: 8426541 - DNA, 20 bp, Homo sapiens
ccagacagcacctgcctggt

SEQ ID NO: 8426542 - DNA, 22 bp, Homo sapiens
ccagaataggagtaataaaacc

SEQ ID NO: 8426543 - DNA, 22 bp, Homo sapiens
tctctaaatacagatgtcatgg

SEQ ID NO: 8426544 - DNA, 22 bp, Homo sapiens
tctctaaatgattgtgtactcc

SEQ ID NO: 8426545 - DNA, 22 bp, Homo sapiens
tctctaaatgattgtgtactcc

SEQ ID NO: 8426546 - DNA, 22 bp, Homo sapiens
tctctaaatctggttcacttgc

SEQ ID NO: 8426547 - DNA, 22 bp, Homo sapiens
tctcctgggaggacaaggaagg

SEQ ID NO: 8426548 - DNA, 22 bp, Homo sapiens
tctcctgggaggacaaggaagg

SEQ ID NO: 8426549 - DNA, 22 bp, Homo sapiens
tctcctgggaggacaaggaagg

SEQ ID NO: 8426550 - DNA, 19 bp, Homo sapiens
tctccagttgctttcaggg

SEQ ID NO: 8426551 - DNA, 19 bp, Homo sapiens
tctccagttgctttcaggg

SEQ ID NO: 8426552 - DNA, 19 bp, Homo sapiens
tctccagtttattcttcca

SEQ ID NO: 8426553 - DNA, 19 bp, Homo sapiens
tctccagtttattcttcca

SEQ ID NO: 8426554 - DNA, 22 bp, Homo sapiens
tctccataggcagttcataaca

SEQ ID NO: 8426555 - DNA, 22 bp, Homo sapiens
tctccatacttgcctttggcct

SEQ ID NO: 8426556 - DNA, 22 bp, Homo sapiens
tctccagtctcaagacattgag

SEQ ID NO: 8426557 - DNA, 22 bp, Homo sapiens
tctccagtctcaagacattgag

SEQ ID NO: 8426558 - DNA, 22 bp, Homo sapiens
tctccagtctcaagacattgag

SEQ ID NO: 8426559 - DNA, 22 bp, Homo sapiens
tctccagtcccttctctgttag

SEQ ID NO: 8426560 - DNA, 23 bp, Homo sapiens
tctccagtgtctcttcattgagt

SEQ ID NO: 8426561 - DNA, 23 bp, Homo sapiens
tctccagtgtctcttcattgagt

SEQ ID NO: 8426562 - DNA, 21 bp, Homo sapiens
tctccagttgacagtgtctcc

SEQ ID NO: 8426563 - DNA, 21 bp, Homo sapiens
tctccagttgacagtgtctcc

SEQ ID NO: 8426564 - DNA, 22 bp, Homo sapiens
tctccagtgaatctcctcctgg

SEQ ID NO: 8426565 - DNA, 21 bp, Homo sapiens
tctccagtgcttctgcctctt

SEQ ID NO: 8426566 - DNA, 22 bp, Homo sapiens
tctccagtatctttccaatgaa

SEQ ID NO: 8426567 - DNA, 22 bp, Homo sapiens
tctccagtatctttccaatgaa

SEQ ID NO: 8426568 - DNA, 19 bp, Homo sapiens
ccagaggactgttaatgaa

SEQ ID NO: 8426569 - DNA, 22 bp, Homo sapiens
ccagaggaaaaatatctcccta

SEQ ID NO: 8426570 - DNA, 22 bp, Homo sapiens
ccacagtacaggaaatcttgtt

SEQ ID NO: 8426571 - DNA, 22 bp, Homo sapiens
ccacagtaaagaaacaacttcg

SEQ ID NO: 8426572 - DNA, 22 bp, Homo sapiens
tcctggtggatagaagccaagg

SEQ ID NO: 8426573 - DNA, 22 bp, Homo sapiens
tcctggtgctgacacccatagc

SEQ ID NO: 8426574 - DNA, 22 bp, Homo sapiens
tcctggtctacactgcattggg

SEQ ID NO: 8426575 - DNA, 22 bp, Homo sapiens
tcctggtctacactgcattggg

SEQ ID NO: 8426576 - DNA, 22 bp, Homo sapiens
tcctggtcagtgccaaactggt

SEQ ID NO: 8426577 - DNA, 22 bp, Homo sapiens
tcctggggagggttctggctcc

SEQ ID NO: 8426578 - DNA, 22 bp, Homo sapiens
ccacagtagaattcatctccct

SEQ ID NO: 8426579 - DNA, 22 bp, Homo sapiens
ccacagtagaattcatctccct

SEQ ID NO: 8426580 - DNA, 22 bp, Homo sapiens
ccacagtagcatccaaacagta

SEQ ID NO: 8426581 - DNA, 22 bp, Homo sapiens
ccacagtgagttctgtactctg

SEQ ID NO: 8426582 - DNA, 22 bp, Homo sapiens
ccactctgattttggctccact

SEQ ID NO: 8426583 - DNA, 22 bp, Homo sapiens
ccactgagaaggggttggggtc

SEQ ID NO: 8426584 - DNA, 22 bp, Homo sapiens
ccactgccagccgcccggaggc

SEQ ID NO: 8426585 - DNA, 22 bp, Homo sapiens
ccactgcacttcagcctgggtg

SEQ ID NO: 8426586 - DNA, 22 bp, Homo sapiens
ccactgcactccagccttggca

SEQ ID NO: 8426587 - DNA, 22 bp, Homo sapiens
ccactgagtgagcagagcaggg

SEQ ID NO: 8426588 - DNA, 22 bp, Homo sapiens
ccactgagtacccgatggctgc

SEQ ID NO: 8426589 - DNA, 22 bp, Homo sapiens
ccactgagtacccgatggctgc

SEQ ID NO: 8426590 - DNA, 22 bp, Homo sapiens
ccactgagcagtagctgcgtcg

SEQ ID NO: 8426591 - DNA, 22 bp, Homo sapiens
ccactgaggggtcatggtggga

SEQ ID NO: 8426592 - DNA, 22 bp, Homo sapiens
ccactgaggttttgtggttatg

SEQ ID NO: 8426593 - DNA, 22 bp, Homo sapiens
ccactgaggcctgggcccaggg

SEQ ID NO: 8426594 - DNA, 22 bp, Homo sapiens
ccactgcctatttgcagggccc

SEQ ID NO: 8426595 - DNA, 22 bp, Homo sapiens
ccagaaaactctacatgcttgt

SEQ ID NO: 8426596 - DNA, 22 bp, Homo sapiens
ccactgccatgggctaggcatg

SEQ ID NO: 8426597 - DNA, 22 bp, Homo sapiens
ccactgcccaccccgacgtcta

SEQ ID NO: 8426598 - DNA, 22 bp, Homo sapiens
ccagaagtcaatgcagatgtga

SEQ ID NO: 8426599 - DNA, 22 bp, Homo sapiens
ccagaatagaatgaaagaaggg

SEQ ID NO: 8426600 - DNA, 22 bp, Homo sapiens
ccagaatagaaggcagctgtca

SEQ ID NO: 8426601 - DNA, 22 bp, Homo sapiens
ccagaagttcctaagcatcatt

SEQ ID NO: 8426602 - DNA, 22 bp, Homo sapiens
ccagaagtgtctatcaagatgt

SEQ ID NO: 8426603 - DNA, 22 bp, Homo sapiens
ccagaagtcaggaatgagtctt

SEQ ID NO: 8426604 - DNA, 22 bp, Homo sapiens
ccagaagtggctttctcaggga

SEQ ID NO: 8426605 - DNA, 22 bp, Homo sapiens
ccagaatcccattgtcacttca

SEQ ID NO: 8426606 - DNA, 23 bp, Homo sapiens
ccagaatctactcattggaatga

SEQ ID NO: 8426607 - DNA, 22 bp, Homo sapiens
ccagaagaggacacagtgtgga

SEQ ID NO: 8426608 - DNA, 22 bp, Homo sapiens
ccagaagatggctcaaaccatg

SEQ ID NO: 8426609 - DNA, 20 bp, Homo sapiens
ccagaagcactcttcatgtt

SEQ ID NO: 8426610 - DNA, 22 bp, Homo sapiens
ccagaagcaaaacagacagttt

SEQ ID NO: 8426611 - DNA, 21 bp, Homo sapiens
ccagaagctgcttgcaggcta

SEQ ID NO: 8426612 - DNA, 22 bp, Homo sapiens
ccagaagcagagcctgaggcag

SEQ ID NO: 8426613 - DNA, 22 bp, Homo sapiens
ccagaagcagagcctgaggcag

SEQ ID NO: 8426614 - DNA, 22 bp, Homo sapiens
tctgaggatctgaagggaacag

SEQ ID NO: 8426615 - DNA, 22 bp, Homo sapiens
tctgaggatagaggcaatagga

SEQ ID NO: 8426616 - DNA, 21 bp, Homo sapiens
tctgaggagaaactcttggtg

SEQ ID NO: 8426617 - DNA, 22 bp, Homo sapiens
tctgaggaccatcggggagctg

SEQ ID NO: 8426618 - DNA, 22 bp, Homo sapiens
tctgaggaccatcggggagctg

SEQ ID NO: 8426619 - DNA, 22 bp, Homo sapiens
tctgagatttgtatggtgagac

SEQ ID NO: 8426620 - DNA, 22 bp, Homo sapiens
tctgaggacctactgaagagtt

SEQ ID NO: 8426621 - DNA, 22 bp, Homo sapiens
tctgaggacagtgctgtgcctg

SEQ ID NO: 8426622 - DNA, 22 bp, Homo sapiens
tctgagagtctttcttcaagtg

SEQ ID NO: 8426623 - DNA, 22 bp, Homo sapiens
ccagccctacagtatcacctgt

SEQ ID NO: 8426624 - DNA, 20 bp, Homo sapiens
tctgagagtctgagtgatga

SEQ ID NO: 8426625 - DNA, 22 bp, Homo sapiens
ccagccctcactgaggcctctc

SEQ ID NO: 8426626 - DNA, 22 bp, Homo sapiens
tctgaggagtgaccctcttgca

SEQ ID NO: 8426627 - DNA, 22 bp, Homo sapiens
tctgaggcccctgggcaggatg

SEQ ID NO: 8426628 - DNA, 22 bp, Homo sapiens
tctgaggcccctgggcaggatg

SEQ ID NO: 8426629 - DNA, 22 bp, Homo sapiens
ccagccatgggccacctagctg

SEQ ID NO: 8426630 - DNA, 22 bp, Homo sapiens
ccagccatgggccacctagctg

SEQ ID NO: 8426631 - DNA, 22 bp, Homo sapiens
ccagcccaaacaagccgccttc

SEQ ID NO: 8426632 - DNA, 22 bp, Homo sapiens
ccagcccaaacaagccgccttc

SEQ ID NO: 8426633 - DNA, 22 bp, Homo sapiens
ccagcccaaacaagccgccttc

SEQ ID NO: 8426634 - DNA, 21 bp, Homo sapiens
ccagcccagcctccttctctt

SEQ ID NO: 8426635 - DNA, 22 bp, Homo sapiens
ccagcccctatcctcgctccac

SEQ ID NO: 8426636 - DNA, 22 bp, Homo sapiens
ccagccccgggaacctggccgt

SEQ ID NO: 8426637 - DNA, 19 bp, Homo sapiens
ccagcccatagtccatcac

SEQ ID NO: 8426638 - DNA, 19 bp, Homo sapiens
ccagcccatagtccatcac

SEQ ID NO: 8426639 - DNA, 19 bp, Homo sapiens
ccagcccatagtccatcac

SEQ ID NO: 8426640 - DNA, 22 bp, Homo sapiens
ccagccccgggaacctggccgt

SEQ ID NO: 8426641 - DNA, 22 bp, Homo sapiens
tctcttaataagtaaatactga

SEQ ID NO: 8426642 - DNA, 22 bp, Homo sapiens
tctcttaataagtaaatactga

SEQ ID NO: 8426643 - DNA, 19 bp, Homo sapiens
tctcttgaataggtcaaac

SEQ ID NO: 8426644 - DNA, 19 bp, Homo sapiens
tctcttgaataggtcaaac

SEQ ID NO: 8426645 - DNA, 22 bp, Homo sapiens
tctcttgggaggaaagagagaa

SEQ ID NO: 8426646 - DNA, 22 bp, Homo sapiens
tctcttgggaggaaagagagaa

SEQ ID NO: 8426647 - DNA, 22 bp, Homo sapiens
tctcttggaggttcttcctgtt

SEQ ID NO: 8426648 - DNA, 22 bp, Homo sapiens
tctcttggaaagcttgcccact

SEQ ID NO: 8426649 - DNA, 22 bp, Homo sapiens
tctcttggacatgtggctctgc

SEQ ID NO: 8426650 - DNA, 22 bp, Homo sapiens
ccagccacgaagctcccttcat

SEQ ID NO: 8426651 - DNA, 22 bp, Homo sapiens
ccagccacgaagctcccttcat

SEQ ID NO: 8426652 - DNA, 22 bp, Homo sapiens
ccagccactgggccactgccag

SEQ ID NO: 8426653 - DNA, 22 bp, Homo sapiens
ccagccagtcccgcatgaccgc

SEQ ID NO: 8426654 - DNA, 22 bp, Homo sapiens
ccagccactgggccactgccag

SEQ ID NO: 8426655 - DNA, 22 bp, Homo sapiens
ccagccagtatattccaaagcc

SEQ ID NO: 8426656 - DNA, 22 bp, Homo sapiens
ccagccagtcccgcatgaccgc

SEQ ID NO: 8426657 - DNA, 22 bp, Homo sapiens
tctcttggggaaagagaagaat

SEQ ID NO: 8426658 - DNA, 22 bp, Homo sapiens
tctgaaataggaaagcaaatgg

SEQ ID NO: 8426659 - DNA, 22 bp, Homo sapiens
tctgaaatatattttgagtgtt

SEQ ID NO: 8426660 - DNA, 22 bp, Homo sapiens
ccagccttcacctgctctggtc

SEQ ID NO: 8426661 - DNA, 22 bp, Homo sapiens
ccagccttctgagctgcctgga

SEQ ID NO: 8426662 - DNA, 22 bp, Homo sapiens
ccagccttgcaccgagccagcc

SEQ ID NO: 8426663 - DNA, 22 bp, Homo sapiens
ccagctcagggtcacatggcac

SEQ ID NO: 8426664 - DNA, 23 bp, Homo sapiens
ccagctcatccattacctctctt

SEQ ID NO: 8426665 - DNA, 22 bp, Homo sapiens
ccagctccactgtcagatgaga

SEQ ID NO: 8426666 - DNA, 21 bp, Homo sapiens
ccagctccaggaccttggatc

SEQ ID NO: 8426667 - DNA, 21 bp, Homo sapiens
ccagctccaggaccttggatc

SEQ ID NO: 8426668 - DNA, 22 bp, Homo sapiens
ccagcctggggaggcagcttct

SEQ ID NO: 8426669 - DNA, 22 bp, Homo sapiens
ccagcctggagggcagtggtgg

SEQ ID NO: 8426670 - DNA, 22 bp, Homo sapiens
ccagcctggagggcagtggtgg

SEQ ID NO: 8426671 - DNA, 22 bp, Homo sapiens
ccagcctggactgggtcttgtg

SEQ ID NO: 8426672 - DNA, 22 bp, Homo sapiens
tctgagtgatgttgagtcagaa

SEQ ID NO: 8426673 - DNA, 22 bp, Homo sapiens
tctgagtgagtgtaggcctgac

SEQ ID NO: 8426674 - DNA, 22 bp, Homo sapiens
ccagctctagccccatgtggct

SEQ ID NO: 8426675 - DNA, 22 bp, Homo sapiens
ccagctctcaaggctccctggg

SEQ ID NO: 8426676 - DNA, 22 bp, Homo sapiens
ccagctcctcttcccagtgtca

SEQ ID NO: 8426677 - DNA, 22 bp, Homo sapiens
ccagctcctcttgtctctagca

SEQ ID NO: 8426678 - DNA, 22 bp, Homo sapiens
ccagctccaggactgggagctg

SEQ ID NO: 8426679 - DNA, 22 bp, Homo sapiens
tctgccagaagttctgagagta

SEQ ID NO: 8426680 - DNA, 22 bp, Homo sapiens
tctgccagaagccagggtctgg

SEQ ID NO: 8426681 - DNA, 22 bp, Homo sapiens
tctgccagaagttctgagagta

SEQ ID NO: 8426682 - DNA, 22 bp, Homo sapiens
tctgccagccctgtgagtcttg

SEQ ID NO: 8426683 - DNA, 21 bp, Homo sapiens
tctgccagctgaagaggtgga

SEQ ID NO: 8426684 - DNA, 22 bp, Homo sapiens
tctgcctcgctaacagcagcca

SEQ ID NO: 8426685 - DNA, 17 bp, Homo sapiens
tctgtcttgactgtcac

SEQ ID NO: 8426686 - DNA, 23 bp, Homo sapiens
tctgtcttgtttaggccactgtt

SEQ ID NO: 8426687 - DNA, 22 bp, Homo sapiens
tctgtcttggccagccatctgg

SEQ ID NO: 8426688 - DNA, 22 bp, Homo sapiens
tctgtcttcttcattgcctata

SEQ ID NO: 8426689 - DNA, 22 bp, Homo sapiens
tctgtcttctgtagctaataat

SEQ ID NO: 8426690 - DNA, 21 bp, Homo sapiens
tctgtcttcctcagcctaagg

SEQ ID NO: 8426691 - DNA, 22 bp, Homo sapiens
tctgtcttagcatctttgctca

SEQ ID NO: 8426692 - DNA, 22 bp, Homo sapiens
tctgtcttagccatctcaggct

SEQ ID NO: 8426693 - DNA, 22 bp, Homo sapiens
tctgtcttagccatctcaggct

SEQ ID NO: 8426694 - DNA, 22 bp, Homo sapiens
tctgtcttcatcagcatgtgat

SEQ ID NO: 8426695 - DNA, 23 bp, Homo sapiens
tctgtctgtgtatgtgcagaaag

SEQ ID NO: 8426696 - DNA, 23 bp, Homo sapiens
tctgtctgtgtatgtgcagaaag

SEQ ID NO: 8426697 - DNA, 17 bp, Homo sapiens
tctgtctgtggtccact

SEQ ID NO: 8426698 - DNA, 22 bp, Homo sapiens
tctgtcatccaggctggaatat

SEQ ID NO: 8426699 - DNA, 18 bp, Homo sapiens
tctgtctgtacaagtatc

SEQ ID NO: 8426700 - DNA, 18 bp, Homo sapiens
tctgtctgtacaagtatc

SEQ ID NO: 8426701 - DNA, 22 bp, Homo sapiens
ccaggaggcagaggttgtagtg

SEQ ID NO: 8426702 - DNA, 22 bp, Homo sapiens
ccaggaggcagaggttgtagtg

SEQ ID NO: 8426703 - DNA, 22 bp, Homo sapiens
ccaggaggcagaagttgcagtg

SEQ ID NO: 8426704 - DNA, 22 bp, Homo sapiens
ccaggaggcggaggttgcagcg

SEQ ID NO: 8426705 - DNA, 22 bp, Homo sapiens
ccaggaggcggaaggtacagtg

SEQ ID NO: 8426706 - DNA, 22 bp, Homo sapiens
tctgtcagcccctcagctgtca

SEQ ID NO: 8426707 - DNA, 22 bp, Homo sapiens
tctgtcataaacacacacaagc

SEQ ID NO: 8426708 - DNA, 22 bp, Homo sapiens
tctgtcataaacacacacaagc

SEQ ID NO: 8426709 - DNA, 21 bp, Homo sapiens
ccaggaaggactgagctccct

SEQ ID NO: 8426710 - DNA, 21 bp, Homo sapiens
ccaggaaggactgagctccct

SEQ ID NO: 8426711 - DNA, 22 bp, Homo sapiens
ccaggagcctgggccaggctgg

SEQ ID NO: 8426712 - DNA, 22 bp, Homo sapiens
ccaggaggatggttgttaggtg

SEQ ID NO: 8426713 - DNA, 22 bp, Homo sapiens
ccaggaggcagaagttgcagtg

SEQ ID NO: 8426714 - DNA, 22 bp, Homo sapiens
ccaggaagctctgctccacggg

SEQ ID NO: 8426715 - DNA, 22 bp, Homo sapiens
ccaggaagctgtctgatatgaa

SEQ ID NO: 8426716 - DNA, 22 bp, Homo sapiens
ccaggaagctgtctgatatgaa

SEQ ID NO: 8426717 - DNA, 22 bp, Homo sapiens
ccaggaaggaagcaggggtttc

SEQ ID NO: 8426718 - DNA, 22 bp, Homo sapiens
ccaggaagctgtgagattccaa

SEQ ID NO: 8426719 - DNA, 22 bp, Homo sapiens
ccaggaagctgtgagattccaa

SEQ ID NO: 8426720 - DNA, 22 bp, Homo sapiens
ccaggaagcctttttctttgac

SEQ ID NO: 8426721 - DNA, 22 bp, Homo sapiens
ccaggaagcggtgagggctgcc

SEQ ID NO: 8426722 - DNA, 22 bp, Homo sapiens
ccaggaagcggtgagggctgcc

SEQ ID NO: 8426723 - DNA, 19 bp, Homo sapiens
ccaggaacccctagctacc

SEQ ID NO: 8426724 - DNA, 22 bp, Homo sapiens
ccaggaagaaacagtctttata

SEQ ID NO: 8426725 - DNA, 22 bp, Homo sapiens
ccaggaagacacatgctcatcc

SEQ ID NO: 8426726 - DNA, 22 bp, Homo sapiens
ccaggaagacacatgctcatcc

SEQ ID NO: 8426727 - DNA, 22 bp, Homo sapiens
ccaggaaccgatgatcagaggg

SEQ ID NO: 8426728 - DNA, 22 bp, Homo sapiens
ccaggaagcataatgtagtggg

SEQ ID NO: 8426729 - DNA, 22 bp, Homo sapiens
ccaggaagatttattttggctt

SEQ ID NO: 8426730 - DNA, 23 bp, Homo sapiens
ccaggaagaggccatccacagtc

SEQ ID NO: 8426731 - DNA, 23 bp, Homo sapiens
ccaggaagaggccatccacagtc

SEQ ID NO: 8426732 - DNA, 22 bp, Homo sapiens
ccaggaagcctcagatgctgag

SEQ ID NO: 8426733 - DNA, 22 bp, Homo sapiens
ccaggaagcctcagatgctgag

SEQ ID NO: 8426734 - DNA, 22 bp, Homo sapiens
ccaggaagcctcagatgctgag

SEQ ID NO: 8426735 - DNA, 22 bp, Homo sapiens
ccaggaagcctgtgtctctgga

SEQ ID NO: 8426736 - DNA, 22 bp, Homo sapiens
tctggaggcaggctgccaggat

SEQ ID NO: 8426737 - DNA, 22 bp, Homo sapiens
tctggagcttgaagctttggtt

SEQ ID NO: 8426738 - DNA, 22 bp, Homo sapiens
tctggagctggagggcaaggca

SEQ ID NO: 8426739 - DNA, 22 bp, Homo sapiens
tctggcttctcctagagcaatg

SEQ ID NO: 8426740 - DNA, 22 bp, Homo sapiens
tctggcttccctctgttctggg

SEQ ID NO: 8426741 - DNA, 22 bp, Homo sapiens
tctggcttcagtagggttcact

SEQ ID NO: 8426742 - DNA, 23 bp, Homo sapiens
tctggcttccagtgggttcaacc

SEQ ID NO: 8426743 - DNA, 22 bp, Homo sapiens
tctggctgttgttaggttcctg

SEQ ID NO: 8426744 - DNA, 22 bp, Homo sapiens
tctggctgttaggcctgacctt

SEQ ID NO: 8426745 - DNA, 22 bp, Homo sapiens
tctggcttcaactttactgaaa

SEQ ID NO: 8426746 - DNA, 22 bp, Homo sapiens
tctggctgttttagatgagctc

SEQ ID NO: 8426747 - DNA, 21 bp, Homo sapiens
ccagctgtctgtccttaggca

SEQ ID NO: 8426748 - DNA, 22 bp, Homo sapiens
ccagctgtgccggggacctggg

SEQ ID NO: 8426749 - DNA, 22 bp, Homo sapiens
ccagctgtgcctaggagcaggg

SEQ ID NO: 8426750 - DNA, 23 bp, Homo sapiens
ccagctgtgcctggcccaggagc

SEQ ID NO: 8426751 - DNA, 22 bp, Homo sapiens
ccagctgttggagtttcactgc

SEQ ID NO: 8426752 - DNA, 22 bp, Homo sapiens
ccagctgtttctgatgctaggc

SEQ ID NO: 8426753 - DNA, 22 bp, Homo sapiens
tctggcttggacacaatcttcc

SEQ ID NO: 8426754 - DNA, 22 bp, Homo sapiens
ccagctgtcactcagaaaggcc

SEQ ID NO: 8426755 - DNA, 22 bp, Homo sapiens
ccagctgtcactcagaaaggcc

SEQ ID NO: 8426756 - DNA, 22 bp, Homo sapiens
ccagctgtcactcagaaaggcc

SEQ ID NO: 8426757 - DNA, 22 bp, Homo sapiens
tctggctttattttcatcatct

SEQ ID NO: 8426758 - DNA, 22 bp, Homo sapiens
ccagctgtctggttccagagcc

SEQ ID NO: 8426759 - DNA, 22 bp, Homo sapiens
tctggcttggctggcatctctg

SEQ ID NO: 8426760 - DNA, 22 bp, Homo sapiens
tctggcttgtctcagggtctga

SEQ ID NO: 8426761 - DNA, 22 bp, Homo sapiens
tctgccttttcactgccactaa

SEQ ID NO: 8426762 - DNA, 22 bp, Homo sapiens
tctgcctttgctttggctgtca

SEQ ID NO: 8426763 - DNA, 22 bp, Homo sapiens
tctgcctttctcaagggcaaaa

SEQ ID NO: 8426764 - DNA, 22 bp, Homo sapiens
tctgccttttactagctggatg

SEQ ID NO: 8426765 - DNA, 22 bp, Homo sapiens
tctgccttttactagctggatg

SEQ ID NO: 8426766 - DNA, 22 bp, Homo sapiens
tctgcctttgtggtcgggagaa

SEQ ID NO: 8426767 - DNA, 22 bp, Homo sapiens
tctgccttgttgcaggcgctat

SEQ ID NO: 8426768 - DNA, 22 bp, Homo sapiens
tctgccttgtttgagctttgac

SEQ ID NO: 8426769 - DNA, 22 bp, Homo sapiens
tctgcctttcacacagacggcc

SEQ ID NO: 8426770 - DNA, 22 bp, Homo sapiens
tctgcctttcccaggctactgt

SEQ ID NO: 8426771 - DNA, 22 bp, Homo sapiens
tctgcctgaaccactcttggag

SEQ ID NO: 8426772 - DNA, 22 bp, Homo sapiens
tctgcctgaaccactcttggag

SEQ ID NO: 8426773 - DNA, 22 bp, Homo sapiens
tctgcctgagaagtggggtgcc

SEQ ID NO: 8426774 - DNA, 22 bp, Homo sapiens
tctgccttggcaaccacagctt

SEQ ID NO: 8426775 - DNA, 22 bp, Homo sapiens
tctgccttgccgaattccaggc

SEQ ID NO: 8426776 - DNA, 22 bp, Homo sapiens
tctgcctcgctaacagcagcca

SEQ ID NO: 8426777 - DNA, 22 bp, Homo sapiens
tctgcctctttcaggcctggca

SEQ ID NO: 8426778 - DNA, 22 bp, Homo sapiens
ccagctgggattaagggaaaat

SEQ ID NO: 8426779 - DNA, 22 bp, Homo sapiens
ccagctggtaagtgatggagcc

SEQ ID NO: 8426780 - DNA, 22 bp, Homo sapiens
ccagctggggaagtggggcata

SEQ ID NO: 8426781 - DNA, 22 bp, Homo sapiens
ccagctggggaagtggggcata

SEQ ID NO: 8426782 - DNA, 22 bp, Homo sapiens
ccagctgggtccctgctggggc

SEQ ID NO: 8426783 - DNA, 22 bp, Homo sapiens
ccagctggtctgtgctcatgtt

SEQ ID NO: 8426784 - DNA, 22 bp, Homo sapiens
ccagctggtctgtgctcatgtt

SEQ ID NO: 8426785 - DNA, 22 bp, Homo sapiens
ccagctggtaagtgatggagcc

SEQ ID NO: 8426786 - DNA, 22 bp, Homo sapiens
ccagctggttaaaatagagaaa

SEQ ID NO: 8426787 - DNA, 22 bp, Homo sapiens
tctggagccttggatgggaaag

SEQ ID NO: 8426788 - DNA, 22 bp, Homo sapiens
ccagctggtgttccttaggacc

SEQ ID NO: 8426789 - DNA, 22 bp, Homo sapiens
caggaaatggggtttagttatt

SEQ ID NO: 8426790 - DNA, 22 bp, Homo sapiens
caggaaatgggtcgttttataa

SEQ ID NO: 8426791 - DNA, 22 bp, Homo sapiens
caggaaatgtataattttataa

SEQ ID NO: 8426792 - DNA, 23 bp, Homo sapiens
caggaaatgttcttgaagcctga

SEQ ID NO: 8426793 - DNA, 22 bp, Homo sapiens
caggaaattcttttgtttgtgc

SEQ ID NO: 8426794 - DNA, 22 bp, Homo sapiens
caggaaataaaaagtatcttct

SEQ ID NO: 8426795 - DNA, 22 bp, Homo sapiens
caggaaagtctgtaaaggaacc

SEQ ID NO: 8426796 - DNA, 22 bp, Homo sapiens
caggaaatggctgaataaattc

SEQ ID NO: 8426797 - DNA, 22 bp, Homo sapiens
caggaaatttatgttctactta

SEQ ID NO: 8426798 - DNA, 22 bp, Homo sapiens
caggaaattggctatttgggat

SEQ ID NO: 8426799 - DNA, 22 bp, Homo sapiens
caggaaattgcaacagtctgag

SEQ ID NO: 8426800 - DNA, 22 bp, Homo sapiens
gttggcagagagaagcctagca

SEQ ID NO: 8426801 - DNA, 22 bp, Homo sapiens
gttggctatagggagatggggc

SEQ ID NO: 8426802 - DNA, 22 bp, Homo sapiens
gttggccattaattggaggaca

SEQ ID NO: 8426803 - DNA, 22 bp, Homo sapiens
gttggctttgctctctgtccta

SEQ ID NO: 8426804 - DNA, 22 bp, Homo sapiens
gttggctttgctctctgtccta

SEQ ID NO: 8426805 - DNA, 22 bp, Homo sapiens
caggaaaggtagtcacaatgta

SEQ ID NO: 8426806 - DNA, 22 bp, Homo sapiens
caggaaaggtgtgtcatgatgg

SEQ ID NO: 8426807 - DNA, 22 bp, Homo sapiens
caggaaagggatgggctgccac

SEQ ID NO: 8426808 - DNA, 22 bp, Homo sapiens
caggaaagccgagtgccatagg

SEQ ID NO: 8426809 - DNA, 22 bp, Homo sapiens
caggaaagccgagtgccatagg

SEQ ID NO: 8426810 - DNA, 22 bp, Homo sapiens
gttcttaaagattcatcaagca

SEQ ID NO: 8426811 - DNA, 21 bp, Homo sapiens
gttctgttgactgtgggcatc

SEQ ID NO: 8426812 - DNA, 22 bp, Homo sapiens
gttctgggtctggacacacaga

SEQ ID NO: 8426813 - DNA, 22 bp, Homo sapiens
gttctgggtagatgtatctttt

SEQ ID NO: 8426814 - DNA, 22 bp, Homo sapiens
gttctgggttctgggttattgg

SEQ ID NO: 8426815 - DNA, 22 bp, Homo sapiens
gttctgtagtcatagagcaatt

SEQ ID NO: 8426816 - DNA, 22 bp, Homo sapiens
gttctgtagtcatagagcaatt

SEQ ID NO: 8426817 - DNA, 22 bp, Homo sapiens
gttctgggagatcttgagcttc

SEQ ID NO: 8426818 - DNA, 22 bp, Homo sapiens
gttctgggttcaaaccccggcc

SEQ ID NO: 8426819 - DNA, 22 bp, Homo sapiens
gttgctttacagctggtgacag

SEQ ID NO: 8426820 - DNA, 22 bp, Homo sapiens
gttgcttttctccatcacatgg

SEQ ID NO: 8426821 - DNA, 22 bp, Homo sapiens
gttgctgaaattaatattggag

SEQ ID NO: 8426822 - DNA, 22 bp, Homo sapiens
gttctgggaaggtggacctgtt

SEQ ID NO: 8426823 - DNA, 22 bp, Homo sapiens
gttctgggaaggtggacctgtt

SEQ ID NO: 8426824 - DNA, 22 bp, Homo sapiens
gttcctgaagggactggtgcag

SEQ ID NO: 8426825 - DNA, 22 bp, Homo sapiens
gttcctcagcccttacttagcc

SEQ ID NO: 8426826 - DNA, 22 bp, Homo sapiens
gttcctcagttgtaaaaaatgt

SEQ ID NO: 8426827 - DNA, 22 bp, Homo sapiens
gttcctcatccagtcatgacta

SEQ ID NO: 8426828 - DNA, 22 bp, Homo sapiens
gttcctcatgagtaccccttaa

SEQ ID NO: 8426829 - DNA, 22 bp, Homo sapiens
gttcctcaaaaaggagagcccc

SEQ ID NO: 8426830 - DNA, 22 bp, Homo sapiens
gttcctcacgtggacagatgat

SEQ ID NO: 8426831 - DNA, 22 bp, Homo sapiens
gttcctaaccagcagagaaaca

SEQ ID NO: 8426832 - DNA, 22 bp, Homo sapiens
gttccgtttatatgctggatta

SEQ ID NO: 8426833 - DNA, 22 bp, Homo sapiens
gttcacagtgttttctttgcat

SEQ ID NO: 8426834 - DNA, 22 bp, Homo sapiens
gttcccaggccctgggctctcc

SEQ ID NO: 8426835 - DNA, 22 bp, Homo sapiens
gttcccattgccctagcttgta

SEQ ID NO: 8426836 - DNA, 22 bp, Homo sapiens
gttcccatgcctccaagcttca

SEQ ID NO: 8426837 - DNA, 18 bp, Homo sapiens
gtttacattactgaatag

SEQ ID NO: 8426838 - DNA, 22 bp, Homo sapiens
gtttacatgtaatgtgttattg

SEQ ID NO: 8426839 - DNA, 22 bp, Homo sapiens
gtttacatgtactcattatact

SEQ ID NO: 8426840 - DNA, 22 bp, Homo sapiens
gtttcaaagcacagctcacatt

SEQ ID NO: 8426841 - DNA, 22 bp, Homo sapiens
gtttcaaaagtcaggctattct

SEQ ID NO: 8426842 - DNA, 22 bp, Homo sapiens
gtttattcttcagcaacatctg

SEQ ID NO: 8426843 - DNA, 22 bp, Homo sapiens
gtttattccagcaatctgctta

SEQ ID NO: 8426844 - DNA, 22 bp, Homo sapiens
gtttcctgccctgtcttatcca

SEQ ID NO: 8426845 - DNA, 22 bp, Homo sapiens
gtttcctgcacacgtgttatat

SEQ ID NO: 8426846 - DNA, 22 bp, Homo sapiens
gtttcctgaccctggcccagca

SEQ ID NO: 8426847 - DNA, 22 bp, Homo sapiens
gtttcctgactgtggaattata

SEQ ID NO: 8426848 - DNA, 22 bp, Homo sapiens
gtttcctataactcaggcacca

SEQ ID NO: 8426849 - DNA, 22 bp, Homo sapiens
gtttcctatggctgctgcagga

SEQ ID NO: 8426850 - DNA, 22 bp, Homo sapiens
gtttcctaggcttatacagctg

SEQ ID NO: 8426851 - DNA, 22 bp, Homo sapiens
gtttcctatgtccattgaggga

SEQ ID NO: 8426852 - DNA, 20 bp, Homo sapiens
gtttcctatttacctcctca

SEQ ID NO: 8426853 - DNA, 22 bp, Homo sapiens
gtttcctctgctggttttcatt

SEQ ID NO: 8426854 - DNA, 22 bp, Homo sapiens
gtttcctgaagttatttcatcc

SEQ ID NO: 8426855 - DNA, 22 bp, Homo sapiens
gtttgctaatttaaagctattt

SEQ ID NO: 8426856 - DNA, 22 bp, Homo sapiens
gtttgccttttagataggaatg

SEQ ID NO: 8426857 - DNA, 22 bp, Homo sapiens
gtttgccttttagataggaatg

SEQ ID NO: 8426858 - DNA, 22 bp, Homo sapiens
gtttgcctgccgacgctctcat

SEQ ID NO: 8426859 - DNA, 22 bp, Homo sapiens
gtttgcctgtgatgtacatttc

SEQ ID NO: 8426860 - DNA, 22 bp, Homo sapiens
gtttcctggaggttatttttga

SEQ ID NO: 8426861 - DNA, 22 bp, Homo sapiens
gtttcctgtctgctttactata

SEQ ID NO: 8426862 - DNA, 22 bp, Homo sapiens
caggaacagcaccaggagctag

SEQ ID NO: 8426863 - DNA, 22 bp, Homo sapiens
caggaacagagtggcattgtct

SEQ ID NO: 8426864 - DNA, 22 bp, Homo sapiens
caggaacagcaccaggagctag

SEQ ID NO: 8426865 - DNA, 22 bp, Homo sapiens
caggaagaggacaggcttcccc

SEQ ID NO: 8426866 - DNA, 22 bp, Homo sapiens
caggaagaggacaggcttcccc

SEQ ID NO: 8426867 - DNA, 22 bp, Homo sapiens
caggaagaggacaggcttcccc

SEQ ID NO: 8426868 - DNA, 22 bp, Homo sapiens
caggaagagaacatggaggctg

SEQ ID NO: 8426869 - DNA, 22 bp, Homo sapiens
caggaagcacagtgaggagacc

SEQ ID NO: 8426870 - DNA, 22 bp, Homo sapiens
caggaagcacagtgaggagacc

SEQ ID NO: 8426871 - DNA, 22 bp, Homo sapiens
caggaagcaagtgattttcttg

SEQ ID NO: 8426872 - DNA, 22 bp, Homo sapiens
caggaagcaccagcccggcccc

SEQ ID NO: 8426873 - DNA, 22 bp, Homo sapiens
caggaagattgtggaggtggtt

SEQ ID NO: 8426874 - DNA, 22 bp, Homo sapiens
caggaagattgtggaggtggtt

SEQ ID NO: 8426875 - DNA, 22 bp, Homo sapiens
caggaagattagaccaagagct

SEQ ID NO: 8426876 - DNA, 22 bp, Homo sapiens
caggaagattagaccaagagct

SEQ ID NO: 8426877 - DNA, 23 bp, Homo sapiens
caggaagcagatggggtagaaga

SEQ ID NO: 8426878 - DNA, 22 bp, Homo sapiens
gtttacaacatcttgtccttca

SEQ ID NO: 8426879 - DNA, 22 bp, Homo sapiens
gtttacaacatgccaactgggc

SEQ ID NO: 8426880 - DNA, 22 bp, Homo sapiens
gtttacagtggcttcattggat

SEQ ID NO: 8426881 - DNA, 22 bp, Homo sapiens
gtttacatattttaattggtga

SEQ ID NO: 8426882 - DNA, 22 bp, Homo sapiens
gtttacatgcagaaaatcaatg

SEQ ID NO: 8426883 - DNA, 22 bp, Homo sapiens
gtttacatgcagaaaatcaatg

SEQ ID NO: 8426884 - DNA, 22 bp, Homo sapiens
gttacacagctaagcttctcct

SEQ ID NO: 8426885 - DNA, 22 bp, Homo sapiens
gttacagtcaggagatattttg

SEQ ID NO: 8426886 - DNA, 22 bp, Homo sapiens
gttacagtgcatgtggcttctg

SEQ ID NO: 8426887 - DNA, 22 bp, Homo sapiens
gttacaatgtccttacatgaaa

SEQ ID NO: 8426888 - DNA, 22 bp, Homo sapiens
gttacaatgtccttacatgaaa

SEQ ID NO: 8426889 - DNA, 22 bp, Homo sapiens
gttacaatgttcttcagttctg

SEQ ID NO: 8426890 - DNA, 22 bp, Homo sapiens
gttacaaatgtaaattctgggg

SEQ ID NO: 8426891 - DNA, 22 bp, Homo sapiens
gttacaaatgccaaagctgaga

SEQ ID NO: 8426892 - DNA, 22 bp, Homo sapiens
gttaaataacctcatgtccgtt

SEQ ID NO: 8426893 - DNA, 22 bp, Homo sapiens
gttaaagaagaatagttccttt

SEQ ID NO: 8426894 - DNA, 20 bp, Homo sapiens
gttaaaagagtaatttgagg

SEQ ID NO: 8426895 - DNA, 22 bp, Homo sapiens
gttaaaagaacaactcggaggt

SEQ ID NO: 8426896 - DNA, 20 bp, Homo sapiens
gttaaaagagtaatttgagg

SEQ ID NO: 8426897 - DNA, 22 bp, Homo sapiens
gtgtgtgtactctgtatataaa

SEQ ID NO: 8426898 - DNA, 23 bp, Homo sapiens
gtgtgtggaaagtgcatgggcct

SEQ ID NO: 8426899 - DNA, 22 bp, Homo sapiens
gtgtgtggaaagttttccatgg

SEQ ID NO: 8426900 - DNA, 22 bp, Homo sapiens
gtgtgtggaatgctcatttatt

SEQ ID NO: 8426901 - DNA, 22 bp, Homo sapiens
cagctgtggggagcttgggcca

SEQ ID NO: 8426902 - DNA, 22 bp, Homo sapiens
cagctgtgtaaacacatgtgta

SEQ ID NO: 8426903 - DNA, 22 bp, Homo sapiens
cagctgtggggagcttgggcca

SEQ ID NO: 8426904 - DNA, 22 bp, Homo sapiens
cagctgtgtatgagagcatgct

SEQ ID NO: 8426905 - DNA, 22 bp, Homo sapiens
cagctgtgtagatgcagggtca

SEQ ID NO: 8426906 - DNA, 22 bp, Homo sapiens
cagctgtgattcctgctgtcca

SEQ ID NO: 8426907 - DNA, 22 bp, Homo sapiens
cagctgtgctgattgctcagta

SEQ ID NO: 8426908 - DNA, 22 bp, Homo sapiens
cagctgtgctgattgctcagta

SEQ ID NO: 8426909 - DNA, 22 bp, Homo sapiens
cagctgtgctgattgctcagta

SEQ ID NO: 8426910 - DNA, 22 bp, Homo sapiens
cagctgtggagggaggaaatgc

SEQ ID NO: 8426911 - DNA, 22 bp, Homo sapiens
cagcttcaccagggccatggtt

SEQ ID NO: 8426912 - DNA, 22 bp, Homo sapiens
cagcttcaccagggccatggtt

SEQ ID NO: 8426913 - DNA, 22 bp, Homo sapiens
cagctgtttgggcatggccaga

SEQ ID NO: 8426914 - DNA, 22 bp, Homo sapiens
cagctgttgtgctgggcagtta

SEQ ID NO: 8426915 - DNA, 22 bp, Homo sapiens
cagctgttgtgatttccaggag

SEQ ID NO: 8426916 - DNA, 22 bp, Homo sapiens
cagctgttgtgtatcaggcaga

SEQ ID NO: 8426917 - DNA, 22 bp, Homo sapiens
cagcttccatctccactgccct

SEQ ID NO: 8426918 - DNA, 22 bp, Homo sapiens
cagcttcatgacaaacagtttt

SEQ ID NO: 8426919 - DNA, 22 bp, Homo sapiens
cagcttctaaagtgtgaagcca

SEQ ID NO: 8426920 - DNA, 22 bp, Homo sapiens
gttattcaacttgtgtctctta

SEQ ID NO: 8426921 - DNA, 22 bp, Homo sapiens
gttattcaatggcttataagga

SEQ ID NO: 8426922 - DNA, 22 bp, Homo sapiens
gttacatggagcaatgatgcat

SEQ ID NO: 8426923 - DNA, 22 bp, Homo sapiens
cagcttctatttatctttgtgt

SEQ ID NO: 8426924 - DNA, 22 bp, Homo sapiens
cagcttctagcatcggctttga

SEQ ID NO: 8426925 - DNA, 22 bp, Homo sapiens
cagcttctccagatgaccctca

SEQ ID NO: 8426926 - DNA, 22 bp, Homo sapiens
cagcttctccagatgaccctca

SEQ ID NO: 8426927 - DNA, 22 bp, Homo sapiens
cagcttctcagaaagctgaggt

SEQ ID NO: 8426928 - DNA, 22 bp, Homo sapiens
cagcttctcagaaagctgaggt

SEQ ID NO: 8426929 - DNA, 21 bp, Homo sapiens
cagcttctgaaggtgtaggaa

SEQ ID NO: 8426930 - DNA, 22 bp, Homo sapiens
cagcttctgagcaagccagggg

SEQ ID NO: 8426931 - DNA, 22 bp, Homo sapiens
cagcttctcgggagcgcatgtg

SEQ ID NO: 8426932 - DNA, 22 bp, Homo sapiens
cagcttctccggcctggtgcgg

SEQ ID NO: 8426933 - DNA, 22 bp, Homo sapiens
cagcttctccattcttctggct

SEQ ID NO: 8426934 - DNA, 22 bp, Homo sapiens
cagcttgggggcgctggcctca

SEQ ID NO: 8426935 - DNA, 22 bp, Homo sapiens
cagcttgggagtttggttttat

SEQ ID NO: 8426936 - DNA, 22 bp, Homo sapiens
cagcttgggtcaggtgcctgct

SEQ ID NO: 8426937 - DNA, 22 bp, Homo sapiens
cagcttggcttccgctttactg

SEQ ID NO: 8426938 - DNA, 22 bp, Homo sapiens
cagcttggcttcacattctgta

SEQ ID NO: 8426939 - DNA, 22 bp, Homo sapiens
cagcttggcgaatgtaggtatg

SEQ ID NO: 8426940 - DNA, 22 bp, Homo sapiens
cagcttggattttggcacgtgt

SEQ ID NO: 8426941 - DNA, 22 bp, Homo sapiens
cagcttggaggaggatctaaga

SEQ ID NO: 8426942 - DNA, 20 bp, Homo sapiens
cagcttggatgagaggctga

SEQ ID NO: 8426943 - DNA, 22 bp, Homo sapiens
cagctttattaatgattgtctt

SEQ ID NO: 8426944 - DNA, 22 bp, Homo sapiens
cagcttgtgtcattcatcttgt

SEQ ID NO: 8426945 - DNA, 22 bp, Homo sapiens
cagcttgggtcaggtgcctgct

SEQ ID NO: 8426946 - DNA, 23 bp, Homo sapiens
cagctttcagggctttagggaag

SEQ ID NO: 8426947 - DNA, 22 bp, Homo sapiens
cagctttccccgtgcctcagcc

SEQ ID NO: 8426948 - DNA, 22 bp, Homo sapiens
cagctttctaccttaggcagtg

SEQ ID NO: 8426949 - DNA, 22 bp, Homo sapiens
caggaaaatggaatcacctgta

SEQ ID NO: 8426950 - DNA, 22 bp, Homo sapiens
caggaaaatctgcccacacaag

SEQ ID NO: 8426951 - DNA, 22 bp, Homo sapiens
caggaaagagctgccaggcagg

SEQ ID NO: 8426952 - DNA, 22 bp, Homo sapiens
caggaaagagctgccaggcagg

SEQ ID NO: 8426953 - DNA, 22 bp, Homo sapiens
caggaaacatatgtgcttgagg

SEQ ID NO: 8426954 - DNA, 19 bp, Homo sapiens
caggaaacacctactgcta

SEQ ID NO: 8426955 - DNA, 22 bp, Homo sapiens
caggaaacaaagccttgctcat

SEQ ID NO: 8426956 - DNA, 22 bp, Homo sapiens
caggaaacattcttggtaagga

SEQ ID NO: 8426957 - DNA, 22 bp, Homo sapiens
caggaaacattcccataacaca

SEQ ID NO: 8426958 - DNA, 21 bp, Homo sapiens
caggaaactgaggccatgggg

SEQ ID NO: 8426959 - DNA, 22 bp, Homo sapiens
caggaaacggctattcttttgt

SEQ ID NO: 8426960 - DNA, 22 bp, Homo sapiens
caggaaaccgcatcccagtggg

SEQ ID NO: 8426961 - DNA, 16 bp, Homo sapiens
caggaaacttaaagac

SEQ ID NO: 8426962 - DNA, 22 bp, Homo sapiens
caggaaactgtgggcttaaatc

SEQ ID NO: 8426963 - DNA, 22 bp, Homo sapiens
caggaaagaaatgagaacacca

SEQ ID NO: 8426964 - DNA, 17 bp, Homo sapiens
cagctgtgagagcctta

SEQ ID NO: 8426965 - DNA, 17 bp, Homo sapiens
cagctgtgagagcctta

SEQ ID NO: 8426966 - DNA, 22 bp, Homo sapiens
cagctgggtgatcttgggcagg

SEQ ID NO: 8426967 - DNA, 22 bp, Homo sapiens
cagctggggagagacatggcag

SEQ ID NO: 8426968 - DNA, 22 bp, Homo sapiens
cagctggggcagccacgtgcgg

SEQ ID NO: 8426969 - DNA, 22 bp, Homo sapiens
cagctgggcctcctgagccctg

SEQ ID NO: 8426970 - DNA, 19 bp, Homo sapiens
gtgtggcagagagtgacca

SEQ ID NO: 8426971 - DNA, 22 bp, Homo sapiens
gtgtggcacctcctttccagct

SEQ ID NO: 8426972 - DNA, 21 bp, Homo sapiens
gtgtggatatgtgacaggtgg

SEQ ID NO: 8426973 - DNA, 22 bp, Homo sapiens
gtgtggccctgcgtcctgagtc

SEQ ID NO: 8426974 - DNA, 22 bp, Homo sapiens
gtgtggcagggcgtttgcagac

SEQ ID NO: 8426975 - DNA, 20 bp, Homo sapiens
gtgtggccaggagctgcgct

SEQ ID NO: 8426976 - DNA, 22 bp, Homo sapiens
cagctggctgcggtgaggggac

SEQ ID NO: 8426977 - DNA, 22 bp, Homo sapiens
gtgtggccgtgtatccatggct

SEQ ID NO: 8426978 - DNA, 22 bp, Homo sapiens
cagctggctggtcagtgcacaa

SEQ ID NO: 8426979 - DNA, 22 bp, Homo sapiens
cagctggctggtcagtgcacaa

SEQ ID NO: 8426980 - DNA, 22 bp, Homo sapiens
gtgtgctgcccaactcgcagat

SEQ ID NO: 8426981 - DNA, 22 bp, Homo sapiens
gtgtgctgttgttcaggtagaa

SEQ ID NO: 8426982 - DNA, 22 bp, Homo sapiens
gtgtgctgagtgactgtcatca

SEQ ID NO: 8426983 - DNA, 22 bp, Homo sapiens
gtgtgctcaagggcaggaacct

SEQ ID NO: 8426984 - DNA, 22 bp, Homo sapiens
gtgtgctcaagggcaggaacct

SEQ ID NO: 8426985 - DNA, 18 bp, Homo sapiens
gtgtgctcagagagtgag

SEQ ID NO: 8426986 - DNA, 22 bp, Homo sapiens
gtgtgctctggaggctagattt

SEQ ID NO: 8426987 - DNA, 22 bp, Homo sapiens
gtgtgctcagctcatttggata

SEQ ID NO: 8426988 - DNA, 22 bp, Homo sapiens
gtgtgctccctctgtcgtcata

SEQ ID NO: 8426989 - DNA, 22 bp, Homo sapiens
gtgtacagtgatttgagttcac

SEQ ID NO: 8426990 - DNA, 22 bp, Homo sapiens
gtgtacagtgatttgagttcac

SEQ ID NO: 8426991 - DNA, 22 bp, Homo sapiens
gtgtacagtaagtgaatctagg

SEQ ID NO: 8426992 - DNA, 22 bp, Homo sapiens
gtggtacagctgaaaggcttgc

SEQ ID NO: 8426993 - DNA, 22 bp, Homo sapiens
gtgggttcgtggtctcgctggc

SEQ ID NO: 8426994 - DNA, 22 bp, Homo sapiens
gtgggtggggagctctctggag

SEQ ID NO: 8426995 - DNA, 22 bp, Homo sapiens
gtgtacatagaattgtgctttg

SEQ ID NO: 8426996 - DNA, 22 bp, Homo sapiens
gtgtacatattgagtctgctga

SEQ ID NO: 8426997 - DNA, 22 bp, Homo sapiens
gtgtatctggcatgtcgagtgt

SEQ ID NO: 8426998 - DNA, 22 bp, Homo sapiens
gtgtatgatttcaaatggctag

SEQ ID NO: 8426999 - DNA, 22 bp, Homo sapiens
gtgtgactttatttggaaatag

SEQ ID NO: 8427000 - DNA, 22 bp, Homo sapiens
gtgtgactttatttggaaatag

SEQ ID NO: 8427001 - DNA, 22 bp, Homo sapiens
gtgtgagagaagctgccatgga

SEQ ID NO: 8427002 - DNA, 22 bp, Homo sapiens
gtgtgagagcaaaactgcagga

SEQ ID NO: 8427003 - DNA, 22 bp, Homo sapiens
gtgtcttttgaggctgaccagt

SEQ ID NO: 8427004 - DNA, 22 bp, Homo sapiens
gtgtctttattcctctatgttt

SEQ ID NO: 8427005 - DNA, 22 bp, Homo sapiens
gtgtctgcttgctgagcattta

SEQ ID NO: 8427006 - DNA, 19 bp, Homo sapiens
gtgtctgcctttgtgccac

SEQ ID NO: 8427007 - DNA, 22 bp, Homo sapiens
gtgtctgcacataggatctcaa

SEQ ID NO: 8427008 - DNA, 22 bp, Homo sapiens
cagctgcaggctgtgcaggaag

SEQ ID NO: 8427009 - DNA, 22 bp, Homo sapiens
cagctgcaggctgtgcaggaag

SEQ ID NO: 8427010 - DNA, 22 bp, Homo sapiens
cagctgcattaattttagtgaa

SEQ ID NO: 8427011 - DNA, 22 bp, Homo sapiens
cagctgccctgccttgccctta

SEQ ID NO: 8427012 - DNA, 22 bp, Homo sapiens
cagctgcccctccagggctggg

SEQ ID NO: 8427013 - DNA, 22 bp, Homo sapiens
cagctgcctatgacctagcctc

SEQ ID NO: 8427014 - DNA, 22 bp, Homo sapiens
cagctgcctatgacctagcctc

SEQ ID NO: 8427015 - DNA, 20 bp, Homo sapiens
cagctgcctggctctgggat

SEQ ID NO: 8427016 - DNA, 22 bp, Homo sapiens
cagctgcctgtattgtcctcat

SEQ ID NO: 8427017 - DNA, 22 bp, Homo sapiens
cagctgcctgtattgtcctcat

SEQ ID NO: 8427018 - DNA, 22 bp, Homo sapiens
gtggggagtgttctgtgattgg

SEQ ID NO: 8427019 - DNA, 22 bp, Homo sapiens
cagctgcagatcatgtttacag

SEQ ID NO: 8427020 - DNA, 22 bp, Homo sapiens
gtgggtggatcacctgaggtca

SEQ ID NO: 8427021 - DNA, 22 bp, Homo sapiens
cagctggctccacctctgggct

SEQ ID NO: 8427022 - DNA, 22 bp, Homo sapiens
cagctggctgcatgatgccaaa

SEQ ID NO: 8427023 - DNA, 22 bp, Homo sapiens
cagctggctgcatgatgccaaa

SEQ ID NO: 8427024 - DNA, 22 bp, Homo sapiens
cagctggcgcctggggaccaga

SEQ ID NO: 8427025 - DNA, 22 bp, Homo sapiens
cagctggcgcctggggaccaga

SEQ ID NO: 8427026 - DNA, 22 bp, Homo sapiens
cagctggcgggcagagccgcca

SEQ ID NO: 8427027 - DNA, 22 bp, Homo sapiens
cagctggcgggcagagccgcca

SEQ ID NO: 8427028 - DNA, 22 bp, Homo sapiens
cagctggcctgatccctgtggc

SEQ ID NO: 8427029 - DNA, 22 bp, Homo sapiens
cagctggcctgatccctgtggc

SEQ ID NO: 8427030 - DNA, 22 bp, Homo sapiens
cagctggccctttggtagcctt

SEQ ID NO: 8427031 - DNA, 22 bp, Homo sapiens
cagctggccctttggtagcctt

SEQ ID NO: 8427032 - DNA, 22 bp, Homo sapiens
cagctgctcttctggcctgtca

SEQ ID NO: 8427033 - DNA, 22 bp, Homo sapiens
cagctgctcttctggcctgtca

SEQ ID NO: 8427034 - DNA, 22 bp, Homo sapiens
cagctgctcttctggcctgtca

SEQ ID NO: 8427035 - DNA, 22 bp, Homo sapiens
cagctgctgatggcctgacaga

SEQ ID NO: 8427036 - DNA, 22 bp, Homo sapiens
cagctgctgcccttggctgcag

SEQ ID NO: 8427037 - DNA, 22 bp, Homo sapiens
cagctgcctgtctggaggcaat

SEQ ID NO: 8427038 - DNA, 19 bp, Homo sapiens
cagctgccttttctttgca

SEQ ID NO: 8427039 - DNA, 22 bp, Homo sapiens
cagctgccttctgcgggaagtc

SEQ ID NO: 8427040 - DNA, 22 bp, Homo sapiens
cagctgctctggtggtctctcc

SEQ ID NO: 8427041 - DNA, 22 bp, Homo sapiens
cagctggccaatcagggcgccc

SEQ ID NO: 8427042 - DNA, 22 bp, Homo sapiens
cagctgctgttcagttttgttt

SEQ ID NO: 8427043 - DNA, 22 bp, Homo sapiens
cagctgcttactagctgtgtga

SEQ ID NO: 8427044 - DNA, 22 bp, Homo sapiens
cagctcttagagggagacagac

SEQ ID NO: 8427045 - DNA, 22 bp, Homo sapiens
cagctcttcagtgcctgagata

SEQ ID NO: 8427046 - DNA, 22 bp, Homo sapiens
cagctcttattttctctcctaa

SEQ ID NO: 8427047 - DNA, 22 bp, Homo sapiens
cagctcttcctagccatgccac

SEQ ID NO: 8427048 - DNA, 17 bp, Homo sapiens
cagctcttcctccctct

SEQ ID NO: 8427049 - DNA, 22 bp, Homo sapiens
cagctcttggagcctccagtaa

SEQ ID NO: 8427050 - DNA, 22 bp, Homo sapiens
cagctctttactctgcaatgat

SEQ ID NO: 8427051 - DNA, 22 bp, Homo sapiens
cagctcttggagaaaccagagc

SEQ ID NO: 8427052 - DNA, 22 bp, Homo sapiens
cagctcttttttgcagcagctg

SEQ ID NO: 8427053 - DNA, 22 bp, Homo sapiens
cagctctttgagtattccattt

SEQ ID NO: 8427054 - DNA, 22 bp, Homo sapiens
cagctgaacatgtagagcatct

SEQ ID NO: 8427055 - DNA, 22 bp, Homo sapiens
cagctgaaagaaggaagtgtca

SEQ ID NO: 8427056 - DNA, 22 bp, Homo sapiens
cagctgagtttccaagtctgcc

SEQ ID NO: 8427057 - DNA, 22 bp, Homo sapiens
cagctgagttactctgaggtct

SEQ ID NO: 8427058 - DNA, 22 bp, Homo sapiens
cagctgagttactctgaggtct

SEQ ID NO: 8427059 - DNA, 22 bp, Homo sapiens
cagctgagtggaccctagaggc

SEQ ID NO: 8427060 - DNA, 22 bp, Homo sapiens
cagctgagtggaccctagaggc

SEQ ID NO: 8427061 - DNA, 22 bp, Homo sapiens
cagctgagtctgaggttctttg

SEQ ID NO: 8427062 - DNA, 22 bp, Homo sapiens
cagctgagtgttggcatgttca

SEQ ID NO: 8427063 - DNA, 20 bp, Homo sapiens
gtggcctgtcctgttgtggg

SEQ ID NO: 8427064 - DNA, 22 bp, Homo sapiens
gtggcctgtgctgtctccccaa

SEQ ID NO: 8427065 - DNA, 22 bp, Homo sapiens
cagctgaagagaggtgctgagt

SEQ ID NO: 8427066 - DNA, 22 bp, Homo sapiens
cagctgaacctttccctggagc

SEQ ID NO: 8427067 - DNA, 22 bp, Homo sapiens
cagctgaagaaagagtggttag

SEQ ID NO: 8427068 - DNA, 22 bp, Homo sapiens
cagctgagctcccaggccatca

SEQ ID NO: 8427069 - DNA, 22 bp, Homo sapiens
cagctgagctgccagactactg

SEQ ID NO: 8427070 - DNA, 22 bp, Homo sapiens
cagctgagctcccaggccatca

SEQ ID NO: 8427071 - DNA, 22 bp, Homo sapiens
cagctgaggaatactagatgta

SEQ ID NO: 8427072 - DNA, 18 bp, Homo sapiens
cagctgaggaccaaactg

SEQ ID NO: 8427073 - DNA, 22 bp, Homo sapiens
cagctgagtatgcattcaagca

SEQ ID NO: 8427074 - DNA, 22 bp, Homo sapiens
cagctgaggtcttttttatgtg

SEQ ID NO: 8427075 - DNA, 22 bp, Homo sapiens
cagctgaggtcaaagaagcagg

SEQ ID NO: 8427076 - DNA, 22 bp, Homo sapiens
cagctgaggtcaaagaagcagg

SEQ ID NO: 8427077 - DNA, 22 bp, Homo sapiens
gtggcttctggctgggcctcag

SEQ ID NO: 8427078 - DNA, 22 bp, Homo sapiens
gtggcttcttcttgggagctgc

SEQ ID NO: 8427079 - DNA, 22 bp, Homo sapiens
gtggcttcttcttgggagctgc

SEQ ID NO: 8427080 - DNA, 22 bp, Homo sapiens
gtggcttcttctgccagaagga

SEQ ID NO: 8427081 - DNA, 22 bp, Homo sapiens
gtggcttggaccagtcacagtg

SEQ ID NO: 8427082 - DNA, 22 bp, Homo sapiens
gtggctttggaattgtagactc

SEQ ID NO: 8427083 - DNA, 22 bp, Homo sapiens
gtggctttggaattgtagactc

SEQ ID NO: 8427084 - DNA, 22 bp, Homo sapiens
gtgggaagtctctcggaggaag

SEQ ID NO: 8427085 - DNA, 22 bp, Homo sapiens
gtgggacaaggatgaagatatt

SEQ ID NO: 8427086 - DNA, 22 bp, Homo sapiens
gtgggaagagccaattggggta

SEQ ID NO: 8427087 - DNA, 22 bp, Homo sapiens
gtggcgaggggaggtcctggcg

SEQ ID NO: 8427088 - DNA, 22 bp, Homo sapiens
gtggctatatttgaggatacgt

SEQ ID NO: 8427089 - DNA, 22 bp, Homo sapiens
gtggcttctgcggtgtgcgcag

SEQ ID NO: 8427090 - DNA, 22 bp, Homo sapiens
gtggcttctgcggtgtgcgcag

SEQ ID NO: 8427091 - DNA, 22 bp, Homo sapiens
gtggcttctgcggtgtgcgcag

SEQ ID NO: 8427092 - DNA, 22 bp, Homo sapiens
gtggggagggagatgctgaagt

SEQ ID NO: 8427093 - DNA, 22 bp, Homo sapiens
gtgggcaggccccaaagcaggg

SEQ ID NO: 8427094 - DNA, 22 bp, Homo sapiens
gtgggacagcggggtgggacag

SEQ ID NO: 8427095 - DNA, 22 bp, Homo sapiens
gtggcagagatagaactggaat

SEQ ID NO: 8427096 - DNA, 22 bp, Homo sapiens
gtggcagagaacaaggagaggt

SEQ ID NO: 8427097 - DNA, 22 bp, Homo sapiens
gtggcagagaacaaggagaggt

SEQ ID NO: 8427098 - DNA, 22 bp, Homo sapiens
gtggcagaactatgtgattgct

SEQ ID NO: 8427099 - DNA, 22 bp, Homo sapiens
gtggcagaccttcccttctcct

SEQ ID NO: 8427100 - DNA, 22 bp, Homo sapiens
gtggcagaaatattcttgctct

SEQ ID NO: 8427101 - DNA, 22 bp, Homo sapiens
gtggcagaaactggcagaggag

SEQ ID NO: 8427102 - DNA, 22 bp, Homo sapiens
gtggcagggtgctcatcatgca

SEQ ID NO: 8427103 - DNA, 22 bp, Homo sapiens
cagcccaggactgcaggtgttt

SEQ ID NO: 8427104 - DNA, 22 bp, Homo sapiens
cagcccagcgcaaacaactggc

SEQ ID NO: 8427105 - DNA, 21 bp, Homo sapiens
cagcccagcttcttccccagt

SEQ ID NO: 8427106 - DNA, 22 bp, Homo sapiens
cagcccagccgagggcctggct

SEQ ID NO: 8427107 - DNA, 22 bp, Homo sapiens
gtggcccacacagacagcatct

SEQ ID NO: 8427108 - DNA, 22 bp, Homo sapiens
cagctctggcagagcccaaccc

SEQ ID NO: 8427109 - DNA, 22 bp, Homo sapiens
cagctctgtgcaggcctgggga

SEQ ID NO: 8427110 - DNA, 22 bp, Homo sapiens
cagctctgtgcaggcctgggga

SEQ ID NO: 8427111 - DNA, 22 bp, Homo sapiens
cagctctgggagtcccacccct

SEQ ID NO: 8427112 - DNA, 22 bp, Homo sapiens
gtggccataggaggtcagatga

SEQ ID NO: 8427113 - DNA, 22 bp, Homo sapiens
gtggccagtgggaatgggctca

SEQ ID NO: 8427114 - DNA, 22 bp, Homo sapiens
gtggccaggtcagggacttgtg

SEQ ID NO: 8427115 - DNA, 19 bp, Homo sapiens
gtggccagggcaggggctg

SEQ ID NO: 8427116 - DNA, 19 bp, Homo sapiens
gtggccagggcaggggctg

SEQ ID NO: 8427117 - DNA, 22 bp, Homo sapiens
gtggcaggttccgtagacagca

SEQ ID NO: 8427118 - DNA, 22 bp, Homo sapiens
gtggcaggttccgtagacagca

SEQ ID NO: 8427119 - DNA, 22 bp, Homo sapiens
taagattacagtgagaaataaa

SEQ ID NO: 8427120 - DNA, 22 bp, Homo sapiens
taagatgtggaatcacagcttc

SEQ ID NO: 8427121 - DNA, 22 bp, Homo sapiens
taagattatacttaaagagaaa

SEQ ID NO: 8427122 - DNA, 22 bp, Homo sapiens
taagcaaaggattttgatcttt

SEQ ID NO: 8427123 - DNA, 22 bp, Homo sapiens
taagatgtacaaccacttctct

SEQ ID NO: 8427124 - DNA, 22 bp, Homo sapiens
taagatgtacttttgtcctcac

SEQ ID NO: 8427125 - DNA, 22 bp, Homo sapiens
taagacacgggctgatctaaag

SEQ ID NO: 8427126 - DNA, 22 bp, Homo sapiens
taagacacgggctgatctaaag

SEQ ID NO: 8427127 - DNA, 22 bp, Homo sapiens
taagacacctctctgcccttca

SEQ ID NO: 8427128 - DNA, 22 bp, Homo sapiens
taagacacctctctgcccttca

SEQ ID NO: 8427129 - DNA, 23 bp, Homo sapiens
taagacacccgactccagagatg

SEQ ID NO: 8427130 - DNA, 23 bp, Homo sapiens
taagacacccgactccagagatg

SEQ ID NO: 8427131 - DNA, 22 bp, Homo sapiens
taagacacattggagtagatga

SEQ ID NO: 8427132 - DNA, 22 bp, Homo sapiens
taagacacattggagtagatga

SEQ ID NO: 8427133 - DNA, 22 bp, Homo sapiens
taagacacattgagaaacacaa

SEQ ID NO: 8427134 - DNA, 22 bp, Homo sapiens
taagacacattcatatctgtct

SEQ ID NO: 8427135 - DNA, 22 bp, Homo sapiens
taagacacattgagaaacacaa

SEQ ID NO: 8427136 - DNA, 22 bp, Homo sapiens
taagacacatgcgtacaagata

SEQ ID NO: 8427137 - DNA, 22 bp, Homo sapiens
taagacacatgcgtacaagata

SEQ ID NO: 8427138 - DNA, 22 bp, Homo sapiens
taagacacattcatatctgtct

SEQ ID NO: 8427139 - DNA, 22 bp, Homo sapiens
caggcacggtggctcatgcctg

SEQ ID NO: 8427140 - DNA, 22 bp, Homo sapiens
taaggcagatgtggaatcaatt

SEQ ID NO: 8427141 - DNA, 22 bp, Homo sapiens
taaggcacccttctgagtagag

SEQ ID NO: 8427142 - DNA, 22 bp, Homo sapiens
taagcaaatagctagatcagag

SEQ ID NO: 8427143 - DNA, 22 bp, Homo sapiens
caggcacatgggagctcatcat

SEQ ID NO: 8427144 - DNA, 22 bp, Homo sapiens
caggcacatgggagctcatcat

SEQ ID NO: 8427145 - DNA, 22 bp, Homo sapiens
caggcacatgggagctcatcat

SEQ ID NO: 8427146 - DNA, 22 bp, Homo sapiens
caggcaccaacttcctggggag

SEQ ID NO: 8427147 - DNA, 22 bp, Homo sapiens
taagacacagtccgcactctct

SEQ ID NO: 8427148 - DNA, 22 bp, Homo sapiens
taagacacagtccgcactctct

SEQ ID NO: 8427149 - DNA, 22 bp, Homo sapiens
taagacacaaatatcttttaca

SEQ ID NO: 8427150 - DNA, 19 bp, Homo sapiens
taagacacaaatgcaagcc

SEQ ID NO: 8427151 - DNA, 22 bp, Homo sapiens
caggcacagtgttgctgttcaa

SEQ ID NO: 8427152 - DNA, 22 bp, Homo sapiens
caggcacagtggggtcctctct

SEQ ID NO: 8427153 - DNA, 17 bp, Homo sapiens
caggcacatgaagccag

SEQ ID NO: 8427154 - DNA, 22 bp, Homo sapiens
caggcacagctaagactggcca

SEQ ID NO: 8427155 - DNA, 22 bp, Homo sapiens
caggcacagctaagactggcca

SEQ ID NO: 8427156 - DNA, 22 bp, Homo sapiens
caggcacagctaagactggcca

SEQ ID NO: 8427157 - DNA, 22 bp, Homo sapiens
caggcacaagatcggctagata

SEQ ID NO: 8427158 - DNA, 22 bp, Homo sapiens
caggcacaagatcggctagata

SEQ ID NO: 8427159 - DNA, 22 bp, Homo sapiens
caggcacaaatttctagataag

SEQ ID NO: 8427160 - DNA, 22 bp, Homo sapiens
caggcacaagatcggctagata

SEQ ID NO: 8427161 - DNA, 22 bp, Homo sapiens
caggcaaggaggcactgaggga

SEQ ID NO: 8427162 - DNA, 22 bp, Homo sapiens
caggcacaaaaggaccccagca

SEQ ID NO: 8427163 - DNA, 22 bp, Homo sapiens
caggcaagattagagatgagca

SEQ ID NO: 8427164 - DNA, 22 bp, Homo sapiens
caggcaagcaaggggtcttgaa

SEQ ID NO: 8427165 - DNA, 22 bp, Homo sapiens
caggcaagcacggtgaacctgg

SEQ ID NO: 8427166 - DNA, 22 bp, Homo sapiens
caggcaagcaaggggtcttgaa

SEQ ID NO: 8427167 - DNA, 22 bp, Homo sapiens
caggcaagatccagaggctgct

SEQ ID NO: 8427168 - DNA, 22 bp, Homo sapiens
caggcaagatccagaggctgct

SEQ ID NO: 8427169 - DNA, 22 bp, Homo sapiens
caggcaacgtccttagagatgc

SEQ ID NO: 8427170 - DNA, 22 bp, Homo sapiens
caggatggtggcatgatcagaa

SEQ ID NO: 8427171 - DNA, 22 bp, Homo sapiens
taacattaggtagacataagcc

SEQ ID NO: 8427172 - DNA, 22 bp, Homo sapiens
taacattaggtagacataagcc

SEQ ID NO: 8427173 - DNA, 22 bp, Homo sapiens
taacattatacagagaggacag

SEQ ID NO: 8427174 - DNA, 20 bp, Homo sapiens
taacagaagtagaagtgggt

SEQ ID NO: 8427175 - DNA, 22 bp, Homo sapiens
taacagaagagcaggcagccct

SEQ ID NO: 8427176 - DNA, 22 bp, Homo sapiens
taacagaaatatttccaggtga

SEQ ID NO: 8427177 - DNA, 22 bp, Homo sapiens
taacagaaatagaaatgagagt

SEQ ID NO: 8427178 - DNA, 22 bp, Homo sapiens
taacagaaatagtaggtgaggg

SEQ ID NO: 8427179 - DNA, 22 bp, Homo sapiens
taacagaaaggggacagaaata

SEQ ID NO: 8427180 - DNA, 22 bp, Homo sapiens
taacagaaaggggacagaaata

SEQ ID NO: 8427181 - DNA, 22 bp, Homo sapiens
taacagaaaggctcaggtgctc

SEQ ID NO: 8427182 - DNA, 22 bp, Homo sapiens
taacactgtgtctgccatatcc

SEQ ID NO: 8427183 - DNA, 22 bp, Homo sapiens
taacaatacccattctaattac

SEQ ID NO: 8427184 - DNA, 22 bp, Homo sapiens
taacaatacccattctaattac

SEQ ID NO: 8427185 - DNA, 22 bp, Homo sapiens
taacaaggtggtcttggtattt

SEQ ID NO: 8427186 - DNA, 22 bp, Homo sapiens
taacaaggtaagcctggccatg

SEQ ID NO: 8427187 - DNA, 22 bp, Homo sapiens
taacaagatttgtaaaattgta

SEQ ID NO: 8427188 - DNA, 22 bp, Homo sapiens
taacaacatgcaatttaacctt

SEQ ID NO: 8427189 - DNA, 22 bp, Homo sapiens
taacaactggacaatgttgctc

SEQ ID NO: 8427190 - DNA, 22 bp, Homo sapiens
taacaactgctgaggtatttga

SEQ ID NO: 8427191 - DNA, 22 bp, Homo sapiens
taacaacttgcttttatcttag

SEQ ID NO: 8427192 - DNA, 22 bp, Homo sapiens
caggatccctggcctccgccca

SEQ ID NO: 8427193 - DNA, 22 bp, Homo sapiens
caggatcctggctgcatggacg

SEQ ID NO: 8427194 - DNA, 22 bp, Homo sapiens
caggatgagaggcccagggaag

SEQ ID NO: 8427195 - DNA, 22 bp, Homo sapiens
caggatgagaagggctcttacg

SEQ ID NO: 8427196 - DNA, 18 bp, Homo sapiens
caggatgagtgatgggga

SEQ ID NO: 8427197 - DNA, 22 bp, Homo sapiens
caggatgaggtagaggcagata

SEQ ID NO: 8427198 - DNA, 22 bp, Homo sapiens
caggatgcggcctgactctaag

SEQ ID NO: 8427199 - DNA, 20 bp, Homo sapiens
caggatgattggacacgatg

SEQ ID NO: 8427200 - DNA, 22 bp, Homo sapiens
caggatgcagtgggacccaggg

SEQ ID NO: 8427201 - DNA, 22 bp, Homo sapiens
caggatgccatctgctgctgct

SEQ ID NO: 8427202 - DNA, 22 bp, Homo sapiens
caggatgatgttaattgaagtt

SEQ ID NO: 8427203 - DNA, 22 bp, Homo sapiens
tacagtaaccttatttgtcatt

SEQ ID NO: 8427204 - DNA, 22 bp, Homo sapiens
tacagtaaccttatttgtcatt

SEQ ID NO: 8427205 - DNA, 22 bp, Homo sapiens
tacagtaaccagtctacttaga

SEQ ID NO: 8427206 - DNA, 22 bp, Homo sapiens
caggccctgctgctgagacctt

SEQ ID NO: 8427207 - DNA, 22 bp, Homo sapiens
tacagtaacatgttgtacaagc

SEQ ID NO: 8427208 - DNA, 22 bp, Homo sapiens
tacagtaaccagtctacttaga

SEQ ID NO: 8427209 - DNA, 22 bp, Homo sapiens
tacaggtggtaaaaatattgtt

SEQ ID NO: 8427210 - DNA, 22 bp, Homo sapiens
tacagtaaagctgctatgaatt

SEQ ID NO: 8427211 - DNA, 22 bp, Homo sapiens
tacagtaaatgtggtagaaact

SEQ ID NO: 8427212 - DNA, 22 bp, Homo sapiens
tacagtaaatgtggtagaaact

SEQ ID NO: 8427213 - DNA, 22 bp, Homo sapiens
caggccctgggcaggcacagag

SEQ ID NO: 8427214 - DNA, 22 bp, Homo sapiens
caggccctgggcaggatcagcc

SEQ ID NO: 8427215 - DNA, 22 bp, Homo sapiens
caggccctggcagggctgagtc

SEQ ID NO: 8427216 - DNA, 19 bp, Homo sapiens
caggccctggacccatctg

SEQ ID NO: 8427217 - DNA, 22 bp, Homo sapiens
caggccctggcagggctgagtc

SEQ ID NO: 8427218 - DNA, 18 bp, Homo sapiens
caggccctgtctggcctc

SEQ ID NO: 8427219 - DNA, 22 bp, Homo sapiens
caggccctgggcaggcacagag

SEQ ID NO: 8427220 - DNA, 22 bp, Homo sapiens
caggccctttcctgggcatagg

SEQ ID NO: 8427221 - DNA, 22 bp, Homo sapiens
tacagtttgttacattgttagt

SEQ ID NO: 8427222 - DNA, 20 bp, Homo sapiens
tacatattatatcagctgca

SEQ ID NO: 8427223 - DNA, 22 bp, Homo sapiens
tacatatgtaaacatgtataaa

SEQ ID NO: 8427224 - DNA, 22 bp, Homo sapiens
tacatattcaacgttcagtatt

SEQ ID NO: 8427225 - DNA, 22 bp, Homo sapiens
tacatgtggagataactgaagc

SEQ ID NO: 8427226 - DNA, 22 bp, Homo sapiens
tacatcaaatcaatgttccagt

SEQ ID NO: 8427227 - DNA, 22 bp, Homo sapiens
tacaaatgagttgtatgaacca

SEQ ID NO: 8427228 - DNA, 22 bp, Homo sapiens
tacaaatgagttgtatgaacca

SEQ ID NO: 8427229 - DNA, 22 bp, Homo sapiens
tacaaactaacatgtctcatcc

SEQ ID NO: 8427230 - DNA, 22 bp, Homo sapiens
tacaaggaaaatcttgaagtac

SEQ ID NO: 8427231 - DNA, 22 bp, Homo sapiens
tacaaggaaaattttatagtaa

SEQ ID NO: 8427232 - DNA, 22 bp, Homo sapiens
tacaaggcaaatccatgatgtc

SEQ ID NO: 8427233 - DNA, 20 bp, Homo sapiens
tacaaattttccatgtttcc

SEQ ID NO: 8427234 - DNA, 22 bp, Homo sapiens
tacaaattaatgggcatgttta

SEQ ID NO: 8427235 - DNA, 22 bp, Homo sapiens
tacaaatggttgaatggatgaa

SEQ ID NO: 8427236 - DNA, 22 bp, Homo sapiens
tacaaatgggttaaaatatagt

SEQ ID NO: 8427237 - DNA, 22 bp, Homo sapiens
tacaagtgctagcagatattgt

SEQ ID NO: 8427238 - DNA, 22 bp, Homo sapiens
tacaagtgctagcagatattgt

SEQ ID NO: 8427239 - DNA, 22 bp, Homo sapiens
tacaagtgtaagcttgtgagac

SEQ ID NO: 8427240 - DNA, 22 bp, Homo sapiens
tacaagtgtgcaccaccatgtc

SEQ ID NO: 8427241 - DNA, 22 bp, Homo sapiens
tacaagttccattttgaaagtg

SEQ ID NO: 8427242 - DNA, 22 bp, Homo sapiens
tacaagtactgtggctttgaat

SEQ ID NO: 8427243 - DNA, 20 bp, Homo sapiens
tacaagtacattatagttat

SEQ ID NO: 8427244 - DNA, 22 bp, Homo sapiens
tacaagtagctcaggttttctg

SEQ ID NO: 8427245 - DNA, 22 bp, Homo sapiens
tacaaggaggctaatgatgaca

SEQ ID NO: 8427246 - DNA, 20 bp, Homo sapiens
tacaagtacattatagttat

SEQ ID NO: 8427247 - DNA, 22 bp, Homo sapiens
tacaatacttaacctattttgc

SEQ ID NO: 8427248 - DNA, 21 bp, Homo sapiens
tacaagttgcttttgaagtcc

SEQ ID NO: 8427249 - DNA, 22 bp, Homo sapiens
tacagctgttggtgtttcctct

SEQ ID NO: 8427250 - DNA, 22 bp, Homo sapiens
tacagggattgttttaatcacc

SEQ ID NO: 8427251 - DNA, 22 bp, Homo sapiens
tacagggattcctgccgctcgc

SEQ ID NO: 8427252 - DNA, 22 bp, Homo sapiens
tacagctggactggtagctgtg

SEQ ID NO: 8427253 - DNA, 22 bp, Homo sapiens
tacagggtataggtacagatga

SEQ ID NO: 8427254 - DNA, 22 bp, Homo sapiens
tacagggtataggtacagatga

SEQ ID NO: 8427255 - DNA, 22 bp, Homo sapiens
tacagggtattcaagggtagtt

SEQ ID NO: 8427256 - DNA, 17 bp, Homo sapiens
caggcagacatgtaagc

SEQ ID NO: 8427257 - DNA, 22 bp, Homo sapiens
caggcagaaggaagtaccaggc

SEQ ID NO: 8427258 - DNA, 22 bp, Homo sapiens
caggcagagcaactggtccaga

SEQ ID NO: 8427259 - DNA, 22 bp, Homo sapiens
taatgttagtatgtaatcttat

SEQ ID NO: 8427260 - DNA, 22 bp, Homo sapiens
taatttactcagatgttcaatc

SEQ ID NO: 8427261 - DNA, 22 bp, Homo sapiens
caggcagctgcgacaagagagc

SEQ ID NO: 8427262 - DNA, 22 bp, Homo sapiens
caggcagctgcgacaagagagc

SEQ ID NO: 8427263 - DNA, 22 bp, Homo sapiens
caggcagctgcgacaagagagc

SEQ ID NO: 8427264 - DNA, 22 bp, Homo sapiens
caggcaggagacatttggttgg

SEQ ID NO: 8427265 - DNA, 23 bp, Homo sapiens
caggcaggatgaggactacactc

SEQ ID NO: 8427266 - DNA, 22 bp, Homo sapiens
caggcaggagccagggattcca

SEQ ID NO: 8427267 - DNA, 22 bp, Homo sapiens
caggcagctctgcttttcctaa

SEQ ID NO: 8427268 - DNA, 22 bp, Homo sapiens
caggcagctgactgtcagatat

SEQ ID NO: 8427269 - DNA, 22 bp, Homo sapiens
caggcagctctaatggaaagtg

SEQ ID NO: 8427270 - DNA, 22 bp, Homo sapiens
caggcagccaggggacctgtcc

SEQ ID NO: 8427271 - DNA, 22 bp, Homo sapiens
caggcagcatttactctgatga

SEQ ID NO: 8427272 - DNA, 22 bp, Homo sapiens
caggcagcatcagtctgctgta

SEQ ID NO: 8427273 - DNA, 22 bp, Homo sapiens
caggcagcaggagccctgctcg

SEQ ID NO: 8427274 - DNA, 22 bp, Homo sapiens
caggcagcaggagccctgctcg

SEQ ID NO: 8427275 - DNA, 22 bp, Homo sapiens
taaaaatcttatgaatggcaag

SEQ ID NO: 8427276 - DNA, 22 bp, Homo sapiens
taaaaatcttatgaatggcaag

SEQ ID NO: 8427277 - DNA, 22 bp, Homo sapiens
taaaaatcttatgaatggcaag

SEQ ID NO: 8427278 - DNA, 22 bp, Homo sapiens
taaaaagttgaaaggacttatc

SEQ ID NO: 8427279 - DNA, 22 bp, Homo sapiens
taaaaagttgaaaggacttatc

SEQ ID NO: 8427280 - DNA, 22 bp, Homo sapiens
taaaaatcttatgaatggcaag

SEQ ID NO: 8427281 - DNA, 22 bp, Homo sapiens
taaaatcatgacagattgacat

SEQ ID NO: 8427282 - DNA, 22 bp, Homo sapiens
taaaatcagccgaccatggtgg

SEQ ID NO: 8427283 - DNA, 22 bp, Homo sapiens
taaaatgacttcctccaacatc

SEQ ID NO: 8427284 - DNA, 22 bp, Homo sapiens
taaaatgacttcctccaacatc

SEQ ID NO: 8427285 - DNA, 22 bp, Homo sapiens
taaaaaacattactctgtcctg

SEQ ID NO: 8427286 - DNA, 22 bp, Homo sapiens
taaaaaacattactctgtcctg

SEQ ID NO: 8427287 - DNA, 22 bp, Homo sapiens
taaaaaacattactctgtcctg

SEQ ID NO: 8427288 - DNA, 22 bp, Homo sapiens
taaaaaacattactctgtcctg

SEQ ID NO: 8427289 - DNA, 22 bp, Homo sapiens
taaaaaacattactctgtcctg

SEQ ID NO: 8427290 - DNA, 22 bp, Homo sapiens
taaaaagtagtgagaatggcgc

SEQ ID NO: 8427291 - DNA, 22 bp, Homo sapiens
gttttcctgagcccagagatgc

SEQ ID NO: 8427292 - DNA, 22 bp, Homo sapiens
gttttcctgaaactgatggtgt

SEQ ID NO: 8427293 - DNA, 22 bp, Homo sapiens
gttttcctactgtatcatcaaa

SEQ ID NO: 8427294 - DNA, 22 bp, Homo sapiens
gttttcctgttgagtagtattc

SEQ ID NO: 8427295 - DNA, 22 bp, Homo sapiens
gttttccttctcagccattgcc

SEQ ID NO: 8427296 - DNA, 22 bp, Homo sapiens
gttttctgattagcaaatctga

SEQ ID NO: 8427297 - DNA, 22 bp, Homo sapiens
caggaccaggcgttctgggctg

SEQ ID NO: 8427298 - DNA, 22 bp, Homo sapiens
caggaccaggcgttctgggctg

SEQ ID NO: 8427299 - DNA, 22 bp, Homo sapiens
caggacagtttgctttgccctg

SEQ ID NO: 8427300 - DNA, 22 bp, Homo sapiens
caggacagttggcatctgctgc

SEQ ID NO: 8427301 - DNA, 19 bp, Homo sapiens
caggacagtttgccaagaa

SEQ ID NO: 8427302 - DNA, 19 bp, Homo sapiens
caggacagtttgccaagaa

SEQ ID NO: 8427303 - DNA, 22 bp, Homo sapiens
caggagacaatggctgtggggc

SEQ ID NO: 8427304 - DNA, 22 bp, Homo sapiens
caggagacctggtaagccaagt

SEQ ID NO: 8427305 - DNA, 22 bp, Homo sapiens
caggagacagtgttattttatt

SEQ ID NO: 8427306 - DNA, 22 bp, Homo sapiens
caggagacaatggctgtggggc

SEQ ID NO: 8427307 - DNA, 22 bp, Homo sapiens
caggagaagtctctagggggtg

SEQ ID NO: 8427308 - DNA, 22 bp, Homo sapiens
caggagaaggtttggagtgcag

SEQ ID NO: 8427309 - DNA, 22 bp, Homo sapiens
taaactcttctgtagaatcaga

SEQ ID NO: 8427310 - DNA, 22 bp, Homo sapiens
caggacagtgcaggtccatcct

SEQ ID NO: 8427311 - DNA, 22 bp, Homo sapiens
caggacagtgcaggtccatcct

SEQ ID NO: 8427312 - DNA, 22 bp, Homo sapiens
taaactcttctgtagaatcaga

SEQ ID NO: 8427313 - DNA, 22 bp, Homo sapiens
taaactctcaacagagaaccac

SEQ ID NO: 8427314 - DNA, 22 bp, Homo sapiens
taaactctcaacagagaaccac

SEQ ID NO: 8427315 - DNA, 22 bp, Homo sapiens
taaaccttatttgaataccaac

SEQ ID NO: 8427316 - DNA, 22 bp, Homo sapiens
taaaccaagtgtccatattagt

SEQ ID NO: 8427317 - DNA, 22 bp, Homo sapiens
taaaccaagtgtccatattagt

SEQ ID NO: 8427318 - DNA, 22 bp, Homo sapiens
caggaatgactgcagatggggc

SEQ ID NO: 8427319 - DNA, 22 bp, Homo sapiens
caggaatgagttctggtgctct

SEQ ID NO: 8427320 - DNA, 22 bp, Homo sapiens
caggaatgatattcgaggagat

SEQ ID NO: 8427321 - DNA, 18 bp, Homo sapiens
caggaatggatgggattt

SEQ ID NO: 8427322 - DNA, 22 bp, Homo sapiens
caggacaagagggaatcgataa

SEQ ID NO: 8427323 - DNA, 22 bp, Homo sapiens
caggaatgtttgtgctccttta

SEQ ID NO: 8427324 - DNA, 22 bp, Homo sapiens
caggacaatttccacttggtaa

SEQ ID NO: 8427325 - DNA, 22 bp, Homo sapiens
caggacacagggtgtggctgat

SEQ ID NO: 8427326 - DNA, 22 bp, Homo sapiens
caggacacatttcttgttcagg

SEQ ID NO: 8427327 - DNA, 22 bp, Homo sapiens
caggacagctcaacacctcctc

SEQ ID NO: 8427328 - DNA, 22 bp, Homo sapiens
caggacactacagatgggaggg

SEQ ID NO: 8427329 - DNA, 22 bp, Homo sapiens
caggacagctgggccaccacca

SEQ ID NO: 8427330 - DNA, 22 bp, Homo sapiens
caggacaggagtggggtcaaag

SEQ ID NO: 8427331 - DNA, 22 bp, Homo sapiens
caggacaggagtggggtcaaag

SEQ ID NO: 8427332 - DNA, 22 bp, Homo sapiens
caggacaggccctgtggggtct

SEQ ID NO: 8427333 - DNA, 22 bp, Homo sapiens
caggacaggccctgtggggtct

SEQ ID NO: 8427334 - DNA, 22 bp, Homo sapiens
caggacaggagtggggtcaaag

SEQ ID NO: 8427335 - DNA, 22 bp, Homo sapiens
caggacagtataggctttagga

SEQ ID NO: 8427336 - DNA, 22 bp, Homo sapiens
caggacagtataggctttagga

SEQ ID NO: 8427337 - DNA, 22 bp, Homo sapiens
caggaatagtggagcaacaaga

SEQ ID NO: 8427338 - DNA, 22 bp, Homo sapiens
caggaagtgtgcctgagcacct

SEQ ID NO: 8427339 - DNA, 22 bp, Homo sapiens
caggaatgactgcagatggggc

SEQ ID NO: 8427340 - DNA, 22 bp, Homo sapiens
caggaagtggctgggctgggtt

SEQ ID NO: 8427341 - DNA, 22 bp, Homo sapiens
caggaagtgctcgctgtgggga

SEQ ID NO: 8427342 - DNA, 22 bp, Homo sapiens
caggaagtcgcagagctggggg

SEQ ID NO: 8427343 - DNA, 22 bp, Homo sapiens
caggaagggggatccttggaag

SEQ ID NO: 8427344 - DNA, 22 bp, Homo sapiens
caggaagggggatccttggaag

SEQ ID NO: 8427345 - DNA, 22 bp, Homo sapiens
caggaagctgtgaaggagacgg

SEQ ID NO: 8427346 - DNA, 22 bp, Homo sapiens
caggaagctgtgaaggagacgg

SEQ ID NO: 8427347 - DNA, 22 bp, Homo sapiens
caggaaggaaagggtgtggaga

SEQ ID NO: 8427348 - DNA, 22 bp, Homo sapiens
caggaagctgccggtgagcgag

SEQ ID NO: 8427349 - DNA, 22 bp, Homo sapiens
caggaagctggtcagatcctgt

SEQ ID NO: 8427350 - DNA, 22 bp, Homo sapiens
caggaagctgggtttccataca

SEQ ID NO: 8427351 - DNA, 22 bp, Homo sapiens
caggaagctggtcagatcctgt

SEQ ID NO: 8427352 - DNA, 22 bp, Homo sapiens
caggaagctgagctgcactgca

SEQ ID NO: 8427353 - DNA, 22 bp, Homo sapiens
caggaagctgagctgcactgca

SEQ ID NO: 8427354 - DNA, 22 bp, Homo sapiens
caggaagctgatgtctagtcat

SEQ ID NO: 8427355 - DNA, 22 bp, Homo sapiens
caggaagctgagctgcactgca

SEQ ID NO: 8427356 - DNA, 22 bp, Homo sapiens
caggaagccacaggacaggtag

SEQ ID NO: 8427357 - DNA, 22 bp, Homo sapiens
caggaagccacaggacaggtag

SEQ ID NO: 8427358 - DNA, 22 bp, Homo sapiens
caggaagccacaggacaggtag

SEQ ID NO: 8427359 - DNA, 22 bp, Homo sapiens
caggaagcatctggctagctaa

SEQ ID NO: 8427360 - DNA, 22 bp, Homo sapiens
caggaagcatctggctagctaa

SEQ ID NO: 8427361 - DNA, 22 bp, Homo sapiens
caggaagctcttagcagtcacc

SEQ ID NO: 8427362 - DNA, 22 bp, Homo sapiens
caggaagctagattttgttgct

SEQ ID NO: 8427363 - DNA, 22 bp, Homo sapiens
caggaagctcttagcagtcacc

SEQ ID NO: 8427364 - DNA, 22 bp, Homo sapiens
caggaagccacaggacaggtag

SEQ ID NO: 8427365 - DNA, 22 bp, Homo sapiens
caggaagccttccttgtctgct

SEQ ID NO: 8427366 - DNA, 22 bp, Homo sapiens
gtttgtatgaatgttttatgct

SEQ ID NO: 8427367 - DNA, 23 bp, Homo sapiens
caggaagcagatggggtagaaga

SEQ ID NO: 8427368 - DNA, 22 bp, Homo sapiens
caggaagcagtagaacttttcc

SEQ ID NO: 8427369 - DNA, 23 bp, Homo sapiens
caggaagcagatggggtagaaga

SEQ ID NO: 8427370 - DNA, 22 bp, Homo sapiens
gtttggtggtagcattggctat

SEQ ID NO: 8427371 - DNA, 22 bp, Homo sapiens
gtttggaatagcagtaaacatt

SEQ ID NO: 8427372 - DNA, 22 bp, Homo sapiens
gtttggatagtgagagatactt

SEQ ID NO: 8427373 - DNA, 22 bp, Homo sapiens
caggagtgtttgctacagtttc

SEQ ID NO: 8427374 - DNA, 22 bp, Homo sapiens
caggagtgttgattgctcagga

SEQ ID NO: 8427375 - DNA, 22 bp, Homo sapiens
taacaaaggttgccaaactaag

SEQ ID NO: 8427376 - DNA, 22 bp, Homo sapiens
taacaaagtaccatagactgga

SEQ ID NO: 8427377 - DNA, 22 bp, Homo sapiens
caggagtgaaatgaggcccagg

SEQ ID NO: 8427378 - DNA, 22 bp, Homo sapiens
caggagtgaaatgaggcccagg

SEQ ID NO: 8427379 - DNA, 22 bp, Homo sapiens
caggagtgaaatgaggcccagg

SEQ ID NO: 8427380 - DNA, 22 bp, Homo sapiens
caggagggtgtggaaaactggg

SEQ ID NO: 8427381 - DNA, 22 bp, Homo sapiens
caggagtgagttggggtctaca

SEQ ID NO: 8427382 - DNA, 22 bp, Homo sapiens
caggagtgcaggtggtgaggca

SEQ ID NO: 8427383 - DNA, 22 bp, Homo sapiens
caggagtgcaggtggtgaggca

SEQ ID NO: 8427384 - DNA, 22 bp, Homo sapiens
caggagtggtgtgagggactcc

SEQ ID NO: 8427385 - DNA, 22 bp, Homo sapiens
caggagtggtgtgagggactcc

SEQ ID NO: 8427386 - DNA, 22 bp, Homo sapiens
caggagtgtcgggtcactaggt

SEQ ID NO: 8427387 - DNA, 22 bp, Homo sapiens
caggagtgtcgggtcactaggt

SEQ ID NO: 8427388 - DNA, 22 bp, Homo sapiens
caggagtgtctccacacagcaa

SEQ ID NO: 8427389 - DNA, 22 bp, Homo sapiens
caggagtgtctccacacagcaa

SEQ ID NO: 8427390 - DNA, 22 bp, Homo sapiens
caggagtgtctccacacagcaa

SEQ ID NO: 8427391 - DNA, 22 bp, Homo sapiens
caggagggcccgagactcttcc

SEQ ID NO: 8427392 - DNA, 20 bp, Homo sapiens
caggagggacatttcagcat

SEQ ID NO: 8427393 - DNA, 22 bp, Homo sapiens
caggaggctttgggatccaagt

SEQ ID NO: 8427394 - DNA, 22 bp, Homo sapiens
caggaggctcctagggctctgt

SEQ ID NO: 8427395 - DNA, 22 bp, Homo sapiens
caggaggccaactgtgggactt

SEQ ID NO: 8427396 - DNA, 22 bp, Homo sapiens
caggaggccaactgtgggactt

SEQ ID NO: 8427397 - DNA, 22 bp, Homo sapiens
caggaggcatcatggagcggac

SEQ ID NO: 8427398 - DNA, 22 bp, Homo sapiens
caggaggcatatttaaatccaa

SEQ ID NO: 8427399 - DNA, 22 bp, Homo sapiens
caggaggcagcgctctcaggac

SEQ ID NO: 8427400 - DNA, 22 bp, Homo sapiens
caggaggcagaggatgcccagt

SEQ ID NO: 8427401 - DNA, 22 bp, Homo sapiens
caggaggaaatgtgaccctgct

SEQ ID NO: 8427402 - DNA, 22 bp, Homo sapiens
taaatgtaccttctgccttact

SEQ ID NO: 8427403 - DNA, 22 bp, Homo sapiens
taaatgtcaatgtgatttataa

SEQ ID NO: 8427404 - DNA, 22 bp, Homo sapiens
taaatgtctgttaacatgaatg

SEQ ID NO: 8427405 - DNA, 22 bp, Homo sapiens
taaatgtcaatgtgatttataa

SEQ ID NO: 8427406 - DNA, 22 bp, Homo sapiens
caggagcttctgcccatggcca

SEQ ID NO: 8427407 - DNA, 22 bp, Homo sapiens
caggaggaaactggattcactt

SEQ ID NO: 8427408 - DNA, 22 bp, Homo sapiens
caggagctttcttcccaaactt

SEQ ID NO: 8427409 - DNA, 22 bp, Homo sapiens
caggagctgggtctggaagcag

SEQ ID NO: 8427410 - DNA, 22 bp, Homo sapiens
caggagcttctgcccatggcca

SEQ ID NO: 8427411 - DNA, 22 bp, Homo sapiens
caggagcttctgcccatggcca

SEQ ID NO: 8427412 - DNA, 22 bp, Homo sapiens
taaatgtctgttaacatgaatg

SEQ ID NO: 8427413 - DNA, 22 bp, Homo sapiens
taaatgtgaccttcattttata

SEQ ID NO: 8427414 - DNA, 22 bp, Homo sapiens
taaatgtctttgtcacgttggg

SEQ ID NO: 8427415 - DNA, 22 bp, Homo sapiens
caggagctgggtctggaagcag

SEQ ID NO: 8427416 - DNA, 22 bp, Homo sapiens
taaagccaatatacctagcata

SEQ ID NO: 8427417 - DNA, 22 bp, Homo sapiens
taaagccaacactttactgctc

SEQ ID NO: 8427418 - DNA, 22 bp, Homo sapiens
taaagcatgtactgtgtgctag

SEQ ID NO: 8427419 - DNA, 22 bp, Homo sapiens
taaagcatgtgttagaagtgca

SEQ ID NO: 8427420 - DNA, 22 bp, Homo sapiens
taaagcatgtttcagtaaggtt

SEQ ID NO: 8427421 - DNA, 22 bp, Homo sapiens
taaagtcaaggtactgtttcac

SEQ ID NO: 8427422 - DNA, 22 bp, Homo sapiens
taaagccacgctggaaatcagg

SEQ ID NO: 8427423 - DNA, 22 bp, Homo sapiens
taaagtcacagagcaggtgcaa

SEQ ID NO: 8427424 - DNA, 23 bp, Homo sapiens
taaagtcacatattagagtgagc

SEQ ID NO: 8427425 - DNA, 22 bp, Homo sapiens
taaagtcagatatctgggttga

SEQ ID NO: 8427426 - DNA, 22 bp, Homo sapiens
taaagtcatctttaaacatgcc

SEQ ID NO: 8427427 - DNA, 22 bp, Homo sapiens
taaatgcttagattcatagaaa

SEQ ID NO: 8427428 - DNA, 22 bp, Homo sapiens
taaatcaagaatatcagcttgt

SEQ ID NO: 8427429 - DNA, 22 bp, Homo sapiens
taaatcaagaatatcagcttgt

SEQ ID NO: 8427430 - DNA, 22 bp, Homo sapiens
taaatcaagaatatcagcttgt

SEQ ID NO: 8427431 - DNA, 22 bp, Homo sapiens
caggagcaaatccaaaagaatt

SEQ ID NO: 8427432 - DNA, 23 bp, Homo sapiens
caggagatggctgctgtgtcagc

SEQ ID NO: 8427433 - DNA, 22 bp, Homo sapiens
caggagatgacagggaagaacc

SEQ ID NO: 8427434 - DNA, 22 bp, Homo sapiens
caggagatgacagggaagaacc

SEQ ID NO: 8427435 - DNA, 22 bp, Homo sapiens
caggagatgacagggaagaacc

SEQ ID NO: 8427436 - DNA, 22 bp, Homo sapiens
caggagaggctgtacgtttctc

SEQ ID NO: 8427437 - DNA, 22 bp, Homo sapiens
caggagaggaggctacttctta

SEQ ID NO: 8427438 - DNA, 15 bp, Homo sapiens
caggagaggaaggtt

SEQ ID NO: 8427439 - DNA, 22 bp, Homo sapiens
caggagagcccgggtccgggct

SEQ ID NO: 8427440 - DNA, 22 bp, Homo sapiens
caggagagcccgggtccgggct

SEQ ID NO: 8427441 - DNA, 22 bp, Homo sapiens
caggagactatggcccaaggcc

SEQ ID NO: 8427442 - DNA, 22 bp, Homo sapiens
caggagactcagcatccaggat

SEQ ID NO: 8427443 - DNA, 22 bp, Homo sapiens
caggagagatatgagtccccac

SEQ ID NO: 8427444 - DNA, 19 bp, Homo sapiens
caggagagcatgcactttg

SEQ ID NO: 8427445 - DNA, 19 bp, Homo sapiens
caggagagcatgcactttg

SEQ ID NO: 8427446 - DNA, 22 bp, Homo sapiens
caggagagatatgagtccccac

SEQ ID NO: 8427447 - DNA, 22 bp, Homo sapiens
caggagctctcatcgtcagggc

SEQ ID NO: 8427448 - DNA, 22 bp, Homo sapiens
caggagctcttaaggatgtgat

SEQ ID NO: 8427449 - DNA, 22 bp, Homo sapiens
caggagctggataggaccacaa

SEQ ID NO: 8427450 - DNA, 22 bp, Homo sapiens
caggagctggatctccttgcgg

SEQ ID NO: 8427451 - DNA, 22 bp, Homo sapiens
caggagctggataggaccacaa

SEQ ID NO: 8427452 - DNA, 22 bp, Homo sapiens
caggagctcttaaggatgtgat

SEQ ID NO: 8427453 - DNA, 22 bp, Homo sapiens
caggagctggatctccttgcgg

SEQ ID NO: 8427454 - DNA, 22 bp, Homo sapiens
caggagctggatctccttgcgg

SEQ ID NO: 8427455 - DNA, 22 bp, Homo sapiens
taaagcagtgcaaaagcgtttt

SEQ ID NO: 8427456 - DNA, 22 bp, Homo sapiens
caggagccgccaggcacgttgg

SEQ ID NO: 8427457 - DNA, 22 bp, Homo sapiens
caggagccctggtgggtggaca

SEQ ID NO: 8427458 - DNA, 22 bp, Homo sapiens
caggagctcagatgacatctca

SEQ ID NO: 8427459 - DNA, 22 bp, Homo sapiens
caggagctcactgtctaatggg

SEQ ID NO: 8427460 - DNA, 22 bp, Homo sapiens
caggagctcactgtctaatggg

SEQ ID NO: 8427461 - DNA, 22 bp, Homo sapiens
caggagctcacagtctttgggt

SEQ ID NO: 8427462 - DNA, 22 bp, Homo sapiens
caggagctcacagtctttgggt

SEQ ID NO: 8427463 - DNA, 22 bp, Homo sapiens
caggagctactcaggttgggtt

SEQ ID NO: 8427464 - DNA, 22 bp, Homo sapiens
caggagctactcaggttgggtt

SEQ ID NO: 8427465 - DNA, 22 bp, Homo sapiens
caggagctactcaggttgggtt

SEQ ID NO: 8427466 - DNA, 22 bp, Homo sapiens
caggagctcaagaccaccctgg

SEQ ID NO: 8427467 - DNA, 22 bp, Homo sapiens
cctgggtggcagaggttgcagt

SEQ ID NO: 8427468 - DNA, 22 bp, Homo sapiens
cctgggtgatgtgctgccctcg

SEQ ID NO: 8427469 - DNA, 22 bp, Homo sapiens
cctgggtgacagagtgagacct

SEQ ID NO: 8427470 - DNA, 22 bp, Homo sapiens
cctgggtgaaatctctcctgca

SEQ ID NO: 8427471 - DNA, 22 bp, Homo sapiens
cctgggtctgtattggtaggta

SEQ ID NO: 8427472 - DNA, 22 bp, Homo sapiens
cctgggtctgtattggtaggta

SEQ ID NO: 8427473 - DNA, 22 bp, Homo sapiens
cctgggtctggtcactaagtca

SEQ ID NO: 8427474 - DNA, 22 bp, Homo sapiens
cctgggtctcctcctgctggct

SEQ ID NO: 8427475 - DNA, 19 bp, Homo sapiens
cctgggtctgcagcattca

SEQ ID NO: 8427476 - DNA, 19 bp, Homo sapiens
cctgggtctgcagcattca

SEQ ID NO: 8427477 - DNA, 22 bp, Homo sapiens
cctgggtcttggttcatgctct

SEQ ID NO: 8427478 - DNA, 22 bp, Homo sapiens
cctgggtcttcagtctgctggt

SEQ ID NO: 8427479 - DNA, 22 bp, Homo sapiens
cctgggtcttggttcatgctct

SEQ ID NO: 8427480 - DNA, 22 bp, Homo sapiens
cctgggtcttcagtctgctggt

SEQ ID NO: 8427481 - DNA, 22 bp, Homo sapiens
cctgggtctgtattggtaggta

SEQ ID NO: 8427482 - DNA, 22 bp, Homo sapiens
cctgggtcttcagtctgctggt

SEQ ID NO: 8427483 - DNA, 22 bp, Homo sapiens
cctgggtccctgagagatgatt

SEQ ID NO: 8427484 - DNA, 22 bp, Homo sapiens
cctgggtcctggcagcctcctg

SEQ ID NO: 8427485 - DNA, 22 bp, Homo sapiens
cctgggtcccatcccagagtga

SEQ ID NO: 8427486 - DNA, 22 bp, Homo sapiens
cctgggtcccagccaggctttg

SEQ ID NO: 8427487 - DNA, 22 bp, Homo sapiens
cctgggtctcctcctgctggct

SEQ ID NO: 8427488 - DNA, 22 bp, Homo sapiens
cctgggtctatagacttcaaga

SEQ ID NO: 8427489 - DNA, 22 bp, Homo sapiens
tgtgttcatgttgattcatagc

SEQ ID NO: 8427490 - DNA, 22 bp, Homo sapiens
tgtgttcatttaactgttcttt

SEQ ID NO: 8427491 - DNA, 19 bp, Homo sapiens
tgtgttcattcatcagagg

SEQ ID NO: 8427492 - DNA, 23 bp, Homo sapiens
tgtgttctcacacagatgcagta

SEQ ID NO: 8427493 - DNA, 23 bp, Homo sapiens
tgtgttctcacacagatgcagta

SEQ ID NO: 8427494 - DNA, 22 bp, Homo sapiens
tgtgttcatttctctctgctgt

SEQ ID NO: 8427495 - DNA, 22 bp, Homo sapiens
cctggggctccagagcagcgga

SEQ ID NO: 8427496 - DNA, 19 bp, Homo sapiens
cctgggtccactcagacta

SEQ ID NO: 8427497 - DNA, 22 bp, Homo sapiens
cctgggtcccagccaggctttg

SEQ ID NO: 8427498 - DNA, 22 bp, Homo sapiens
tgtgttctccaactgtagattt

SEQ ID NO: 8427499 - DNA, 22 bp, Homo sapiens
cctggggctccagagcagcgga

SEQ ID NO: 8427500 - DNA, 22 bp, Homo sapiens
tgtgttcagtatgacattcaca

SEQ ID NO: 8427501 - DNA, 22 bp, Homo sapiens
tgtgttcaccaaagtgtagaaa

SEQ ID NO: 8427502 - DNA, 22 bp, Homo sapiens
tgtgttcaccaaagtgtagaaa

SEQ ID NO: 8427503 - DNA, 22 bp, Homo sapiens
tgtgttcagaatttgctgcttt

SEQ ID NO: 8427504 - DNA, 22 bp, Homo sapiens
tgtgttcatgtatgtatacata

SEQ ID NO: 8427505 - DNA, 22 bp, Homo sapiens
tgtgttcatgtatgtatacata

SEQ ID NO: 8427506 - DNA, 22 bp, Homo sapiens
tgtgttcatgtatgtatacata

SEQ ID NO: 8427507 - DNA, 22 bp, Homo sapiens
tgtgttcatgtcactggaatcc

SEQ ID NO: 8427508 - DNA, 22 bp, Homo sapiens
tgtgttcatcatgatatcaggt

SEQ ID NO: 8427509 - DNA, 22 bp, Homo sapiens
tgtgttcaatgacttcatcttt

SEQ ID NO: 8427510 - DNA, 22 bp, Homo sapiens
tgtgttcaatcaccaaaggtat

SEQ ID NO: 8427511 - DNA, 22 bp, Homo sapiens
tgtgttcaatccctagtctcag

SEQ ID NO: 8427512 - DNA, 22 bp, Homo sapiens
cctggggacctgcctcagccct

SEQ ID NO: 8427513 - DNA, 22 bp, Homo sapiens
cctggggacctgcctcagccct

SEQ ID NO: 8427514 - DNA, 20 bp, Homo sapiens
cctgggctcaaagcatcctc

SEQ ID NO: 8427515 - DNA, 20 bp, Homo sapiens
cctgggctcaaagcatcctc

SEQ ID NO: 8427516 - DNA, 22 bp, Homo sapiens
cctgggccttgacctcgtgggc

SEQ ID NO: 8427517 - DNA, 22 bp, Homo sapiens
cctgggccttgacctcgtgggc

SEQ ID NO: 8427518 - DNA, 22 bp, Homo sapiens
cctgggctttgctggcaaggcc

SEQ ID NO: 8427519 - DNA, 22 bp, Homo sapiens
cctgggctcaagcgatcttgtc

SEQ ID NO: 8427520 - DNA, 22 bp, Homo sapiens
cctgggcttccacgagcagagg

SEQ ID NO: 8427521 - DNA, 22 bp, Homo sapiens
cctgggcttccacgagcagagg

SEQ ID NO: 8427522 - DNA, 22 bp, Homo sapiens
cctgggctttgctggcaaggcc

SEQ ID NO: 8427523 - DNA, 22 bp, Homo sapiens
cctgggctttgctggcaaggcc

SEQ ID NO: 8427524 - DNA, 22 bp, Homo sapiens
cctgggctttggaacagtactt

SEQ ID NO: 8427525 - DNA, 22 bp, Homo sapiens
cctgggctttggaacagtactt

SEQ ID NO: 8427526 - DNA, 22 bp, Homo sapiens
cctggggaagtcacttctcttt

SEQ ID NO: 8427527 - DNA, 22 bp, Homo sapiens
cctggggaagtcacttctcttt

SEQ ID NO: 8427528 - DNA, 22 bp, Homo sapiens
tgtgtgtcagagtctccatggt

SEQ ID NO: 8427529 - DNA, 22 bp, Homo sapiens
tgtgtgtcactgaaagaaatct

SEQ ID NO: 8427530 - DNA, 19 bp, Homo sapiens
tgtgtggttggtgaaactc

SEQ ID NO: 8427531 - DNA, 22 bp, Homo sapiens
cctgggcctctcaaagtgctgg

SEQ ID NO: 8427532 - DNA, 22 bp, Homo sapiens
cctgggcctctcaaagtgctgg

SEQ ID NO: 8427533 - DNA, 22 bp, Homo sapiens
cctgggcctggcgggtcggctc

SEQ ID NO: 8427534 - DNA, 22 bp, Homo sapiens
cctgggcctggcgggtcggctc

SEQ ID NO: 8427535 - DNA, 22 bp, Homo sapiens
cctgggcctgaaaacatttctc

SEQ ID NO: 8427536 - DNA, 22 bp, Homo sapiens
tgtgtgtcagtcttgtttaggg

SEQ ID NO: 8427537 - DNA, 22 bp, Homo sapiens
tgtgtgtccttgacctcagtgg

SEQ ID NO: 8427538 - DNA, 19 bp, Homo sapiens
cctgggcctccatcacccc

SEQ ID NO: 8427539 - DNA, 22 bp, Homo sapiens
cctgggcctcacccagctcttg

SEQ ID NO: 8427540 - DNA, 21 bp, Homo sapiens
tgtggctgcctctggccctgg

SEQ ID NO: 8427541 - DNA, 21 bp, Homo sapiens
tgtggctgcctctggccctgg

SEQ ID NO: 8427542 - DNA, 22 bp, Homo sapiens
tgtggcagggatactgaggcag

SEQ ID NO: 8427543 - DNA, 22 bp, Homo sapiens
tgtggcagggatactgaggcag

SEQ ID NO: 8427544 - DNA, 22 bp, Homo sapiens
tgtggcaggcaagatgtacaga

SEQ ID NO: 8427545 - DNA, 22 bp, Homo sapiens
tgtggcaggcattctgaggctg

SEQ ID NO: 8427546 - DNA, 22 bp, Homo sapiens
tgtggcaggcattctgaggctg

SEQ ID NO: 8427547 - DNA, 22 bp, Homo sapiens
tgtggcaggaagagcttctgag

SEQ ID NO: 8427548 - DNA, 22 bp, Homo sapiens
tgtggcaggaagagcttctgag

SEQ ID NO: 8427549 - DNA, 22 bp, Homo sapiens
tgtgcttgtcgtggagccaggc

SEQ ID NO: 8427550 - DNA, 22 bp, Homo sapiens
tgtgctttcaaagttaagtaaa

SEQ ID NO: 8427551 - DNA, 22 bp, Homo sapiens
tgtgcttttctctgctcctgga

SEQ ID NO: 8427552 - DNA, 22 bp, Homo sapiens
tgtggctgttgaggaccccaag

SEQ ID NO: 8427553 - DNA, 22 bp, Homo sapiens
tgtggctgttgaggaccccaag

SEQ ID NO: 8427554 - DNA, 22 bp, Homo sapiens
tgtggctgtgtccacctgctgc

SEQ ID NO: 8427555 - DNA, 22 bp, Homo sapiens
tgtgggaaatgggagtggaaga

SEQ ID NO: 8427556 - DNA, 22 bp, Homo sapiens
cctgggagctgtggaaaggctg

SEQ ID NO: 8427557 - DNA, 22 bp, Homo sapiens
cctgggaggcagaggttgcagt

SEQ ID NO: 8427558 - DNA, 17 bp, Homo sapiens
cctgggaggagttatga

SEQ ID NO: 8427559 - DNA, 22 bp, Homo sapiens
tgtggctgctcaggtgcagacc

SEQ ID NO: 8427560 - DNA, 22 bp, Homo sapiens
tgtggctgctcctgggtggtca

SEQ ID NO: 8427561 - DNA, 22 bp, Homo sapiens
tgtggctggattgattttacct

SEQ ID NO: 8427562 - DNA, 15 bp, Homo sapiens
tgtggctggctcctg

SEQ ID NO: 8427563 - DNA, 22 bp, Homo sapiens
tgtggctgggaagaaggtaact

SEQ ID NO: 8427564 - DNA, 18 bp, Homo sapiens
tgtggctggtccacactg

SEQ ID NO: 8427565 - DNA, 22 bp, Homo sapiens
tgtggctgggctaataggcaaa

SEQ ID NO: 8427566 - DNA, 22 bp, Homo sapiens
tgtggctggtctccgagcgtcg

SEQ ID NO: 8427567 - DNA, 18 bp, Homo sapiens
tgtggctggtccacactg

SEQ ID NO: 8427568 - DNA, 22 bp, Homo sapiens
tgtggctgtctgttctcctagg

SEQ ID NO: 8427569 - DNA, 22 bp, Homo sapiens
tgtggctgtgccgtcacacgtg

SEQ ID NO: 8427570 - DNA, 22 bp, Homo sapiens
tgtggctgtggttttcataaat

SEQ ID NO: 8427571 - DNA, 22 bp, Homo sapiens
tgtggctgtggatgctttccag

SEQ ID NO: 8427572 - DNA, 22 bp, Homo sapiens
tgtggctgtggatgctttccag

SEQ ID NO: 8427573 - DNA, 23 bp, Homo sapiens
cctgggcattggctgcagcttct

SEQ ID NO: 8427574 - DNA, 22 bp, Homo sapiens
cctgggcatctcatgcacctgc

SEQ ID NO: 8427575 - DNA, 22 bp, Homo sapiens
cctgggcctatcctagaaccaa

SEQ ID NO: 8427576 - DNA, 22 bp, Homo sapiens
cctgggccctcaccgccggtgg

SEQ ID NO: 8427577 - DNA, 22 bp, Homo sapiens
cctgggccaggcttgggaatgc

SEQ ID NO: 8427578 - DNA, 21 bp, Homo sapiens
cctgggccaaattccctggac

SEQ ID NO: 8427579 - DNA, 21 bp, Homo sapiens
cctgggccaaattccctggac

SEQ ID NO: 8427580 - DNA, 22 bp, Homo sapiens
cctgggccaggcttgggaatgc

SEQ ID NO: 8427581 - DNA, 22 bp, Homo sapiens
cctgggccaggcttgggaatgc

SEQ ID NO: 8427582 - DNA, 22 bp, Homo sapiens
cctgggaggcggaggttgcagg

SEQ ID NO: 8427583 - DNA, 19 bp, Homo sapiens
cctgggaggcggaggttgc

SEQ ID NO: 8427584 - DNA, 22 bp, Homo sapiens
cctgggaggcggaggttgcagt

SEQ ID NO: 8427585 - DNA, 22 bp, Homo sapiens
cctgggcagcctgctcaaggac

SEQ ID NO: 8427586 - DNA, 22 bp, Homo sapiens
tgtgtgggcgaagacagccttt

SEQ ID NO: 8427587 - DNA, 22 bp, Homo sapiens
tgtggggcttacaaaggcagat

SEQ ID NO: 8427588 - DNA, 22 bp, Homo sapiens
cctgggcctcacccagctcttg

SEQ ID NO: 8427589 - DNA, 22 bp, Homo sapiens
cctgggcctcacccagctcttg

SEQ ID NO: 8427590 - DNA, 22 bp, Homo sapiens
cctgggcctatcctagaaccaa

SEQ ID NO: 8427591 - DNA, 22 bp, Homo sapiens
tgtggggctccctggcagcctg

SEQ ID NO: 8427592 - DNA, 20 bp, Homo sapiens
cctggctgcattcaggacgg

SEQ ID NO: 8427593 - DNA, 20 bp, Homo sapiens
cctggctgcattcaggacgg

SEQ ID NO: 8427594 - DNA, 22 bp, Homo sapiens
cctggctgcattttgctggatg

SEQ ID NO: 8427595 - DNA, 22 bp, Homo sapiens
cctggctgcattttgctggatg

SEQ ID NO: 8427596 - DNA, 22 bp, Homo sapiens
cctggctgcccatggaccctct

SEQ ID NO: 8427597 - DNA, 22 bp, Homo sapiens
cctggctgcccatggaccctct

SEQ ID NO: 8427598 - DNA, 22 bp, Homo sapiens
cctggctgcattttgctggatg

SEQ ID NO: 8427599 - DNA, 22 bp, Homo sapiens
cctggctgccgagtgtgcagcg

SEQ ID NO: 8427600 - DNA, 22 bp, Homo sapiens
cctggctgccgagtgtgcagcg

SEQ ID NO: 8427601 - DNA, 22 bp, Homo sapiens
cctggctgccttgtgttgatct

SEQ ID NO: 8427602 - DNA, 22 bp, Homo sapiens
cctggctgctatagcagcatgt

SEQ ID NO: 8427603 - DNA, 22 bp, Homo sapiens
cctggctgctgtcactgaccat

SEQ ID NO: 8427604 - DNA, 22 bp, Homo sapiens
cctggctgctatagcagcatgt

SEQ ID NO: 8427605 - DNA, 22 bp, Homo sapiens
cctggctgctatagcagcatgt

SEQ ID NO: 8427606 - DNA, 22 bp, Homo sapiens
cctggctgctgtcactgaccat

SEQ ID NO: 8427607 - DNA, 19 bp, Homo sapiens
cctggctgtgaagcctgca

SEQ ID NO: 8427608 - DNA, 23 bp, Homo sapiens
cctggctgtggatttgggcctgc

SEQ ID NO: 8427609 - DNA, 23 bp, Homo sapiens
cctggctgtggatttgggcctgc

SEQ ID NO: 8427610 - DNA, 22 bp, Homo sapiens
cctggctgtgcattgccggccc

SEQ ID NO: 8427611 - DNA, 22 bp, Homo sapiens
cctggctgtgcattgccggccc

SEQ ID NO: 8427612 - DNA, 22 bp, Homo sapiens
cctggctgtggcggtgctctca

SEQ ID NO: 8427613 - DNA, 22 bp, Homo sapiens
cctggctgtggcggtgctctca

SEQ ID NO: 8427614 - DNA, 22 bp, Homo sapiens
cctggctgtttatttcggggct

SEQ ID NO: 8427615 - DNA, 22 bp, Homo sapiens
cctggctgtgtgaccttggcaa

SEQ ID NO: 8427616 - DNA, 23 bp, Homo sapiens
cctggcttcattctcttagggtg

SEQ ID NO: 8427617 - DNA, 22 bp, Homo sapiens
cctggcttcctggagctcacaa

SEQ ID NO: 8427618 - DNA, 22 bp, Homo sapiens
cctggcttatttttatagcagt

SEQ ID NO: 8427619 - DNA, 21 bp, Homo sapiens
cctggcttcagggtgcactgg

SEQ ID NO: 8427620 - DNA, 21 bp, Homo sapiens
cctggcttcagggtgcactgg

SEQ ID NO: 8427621 - DNA, 22 bp, Homo sapiens
cctgggaacagcagagtcctgg

SEQ ID NO: 8427622 - DNA, 22 bp, Homo sapiens
cctgggaacagcagagtcctgg

SEQ ID NO: 8427623 - DNA, 20 bp, Homo sapiens
cctggctttgcagcatgaga

SEQ ID NO: 8427624 - DNA, 22 bp, Homo sapiens
cctggctttagctgccttccct

SEQ ID NO: 8427625 - DNA, 22 bp, Homo sapiens
cctggctttgaccttgctgttt

SEQ ID NO: 8427626 - DNA, 22 bp, Homo sapiens
cctggctttctcatttacaggc

SEQ ID NO: 8427627 - DNA, 21 bp, Homo sapiens
cctgggagatcagctgccttc

SEQ ID NO: 8427628 - DNA, 22 bp, Homo sapiens
cctgggagccaagcctctgtgt

SEQ ID NO: 8427629 - DNA, 22 bp, Homo sapiens
cctgggaagaccggcagtgggg

SEQ ID NO: 8427630 - DNA, 22 bp, Homo sapiens
cctgggaagcccatagcagctt

SEQ ID NO: 8427631 - DNA, 22 bp, Homo sapiens
tgtgcccagactgcctcagtga

SEQ ID NO: 8427632 - DNA, 22 bp, Homo sapiens
tgtgcccagactgcctcagtga

SEQ ID NO: 8427633 - DNA, 22 bp, Homo sapiens
tgtgctgggaaatggcaggata

SEQ ID NO: 8427634 - DNA, 22 bp, Homo sapiens
tgtgctggtacatgtgaggatg

SEQ ID NO: 8427635 - DNA, 22 bp, Homo sapiens
tgtgctgggagatagagggagg

SEQ ID NO: 8427636 - DNA, 22 bp, Homo sapiens
tgtgcttctcacatcactgttg

SEQ ID NO: 8427637 - DNA, 22 bp, Homo sapiens
tgtctgtctgcacagctcatgg

SEQ ID NO: 8427638 - DNA, 22 bp, Homo sapiens
tgtctgtattagtcagcattct

SEQ ID NO: 8427639 - DNA, 20 bp, Homo sapiens
tgtctgtatgcagtcatata

SEQ ID NO: 8427640 - DNA, 22 bp, Homo sapiens
tgtctggtgggttgacaggcag

SEQ ID NO: 8427641 - DNA, 22 bp, Homo sapiens
tgtctggtgggttgacaggcag

SEQ ID NO: 8427642 - DNA, 22 bp, Homo sapiens
tgtctgggttttgggtcatatt

SEQ ID NO: 8427643 - DNA, 23 bp, Homo sapiens
tgtctggttcatgcttattttgg

SEQ ID NO: 8427644 - DNA, 22 bp, Homo sapiens
tgtctgtaatagtcactatgtg

SEQ ID NO: 8427645 - DNA, 22 bp, Homo sapiens
tgtctttagaaagaagcagaca

SEQ ID NO: 8427646 - DNA, 22 bp, Homo sapiens
tgtctttagacctctctggcct

SEQ ID NO: 8427647 - DNA, 22 bp, Homo sapiens
tgtctttacttagaagttcagg

SEQ ID NO: 8427648 - DNA, 22 bp, Homo sapiens
tgtctttacttagaagttcagg

SEQ ID NO: 8427649 - DNA, 22 bp, Homo sapiens
tgtctttacttaataaatatac

SEQ ID NO: 8427650 - DNA, 22 bp, Homo sapiens
tgtctttacttaataaatatac

SEQ ID NO: 8427651 - DNA, 22 bp, Homo sapiens
tgtctgtctgtccttctcatta

SEQ ID NO: 8427652 - DNA, 22 bp, Homo sapiens
tgtctttagagtcacaaaacca

SEQ ID NO: 8427653 - DNA, 22 bp, Homo sapiens
tgtctttagccagcagtcttct

SEQ ID NO: 8427654 - DNA, 21 bp, Homo sapiens
tgtctttaggacctgttaaat

SEQ ID NO: 8427655 - DNA, 21 bp, Homo sapiens
tgtctttaggacctgttaaat

SEQ ID NO: 8427656 - DNA, 22 bp, Homo sapiens
tgtctttagttgcttagatttg

SEQ ID NO: 8427657 - DNA, 22 bp, Homo sapiens
cctggctgaacaaagtccctcc

SEQ ID NO: 8427658 - DNA, 22 bp, Homo sapiens
cctggctcttctgtgtcagccc

SEQ ID NO: 8427659 - DNA, 22 bp, Homo sapiens
cctggctcttctgtgtcagccc

SEQ ID NO: 8427660 - DNA, 22 bp, Homo sapiens
cctggctgacagcttaattcca

SEQ ID NO: 8427661 - DNA, 22 bp, Homo sapiens
cctggctgaaccaatgaagtgg

SEQ ID NO: 8427662 - DNA, 22 bp, Homo sapiens
cctggctcttctgtgtcagccc

SEQ ID NO: 8427663 - DNA, 22 bp, Homo sapiens
cctggctcttcgggagtttgtt

SEQ ID NO: 8427664 - DNA, 22 bp, Homo sapiens
cctggctcttcgggagtttgtt

SEQ ID NO: 8427665 - DNA, 22 bp, Homo sapiens
cctggctcttcgggagtttgtt

SEQ ID NO: 8427666 - DNA, 19 bp, Homo sapiens
cctggctctgagcccagcc

SEQ ID NO: 8427667 - DNA, 19 bp, Homo sapiens
cctggctctgagcccagcc

SEQ ID NO: 8427668 - DNA, 19 bp, Homo sapiens
cctggctctgagcccagcc

SEQ ID NO: 8427669 - DNA, 19 bp, Homo sapiens
cctggctctgagcccagcc

SEQ ID NO: 8427670 - DNA, 22 bp, Homo sapiens
cctggctgaggggccaaggacc

SEQ ID NO: 8427671 - DNA, 22 bp, Homo sapiens
cctggctgaggggccaaggacc

SEQ ID NO: 8427672 - DNA, 23 bp, Homo sapiens
cctggctgacctgaaggtgtagt

SEQ ID NO: 8427673 - DNA, 22 bp, Homo sapiens
cctggctgagggacctcgggta

SEQ ID NO: 8427674 - DNA, 22 bp, Homo sapiens
cctggctgagcctccaggaaga

SEQ ID NO: 8427675 - DNA, 22 bp, Homo sapiens
cctggctgagggacctcgggta

SEQ ID NO: 8427676 - DNA, 22 bp, Homo sapiens
tgtctgggtcacccctcctggc

SEQ ID NO: 8427677 - DNA, 22 bp, Homo sapiens
tgtctggggaactgtgcatcca

SEQ ID NO: 8427678 - DNA, 23 bp, Homo sapiens
tgtctggggcgccagaagagaga

SEQ ID NO: 8427679 - DNA, 23 bp, Homo sapiens
tgtctggggcgccagaagagaga

SEQ ID NO: 8427680 - DNA, 21 bp, Homo sapiens
cctggctgcacagttgctggt

SEQ ID NO: 8427681 - DNA, 23 bp, Homo sapiens
tgtctggggcgccagaagagaga

SEQ ID NO: 8427682 - DNA, 21 bp, Homo sapiens
cctggctgcacagttgctggt

SEQ ID NO: 8427683 - DNA, 22 bp, Homo sapiens
tgtctttctgacccaaggtagt

SEQ ID NO: 8427684 - DNA, 22 bp, Homo sapiens
tgtctttctgacccaaggtagt

SEQ ID NO: 8427685 - DNA, 23 bp, Homo sapiens
tgtctttgaatgggctgtagaca

SEQ ID NO: 8427686 - DNA, 22 bp, Homo sapiens
tgtctttatatatttggaaaat

SEQ ID NO: 8427687 - DNA, 18 bp, Homo sapiens
tgtctttggaccactgaa

SEQ ID NO: 8427688 - DNA, 22 bp, Homo sapiens
tgtgaaggagatgaagggagtg

SEQ ID NO: 8427689 - DNA, 22 bp, Homo sapiens
tgtgaaggtaaggtttgcttga

SEQ ID NO: 8427690 - DNA, 20 bp, Homo sapiens
tgtgagcagatgctgagtga

SEQ ID NO: 8427691 - DNA, 22 bp, Homo sapiens
tgtgaggtaacgctgctctgtt

SEQ ID NO: 8427692 - DNA, 22 bp, Homo sapiens
tgtgaggtaacgctgctctgtt

SEQ ID NO: 8427693 - DNA, 22 bp, Homo sapiens
tgtgagggttttaagggaatga

SEQ ID NO: 8427694 - DNA, 22 bp, Homo sapiens
cctggctgcagtttttgcagaa

SEQ ID NO: 8427695 - DNA, 21 bp, Homo sapiens
cctggctgcacagttgctggt

SEQ ID NO: 8427696 - DNA, 20 bp, Homo sapiens
cctggctgcattcaggacgg

SEQ ID NO: 8427697 - DNA, 22 bp, Homo sapiens
tgtgaggatgttaaggggatga

SEQ ID NO: 8427698 - DNA, 22 bp, Homo sapiens
tgtattaggttgatgcgaaagt

SEQ ID NO: 8427699 - DNA, 23 bp, Homo sapiens
tgtattacagatgcatcagtgat

SEQ ID NO: 8427700 - DNA, 20 bp, Homo sapiens
tgtattacttggtcttacaa

SEQ ID NO: 8427701 - DNA, 22 bp, Homo sapiens
tgtattcagtgatttcacaata

SEQ ID NO: 8427702 - DNA, 21 bp, Homo sapiens
tgtcagctccctgtcctgtgt

SEQ ID NO: 8427703 - DNA, 22 bp, Homo sapiens
tgtcagctggagatggcatggg

SEQ ID NO: 8427704 - DNA, 22 bp, Homo sapiens
tgtcaggacacagctttctgtg

SEQ ID NO: 8427705 - DNA, 22 bp, Homo sapiens
tgtattcaacttcttaaaaatt

SEQ ID NO: 8427706 - DNA, 22 bp, Homo sapiens
tgtattcaacttcttaaaaatt

SEQ ID NO: 8427707 - DNA, 22 bp, Homo sapiens
tgtcatggtagctgaaggatgt

SEQ ID NO: 8427708 - DNA, 22 bp, Homo sapiens
tgtcatggtatttgtgagctgc

SEQ ID NO: 8427709 - DNA, 22 bp, Homo sapiens
tgtcatgtaaagagtaaatggt

SEQ ID NO: 8427710 - DNA, 22 bp, Homo sapiens
tgtcaggagccaccagcactcc

SEQ ID NO: 8427711 - DNA, 22 bp, Homo sapiens
tgtcaggagccaccagcactcc

SEQ ID NO: 8427712 - DNA, 22 bp, Homo sapiens
tgtcatggcactggtaggagtg

SEQ ID NO: 8427713 - DNA, 22 bp, Homo sapiens
cctggcacatgcagtactcaag

SEQ ID NO: 8427714 - DNA, 22 bp, Homo sapiens
cctggcacatctaactcactct

SEQ ID NO: 8427715 - DNA, 22 bp, Homo sapiens
cctggcacatgatagatgctca

SEQ ID NO: 8427716 - DNA, 22 bp, Homo sapiens
cctggcaccttcacagactact

SEQ ID NO: 8427717 - DNA, 22 bp, Homo sapiens
cctggcactgaccaggcactga

SEQ ID NO: 8427718 - DNA, 22 bp, Homo sapiens
cctggcagaaagagttacacct

SEQ ID NO: 8427719 - DNA, 22 bp, Homo sapiens
cctggcagaatattaaagtgca

SEQ ID NO: 8427720 - DNA, 21 bp, Homo sapiens
cctggcagaagcctgatatgc

SEQ ID NO: 8427721 - DNA, 22 bp, Homo sapiens
cctggcagacagcactgaagct

SEQ ID NO: 8427722 - DNA, 22 bp, Homo sapiens
cctggcagacagcactgaagct

SEQ ID NO: 8427723 - DNA, 22 bp, Homo sapiens
tgtatgtatgtatgtatttggg

SEQ ID NO: 8427724 - DNA, 22 bp, Homo sapiens
tgtatgtatgcatcttttatgt

SEQ ID NO: 8427725 - DNA, 22 bp, Homo sapiens
cctggaggtggaggttgcagtg

SEQ ID NO: 8427726 - DNA, 22 bp, Homo sapiens
cctggcacatagtaagtactag

SEQ ID NO: 8427727 - DNA, 22 bp, Homo sapiens
cctggagcacagcccagtccca

SEQ ID NO: 8427728 - DNA, 22 bp, Homo sapiens
cctggagcaaaaatctaaggag

SEQ ID NO: 8427729 - DNA, 22 bp, Homo sapiens
cctggagaggcgctgcagagga

SEQ ID NO: 8427730 - DNA, 22 bp, Homo sapiens
tgtaaacatatgtatgtatgta

SEQ ID NO: 8427731 - DNA, 22 bp, Homo sapiens
tgtaaacatatgtatgtatgta

SEQ ID NO: 8427732 - DNA, 22 bp, Homo sapiens
tgtaaacatgctgaggctggag

SEQ ID NO: 8427733 - DNA, 22 bp, Homo sapiens
tgtaccaggaggaggacaaatt

SEQ ID NO: 8427734 - DNA, 22 bp, Homo sapiens
tgtaccagatgtctaaagccat

SEQ ID NO: 8427735 - DNA, 22 bp, Homo sapiens
tgtaaagaaagacgcagagtta

SEQ ID NO: 8427736 - DNA, 22 bp, Homo sapiens
tgtaaagaaatagcatttgtag

SEQ ID NO: 8427737 - DNA, 22 bp, Homo sapiens
tgtaaactgtagaaaatacttt

SEQ ID NO: 8427738 - DNA, 22 bp, Homo sapiens
tgtaggattttcaccagacctt

SEQ ID NO: 8427739 - DNA, 22 bp, Homo sapiens
tgtaggcatattcatagagttg

SEQ ID NO: 8427740 - DNA, 22 bp, Homo sapiens
tgtaggcacatgtatatatccc

SEQ ID NO: 8427741 - DNA, 22 bp, Homo sapiens
tgtaggatgtaaggcaggcatc

SEQ ID NO: 8427742 - DNA, 22 bp, Homo sapiens
tgtaggtcaagtccattgtgct

SEQ ID NO: 8427743 - DNA, 22 bp, Homo sapiens
tgtaggtcacagtccctatccc

SEQ ID NO: 8427744 - DNA, 22 bp, Homo sapiens
tggtggctaccaggtcctgggg

SEQ ID NO: 8427745 - DNA, 22 bp, Homo sapiens
tggtgctgccacctcctctgct

SEQ ID NO: 8427746 - DNA, 22 bp, Homo sapiens
tggtgctgccacctcctctgct

SEQ ID NO: 8427747 - DNA, 22 bp, Homo sapiens
tggtgctgccaggctcctgcca

SEQ ID NO: 8427748 - DNA, 22 bp, Homo sapiens
tggtgctgcctcagatgcctta

SEQ ID NO: 8427749 - DNA, 22 bp, Homo sapiens
tggtgctgtgatacgaggcact

SEQ ID NO: 8427750 - DNA, 22 bp, Homo sapiens
tggtgggacatctgaggagagg

SEQ ID NO: 8427751 - DNA, 22 bp, Homo sapiens
cctggaaaatgccactttcaca

SEQ ID NO: 8427752 - DNA, 22 bp, Homo sapiens
cctggactcagaggtgctggtg

SEQ ID NO: 8427753 - DNA, 22 bp, Homo sapiens
cctggactgtgtcctgtggtca

SEQ ID NO: 8427754 - DNA, 22 bp, Homo sapiens
tgtaaacagtaggactaaagag

SEQ ID NO: 8427755 - DNA, 22 bp, Homo sapiens
tgtaaacataccagagccaagt

SEQ ID NO: 8427756 - DNA, 22 bp, Homo sapiens
cctggagacctgatggcagcgg

SEQ ID NO: 8427757 - DNA, 22 bp, Homo sapiens
tggtccctaaagatgtctacat

SEQ ID NO: 8427758 - DNA, 22 bp, Homo sapiens
tggtcccattgttctgcccagg

SEQ ID NO: 8427759 - DNA, 19 bp, Homo sapiens
tggtcccatactgctggcc

SEQ ID NO: 8427760 - DNA, 18 bp, Homo sapiens
tggtccagttcagatata

SEQ ID NO: 8427761 - DNA, 18 bp, Homo sapiens
tggtccagttcagatata

SEQ ID NO: 8427762 - DNA, 22 bp, Homo sapiens
tggtccagttctgtgatattgc

SEQ ID NO: 8427763 - DNA, 22 bp, Homo sapiens
tggtccagttctgtgatattgc

SEQ ID NO: 8427764 - DNA, 22 bp, Homo sapiens
tggtccagtttagcattgagtg

SEQ ID NO: 8427765 - DNA, 22 bp, Homo sapiens
tggtccatgtcctccatctctc

SEQ ID NO: 8427766 - DNA, 22 bp, Homo sapiens
tggtccctagcacagctgtcct

SEQ ID NO: 8427767 - DNA, 22 bp, Homo sapiens
tggtccagtaagggtggagaga

SEQ ID NO: 8427768 - DNA, 22 bp, Homo sapiens
tggtccagtcgttcctttcctt

SEQ ID NO: 8427769 - DNA, 22 bp, Homo sapiens
tggtccagtagcagggatacca

SEQ ID NO: 8427770 - DNA, 18 bp, Homo sapiens
tggtccagttcagatata

SEQ ID NO: 8427771 - DNA, 22 bp, Homo sapiens
tggtccagtgacagataggcac

SEQ ID NO: 8427772 - DNA, 22 bp, Homo sapiens
tggtccagtcgttcctttcctt

SEQ ID NO: 8427773 - DNA, 22 bp, Homo sapiens
tggtccagtcgttcctttcctt

SEQ ID NO: 8427774 - DNA, 22 bp, Homo sapiens
cctctgtgcctcgtgtcctctg

SEQ ID NO: 8427775 - DNA, 22 bp, Homo sapiens
cctctgtgcctcgtgtcctctg

SEQ ID NO: 8427776 - DNA, 22 bp, Homo sapiens
tggtccgctcctattcgccgca

SEQ ID NO: 8427777 - DNA, 22 bp, Homo sapiens
cctgccagtgaagctgacgggc

SEQ ID NO: 8427778 - DNA, 22 bp, Homo sapiens
cctgccagtgcctcccactggt

SEQ ID NO: 8427779 - DNA, 22 bp, Homo sapiens
cctgccagtgcctcccactggt

SEQ ID NO: 8427780 - DNA, 22 bp, Homo sapiens
cctgccagtgcctcccactggt

SEQ ID NO: 8427781 - DNA, 22 bp, Homo sapiens
cctgccagtgcctcccactggt

SEQ ID NO: 8427782 - DNA, 22 bp, Homo sapiens
cctgccagtgaagctgacgggc

SEQ ID NO: 8427783 - DNA, 22 bp, Homo sapiens
cctgccagtgaagctgacgggc

SEQ ID NO: 8427784 - DNA, 22 bp, Homo sapiens
cctgcccacagagagggtgcat

SEQ ID NO: 8427785 - DNA, 22 bp, Homo sapiens
cctgcccactccaggagcaact

SEQ ID NO: 8427786 - DNA, 17 bp, Homo sapiens
cctgcccagagacagat

SEQ ID NO: 8427787 - DNA, 22 bp, Homo sapiens
cctgcccactgcccggtcagcc

SEQ ID NO: 8427788 - DNA, 17 bp, Homo sapiens
cctgcccagagacagat

SEQ ID NO: 8427789 - DNA, 17 bp, Homo sapiens
cctgcccagagacagat

SEQ ID NO: 8427790 - DNA, 22 bp, Homo sapiens
tggtctttgtccctccttgatc

SEQ ID NO: 8427791 - DNA, 22 bp, Homo sapiens
tggtctttgagagaagttgatt

SEQ ID NO: 8427792 - DNA, 22 bp, Homo sapiens
tggtctttgagagaagttgatt

SEQ ID NO: 8427793 - DNA, 18 bp, Homo sapiens
tggtgcctttcactcttc

SEQ ID NO: 8427794 - DNA, 22 bp, Homo sapiens
tgtctctgtcttccagggctgt

SEQ ID NO: 8427795 - DNA, 22 bp, Homo sapiens
tgtctctgtctcccaggttgtg

SEQ ID NO: 8427796 - DNA, 22 bp, Homo sapiens
tgtctctggcccatgagcagag

SEQ ID NO: 8427797 - DNA, 22 bp, Homo sapiens
tgtctctggctgcagcctgttc

SEQ ID NO: 8427798 - DNA, 22 bp, Homo sapiens
tgtctctggctgcagcctgttc

SEQ ID NO: 8427799 - DNA, 22 bp, Homo sapiens
tgtctctggctgcagcctgttc

SEQ ID NO: 8427800 - DNA, 22 bp, Homo sapiens
tgtctcagtatacgaaacactt

SEQ ID NO: 8427801 - DNA, 22 bp, Homo sapiens
tgtctcttggctctatcactta

SEQ ID NO: 8427802 - DNA, 22 bp, Homo sapiens
cctggcccacatggcttctccc

SEQ ID NO: 8427803 - DNA, 22 bp, Homo sapiens
cctggcccacatggcttctccc

SEQ ID NO: 8427804 - DNA, 22 bp, Homo sapiens
cctggcccacatggcttctccc

SEQ ID NO: 8427805 - DNA, 22 bp, Homo sapiens
tgtctcagaggcaggaagagcc

SEQ ID NO: 8427806 - DNA, 22 bp, Homo sapiens
tgtctcagaggcaggaagagcc

SEQ ID NO: 8427807 - DNA, 22 bp, Homo sapiens
tgtctcaggcccaagccagtaa

SEQ ID NO: 8427808 - DNA, 22 bp, Homo sapiens
tgtctcagggcagcagcagggg

SEQ ID NO: 8427809 - DNA, 18 bp, Homo sapiens
tgtctcaggctgaaacag

SEQ ID NO: 8427810 - DNA, 22 bp, Homo sapiens
tgtctattaattccacataaaa

SEQ ID NO: 8427811 - DNA, 22 bp, Homo sapiens
tgtcctggatcatgcctctgaa

SEQ ID NO: 8427812 - DNA, 22 bp, Homo sapiens
tgtcctggaaaaatggagagtt

SEQ ID NO: 8427813 - DNA, 22 bp, Homo sapiens
tgtcctggaaaaatggagagtt

SEQ ID NO: 8427814 - DNA, 22 bp, Homo sapiens
tgtcctggagacacaaggtggt

SEQ ID NO: 8427815 - DNA, 19 bp, Homo sapiens
cctggccctgctgcgcggg

SEQ ID NO: 8427816 - DNA, 19 bp, Homo sapiens
cctggccctgctgcgcggg

SEQ ID NO: 8427817 - DNA, 22 bp, Homo sapiens
cctggccctggaatagggcagg

SEQ ID NO: 8427818 - DNA, 22 bp, Homo sapiens
cctggcccagggactttcgcct

SEQ ID NO: 8427819 - DNA, 22 bp, Homo sapiens
cctggcctcctggccttctcat

SEQ ID NO: 8427820 - DNA, 22 bp, Homo sapiens
cctggcctcagacagagggtgg

SEQ ID NO: 8427821 - DNA, 22 bp, Homo sapiens
cctggctccagctgcctgtcct

SEQ ID NO: 8427822 - DNA, 22 bp, Homo sapiens
cctggctccagctgcctgtcct

SEQ ID NO: 8427823 - DNA, 21 bp, Homo sapiens
cctggctccagaacttccggt

SEQ ID NO: 8427824 - DNA, 22 bp, Homo sapiens
cctggctccaaagctgtgactc

SEQ ID NO: 8427825 - DNA, 22 bp, Homo sapiens
cctggctcccggaacagggtct

SEQ ID NO: 8427826 - DNA, 22 bp, Homo sapiens
cctggctcccggaacagggtct

SEQ ID NO: 8427827 - DNA, 22 bp, Homo sapiens
cctggctccagctgcctgtcct

SEQ ID NO: 8427828 - DNA, 22 bp, Homo sapiens
cctggctcccccatcatagctg

SEQ ID NO: 8427829 - DNA, 22 bp, Homo sapiens
cctggctcccccatcatagctg

SEQ ID NO: 8427830 - DNA, 22 bp, Homo sapiens
cctggcctgtgaatctgagagc

SEQ ID NO: 8427831 - DNA, 22 bp, Homo sapiens
cctggcctctccgagtaacctg

SEQ ID NO: 8427832 - DNA, 22 bp, Homo sapiens
cctggcctgctcggctcttaag

SEQ ID NO: 8427833 - DNA, 22 bp, Homo sapiens
cctggctcctgcctctgcaggg

SEQ ID NO: 8427834 - DNA, 22 bp, Homo sapiens
cctggctcctgcctctgcaggg

SEQ ID NO: 8427835 - DNA, 22 bp, Homo sapiens
cctggctcctgcctctgcaggg

SEQ ID NO: 8427836 - DNA, 22 bp, Homo sapiens
cctggctcctgcacagatcttt

SEQ ID NO: 8427837 - DNA, 22 bp, Homo sapiens
cctggctcctgcacagatcttt

SEQ ID NO: 8427838 - DNA, 22 bp, Homo sapiens
cctggctccgtgtcacgtgccc

SEQ ID NO: 8427839 - DNA, 22 bp, Homo sapiens
cctggctccgtgtcacgtgccc

SEQ ID NO: 8427840 - DNA, 22 bp, Homo sapiens
cctggctccgtgtcacgtgccc

SEQ ID NO: 8427841 - DNA, 22 bp, Homo sapiens
cctggctccctgcacagggctc

SEQ ID NO: 8427842 - DNA, 22 bp, Homo sapiens
cctggctccctgcacagggctc

SEQ ID NO: 8427843 - DNA, 22 bp, Homo sapiens
cctggctcccggaacagggtct

SEQ ID NO: 8427844 - DNA, 22 bp, Homo sapiens
cctggctcccggaacagggtct

SEQ ID NO: 8427845 - DNA, 22 bp, Homo sapiens
cctggctccctggacctcatta

SEQ ID NO: 8427846 - DNA, 22 bp, Homo sapiens
cctggctcgctgacctcagggg

SEQ ID NO: 8427847 - DNA, 22 bp, Homo sapiens
cctggctctagaggccactcct

SEQ ID NO: 8427848 - DNA, 22 bp, Homo sapiens
cctggctcgctgacctcagggg

SEQ ID NO: 8427849 - DNA, 22 bp, Homo sapiens
cctggctcgctgacctcagggg

SEQ ID NO: 8427850 - DNA, 22 bp, Homo sapiens
cctggctctgaagtccacatca

SEQ ID NO: 8427851 - DNA, 22 bp, Homo sapiens
cctggctctctgcagatcctgg

SEQ ID NO: 8427852 - DNA, 22 bp, Homo sapiens
cctggctctctgcagatcctgg

SEQ ID NO: 8427853 - DNA, 22 bp, Homo sapiens
cctggctctagaggccactcct

SEQ ID NO: 8427854 - DNA, 22 bp, Homo sapiens
cctggctctagaggccactcct

SEQ ID NO: 8427855 - DNA, 22 bp, Homo sapiens
cctggctctagaggccactcct

SEQ ID NO: 8427856 - DNA, 22 bp, Homo sapiens
cctggcaggctggggacagtgc

SEQ ID NO: 8427857 - DNA, 20 bp, Homo sapiens
cctggcaggcgggttactta

SEQ ID NO: 8427858 - DNA, 22 bp, Homo sapiens
cctggcaggctggggacagtgc

SEQ ID NO: 8427859 - DNA, 22 bp, Homo sapiens
cctggcaggactgttgtaagaa

SEQ ID NO: 8427860 - DNA, 22 bp, Homo sapiens
cctggcaggcccctcctggatt

SEQ ID NO: 8427861 - DNA, 22 bp, Homo sapiens
cctggcaggcccctcctggatt

SEQ ID NO: 8427862 - DNA, 22 bp, Homo sapiens
cctggcaggcaagaggaaggga

SEQ ID NO: 8427863 - DNA, 22 bp, Homo sapiens
cctggcaggttacaaccagtta

SEQ ID NO: 8427864 - DNA, 22 bp, Homo sapiens
cctggcaggtggaggttgcagt

SEQ ID NO: 8427865 - DNA, 22 bp, Homo sapiens
cctggcaggtggcgccctcggc

SEQ ID NO: 8427866 - DNA, 22 bp, Homo sapiens
cctggcagtcaggggagtcctt

SEQ ID NO: 8427867 - DNA, 22 bp, Homo sapiens
cctggcaggtagcattgaggag

SEQ ID NO: 8427868 - DNA, 22 bp, Homo sapiens
cctggcagggctgcagtaatgg

SEQ ID NO: 8427869 - DNA, 23 bp, Homo sapiens
cctggcagcaaacgaggaggtta

SEQ ID NO: 8427870 - DNA, 22 bp, Homo sapiens
cctggcagcagcacatgccttc

SEQ ID NO: 8427871 - DNA, 22 bp, Homo sapiens
cctggcagcaggtgggcccgtg

SEQ ID NO: 8427872 - DNA, 22 bp, Homo sapiens
cctggcagcattggtagagatt

SEQ ID NO: 8427873 - DNA, 18 bp, Homo sapiens
cctggcagccatgcgcgc

SEQ ID NO: 8427874 - DNA, 18 bp, Homo sapiens
cctggcagccatgcgcgc

SEQ ID NO: 8427875 - DNA, 23 bp, Homo sapiens
cctggcagcaaacgaggaggtta

SEQ ID NO: 8427876 - DNA, 23 bp, Homo sapiens
cctggcagcaaacgaggaggtta

SEQ ID NO: 8427877 - DNA, 22 bp, Homo sapiens
cctggcagactgtgagggcagg

SEQ ID NO: 8427878 - DNA, 22 bp, Homo sapiens
cctggcagactgtgagggcagg

SEQ ID NO: 8427879 - DNA, 22 bp, Homo sapiens
cctggcagactgtgagggcagg

SEQ ID NO: 8427880 - DNA, 19 bp, Homo sapiens
tgtcccagactccgtgtct

SEQ ID NO: 8427881 - DNA, 22 bp, Homo sapiens
tgtcctcaggacctggcacagt

SEQ ID NO: 8427882 - DNA, 22 bp, Homo sapiens
tgtcctcgtccgcctcgaactc

SEQ ID NO: 8427883 - DNA, 22 bp, Homo sapiens
tgtccatggagaagctcagggc

SEQ ID NO: 8427884 - DNA, 22 bp, Homo sapiens
tgtccatgggcgtcaggcagga

SEQ ID NO: 8427885 - DNA, 22 bp, Homo sapiens
tgtccatgggcgtcaggcagga

SEQ ID NO: 8427886 - DNA, 22 bp, Homo sapiens
tgtcccaaccctgagaagattc

SEQ ID NO: 8427887 - DNA, 22 bp, Homo sapiens
tgtccagtgattctcatgagcc

SEQ ID NO: 8427888 - DNA, 22 bp, Homo sapiens
tgtccatacaatgtaacatctt

SEQ ID NO: 8427889 - DNA, 22 bp, Homo sapiens
cctggcccacatggcttctccc

SEQ ID NO: 8427890 - DNA, 22 bp, Homo sapiens
cctggcccacatggcttctccc

SEQ ID NO: 8427891 - DNA, 22 bp, Homo sapiens
tgtccaggttagcttcaaacac

SEQ ID NO: 8427892 - DNA, 22 bp, Homo sapiens
cctggccatagggcccaggaaa

SEQ ID NO: 8427893 - DNA, 22 bp, Homo sapiens
cctggccagtttccaggccctg

SEQ ID NO: 8427894 - DNA, 22 bp, Homo sapiens
cctggccagtttccaggccctg

SEQ ID NO: 8427895 - DNA, 22 bp, Homo sapiens
cctggccaggctccaagtactg

SEQ ID NO: 8427896 - DNA, 22 bp, Homo sapiens
cctggccaggctctcagcactg

SEQ ID NO: 8427897 - DNA, 22 bp, Homo sapiens
cctggccaggctctcagcactg

SEQ ID NO: 8427898 - DNA, 22 bp, Homo sapiens
cctggccagcgccggctgctcg

SEQ ID NO: 8427899 - DNA, 22 bp, Homo sapiens
cctggccagcgccggctgctcg

SEQ ID NO: 8427900 - DNA, 22 bp, Homo sapiens
cctggcagttcatcaaatggca

SEQ ID NO: 8427901 - DNA, 22 bp, Homo sapiens
cctggccagccagggctggggt

SEQ ID NO: 8427902 - DNA, 22 bp, Homo sapiens
cctggcatgaggagcatgaggt

SEQ ID NO: 8427903 - DNA, 22 bp, Homo sapiens
cctggcagttttgcccaggatt

SEQ ID NO: 8427904 - DNA, 22 bp, Homo sapiens
cctggcagttttgcccaggatt

SEQ ID NO: 8427905 - DNA, 22 bp, Homo sapiens
cctggcagttttgcccaggatt

SEQ ID NO: 8427906 - DNA, 22 bp, Homo sapiens
cctggcagtcaggggagtcctt

SEQ ID NO: 8427907 - DNA, 22 bp, Homo sapiens
cctggcagtggtgaagaagagg

SEQ ID NO: 8427908 - DNA, 22 bp, Homo sapiens
tggcagcaatttgtgatgttga

SEQ ID NO: 8427909 - DNA, 22 bp, Homo sapiens
tggcaaggccacaggtgcagtt

SEQ ID NO: 8427910 - DNA, 22 bp, Homo sapiens
tggcaaggccacaggtgcagtt

SEQ ID NO: 8427911 - DNA, 22 bp, Homo sapiens
tggcaaggctgtgggggcagag

SEQ ID NO: 8427912 - DNA, 22 bp, Homo sapiens
tggcacaggaatttagatgcag

SEQ ID NO: 8427913 - DNA, 22 bp, Homo sapiens
tggcacaggaatttagatgcag

SEQ ID NO: 8427914 - DNA, 22 bp, Homo sapiens
tggcacaggaatttagatgcag

SEQ ID NO: 8427915 - DNA, 22 bp, Homo sapiens
tggcacaggatctcagcggcca

SEQ ID NO: 8427916 - DNA, 22 bp, Homo sapiens
tggcacaggatctcagcggcca

SEQ ID NO: 8427917 - DNA, 22 bp, Homo sapiens
tggcacaggagcactgccctgg

SEQ ID NO: 8427918 - DNA, 22 bp, Homo sapiens
tggcacaggagcactgccctgg

SEQ ID NO: 8427919 - DNA, 22 bp, Homo sapiens
tggcacaggagcactgccctgg

SEQ ID NO: 8427920 - DNA, 22 bp, Homo sapiens
tggcacagggcttggtcgctca

SEQ ID NO: 8427921 - DNA, 22 bp, Homo sapiens
tggcacagggcttggtcgctca

SEQ ID NO: 8427922 - DNA, 22 bp, Homo sapiens
tggcacagtcctgggtgcctgc

SEQ ID NO: 8427923 - DNA, 22 bp, Homo sapiens
tggcacagtcctgggtgcctgc

SEQ ID NO: 8427924 - DNA, 22 bp, Homo sapiens
tggccaggcaggtagaacggcc

SEQ ID NO: 8427925 - DNA, 22 bp, Homo sapiens
tggccaggcaggtagaacggcc

SEQ ID NO: 8427926 - DNA, 22 bp, Homo sapiens
tggccaggcaggtagaacggcc

SEQ ID NO: 8427927 - DNA, 22 bp, Homo sapiens
tggccaggcaggtagaacggcc

SEQ ID NO: 8427928 - DNA, 23 bp, Homo sapiens
tggccaggcataaaggtgggtgg

SEQ ID NO: 8427929 - DNA, 22 bp, Homo sapiens
tggccaggcattcagataagac

SEQ ID NO: 8427930 - DNA, 22 bp, Homo sapiens
cctaggccctaggcttccatca

SEQ ID NO: 8427931 - DNA, 22 bp, Homo sapiens
cctaggccctcaaagagcataa

SEQ ID NO: 8427932 - DNA, 23 bp, Homo sapiens
tggccaggcataaaggtgggtgg

SEQ ID NO: 8427933 - DNA, 22 bp, Homo sapiens
cctagttttcattcagcagcct

SEQ ID NO: 8427934 - DNA, 22 bp, Homo sapiens
cctatacaggcttctttacatg

SEQ ID NO: 8427935 - DNA, 22 bp, Homo sapiens
cctaggctggctgtcttcaggt

SEQ ID NO: 8427936 - DNA, 22 bp, Homo sapiens
cctaggcttgttttcatcagct

SEQ ID NO: 8427937 - DNA, 22 bp, Homo sapiens
cctagggtcagtgtggcaggag

SEQ ID NO: 8427938 - DNA, 22 bp, Homo sapiens
cctagggatgtgttagccagat

SEQ ID NO: 8427939 - DNA, 22 bp, Homo sapiens
cctagggatacagcagagtaca

SEQ ID NO: 8427940 - DNA, 22 bp, Homo sapiens
cctagggagcctgagagcagtg

SEQ ID NO: 8427941 - DNA, 21 bp, Homo sapiens
tggccagctggagtctccaca

SEQ ID NO: 8427942 - DNA, 22 bp, Homo sapiens
tggccaggaggctgcttctgac

SEQ ID NO: 8427943 - DNA, 22 bp, Homo sapiens
tggccaggaggctgcttctgac

SEQ ID NO: 8427944 - DNA, 22 bp, Homo sapiens
tggccaggaggctgcttctgac

SEQ ID NO: 8427945 - DNA, 22 bp, Homo sapiens
tggccaggaggctgcttctgac

SEQ ID NO: 8427946 - DNA, 22 bp, Homo sapiens
tggcagctggctctgcgcaggc

SEQ ID NO: 8427947 - DNA, 22 bp, Homo sapiens
tggcagcttcctgctcatagga

SEQ ID NO: 8427948 - DNA, 22 bp, Homo sapiens
tggcagcttgaatgcagtcttt

SEQ ID NO: 8427949 - DNA, 22 bp, Homo sapiens
tggcagctgtgtccaggtagaa

SEQ ID NO: 8427950 - DNA, 22 bp, Homo sapiens
tggagctgagagccaggctggc

SEQ ID NO: 8427951 - DNA, 22 bp, Homo sapiens
tggagctgagagccaggctggc

SEQ ID NO: 8427952 - DNA, 22 bp, Homo sapiens
tggagctgagagccaggctggc

SEQ ID NO: 8427953 - DNA, 22 bp, Homo sapiens
tggagctgagaagtggagctct

SEQ ID NO: 8427954 - DNA, 22 bp, Homo sapiens
tggagctgagaagtggagctct

SEQ ID NO: 8427955 - DNA, 22 bp, Homo sapiens
tggagctgactcacaccagcta

SEQ ID NO: 8427956 - DNA, 20 bp, Homo sapiens
ccctggagagaagctccacg

SEQ ID NO: 8427957 - DNA, 22 bp, Homo sapiens
ccctggagctagtctgagcaga

SEQ ID NO: 8427958 - DNA, 22 bp, Homo sapiens
ccctggagatcgggagaggaag

SEQ ID NO: 8427959 - DNA, 22 bp, Homo sapiens
ccctggactgttcagggcctga

SEQ ID NO: 8427960 - DNA, 22 bp, Homo sapiens
ccctgctgcagagagctttcca

SEQ ID NO: 8427961 - DNA, 22 bp, Homo sapiens
ccctggactgttcagggcctga

SEQ ID NO: 8427962 - DNA, 22 bp, Homo sapiens
ccctccagggagccatgctggg

SEQ ID NO: 8427963 - DNA, 22 bp, Homo sapiens
ccctccagggagccatgctggg

SEQ ID NO: 8427964 - DNA, 22 bp, Homo sapiens
ccctccagggagccatgctggg

SEQ ID NO: 8427965 - DNA, 22 bp, Homo sapiens
ccctccaggcctgtcatgttcc

SEQ ID NO: 8427966 - DNA, 22 bp, Homo sapiens
ccctccagctcaaagcaaccgg

SEQ ID NO: 8427967 - DNA, 22 bp, Homo sapiens
ccctccaccaagcagggcgcca

SEQ ID NO: 8427968 - DNA, 22 bp, Homo sapiens
ccctccagagcctggacattct

SEQ ID NO: 8427969 - DNA, 22 bp, Homo sapiens
ccctccagagcctggacattct

SEQ ID NO: 8427970 - DNA, 22 bp, Homo sapiens
ccctccagagcttgacctgctg

SEQ ID NO: 8427971 - DNA, 22 bp, Homo sapiens
ccctcatgccagacagcatgca

SEQ ID NO: 8427972 - DNA, 22 bp, Homo sapiens
ccctccagccatggacccaggt

SEQ ID NO: 8427973 - DNA, 22 bp, Homo sapiens
ccctccagccatggacccaggt

SEQ ID NO: 8427974 - DNA, 22 bp, Homo sapiens
ccctccagagcttgacctgctg

SEQ ID NO: 8427975 - DNA, 22 bp, Homo sapiens
ccctccagagcttgacctgctg

SEQ ID NO: 8427976 - DNA, 20 bp, Homo sapiens
ccctccagcaaccaggactt

SEQ ID NO: 8427977 - DNA, 22 bp, Homo sapiens
tggatctggttccctgagcctt

SEQ ID NO: 8427978 - DNA, 21 bp, Homo sapiens
tggatctgtgatctggggcac

SEQ ID NO: 8427979 - DNA, 22 bp, Homo sapiens
tggatctgactggcttttcttc

SEQ ID NO: 8427980 - DNA, 22 bp, Homo sapiens
tggatgagaaactctggtgact

SEQ ID NO: 8427981 - DNA, 22 bp, Homo sapiens
tggatgagattaaagtgaggtt

SEQ ID NO: 8427982 - DNA, 22 bp, Homo sapiens
tggatgaggctgggttaggcag

SEQ ID NO: 8427983 - DNA, 22 bp, Homo sapiens
tggatgagaaactctggtgact

SEQ ID NO: 8427984 - DNA, 18 bp, Homo sapiens
tggatctttatgaggctg

SEQ ID NO: 8427985 - DNA, 22 bp, Homo sapiens
tggcaagagggatgcaaggttt

SEQ ID NO: 8427986 - DNA, 17 bp, Homo sapiens
tggcaagacagctcagg

SEQ ID NO: 8427987 - DNA, 22 bp, Homo sapiens
tggatgagttcaatgaggcaga

SEQ ID NO: 8427988 - DNA, 22 bp, Homo sapiens
tggatgagtctgagattgggca

SEQ ID NO: 8427989 - DNA, 22 bp, Homo sapiens
tggatgagggctgagcactggg

SEQ ID NO: 8427990 - DNA, 22 bp, Homo sapiens
tggatgagggctgagcactggg

SEQ ID NO: 8427991 - DNA, 22 bp, Homo sapiens
tggatgagtctgagattgggca

SEQ ID NO: 8427992 - DNA, 17 bp, Homo sapiens
tggcaagaatggaaatg

SEQ ID NO: 8427993 - DNA, 22 bp, Homo sapiens
tggcaagaaactgaggcctgct

SEQ ID NO: 8427994 - DNA, 22 bp, Homo sapiens
tggcaagaatattggaccagaa

SEQ ID NO: 8427995 - DNA, 18 bp, Homo sapiens
tggagctgagggcaatgc

SEQ ID NO: 8427996 - DNA, 18 bp, Homo sapiens
tggagctgagggcaatgc

SEQ ID NO: 8427997 - DNA, 22 bp, Homo sapiens
ccctggcaaaatccctggtaca

SEQ ID NO: 8427998 - DNA, 22 bp, Homo sapiens
tggagctgagcacctccagggc

SEQ ID NO: 8427999 - DNA, 22 bp, Homo sapiens
tggagctgagcacctccagggc

SEQ ID NO: 8428000 - DNA, 22 bp, Homo sapiens
ccctggcctccaggcagtcctg

SEQ ID NO: 8428001 - DNA, 20 bp, Homo sapiens
ccctggcctgtttcatgccc

SEQ ID NO: 8428002 - DNA, 20 bp, Homo sapiens
ccctggcctgtttcatgccc

SEQ ID NO: 8428003 - DNA, 22 bp, Homo sapiens
ccctggcctccaggcagtcctg

SEQ ID NO: 8428004 - DNA, 22 bp, Homo sapiens
ccctggcctccaggcagtcctg

SEQ ID NO: 8428005 - DNA, 22 bp, Homo sapiens
ccctggcctacaggcccagaga

SEQ ID NO: 8428006 - DNA, 22 bp, Homo sapiens
ccctggctgccagtcaccagac

SEQ ID NO: 8428007 - DNA, 22 bp, Homo sapiens
ccctggctgccagtcaccagac

SEQ ID NO: 8428008 - DNA, 22 bp, Homo sapiens
ccctggctgccagtcaccagac

SEQ ID NO: 8428009 - DNA, 22 bp, Homo sapiens
ccctggctcttcaccacctgcc

SEQ ID NO: 8428010 - DNA, 22 bp, Homo sapiens
ccctggctcttcaccacctgcc

SEQ ID NO: 8428011 - DNA, 22 bp, Homo sapiens
ccctggctctgcctcagagccc

SEQ ID NO: 8428012 - DNA, 17 bp, Homo sapiens
ccctggctctaggtgga

SEQ ID NO: 8428013 - DNA, 17 bp, Homo sapiens
ccctggctctaggtgga

SEQ ID NO: 8428014 - DNA, 23 bp, Homo sapiens
ccctggccttggggcacaggctg

SEQ ID NO: 8428015 - DNA, 22 bp, Homo sapiens
tggcccagtgcttatgctctga

SEQ ID NO: 8428016 - DNA, 22 bp, Homo sapiens
tggcccagcagttctgccccag

SEQ ID NO: 8428017 - DNA, 22 bp, Homo sapiens
tggccccattttacagatgaaa

SEQ ID NO: 8428018 - DNA, 20 bp, Homo sapiens
tggcccagtggggcagggtg

SEQ ID NO: 8428019 - DNA, 20 bp, Homo sapiens
tggcccagtggggcagggtg

SEQ ID NO: 8428020 - DNA, 22 bp, Homo sapiens
tggcccgacctctgctcatgca

SEQ ID NO: 8428021 - DNA, 22 bp, Homo sapiens
tggccctgctatgatcctgcaa

SEQ ID NO: 8428022 - DNA, 22 bp, Homo sapiens
tggccctgctatgatcctgcaa

SEQ ID NO: 8428023 - DNA, 22 bp, Homo sapiens
tggccctgctatgatcctgcaa

SEQ ID NO: 8428024 - DNA, 22 bp, Homo sapiens
tggccctgctggacacgcctgc

SEQ ID NO: 8428025 - DNA, 22 bp, Homo sapiens
tggccctgctggacacgcctgc

SEQ ID NO: 8428026 - DNA, 22 bp, Homo sapiens
tggctcagtttcagtcctggtt

SEQ ID NO: 8428027 - DNA, 22 bp, Homo sapiens
tggctcagtttagcagctcagt

SEQ ID NO: 8428028 - DNA, 22 bp, Homo sapiens
tggctcagtttctgcccagctg

SEQ ID NO: 8428029 - DNA, 22 bp, Homo sapiens
tggctcagtttgggggattgaa

SEQ ID NO: 8428030 - DNA, 22 bp, Homo sapiens
tggctcagtttctgcccagctg

SEQ ID NO: 8428031 - DNA, 22 bp, Homo sapiens
tggctcagtttgggggattgaa

SEQ ID NO: 8428032 - DNA, 21 bp, Homo sapiens
tggctcagttgctgggcacag

SEQ ID NO: 8428033 - DNA, 22 bp, Homo sapiens
tggctcagtttagcagctcagt

SEQ ID NO: 8428034 - DNA, 22 bp, Homo sapiens
tggctcagctgactcggcttct

SEQ ID NO: 8428035 - DNA, 22 bp, Homo sapiens
tggccctgcttatgtctctctt

SEQ ID NO: 8428036 - DNA, 22 bp, Homo sapiens
tggccctgcttatgtctctctt

SEQ ID NO: 8428037 - DNA, 22 bp, Homo sapiens
tggctcagctgactcggcttct

SEQ ID NO: 8428038 - DNA, 22 bp, Homo sapiens
tggccctgctgtatcatctgct

SEQ ID NO: 8428039 - DNA, 22 bp, Homo sapiens
tggccctgctgggtcagagctg

SEQ ID NO: 8428040 - DNA, 22 bp, Homo sapiens
cctccagcgcgatccactccgg

SEQ ID NO: 8428041 - DNA, 22 bp, Homo sapiens
cctccagccttcctgaagagcc

SEQ ID NO: 8428042 - DNA, 22 bp, Homo sapiens
tggctgagggggcagttcagga

SEQ ID NO: 8428043 - DNA, 22 bp, Homo sapiens
tggctgagagcaattgactctg

SEQ ID NO: 8428044 - DNA, 22 bp, Homo sapiens
tggctgagggggcagttcagga

SEQ ID NO: 8428045 - DNA, 23 bp, Homo sapiens
tggctgaggtccaggtagtttca

SEQ ID NO: 8428046 - DNA, 22 bp, Homo sapiens
tggctgaggtaactatgaataa

SEQ ID NO: 8428047 - DNA, 22 bp, Homo sapiens
tggctgagggggctctgctcag

SEQ ID NO: 8428048 - DNA, 22 bp, Homo sapiens
tggctgagggggctctgctcag

SEQ ID NO: 8428049 - DNA, 22 bp, Homo sapiens
tggctgagggggcagttcagga

SEQ ID NO: 8428050 - DNA, 22 bp, Homo sapiens
cctccagcattactggcccatg

SEQ ID NO: 8428051 - DNA, 22 bp, Homo sapiens
cctccagcattactggcccatg

SEQ ID NO: 8428052 - DNA, 22 bp, Homo sapiens
cctccagcattactggcccatg

SEQ ID NO: 8428053 - DNA, 22 bp, Homo sapiens
cctccactctggcctctcaggt

SEQ ID NO: 8428054 - DNA, 22 bp, Homo sapiens
tggctgaggtctggggcttctg

SEQ ID NO: 8428055 - DNA, 22 bp, Homo sapiens
tggctgaggtaactatgaataa

SEQ ID NO: 8428056 - DNA, 23 bp, Homo sapiens
tggctgaggtccaggtagtttca

SEQ ID NO: 8428057 - DNA, 22 bp, Homo sapiens
cctccctgctcctcaactggca

SEQ ID NO: 8428058 - DNA, 22 bp, Homo sapiens
cctccctggccagagcagcagc

SEQ ID NO: 8428059 - DNA, 22 bp, Homo sapiens
cctccctggtggctctggtcta

SEQ ID NO: 8428060 - DNA, 22 bp, Homo sapiens
cctcctagaggaaccccagggc

SEQ ID NO: 8428061 - DNA, 22 bp, Homo sapiens
cctccctgtctacctgttgtgg

SEQ ID NO: 8428062 - DNA, 22 bp, Homo sapiens
cctccctggtggctctggtcta

SEQ ID NO: 8428063 - DNA, 22 bp, Homo sapiens
cctccctggtggctctggtcta

SEQ ID NO: 8428064 - DNA, 22 bp, Homo sapiens
cctcctggtccagcatctcttt

SEQ ID NO: 8428065 - DNA, 23 bp, Homo sapiens
cctcctcatatctttgactagtg

SEQ ID NO: 8428066 - DNA, 22 bp, Homo sapiens
cctcctctgggaagattcagag

SEQ ID NO: 8428067 - DNA, 22 bp, Homo sapiens
cctcgtgtgctaggatccaggt

SEQ ID NO: 8428068 - DNA, 22 bp, Homo sapiens
cctcggctgggccttggccact

SEQ ID NO: 8428069 - DNA, 22 bp, Homo sapiens
cctcggctgggccttggccact

SEQ ID NO: 8428070 - DNA, 22 bp, Homo sapiens
cctctcagtattgaactttata

SEQ ID NO: 8428071 - DNA, 23 bp, Homo sapiens
cctctccagacactgggccttgt

SEQ ID NO: 8428072 - DNA, 23 bp, Homo sapiens
cctctccagacactgggccttgt

SEQ ID NO: 8428073 - DNA, 22 bp, Homo sapiens
cctctccagcggcctcagggcc

SEQ ID NO: 8428074 - DNA, 22 bp, Homo sapiens
cctcggctgggccttggccact

SEQ ID NO: 8428075 - DNA, 22 bp, Homo sapiens
cctctcagccggactgtcaggc

SEQ ID NO: 8428076 - DNA, 21 bp, Homo sapiens
tggctgcctggctctgtggtt

SEQ ID NO: 8428077 - DNA, 22 bp, Homo sapiens
tggctgcctagtgtctgagcag

SEQ ID NO: 8428078 - DNA, 22 bp, Homo sapiens
tggctgcctagtccctcagcct

SEQ ID NO: 8428079 - DNA, 22 bp, Homo sapiens
tggctgccgactggctcttggc

SEQ ID NO: 8428080 - DNA, 21 bp, Homo sapiens
tggctgcctacatgctgcagg

SEQ ID NO: 8428081 - DNA, 22 bp, Homo sapiens
tggctgcctagtccctcagcct

SEQ ID NO: 8428082 - DNA, 21 bp, Homo sapiens
tggctgcctacatgctgcagg

SEQ ID NO: 8428083 - DNA, 22 bp, Homo sapiens
tggctgccgactggctcttggc

SEQ ID NO: 8428084 - DNA, 20 bp, Homo sapiens
cctctctgaagaggtcatct

SEQ ID NO: 8428085 - DNA, 20 bp, Homo sapiens
cctctctgaagaggtcatct

SEQ ID NO: 8428086 - DNA, 22 bp, Homo sapiens
cctctctcttgtagtccctgcc

SEQ ID NO: 8428087 - DNA, 22 bp, Homo sapiens
cctctctcttgtagtccctgcc

SEQ ID NO: 8428088 - DNA, 22 bp, Homo sapiens
tggctgcctttcacctcatctc

SEQ ID NO: 8428089 - DNA, 22 bp, Homo sapiens
tggctgcctttcacctcatctc

SEQ ID NO: 8428090 - DNA, 22 bp, Homo sapiens
tggctgccttccctgctggagg

SEQ ID NO: 8428091 - DNA, 22 bp, Homo sapiens
tggctgccttccctgctggagg

SEQ ID NO: 8428092 - DNA, 20 bp, Homo sapiens
cctctctgccctgcaaggcc

SEQ ID NO: 8428093 - DNA, 22 bp, Homo sapiens
cctctctgtgtggcctctccat

SEQ ID NO: 8428094 - DNA, 22 bp, Homo sapiens
cctctgggctgcctgcacgggt

SEQ ID NO: 8428095 - DNA, 22 bp, Homo sapiens
cctctgggctggaaaattaatg

SEQ ID NO: 8428096 - DNA, 22 bp, Homo sapiens
cctctgggggcttccttaccct

SEQ ID NO: 8428097 - DNA, 22 bp, Homo sapiens
cctctggggcatcagacaaagg

SEQ ID NO: 8428098 - DNA, 22 bp, Homo sapiens
cctctggctgtaccactggcac

SEQ ID NO: 8428099 - DNA, 22 bp, Homo sapiens
cctctgaggtgagcccagctgg

SEQ ID NO: 8428100 - DNA, 22 bp, Homo sapiens
cctctgagaccagctctgcacc

SEQ ID NO: 8428101 - DNA, 22 bp, Homo sapiens
cctctgagaccagctctgcacc

SEQ ID NO: 8428102 - DNA, 22 bp, Homo sapiens
cctctgagaacacctggcgtcc

SEQ ID NO: 8428103 - DNA, 22 bp, Homo sapiens
cctctgagccagcgtcttctct

SEQ ID NO: 8428104 - DNA, 22 bp, Homo sapiens
cctctgagccagcgtcttctct

SEQ ID NO: 8428105 - DNA, 21 bp, Homo sapiens
cctctgtagttaagtttccta

SEQ ID NO: 8428106 - DNA, 22 bp, Homo sapiens
cctctgtagtaagagaacatat

SEQ ID NO: 8428107 - DNA, 22 bp, Homo sapiens
cctctgtacaggtcagcatcta

SEQ ID NO: 8428108 - DNA, 22 bp, Homo sapiens
cctctgtaagccttagtctaga

SEQ ID NO: 8428109 - DNA, 22 bp, Homo sapiens
cctctgtaagcctcagtttctt

SEQ ID NO: 8428110 - DNA, 22 bp, Homo sapiens
cctctgtaatgattcactgaat

SEQ ID NO: 8428111 - DNA, 22 bp, Homo sapiens
cctctgtacagcctctttattg

SEQ ID NO: 8428112 - DNA, 22 bp, Homo sapiens
cctctgggttagtttagggagc

SEQ ID NO: 8428113 - DNA, 22 bp, Homo sapiens
cctctgggttagtttagggagc

SEQ ID NO: 8428114 - DNA, 18 bp, Homo sapiens
cctctgggttttgttccc

SEQ ID NO: 8428115 - DNA, 22 bp, Homo sapiens
cctctgtgatttctgagccaat

SEQ ID NO: 8428116 - DNA, 22 bp, Homo sapiens
cctctgggtatctgtggaagta

SEQ ID NO: 8428117 - DNA, 22 bp, Homo sapiens
cctctgggtatctgtggaagta

SEQ ID NO: 8428118 - DNA, 22 bp, Homo sapiens
cctctgggtgggaggccgggcg

SEQ ID NO: 8428119 - DNA, 22 bp, Homo sapiens
cctctgggtgggaggccgggcg

SEQ ID NO: 8428120 - DNA, 22 bp, Homo sapiens
cctctgggtgacagactcttgg

SEQ ID NO: 8428121 - DNA, 22 bp, Homo sapiens
cctctggggtgagtgggccact

SEQ ID NO: 8428122 - DNA, 22 bp, Homo sapiens
cctctgggggtcctcagagtct

SEQ ID NO: 8428123 - DNA, 22 bp, Homo sapiens
cctctggggtctagcaatagca

SEQ ID NO: 8428124 - DNA, 22 bp, Homo sapiens
ccctcagcttctccctgcagct

SEQ ID NO: 8428125 - DNA, 22 bp, Homo sapiens
ccctcagcttctccctgcagct

SEQ ID NO: 8428126 - DNA, 22 bp, Homo sapiens
ccctcagcttctccctgcagct

SEQ ID NO: 8428127 - DNA, 22 bp, Homo sapiens
cccctctgcaaatagccaggct

SEQ ID NO: 8428128 - DNA, 19 bp, Homo sapiens
ccctcaggtctgagcagtc

SEQ ID NO: 8428129 - DNA, 22 bp, Homo sapiens
ccctcagggaccactgacttca

SEQ ID NO: 8428130 - DNA, 22 bp, Homo sapiens
cccctcctggccacactgtcag

SEQ ID NO: 8428131 - DNA, 22 bp, Homo sapiens
cccctcctggccacactgtcag

SEQ ID NO: 8428132 - DNA, 22 bp, Homo sapiens
cccctcctgcagcacctttctt

SEQ ID NO: 8428133 - DNA, 22 bp, Homo sapiens
cccctcattctctgagctagtt

SEQ ID NO: 8428134 - DNA, 22 bp, Homo sapiens
cccctctccctcacttatcaat

SEQ ID NO: 8428135 - DNA, 22 bp, Homo sapiens
cccccacctgaggacagtctta

SEQ ID NO: 8428136 - DNA, 22 bp, Homo sapiens
cccccaccgtgttcctgctcgg

SEQ ID NO: 8428137 - DNA, 22 bp, Homo sapiens
cccccaccgtgttcctgctcgg

SEQ ID NO: 8428138 - DNA, 22 bp, Homo sapiens
ccccagggaagctttgcttact

SEQ ID NO: 8428139 - DNA, 22 bp, Homo sapiens
ccccagggaagctttgcttact

SEQ ID NO: 8428140 - DNA, 22 bp, Homo sapiens
cccccactaagttgagggccct

SEQ ID NO: 8428141 - DNA, 22 bp, Homo sapiens
cccccagatgcgagccatagcc

SEQ ID NO: 8428142 - DNA, 18 bp, Homo sapiens
cccccagccaaattctct

SEQ ID NO: 8428143 - DNA, 22 bp, Homo sapiens
cccccatccatgtcaggagagg

SEQ ID NO: 8428144 - DNA, 22 bp, Homo sapiens
cccccagtctgaacagcagctg

SEQ ID NO: 8428145 - DNA, 22 bp, Homo sapiens
ccccctctgccggggtccttca

SEQ ID NO: 8428146 - DNA, 17 bp, Homo sapiens
cccctacctccgtttga

SEQ ID NO: 8428147 - DNA, 22 bp, Homo sapiens
ccccctgcgcccggcacgtcat

SEQ ID NO: 8428148 - DNA, 22 bp, Homo sapiens
ccccctgcgcccggcacgtcat

SEQ ID NO: 8428149 - DNA, 16 bp, Homo sapiens
cccctcaggaagtaca

SEQ ID NO: 8428150 - DNA, 22 bp, Homo sapiens
cccctcaggtacccgtgcagca

SEQ ID NO: 8428151 - DNA, 22 bp, Homo sapiens
cccctcaggtacccgtgcagca

SEQ ID NO: 8428152 - DNA, 22 bp, Homo sapiens
tgctggagacctgcttgcacca

SEQ ID NO: 8428153 - DNA, 22 bp, Homo sapiens
ccccagccagcaggacctctga

SEQ ID NO: 8428154 - DNA, 22 bp, Homo sapiens
ccccagccttccatgggaattg

SEQ ID NO: 8428155 - DNA, 22 bp, Homo sapiens
ccccagccttccatgggaattg

SEQ ID NO: 8428156 - DNA, 22 bp, Homo sapiens
ccccagcccacaagcatattaa

SEQ ID NO: 8428157 - DNA, 22 bp, Homo sapiens
tgctggagagctagttctgcag

SEQ ID NO: 8428158 - DNA, 22 bp, Homo sapiens
tgctggagagccttggccaagg

SEQ ID NO: 8428159 - DNA, 22 bp, Homo sapiens
tgctggagcaacattattgtgc

SEQ ID NO: 8428160 - DNA, 22 bp, Homo sapiens
ccccaggcctgttggatggcgc

SEQ ID NO: 8428161 - DNA, 22 bp, Homo sapiens
ccccactctcggccagataggc

SEQ ID NO: 8428162 - DNA, 22 bp, Homo sapiens
tgctgcaggaattctcaaggga

SEQ ID NO: 8428163 - DNA, 22 bp, Homo sapiens
tgctgcagctaaggtgaggtgc

SEQ ID NO: 8428164 - DNA, 22 bp, Homo sapiens
tgctgcagatcagctgagtcct

SEQ ID NO: 8428165 - DNA, 22 bp, Homo sapiens
tgctgcagacgaagcccatgcc

SEQ ID NO: 8428166 - DNA, 22 bp, Homo sapiens
tgctgcagattgcagattaact

SEQ ID NO: 8428167 - DNA, 22 bp, Homo sapiens
tgctgcagatcagctgagtcct

SEQ ID NO: 8428168 - DNA, 22 bp, Homo sapiens
tgctgcagcagtgcgggcagct

SEQ ID NO: 8428169 - DNA, 22 bp, Homo sapiens
tgctgcagcagtgcgggcagct

SEQ ID NO: 8428170 - DNA, 22 bp, Homo sapiens
ccccagcagcacctggggcagt

SEQ ID NO: 8428171 - DNA, 22 bp, Homo sapiens
ccccagcagcacctggggcagt

SEQ ID NO: 8428172 - DNA, 22 bp, Homo sapiens
ccccactctcggccagataggc

SEQ ID NO: 8428173 - DNA, 22 bp, Homo sapiens
ccccagcagactcagggcaggt

SEQ ID NO: 8428174 - DNA, 22 bp, Homo sapiens
ccccagccagcaggacctctga

SEQ ID NO: 8428175 - DNA, 22 bp, Homo sapiens
ccccagccagcaggacctctga

SEQ ID NO: 8428176 - DNA, 22 bp, Homo sapiens
ccccagccagcaggacctctga

SEQ ID NO: 8428177 - DNA, 22 bp, Homo sapiens
ccccagccagcttgtagtagaa

SEQ ID NO: 8428178 - DNA, 22 bp, Homo sapiens
ccccagccagcttgtagtagaa

SEQ ID NO: 8428179 - DNA, 22 bp, Homo sapiens
ccccagccagcaggacctctga

SEQ ID NO: 8428180 - DNA, 22 bp, Homo sapiens
cccaggctcctgctgtgttgac

SEQ ID NO: 8428181 - DNA, 22 bp, Homo sapiens
cccaggctcctgactcattcta

SEQ ID NO: 8428182 - DNA, 21 bp, Homo sapiens
cccaggctgaattaaaaatat

SEQ ID NO: 8428183 - DNA, 22 bp, Homo sapiens
cccaggctcttatgtgacttgc

SEQ ID NO: 8428184 - DNA, 21 bp, Homo sapiens
cccaggctgaattaaaaatat

SEQ ID NO: 8428185 - DNA, 22 bp, Homo sapiens
tgctccagtgagctggccatcc

SEQ ID NO: 8428186 - DNA, 22 bp, Homo sapiens
tgctccaggtgtgcctctcatg

SEQ ID NO: 8428187 - DNA, 22 bp, Homo sapiens
tgctccaggtgtgcctctcatg

SEQ ID NO: 8428188 - DNA, 22 bp, Homo sapiens
tgctcccaaacctgacaggctc

SEQ ID NO: 8428189 - DNA, 22 bp, Homo sapiens
tgctccaggtgtgcctctcatg

SEQ ID NO: 8428190 - DNA, 20 bp, Homo sapiens
tgctccatctaaagtgatta

SEQ ID NO: 8428191 - DNA, 22 bp, Homo sapiens
cccaggctcctagaggcccaga

SEQ ID NO: 8428192 - DNA, 22 bp, Homo sapiens
cccaggctcctagaggcccaga

SEQ ID NO: 8428193 - DNA, 22 bp, Homo sapiens
cccaggctcctagaggcccaga

SEQ ID NO: 8428194 - DNA, 22 bp, Homo sapiens
tgcctgggccttcccacctctg

SEQ ID NO: 8428195 - DNA, 22 bp, Homo sapiens
tgcctgggatctgtgccctttg

SEQ ID NO: 8428196 - DNA, 22 bp, Homo sapiens
tgcctgggatctgtgccctttg

SEQ ID NO: 8428197 - DNA, 22 bp, Homo sapiens
tgcctgggcctctgaggaaggc

SEQ ID NO: 8428198 - DNA, 22 bp, Homo sapiens
tgcctgggcctctgaggaaggc

SEQ ID NO: 8428199 - DNA, 20 bp, Homo sapiens
tgcctgggaaggcgtggagg

SEQ ID NO: 8428200 - DNA, 22 bp, Homo sapiens
tgcctgggacatgctgtggact

SEQ ID NO: 8428201 - DNA, 22 bp, Homo sapiens
tgcctgggagtgaccaagactc

SEQ ID NO: 8428202 - DNA, 22 bp, Homo sapiens
tgcctgggagtgaccaagactc

SEQ ID NO: 8428203 - DNA, 22 bp, Homo sapiens
tgctgagaggaaagaatgcaca

SEQ ID NO: 8428204 - DNA, 17 bp, Homo sapiens
tgctgacagctgtgtgt

SEQ ID NO: 8428205 - DNA, 20 bp, Homo sapiens
tgctgcagacagggccattg

SEQ ID NO: 8428206 - DNA, 20 bp, Homo sapiens
tgctgcagacagggccattg

SEQ ID NO: 8428207 - DNA, 20 bp, Homo sapiens
tgctgcagacagggccattg

SEQ ID NO: 8428208 - DNA, 22 bp, Homo sapiens
tgctcccagctgtaggaatgtt

SEQ ID NO: 8428209 - DNA, 17 bp, Homo sapiens
cccagggaccactgctt

SEQ ID NO: 8428210 - DNA, 20 bp, Homo sapiens
cccagggacctgagctccat

SEQ ID NO: 8428211 - DNA, 22 bp, Homo sapiens
tgctcccacactactcggaggc

SEQ ID NO: 8428212 - DNA, 22 bp, Homo sapiens
tgctcccaaacgacctactgtg

SEQ ID NO: 8428213 - DNA, 22 bp, Homo sapiens
cccagggaggcccaggctctgc

SEQ ID NO: 8428214 - DNA, 22 bp, Homo sapiens
cccagggaggtagcaggagaaa

SEQ ID NO: 8428215 - DNA, 22 bp, Homo sapiens
cccagggatgtggcagatgtta

SEQ ID NO: 8428216 - DNA, 22 bp, Homo sapiens
cccagggatgtggcagatgtta

SEQ ID NO: 8428217 - DNA, 22 bp, Homo sapiens
cccagggatgtggcagatgtta

SEQ ID NO: 8428218 - DNA, 22 bp, Homo sapiens
tgctctggagtggcttgtgcac

SEQ ID NO: 8428219 - DNA, 22 bp, Homo sapiens
tgcattatgcttgtgctgtata

SEQ ID NO: 8428220 - DNA, 22 bp, Homo sapiens
tgcattattacaaggtaagact

SEQ ID NO: 8428221 - DNA, 23 bp, Homo sapiens
tgcattatcctctctgaagacca

SEQ ID NO: 8428222 - DNA, 22 bp, Homo sapiens
tgcattatacatggatctaaag

SEQ ID NO: 8428223 - DNA, 22 bp, Homo sapiens
tgcattcagttggtcagctttt

SEQ ID NO: 8428224 - DNA, 22 bp, Homo sapiens
tgcattcatcatttgaaagccc

SEQ ID NO: 8428225 - DNA, 22 bp, Homo sapiens
tgcattcaatacagtaagaata

SEQ ID NO: 8428226 - DNA, 22 bp, Homo sapiens
tgccacagacaggacagaacag

SEQ ID NO: 8428227 - DNA, 22 bp, Homo sapiens
tgccaagtggagctcaggaatc

SEQ ID NO: 8428228 - DNA, 22 bp, Homo sapiens
tgccaattcgcagtgagtattt

SEQ ID NO: 8428229 - DNA, 22 bp, Homo sapiens
tgccaagtttctctcagggact

SEQ ID NO: 8428230 - DNA, 22 bp, Homo sapiens
cccaggaggtggaggctgcagt

SEQ ID NO: 8428231 - DNA, 22 bp, Homo sapiens
cccaggaggtggaggctgcagt

SEQ ID NO: 8428232 - DNA, 22 bp, Homo sapiens
cccaggaggtggagttcacagt

SEQ ID NO: 8428233 - DNA, 22 bp, Homo sapiens
cccaggaggtgtgcccaactcg

SEQ ID NO: 8428234 - DNA, 22 bp, Homo sapiens
tgccaggcctcaggagtctcca

SEQ ID NO: 8428235 - DNA, 22 bp, Homo sapiens
tgccaggcctcaggagtctcca

SEQ ID NO: 8428236 - DNA, 22 bp, Homo sapiens
cccaggaggtgtgcccaactcg

SEQ ID NO: 8428237 - DNA, 22 bp, Homo sapiens
cccaggcagagagctggtgagc

SEQ ID NO: 8428238 - DNA, 22 bp, Homo sapiens
cccaggcagagagctggtgagc

SEQ ID NO: 8428239 - DNA, 22 bp, Homo sapiens
cccaggcactcttggtcatttt

SEQ ID NO: 8428240 - DNA, 22 bp, Homo sapiens
cccaggcagaattagtgtttca

SEQ ID NO: 8428241 - DNA, 22 bp, Homo sapiens
cccaggcacatccactctgtga

SEQ ID NO: 8428242 - DNA, 22 bp, Homo sapiens
cccaggcacagattatcccaat

SEQ ID NO: 8428243 - DNA, 22 bp, Homo sapiens
cccaggcacactgaagtgacat

SEQ ID NO: 8428244 - DNA, 22 bp, Homo sapiens
cccaggatgtcgaggctgcagt

SEQ ID NO: 8428245 - DNA, 22 bp, Homo sapiens
tgccaggcgtggtggtgcgcac

SEQ ID NO: 8428246 - DNA, 21 bp, Homo sapiens
tgccaggcctgagctggggtc

SEQ ID NO: 8428247 - DNA, 22 bp, Homo sapiens
tgccaggcgattgctatcagca

SEQ ID NO: 8428248 - DNA, 22 bp, Homo sapiens
tgccaggcgattgctatcagca

SEQ ID NO: 8428249 - DNA, 22 bp, Homo sapiens
cccaggcagcctgcagggaagg

SEQ ID NO: 8428250 - DNA, 22 bp, Homo sapiens
cccaggcagccccagaagcttg

SEQ ID NO: 8428251 - DNA, 22 bp, Homo sapiens
cccaggcagcccttctgacgca

SEQ ID NO: 8428252 - DNA, 22 bp, Homo sapiens
cccaggcagtgtgtgcatgcgt

SEQ ID NO: 8428253 - DNA, 22 bp, Homo sapiens
cccaggcagtgctgatccctca

SEQ ID NO: 8428254 - DNA, 22 bp, Homo sapiens
cccaggcagtgctgatccctca

SEQ ID NO: 8428255 - DNA, 22 bp, Homo sapiens
cccaggcagtgctgatccctca

SEQ ID NO: 8428256 - DNA, 22 bp, Homo sapiens
cccaggcaggagtgtggtggct

SEQ ID NO: 8428257 - DNA, 22 bp, Homo sapiens
cccaggcagggacgtgctctgg

SEQ ID NO: 8428258 - DNA, 22 bp, Homo sapiens
cccaggcagggacgtgctctgg

SEQ ID NO: 8428259 - DNA, 22 bp, Homo sapiens
tgcagggacaggctctggggat

SEQ ID NO: 8428260 - DNA, 22 bp, Homo sapiens
tgcagggagctctggggtgcag

SEQ ID NO: 8428261 - DNA, 22 bp, Homo sapiens
tgcagggaatctgtggctggac

SEQ ID NO: 8428262 - DNA, 22 bp, Homo sapiens
cccagcgagtttgccggtgaac

SEQ ID NO: 8428263 - DNA, 22 bp, Homo sapiens
tctgtggcagttctggttcatc

SEQ ID NO: 8428264 - DNA, 22 bp, Homo sapiens
cccagcctactctgccatagca

SEQ ID NO: 8428265 - DNA, 22 bp, Homo sapiens
cccagcctactctgccatagca

SEQ ID NO: 8428266 - DNA, 22 bp, Homo sapiens
cccagcctgtgacagccgtcct

SEQ ID NO: 8428267 - DNA, 22 bp, Homo sapiens
cccagcctgtgacagccgtcct

SEQ ID NO: 8428268 - DNA, 22 bp, Homo sapiens
cccagcctggtgcactgtgggg

SEQ ID NO: 8428269 - DNA, 22 bp, Homo sapiens
cccagcctttgcttcctggttc

SEQ ID NO: 8428270 - DNA, 22 bp, Homo sapiens
cccagccttccaccctggacta

SEQ ID NO: 8428271 - DNA, 22 bp, Homo sapiens
tgcatcaacctaatatcagctc

SEQ ID NO: 8428272 - DNA, 22 bp, Homo sapiens
tgcattaaaaccatcgaccatc

SEQ ID NO: 8428273 - DNA, 22 bp, Homo sapiens
tgcattaaaatgatggagaaat

SEQ ID NO: 8428274 - DNA, 22 bp, Homo sapiens
tgcattaaaatgtgcctctctt

SEQ ID NO: 8428275 - DNA, 22 bp, Homo sapiens
tgcattaaatataatctgttga

SEQ ID NO: 8428276 - DNA, 22 bp, Homo sapiens
tgcattaagcacacttttgaat

SEQ ID NO: 8428277 - DNA, 22 bp, Homo sapiens
tgcattaagaatttctgaggat

SEQ ID NO: 8428278 - DNA, 22 bp, Homo sapiens
tgcattaagggcctggagatac

SEQ ID NO: 8428279 - DNA, 22 bp, Homo sapiens
tgcattaaggccattgaaattt

SEQ ID NO: 8428280 - DNA, 22 bp, Homo sapiens
tgcattaatttttgccaggttc

SEQ ID NO: 8428281 - DNA, 22 bp, Homo sapiens
tgcattataactgaatgttgtt

SEQ ID NO: 8428282 - DNA, 22 bp, Homo sapiens
tgcattaaggtaattgtataat

SEQ ID NO: 8428283 - DNA, 20 bp, Homo sapiens
tgcattaagtggcattgagc

SEQ ID NO: 8428284 - DNA, 22 bp, Homo sapiens
tgcattaagtgtctgcatatgg

SEQ ID NO: 8428285 - DNA, 22 bp, Homo sapiens
cccagctgatttttgcagagat

SEQ ID NO: 8428286 - DNA, 22 bp, Homo sapiens
cccagctgaacttgcattccaa

SEQ ID NO: 8428287 - DNA, 22 bp, Homo sapiens
cccagctgatttttgcagagat

SEQ ID NO: 8428288 - DNA, 22 bp, Homo sapiens
cccagctgcacctctatggcct

SEQ ID NO: 8428289 - DNA, 22 bp, Homo sapiens
cccagctcttcaagtcaccccc

SEQ ID NO: 8428290 - DNA, 22 bp, Homo sapiens
cccagctcttcaagtcaccccc

SEQ ID NO: 8428291 - DNA, 22 bp, Homo sapiens
cccagctcttcaagtcaccccc

SEQ ID NO: 8428292 - DNA, 22 bp, Homo sapiens
cccagctggccaggtggctttg

SEQ ID NO: 8428293 - DNA, 18 bp, Homo sapiens
cccagctggtgggtcagt

SEQ ID NO: 8428294 - DNA, 17 bp, Homo sapiens
cccagctggcagtgccg

SEQ ID NO: 8428295 - DNA, 23 bp, Homo sapiens
cccagctggaagttagaggacca

SEQ ID NO: 8428296 - DNA, 17 bp, Homo sapiens
cccagctggcagtgccg

SEQ ID NO: 8428297 - DNA, 22 bp, Homo sapiens
cccagctgtaacgggtctgcac

SEQ ID NO: 8428298 - DNA, 23 bp, Homo sapiens
cccagctgcagacaagggagggt

SEQ ID NO: 8428299 - DNA, 22 bp, Homo sapiens
ttggaaaagcgttctctgtagc

SEQ ID NO: 8428300 - DNA, 22 bp, Homo sapiens
ttggatcttatgaaggtggcat

SEQ ID NO: 8428301 - DNA, 22 bp, Homo sapiens
ttggaaaacttacacagagctg

SEQ ID NO: 8428302 - DNA, 22 bp, Homo sapiens
ttggcatttattctaaggtcaa

SEQ ID NO: 8428303 - DNA, 22 bp, Homo sapiens
ttgcttttaattaatcattgct

SEQ ID NO: 8428304 - DNA, 22 bp, Homo sapiens
ttgcttttccctgtctctgatt

SEQ ID NO: 8428305 - DNA, 22 bp, Homo sapiens
ttgcttttgtgtgctctctgga

SEQ ID NO: 8428306 - DNA, 22 bp, Homo sapiens
ttgcttttgggaaaacatgcct

SEQ ID NO: 8428307 - DNA, 20 bp, Homo sapiens
ttgataggcagcttgtcagg

SEQ ID NO: 8428308 - DNA, 20 bp, Homo sapiens
ctcagtgctttcattgcctc

SEQ ID NO: 8428309 - DNA, 22 bp, Homo sapiens
ctcagtttttttaagagccatg

SEQ ID NO: 8428310 - DNA, 22 bp, Homo sapiens
ttgctttgccaccagaagtcta

SEQ ID NO: 8428311 - DNA, 22 bp, Homo sapiens
ttgggatctcaaatccagctat

SEQ ID NO: 8428312 - DNA, 21 bp, Homo sapiens
ttgggatctgagaagtgaaaa

SEQ ID NO: 8428313 - DNA, 22 bp, Homo sapiens
ttgggatctacatagctatgta

SEQ ID NO: 8428314 - DNA, 22 bp, Homo sapiens
ttgggaggtaatggagccaagt

SEQ ID NO: 8428315 - DNA, 22 bp, Homo sapiens
ttggctgctcagtgatatgaga

SEQ ID NO: 8428316 - DNA, 22 bp, Homo sapiens
ttggctgctgaaatatgttctg

SEQ ID NO: 8428317 - DNA, 22 bp, Homo sapiens
ttggctgctctgtgtttagtat

SEQ ID NO: 8428318 - DNA, 22 bp, Homo sapiens
ttggctgctgggaactcaaaca

SEQ ID NO: 8428319 - DNA, 22 bp, Homo sapiens
ttggctgctgaaatatgttctg

SEQ ID NO: 8428320 - DNA, 22 bp, Homo sapiens
ttggctgctagatggtgttaga

SEQ ID NO: 8428321 - DNA, 22 bp, Homo sapiens
ttggctgctatttccatattta

SEQ ID NO: 8428322 - DNA, 22 bp, Homo sapiens
ttgggcactgtgggttgtctgt

SEQ ID NO: 8428323 - DNA, 22 bp, Homo sapiens
ctcataaggagctcacaaccta

SEQ ID NO: 8428324 - DNA, 22 bp, Homo sapiens
ttggccagactgaggtgctggg

SEQ ID NO: 8428325 - DNA, 22 bp, Homo sapiens
ttggccaacatggtgaaacccc

SEQ ID NO: 8428326 - DNA, 22 bp, Homo sapiens
ttggtacatgcagatatttagt

SEQ ID NO: 8428327 - DNA, 22 bp, Homo sapiens
ttggtacatgcagatatttagt

SEQ ID NO: 8428328 - DNA, 22 bp, Homo sapiens
ttggtacagatgaggtattctc

SEQ ID NO: 8428329 - DNA, 22 bp, Homo sapiens
ttggtacaatgtgctaggtagg

SEQ ID NO: 8428330 - DNA, 22 bp, Homo sapiens
ttggtaattgtgtttattaaat

SEQ ID NO: 8428331 - DNA, 22 bp, Homo sapiens
ttggtacaaaaccatgaaagaa

SEQ ID NO: 8428332 - DNA, 22 bp, Homo sapiens
ttggtacaaaagtaactgtggt

SEQ ID NO: 8428333 - DNA, 22 bp, Homo sapiens
ttggtaaaatcatagtggtaac

SEQ ID NO: 8428334 - DNA, 22 bp, Homo sapiens
ttgggttttgatacatgtctaa

SEQ ID NO: 8428335 - DNA, 22 bp, Homo sapiens
ttgggttttcccttgaaactga

SEQ ID NO: 8428336 - DNA, 22 bp, Homo sapiens
ttgggtcttatggctggagtag

SEQ ID NO: 8428337 - DNA, 22 bp, Homo sapiens
ttgggtctgtttagctgagaag

SEQ ID NO: 8428338 - DNA, 22 bp, Homo sapiens
ctccagggagcttggaaagacc

SEQ ID NO: 8428339 - DNA, 22 bp, Homo sapiens
ctccagggagctgtggaggttt

SEQ ID NO: 8428340 - DNA, 22 bp, Homo sapiens
ctccaggcgcttaccaagcgct

SEQ ID NO: 8428341 - DNA, 22 bp, Homo sapiens
ctccaggcgcttaccaagcgct

SEQ ID NO: 8428342 - DNA, 22 bp, Homo sapiens
ttggtacattacagtttgattg

SEQ ID NO: 8428343 - DNA, 22 bp, Homo sapiens
ttggtacatgttaaggaagagt

SEQ ID NO: 8428344 - DNA, 22 bp, Homo sapiens
ttggtatttcctcaggcatgtc

SEQ ID NO: 8428345 - DNA, 22 bp, Homo sapiens
ctccaggcgccgcttttgcagt

SEQ ID NO: 8428346 - DNA, 22 bp, Homo sapiens
ttgtatttgattgtcatatcgt

SEQ ID NO: 8428347 - DNA, 22 bp, Homo sapiens
ttgtatttgattgtcatatcgt

SEQ ID NO: 8428348 - DNA, 22 bp, Homo sapiens
ttgtatttgattgtcatatcgt

SEQ ID NO: 8428349 - DNA, 22 bp, Homo sapiens
ttgtatttgggtagtatagaga

SEQ ID NO: 8428350 - DNA, 22 bp, Homo sapiens
ttgtatttcttccggtctcatt

SEQ ID NO: 8428351 - DNA, 22 bp, Homo sapiens
ctccagggcagcatggcagtgg

SEQ ID NO: 8428352 - DNA, 22 bp, Homo sapiens
ctccagggatgagacagagtag

SEQ ID NO: 8428353 - DNA, 22 bp, Homo sapiens
ctccagggcagcatggcagtgg

SEQ ID NO: 8428354 - DNA, 22 bp, Homo sapiens
ctccaggggccagaagcctggc

SEQ ID NO: 8428355 - DNA, 22 bp, Homo sapiens
ttgttaaaatgcatattctggt

SEQ ID NO: 8428356 - DNA, 22 bp, Homo sapiens
ttgttaaagatgcagattccat

SEQ ID NO: 8428357 - DNA, 22 bp, Homo sapiens
ttgttacagcacttaacctttt

SEQ ID NO: 8428358 - DNA, 22 bp, Homo sapiens
ttgttacacataataacatttt

SEQ ID NO: 8428359 - DNA, 22 bp, Homo sapiens
ttgtgtacacgcctttaaatga

SEQ ID NO: 8428360 - DNA, 22 bp, Homo sapiens
ttgtattttgttatgctactgc

SEQ ID NO: 8428361 - DNA, 22 bp, Homo sapiens
ttgttaaaattggagccgagag

SEQ ID NO: 8428362 - DNA, 22 bp, Homo sapiens
ttgttaaaatgaggtcattctg

SEQ ID NO: 8428363 - DNA, 22 bp, Homo sapiens
ctccagtgcactggtcttttca

SEQ ID NO: 8428364 - DNA, 22 bp, Homo sapiens
ctccagtgccctccttgggggc

SEQ ID NO: 8428365 - DNA, 22 bp, Homo sapiens
tttaaaaaactagtctgagtct

SEQ ID NO: 8428366 - DNA, 22 bp, Homo sapiens
tttaaaaaactagtctgagtct

SEQ ID NO: 8428367 - DNA, 22 bp, Homo sapiens
tttaaaaaactagtctgagtct

SEQ ID NO: 8428368 - DNA, 22 bp, Homo sapiens
tttaaaaaactagtctgagtct

SEQ ID NO: 8428369 - DNA, 22 bp, Homo sapiens
tttaaaaaactagtctgagtct

SEQ ID NO: 8428370 - DNA, 22 bp, Homo sapiens
ctccagtctttcagatgtccct

SEQ ID NO: 8428371 - DNA, 22 bp, Homo sapiens
ctccagtctttcagatgtccct

SEQ ID NO: 8428372 - DNA, 22 bp, Homo sapiens
ctccagtctagtagagcctgct

SEQ ID NO: 8428373 - DNA, 22 bp, Homo sapiens
ctccagtgagcgcggggcatgg

SEQ ID NO: 8428374 - DNA, 22 bp, Homo sapiens
ctccagtgagcgcggggcatgg

SEQ ID NO: 8428375 - DNA, 22 bp, Homo sapiens
ctccagtgagtgagcaggcgac

SEQ ID NO: 8428376 - DNA, 22 bp, Homo sapiens
ctccaggtgcagaaggactcag

SEQ ID NO: 8428377 - DNA, 22 bp, Homo sapiens
ctccaggttttacaaggtctat

SEQ ID NO: 8428378 - DNA, 22 bp, Homo sapiens
ctccagtatctgtaggaaaagg

SEQ ID NO: 8428379 - DNA, 22 bp, Homo sapiens
ctctccactcagcgtcatgtcc

SEQ ID NO: 8428380 - DNA, 22 bp, Homo sapiens
ctctcagaagcttccagtatgg

SEQ ID NO: 8428381 - DNA, 22 bp, Homo sapiens
ctctcagaagcttccagtatgg

SEQ ID NO: 8428382 - DNA, 22 bp, Homo sapiens
ctctccactgtcctttgctggt

SEQ ID NO: 8428383 - DNA, 22 bp, Homo sapiens
ctctccagaatatgccgccgtg

SEQ ID NO: 8428384 - DNA, 22 bp, Homo sapiens
ctcctgggctgtcggcgctctg

SEQ ID NO: 8428385 - DNA, 22 bp, Homo sapiens
ctcctgggctgggaactcagcc

SEQ ID NO: 8428386 - DNA, 22 bp, Homo sapiens
ctcctgggctgggaactcagcc

SEQ ID NO: 8428387 - DNA, 22 bp, Homo sapiens
ctcctgggctgggaactcagcc

SEQ ID NO: 8428388 - DNA, 18 bp, Homo sapiens
ctcctgggctgcagatgc

SEQ ID NO: 8428389 - DNA, 18 bp, Homo sapiens
ctcctgggctgcagatgc

SEQ ID NO: 8428390 - DNA, 22 bp, Homo sapiens
ctctccagagcccttccggccc

SEQ ID NO: 8428391 - DNA, 22 bp, Homo sapiens
ctctccagagcccttccggccc

SEQ ID NO: 8428392 - DNA, 22 bp, Homo sapiens
ctctccagatctgctgagccag

SEQ ID NO: 8428393 - DNA, 22 bp, Homo sapiens
ctctccagatctgctgagccag

SEQ ID NO: 8428394 - DNA, 22 bp, Homo sapiens
ctctccagatctgctgagccag

SEQ ID NO: 8428395 - DNA, 22 bp, Homo sapiens
ctctccagaattattactatta

SEQ ID NO: 8428396 - DNA, 22 bp, Homo sapiens
ctctccagccaggggcttcctg

SEQ ID NO: 8428397 - DNA, 22 bp, Homo sapiens
ctctccagccaggggcttcctg

SEQ ID NO: 8428398 - DNA, 22 bp, Homo sapiens
ctctccagcagatgtagtctgt

SEQ ID NO: 8428399 - DNA, 22 bp, Homo sapiens
ctctccagccacagaagctgct

SEQ ID NO: 8428400 - DNA, 22 bp, Homo sapiens
ctctccagccacagaagctgct

SEQ ID NO: 8428401 - DNA, 22 bp, Homo sapiens
ctctccagcctttagcccacgc

SEQ ID NO: 8428402 - DNA, 22 bp, Homo sapiens
ctctccagcctttagcccacgc

SEQ ID NO: 8428403 - DNA, 22 bp, Homo sapiens
ctcctggctcgcccccagctga

SEQ ID NO: 8428404 - DNA, 22 bp, Homo sapiens
ctcctggctcgcccccagctga

SEQ ID NO: 8428405 - DNA, 22 bp, Homo sapiens
ctcctgggagcagggatggatg

SEQ ID NO: 8428406 - DNA, 22 bp, Homo sapiens
ctcctgggagcagggatggatg

SEQ ID NO: 8428407 - DNA, 22 bp, Homo sapiens
ctcctgggagctgtggcagagc

SEQ ID NO: 8428408 - DNA, 22 bp, Homo sapiens
ctcctgggagctgtggcagagc

SEQ ID NO: 8428409 - DNA, 22 bp, Homo sapiens
ctcctgggaggatgcggacccg

SEQ ID NO: 8428410 - DNA, 22 bp, Homo sapiens
ctcctgggaggatgcggacccg

SEQ ID NO: 8428411 - DNA, 22 bp, Homo sapiens
ctcctgggagtcttcctggatg

SEQ ID NO: 8428412 - DNA, 22 bp, Homo sapiens
ctcctgggctcaagtgatcctc

SEQ ID NO: 8428413 - DNA, 22 bp, Homo sapiens
ctcctgggctcaagtgatcctc

SEQ ID NO: 8428414 - DNA, 18 bp, Homo sapiens
ctcctgggctgcagatgc

SEQ ID NO: 8428415 - DNA, 22 bp, Homo sapiens
ctcctgggctcatatcattcag

SEQ ID NO: 8428416 - DNA, 22 bp, Homo sapiens
ctcctgggctcatatcattcag

SEQ ID NO: 8428417 - DNA, 22 bp, Homo sapiens
ctcctgggctatgtctgcttgg

SEQ ID NO: 8428418 - DNA, 21 bp, Homo sapiens
ctcctgggctaagatatagtg

SEQ ID NO: 8428419 - DNA, 21 bp, Homo sapiens
ctcctgggctaagatatagtg

SEQ ID NO: 8428420 - DNA, 22 bp, Homo sapiens
ctcctgggatgactctttcttt

SEQ ID NO: 8428421 - DNA, 22 bp, Homo sapiens
ctctccaggactttggcccaat

SEQ ID NO: 8428422 - DNA, 19 bp, Homo sapiens
ctctccagctccagtagct

SEQ ID NO: 8428423 - DNA, 22 bp, Homo sapiens
ctctccaggactttggcccaat

SEQ ID NO: 8428424 - DNA, 22 bp, Homo sapiens
ctctccagcctttagcccacgc

SEQ ID NO: 8428425 - DNA, 22 bp, Homo sapiens
ctctccaggagagcactttgag

SEQ ID NO: 8428426 - DNA, 22 bp, Homo sapiens
tttcagttcagtttattatatc

SEQ ID NO: 8428427 - DNA, 21 bp, Homo sapiens
ctctccagtggttcctgattc

SEQ ID NO: 8428428 - DNA, 21 bp, Homo sapiens
ctctccagtggttcctgattc

SEQ ID NO: 8428429 - DNA, 22 bp, Homo sapiens
ctctccagttacctaggtctga

SEQ ID NO: 8428430 - DNA, 22 bp, Homo sapiens
tttcagttgtcctgttaatagc

SEQ ID NO: 8428431 - DNA, 22 bp, Homo sapiens
ctctccagttacctaggtctga

SEQ ID NO: 8428432 - DNA, 22 bp, Homo sapiens
ctctccccggtacgagcggccg

SEQ ID NO: 8428433 - DNA, 22 bp, Homo sapiens
ctctccccggtacgagcggccg

SEQ ID NO: 8428434 - DNA, 22 bp, Homo sapiens
ctctccctggccagctgtgcag

SEQ ID NO: 8428435 - DNA, 22 bp, Homo sapiens
ctctcctccaacagccctgccg

SEQ ID NO: 8428436 - DNA, 22 bp, Homo sapiens
ctctcctcagaacaggccctct

SEQ ID NO: 8428437 - DNA, 22 bp, Homo sapiens
tttacatgtcaagactggcagt

SEQ ID NO: 8428438 - DNA, 22 bp, Homo sapiens
tttacatgtaatgttatacaaa

SEQ ID NO: 8428439 - DNA, 22 bp, Homo sapiens
tttacatgtccttcaagagcag

SEQ ID NO: 8428440 - DNA, 22 bp, Homo sapiens
tttacatggaatattgtcttgt

SEQ ID NO: 8428441 - DNA, 22 bp, Homo sapiens
tttacatggaatattgtcttgt

SEQ ID NO: 8428442 - DNA, 22 bp, Homo sapiens
tttacatttccctctgtcagtt

SEQ ID NO: 8428443 - DNA, 22 bp, Homo sapiens
tttacattgcattaggtattat

SEQ ID NO: 8428444 - DNA, 22 bp, Homo sapiens
tttacattgcattaggtattat

SEQ ID NO: 8428445 - DNA, 22 bp, Homo sapiens
tttacattgcattaggtattat

SEQ ID NO: 8428446 - DNA, 17 bp, Homo sapiens
tttacattgctcgcagt

SEQ ID NO: 8428447 - DNA, 17 bp, Homo sapiens
tttagaatacaatgttt

SEQ ID NO: 8428448 - DNA, 17 bp, Homo sapiens
tttagaatacaatgttt

SEQ ID NO: 8428449 - DNA, 17 bp, Homo sapiens
tttagaatacaatgttt

SEQ ID NO: 8428450 - DNA, 22 bp, Homo sapiens
tttacagttccatgtgataggc

SEQ ID NO: 8428451 - DNA, 22 bp, Homo sapiens
tttacagttccatgtgataggc

SEQ ID NO: 8428452 - DNA, 22 bp, Homo sapiens
tttacagttaagaaatgttacc

SEQ ID NO: 8428453 - DNA, 22 bp, Homo sapiens
tttacagtgtcttgttgactgt

SEQ ID NO: 8428454 - DNA, 22 bp, Homo sapiens
tttacagtgtcttgttgactgt

SEQ ID NO: 8428455 - DNA, 22 bp, Homo sapiens
tttacagttaagaaatgttacc

SEQ ID NO: 8428456 - DNA, 22 bp, Homo sapiens
tttaaatttagaagaaacactg

SEQ ID NO: 8428457 - DNA, 22 bp, Homo sapiens
tttaaattatagttaatgtctg

SEQ ID NO: 8428458 - DNA, 22 bp, Homo sapiens
tttaaattctgtctgccgctta

SEQ ID NO: 8428459 - DNA, 22 bp, Homo sapiens
tttaaatttgtgtttagagggt

SEQ ID NO: 8428460 - DNA, 22 bp, Homo sapiens
tttaaatttagaagaaacactg

SEQ ID NO: 8428461 - DNA, 22 bp, Homo sapiens
tttaaaaaactagtctgagtct

SEQ ID NO: 8428462 - DNA, 22 bp, Homo sapiens
tttaaaaggcagcttcttttgt

SEQ ID NO: 8428463 - DNA, 22 bp, Homo sapiens
tttaaaaggggtattaagtcca

SEQ ID NO: 8428464 - DNA, 22 bp, Homo sapiens
tttaaaaggggtattaagtcca

SEQ ID NO: 8428465 - DNA, 22 bp, Homo sapiens
ctcctgagctctgaggaagctt

SEQ ID NO: 8428466 - DNA, 22 bp, Homo sapiens
ctcctgagctctgaggaagctt

SEQ ID NO: 8428467 - DNA, 22 bp, Homo sapiens
ctcctgagctctgaggaagctt

SEQ ID NO: 8428468 - DNA, 22 bp, Homo sapiens
ctcctgagaggatctctgttgt

SEQ ID NO: 8428469 - DNA, 22 bp, Homo sapiens
ctcctggctatgactacatttc

SEQ ID NO: 8428470 - DNA, 22 bp, Homo sapiens
ctcctgagaggatctctgttgt

SEQ ID NO: 8428471 - DNA, 22 bp, Homo sapiens
ctcctgacacagtccacacttg

SEQ ID NO: 8428472 - DNA, 22 bp, Homo sapiens
ctcctgagaattttcagttgga

SEQ ID NO: 8428473 - DNA, 22 bp, Homo sapiens
ctcctgagaattttcagttgga

SEQ ID NO: 8428474 - DNA, 22 bp, Homo sapiens
ctcctctgggtcctggtggcca

SEQ ID NO: 8428475 - DNA, 22 bp, Homo sapiens
ctcctctgtctggccctgagcc

SEQ ID NO: 8428476 - DNA, 22 bp, Homo sapiens
ctcctctgtctggccctgagcc

SEQ ID NO: 8428477 - DNA, 22 bp, Homo sapiens
ctcctctgtctaccacgagggt

SEQ ID NO: 8428478 - DNA, 22 bp, Homo sapiens
tttagacaagatccttctgaat

SEQ ID NO: 8428479 - DNA, 22 bp, Homo sapiens
tttagaattggctagtgggaat

SEQ ID NO: 8428480 - DNA, 22 bp, Homo sapiens
tttagaattggctagtgggaat

SEQ ID NO: 8428481 - DNA, 22 bp, Homo sapiens
tttagaatgttagcgttaaagg

SEQ ID NO: 8428482 - DNA, 22 bp, Homo sapiens
tttagaatgtgactgtatttga

SEQ ID NO: 8428483 - DNA, 22 bp, Homo sapiens
tttagaatgtgactgtatttga

SEQ ID NO: 8428484 - DNA, 22 bp, Homo sapiens
tttagaatgttagcgttaaagg

SEQ ID NO: 8428485 - DNA, 22 bp, Homo sapiens
tttagacagcggctctgaacca

SEQ ID NO: 8428486 - DNA, 22 bp, Homo sapiens
ctcctctggaaattcctctgcc

SEQ ID NO: 8428487 - DNA, 22 bp, Homo sapiens
ctcctctggaaattcctctgcc

SEQ ID NO: 8428488 - DNA, 22 bp, Homo sapiens
ctcctctggcttcctggaggca

SEQ ID NO: 8428489 - DNA, 22 bp, Homo sapiens
ctcctctccatcagcgccaccc

SEQ ID NO: 8428490 - DNA, 22 bp, Homo sapiens
ctaatagagcttcggaactctg

SEQ ID NO: 8428491 - DNA, 22 bp, Homo sapiens
ctaatagataccacattggaca

SEQ ID NO: 8428492 - DNA, 22 bp, Homo sapiens
ctaatagataccacattggaca

SEQ ID NO: 8428493 - DNA, 22 bp, Homo sapiens
ctaatagagcttcggaactctg

SEQ ID NO: 8428494 - DNA, 22 bp, Homo sapiens
ctaataatagaggtggcatttg

SEQ ID NO: 8428495 - DNA, 22 bp, Homo sapiens
ctaatatttttagaaatcacga

SEQ ID NO: 8428496 - DNA, 22 bp, Homo sapiens
ctaattgtaagctccttgaggg

SEQ ID NO: 8428497 - DNA, 22 bp, Homo sapiens
ctaattatgttgttataatcaa

SEQ ID NO: 8428498 - DNA, 20 bp, Homo sapiens
ctaattacagattttggaca

SEQ ID NO: 8428499 - DNA, 22 bp, Homo sapiens
ctaatttaatgaatgagtctta

SEQ ID NO: 8428500 - DNA, 22 bp, Homo sapiens
ttcctggggacttaccgtcatt

SEQ ID NO: 8428501 - DNA, 20 bp, Homo sapiens
ttcctggggaatgatagaag

SEQ ID NO: 8428502 - DNA, 22 bp, Homo sapiens
ctacaaaagtaattgtggtttt

SEQ ID NO: 8428503 - DNA, 22 bp, Homo sapiens
ttccttcctgtcttccttactg

SEQ ID NO: 8428504 - DNA, 22 bp, Homo sapiens
ttccaaagaagttcacatttac

SEQ ID NO: 8428505 - DNA, 22 bp, Homo sapiens
ttccaaagaagttcacatttac

SEQ ID NO: 8428506 - DNA, 22 bp, Homo sapiens
ttccaaactgccaattcagaag

SEQ ID NO: 8428507 - DNA, 22 bp, Homo sapiens
ttccaaagctgctttatttagt

SEQ ID NO: 8428508 - DNA, 22 bp, Homo sapiens
ttccaaagctgctttatttagt

SEQ ID NO: 8428509 - DNA, 22 bp, Homo sapiens
ttccaaagttattcaagcagta

SEQ ID NO: 8428510 - DNA, 22 bp, Homo sapiens
ttccaaagttagttattagaaa

SEQ ID NO: 8428511 - DNA, 22 bp, Homo sapiens
ttccaaagtcatgttgctgata

SEQ ID NO: 8428512 - DNA, 22 bp, Homo sapiens
ttccaaagtcatgttgctgata

SEQ ID NO: 8428513 - DNA, 22 bp, Homo sapiens
ttcccaaaatataacagttaac

SEQ ID NO: 8428514 - DNA, 22 bp, Homo sapiens
ttcccaaagctttgtctgtgaa

SEQ ID NO: 8428515 - DNA, 22 bp, Homo sapiens
ttccaggatgggctgtcctact

SEQ ID NO: 8428516 - DNA, 22 bp, Homo sapiens
ttccaggatgggctgtcctact

SEQ ID NO: 8428517 - DNA, 22 bp, Homo sapiens
ctaagaaaatagaagcatgcta

SEQ ID NO: 8428518 - DNA, 22 bp, Homo sapiens
ctaagaaaatagaagcatgcta

SEQ ID NO: 8428519 - DNA, 22 bp, Homo sapiens
ttcccttctagttttgagagac

SEQ ID NO: 8428520 - DNA, 22 bp, Homo sapiens
ttcccttctagttttgagagac

SEQ ID NO: 8428521 - DNA, 21 bp, Homo sapiens
ttcccttctggttttgagaga

SEQ ID NO: 8428522 - DNA, 22 bp, Homo sapiens
ttcccttctagttttgagagac

SEQ ID NO: 8428523 - DNA, 22 bp, Homo sapiens
ttcccttgaccccagaccctgg

SEQ ID NO: 8428524 - DNA, 22 bp, Homo sapiens
ttccctttgttaaattggaaga

SEQ ID NO: 8428525 - DNA, 22 bp, Homo sapiens
ttcccttaaattatggcatcta

SEQ ID NO: 8428526 - DNA, 22 bp, Homo sapiens
ttcccttcctcactctacttgt

SEQ ID NO: 8428527 - DNA, 22 bp, Homo sapiens
ttccctggttaaccattttctg

SEQ ID NO: 8428528 - DNA, 22 bp, Homo sapiens
ttccctggttaaccattttctg

SEQ ID NO: 8428529 - DNA, 22 bp, Homo sapiens
ttcccacattctttacattcat

SEQ ID NO: 8428530 - DNA, 22 bp, Homo sapiens
ttcccacattctttacattcat

SEQ ID NO: 8428531 - DNA, 22 bp, Homo sapiens
ttcccacagtgactccagagaa

SEQ ID NO: 8428532 - DNA, 22 bp, Homo sapiens
ttcccacagtgttgaatcctct

SEQ ID NO: 8428533 - DNA, 22 bp, Homo sapiens
ttcagaaacagagtgagtgagt

SEQ ID NO: 8428534 - DNA, 22 bp, Homo sapiens
ttcagaaacagagtgagtgagt

SEQ ID NO: 8428535 - DNA, 22 bp, Homo sapiens
ttcagaaaaagaccattgcaat

SEQ ID NO: 8428536 - DNA, 22 bp, Homo sapiens
ttcagaaacatcagtggatgga

SEQ ID NO: 8428537 - DNA, 22 bp, Homo sapiens
ttcagaaaggataattggaagg

SEQ ID NO: 8428538 - DNA, 22 bp, Homo sapiens
ttcagaaaaaacttcaataagt

SEQ ID NO: 8428539 - DNA, 22 bp, Homo sapiens
ttcagaaaaaacttcaataagt

SEQ ID NO: 8428540 - DNA, 22 bp, Homo sapiens
cggctggggctgtccccatgac

SEQ ID NO: 8428541 - DNA, 22 bp, Homo sapiens
cggctgaggatctccaggcctg

SEQ ID NO: 8428542 - DNA, 22 bp, Homo sapiens
cggctggggctgtccccatgac

SEQ ID NO: 8428543 - DNA, 22 bp, Homo sapiens
cggctgcttctgagccccggcg

SEQ ID NO: 8428544 - DNA, 22 bp, Homo sapiens
cggctgctgcctgagtcgctgt

SEQ ID NO: 8428545 - DNA, 21 bp, Homo sapiens
cggctcagtgcctgctccttc

SEQ ID NO: 8428546 - DNA, 22 bp, Homo sapiens
cggctcctccgcccttgctcac

SEQ ID NO: 8428547 - DNA, 22 bp, Homo sapiens
cggctgagacggccatagacac

SEQ ID NO: 8428548 - DNA, 22 bp, Homo sapiens
cggctgagcagtgctgatggaa

SEQ ID NO: 8428549 - DNA, 23 bp, Homo sapiens
cggctgctcggccgagtcctcgg

SEQ ID NO: 8428550 - DNA, 22 bp, Homo sapiens
ttcattctgcagttctcagctc

SEQ ID NO: 8428551 - DNA, 22 bp, Homo sapiens
ttcattcccttatattagcatt

SEQ ID NO: 8428552 - DNA, 22 bp, Homo sapiens
ttcattccttctgtaccttgcc

SEQ ID NO: 8428553 - DNA, 22 bp, Homo sapiens
ttcagaaaggttaatctggatt

SEQ ID NO: 8428554 - DNA, 22 bp, Homo sapiens
ttcagaaaggttaatctggatt

SEQ ID NO: 8428555 - DNA, 22 bp, Homo sapiens
ttcacatctataacttagataa

SEQ ID NO: 8428556 - DNA, 22 bp, Homo sapiens
ttcacagtttaatggcaaggat

SEQ ID NO: 8428557 - DNA, 22 bp, Homo sapiens
ttcacagtttgctgggacagga

SEQ ID NO: 8428558 - DNA, 22 bp, Homo sapiens
ttcacagtgtgatctatgggca

SEQ ID NO: 8428559 - DNA, 22 bp, Homo sapiens
ttcacattacaaggccatattt

SEQ ID NO: 8428560 - DNA, 22 bp, Homo sapiens
ttcacattaagcctcctcctac

SEQ ID NO: 8428561 - DNA, 22 bp, Homo sapiens
ttcacatgttggacatagagga

SEQ ID NO: 8428562 - DNA, 22 bp, Homo sapiens
cgctgggggaacagcgagggtg

SEQ ID NO: 8428563 - DNA, 22 bp, Homo sapiens
cgctggtcaccatggcgtcctg

SEQ ID NO: 8428564 - DNA, 22 bp, Homo sapiens
cgcttctctactcccagccagt

SEQ ID NO: 8428565 - DNA, 22 bp, Homo sapiens
cgctgggtgcagtgattggcat

SEQ ID NO: 8428566 - DNA, 21 bp, Homo sapiens
cggaaactcggctctggttcc

SEQ ID NO: 8428567 - DNA, 22 bp, Homo sapiens
cggaaactacgtgacacccgtt

SEQ ID NO: 8428568 - DNA, 22 bp, Homo sapiens
cggaaacttgagaaccagccag

SEQ ID NO: 8428569 - DNA, 22 bp, Homo sapiens
cggcatccccacttcctcctgc

SEQ ID NO: 8428570 - DNA, 22 bp, Homo sapiens
cggcagtgggcgccaggtctcc

SEQ ID NO: 8428571 - DNA, 22 bp, Homo sapiens
ttgacttcccagacttgtgttt

SEQ ID NO: 8428572 - DNA, 22 bp, Homo sapiens
ttgacttcagcctgtacttgta

SEQ ID NO: 8428573 - DNA, 22 bp, Homo sapiens
ttgacttcagcctgtacttgta

SEQ ID NO: 8428574 - DNA, 22 bp, Homo sapiens
ttgacttcccagacttgtgttt

SEQ ID NO: 8428575 - DNA, 22 bp, Homo sapiens
ttgacccagctttccccacaat

SEQ ID NO: 8428576 - DNA, 22 bp, Homo sapiens
ctcagcagtatactctgaagat

SEQ ID NO: 8428577 - DNA, 20 bp, Homo sapiens
ttgacctgcaagtcatcatt

SEQ ID NO: 8428578 - DNA, 22 bp, Homo sapiens
ttgactcatacctgcctgaccc

SEQ ID NO: 8428579 - DNA, 22 bp, Homo sapiens
ttgaccttggcttttaaaatat

SEQ ID NO: 8428580 - DNA, 22 bp, Homo sapiens
ttgacctgggcacagtgagcat

SEQ ID NO: 8428581 - DNA, 22 bp, Homo sapiens
ttgagaaaatagttcgaatgtt

SEQ ID NO: 8428582 - DNA, 22 bp, Homo sapiens
ttgagctcccgcttcttctttg

SEQ ID NO: 8428583 - DNA, 22 bp, Homo sapiens
ttgagaaacatctaatctttgt

SEQ ID NO: 8428584 - DNA, 22 bp, Homo sapiens
ttgagcttgaggagttatttga

SEQ ID NO: 8428585 - DNA, 22 bp, Homo sapiens
ttgagctgtatacctatgactg

SEQ ID NO: 8428586 - DNA, 20 bp, Homo sapiens
ttgagcttccaagtctttgt

SEQ ID NO: 8428587 - DNA, 22 bp, Homo sapiens
ttgaggagtggcgctggactta

SEQ ID NO: 8428588 - DNA, 21 bp, Homo sapiens
ttgaggagtgagagtgggttt

SEQ ID NO: 8428589 - DNA, 23 bp, Homo sapiens
ttgaggagtgctttttctatcca

SEQ ID NO: 8428590 - DNA, 22 bp, Homo sapiens
ttgaggagaagactttgcttcc

SEQ ID NO: 8428591 - DNA, 22 bp, Homo sapiens
ttgaggacagtgcttggggccc

SEQ ID NO: 8428592 - DNA, 20 bp, Homo sapiens
ttgaggagatattgaatact

SEQ ID NO: 8428593 - DNA, 22 bp, Homo sapiens
ttgaggagcactagtcaggtat

SEQ ID NO: 8428594 - DNA, 22 bp, Homo sapiens
ttgaggaggaaaagggggtacc

SEQ ID NO: 8428595 - DNA, 22 bp, Homo sapiens
ttgaggagcaggatgggaggct

SEQ ID NO: 8428596 - DNA, 23 bp, Homo sapiens
ttgaggagcagcgctttttaccg

SEQ ID NO: 8428597 - DNA, 20 bp, Homo sapiens
ttgagcttttagtacagaca

SEQ ID NO: 8428598 - DNA, 22 bp, Homo sapiens
ttgaggaggcctttcagggctt

SEQ ID NO: 8428599 - DNA, 22 bp, Homo sapiens
ttgaggaggaactgtgaggcaa

SEQ ID NO: 8428600 - DNA, 22 bp, Homo sapiens
ttgaggaggacagaaacattta

SEQ ID NO: 8428601 - DNA, 22 bp, Homo sapiens
ttgaggagtagaagctttgaat

SEQ ID NO: 8428602 - DNA, 22 bp, Homo sapiens
ttgaggagtacaaagcatgctt

SEQ ID NO: 8428603 - DNA, 22 bp, Homo sapiens
ttgaggagtcaggggcacggaa

SEQ ID NO: 8428604 - DNA, 22 bp, Homo sapiens
ttgaggaggtagtacagagtat

SEQ ID NO: 8428605 - DNA, 22 bp, Homo sapiens
ttgaggaggtatgactaggtac

SEQ ID NO: 8428606 - DNA, 22 bp, Homo sapiens
ttgaggaggtcctgggtttact

SEQ ID NO: 8428607 - DNA, 22 bp, Homo sapiens
ctattttctgtctctatagagt

SEQ ID NO: 8428608 - DNA, 22 bp, Homo sapiens
ctattttaacttgattacctct

SEQ ID NO: 8428609 - DNA, 22 bp, Homo sapiens
ctattttaacttgattacctct

SEQ ID NO: 8428610 - DNA, 22 bp, Homo sapiens
ctattttaagaggccattaggt

SEQ ID NO: 8428611 - DNA, 22 bp, Homo sapiens
ttcttgtttattaagatataaa

SEQ ID NO: 8428612 - DNA, 22 bp, Homo sapiens
ttcttgtttattaagatataaa

SEQ ID NO: 8428613 - DNA, 22 bp, Homo sapiens
ttcttgttttgcccaagttgta

SEQ ID NO: 8428614 - DNA, 22 bp, Homo sapiens
ttcttgtactggagatacatga

SEQ ID NO: 8428615 - DNA, 22 bp, Homo sapiens
ttcttgtatataaaaatcattt

SEQ ID NO: 8428616 - DNA, 22 bp, Homo sapiens
ttcttgtactggagatacatga

SEQ ID NO: 8428617 - DNA, 22 bp, Homo sapiens
ttcttgtatataaaaatcattt

SEQ ID NO: 8428618 - DNA, 22 bp, Homo sapiens
ttcttgtatgtatgcaaaatca

SEQ ID NO: 8428619 - DNA, 22 bp, Homo sapiens
ttcttgtaatttggagaaatga

SEQ ID NO: 8428620 - DNA, 22 bp, Homo sapiens
ttcttggccaccagatctcact

SEQ ID NO: 8428621 - DNA, 22 bp, Homo sapiens
ttcttgttctcctcatttagag

SEQ ID NO: 8428622 - DNA, 22 bp, Homo sapiens
ttcttgttctggttctgttagc

SEQ ID NO: 8428623 - DNA, 22 bp, Homo sapiens
ttcttgttccatgaaagacaga

SEQ ID NO: 8428624 - DNA, 22 bp, Homo sapiens
ttcttgtatgtatgcaaaatca

SEQ ID NO: 8428625 - DNA, 22 bp, Homo sapiens
ctcagcagagaccagggaggaa

SEQ ID NO: 8428626 - DNA, 22 bp, Homo sapiens
ctcagcactttggaaggctgat

SEQ ID NO: 8428627 - DNA, 22 bp, Homo sapiens
ctcagcactgacccaggagatg

SEQ ID NO: 8428628 - DNA, 22 bp, Homo sapiens
ctcagagggaggactgggctgg

SEQ ID NO: 8428629 - DNA, 22 bp, Homo sapiens
ctcagagggaggactgggctgg

SEQ ID NO: 8428630 - DNA, 22 bp, Homo sapiens
ctcagcaccccgacaggacatt

SEQ ID NO: 8428631 - DNA, 22 bp, Homo sapiens
ctcagaggggatgcttggagaa

SEQ ID NO: 8428632 - DNA, 22 bp, Homo sapiens
ctcagaggggatgcttggagaa

SEQ ID NO: 8428633 - DNA, 23 bp, Homo sapiens
ctcagaggcctgtccagggtggt

SEQ ID NO: 8428634 - DNA, 22 bp, Homo sapiens
ctattttgcctgcctagaaatc

SEQ ID NO: 8428635 - DNA, 17 bp, Homo sapiens
ctcagcagggctcactt

SEQ ID NO: 8428636 - DNA, 22 bp, Homo sapiens
ctcagcagtaaacgtccggaac

SEQ ID NO: 8428637 - DNA, 22 bp, Homo sapiens
ctcagcaggtcttgggtagggg

SEQ ID NO: 8428638 - DNA, 17 bp, Homo sapiens
ctcagcagggctcactt

SEQ ID NO: 8428639 - DNA, 22 bp, Homo sapiens
ctcagcaggtaccacatgatct

SEQ ID NO: 8428640 - DNA, 23 bp, Homo sapiens
ctcagcaggtcaggccccttcct

SEQ ID NO: 8428641 - DNA, 20 bp, Homo sapiens
ctcagcagattcttctagaa

SEQ ID NO: 8428642 - DNA, 22 bp, Homo sapiens
ctcagcagcagggaagaggtca

SEQ ID NO: 8428643 - DNA, 23 bp, Homo sapiens
ctcagcagcctgctgcagataag

SEQ ID NO: 8428644 - DNA, 23 bp, Homo sapiens
ctcagcagcctgctgcagataag

SEQ ID NO: 8428645 - DNA, 22 bp, Homo sapiens
ctcagcagctacaggattcggg

SEQ ID NO: 8428646 - DNA, 22 bp, Homo sapiens
ctcagcagctgctgctggtggg

SEQ ID NO: 8428647 - DNA, 22 bp, Homo sapiens
ttctgtcatcctttctagatgt

SEQ ID NO: 8428648 - DNA, 22 bp, Homo sapiens
ttctgtcatgctcatgtaattg

SEQ ID NO: 8428649 - DNA, 22 bp, Homo sapiens
ttctgtcaaatttgccatatgg

SEQ ID NO: 8428650 - DNA, 22 bp, Homo sapiens
ttctgtcacagtgctggtatca

SEQ ID NO: 8428651 - DNA, 22 bp, Homo sapiens
ttctgtccactgctggggcctc

SEQ ID NO: 8428652 - DNA, 22 bp, Homo sapiens
ttctgtatattgtaaagactca

SEQ ID NO: 8428653 - DNA, 22 bp, Homo sapiens
ttctgtatctctgtgtttcttg

SEQ ID NO: 8428654 - DNA, 22 bp, Homo sapiens
ttctgtatctttcttcaagatt

SEQ ID NO: 8428655 - DNA, 22 bp, Homo sapiens
ttctgtatggaaacatcctcca

SEQ ID NO: 8428656 - DNA, 22 bp, Homo sapiens
ttctgtatttcaatgtctttat

SEQ ID NO: 8428657 - DNA, 22 bp, Homo sapiens
ttctgtcaaactcacaggccga

SEQ ID NO: 8428658 - DNA, 22 bp, Homo sapiens
ttctgtcaaatgccagtagaga

SEQ ID NO: 8428659 - DNA, 22 bp, Homo sapiens
ttctgtatgtacatatgtgtat

SEQ ID NO: 8428660 - DNA, 22 bp, Homo sapiens
ttctgtatgtatgccagagcat

SEQ ID NO: 8428661 - DNA, 22 bp, Homo sapiens
ttctgtatttagtttgaggaca

SEQ ID NO: 8428662 - DNA, 22 bp, Homo sapiens
ctattttaacttgattacctct

SEQ ID NO: 8428663 - DNA, 22 bp, Homo sapiens
ttctgtacttcaggggctctgt

SEQ ID NO: 8428664 - DNA, 22 bp, Homo sapiens
ttctgtactctttgagaagaat

SEQ ID NO: 8428665 - DNA, 21 bp, Homo sapiens
ttctgtagctgttagcttttc

SEQ ID NO: 8428666 - DNA, 22 bp, Homo sapiens
ttctgtaggcacacagtttcaa

SEQ ID NO: 8428667 - DNA, 22 bp, Homo sapiens
ttctgtaggcatggaacaggga

SEQ ID NO: 8428668 - DNA, 22 bp, Homo sapiens
ttctgtaggacttctgccaact

SEQ ID NO: 8428669 - DNA, 22 bp, Homo sapiens
ttctgtagtattcttttggtca

SEQ ID NO: 8428670 - DNA, 22 bp, Homo sapiens
ctattcagcctctaagacaagt

SEQ ID NO: 8428671 - DNA, 22 bp, Homo sapiens
ctattcagttgtgggcaacaat

SEQ ID NO: 8428672 - DNA, 22 bp, Homo sapiens
ctattcagtaagccaaaaccat

SEQ ID NO: 8428673 - DNA, 22 bp, Homo sapiens
ctagggccaaaggctgtgatgc

SEQ ID NO: 8428674 - DNA, 23 bp, Homo sapiens
ctagggcagtatttcacagacac

SEQ ID NO: 8428675 - DNA, 22 bp, Homo sapiens
ctagggagtggcagagctggga

SEQ ID NO: 8428676 - DNA, 22 bp, Homo sapiens
ctagggcaatgactcaaagcgg

SEQ ID NO: 8428677 - DNA, 22 bp, Homo sapiens
ctagggcactaggactcatgtg

SEQ ID NO: 8428678 - DNA, 22 bp, Homo sapiens
ctagggcagggagtgtttgcgc

SEQ ID NO: 8428679 - DNA, 22 bp, Homo sapiens
ctagggagggatgttggcatga

SEQ ID NO: 8428680 - DNA, 22 bp, Homo sapiens
ctatttcagcagaagccggaga

SEQ ID NO: 8428681 - DNA, 22 bp, Homo sapiens
ctatttcatgttcctatggccg

SEQ ID NO: 8428682 - DNA, 22 bp, Homo sapiens
ctatttctaaacctataagtga

SEQ ID NO: 8428683 - DNA, 15 bp, Homo sapiens
ctatttcatccttct

SEQ ID NO: 8428684 - DNA, 22 bp, Homo sapiens
ctatttcagctgcctttgactg

SEQ ID NO: 8428685 - DNA, 22 bp, Homo sapiens
ctatttcaaggcccagatatga

SEQ ID NO: 8428686 - DNA, 22 bp, Homo sapiens
ctatttggggtagaagatggat

SEQ ID NO: 8428687 - DNA, 22 bp, Homo sapiens
ctatttggccaagctgcccaca

SEQ ID NO: 8428688 - DNA, 22 bp, Homo sapiens
ctatttctgcctaatgacctgt

SEQ ID NO: 8428689 - DNA, 22 bp, Homo sapiens
ctatttcattgtgctgagtctg

SEQ ID NO: 8428690 - DNA, 22 bp, Homo sapiens
ctatttggatgttagcctcagt

SEQ ID NO: 8428691 - DNA, 22 bp, Homo sapiens
ctagggaatgagagactggatc

SEQ ID NO: 8428692 - DNA, 22 bp, Homo sapiens
ctagggaaagtggacatggctt

SEQ ID NO: 8428693 - DNA, 22 bp, Homo sapiens
ctagggaaggacaacctcttcc

SEQ ID NO: 8428694 - DNA, 22 bp, Homo sapiens
ctagggaacaagatgcccaggg

SEQ ID NO: 8428695 - DNA, 22 bp, Homo sapiens
ctaggctggagtgcagtggcac

SEQ ID NO: 8428696 - DNA, 22 bp, Homo sapiens
ctaggctggagtgcagtggcat

SEQ ID NO: 8428697 - DNA, 22 bp, Homo sapiens
ctaggctcagtctctggtctgt

SEQ ID NO: 8428698 - DNA, 22 bp, Homo sapiens
ctaggcccatgaggtttgctgg

SEQ ID NO: 8428699 - DNA, 22 bp, Homo sapiens
ttcctttctctggactgcagcc

SEQ ID NO: 8428700 - DNA, 22 bp, Homo sapiens
ttcctttcacgttttaatgcac

SEQ ID NO: 8428701 - DNA, 22 bp, Homo sapiens
tttgtgaataggttggcttcca

SEQ ID NO: 8428702 - DNA, 22 bp, Homo sapiens
tttgtcttgtgtccttaggacc

SEQ ID NO: 8428703 - DNA, 22 bp, Homo sapiens
ctctcctggggagcacacacac

SEQ ID NO: 8428704 - DNA, 22 bp, Homo sapiens
tttgtcttgaggctggggaagt

SEQ ID NO: 8428705 - DNA, 22 bp, Homo sapiens
ctctggctgtttgcagctcaag

SEQ ID NO: 8428706 - DNA, 22 bp, Homo sapiens
ctctggctgtcccgatgagcag

SEQ ID NO: 8428707 - DNA, 22 bp, Homo sapiens
ctctggcttagtatgctccaaa

SEQ ID NO: 8428708 - DNA, 22 bp, Homo sapiens
ctctggcttctaccttgcagtt

SEQ ID NO: 8428709 - DNA, 22 bp, Homo sapiens
ctctggctggctgggcctcagt

SEQ ID NO: 8428710 - DNA, 19 bp, Homo sapiens
ctctggctcctgggctgcc

SEQ ID NO: 8428711 - DNA, 22 bp, Homo sapiens
ctctgggcaaagatgcctcatc

SEQ ID NO: 8428712 - DNA, 22 bp, Homo sapiens
ctctgggcaaagatgcctcatc

SEQ ID NO: 8428713 - DNA, 22 bp, Homo sapiens
ctctgggcaaagatgcctcatc

SEQ ID NO: 8428714 - DNA, 22 bp, Homo sapiens
ctctgggcaagtatgatagaaa

SEQ ID NO: 8428715 - DNA, 22 bp, Homo sapiens
ctctgggcaagtatgatagaaa

SEQ ID NO: 8428716 - DNA, 22 bp, Homo sapiens
ctctgggcaagtttcttcatga

SEQ ID NO: 8428717 - DNA, 19 bp, Homo sapiens
ctctgggcaagtcacttaa

SEQ ID NO: 8428718 - DNA, 19 bp, Homo sapiens
ctctgggcaagtcacttaa

SEQ ID NO: 8428719 - DNA, 18 bp, Homo sapiens
ctctgggagaggcataca

SEQ ID NO: 8428720 - DNA, 22 bp, Homo sapiens
ctctgggatgaggcctaggcac

SEQ ID NO: 8428721 - DNA, 17 bp, Homo sapiens
ctctgggcagcctgggg

SEQ ID NO: 8428722 - DNA, 17 bp, Homo sapiens
ctctgggcagcctgggg

SEQ ID NO: 8428723 - DNA, 17 bp, Homo sapiens
ctctgggcagcctgggg

SEQ ID NO: 8428724 - DNA, 22 bp, Homo sapiens
ctctgggcactgtatgggttct

SEQ ID NO: 8428725 - DNA, 22 bp, Homo sapiens
ctctgggcaccaaagagcagct

SEQ ID NO: 8428726 - DNA, 22 bp, Homo sapiens
ctctgggcactgtatgggttct

SEQ ID NO: 8428727 - DNA, 22 bp, Homo sapiens
ctctgggcaccaaagagcagct

SEQ ID NO: 8428728 - DNA, 22 bp, Homo sapiens
ctctgggcaagtttcttcatga

SEQ ID NO: 8428729 - DNA, 22 bp, Homo sapiens
ctctgggcacattttccaggac

SEQ ID NO: 8428730 - DNA, 22 bp, Homo sapiens
ctctgggcacattttccaggac

SEQ ID NO: 8428731 - DNA, 22 bp, Homo sapiens
ctctgggccaccgctggtgtat

SEQ ID NO: 8428732 - DNA, 22 bp, Homo sapiens
ctctgggccaccgctggtgtat

SEQ ID NO: 8428733 - DNA, 22 bp, Homo sapiens
ctctgggcaggacgccaggcct

SEQ ID NO: 8428734 - DNA, 22 bp, Homo sapiens
ctctgggcaggacgccaggcct

SEQ ID NO: 8428735 - DNA, 22 bp, Homo sapiens
ctctgggcaggaccagtggacc

SEQ ID NO: 8428736 - DNA, 22 bp, Homo sapiens
ctctgggcaggaccagtggacc

SEQ ID NO: 8428737 - DNA, 22 bp, Homo sapiens
ctctgggcaggaccagtggacc

SEQ ID NO: 8428738 - DNA, 22 bp, Homo sapiens
ttttattctcagctccagagag

SEQ ID NO: 8428739 - DNA, 22 bp, Homo sapiens
ttttattctcaagacaatggga

SEQ ID NO: 8428740 - DNA, 22 bp, Homo sapiens
ttttattcatagggatggagag

SEQ ID NO: 8428741 - DNA, 22 bp, Homo sapiens
ttttattcaaatagttcacact

SEQ ID NO: 8428742 - DNA, 22 bp, Homo sapiens
ttttattctaagtatgatggga

SEQ ID NO: 8428743 - DNA, 22 bp, Homo sapiens
ctctgggctgaatggctgaacc

SEQ ID NO: 8428744 - DNA, 22 bp, Homo sapiens
ctctgggctccttcagcccttt

SEQ ID NO: 8428745 - DNA, 22 bp, Homo sapiens
ctctgggctccttcagcccttt

SEQ ID NO: 8428746 - DNA, 22 bp, Homo sapiens
ctctgggctccttcagcccttt

SEQ ID NO: 8428747 - DNA, 22 bp, Homo sapiens
ctctgggctgaatggctgaacc

SEQ ID NO: 8428748 - DNA, 22 bp, Homo sapiens
ctctgggccatgctactgctct

SEQ ID NO: 8428749 - DNA, 22 bp, Homo sapiens
ctctgggccatgctactgctct

SEQ ID NO: 8428750 - DNA, 21 bp, Homo sapiens
ctctgggccattttcttccac

SEQ ID NO: 8428751 - DNA, 22 bp, Homo sapiens
ctctgggcccacttaaatctgg

SEQ ID NO: 8428752 - DNA, 22 bp, Homo sapiens
ctctgggcccacttaaatctgg

SEQ ID NO: 8428753 - DNA, 21 bp, Homo sapiens
ctctgggccattttcttccac

SEQ ID NO: 8428754 - DNA, 23 bp, Homo sapiens
ctctgggcgggcaggtcagcctc

SEQ ID NO: 8428755 - DNA, 23 bp, Homo sapiens
ctctgggcgggcaggtcagcctc

SEQ ID NO: 8428756 - DNA, 22 bp, Homo sapiens
ctctgggcggcccaggccaacc

SEQ ID NO: 8428757 - DNA, 22 bp, Homo sapiens
ctctgggcggcccaggccaacc

SEQ ID NO: 8428758 - DNA, 22 bp, Homo sapiens
ctctgggcggcccaggccaacc

SEQ ID NO: 8428759 - DNA, 22 bp, Homo sapiens
ctcttttagagatgaaaattgg

SEQ ID NO: 8428760 - DNA, 22 bp, Homo sapiens
ctcttttatgtgacgtgtgtga

SEQ ID NO: 8428761 - DNA, 22 bp, Homo sapiens
ctcttttacaccaaaaggccta

SEQ ID NO: 8428762 - DNA, 22 bp, Homo sapiens
tttttaatgcagtctgagacat

SEQ ID NO: 8428763 - DNA, 22 bp, Homo sapiens
tttttaagctcctttgatgtca

SEQ ID NO: 8428764 - DNA, 22 bp, Homo sapiens
ttttgttttcttagaaacctgg

SEQ ID NO: 8428765 - DNA, 22 bp, Homo sapiens
ctctgggttcactgaggctctg

SEQ ID NO: 8428766 - DNA, 22 bp, Homo sapiens
ctctggtcaagcaaagaggttt

SEQ ID NO: 8428767 - DNA, 22 bp, Homo sapiens
ctctggtcatttggaagagcat

SEQ ID NO: 8428768 - DNA, 21 bp, Homo sapiens
ctctggtcctgtctggcaggc

SEQ ID NO: 8428769 - DNA, 22 bp, Homo sapiens
ctctttggcccccgatgattca

SEQ ID NO: 8428770 - DNA, 22 bp, Homo sapiens
ctctttggccagaaaatgtttt

SEQ ID NO: 8428771 - DNA, 22 bp, Homo sapiens
ctcttttaattgtcataacaac

SEQ ID NO: 8428772 - DNA, 22 bp, Homo sapiens
ctgaagagcaaaccaactggac

SEQ ID NO: 8428773 - DNA, 22 bp, Homo sapiens
ctgaagagatgtcaatattggc

SEQ ID NO: 8428774 - DNA, 22 bp, Homo sapiens
ctgaagagactggagggggcat

SEQ ID NO: 8428775 - DNA, 20 bp, Homo sapiens
ctgaagagactggaggggca

SEQ ID NO: 8428776 - DNA, 22 bp, Homo sapiens
ctgaagagaaatgtacacatgg

SEQ ID NO: 8428777 - DNA, 22 bp, Homo sapiens
ctgaagagaaagggagctcttc

SEQ ID NO: 8428778 - DNA, 22 bp, Homo sapiens
ctgaagagaaagggagctcttc

SEQ ID NO: 8428779 - DNA, 22 bp, Homo sapiens
ctgaacttattgagtgcttgct

SEQ ID NO: 8428780 - DNA, 22 bp, Homo sapiens
tttttaatgcagtctgagacat

SEQ ID NO: 8428781 - DNA, 22 bp, Homo sapiens
ctgaaaggaataaggctctttg

SEQ ID NO: 8428782 - DNA, 22 bp, Homo sapiens
ctgagaagagggtatgtggcgc

SEQ ID NO: 8428783 - DNA, 22 bp, Homo sapiens
ctgagaataaagccagcaggag

SEQ ID NO: 8428784 - DNA, 22 bp, Homo sapiens
ctgagaatggacagcagggcag

SEQ ID NO: 8428785 - DNA, 22 bp, Homo sapiens
ctgactgttgctgttgatgagg

SEQ ID NO: 8428786 - DNA, 22 bp, Homo sapiens
ctgactgtttgctgaaaggtct

SEQ ID NO: 8428787 - DNA, 22 bp, Homo sapiens
ctgacttcagggataaaaagta

SEQ ID NO: 8428788 - DNA, 17 bp, Homo sapiens
ctgaagagtcctggcta

SEQ ID NO: 8428789 - DNA, 20 bp, Homo sapiens
ctgaagagtggcctgatctg

SEQ ID NO: 8428790 - DNA, 22 bp, Homo sapiens
ctgactgtctcttctcccatga

SEQ ID NO: 8428791 - DNA, 22 bp, Homo sapiens
ctgactgtgagagcaggaatgg

SEQ ID NO: 8428792 - DNA, 22 bp, Homo sapiens
ctgaagaggacgcagcagcaag

SEQ ID NO: 8428793 - DNA, 22 bp, Homo sapiens
ctgaagagctctcctgtcccct

SEQ ID NO: 8428794 - DNA, 23 bp, Homo sapiens
ctgaagagccaacaaaaagcttg

SEQ ID NO: 8428795 - DNA, 22 bp, Homo sapiens
ctgaagagcactgtggccagtt

SEQ ID NO: 8428796 - DNA, 22 bp, Homo sapiens
ctgaagaggacgcagcagcaag

SEQ ID NO: 8428797 - DNA, 22 bp, Homo sapiens
ctgaagaggactgggttggagg

SEQ ID NO: 8428798 - DNA, 22 bp, Homo sapiens
ctgaagaggagaccgcgcccac

SEQ ID NO: 8428799 - DNA, 22 bp, Homo sapiens
ctgaagaggctccgcccacaag

SEQ ID NO: 8428800 - DNA, 22 bp, Homo sapiens
ctgaagaggttgttgaggaata

SEQ ID NO: 8428801 - DNA, 22 bp, Homo sapiens
ctgattctttgaagatgcaccc

SEQ ID NO: 8428802 - DNA, 22 bp, Homo sapiens
ctgatttacatatacaaaagat

SEQ ID NO: 8428803 - DNA, 22 bp, Homo sapiens
ctgcaaaagtaattgcaggttt

SEQ ID NO: 8428804 - DNA, 23 bp, Homo sapiens
ctgatttgagcagaataaaatag

SEQ ID NO: 8428805 - DNA, 21 bp, Homo sapiens
ctgcagagcatgcaaaatgtt

SEQ ID NO: 8428806 - DNA, 21 bp, Homo sapiens
ctgcagagcatgcaaaatgtt

SEQ ID NO: 8428807 - DNA, 22 bp, Homo sapiens
ctgcagagctaggctgagtgaa

SEQ ID NO: 8428808 - DNA, 22 bp, Homo sapiens
ctgcagagcatgaggaggtctg

SEQ ID NO: 8428809 - DNA, 22 bp, Homo sapiens
ctgcagagcatgaggaggtctg

SEQ ID NO: 8428810 - DNA, 23 bp, Homo sapiens
ctgcagagaactgagggacagcc

SEQ ID NO: 8428811 - DNA, 22 bp, Homo sapiens
ctgcagaacaattcctgctgtt

SEQ ID NO: 8428812 - DNA, 22 bp, Homo sapiens
ctgcagaaatatggatgtgata

SEQ ID NO: 8428813 - DNA, 22 bp, Homo sapiens
ctgcaaaagtcattgtggtttt

SEQ ID NO: 8428814 - DNA, 22 bp, Homo sapiens
ctgcaaaagtaattggggcttt

SEQ ID NO: 8428815 - DNA, 22 bp, Homo sapiens
ctgcagaaacctttcctgattt

SEQ ID NO: 8428816 - DNA, 22 bp, Homo sapiens
ctgatgttcatttcttttgtac

SEQ ID NO: 8428817 - DNA, 22 bp, Homo sapiens
ctgatgaggatatagatacaca

SEQ ID NO: 8428818 - DNA, 22 bp, Homo sapiens
ctgagtccttgggcttagagtg

SEQ ID NO: 8428819 - DNA, 22 bp, Homo sapiens
ctgaggcagaaaaagcaagggt

SEQ ID NO: 8428820 - DNA, 22 bp, Homo sapiens
ctgaggcagaaaaagcaagggt

SEQ ID NO: 8428821 - DNA, 22 bp, Homo sapiens
ctgaggcagagagaacccgggc

SEQ ID NO: 8428822 - DNA, 22 bp, Homo sapiens
ctgaggcagagaatgagtttgt

SEQ ID NO: 8428823 - DNA, 22 bp, Homo sapiens
ctgagtccagggacagaggcgt

SEQ ID NO: 8428824 - DNA, 22 bp, Homo sapiens
ctgagtccagggacagaggcgt

SEQ ID NO: 8428825 - DNA, 22 bp, Homo sapiens
ctgaggagggaagtccccaaag

SEQ ID NO: 8428826 - DNA, 22 bp, Homo sapiens
ctgaggaggctaatttgaggat

SEQ ID NO: 8428827 - DNA, 22 bp, Homo sapiens
ctgaggagaaatgggatggttc

SEQ ID NO: 8428828 - DNA, 22 bp, Homo sapiens
ctgaggagaaagatggtccaag

SEQ ID NO: 8428829 - DNA, 22 bp, Homo sapiens
ctgaggagaaagatggtccaag

SEQ ID NO: 8428830 - DNA, 22 bp, Homo sapiens
ctgagagatcaagccacaggat

SEQ ID NO: 8428831 - DNA, 22 bp, Homo sapiens
ctgaggaccccacaggaggccc

SEQ ID NO: 8428832 - DNA, 22 bp, Homo sapiens
ctgaggaccccacaggaggccc

SEQ ID NO: 8428833 - DNA, 22 bp, Homo sapiens
ctgagagaatcatgctgcaggt

SEQ ID NO: 8428834 - DNA, 22 bp, Homo sapiens
ctgagaattactctgatgagta

SEQ ID NO: 8428835 - DNA, 22 bp, Homo sapiens
ctgagacacagtggctgaaaag

SEQ ID NO: 8428836 - DNA, 22 bp, Homo sapiens
ctgagacacggagaggctgtgt

SEQ ID NO: 8428837 - DNA, 22 bp, Homo sapiens
ctgagagaaacatgactcagga

SEQ ID NO: 8428838 - DNA, 22 bp, Homo sapiens
ctgagactgtaccacttcctcc

SEQ ID NO: 8428839 - DNA, 22 bp, Homo sapiens
ctgagactttcatgtgctttta

SEQ ID NO: 8428840 - DNA, 22 bp, Homo sapiens
ctgagacattatgacaagtgga

SEQ ID NO: 8428841 - DNA, 22 bp, Homo sapiens
ctgagacccagacacctgagga

SEQ ID NO: 8428842 - DNA, 22 bp, Homo sapiens
ctgaggagtttcttatatgtgt

SEQ ID NO: 8428843 - DNA, 22 bp, Homo sapiens
ctgaggagtttgggttgttcaa

SEQ ID NO: 8428844 - DNA, 22 bp, Homo sapiens
ctgaggagttggtgaataagcc

SEQ ID NO: 8428845 - DNA, 19 bp, Homo sapiens
ctgaggcaagtggtggtca

SEQ ID NO: 8428846 - DNA, 22 bp, Homo sapiens
ctgaggcacagtgaacttctcc

SEQ ID NO: 8428847 - DNA, 22 bp, Homo sapiens
ctgaggagtcagcttactcact

SEQ ID NO: 8428848 - DNA, 22 bp, Homo sapiens
ctgaggaggggcctgagtgaga

SEQ ID NO: 8428849 - DNA, 22 bp, Homo sapiens
ctgaggagtcagttccactcag

SEQ ID NO: 8428850 - DNA, 22 bp, Homo sapiens
ctgaggagtgggtgggcagtga

SEQ ID NO: 8428851 - DNA, 22 bp, Homo sapiens
ctgaggcactaacaaggacaag

SEQ ID NO: 8428852 - DNA, 22 bp, Homo sapiens
ctgaggcacccatcttctcctg

SEQ ID NO: 8428853 - DNA, 22 bp, Homo sapiens
ctgaggcacctacagtctcggg

SEQ ID NO: 8428854 - DNA, 22 bp, Homo sapiens
ctgaggcaccggcaatgttctg

SEQ ID NO: 8428855 - DNA, 22 bp, Homo sapiens
ctgaggcacccatcttctcctg

SEQ ID NO: 8428856 - DNA, 22 bp, Homo sapiens
ctgaggcactgtcagctgaggc

SEQ ID NO: 8428857 - DNA, 22 bp, Homo sapiens
ctgaggcactggtaatgggcat

SEQ ID NO: 8428858 - DNA, 22 bp, Homo sapiens
ctgaggcactggtaatgggcat

SEQ ID NO: 8428859 - DNA, 22 bp, Homo sapiens
ctgcagaggggttgaagggtcc

SEQ ID NO: 8428860 - DNA, 22 bp, Homo sapiens
ctgcagaggggttgaagggtcc

SEQ ID NO: 8428861 - DNA, 22 bp, Homo sapiens
ctgcagaggtcttgctgatggt

SEQ ID NO: 8428862 - DNA, 22 bp, Homo sapiens
ctgcagagcttgtctggatgtg

SEQ ID NO: 8428863 - DNA, 22 bp, Homo sapiens
ctgcagagctaggctgagtgaa

SEQ ID NO: 8428864 - DNA, 22 bp, Homo sapiens
ctgcagagcttgtctggatgtg

SEQ ID NO: 8428865 - DNA, 22 bp, Homo sapiens
ctgcagagcttgtctggatgtg

SEQ ID NO: 8428866 - DNA, 22 bp, Homo sapiens
ctgcagagtggagcctcggctg

SEQ ID NO: 8428867 - DNA, 22 bp, Homo sapiens
ctgcagcatcgccacctgcctc

SEQ ID NO: 8428868 - DNA, 22 bp, Homo sapiens
ctgcagcatcgccacctgcctc

SEQ ID NO: 8428869 - DNA, 22 bp, Homo sapiens
ctgcagccacgagtcacagccc

SEQ ID NO: 8428870 - DNA, 22 bp, Homo sapiens
ctgccaggcctggggtgctgtc

SEQ ID NO: 8428871 - DNA, 22 bp, Homo sapiens
ctgccaggcctccgctgtcccc

SEQ ID NO: 8428872 - DNA, 22 bp, Homo sapiens
ctgccaggcctccgctgtcccc

SEQ ID NO: 8428873 - DNA, 22 bp, Homo sapiens
ctgccaggggcctcacaggcca

SEQ ID NO: 8428874 - DNA, 22 bp, Homo sapiens
ctgccaggggcctcacaggcca

SEQ ID NO: 8428875 - DNA, 22 bp, Homo sapiens
ctgccagggaggctgggaagtt

SEQ ID NO: 8428876 - DNA, 22 bp, Homo sapiens
ctgccagggcatcctgtggtgg

SEQ ID NO: 8428877 - DNA, 22 bp, Homo sapiens
ctgccaggcgatggattggctg

SEQ ID NO: 8428878 - DNA, 22 bp, Homo sapiens
ctgccaggcctggggtgctgtc

SEQ ID NO: 8428879 - DNA, 22 bp, Homo sapiens
ctgcctcagcgttgtggcccta

SEQ ID NO: 8428880 - DNA, 22 bp, Homo sapiens
ctgcctcagccttctgggtgac

SEQ ID NO: 8428881 - DNA, 22 bp, Homo sapiens
ctgcctagcgccatctgcctct

SEQ ID NO: 8428882 - DNA, 22 bp, Homo sapiens
ctgcctccaggctcaccttgac

SEQ ID NO: 8428883 - DNA, 22 bp, Homo sapiens
ctgcctcctcacgtccacagtg

SEQ ID NO: 8428884 - DNA, 22 bp, Homo sapiens
ctgcctcctcacgtccacagtg

SEQ ID NO: 8428885 - DNA, 22 bp, Homo sapiens
ctgccaggtgccagggcgcggc

SEQ ID NO: 8428886 - DNA, 22 bp, Homo sapiens
ctgccaggtgcctttgtgcagt

SEQ ID NO: 8428887 - DNA, 22 bp, Homo sapiens
ctgccaggttggcgctcgctct

SEQ ID NO: 8428888 - DNA, 22 bp, Homo sapiens
ctgccaggttggcgctcgctct

SEQ ID NO: 8428889 - DNA, 20 bp, Homo sapiens
ctgccatgattgatagagtg

SEQ ID NO: 8428890 - DNA, 22 bp, Homo sapiens
ctgccatgtagtctatggggcg

SEQ ID NO: 8428891 - DNA, 22 bp, Homo sapiens
ctgccctggggggcctccttgc

SEQ ID NO: 8428892 - DNA, 22 bp, Homo sapiens
ctgccctgggtgctggggatcc

SEQ ID NO: 8428893 - DNA, 22 bp, Homo sapiens
ctggaggacagaggccatgtct

SEQ ID NO: 8428894 - DNA, 22 bp, Homo sapiens
ctggaggacagaggccatgtct

SEQ ID NO: 8428895 - DNA, 22 bp, Homo sapiens
ctggaggaccacagaagctggt

SEQ ID NO: 8428896 - DNA, 22 bp, Homo sapiens
ctggaggaatcacagaaggctt

SEQ ID NO: 8428897 - DNA, 22 bp, Homo sapiens
ctggaggacagaggccatgtct

SEQ ID NO: 8428898 - DNA, 22 bp, Homo sapiens
ctggaggaataatggcatcttg

SEQ ID NO: 8428899 - DNA, 22 bp, Homo sapiens
ctggagctctgtgtgttcctga

SEQ ID NO: 8428900 - DNA, 22 bp, Homo sapiens
ctggagctctccagagccccgt

SEQ ID NO: 8428901 - DNA, 22 bp, Homo sapiens
ctggacagtgggcagaggagac

SEQ ID NO: 8428902 - DNA, 19 bp, Homo sapiens
ctggacctggaggcccgga

SEQ ID NO: 8428903 - DNA, 22 bp, Homo sapiens
ctggaccctgtttccctaggtc

SEQ ID NO: 8428904 - DNA, 21 bp, Homo sapiens
ctggactgaggagacagtcgc

SEQ ID NO: 8428905 - DNA, 20 bp, Homo sapiens
ctggacttgctgctcacctg

SEQ ID NO: 8428906 - DNA, 22 bp, Homo sapiens
ctggactcatccatagaggtga

SEQ ID NO: 8428907 - DNA, 22 bp, Homo sapiens
ctggactcatccatagaggtga

SEQ ID NO: 8428908 - DNA, 22 bp, Homo sapiens
ctggactcagggtgctccagcg

SEQ ID NO: 8428909 - DNA, 22 bp, Homo sapiens
ctggaggcagttgccccagtca

SEQ ID NO: 8428910 - DNA, 22 bp, Homo sapiens
ctggaggcagttgccccagtca

SEQ ID NO: 8428911 - DNA, 22 bp, Homo sapiens
ctggaggctggcttcccctggc

SEQ ID NO: 8428912 - DNA, 22 bp, Homo sapiens
ctggaggctgagttgggtctcc

SEQ ID NO: 8428913 - DNA, 21 bp, Homo sapiens
ctggaggcaggtggtgccagg

SEQ ID NO: 8428914 - DNA, 21 bp, Homo sapiens
ctggaggcaggtggtgccagg

SEQ ID NO: 8428915 - DNA, 22 bp, Homo sapiens
ctggaggagaacttgaggaagg

SEQ ID NO: 8428916 - DNA, 22 bp, Homo sapiens
ctggaggacccctgcctggaag

SEQ ID NO: 8428917 - DNA, 22 bp, Homo sapiens
ctggaggaccacagaagctggt

SEQ ID NO: 8428918 - DNA, 22 bp, Homo sapiens
ctggaggacccctgcctggaag

SEQ ID NO: 8428919 - DNA, 22 bp, Homo sapiens
ctggaggagcatggactggagt

SEQ ID NO: 8428920 - DNA, 22 bp, Homo sapiens
ctggaggcaaagcagaggcatg

SEQ ID NO: 8428921 - DNA, 22 bp, Homo sapiens
ctggaggcaaagcagaggcatg

SEQ ID NO: 8428922 - DNA, 22 bp, Homo sapiens
ctggaggtgggggcaagagtgt

SEQ ID NO: 8428923 - DNA, 22 bp, Homo sapiens
ctggaggtgggggcaagagtgt

SEQ ID NO: 8428924 - DNA, 22 bp, Homo sapiens
ctggaggtcatgtaatatggaa

SEQ ID NO: 8428925 - DNA, 21 bp, Homo sapiens
ctggagtcattttctgagtag

SEQ ID NO: 8428926 - DNA, 21 bp, Homo sapiens
ctggagggtagagttgggctg

SEQ ID NO: 8428927 - DNA, 22 bp, Homo sapiens
ctggaggggccatccacagtct

SEQ ID NO: 8428928 - DNA, 22 bp, Homo sapiens
ctggaggggctggcatggtagc

SEQ ID NO: 8428929 - DNA, 22 bp, Homo sapiens
ctggaggggctggcatggtagc

SEQ ID NO: 8428930 - DNA, 22 bp, Homo sapiens
ctggagggctggactaaggaaa

SEQ ID NO: 8428931 - DNA, 22 bp, Homo sapiens
ctggagggcttctgcaggttac

SEQ ID NO: 8428932 - DNA, 22 bp, Homo sapiens
ctgctttagacaactgctggga

SEQ ID NO: 8428933 - DNA, 22 bp, Homo sapiens
ctgctttatctgagacaagtca

SEQ ID NO: 8428934 - DNA, 23 bp, Homo sapiens
ctgctttcccactccatgctctt

SEQ ID NO: 8428935 - DNA, 22 bp, Homo sapiens
ctgctttaggtggaatgttcta

SEQ ID NO: 8428936 - DNA, 22 bp, Homo sapiens
ctgctttatagggcttccatgt

SEQ ID NO: 8428937 - DNA, 22 bp, Homo sapiens
ctgcctggcctgatctccacgc

SEQ ID NO: 8428938 - DNA, 22 bp, Homo sapiens
ctgcctggctaaactcaagtcg

SEQ ID NO: 8428939 - DNA, 22 bp, Homo sapiens
ctgcctggctaaactcaagtcg

SEQ ID NO: 8428940 - DNA, 22 bp, Homo sapiens
ctgcctggctaaactcaagtcg

SEQ ID NO: 8428941 - DNA, 19 bp, Homo sapiens
ctgcttccttccctcactg

SEQ ID NO: 8428942 - DNA, 22 bp, Homo sapiens
ctgcctgggccggccaccctct

SEQ ID NO: 8428943 - DNA, 22 bp, Homo sapiens
ctgcctgggccatgcccagtcc

SEQ ID NO: 8428944 - DNA, 22 bp, Homo sapiens
ctgcctgggccatgcccagtcc

SEQ ID NO: 8428945 - DNA, 22 bp, Homo sapiens
ctgcctggcatagtctggtcga

SEQ ID NO: 8428946 - DNA, 22 bp, Homo sapiens
ctgcctggcatagtctggtcga

SEQ ID NO: 8428947 - DNA, 22 bp, Homo sapiens
ctgcctggccacaacccagggt

SEQ ID NO: 8428948 - DNA, 22 bp, Homo sapiens
ctgcctggccacaacccagggt

SEQ ID NO: 8428949 - DNA, 20 bp, Homo sapiens
ctgcctggaggcctctacct

SEQ ID NO: 8428950 - DNA, 20 bp, Homo sapiens
ctgcctggaggcctctacct

SEQ ID NO: 8428951 - DNA, 20 bp, Homo sapiens
ctgcctggaggcctctacct

SEQ ID NO: 8428952 - DNA, 17 bp, Homo sapiens
ctgcctggagtcccatc

SEQ ID NO: 8428953 - DNA, 22 bp, Homo sapiens
ctgcctggaatgccagcttctc

SEQ ID NO: 8428954 - DNA, 22 bp, Homo sapiens
ctgcctgctcaccagggctctg

SEQ ID NO: 8428955 - DNA, 22 bp, Homo sapiens
ctgcctggacagctcttacctt

SEQ ID NO: 8428956 - DNA, 22 bp, Homo sapiens
ctgcctggaatgccagcttctc

SEQ ID NO: 8428957 - DNA, 22 bp, Homo sapiens
ctgcctggaccggcagccctcc

SEQ ID NO: 8428958 - DNA, 22 bp, Homo sapiens
ctgcctggaccggcagccctcc

SEQ ID NO: 8428959 - DNA, 22 bp, Homo sapiens
ctgcctggaccggcagccctcc

SEQ ID NO: 8428960 - DNA, 22 bp, Homo sapiens
ctgcctggaccggcagccctcc

SEQ ID NO: 8428961 - DNA, 22 bp, Homo sapiens
ctgcctggagcattctgaaggt

SEQ ID NO: 8428962 - DNA, 22 bp, Homo sapiens
ctggacaggctggggactgcaa

SEQ ID NO: 8428963 - DNA, 22 bp, Homo sapiens
ctggacaggctggggactgcaa

SEQ ID NO: 8428964 - DNA, 22 bp, Homo sapiens
ctggacagtgctgcttgagatg

SEQ ID NO: 8428965 - DNA, 22 bp, Homo sapiens
ctggacagaaaaggccactgga

SEQ ID NO: 8428966 - DNA, 22 bp, Homo sapiens
ctggacagaagtggctgggcag

SEQ ID NO: 8428967 - DNA, 22 bp, Homo sapiens
ctggacagaaagggctgctgtg

SEQ ID NO: 8428968 - DNA, 22 bp, Homo sapiens
ctggacagaaagggctgctgtg

SEQ ID NO: 8428969 - DNA, 22 bp, Homo sapiens
ctggacacaaacatctcctctg

SEQ ID NO: 8428970 - DNA, 22 bp, Homo sapiens
ctggacacactggagtctggca

SEQ ID NO: 8428971 - DNA, 22 bp, Homo sapiens
ctggacacactggagtctggca

SEQ ID NO: 8428972 - DNA, 16 bp, Homo sapiens
ctggacagaaaaacct

SEQ ID NO: 8428973 - DNA, 22 bp, Homo sapiens
ctggacaaccactcagcctcag

SEQ ID NO: 8428974 - DNA, 22 bp, Homo sapiens
ctggaaggttctttgtgtgcct

SEQ ID NO: 8428975 - DNA, 22 bp, Homo sapiens
ctggaaagggtcctcattctgt

SEQ ID NO: 8428976 - DNA, 22 bp, Homo sapiens
ctggaagtataggggagatgat

SEQ ID NO: 8428977 - DNA, 19 bp, Homo sapiens
ctggaatgtggctggtgca

SEQ ID NO: 8428978 - DNA, 22 bp, Homo sapiens
ctggaaagacagagggcatggg

SEQ ID NO: 8428979 - DNA, 22 bp, Homo sapiens
ctggaaagatttctttggagtc

SEQ ID NO: 8428980 - DNA, 22 bp, Homo sapiens
ctggaaaatgaagaagcagagg

SEQ ID NO: 8428981 - DNA, 22 bp, Homo sapiens
ctgcttttgagcccagtgctca

SEQ ID NO: 8428982 - DNA, 17 bp, Homo sapiens
ctgctttgtgcaacgct

SEQ ID NO: 8428983 - DNA, 22 bp, Homo sapiens
ctgctttgactgttaagaacca

SEQ ID NO: 8428984 - DNA, 22 bp, Homo sapiens
ctggattcatgccaggccaccc

SEQ ID NO: 8428985 - DNA, 22 bp, Homo sapiens
ctggatgctgagaggtaccaag

SEQ ID NO: 8428986 - DNA, 22 bp, Homo sapiens
ctggatcttgctgcattgagaa

SEQ ID NO: 8428987 - DNA, 22 bp, Homo sapiens
ctggatcttcagagatcaccag

SEQ ID NO: 8428988 - DNA, 22 bp, Homo sapiens
ctggatccatcgggtcccgagt

SEQ ID NO: 8428989 - DNA, 22 bp, Homo sapiens
ctggatctaaaggtggatgtag

SEQ ID NO: 8428990 - DNA, 22 bp, Homo sapiens
ctggatctgaacatcggtatca

SEQ ID NO: 8428991 - DNA, 22 bp, Homo sapiens
ctggatctgtcttttggatccc

SEQ ID NO: 8428992 - DNA, 22 bp, Homo sapiens
ctggatctgtttgtgcttgtgg

SEQ ID NO: 8428993 - DNA, 22 bp, Homo sapiens
ctggatctgtcccctttttgtt

SEQ ID NO: 8428994 - DNA, 21 bp, Homo sapiens
ctggatctgtcatcgagtttt

SEQ ID NO: 8428995 - DNA, 22 bp, Homo sapiens
ctggcacatgctccctgagtgg

SEQ ID NO: 8428996 - DNA, 22 bp, Homo sapiens
ctggcactgagtggcttatgac

SEQ ID NO: 8428997 - DNA, 22 bp, Homo sapiens
ctggcaccaggcatgctgggag

SEQ ID NO: 8428998 - DNA, 22 bp, Homo sapiens
ctggcacctccagctcatggcc

SEQ ID NO: 8428999 - DNA, 22 bp, Homo sapiens
ctggcagattggggtcagcagt

SEQ ID NO: 8429000 - DNA, 22 bp, Homo sapiens
ctggcagattggggtcagcagt

SEQ ID NO: 8429001 - DNA, 22 bp, Homo sapiens
ctggcagattggggtcagcagt

SEQ ID NO: 8429002 - DNA, 22 bp, Homo sapiens
ctggcagcagcttctggatcga

SEQ ID NO: 8429003 - DNA, 22 bp, Homo sapiens
ctggcagcagcttctggatcga

SEQ ID NO: 8429004 - DNA, 22 bp, Homo sapiens
ctggcagatagtaagtgatcaa

SEQ ID NO: 8429005 - DNA, 22 bp, Homo sapiens
ctggcagatatttgcagacatg

SEQ ID NO: 8429006 - DNA, 22 bp, Homo sapiens
ctggcagatatttgcagacatg

SEQ ID NO: 8429007 - DNA, 22 bp, Homo sapiens
ctggcagacttaccatcagaca

SEQ ID NO: 8429008 - DNA, 22 bp, Homo sapiens
ctggcagcattaacagagagca

SEQ ID NO: 8429009 - DNA, 22 bp, Homo sapiens
ctggcagcattaacagagagca

SEQ ID NO: 8429010 - DNA, 22 bp, Homo sapiens
ctggcagcatggagcctgtgct

SEQ ID NO: 8429011 - DNA, 22 bp, Homo sapiens
ctggcagcatggagcctgtgct

SEQ ID NO: 8429012 - DNA, 22 bp, Homo sapiens
ctggcagcatggagcctgtgct

SEQ ID NO: 8429013 - DNA, 22 bp, Homo sapiens
ctggcagcaggtcacacgcaga

SEQ ID NO: 8429014 - DNA, 22 bp, Homo sapiens
ctggcagcaggtcacacgcaga

SEQ ID NO: 8429015 - DNA, 22 bp, Homo sapiens
ctggcagcagttatgaaacaat

SEQ ID NO: 8429016 - DNA, 22 bp, Homo sapiens
ctggcagggctctttgggtgct

SEQ ID NO: 8429017 - DNA, 22 bp, Homo sapiens
ctggcagggctctttgggtgct

SEQ ID NO: 8429018 - DNA, 22 bp, Homo sapiens
ctggcagcattaacagagagca

SEQ ID NO: 8429019 - DNA, 22 bp, Homo sapiens
ctggcagggtgggctttgcttt

SEQ ID NO: 8429020 - DNA, 22 bp, Homo sapiens
ctggcagtgccctcagccccca

SEQ ID NO: 8429021 - DNA, 22 bp, Homo sapiens
ctggcagtctgcctcttcactg

SEQ ID NO: 8429022 - DNA, 22 bp, Homo sapiens
ctggcagtctggtggaaggcct

SEQ ID NO: 8429023 - DNA, 22 bp, Homo sapiens
ctggcagtctgcctcttcactg

SEQ ID NO: 8429024 - DNA, 22 bp, Homo sapiens
ctggcagtttgccaggagctcg

SEQ ID NO: 8429025 - DNA, 22 bp, Homo sapiens
ctggcagtttgccaggagctcg

SEQ ID NO: 8429026 - DNA, 22 bp, Homo sapiens
ctggcatgaaatggcatctcat

SEQ ID NO: 8429027 - DNA, 22 bp, Homo sapiens
ctggcatgaaatggcatctcat

SEQ ID NO: 8429028 - DNA, 22 bp, Homo sapiens
ctggccaccaagagcttgctca

SEQ ID NO: 8429029 - DNA, 22 bp, Homo sapiens
ctggccaccaagagcttgctca

SEQ ID NO: 8429030 - DNA, 23 bp, Homo sapiens
ctggccaccatctttctggcttc

SEQ ID NO: 8429031 - DNA, 19 bp, Homo sapiens
ctggccacacctgctggtt

SEQ ID NO: 8429032 - DNA, 22 bp, Homo sapiens
ctggccaggcggcccctgcatg

SEQ ID NO: 8429033 - DNA, 22 bp, Homo sapiens
ctggcatgctaatacagcctgt

SEQ ID NO: 8429034 - DNA, 21 bp, Homo sapiens
ctggcatgaggagctttgttt

SEQ ID NO: 8429035 - DNA, 22 bp, Homo sapiens
ctggcatgtgtttggctcctgt

SEQ ID NO: 8429036 - DNA, 22 bp, Homo sapiens
ctggcatggtgtatttgttcaa

SEQ ID NO: 8429037 - DNA, 22 bp, Homo sapiens
ctggcatgtgtttggctcctgt

SEQ ID NO: 8429038 - DNA, 21 bp, Homo sapiens
ctggcattatgatagcgtcct

SEQ ID NO: 8429039 - DNA, 22 bp, Homo sapiens
ctggcattcttgtttctggaaa

SEQ ID NO: 8429040 - DNA, 18 bp, Homo sapiens
ctggcattcttccctgga

SEQ ID NO: 8429041 - DNA, 22 bp, Homo sapiens
ctggcatttagacccacagcaa

SEQ ID NO: 8429042 - DNA, 22 bp, Homo sapiens
ctggccaagcttctctaagcag

SEQ ID NO: 8429043 - DNA, 22 bp, Homo sapiens
ctggccacaactagcccaggac

SEQ ID NO: 8429044 - DNA, 22 bp, Homo sapiens
ctggcctgcagatcccagggtc

SEQ ID NO: 8429045 - DNA, 22 bp, Homo sapiens
ctggcctgctgggtgaggtcct

SEQ ID NO: 8429046 - DNA, 22 bp, Homo sapiens
ctggcctgctgggtgaggtcct

SEQ ID NO: 8429047 - DNA, 22 bp, Homo sapiens
ctggcctgcctgccggttgtcg

SEQ ID NO: 8429048 - DNA, 22 bp, Homo sapiens
ctggcctgaggtcggctgtagg

SEQ ID NO: 8429049 - DNA, 22 bp, Homo sapiens
ctggcctgatctcatgctgtcc

SEQ ID NO: 8429050 - DNA, 22 bp, Homo sapiens
ctggcctgatctcatgctgtcc

SEQ ID NO: 8429051 - DNA, 22 bp, Homo sapiens
ctggcctggcagggagggcatg

SEQ ID NO: 8429052 - DNA, 22 bp, Homo sapiens
ctggcctggcagggagggcatg

SEQ ID NO: 8429053 - DNA, 22 bp, Homo sapiens
ctggcctgagcacagcggctgc

SEQ ID NO: 8429054 - DNA, 22 bp, Homo sapiens
ctggcctgagcacagcggctgc

SEQ ID NO: 8429055 - DNA, 22 bp, Homo sapiens
ctggcctgaggccgccttcaga

SEQ ID NO: 8429056 - DNA, 22 bp, Homo sapiens
ctggcctgaggccgccttcaga

SEQ ID NO: 8429057 - DNA, 22 bp, Homo sapiens
ctggccctgtggcctaaggact

SEQ ID NO: 8429058 - DNA, 22 bp, Homo sapiens
ctggccctgtggcctaaggact

SEQ ID NO: 8429059 - DNA, 22 bp, Homo sapiens
ctggcctctgtgttcaccatag

SEQ ID NO: 8429060 - DNA, 22 bp, Homo sapiens
ctggcccagagagcagagctta

SEQ ID NO: 8429061 - DNA, 22 bp, Homo sapiens
ctggcccagagagcagagctta

SEQ ID NO: 8429062 - DNA, 22 bp, Homo sapiens
ctggcccagagagcagagctta

SEQ ID NO: 8429063 - DNA, 22 bp, Homo sapiens
ctggccagttgccttcctgggt

SEQ ID NO: 8429064 - DNA, 21 bp, Homo sapiens
ctggcccagggatctgcattt

SEQ ID NO: 8429065 - DNA, 21 bp, Homo sapiens
ctggcccagggatctgcattt

SEQ ID NO: 8429066 - DNA, 23 bp, Homo sapiens
ctggcccaggtgagaggttggtg

SEQ ID NO: 8429067 - DNA, 21 bp, Homo sapiens
ctggcccagggatctgcattt

SEQ ID NO: 8429068 - DNA, 22 bp, Homo sapiens
ctggcccaggctcctggggcac

SEQ ID NO: 8429069 - DNA, 20 bp, Homo sapiens
ctggcccaggatgatggcgc

SEQ ID NO: 8429070 - DNA, 20 bp, Homo sapiens
ctggcccaggatgatggcgc

SEQ ID NO: 8429071 - DNA, 22 bp, Homo sapiens
ctggcccaggagagcaggcatt

SEQ ID NO: 8429072 - DNA, 22 bp, Homo sapiens
ctggcccaggaagacgtgtccc

SEQ ID NO: 8429073 - DNA, 22 bp, Homo sapiens
ctggcccagagctctggccttt

SEQ ID NO: 8429074 - DNA, 22 bp, Homo sapiens
ctggcccagagctctggccttt

SEQ ID NO: 8429075 - DNA, 22 bp, Homo sapiens
ctggcccagagctctggccttt

SEQ ID NO: 8429076 - DNA, 22 bp, Homo sapiens
ctggctcctctacacacccaaa

SEQ ID NO: 8429077 - DNA, 22 bp, Homo sapiens
ctggctcctgaggcttggcccc

SEQ ID NO: 8429078 - DNA, 22 bp, Homo sapiens
ctggctcctgtttaaccagctg

SEQ ID NO: 8429079 - DNA, 23 bp, Homo sapiens
ctggctctgtaggtggcatcctt

SEQ ID NO: 8429080 - DNA, 22 bp, Homo sapiens
ctggctctgagcccacctccag

SEQ ID NO: 8429081 - DNA, 22 bp, Homo sapiens
ctggctctgggctaagctccca

SEQ ID NO: 8429082 - DNA, 22 bp, Homo sapiens
ctggcctggcaggggacctcta

SEQ ID NO: 8429083 - DNA, 22 bp, Homo sapiens
ctggcctgggagctgctagcgt

SEQ ID NO: 8429084 - DNA, 22 bp, Homo sapiens
ctggcctgggagctgctagcgt

SEQ ID NO: 8429085 - DNA, 22 bp, Homo sapiens
ctggcctggcgcagtggctcac

SEQ ID NO: 8429086 - DNA, 22 bp, Homo sapiens
ctggctccaccccaggaggatg

SEQ ID NO: 8429087 - DNA, 22 bp, Homo sapiens
ctggctccctggacatggggcc

SEQ ID NO: 8429088 - DNA, 23 bp, Homo sapiens
ctggctccgaagactccaggatc

SEQ ID NO: 8429089 - DNA, 23 bp, Homo sapiens
ctggctccgaagactccaggatc

SEQ ID NO: 8429090 - DNA, 22 bp, Homo sapiens
ctggctcctcagtattccactt

SEQ ID NO: 8429091 - DNA, 23 bp, Homo sapiens
ctggctccgaagactccaggatc

SEQ ID NO: 8429092 - DNA, 22 bp, Homo sapiens
ctggctccaggtcatgcactca

SEQ ID NO: 8429093 - DNA, 22 bp, Homo sapiens
ctggctccactccctgcctgac

SEQ ID NO: 8429094 - DNA, 22 bp, Homo sapiens
ctggcctggggcctcagctgct

SEQ ID NO: 8429095 - DNA, 22 bp, Homo sapiens
gctgggagtgggcaagatgaga

SEQ ID NO: 8429096 - DNA, 22 bp, Homo sapiens
gctgggagtgggcaagatgaga

SEQ ID NO: 8429097 - DNA, 22 bp, Homo sapiens
gctgggcaacggaagagagaaa

SEQ ID NO: 8429098 - DNA, 22 bp, Homo sapiens
gctgggagtttgatttgactgg

SEQ ID NO: 8429099 - DNA, 22 bp, Homo sapiens
gctgggagttactgtctccttt

SEQ ID NO: 8429100 - DNA, 22 bp, Homo sapiens
gctggcctgggcagaggctatg

SEQ ID NO: 8429101 - DNA, 22 bp, Homo sapiens
gctggcctgggctcaagaccag

SEQ ID NO: 8429102 - DNA, 22 bp, Homo sapiens
gctggccttgtgtctgaggaag

SEQ ID NO: 8429103 - DNA, 22 bp, Homo sapiens
gctgggcaggcctcgtgagggc

SEQ ID NO: 8429104 - DNA, 22 bp, Homo sapiens
gctgggcagctgaggcctctca

SEQ ID NO: 8429105 - DNA, 22 bp, Homo sapiens
gctgggcagcctggccgctgcc

SEQ ID NO: 8429106 - DNA, 22 bp, Homo sapiens
gctgggcagcctggccgctgcc

SEQ ID NO: 8429107 - DNA, 22 bp, Homo sapiens
gctgggcaccggagagacccca

SEQ ID NO: 8429108 - DNA, 22 bp, Homo sapiens
gctgggcactgtcccataggct

SEQ ID NO: 8429109 - DNA, 22 bp, Homo sapiens
gctgggcaaggctgaagctacc

SEQ ID NO: 8429110 - DNA, 22 bp, Homo sapiens
gctggccagggctgctcgcgga

SEQ ID NO: 8429111 - DNA, 22 bp, Homo sapiens
gctggccagggctgctcgcgga

SEQ ID NO: 8429112 - DNA, 22 bp, Homo sapiens
gctggagctgcagcctgggcct

SEQ ID NO: 8429113 - DNA, 22 bp, Homo sapiens
gctggagctgcagcctgggcct

SEQ ID NO: 8429114 - DNA, 22 bp, Homo sapiens
gctggcctcgcaggcaggatgt

SEQ ID NO: 8429115 - DNA, 22 bp, Homo sapiens
gctggcctcctgctagatggaa

SEQ ID NO: 8429116 - DNA, 22 bp, Homo sapiens
gctggcctcatcactgacttct

SEQ ID NO: 8429117 - DNA, 22 bp, Homo sapiens
gctggccccgagtgctacgctc

SEQ ID NO: 8429118 - DNA, 22 bp, Homo sapiens
gctggcctgaccagccacaggc

SEQ ID NO: 8429119 - DNA, 22 bp, Homo sapiens
gctggcctgaccagccacaggc

SEQ ID NO: 8429120 - DNA, 22 bp, Homo sapiens
gctggcctgagggccgaggctc

SEQ ID NO: 8429121 - DNA, 22 bp, Homo sapiens
gctggcctgacctgaggctggg

SEQ ID NO: 8429122 - DNA, 22 bp, Homo sapiens
gctggcctgacctgaggctggg

SEQ ID NO: 8429123 - DNA, 22 bp, Homo sapiens
gctggcctgacctgaggctggg

SEQ ID NO: 8429124 - DNA, 22 bp, Homo sapiens
gctggagatagtaggatccata

SEQ ID NO: 8429125 - DNA, 22 bp, Homo sapiens
gctggagatgctatgcagaggg

SEQ ID NO: 8429126 - DNA, 22 bp, Homo sapiens
gctggagctgagttccctgggc

SEQ ID NO: 8429127 - DNA, 22 bp, Homo sapiens
gctggagctgagttccctgggc

SEQ ID NO: 8429128 - DNA, 22 bp, Homo sapiens
gctggagatgctatgcagaggg

SEQ ID NO: 8429129 - DNA, 22 bp, Homo sapiens
gctggagatgctatgcagaggg

SEQ ID NO: 8429130 - DNA, 22 bp, Homo sapiens
gctgaggattgaagagttgcca

SEQ ID NO: 8429131 - DNA, 22 bp, Homo sapiens
gctgaggattgaagagttgcca

SEQ ID NO: 8429132 - DNA, 22 bp, Homo sapiens
gctgagctgaggcagggctggg

SEQ ID NO: 8429133 - DNA, 22 bp, Homo sapiens
gctgagctcccagcagtatctg

SEQ ID NO: 8429134 - DNA, 22 bp, Homo sapiens
gctgagctagctatctcagtct

SEQ ID NO: 8429135 - DNA, 22 bp, Homo sapiens
gctgagctagaaaaggaccaca

SEQ ID NO: 8429136 - DNA, 22 bp, Homo sapiens
gctgagccacaggcagtgcact

SEQ ID NO: 8429137 - DNA, 22 bp, Homo sapiens
gctgagcaggtttgatgctttt

SEQ ID NO: 8429138 - DNA, 22 bp, Homo sapiens
gctgagcccccctgcgtgggtc

SEQ ID NO: 8429139 - DNA, 22 bp, Homo sapiens
gctgcctgggcaggaggcgctg

SEQ ID NO: 8429140 - DNA, 22 bp, Homo sapiens
gctgcctgggcaggaggcgctg

SEQ ID NO: 8429141 - DNA, 22 bp, Homo sapiens
gctgcctggctttagtccactt

SEQ ID NO: 8429142 - DNA, 22 bp, Homo sapiens
gctgcctggaataacggctggc

SEQ ID NO: 8429143 - DNA, 22 bp, Homo sapiens
gctgcctgatgtccagcaggac

SEQ ID NO: 8429144 - DNA, 22 bp, Homo sapiens
gctgcctgccttgcctggagga

SEQ ID NO: 8429145 - DNA, 22 bp, Homo sapiens
gctgcctgctcacccggcctgg

SEQ ID NO: 8429146 - DNA, 22 bp, Homo sapiens
gctgcctgcttcatgtgggaga

SEQ ID NO: 8429147 - DNA, 22 bp, Homo sapiens
gctgcctgctcggctcctggga

SEQ ID NO: 8429148 - DNA, 22 bp, Homo sapiens
gctgctctcagagctcatgctg

SEQ ID NO: 8429149 - DNA, 20 bp, Homo sapiens
gctgctctccacggtctgca

SEQ ID NO: 8429150 - DNA, 22 bp, Homo sapiens
gctgctctccatggccgtgagt

SEQ ID NO: 8429151 - DNA, 19 bp, Homo sapiens
gctgctctgggtctcatct

SEQ ID NO: 8429152 - DNA, 22 bp, Homo sapiens
gctgctctggctctgcagtgtc

SEQ ID NO: 8429153 - DNA, 22 bp, Homo sapiens
gctgctctgaaaatgactgttg

SEQ ID NO: 8429154 - DNA, 22 bp, Homo sapiens
gctgctctgaaaatgactgttg

SEQ ID NO: 8429155 - DNA, 22 bp, Homo sapiens
gctgcctgtcccaggatgagga

SEQ ID NO: 8429156 - DNA, 21 bp, Homo sapiens
gctgctcgagatccagtgctt

SEQ ID NO: 8429157 - DNA, 22 bp, Homo sapiens
gctgcctgtcccaggatgagga

SEQ ID NO: 8429158 - DNA, 21 bp, Homo sapiens
gctgctcgagatccagtgctt

SEQ ID NO: 8429159 - DNA, 22 bp, Homo sapiens
gctgctctcagagctcatgctg

SEQ ID NO: 8429160 - DNA, 20 bp, Homo sapiens
gctgctcgctgcagtcactc

SEQ ID NO: 8429161 - DNA, 21 bp, Homo sapiens
gctgctcgagatccagtgctt

SEQ ID NO: 8429162 - DNA, 22 bp, Homo sapiens
gctgcctggtttctcagctgca

SEQ ID NO: 8429163 - DNA, 22 bp, Homo sapiens
gctgctcttttcagagatgaga

SEQ ID NO: 8429164 - DNA, 22 bp, Homo sapiens
gctgctgcaagagccagctctt

SEQ ID NO: 8429165 - DNA, 22 bp, Homo sapiens
gctgctctgtgacagcctccgg

SEQ ID NO: 8429166 - DNA, 22 bp, Homo sapiens
gctgctctgctgtgtaagcagg

SEQ ID NO: 8429167 - DNA, 22 bp, Homo sapiens
gcctgtttgactggtctctgct

SEQ ID NO: 8429168 - DNA, 22 bp, Homo sapiens
gcctgtttgagaatagtcaggg

SEQ ID NO: 8429169 - DNA, 22 bp, Homo sapiens
gcctgtttgagaatagtcaggg

SEQ ID NO: 8429170 - DNA, 22 bp, Homo sapiens
gcctgtttctcctccttggccc

SEQ ID NO: 8429171 - DNA, 22 bp, Homo sapiens
gcctgtttctaatctcatttct

SEQ ID NO: 8429172 - DNA, 22 bp, Homo sapiens
gcctgtttactttgccgcagga

SEQ ID NO: 8429173 - DNA, 22 bp, Homo sapiens
gcctgtttatctatcatgaact

SEQ ID NO: 8429174 - DNA, 22 bp, Homo sapiens
gcctgtttccatcaacacatgc

SEQ ID NO: 8429175 - DNA, 22 bp, Homo sapiens
gcctgtttccctgacgcttaca

SEQ ID NO: 8429176 - DNA, 22 bp, Homo sapiens
gcctgtttggctgctgacattg

SEQ ID NO: 8429177 - DNA, 22 bp, Homo sapiens
gcctgtttgttatgtcatggta

SEQ ID NO: 8429178 - DNA, 22 bp, Homo sapiens
gcctgtttggaatctgtttaat

SEQ ID NO: 8429179 - DNA, 22 bp, Homo sapiens
gcctgtttggcatcattggttg

SEQ ID NO: 8429180 - DNA, 22 bp, Homo sapiens
gcctgtttttgcttcgtttaag

SEQ ID NO: 8429181 - DNA, 22 bp, Homo sapiens
gcctgtttgttatgtcatggta

SEQ ID NO: 8429182 - DNA, 22 bp, Homo sapiens
gcctgttttagatgcattgatg

SEQ ID NO: 8429183 - DNA, 22 bp, Homo sapiens
gcctgtttgtttgcaaaggagc

SEQ ID NO: 8429184 - DNA, 22 bp, Homo sapiens
gcctgttttcctgctgtggttg

SEQ ID NO: 8429185 - DNA, 22 bp, Homo sapiens
gccttagaaaaataagatttta

SEQ ID NO: 8429186 - DNA, 22 bp, Homo sapiens
gccttactgagggcaattttga

SEQ ID NO: 8429187 - DNA, 22 bp, Homo sapiens
gccttagcctgcacttcctgtt

SEQ ID NO: 8429188 - DNA, 22 bp, Homo sapiens
gctcactggcctgaagaggacg

SEQ ID NO: 8429189 - DNA, 22 bp, Homo sapiens
gctcactgcaacctctgcttcc

SEQ ID NO: 8429190 - DNA, 20 bp, Homo sapiens
gctcagagcctgaacttcat

SEQ ID NO: 8429191 - DNA, 22 bp, Homo sapiens
gctcatgactgtaatcccagca

SEQ ID NO: 8429192 - DNA, 22 bp, Homo sapiens
gctcagagcccgaggcttgcat

SEQ ID NO: 8429193 - DNA, 22 bp, Homo sapiens
gctcagagcccgaggcttgcat

SEQ ID NO: 8429194 - DNA, 19 bp, Homo sapiens
gctcagagccatgggggct

SEQ ID NO: 8429195 - DNA, 19 bp, Homo sapiens
gctcagagccatgggggct

SEQ ID NO: 8429196 - DNA, 19 bp, Homo sapiens
gctcagagccatgggggct

SEQ ID NO: 8429197 - DNA, 19 bp, Homo sapiens
gctcagagccatgggggct

SEQ ID NO: 8429198 - DNA, 22 bp, Homo sapiens
gctcagagcatcccagtgaatg

SEQ ID NO: 8429199 - DNA, 22 bp, Homo sapiens
gctcagagcatcccagtgaatg

SEQ ID NO: 8429200 - DNA, 22 bp, Homo sapiens
gctcagagcatcccagtgaatg

SEQ ID NO: 8429201 - DNA, 22 bp, Homo sapiens
gctcagagcactcagactcagc

SEQ ID NO: 8429202 - DNA, 22 bp, Homo sapiens
gctcagagcagatggtactcag

SEQ ID NO: 8429203 - DNA, 22 bp, Homo sapiens
gctcagagcagatggtactcag

SEQ ID NO: 8429204 - DNA, 22 bp, Homo sapiens
gctcagaccccaccctggcaga

SEQ ID NO: 8429205 - DNA, 22 bp, Homo sapiens
gctcagaccccaccctggcaga

SEQ ID NO: 8429206 - DNA, 22 bp, Homo sapiens
gctcagagatgttcagtagctt

SEQ ID NO: 8429207 - DNA, 22 bp, Homo sapiens
gctcagagatgttcagtagctt

SEQ ID NO: 8429208 - DNA, 22 bp, Homo sapiens
gctcagagatgttcagtagctt

SEQ ID NO: 8429209 - DNA, 22 bp, Homo sapiens
gctcagagatgttcagtagctt

SEQ ID NO: 8429210 - DNA, 22 bp, Homo sapiens
gctcagagatggggaatgaaaa

SEQ ID NO: 8429211 - DNA, 22 bp, Homo sapiens
gctcagagataaaactgatcag

SEQ ID NO: 8429212 - DNA, 22 bp, Homo sapiens
gctcagagatggggaatgaaaa

SEQ ID NO: 8429213 - DNA, 22 bp, Homo sapiens
gctcagagatgtctgctgcctt

SEQ ID NO: 8429214 - DNA, 22 bp, Homo sapiens
gctcagagatgtctgctgcctt

SEQ ID NO: 8429215 - DNA, 22 bp, Homo sapiens
gctcctggcaggcagtgtgtgt

SEQ ID NO: 8429216 - DNA, 22 bp, Homo sapiens
gctccaggagctcacagctcgc

SEQ ID NO: 8429217 - DNA, 22 bp, Homo sapiens
gctccaggagagggaagcagat

SEQ ID NO: 8429218 - DNA, 22 bp, Homo sapiens
gctccaggagctcacagctcgc

SEQ ID NO: 8429219 - DNA, 22 bp, Homo sapiens
gctccaggaggatgaccttcct

SEQ ID NO: 8429220 - DNA, 22 bp, Homo sapiens
gctccaggaggatgaccttcct

SEQ ID NO: 8429221 - DNA, 22 bp, Homo sapiens
gctcctggccagcacagggccc

SEQ ID NO: 8429222 - DNA, 22 bp, Homo sapiens
gctcctggccagcacagggccc

SEQ ID NO: 8429223 - DNA, 22 bp, Homo sapiens
gctcctggcaggcagtgtgtgt

SEQ ID NO: 8429224 - DNA, 22 bp, Homo sapiens
gctcctggcatcctgcttttaa

SEQ ID NO: 8429225 - DNA, 22 bp, Homo sapiens
gctcctggcatcctgcttttaa

SEQ ID NO: 8429226 - DNA, 22 bp, Homo sapiens
gctcctggccagcacagggccc

SEQ ID NO: 8429227 - DNA, 22 bp, Homo sapiens
gctcctggctctctgagggctg

SEQ ID NO: 8429228 - DNA, 22 bp, Homo sapiens
gctcctggctctctgagggctg

SEQ ID NO: 8429229 - DNA, 22 bp, Homo sapiens
gctcctggctctctgagggctg

SEQ ID NO: 8429230 - DNA, 22 bp, Homo sapiens
gctcctggctccaggcagccaa

SEQ ID NO: 8429231 - DNA, 22 bp, Homo sapiens
gctcctggctccaggcagccaa

SEQ ID NO: 8429232 - DNA, 22 bp, Homo sapiens
gctcctggctccaggcagccaa

SEQ ID NO: 8429233 - DNA, 22 bp, Homo sapiens
gctcctggctccaggcagccaa

SEQ ID NO: 8429234 - DNA, 22 bp, Homo sapiens
gctcctggctccaggcagccaa

SEQ ID NO: 8429235 - DNA, 22 bp, Homo sapiens
gctccagctccggctccgaagc

SEQ ID NO: 8429236 - DNA, 22 bp, Homo sapiens
gctccagcacctagagcaggtc

SEQ ID NO: 8429237 - DNA, 22 bp, Homo sapiens
gctccagctcgtggctcccagc

SEQ ID NO: 8429238 - DNA, 22 bp, Homo sapiens
gctccagctcgtggctcccagc

SEQ ID NO: 8429239 - DNA, 22 bp, Homo sapiens
gctccaggaagggaaatctcca

SEQ ID NO: 8429240 - DNA, 22 bp, Homo sapiens
gctccaaagtccagctgtttcc

SEQ ID NO: 8429241 - DNA, 22 bp, Homo sapiens
gctccaaagtacagtgacttac

SEQ ID NO: 8429242 - DNA, 22 bp, Homo sapiens
gctcatgtgtgattacagtttt

SEQ ID NO: 8429243 - DNA, 22 bp, Homo sapiens
gctccaaggtatccaccagggt

SEQ ID NO: 8429244 - DNA, 22 bp, Homo sapiens
gctccactgcccctgggcaccg

SEQ ID NO: 8429245 - DNA, 22 bp, Homo sapiens
gctctgaggctgggagcactct

SEQ ID NO: 8429246 - DNA, 22 bp, Homo sapiens
gctctgagtaaatgaaagcatt

SEQ ID NO: 8429247 - DNA, 22 bp, Homo sapiens
gctctgaggctgtgaggtgctg

SEQ ID NO: 8429248 - DNA, 22 bp, Homo sapiens
gctctgagcccccagaagcaga

SEQ ID NO: 8429249 - DNA, 22 bp, Homo sapiens
gctctgagccgggggcctgtcc

SEQ ID NO: 8429250 - DNA, 22 bp, Homo sapiens
gctctgagctgtcttgcaggtc

SEQ ID NO: 8429251 - DNA, 22 bp, Homo sapiens
gctctgagtgatcagctgggaa

SEQ ID NO: 8429252 - DNA, 22 bp, Homo sapiens
gctctgagtgattaaggagctt

SEQ ID NO: 8429253 - DNA, 22 bp, Homo sapiens
gctctgagtctcagctaccaca

SEQ ID NO: 8429254 - DNA, 22 bp, Homo sapiens
gctctgccaaggacccattctc

SEQ ID NO: 8429255 - DNA, 18 bp, Homo sapiens
gctctgcagctgaggctt

SEQ ID NO: 8429256 - DNA, 18 bp, Homo sapiens
gctctgcaggtgctcggt

SEQ ID NO: 8429257 - DNA, 22 bp, Homo sapiens
gctctgccaaggacccattctc

SEQ ID NO: 8429258 - DNA, 19 bp, Homo sapiens
gctcctgggcctcactcat

SEQ ID NO: 8429259 - DNA, 19 bp, Homo sapiens
gctcctgggcctcactcat

SEQ ID NO: 8429260 - DNA, 19 bp, Homo sapiens
gctcctgggcctcactcat

SEQ ID NO: 8429261 - DNA, 16 bp, Homo sapiens
gctcctgggccctcga

SEQ ID NO: 8429262 - DNA, 16 bp, Homo sapiens
gctcctgggccctcga

SEQ ID NO: 8429263 - DNA, 22 bp, Homo sapiens
gctcctgggccctgggctaact

SEQ ID NO: 8429264 - DNA, 22 bp, Homo sapiens
gctcctgggccctgggctaact

SEQ ID NO: 8429265 - DNA, 22 bp, Homo sapiens
gctcctggcttcactgacatca

SEQ ID NO: 8429266 - DNA, 22 bp, Homo sapiens
gctcctggcttcactgacatca

SEQ ID NO: 8429267 - DNA, 22 bp, Homo sapiens
gctcctggcttcactgacatca

SEQ ID NO: 8429268 - DNA, 22 bp, Homo sapiens
gctcctggcttcactgacatca

SEQ ID NO: 8429269 - DNA, 22 bp, Homo sapiens
gctcctggctctggccaaggga

SEQ ID NO: 8429270 - DNA, 22 bp, Homo sapiens
gctcctggctctggccaaggga

SEQ ID NO: 8429271 - DNA, 22 bp, Homo sapiens
gctcctggctctggccaaggga

SEQ ID NO: 8429272 - DNA, 22 bp, Homo sapiens
gctcctgggtgtggctgcccct

SEQ ID NO: 8429273 - DNA, 22 bp, Homo sapiens
gctcctgggtgtggctgcccct

SEQ ID NO: 8429274 - DNA, 22 bp, Homo sapiens
gctcctgggtgtggctgcccct

SEQ ID NO: 8429275 - DNA, 22 bp, Homo sapiens
gctcctgggctctaccttgcta

SEQ ID NO: 8429276 - DNA, 22 bp, Homo sapiens
gctcctgggctctaccttgcta

SEQ ID NO: 8429277 - DNA, 22 bp, Homo sapiens
gctctgagcactgtgcggctgg

SEQ ID NO: 8429278 - DNA, 22 bp, Homo sapiens
gctgaaatgtttaatttgggag

SEQ ID NO: 8429279 - DNA, 22 bp, Homo sapiens
gctgaaattagactgcagaagt

SEQ ID NO: 8429280 - DNA, 17 bp, Homo sapiens
gctgaacaaggaaaata

SEQ ID NO: 8429281 - DNA, 22 bp, Homo sapiens
gctgagcacacctagggtagag

SEQ ID NO: 8429282 - DNA, 22 bp, Homo sapiens
gctgagcacacctagggtagag

SEQ ID NO: 8429283 - DNA, 22 bp, Homo sapiens
gctgagcacagcctgtgtcctc

SEQ ID NO: 8429284 - DNA, 22 bp, Homo sapiens
gctgagcacagcctgtgtcctc

SEQ ID NO: 8429285 - DNA, 22 bp, Homo sapiens
gctgagagtgggtgcagtgctt

SEQ ID NO: 8429286 - DNA, 22 bp, Homo sapiens
gctgaagacaatggaattgact

SEQ ID NO: 8429287 - DNA, 22 bp, Homo sapiens
gctctgtgttttgcccaggaga

SEQ ID NO: 8429288 - DNA, 17 bp, Homo sapiens
gctctgccaggaaagag

SEQ ID NO: 8429289 - DNA, 19 bp, Homo sapiens
gctctgccagtggtaacat

SEQ ID NO: 8429290 - DNA, 22 bp, Homo sapiens
gctctgcccaatgtccctacac

SEQ ID NO: 8429291 - DNA, 22 bp, Homo sapiens
gcctgtttaagtattctgacat

SEQ ID NO: 8429292 - DNA, 22 bp, Homo sapiens
gcctgtgtggatgcgccggtgc

SEQ ID NO: 8429293 - DNA, 22 bp, Homo sapiens
gcctgtgtttttaactctagga

SEQ ID NO: 8429294 - DNA, 22 bp, Homo sapiens
gcctgtgtgtttagctctgggg

SEQ ID NO: 8429295 - DNA, 22 bp, Homo sapiens
gcctgtgtggatgggcccctgg

SEQ ID NO: 8429296 - DNA, 22 bp, Homo sapiens
gcctgtgtctgggtggccagag

SEQ ID NO: 8429297 - DNA, 22 bp, Homo sapiens
gcctgtgtccttcccagtgggg

SEQ ID NO: 8429298 - DNA, 22 bp, Homo sapiens
gcctgtgtcatgtagtagcttc

SEQ ID NO: 8429299 - DNA, 22 bp, Homo sapiens
gcctgtgtcatgtagtagcttc

SEQ ID NO: 8429300 - DNA, 22 bp, Homo sapiens
gcctgtgggttggagcttggcc

SEQ ID NO: 8429301 - DNA, 22 bp, Homo sapiens
gcctgtggggctgaggctgcct

SEQ ID NO: 8429302 - DNA, 22 bp, Homo sapiens
gcctgtggcccaactgtctgtc

SEQ ID NO: 8429303 - DNA, 22 bp, Homo sapiens
gcctgtggccgactgagagcct

SEQ ID NO: 8429304 - DNA, 22 bp, Homo sapiens
gcctgtgctttcttccctcctg

SEQ ID NO: 8429305 - DNA, 22 bp, Homo sapiens
gcctgggattctcaaaggggtg

SEQ ID NO: 8429306 - DNA, 22 bp, Homo sapiens
gcctgggattgtgtaagtgaat

SEQ ID NO: 8429307 - DNA, 22 bp, Homo sapiens
gcctgtatttattgagagtgta

SEQ ID NO: 8429308 - DNA, 22 bp, Homo sapiens
gcctgtcaattttgtgtacaat

SEQ ID NO: 8429309 - DNA, 22 bp, Homo sapiens
gcctgtgcttaactgacgtgag

SEQ ID NO: 8429310 - DNA, 22 bp, Homo sapiens
gcctgggattcccagaggggca

SEQ ID NO: 8429311 - DNA, 22 bp, Homo sapiens
gcctgggattcccagaggggca

SEQ ID NO: 8429312 - DNA, 19 bp, Homo sapiens
gcctgggatgggcagaact

SEQ ID NO: 8429313 - DNA, 20 bp, Homo sapiens
gcctgggattatccactggt

SEQ ID NO: 8429314 - DNA, 22 bp, Homo sapiens
gcctgggatagaggcaatgcat

SEQ ID NO: 8429315 - DNA, 22 bp, Homo sapiens
gcctgggagaatgacctccaac

SEQ ID NO: 8429316 - DNA, 18 bp, Homo sapiens
gcctgggagaagtttcac

SEQ ID NO: 8429317 - DNA, 21 bp, Homo sapiens
gcctgggatagtggcctccgg

SEQ ID NO: 8429318 - DNA, 21 bp, Homo sapiens
gcctgggatagtggcctccgg

SEQ ID NO: 8429319 - DNA, 22 bp, Homo sapiens
gcctgggaactctgatctcctg

SEQ ID NO: 8429320 - DNA, 22 bp, Homo sapiens
gcctgggaagactaagtgggag

SEQ ID NO: 8429321 - DNA, 22 bp, Homo sapiens
gcctgggacccttagctcttgg

SEQ ID NO: 8429322 - DNA, 21 bp, Homo sapiens
gcctgggaagagaaaggtaag

SEQ ID NO: 8429323 - DNA, 22 bp, Homo sapiens
gcctgggactgcagatccccag

SEQ ID NO: 8429324 - DNA, 23 bp, Homo sapiens
gcctgggactggtagtgtgacct

SEQ ID NO: 8429325 - DNA, 22 bp, Homo sapiens
gcctgggactggatgtgtttgt

SEQ ID NO: 8429326 - DNA, 23 bp, Homo sapiens
gcctgggactcaggaggagctca

SEQ ID NO: 8429327 - DNA, 22 bp, Homo sapiens
gcctggcaggggcctgggagtg

SEQ ID NO: 8429328 - DNA, 21 bp, Homo sapiens
gcctggcaggtggaagggctc

SEQ ID NO: 8429329 - DNA, 21 bp, Homo sapiens
gcctggcaggtggaagggctc

SEQ ID NO: 8429330 - DNA, 22 bp, Homo sapiens
gcctggcagtggggccctggga

SEQ ID NO: 8429331 - DNA, 22 bp, Homo sapiens
gcctggcaggcctgggccagca

SEQ ID NO: 8429332 - DNA, 22 bp, Homo sapiens
gcctggagtagcatggcaagcc

SEQ ID NO: 8429333 - DNA, 21 bp, Homo sapiens
gcctgggaaatctgggaagcc

SEQ ID NO: 8429334 - DNA, 22 bp, Homo sapiens
gcctgggaaatggtggggtcag

SEQ ID NO: 8429335 - DNA, 22 bp, Homo sapiens
gcctgggaaatggtggggtcag

SEQ ID NO: 8429336 - DNA, 22 bp, Homo sapiens
gcctgggaaagagtagggaaat

SEQ ID NO: 8429337 - DNA, 22 bp, Homo sapiens
gcctgggaaagagtagggaaat

SEQ ID NO: 8429338 - DNA, 22 bp, Homo sapiens
gcctggcccagggctcttgttg

SEQ ID NO: 8429339 - DNA, 22 bp, Homo sapiens
gcctggccgctccgagctccgc

SEQ ID NO: 8429340 - DNA, 22 bp, Homo sapiens
gcctggccgggtcttggatttt

SEQ ID NO: 8429341 - DNA, 22 bp, Homo sapiens
gcctggcctgaactaggaggtg

SEQ ID NO: 8429342 - DNA, 22 bp, Homo sapiens
gcctggcttttgcctcatgttc

SEQ ID NO: 8429343 - DNA, 17 bp, Homo sapiens
gcctggcccagcctggc

SEQ ID NO: 8429344 - DNA, 23 bp, Homo sapiens
gcctggccaccccagggctgctt

SEQ ID NO: 8429345 - DNA, 17 bp, Homo sapiens
gcctggcccagcctggc

SEQ ID NO: 8429346 - DNA, 22 bp, Homo sapiens
gcctggccgctccgagctccgc

SEQ ID NO: 8429347 - DNA, 22 bp, Homo sapiens
gcctggacaccgcccttgcaga

SEQ ID NO: 8429348 - DNA, 22 bp, Homo sapiens
gcctggagcctcagcaaggagg

SEQ ID NO: 8429349 - DNA, 22 bp, Homo sapiens
gcctggagcctcagcaaggagg

SEQ ID NO: 8429350 - DNA, 22 bp, Homo sapiens
gcctggagggctctagagaggc

SEQ ID NO: 8429351 - DNA, 22 bp, Homo sapiens
gcctggaggggacagtctctgg

SEQ ID NO: 8429352 - DNA, 22 bp, Homo sapiens
gcctggaggggccagggtggta

SEQ ID NO: 8429353 - DNA, 22 bp, Homo sapiens
gcctggagggtccctctctgga

SEQ ID NO: 8429354 - DNA, 22 bp, Homo sapiens
gcctgcctttgtgaggaagcgg

SEQ ID NO: 8429355 - DNA, 22 bp, Homo sapiens
gcctgctgggagacacccccag

SEQ ID NO: 8429356 - DNA, 23 bp, Homo sapiens
gcctgctgtcacagcgggcccag

SEQ ID NO: 8429357 - DNA, 22 bp, Homo sapiens
gcctgctcagacctagcaggcc

SEQ ID NO: 8429358 - DNA, 22 bp, Homo sapiens
gcctgctctccggatccctgat

SEQ ID NO: 8429359 - DNA, 21 bp, Homo sapiens
gcctgctgttcaccctgccac

SEQ ID NO: 8429360 - DNA, 22 bp, Homo sapiens
gcctgcttcacggacaggcctc

SEQ ID NO: 8429361 - DNA, 22 bp, Homo sapiens
gcctgcttcctagccttccaag

SEQ ID NO: 8429362 - DNA, 22 bp, Homo sapiens
gcctgcttccttttcatagatg

SEQ ID NO: 8429363 - DNA, 22 bp, Homo sapiens
gcctgcctgctgtgtgcaagtt

SEQ ID NO: 8429364 - DNA, 22 bp, Homo sapiens
gcctgcctgctgtcatctgcct

SEQ ID NO: 8429365 - DNA, 22 bp, Homo sapiens
gcctgcctgctgtcatctgcct

SEQ ID NO: 8429366 - DNA, 21 bp, Homo sapiens
gcctgcctgcgtgaccctctt

SEQ ID NO: 8429367 - DNA, 22 bp, Homo sapiens
gcctgcctgttggctgaggtgc

SEQ ID NO: 8429368 - DNA, 22 bp, Homo sapiens
gcctgccttcggtgcgcagcgg

SEQ ID NO: 8429369 - DNA, 22 bp, Homo sapiens
gcctgccttcggtgcgcagcgg

SEQ ID NO: 8429370 - DNA, 20 bp, Homo sapiens
gcctgcctcagctagctgag

SEQ ID NO: 8429371 - DNA, 22 bp, Homo sapiens
gcctgcctcaaaatcccagttc

SEQ ID NO: 8429372 - DNA, 17 bp, Homo sapiens
gcctctgcttgtgtcat

SEQ ID NO: 8429373 - DNA, 22 bp, Homo sapiens
gcctgccaaaagaagctgctgg

SEQ ID NO: 8429374 - DNA, 22 bp, Homo sapiens
gcctgccaaaagaagctgctgg

SEQ ID NO: 8429375 - DNA, 18 bp, Homo sapiens
gcctgccaactcctgatc

SEQ ID NO: 8429376 - DNA, 22 bp, Homo sapiens
gcccaggctggagtgcagtagc

SEQ ID NO: 8429377 - DNA, 22 bp, Homo sapiens
gcccaggctagcgtagagtgca

SEQ ID NO: 8429378 - DNA, 22 bp, Homo sapiens
gcccaggctggagtgcagtggc

SEQ ID NO: 8429379 - DNA, 22 bp, Homo sapiens
gcccaggattctttcttcctta

SEQ ID NO: 8429380 - DNA, 22 bp, Homo sapiens
gcccaggctagcgtagagtgca

SEQ ID NO: 8429381 - DNA, 22 bp, Homo sapiens
gcccaggatggctggaggtgct

SEQ ID NO: 8429382 - DNA, 22 bp, Homo sapiens
gcccaggagttggtggctgcag

SEQ ID NO: 8429383 - DNA, 22 bp, Homo sapiens
gcccaggagttggtggctgcag

SEQ ID NO: 8429384 - DNA, 22 bp, Homo sapiens
gcccaggatctgctcagatcat

SEQ ID NO: 8429385 - DNA, 20 bp, Homo sapiens
gcccaggatctctgaggcat

SEQ ID NO: 8429386 - DNA, 22 bp, Homo sapiens
gccatgtcctgggcatctgcca

SEQ ID NO: 8429387 - DNA, 22 bp, Homo sapiens
gccatatatattttgcactagg

SEQ ID NO: 8429388 - DNA, 22 bp, Homo sapiens
gccattgatgtgaaagtaagac

SEQ ID NO: 8429389 - DNA, 22 bp, Homo sapiens
gccattgggctgtagttttttg

SEQ ID NO: 8429390 - DNA, 22 bp, Homo sapiens
gccattgagattgaagtaagca

SEQ ID NO: 8429391 - DNA, 22 bp, Homo sapiens
gcccaggagttggaggctgcag

SEQ ID NO: 8429392 - DNA, 22 bp, Homo sapiens
gccagggaaactgcagaccagc

SEQ ID NO: 8429393 - DNA, 22 bp, Homo sapiens
gccaggctgtttttattactgt

SEQ ID NO: 8429394 - DNA, 22 bp, Homo sapiens
gccaggctgtggggaacttgaa

SEQ ID NO: 8429395 - DNA, 22 bp, Homo sapiens
gccagtgggtagttggagctgg

SEQ ID NO: 8429396 - DNA, 22 bp, Homo sapiens
gccagtttccacctaggcaatt

SEQ ID NO: 8429397 - DNA, 22 bp, Homo sapiens
gccatatacccactgtctccat

SEQ ID NO: 8429398 - DNA, 22 bp, Homo sapiens
gccagtgtgtcttgcaggctcc

SEQ ID NO: 8429399 - DNA, 22 bp, Homo sapiens
gccagtgtttatagcagtgagg

SEQ ID NO: 8429400 - DNA, 22 bp, Homo sapiens
gccaggctgctggctgctgtcc

SEQ ID NO: 8429401 - DNA, 22 bp, Homo sapiens
gccaggctgctccagggaggcc

SEQ ID NO: 8429402 - DNA, 22 bp, Homo sapiens
gccaggctggtgtcacaactct

SEQ ID NO: 8429403 - DNA, 22 bp, Homo sapiens
gccaggctggttatttaatgag

SEQ ID NO: 8429404 - DNA, 22 bp, Homo sapiens
gccaggctgaggctctggaaga

SEQ ID NO: 8429405 - DNA, 22 bp, Homo sapiens
gccaggctgccttatctctagc

SEQ ID NO: 8429406 - DNA, 19 bp, Homo sapiens
gccaggctcttattctgtg

SEQ ID NO: 8429407 - DNA, 22 bp, Homo sapiens
gccaggctcttggttatgtttt

SEQ ID NO: 8429408 - DNA, 22 bp, Homo sapiens
gccaggctcttccatttgggtc

SEQ ID NO: 8429409 - DNA, 22 bp, Homo sapiens
gccgaggctctgcccagctgct

SEQ ID NO: 8429410 - DNA, 22 bp, Homo sapiens
gccggggctggggagagacatg

SEQ ID NO: 8429411 - DNA, 22 bp, Homo sapiens
gcctcctgtcccaggctgagga

SEQ ID NO: 8429412 - DNA, 22 bp, Homo sapiens
gcctcctgttatgccatgtgcc

SEQ ID NO: 8429413 - DNA, 22 bp, Homo sapiens
gcctcctgttatgccatgtgcc

SEQ ID NO: 8429414 - DNA, 22 bp, Homo sapiens
gcctcctgtcccaggctgagga

SEQ ID NO: 8429415 - DNA, 22 bp, Homo sapiens
gccgtgtcatctgcgggtggca

SEQ ID NO: 8429416 - DNA, 22 bp, Homo sapiens
gcctctgcatgctcagcaccca

SEQ ID NO: 8429417 - DNA, 22 bp, Homo sapiens
gcctctgcatgctcagcaccca

SEQ ID NO: 8429418 - DNA, 22 bp, Homo sapiens
gcctctgcatcatcactccagc

SEQ ID NO: 8429419 - DNA, 19 bp, Homo sapiens
gcctctgctggggacaggc

SEQ ID NO: 8429420 - DNA, 22 bp, Homo sapiens
gcctctgctgcaagcctggttg

SEQ ID NO: 8429421 - DNA, 22 bp, Homo sapiens
gcctctgctgcaagcctggttg

SEQ ID NO: 8429422 - DNA, 22 bp, Homo sapiens
gcctctgctctcaggtagcctc

SEQ ID NO: 8429423 - DNA, 22 bp, Homo sapiens
gccctcagagttccccacagtg

SEQ ID NO: 8429424 - DNA, 22 bp, Homo sapiens
gccctcagcaggaaagatcaac

SEQ ID NO: 8429425 - DNA, 22 bp, Homo sapiens
gccctcagatgggaaaggaggg

SEQ ID NO: 8429426 - DNA, 22 bp, Homo sapiens
gccctcagagttccccacagtg

SEQ ID NO: 8429427 - DNA, 22 bp, Homo sapiens
gccctcagcaggaaagatcaac

SEQ ID NO: 8429428 - DNA, 22 bp, Homo sapiens
gccctcagctcctggacacatg

SEQ ID NO: 8429429 - DNA, 22 bp, Homo sapiens
gccctcagcatcctcagggcca

SEQ ID NO: 8429430 - DNA, 22 bp, Homo sapiens
gccctcagatgggaaaggaggg

SEQ ID NO: 8429431 - DNA, 22 bp, Homo sapiens
gccctcagcatcctcagggcca

SEQ ID NO: 8429432 - DNA, 22 bp, Homo sapiens
gccctcagcttgatgttgttct

SEQ ID NO: 8429433 - DNA, 22 bp, Homo sapiens
gccctcaggacaaggttacgct

SEQ ID NO: 8429434 - DNA, 17 bp, Homo sapiens
gccctcagctttaacca

SEQ ID NO: 8429435 - DNA, 19 bp, Homo sapiens
gccctcaggcagctccatc

SEQ ID NO: 8429436 - DNA, 22 bp, Homo sapiens
gccctcagctcctggacacatg

SEQ ID NO: 8429437 - DNA, 22 bp, Homo sapiens
gccctcagctcctggacacatg

SEQ ID NO: 8429438 - DNA, 22 bp, Homo sapiens
gccctctcggcatagcaggggc

SEQ ID NO: 8429439 - DNA, 22 bp, Homo sapiens
gccctcagtgaccactgattca

SEQ ID NO: 8429440 - DNA, 22 bp, Homo sapiens
gccctcagtggattcttattgt

SEQ ID NO: 8429441 - DNA, 22 bp, Homo sapiens
gccctcctttgcttctcctagt

SEQ ID NO: 8429442 - DNA, 22 bp, Homo sapiens
gccctcctttgcttctcctagt

SEQ ID NO: 8429443 - DNA, 21 bp, Homo sapiens
gccctcaggggaggatggcct

SEQ ID NO: 8429444 - DNA, 20 bp, Homo sapiens
gccctcagtcttgtctttat

SEQ ID NO: 8429445 - DNA, 23 bp, Homo sapiens
gccctcagtagaaaatgttagaa

SEQ ID NO: 8429446 - DNA, 21 bp, Homo sapiens
gccctcaggggaggatggcct

SEQ ID NO: 8429447 - DNA, 22 bp, Homo sapiens
gccctcaggcagggagtctttc

SEQ ID NO: 8429448 - DNA, 21 bp, Homo sapiens
gccctcaggggaggatggcct

SEQ ID NO: 8429449 - DNA, 15 bp, Homo sapiens
gccctcaggcgacac

SEQ ID NO: 8429450 - DNA, 19 bp, Homo sapiens
gccctcaggcagctccatc

SEQ ID NO: 8429451 - DNA, 22 bp, Homo sapiens
gccctttgtggtcagaggcctg

SEQ ID NO: 8429452 - DNA, 22 bp, Homo sapiens
gcccttggaacagcctcctgct

SEQ ID NO: 8429453 - DNA, 22 bp, Homo sapiens
gcccttcacgatggtatcttag

SEQ ID NO: 8429454 - DNA, 22 bp, Homo sapiens
gcccttcatttatagttggaat

SEQ ID NO: 8429455 - DNA, 22 bp, Homo sapiens
gcccttcagttactccttgatg

SEQ ID NO: 8429456 - DNA, 20 bp, Homo sapiens
gccctctgcctccctcagcg

SEQ ID NO: 8429457 - DNA, 20 bp, Homo sapiens
gccctctgcctccctcagcg

SEQ ID NO: 8429458 - DNA, 22 bp, Homo sapiens
gccctctgctcagctcctcagc

SEQ ID NO: 8429459 - DNA, 22 bp, Homo sapiens
gccctctggcacagagatgcag

SEQ ID NO: 8429460 - DNA, 22 bp, Homo sapiens
gccctctggcacagagatgcag

SEQ ID NO: 8429461 - DNA, 22 bp, Homo sapiens
gccctgttttgaaacttgcata

SEQ ID NO: 8429462 - DNA, 22 bp, Homo sapiens
gcactttcagcaggcagacaga

SEQ ID NO: 8429463 - DNA, 22 bp, Homo sapiens
gcagaaacttggagaagccagg

SEQ ID NO: 8429464 - DNA, 22 bp, Homo sapiens
gcagaacctgaattgaacattg

SEQ ID NO: 8429465 - DNA, 22 bp, Homo sapiens
gcagaagcagggcaggggcaaa

SEQ ID NO: 8429466 - DNA, 22 bp, Homo sapiens
gcagaagctgggagaagggatt

SEQ ID NO: 8429467 - DNA, 22 bp, Homo sapiens
gcagaagctgggcagcgaggtg

SEQ ID NO: 8429468 - DNA, 22 bp, Homo sapiens
gcagagcatgtcctcaggacag

SEQ ID NO: 8429469 - DNA, 22 bp, Homo sapiens
gcagagcagtgcttgcccagcg

SEQ ID NO: 8429470 - DNA, 22 bp, Homo sapiens
gcagagccaggctggggcaggt

SEQ ID NO: 8429471 - DNA, 22 bp, Homo sapiens
gcagagccccattgctggcggg

SEQ ID NO: 8429472 - DNA, 22 bp, Homo sapiens
gcagagcccctcaagccagcct

SEQ ID NO: 8429473 - DNA, 22 bp, Homo sapiens
gcagagccaggagagacccttg

SEQ ID NO: 8429474 - DNA, 22 bp, Homo sapiens
gcagagccagaatggccaggac

SEQ ID NO: 8429475 - DNA, 22 bp, Homo sapiens
gcacctggctgcccaggtggag

SEQ ID NO: 8429476 - DNA, 22 bp, Homo sapiens
gcacctggacagtgaccctagc

SEQ ID NO: 8429477 - DNA, 22 bp, Homo sapiens
gcacctcattttgcaggtagaa

SEQ ID NO: 8429478 - DNA, 22 bp, Homo sapiens
gcaccgccttggaccgcccgct

SEQ ID NO: 8429479 - DNA, 22 bp, Homo sapiens
gcacacactgttttcctcacat

SEQ ID NO: 8429480 - DNA, 22 bp, Homo sapiens
gcacacacatgtgagtacatgc

SEQ ID NO: 8429481 - DNA, 22 bp, Homo sapiens
gcacacacatgtgagtacatgc

SEQ ID NO: 8429482 - DNA, 22 bp, Homo sapiens
gcacaatggaccgtgtgctctg

SEQ ID NO: 8429483 - DNA, 22 bp, Homo sapiens
gcacaattccatgggacagccc

SEQ ID NO: 8429484 - DNA, 22 bp, Homo sapiens
gcacccagtttgtctcagggtt

SEQ ID NO: 8429485 - DNA, 22 bp, Homo sapiens
gcacccagtgggatgcttagca

SEQ ID NO: 8429486 - DNA, 22 bp, Homo sapiens
gcacccagtgggatgcttagca

SEQ ID NO: 8429487 - DNA, 22 bp, Homo sapiens
gcacccagggacttggctggcc

SEQ ID NO: 8429488 - DNA, 22 bp, Homo sapiens
gcacccaggcttgggcagcaac

SEQ ID NO: 8429489 - DNA, 22 bp, Homo sapiens
gattttctgagccttcaaattt

SEQ ID NO: 8429490 - DNA, 22 bp, Homo sapiens
gattttctgagccttcaaattt

SEQ ID NO: 8429491 - DNA, 22 bp, Homo sapiens
gcaaaaaatgcttgttgcttag

SEQ ID NO: 8429492 - DNA, 22 bp, Homo sapiens
gcaaaaaatgcttgttgcttag

SEQ ID NO: 8429493 - DNA, 22 bp, Homo sapiens
gatttttatataaagtgagaaa

SEQ ID NO: 8429494 - DNA, 22 bp, Homo sapiens
gcaaacatgttgtgagatacca

SEQ ID NO: 8429495 - DNA, 17 bp, Homo sapiens
gcacaaatcaattacta

SEQ ID NO: 8429496 - DNA, 23 bp, Homo sapiens
gcacaagacctggcagcttccat

SEQ ID NO: 8429497 - DNA, 22 bp, Homo sapiens
gcacaaaaggtacttcatgtag

SEQ ID NO: 8429498 - DNA, 22 bp, Homo sapiens
gcacaaaaggtacttcatgtag

SEQ ID NO: 8429499 - DNA, 22 bp, Homo sapiens
gcacaaaacacattttgacaat

SEQ ID NO: 8429500 - DNA, 22 bp, Homo sapiens
gcacaaaacacattttgacaat

SEQ ID NO: 8429501 - DNA, 17 bp, Homo sapiens
gcaattattgggcattt

SEQ ID NO: 8429502 - DNA, 22 bp, Homo sapiens
gcaattatatcaccagagatct

SEQ ID NO: 8429503 - DNA, 22 bp, Homo sapiens
gcaattatatcaccagagatct

SEQ ID NO: 8429504 - DNA, 22 bp, Homo sapiens
gcaatcaatgatttatatttgt

SEQ ID NO: 8429505 - DNA, 22 bp, Homo sapiens
gattttcattatagctagtttc

SEQ ID NO: 8429506 - DNA, 22 bp, Homo sapiens
gattttattagcccaaactttg

SEQ ID NO: 8429507 - DNA, 22 bp, Homo sapiens
gattttatctttgtgtgcagta

SEQ ID NO: 8429508 - DNA, 22 bp, Homo sapiens
gattttacatgtcatatctatt

SEQ ID NO: 8429509 - DNA, 22 bp, Homo sapiens
gattttacaaactgcaggaccc

SEQ ID NO: 8429510 - DNA, 22 bp, Homo sapiens
gattttactgtctgtgtatctc

SEQ ID NO: 8429511 - DNA, 22 bp, Homo sapiens
gatttggcttggatgattaaac

SEQ ID NO: 8429512 - DNA, 22 bp, Homo sapiens
gatttgcattctgaaagctacc

SEQ ID NO: 8429513 - DNA, 22 bp, Homo sapiens
gatttcttgataattcaaatcc

SEQ ID NO: 8429514 - DNA, 22 bp, Homo sapiens
gatttcttgataattcaaatcc

SEQ ID NO: 8429515 - DNA, 22 bp, Homo sapiens
gattaagtaactgaacactttg

SEQ ID NO: 8429516 - DNA, 20 bp, Homo sapiens
gattacaaaatgaaatgcat

SEQ ID NO: 8429517 - DNA, 22 bp, Homo sapiens
gattacaaaactcatctatgac

SEQ ID NO: 8429518 - DNA, 22 bp, Homo sapiens
gattacattctccttgtattag

SEQ ID NO: 8429519 - DNA, 22 bp, Homo sapiens
gattaagagaagtttcttatcg

SEQ ID NO: 8429520 - DNA, 22 bp, Homo sapiens
gattaaaaataacccatgctga

SEQ ID NO: 8429521 - DNA, 22 bp, Homo sapiens
gatgttaagaaggaattgaagt

SEQ ID NO: 8429522 - DNA, 22 bp, Homo sapiens
gatgtttggctcaaacgagtgt

SEQ ID NO: 8429523 - DNA, 22 bp, Homo sapiens
gatgtttatatctaacttaagt

SEQ ID NO: 8429524 - DNA, 22 bp, Homo sapiens
gattcaaagttaatgaagatgc

SEQ ID NO: 8429525 - DNA, 22 bp, Homo sapiens
gattcaaaaataagctcctatt

SEQ ID NO: 8429526 - DNA, 22 bp, Homo sapiens
gattcaaagacagactcatttc

SEQ ID NO: 8429527 - DNA, 22 bp, Homo sapiens
gattcaaaagtttgagctccaa

SEQ ID NO: 8429528 - DNA, 22 bp, Homo sapiens
gattattttgtgcaataatcgg

SEQ ID NO: 8429529 - DNA, 22 bp, Homo sapiens
gattagaatgggaagatacaag

SEQ ID NO: 8429530 - DNA, 22 bp, Homo sapiens
gattagatgactaatgagctgt

SEQ ID NO: 8429531 - DNA, 22 bp, Homo sapiens
gattagaagaacttgttagcct

SEQ ID NO: 8429532 - DNA, 22 bp, Homo sapiens
gattagaagaacttgttagcct

SEQ ID NO: 8429533 - DNA, 22 bp, Homo sapiens
gattagaaatgttaccatacag

SEQ ID NO: 8429534 - DNA, 22 bp, Homo sapiens
gattagaatatgtcagtcataa

SEQ ID NO: 8429535 - DNA, 22 bp, Homo sapiens
gattagaatggatagatcccca

SEQ ID NO: 8429536 - DNA, 17 bp, Homo sapiens
gattagaaaacacatga

SEQ ID NO: 8429537 - DNA, 22 bp, Homo sapiens
gattctttagcccagaaagtta

SEQ ID NO: 8429538 - DNA, 22 bp, Homo sapiens
gattctttggcctttattgaca

SEQ ID NO: 8429539 - DNA, 22 bp, Homo sapiens
gattgaaaggaaaaccagagtg

SEQ ID NO: 8429540 - DNA, 22 bp, Homo sapiens
gatttacaaagctctctagtgt

SEQ ID NO: 8429541 - DNA, 22 bp, Homo sapiens
gatttaaagtagacctttgttt

SEQ ID NO: 8429542 - DNA, 22 bp, Homo sapiens
gatttacagatctaagggtcac

SEQ ID NO: 8429543 - DNA, 22 bp, Homo sapiens
gattgagtctgaggatgctgca

SEQ ID NO: 8429544 - DNA, 22 bp, Homo sapiens
gattgtcactccctatatggta

SEQ ID NO: 8429545 - DNA, 22 bp, Homo sapiens
gatttacagctatacccaatgg

SEQ ID NO: 8429546 - DNA, 22 bp, Homo sapiens
gatttagattcgctggggctgg

SEQ ID NO: 8429547 - DNA, 21 bp, Homo sapiens
gatttagtggctgttctacct

SEQ ID NO: 8429548 - DNA, 22 bp, Homo sapiens
gatttataaaggttgcactgga

SEQ ID NO: 8429549 - DNA, 22 bp, Homo sapiens
gatgtacactcagaaaagtcat

SEQ ID NO: 8429550 - DNA, 22 bp, Homo sapiens
gatgtccagcgtctggctgcct

SEQ ID NO: 8429551 - DNA, 22 bp, Homo sapiens
gatgtgtctattcaacatgaaa

SEQ ID NO: 8429552 - DNA, 22 bp, Homo sapiens
gatggtctgtattaaacagatg

SEQ ID NO: 8429553 - DNA, 22 bp, Homo sapiens
gatggggttttgccaggctggt

SEQ ID NO: 8429554 - DNA, 22 bp, Homo sapiens
gatggggttttgccaggctggt

SEQ ID NO: 8429555 - DNA, 17 bp, Homo sapiens
gatggggctgacatcag

SEQ ID NO: 8429556 - DNA, 22 bp, Homo sapiens
gatgggggccagggcctgcttt

SEQ ID NO: 8429557 - DNA, 18 bp, Homo sapiens
gatggggtccaggcatag

SEQ ID NO: 8429558 - DNA, 22 bp, Homo sapiens
gatggggatgagaagtgagcag

SEQ ID NO: 8429559 - DNA, 22 bp, Homo sapiens
gatggggatgagaagtgagcag

SEQ ID NO: 8429560 - DNA, 22 bp, Homo sapiens
gatgggcgtggcgcgtttggtg

SEQ ID NO: 8429561 - DNA, 22 bp, Homo sapiens
gatggtgcaggtgaagtgctgg

SEQ ID NO: 8429562 - DNA, 22 bp, Homo sapiens
gatggtctttgtctctgataag

SEQ ID NO: 8429563 - DNA, 22 bp, Homo sapiens
gatgtacaagtaaaatatgtgt

SEQ ID NO: 8429564 - DNA, 22 bp, Homo sapiens
gatgtacaagattgtaggaatg

SEQ ID NO: 8429565 - DNA, 22 bp, Homo sapiens
gatgggcgtggcgcgtttggtg

SEQ ID NO: 8429566 - DNA, 22 bp, Homo sapiens
gatggcttaagagtaaaaggca

SEQ ID NO: 8429567 - DNA, 22 bp, Homo sapiens
gatggcttacagacagttagga

SEQ ID NO: 8429568 - DNA, 22 bp, Homo sapiens
gatggcttgttttctggctgaa

SEQ ID NO: 8429569 - DNA, 22 bp, Homo sapiens
gatggcttccttctcactgtgt

SEQ ID NO: 8429570 - DNA, 18 bp, Homo sapiens
gatgggagcaagagaaga

SEQ ID NO: 8429571 - DNA, 22 bp, Homo sapiens
gatggctttgcctgctgtgagg

SEQ ID NO: 8429572 - DNA, 22 bp, Homo sapiens
gatggaatgaatggcagataca

SEQ ID NO: 8429573 - DNA, 22 bp, Homo sapiens
gatggacacctcctgaggttct

SEQ ID NO: 8429574 - DNA, 22 bp, Homo sapiens
gatggacacctcctgaggttct

SEQ ID NO: 8429575 - DNA, 22 bp, Homo sapiens
gatggaagaaaaatgcatgtct

SEQ ID NO: 8429576 - DNA, 22 bp, Homo sapiens
gatggaggaaaagttggaatgc

SEQ ID NO: 8429577 - DNA, 19 bp, Homo sapiens
gatgctcattcaggtggaa

SEQ ID NO: 8429578 - DNA, 22 bp, Homo sapiens
gatgctcatctgtcctttgatg

SEQ ID NO: 8429579 - DNA, 22 bp, Homo sapiens
gatgctgactgaccaaaaggat

SEQ ID NO: 8429580 - DNA, 22 bp, Homo sapiens
gatgcctgtggtgagcacacat

SEQ ID NO: 8429581 - DNA, 22 bp, Homo sapiens
gatgcttcaagcttccttataa

SEQ ID NO: 8429582 - DNA, 22 bp, Homo sapiens
gatgctgataattcatgagaag

SEQ ID NO: 8429583 - DNA, 22 bp, Homo sapiens
gatgctgattatttcttgctag

SEQ ID NO: 8429584 - DNA, 22 bp, Homo sapiens
gatgctggcctggccatctggg

SEQ ID NO: 8429585 - DNA, 21 bp, Homo sapiens
gcaggggatagaaatggtctg

SEQ ID NO: 8429586 - DNA, 22 bp, Homo sapiens
gcaggggctactctgagcttcc

SEQ ID NO: 8429587 - DNA, 22 bp, Homo sapiens
gcaggggctgagcaccagcggg

SEQ ID NO: 8429588 - DNA, 22 bp, Homo sapiens
gcaggggctgagcaccagcggg

SEQ ID NO: 8429589 - DNA, 22 bp, Homo sapiens
gcaggggctgagcaccagcggg

SEQ ID NO: 8429590 - DNA, 22 bp, Homo sapiens
gcagggtgacgttgcccacctc

SEQ ID NO: 8429591 - DNA, 22 bp, Homo sapiens
gcagggggtcattcacgctggc

SEQ ID NO: 8429592 - DNA, 22 bp, Homo sapiens
gcagggggtcattcacgctggc

SEQ ID NO: 8429593 - DNA, 22 bp, Homo sapiens
gcagggcacagacagtgccaag

SEQ ID NO: 8429594 - DNA, 22 bp, Homo sapiens
gcagggcagacctccagcctat

SEQ ID NO: 8429595 - DNA, 22 bp, Homo sapiens
gcagggcagagggagaatctct

SEQ ID NO: 8429596 - DNA, 19 bp, Homo sapiens
gcaggcttgggtctcccca

SEQ ID NO: 8429597 - DNA, 22 bp, Homo sapiens
gcaggcttgggacgagctggag

SEQ ID NO: 8429598 - DNA, 22 bp, Homo sapiens
gcaggcttgcccggcctccttc

SEQ ID NO: 8429599 - DNA, 22 bp, Homo sapiens
gcaggcttctctcttccctacc

SEQ ID NO: 8429600 - DNA, 22 bp, Homo sapiens
gcaggcttgcccggcctccttc

SEQ ID NO: 8429601 - DNA, 22 bp, Homo sapiens
gcaggctttgacttggggcaac

SEQ ID NO: 8429602 - DNA, 22 bp, Homo sapiens
gcaggctttgacttggggcagc

SEQ ID NO: 8429603 - DNA, 18 bp, Homo sapiens
gcaggcttttcctgggtc

SEQ ID NO: 8429604 - DNA, 21 bp, Homo sapiens
gcaggctggtcaaacctcagt

SEQ ID NO: 8429605 - DNA, 21 bp, Homo sapiens
gcaggctggtcaaacctcagt

SEQ ID NO: 8429606 - DNA, 21 bp, Homo sapiens
gcaggctggtcaaacctcagt

SEQ ID NO: 8429607 - DNA, 22 bp, Homo sapiens
gcaggctggaggctgttctggg

SEQ ID NO: 8429608 - DNA, 22 bp, Homo sapiens
gcaggctggggtagccccactt

SEQ ID NO: 8429609 - DNA, 22 bp, Homo sapiens
gcaggctggggtagccccactt

SEQ ID NO: 8429610 - DNA, 22 bp, Homo sapiens
gcaggctggggtagccccactt

SEQ ID NO: 8429611 - DNA, 22 bp, Homo sapiens
gcaggctggtctgaccatccct

SEQ ID NO: 8429612 - DNA, 22 bp, Homo sapiens
gcaggctggtctgaccatccct

SEQ ID NO: 8429613 - DNA, 22 bp, Homo sapiens
gcaggcttatggggagacagag

SEQ ID NO: 8429614 - DNA, 22 bp, Homo sapiens
gcaggcttatggggagacagag

SEQ ID NO: 8429615 - DNA, 22 bp, Homo sapiens
gcaggctgtggtatgttgggca

SEQ ID NO: 8429616 - DNA, 22 bp, Homo sapiens
gcaggcttgagagatcagatgg

SEQ ID NO: 8429617 - DNA, 22 bp, Homo sapiens
gcaggcttcccccacacctacg

SEQ ID NO: 8429618 - DNA, 22 bp, Homo sapiens
gcaggcttcccccacacctacg

SEQ ID NO: 8429619 - DNA, 22 bp, Homo sapiens
gcaggcttcaagcacagctttt

SEQ ID NO: 8429620 - DNA, 22 bp, Homo sapiens
gcaggctggaggctgttctggg

SEQ ID NO: 8429621 - DNA, 22 bp, Homo sapiens
gcaggctggaggctgttctggg

SEQ ID NO: 8429622 - DNA, 22 bp, Homo sapiens
gcaggctgctgagatccttagg

SEQ ID NO: 8429623 - DNA, 22 bp, Homo sapiens
gcaggctgctgagatccttagg

SEQ ID NO: 8429624 - DNA, 22 bp, Homo sapiens
gcaggcagaggtggaggagaca

SEQ ID NO: 8429625 - DNA, 22 bp, Homo sapiens
gcaggctgccctcttgtgttga

SEQ ID NO: 8429626 - DNA, 22 bp, Homo sapiens
gcaggctgccctcttgtgttga

SEQ ID NO: 8429627 - DNA, 22 bp, Homo sapiens
gcaggctgccaccttctgagtt

SEQ ID NO: 8429628 - DNA, 22 bp, Homo sapiens
gcaggcagagaggggtttccag

SEQ ID NO: 8429629 - DNA, 17 bp, Homo sapiens
gcaggcactgctgcctg

SEQ ID NO: 8429630 - DNA, 17 bp, Homo sapiens
gcaggcactgctgcctg

SEQ ID NO: 8429631 - DNA, 14 bp, Homo sapiens
gcaggcagaccacc

SEQ ID NO: 8429632 - DNA, 22 bp, Homo sapiens
gcaggcagagaaggaacattta

SEQ ID NO: 8429633 - DNA, 22 bp, Homo sapiens
gcaggcaccgggttgctcccct

SEQ ID NO: 8429634 - DNA, 22 bp, Homo sapiens
gcaggcaccgggttgctcccct

SEQ ID NO: 8429635 - DNA, 22 bp, Homo sapiens
gcaggcaccacggctcaggtct

SEQ ID NO: 8429636 - DNA, 22 bp, Homo sapiens
gcaggcaccgcggcggcaggtt

SEQ ID NO: 8429637 - DNA, 22 bp, Homo sapiens
gcaggagttcaattgcccatga

SEQ ID NO: 8429638 - DNA, 22 bp, Homo sapiens
gcaggagctgctctcctgacga

SEQ ID NO: 8429639 - DNA, 22 bp, Homo sapiens
gcaggagctgctctcctgacga

SEQ ID NO: 8429640 - DNA, 22 bp, Homo sapiens
gcaggagctcgtttccaggctg

SEQ ID NO: 8429641 - DNA, 22 bp, Homo sapiens
gcaggagccaggccgagctggt

SEQ ID NO: 8429642 - DNA, 22 bp, Homo sapiens
gcaggagccacttcagggatgc

SEQ ID NO: 8429643 - DNA, 22 bp, Homo sapiens
gcaggagagccagcaggcttcc

SEQ ID NO: 8429644 - DNA, 22 bp, Homo sapiens
gcaggagccaggccgagctggt

SEQ ID NO: 8429645 - DNA, 22 bp, Homo sapiens
gcaggagccctggcatgttctt

SEQ ID NO: 8429646 - DNA, 22 bp, Homo sapiens
gcaggagccagggattccagga

SEQ ID NO: 8429647 - DNA, 22 bp, Homo sapiens
gcagctgagcgtgaggaagagt

SEQ ID NO: 8429648 - DNA, 19 bp, Homo sapiens
gcaggactcccagctcctc

SEQ ID NO: 8429649 - DNA, 22 bp, Homo sapiens
gcaggacttgaatccaggcagt

SEQ ID NO: 8429650 - DNA, 22 bp, Homo sapiens
gcaggagagccagcaggcttcc

SEQ ID NO: 8429651 - DNA, 22 bp, Homo sapiens
gcaggagagccagcaggcttcc

SEQ ID NO: 8429652 - DNA, 22 bp, Homo sapiens
gcaggagaacaaagcaagctgc

SEQ ID NO: 8429653 - DNA, 22 bp, Homo sapiens
gcaggagaacaaagcaagctgc

SEQ ID NO: 8429654 - DNA, 22 bp, Homo sapiens
gcaggagaaatgaagattgggt

SEQ ID NO: 8429655 - DNA, 22 bp, Homo sapiens
gcaggagaaatgaagattgggt

SEQ ID NO: 8429656 - DNA, 22 bp, Homo sapiens
gcaggagaaatgaagattgggt

SEQ ID NO: 8429657 - DNA, 22 bp, Homo sapiens
gcagctattgtctcctgggccc

SEQ ID NO: 8429658 - DNA, 22 bp, Homo sapiens
gcagctattgtctcctgggccc

SEQ ID NO: 8429659 - DNA, 22 bp, Homo sapiens
gcagctcaaaggccacggacgg

SEQ ID NO: 8429660 - DNA, 22 bp, Homo sapiens
gcagctcaagagaggtgctatg

SEQ ID NO: 8429661 - DNA, 22 bp, Homo sapiens
gcagctattgtctcctgggccc

SEQ ID NO: 8429662 - DNA, 22 bp, Homo sapiens
gcagctcacagtctccgccatc

SEQ ID NO: 8429663 - DNA, 22 bp, Homo sapiens
gcagctcacagtctccgccatc

SEQ ID NO: 8429664 - DNA, 22 bp, Homo sapiens
gcagctcagggagagggcacca

SEQ ID NO: 8429665 - DNA, 22 bp, Homo sapiens
gcagctcagtaaaagaggagca

SEQ ID NO: 8429666 - DNA, 22 bp, Homo sapiens
gcagctcagtaaaagaggagca

SEQ ID NO: 8429667 - DNA, 22 bp, Homo sapiens
gcagctcagtaaaagaggagca

SEQ ID NO: 8429668 - DNA, 22 bp, Homo sapiens
gcagctccttcaatctcaccat

SEQ ID NO: 8429669 - DNA, 22 bp, Homo sapiens
gcagctcccttgaacttctcct

SEQ ID NO: 8429670 - DNA, 22 bp, Homo sapiens
gcagctctgacaatgcctggaa

SEQ ID NO: 8429671 - DNA, 22 bp, Homo sapiens
gcagctctctggcctgccctgg

SEQ ID NO: 8429672 - DNA, 22 bp, Homo sapiens
gcagctctggggcaggcctgag

SEQ ID NO: 8429673 - DNA, 22 bp, Homo sapiens
gcagctcttcacttactccttt

SEQ ID NO: 8429674 - DNA, 18 bp, Homo sapiens
gcagctagccaggggggc

SEQ ID NO: 8429675 - DNA, 22 bp, Homo sapiens
gcagctaccacccaggaaggac

SEQ ID NO: 8429676 - DNA, 22 bp, Homo sapiens
gcagcctctgcagttcaggagg

SEQ ID NO: 8429677 - DNA, 22 bp, Homo sapiens
gcagcgctactcacagctctga

SEQ ID NO: 8429678 - DNA, 22 bp, Homo sapiens
gcagcgctactcacagctctga

SEQ ID NO: 8429679 - DNA, 22 bp, Homo sapiens
gcagcctctgcagttcaggagg

SEQ ID NO: 8429680 - DNA, 22 bp, Homo sapiens
gcagagctccccaagacaccaa

SEQ ID NO: 8429681 - DNA, 22 bp, Homo sapiens
gcagagctcatgcctgcacctc

SEQ ID NO: 8429682 - DNA, 22 bp, Homo sapiens
gcagagctcaaggtgttcagct

SEQ ID NO: 8429683 - DNA, 16 bp, Homo sapiens
gcagagctcagggact

SEQ ID NO: 8429684 - DNA, 22 bp, Homo sapiens
gcagagctatcttctggatttg

SEQ ID NO: 8429685 - DNA, 22 bp, Homo sapiens
gcagagctatcttctggatttg

SEQ ID NO: 8429686 - DNA, 22 bp, Homo sapiens
gcagagctatcttctggatttg

SEQ ID NO: 8429687 - DNA, 22 bp, Homo sapiens
gcagagccctgggggtatggtg

SEQ ID NO: 8429688 - DNA, 20 bp, Homo sapiens
gcagagcctcactgcaaggg

SEQ ID NO: 8429689 - DNA, 22 bp, Homo sapiens
gcagagcctgtgtctgagcaaa

SEQ ID NO: 8429690 - DNA, 22 bp, Homo sapiens
gcagagcctgtgtctgagcaaa

SEQ ID NO: 8429691 - DNA, 22 bp, Homo sapiens
gcagtagtccataagtactctg

SEQ ID NO: 8429692 - DNA, 22 bp, Homo sapiens
gcagtgggagcttaggcagtgc

SEQ ID NO: 8429693 - DNA, 22 bp, Homo sapiens
gcagtaggggctggagggctgt

SEQ ID NO: 8429694 - DNA, 22 bp, Homo sapiens
gcagtaggagtttccagggtgg

SEQ ID NO: 8429695 - DNA, 22 bp, Homo sapiens
gcagtaggagtttccagggtgg

SEQ ID NO: 8429696 - DNA, 22 bp, Homo sapiens
gcagtggggaatgctggggaga

SEQ ID NO: 8429697 - DNA, 22 bp, Homo sapiens
gcagtggggcgctgggagttgg

SEQ ID NO: 8429698 - DNA, 22 bp, Homo sapiens
gcagtgggcaacaagagctgga

SEQ ID NO: 8429699 - DNA, 22 bp, Homo sapiens
gcagtgggcaacaagagctgga

SEQ ID NO: 8429700 - DNA, 22 bp, Homo sapiens
gcagtgggcaacaagagctgga

SEQ ID NO: 8429701 - DNA, 22 bp, Homo sapiens
gcagtgggcctgaggaagggtg

SEQ ID NO: 8429702 - DNA, 22 bp, Homo sapiens
gcagtgggcctgaggaagggtg

SEQ ID NO: 8429703 - DNA, 19 bp, Homo sapiens
gcaggtggatgtggtcagc

SEQ ID NO: 8429704 - DNA, 19 bp, Homo sapiens
gcaggtggatgtggtcagc

SEQ ID NO: 8429705 - DNA, 22 bp, Homo sapiens
gcaggtggcagaggtgggatct

SEQ ID NO: 8429706 - DNA, 22 bp, Homo sapiens
gcagggtggatggcagggccag

SEQ ID NO: 8429707 - DNA, 22 bp, Homo sapiens
gcagggtggatggcagggccag

SEQ ID NO: 8429708 - DNA, 19 bp, Homo sapiens
gcagggtggcagagctctt

SEQ ID NO: 8429709 - DNA, 19 bp, Homo sapiens
gcagggtggcagagctctt

SEQ ID NO: 8429710 - DNA, 19 bp, Homo sapiens
gcagggtggcagagctctt

SEQ ID NO: 8429711 - DNA, 22 bp, Homo sapiens
gcagggtgccgacttcagggat

SEQ ID NO: 8429712 - DNA, 22 bp, Homo sapiens
gcagggtgccgacttcagggat

SEQ ID NO: 8429713 - DNA, 22 bp, Homo sapiens
gcagggtgatagtgaggctcag

SEQ ID NO: 8429714 - DNA, 22 bp, Homo sapiens
gcagggtgatagtgaggctcag

SEQ ID NO: 8429715 - DNA, 22 bp, Homo sapiens
gcagggtgatagtgaggctcag

SEQ ID NO: 8429716 - DNA, 22 bp, Homo sapiens
gcagggtgatagtgaggctcag

SEQ ID NO: 8429717 - DNA, 22 bp, Homo sapiens
gcagggtgacgttgcccacctc

SEQ ID NO: 8429718 - DNA, 22 bp, Homo sapiens
gcaggtgggggtcggtgcatct

SEQ ID NO: 8429719 - DNA, 22 bp, Homo sapiens
gcaggtggggctgctaccagaa

SEQ ID NO: 8429720 - DNA, 22 bp, Homo sapiens
gcaggtggggctgctaccagaa

SEQ ID NO: 8429721 - DNA, 22 bp, Homo sapiens
gcaggtgggagccgctgcctga

SEQ ID NO: 8429722 - DNA, 22 bp, Homo sapiens
gcaggtggttaaggtcccatgt

SEQ ID NO: 8429723 - DNA, 22 bp, Homo sapiens
gcaggtggtgggggagccgttc

SEQ ID NO: 8429724 - DNA, 19 bp, Homo sapiens
gccagcagaatgatgaggc

SEQ ID NO: 8429725 - DNA, 19 bp, Homo sapiens
gccagcagaatgatgaggc

SEQ ID NO: 8429726 - DNA, 22 bp, Homo sapiens
gccagcagccacagaagtcact

SEQ ID NO: 8429727 - DNA, 22 bp, Homo sapiens
gccagcaaggaggggaaaaatg

SEQ ID NO: 8429728 - DNA, 22 bp, Homo sapiens
gccagatgtagatagcaaggta

SEQ ID NO: 8429729 - DNA, 22 bp, Homo sapiens
gccagcagctcttgggcgggca

SEQ ID NO: 8429730 - DNA, 22 bp, Homo sapiens
gccagcagctcttgggcgggca

SEQ ID NO: 8429731 - DNA, 22 bp, Homo sapiens
gccagcagctgtggggtggcca

SEQ ID NO: 8429732 - DNA, 22 bp, Homo sapiens
gccagcagctgtggggtggcca

SEQ ID NO: 8429733 - DNA, 22 bp, Homo sapiens
gccagcagggaagccttgggct

SEQ ID NO: 8429734 - DNA, 22 bp, Homo sapiens
gccacaggctccagcatcagta

SEQ ID NO: 8429735 - DNA, 22 bp, Homo sapiens
gccacaggctccagcatcagta

SEQ ID NO: 8429736 - DNA, 22 bp, Homo sapiens
gccagatctgacatagtggaag

SEQ ID NO: 8429737 - DNA, 22 bp, Homo sapiens
gccagatgccgtaaagatgggc

SEQ ID NO: 8429738 - DNA, 22 bp, Homo sapiens
gccagcaaagcaagttgtcagc

SEQ ID NO: 8429739 - DNA, 22 bp, Homo sapiens
gccagatttacagatttgccct

SEQ ID NO: 8429740 - DNA, 22 bp, Homo sapiens
gccacagcggggccgctagagc

SEQ ID NO: 8429741 - DNA, 22 bp, Homo sapiens
gccacagcggggccgctagagc

SEQ ID NO: 8429742 - DNA, 22 bp, Homo sapiens
gccacagctcacgttccccatt

SEQ ID NO: 8429743 - DNA, 22 bp, Homo sapiens
gccacaggaaagcaccctggag

SEQ ID NO: 8429744 - DNA, 22 bp, Homo sapiens
gccacaggaaagcaccctggag

SEQ ID NO: 8429745 - DNA, 22 bp, Homo sapiens
gccacaggaaagcaccctggag

SEQ ID NO: 8429746 - DNA, 21 bp, Homo sapiens
gcattaaaagcagttgttggt

SEQ ID NO: 8429747 - DNA, 22 bp, Homo sapiens
gccacagcctctgggaaaactc

SEQ ID NO: 8429748 - DNA, 22 bp, Homo sapiens
gccacagcagggccctctcagg

SEQ ID NO: 8429749 - DNA, 22 bp, Homo sapiens
gccacagcccgagcaccatgag

SEQ ID NO: 8429750 - DNA, 22 bp, Homo sapiens
gccacacttattctcatgcaca

SEQ ID NO: 8429751 - DNA, 22 bp, Homo sapiens
gccacagacagagagtctagtg

SEQ ID NO: 8429752 - DNA, 22 bp, Homo sapiens
gccacagacagagagtctagtg

SEQ ID NO: 8429753 - DNA, 22 bp, Homo sapiens
gcatgtctgtaattacagagcc

SEQ ID NO: 8429754 - DNA, 22 bp, Homo sapiens
gcatggcttctgccaggcacct

SEQ ID NO: 8429755 - DNA, 22 bp, Homo sapiens
gcatggcttctgccaggcacct

SEQ ID NO: 8429756 - DNA, 22 bp, Homo sapiens
gcatgtgtggaggagatgtgct

SEQ ID NO: 8429757 - DNA, 22 bp, Homo sapiens
gaattataaactagtgacttca

SEQ ID NO: 8429758 - DNA, 22 bp, Homo sapiens
gaattagacatgctttgctttt

SEQ ID NO: 8429759 - DNA, 22 bp, Homo sapiens
gaattataggcaaagcagtcat

SEQ ID NO: 8429760 - DNA, 22 bp, Homo sapiens
gaattacatgaccctgagtaga

SEQ ID NO: 8429761 - DNA, 22 bp, Homo sapiens
gaattacattgttagccttcct

SEQ ID NO: 8429762 - DNA, 22 bp, Homo sapiens
gaattacatgaccctgagtaga

SEQ ID NO: 8429763 - DNA, 22 bp, Homo sapiens
gaattacatgaccctgagtaga

SEQ ID NO: 8429764 - DNA, 22 bp, Homo sapiens
gaattacatgaccctgagtaga

SEQ ID NO: 8429765 - DNA, 22 bp, Homo sapiens
gaattacatttgtgttactgca

SEQ ID NO: 8429766 - DNA, 22 bp, Homo sapiens
gaattacatttgtgttactgca

SEQ ID NO: 8429767 - DNA, 22 bp, Homo sapiens
gaattagacatgctttgctttt

SEQ ID NO: 8429768 - DNA, 22 bp, Homo sapiens
gaattccttaggctcttgactg

SEQ ID NO: 8429769 - DNA, 22 bp, Homo sapiens
gaattccactttggcttttggg

SEQ ID NO: 8429770 - DNA, 22 bp, Homo sapiens
gaattcattagggaagctatct

SEQ ID NO: 8429771 - DNA, 22 bp, Homo sapiens
gaattcctctgagctaggagat

SEQ ID NO: 8429772 - DNA, 22 bp, Homo sapiens
gaattataggtttgcatgctaa

SEQ ID NO: 8429773 - DNA, 22 bp, Homo sapiens
gaattcagttatctaattcaag

SEQ ID NO: 8429774 - DNA, 22 bp, Homo sapiens
gaattcatcgtcttagctgcca

SEQ ID NO: 8429775 - DNA, 22 bp, Homo sapiens
gaagttcaatgtcagcatctat

SEQ ID NO: 8429776 - DNA, 22 bp, Homo sapiens
gaagttcaactgccatgcttgg

SEQ ID NO: 8429777 - DNA, 22 bp, Homo sapiens
gaagttccagtgatataaaact

SEQ ID NO: 8429778 - DNA, 22 bp, Homo sapiens
gaagttcctcgtaggagtctct

SEQ ID NO: 8429779 - DNA, 22 bp, Homo sapiens
gaattacatagtttctaggttc

SEQ ID NO: 8429780 - DNA, 22 bp, Homo sapiens
gaatttaagaggatgaatctgt

SEQ ID NO: 8429781 - DNA, 22 bp, Homo sapiens
gaattgtactgcaatcagggga

SEQ ID NO: 8429782 - DNA, 22 bp, Homo sapiens
gaattgtacgctttacataggt

SEQ ID NO: 8429783 - DNA, 22 bp, Homo sapiens
gaattgtatgcagttacttgga

SEQ ID NO: 8429784 - DNA, 22 bp, Homo sapiens
gaattgtattgatttttcagag

SEQ ID NO: 8429785 - DNA, 22 bp, Homo sapiens
gaattcttttctttctgaaagt

SEQ ID NO: 8429786 - DNA, 22 bp, Homo sapiens
gaattctagggtaaatatccta

SEQ ID NO: 8429787 - DNA, 22 bp, Homo sapiens
gaattctagtcacacacattca

SEQ ID NO: 8429788 - DNA, 22 bp, Homo sapiens
gaattctagtcacacacattca

SEQ ID NO: 8429789 - DNA, 22 bp, Homo sapiens
gaattctgggagagatctgaca

SEQ ID NO: 8429790 - DNA, 22 bp, Homo sapiens
gaattctggttttgaaatgaat

SEQ ID NO: 8429791 - DNA, 23 bp, Homo sapiens
gaattcttaaggtcactaaagtc

SEQ ID NO: 8429792 - DNA, 22 bp, Homo sapiens
gaattctgtcgcttactagatg

SEQ ID NO: 8429793 - DNA, 22 bp, Homo sapiens
gacagctgtgcaggagaagggg

SEQ ID NO: 8429794 - DNA, 18 bp, Homo sapiens
gacagctgtcctgagccc

SEQ ID NO: 8429795 - DNA, 22 bp, Homo sapiens
gacacaggtagaataaagtact

SEQ ID NO: 8429796 - DNA, 22 bp, Homo sapiens
gacacaggtagaataaagtact

SEQ ID NO: 8429797 - DNA, 22 bp, Homo sapiens
gacagctgtggagaggcatgtg

SEQ ID NO: 8429798 - DNA, 22 bp, Homo sapiens
gacagctgtggagaggcatgtg

SEQ ID NO: 8429799 - DNA, 22 bp, Homo sapiens
gacagctgtggagaggcatgtg

SEQ ID NO: 8429800 - DNA, 22 bp, Homo sapiens
gacacagggacgtgctctgcct

SEQ ID NO: 8429801 - DNA, 22 bp, Homo sapiens
gacacagggacgtgctctgcct

SEQ ID NO: 8429802 - DNA, 22 bp, Homo sapiens
gacacagggggatgtgtggacg

SEQ ID NO: 8429803 - DNA, 22 bp, Homo sapiens
gacacagggggatgtgtggacg

SEQ ID NO: 8429804 - DNA, 22 bp, Homo sapiens
gacacaggggggcgctagaaga

SEQ ID NO: 8429805 - DNA, 22 bp, Homo sapiens
gacacaggggggcgctagaaga

SEQ ID NO: 8429806 - DNA, 22 bp, Homo sapiens
gacacaggggggcgctagaaga

SEQ ID NO: 8429807 - DNA, 21 bp, Homo sapiens
gacaggactagaccagagctc

SEQ ID NO: 8429808 - DNA, 22 bp, Homo sapiens
gacaggaagtctgaaggaggga

SEQ ID NO: 8429809 - DNA, 20 bp, Homo sapiens
gacaggagagttaggtaggt

SEQ ID NO: 8429810 - DNA, 22 bp, Homo sapiens
gacaggaagtctgaaggaggga

SEQ ID NO: 8429811 - DNA, 22 bp, Homo sapiens
gacacaggaaaagctccagccc

SEQ ID NO: 8429812 - DNA, 22 bp, Homo sapiens
gacacaggaaaagctccagccc

SEQ ID NO: 8429813 - DNA, 22 bp, Homo sapiens
gacacagctttctgaagagcat

SEQ ID NO: 8429814 - DNA, 22 bp, Homo sapiens
gacacagcttgatgagggcttt

SEQ ID NO: 8429815 - DNA, 22 bp, Homo sapiens
gacacaggaatcaccttggatg

SEQ ID NO: 8429816 - DNA, 22 bp, Homo sapiens
gacacaggaatcaccttggatg

SEQ ID NO: 8429817 - DNA, 22 bp, Homo sapiens
gacacaggaaaagctccagccc

SEQ ID NO: 8429818 - DNA, 18 bp, Homo sapiens
gacacaggagagagtccc

SEQ ID NO: 8429819 - DNA, 18 bp, Homo sapiens
gacacaggagagagtccc

SEQ ID NO: 8429820 - DNA, 18 bp, Homo sapiens
gacacaggagagagtccc

SEQ ID NO: 8429821 - DNA, 22 bp, Homo sapiens
gacacaggattcctggctctgc

SEQ ID NO: 8429822 - DNA, 20 bp, Homo sapiens
gacacaggcagtcctcagag

SEQ ID NO: 8429823 - DNA, 20 bp, Homo sapiens
gacacaggcagtcctcagag

SEQ ID NO: 8429824 - DNA, 20 bp, Homo sapiens
gacacaggcagtcctcagag

SEQ ID NO: 8429825 - DNA, 23 bp, Homo sapiens
gacacaggagcacccagctgagc

SEQ ID NO: 8429826 - DNA, 23 bp, Homo sapiens
gacacaggagcacccagctgagc

SEQ ID NO: 8429827 - DNA, 23 bp, Homo sapiens
gacacaggagcacccagctgagc

SEQ ID NO: 8429828 - DNA, 22 bp, Homo sapiens
gacacaggattcctggctctgc

SEQ ID NO: 8429829 - DNA, 22 bp, Homo sapiens
gacacagcttgatgagggcttt

SEQ ID NO: 8429830 - DNA, 22 bp, Homo sapiens
gacacagctaatggcttaggac

SEQ ID NO: 8429831 - DNA, 22 bp, Homo sapiens
gacacagatgatcaggtgtgga

SEQ ID NO: 8429832 - DNA, 22 bp, Homo sapiens
gacacagatatctctgagatta

SEQ ID NO: 8429833 - DNA, 22 bp, Homo sapiens
gacacagagctcacagtctcct

SEQ ID NO: 8429834 - DNA, 22 bp, Homo sapiens
gacacagagctcacagtctcct

SEQ ID NO: 8429835 - DNA, 22 bp, Homo sapiens
gaactgttccctcacaggctgg

SEQ ID NO: 8429836 - DNA, 22 bp, Homo sapiens
gaaggaagtcattagtgcagac

SEQ ID NO: 8429837 - DNA, 21 bp, Homo sapiens
gaaggagaaagcaagtgctgc

SEQ ID NO: 8429838 - DNA, 22 bp, Homo sapiens
gaaggacccacgaagtcactgg

SEQ ID NO: 8429839 - DNA, 22 bp, Homo sapiens
gaaggcctagggatgctctgcg

SEQ ID NO: 8429840 - DNA, 22 bp, Homo sapiens
gaaggagagggtcaaggataat

SEQ ID NO: 8429841 - DNA, 22 bp, Homo sapiens
gaaggagagggtcaaggataat

SEQ ID NO: 8429842 - DNA, 22 bp, Homo sapiens
gaaggagaggattgtgaggctg

SEQ ID NO: 8429843 - DNA, 22 bp, Homo sapiens
gaaggagaggattgtgaggctg

SEQ ID NO: 8429844 - DNA, 22 bp, Homo sapiens
gaaggagaggattgtgaggctg

SEQ ID NO: 8429845 - DNA, 22 bp, Homo sapiens
gaaggagaccctgaagatgctg

SEQ ID NO: 8429846 - DNA, 22 bp, Homo sapiens
gaagttactctcgttaaatatg

SEQ ID NO: 8429847 - DNA, 23 bp, Homo sapiens
gaagtgtctgagctgtatttttc

SEQ ID NO: 8429848 - DNA, 22 bp, Homo sapiens
gaagtgtctccgtttttaaagg

SEQ ID NO: 8429849 - DNA, 22 bp, Homo sapiens
gaagtggggaagcaacaggaga

SEQ ID NO: 8429850 - DNA, 22 bp, Homo sapiens
gaagtgacaagatgctaggatc

SEQ ID NO: 8429851 - DNA, 22 bp, Homo sapiens
gaagtgacagaagggatgggca

SEQ ID NO: 8429852 - DNA, 22 bp, Homo sapiens
gaagggaactgggtctccttgt

SEQ ID NO: 8429853 - DNA, 22 bp, Homo sapiens
gaagtacaaaggacatggaaac

SEQ ID NO: 8429854 - DNA, 22 bp, Homo sapiens
gaaggttttcaggagcctagtc

SEQ ID NO: 8429855 - DNA, 22 bp, Homo sapiens
gaaggctgccagtggccctctt

SEQ ID NO: 8429856 - DNA, 19 bp, Homo sapiens
gaaggctgaaatgaagcac

SEQ ID NO: 8429857 - DNA, 22 bp, Homo sapiens
gaaggctatatgactcagccct

SEQ ID NO: 8429858 - DNA, 22 bp, Homo sapiens
gaaggctaaaggggcagaggtt

SEQ ID NO: 8429859 - DNA, 22 bp, Homo sapiens
gaaggctaaaggggcagaggtt

SEQ ID NO: 8429860 - DNA, 22 bp, Homo sapiens
gaaggctacttctcctcagggc

SEQ ID NO: 8429861 - DNA, 22 bp, Homo sapiens
gaaggctagaaacgatgcttat

SEQ ID NO: 8429862 - DNA, 22 bp, Homo sapiens
gaaggcttcccacctgatattt

SEQ ID NO: 8429863 - DNA, 22 bp, Homo sapiens
gaaggcttcctgatgccaacca

SEQ ID NO: 8429864 - DNA, 22 bp, Homo sapiens
gaaggcttcaaaaggtgtaatt

SEQ ID NO: 8429865 - DNA, 21 bp, Homo sapiens
gaaggcttctgcctggaggag

SEQ ID NO: 8429866 - DNA, 22 bp, Homo sapiens
gaaggcttgattgaggaatgcc

SEQ ID NO: 8429867 - DNA, 22 bp, Homo sapiens
gaaggcttctccagggcttact

SEQ ID NO: 8429868 - DNA, 21 bp, Homo sapiens
gaaggcttctgcctggaggag

SEQ ID NO: 8429869 - DNA, 22 bp, Homo sapiens
gaaggcttcctggaggaggtgg

SEQ ID NO: 8429870 - DNA, 22 bp, Homo sapiens
gaaggcttcctggaggaggtgg

SEQ ID NO: 8429871 - DNA, 22 bp, Homo sapiens
gaaggcttttctaccagatctt

SEQ ID NO: 8429872 - DNA, 22 bp, Homo sapiens
gaaggctttagagagatataaa

SEQ ID NO: 8429873 - DNA, 22 bp, Homo sapiens
gaaggcttggttttttcaacac

SEQ ID NO: 8429874 - DNA, 19 bp, Homo sapiens
gaaggcttttggtatgttt

SEQ ID NO: 8429875 - DNA, 22 bp, Homo sapiens
gaaggctttttgggtaattgta

SEQ ID NO: 8429876 - DNA, 22 bp, Homo sapiens
gaaggcttgcagctctgtggca

SEQ ID NO: 8429877 - DNA, 22 bp, Homo sapiens
gaaggcttgccgggaagcggca

SEQ ID NO: 8429878 - DNA, 20 bp, Homo sapiens
gaaggcttggacagtgacag

SEQ ID NO: 8429879 - DNA, 22 bp, Homo sapiens
gaaggcttgcaagtggttcata

SEQ ID NO: 8429880 - DNA, 22 bp, Homo sapiens
gactggtaaggtattggaattc

SEQ ID NO: 8429881 - DNA, 22 bp, Homo sapiens
gactggtaaggaaattcactaa

SEQ ID NO: 8429882 - DNA, 22 bp, Homo sapiens
gacccagggtggtcacctgaaa

SEQ ID NO: 8429883 - DNA, 22 bp, Homo sapiens
gactgtggcaggctcagcactg

SEQ ID NO: 8429884 - DNA, 22 bp, Homo sapiens
gactgtcttttgaataaaaatg

SEQ ID NO: 8429885 - DNA, 22 bp, Homo sapiens
gactgtcttgtttctaagatga

SEQ ID NO: 8429886 - DNA, 22 bp, Homo sapiens
gactgtctcctgtcatgaggga

SEQ ID NO: 8429887 - DNA, 22 bp, Homo sapiens
gactgtctctgtgaatggtagg

SEQ ID NO: 8429888 - DNA, 22 bp, Homo sapiens
gactgtacttgagagaggaact

SEQ ID NO: 8429889 - DNA, 22 bp, Homo sapiens
gacttctgttaacttgtaagag

SEQ ID NO: 8429890 - DNA, 22 bp, Homo sapiens
gacttctgttaacttgtaagag

SEQ ID NO: 8429891 - DNA, 22 bp, Homo sapiens
gacttctgcctcaggggaaggt

SEQ ID NO: 8429892 - DNA, 22 bp, Homo sapiens
gacttgcctgcactgagcctat

SEQ ID NO: 8429893 - DNA, 22 bp, Homo sapiens
gacttcttcatgtcttttccac

SEQ ID NO: 8429894 - DNA, 22 bp, Homo sapiens
gactgtggtctgttctccaggt

SEQ ID NO: 8429895 - DNA, 22 bp, Homo sapiens
gactgtgtccatgtgctggatt

SEQ ID NO: 8429896 - DNA, 22 bp, Homo sapiens
gacttagaccctgtctttattc

SEQ ID NO: 8429897 - DNA, 22 bp, Homo sapiens
gacttcctaagattcaggaatg

SEQ ID NO: 8429898 - DNA, 22 bp, Homo sapiens
gacttctgaattcctatcaggt

SEQ ID NO: 8429899 - DNA, 22 bp, Homo sapiens
gacttctgaattcctatcaggt

SEQ ID NO: 8429900 - DNA, 22 bp, Homo sapiens
gaccatttctaggaatcagact

SEQ ID NO: 8429901 - DNA, 22 bp, Homo sapiens
gaccatttttacagagcattca

SEQ ID NO: 8429902 - DNA, 18 bp, Homo sapiens
gacccagcagatgggctt

SEQ ID NO: 8429903 - DNA, 22 bp, Homo sapiens
gaccatttgctagtaaattgca

SEQ ID NO: 8429904 - DNA, 22 bp, Homo sapiens
gaccatttgttgaaaagattat

SEQ ID NO: 8429905 - DNA, 22 bp, Homo sapiens
gaccattagctgctattcagta

SEQ ID NO: 8429906 - DNA, 22 bp, Homo sapiens
gaccatttcaggggcagggact

SEQ ID NO: 8429907 - DNA, 22 bp, Homo sapiens
gaccatttccaccatgggcaca

SEQ ID NO: 8429908 - DNA, 22 bp, Homo sapiens
gaccatttctaggaatcagact

SEQ ID NO: 8429909 - DNA, 22 bp, Homo sapiens
gacccagctaaccaggtgggga

SEQ ID NO: 8429910 - DNA, 18 bp, Homo sapiens
gacccagcagatgggctt

SEQ ID NO: 8429911 - DNA, 22 bp, Homo sapiens
gacccaggaagctacttctggt

SEQ ID NO: 8429912 - DNA, 22 bp, Homo sapiens
gacccaggcccaaggctgccag

SEQ ID NO: 8429913 - DNA, 22 bp, Homo sapiens
gacccaggagagagggttgcat

SEQ ID NO: 8429914 - DNA, 22 bp, Homo sapiens
gacccagggtatccagagctgc

SEQ ID NO: 8429915 - DNA, 22 bp, Homo sapiens
gacccaggctcgtgggacggct

SEQ ID NO: 8429916 - DNA, 22 bp, Homo sapiens
gaccatcctggccaacgtggta

SEQ ID NO: 8429917 - DNA, 22 bp, Homo sapiens
gaccatcctggccaacgtggta

SEQ ID NO: 8429918 - DNA, 22 bp, Homo sapiens
gacaggccagacaggagactga

SEQ ID NO: 8429919 - DNA, 22 bp, Homo sapiens
gaccaggctgttccagtctaac

SEQ ID NO: 8429920 - DNA, 22 bp, Homo sapiens
gacaggaggcagagctcaggtg

SEQ ID NO: 8429921 - DNA, 22 bp, Homo sapiens
gacaggaggcagagctcaggtg

SEQ ID NO: 8429922 - DNA, 22 bp, Homo sapiens
gacaggatattatgatagattc

SEQ ID NO: 8429923 - DNA, 21 bp, Homo sapiens
gacaggcaaggagtcacttag

SEQ ID NO: 8429924 - DNA, 22 bp, Homo sapiens
gactttatttccttatttgtga

SEQ ID NO: 8429925 - DNA, 22 bp, Homo sapiens
gactttggttcagggctcagag

SEQ ID NO: 8429926 - DNA, 22 bp, Homo sapiens
gactttggtttgagcaagtcag

SEQ ID NO: 8429927 - DNA, 22 bp, Homo sapiens
gagaaaatcttgggtcaagaat

SEQ ID NO: 8429928 - DNA, 22 bp, Homo sapiens
gagaaaatcttgggtcaagaat

SEQ ID NO: 8429929 - DNA, 22 bp, Homo sapiens
gagacacaagaagacatgcaca

SEQ ID NO: 8429930 - DNA, 22 bp, Homo sapiens
gagaaacaacacttgatgcctt

SEQ ID NO: 8429931 - DNA, 22 bp, Homo sapiens
gactttggtttgagcaagtcag

SEQ ID NO: 8429932 - DNA, 22 bp, Homo sapiens
gagacacacattctggagagaa

SEQ ID NO: 8429933 - DNA, 22 bp, Homo sapiens
gagacacacacaggaggtggca

SEQ ID NO: 8429934 - DNA, 22 bp, Homo sapiens
gagacacacattctggagagaa

SEQ ID NO: 8429935 - DNA, 22 bp, Homo sapiens
gagacacacccaaggttatgag

SEQ ID NO: 8429936 - DNA, 22 bp, Homo sapiens
gagacacaatttccccatccta

SEQ ID NO: 8429937 - DNA, 18 bp, Homo sapiens
gagacacaagggcctgga

SEQ ID NO: 8429938 - DNA, 18 bp, Homo sapiens
gagacacaagggcctgga

SEQ ID NO: 8429939 - DNA, 22 bp, Homo sapiens
gagacacaagacgcaactctgt

SEQ ID NO: 8429940 - DNA, 18 bp, Homo sapiens
gagacacaagggcctgga

SEQ ID NO: 8429941 - DNA, 22 bp, Homo sapiens
gagacacaagaagacatgcaca

SEQ ID NO: 8429942 - DNA, 22 bp, Homo sapiens
gagacacaagaagacatgcaca

SEQ ID NO: 8429943 - DNA, 22 bp, Homo sapiens
gagacacaggcacagaagaggc

SEQ ID NO: 8429944 - DNA, 22 bp, Homo sapiens
gagacacagagaggctgtgtga

SEQ ID NO: 8429945 - DNA, 22 bp, Homo sapiens
gagacacagttatcaggcatac

SEQ ID NO: 8429946 - DNA, 22 bp, Homo sapiens
gagacacaggcacagaagaggc

SEQ ID NO: 8429947 - DNA, 22 bp, Homo sapiens
gagacactcaacaaagatatga

SEQ ID NO: 8429948 - DNA, 22 bp, Homo sapiens
gagacagagaggtactcaacat

SEQ ID NO: 8429949 - DNA, 22 bp, Homo sapiens
gagagtctaggaacctcatata

SEQ ID NO: 8429950 - DNA, 17 bp, Homo sapiens
gagagtctaatgggaga

SEQ ID NO: 8429951 - DNA, 22 bp, Homo sapiens
gagagtccttagtttgcaggta

SEQ ID NO: 8429952 - DNA, 22 bp, Homo sapiens
gagagctgggttcaagtagctg

SEQ ID NO: 8429953 - DNA, 22 bp, Homo sapiens
gagagctggattctggataggt

SEQ ID NO: 8429954 - DNA, 22 bp, Homo sapiens
gagagctggccagcttcagtat

SEQ ID NO: 8429955 - DNA, 22 bp, Homo sapiens
gagagcctttgaagggaagtga

SEQ ID NO: 8429956 - DNA, 22 bp, Homo sapiens
gagagcctttgaagggaagtga

SEQ ID NO: 8429957 - DNA, 22 bp, Homo sapiens
gagagcctgccagtgagtgtat

SEQ ID NO: 8429958 - DNA, 22 bp, Homo sapiens
gagagcctttgaagggaagtga

SEQ ID NO: 8429959 - DNA, 22 bp, Homo sapiens
gagagccctgctcctatcccag

SEQ ID NO: 8429960 - DNA, 22 bp, Homo sapiens
gagagctccttcaggaagcttc

SEQ ID NO: 8429961 - DNA, 22 bp, Homo sapiens
gagagctccttcaggaagcttc

SEQ ID NO: 8429962 - DNA, 22 bp, Homo sapiens
gagacagagtttcactcttgtt

SEQ ID NO: 8429963 - DNA, 22 bp, Homo sapiens
gagacagagatcttgctgagtc

SEQ ID NO: 8429964 - DNA, 22 bp, Homo sapiens
gagacagagatcttgctgagtc

SEQ ID NO: 8429965 - DNA, 22 bp, Homo sapiens
gagagctgcaaggtagggcggg

SEQ ID NO: 8429966 - DNA, 22 bp, Homo sapiens
gagagctgcagccgagaggggg

SEQ ID NO: 8429967 - DNA, 22 bp, Homo sapiens
gagagctgcagccgagaggggg

SEQ ID NO: 8429968 - DNA, 17 bp, Homo sapiens
gagagctgctgcttccg

SEQ ID NO: 8429969 - DNA, 22 bp, Homo sapiens
gaactggtgagagttcacggga

SEQ ID NO: 8429970 - DNA, 22 bp, Homo sapiens
gaactggttacagagggatgtt

SEQ ID NO: 8429971 - DNA, 22 bp, Homo sapiens
gaactggtcttttaggttttct

SEQ ID NO: 8429972 - DNA, 22 bp, Homo sapiens
gaactggtgaagtgaagggcag

SEQ ID NO: 8429973 - DNA, 22 bp, Homo sapiens
gaactggtcagtttagcccact

SEQ ID NO: 8429974 - DNA, 22 bp, Homo sapiens
gaactgggtccttgagtctaga

SEQ ID NO: 8429975 - DNA, 22 bp, Homo sapiens
gaactgggaatgctgtcccatc

SEQ ID NO: 8429976 - DNA, 22 bp, Homo sapiens
gaactgggaatgctgtcccatc

SEQ ID NO: 8429977 - DNA, 22 bp, Homo sapiens
gaactgaagacttttactgtac

SEQ ID NO: 8429978 - DNA, 22 bp, Homo sapiens
gaactgaaacttggtttaaagc

SEQ ID NO: 8429979 - DNA, 22 bp, Homo sapiens
gaactatatgtcttaaagcttt

SEQ ID NO: 8429980 - DNA, 22 bp, Homo sapiens
gaactattcattctcattagcg

SEQ ID NO: 8429981 - DNA, 22 bp, Homo sapiens
gaactatatcttcaagaaaatg

SEQ ID NO: 8429982 - DNA, 22 bp, Homo sapiens
gaactcagagcctgagctagga

SEQ ID NO: 8429983 - DNA, 22 bp, Homo sapiens
gaactcttggtggtcattagat

SEQ ID NO: 8429984 - DNA, 22 bp, Homo sapiens
gaactcttgcagtgaaagctta

SEQ ID NO: 8429985 - DNA, 22 bp, Homo sapiens
gaactacagtaagaattgatgt

SEQ ID NO: 8429986 - DNA, 22 bp, Homo sapiens
gaactacaggtgcagcaagtga

SEQ ID NO: 8429987 - DNA, 22 bp, Homo sapiens
gaacctttttccaagtaaacaa

SEQ ID NO: 8429988 - DNA, 22 bp, Homo sapiens
gaacctgcttccttttatatta

SEQ ID NO: 8429989 - DNA, 22 bp, Homo sapiens
gaacctgtaagtatagatgtgg

SEQ ID NO: 8429990 - DNA, 22 bp, Homo sapiens
gaaccttatggtaaatctagag

SEQ ID NO: 8429991 - DNA, 22 bp, Homo sapiens
gaacctgtttatgttacctgcg

SEQ ID NO: 8429992 - DNA, 22 bp, Homo sapiens
gaacctgagcccaggtggcatt

SEQ ID NO: 8429993 - DNA, 22 bp, Homo sapiens
gaacctgagcgggcagcaagcg

SEQ ID NO: 8429994 - DNA, 21 bp, Homo sapiens
gaacctgagtgaagacttggg

SEQ ID NO: 8429995 - DNA, 22 bp, Homo sapiens
gaacctgatccaatatttactc

SEQ ID NO: 8429996 - DNA, 22 bp, Homo sapiens
gaacctctttagtgcatccttc

SEQ ID NO: 8429997 - DNA, 22 bp, Homo sapiens
gaacagaattaccgaagatctg

SEQ ID NO: 8429998 - DNA, 22 bp, Homo sapiens
gaacagagctgactacaaggca

SEQ ID NO: 8429999 - DNA, 22 bp, Homo sapiens
gaacagagttgaaacaaggctg

SEQ ID NO: 8430000 - DNA, 22 bp, Homo sapiens
gaacagagaagctttactaaag

SEQ ID NO: 8430001 - DNA, 22 bp, Homo sapiens
gaaatacaaagccagccatttt

SEQ ID NO: 8430002 - DNA, 22 bp, Homo sapiens
gaaataatttagaaggtattcc

SEQ ID NO: 8430003 - DNA, 22 bp, Homo sapiens
gaaataattctgtgtctgaaca

SEQ ID NO: 8430004 - DNA, 22 bp, Homo sapiens
gaaataatttagaaggtattcc

SEQ ID NO: 8430005 - DNA, 22 bp, Homo sapiens
gaaataacagctctggaagagt

SEQ ID NO: 8430006 - DNA, 22 bp, Homo sapiens
gaaataacctcatgcaccatga

SEQ ID NO: 8430007 - DNA, 22 bp, Homo sapiens
gaaataatacagtgctcttctc

SEQ ID NO: 8430008 - DNA, 22 bp, Homo sapiens
gaaataatacagtgctcttctc

SEQ ID NO: 8430009 - DNA, 22 bp, Homo sapiens
gaaagtttgcctctctcttgag

SEQ ID NO: 8430010 - DNA, 22 bp, Homo sapiens
gaaagtttcttcattaagatgt

SEQ ID NO: 8430011 - DNA, 17 bp, Homo sapiens
gaaagtttctctctctt

SEQ ID NO: 8430012 - DNA, 22 bp, Homo sapiens
gaaagttttcatatataccaaa

SEQ ID NO: 8430013 - DNA, 22 bp, Homo sapiens
gaaagttttcatatataccaaa

SEQ ID NO: 8430014 - DNA, 22 bp, Homo sapiens
gaaagttttctcacacagtaat

SEQ ID NO: 8430015 - DNA, 22 bp, Homo sapiens
gaaagttttctcacacagtaat

SEQ ID NO: 8430016 - DNA, 22 bp, Homo sapiens
gaacacagtcaagggctgctgt

SEQ ID NO: 8430017 - DNA, 22 bp, Homo sapiens
gaacactgagaaagtcagcttt

SEQ ID NO: 8430018 - DNA, 22 bp, Homo sapiens
gaacacctgggtcccctggggc

SEQ ID NO: 8430019 - DNA, 22 bp, Homo sapiens
gaaattgtgcatttagcaacac

SEQ ID NO: 8430020 - DNA, 22 bp, Homo sapiens
gaaatacaattttgtcccagct

SEQ ID NO: 8430021 - DNA, 22 bp, Homo sapiens
gaacacaactcagaatgctggt

SEQ ID NO: 8430022 - DNA, 21 bp, Homo sapiens
gaaaagcaagggagtagaaca

SEQ ID NO: 8430023 - DNA, 21 bp, Homo sapiens
gaaaagcaagggagtagaaca

SEQ ID NO: 8430024 - DNA, 22 bp, Homo sapiens
gaaaagctaggccagttcagct

SEQ ID NO: 8430025 - DNA, 22 bp, Homo sapiens
gaaaaggaaatttatagagatc

SEQ ID NO: 8430026 - DNA, 22 bp, Homo sapiens
gaaaaggaaatttatagagatc

SEQ ID NO: 8430027 - DNA, 22 bp, Homo sapiens
gaaaagctaggccagttcagct

SEQ ID NO: 8430028 - DNA, 22 bp, Homo sapiens
gaaaaggaaatttatagagatc

SEQ ID NO: 8430029 - DNA, 22 bp, Homo sapiens
gaaaagcttactgccacttggc

SEQ ID NO: 8430030 - DNA, 22 bp, Homo sapiens
gaaaacatccagagatagacct

SEQ ID NO: 8430031 - DNA, 22 bp, Homo sapiens
gaaaacatccagagatagacct

SEQ ID NO: 8430032 - DNA, 22 bp, Homo sapiens
gaaaacatccagagatagacct

SEQ ID NO: 8430033 - DNA, 21 bp, Homo sapiens
gaaaagcaagggagtagaaca

SEQ ID NO: 8430034 - DNA, 22 bp, Homo sapiens
gaaaagggcaagagagagggca

SEQ ID NO: 8430035 - DNA, 22 bp, Homo sapiens
gaaaaggctctcactccctccg

SEQ ID NO: 8430036 - DNA, 22 bp, Homo sapiens
gaaaaggctgcccacttattga

SEQ ID NO: 8430037 - DNA, 22 bp, Homo sapiens
gaaaagtatgtttattttgact

SEQ ID NO: 8430038 - DNA, 22 bp, Homo sapiens
gaaaagtacacagcccaaacat

SEQ ID NO: 8430039 - DNA, 22 bp, Homo sapiens
gaaaagtacacagcccaaacat

SEQ ID NO: 8430040 - DNA, 22 bp, Homo sapiens
gaaaaggattggtaaaatatct

SEQ ID NO: 8430041 - DNA, 22 bp, Homo sapiens
gaaaaggcagagttccggggaa

SEQ ID NO: 8430042 - DNA, 22 bp, Homo sapiens
gaaaaggcctggggcaaagtgt

SEQ ID NO: 8430043 - DNA, 22 bp, Homo sapiens
gaaaaggcctccccataggaat

SEQ ID NO: 8430044 - DNA, 22 bp, Homo sapiens
gaaaaggccactcctaggagct

SEQ ID NO: 8430045 - DNA, 22 bp, Homo sapiens
cttttacactcatctgggaggg

SEQ ID NO: 8430046 - DNA, 22 bp, Homo sapiens
cttttacactcatctgggaggg

SEQ ID NO: 8430047 - DNA, 22 bp, Homo sapiens
cttttaatgggagcagtatttg

SEQ ID NO: 8430048 - DNA, 17 bp, Homo sapiens
cttttaatttacttccc

SEQ ID NO: 8430049 - DNA, 22 bp, Homo sapiens
cttttaatgggagcagtatttg

SEQ ID NO: 8430050 - DNA, 22 bp, Homo sapiens
cttttaatgagcattgctgtct

SEQ ID NO: 8430051 - DNA, 22 bp, Homo sapiens
ctttgtttatatttctcctcga

SEQ ID NO: 8430052 - DNA, 22 bp, Homo sapiens
ctttgttatctgtaaatggtta

SEQ ID NO: 8430053 - DNA, 22 bp, Homo sapiens
ctttgtcattttgtctctcagt

SEQ ID NO: 8430054 - DNA, 22 bp, Homo sapiens
gaaaggcatcttcagtctctga

SEQ ID NO: 8430055 - DNA, 22 bp, Homo sapiens
gaaaggctaaaattataagggt

SEQ ID NO: 8430056 - DNA, 22 bp, Homo sapiens
gaaaggctactgtcatcaatta

SEQ ID NO: 8430057 - DNA, 22 bp, Homo sapiens
gaaaggctcagaagtttgtatt

SEQ ID NO: 8430058 - DNA, 22 bp, Homo sapiens
gaaaggctcactttagatcatg

SEQ ID NO: 8430059 - DNA, 22 bp, Homo sapiens
gaaaggctatgagtttggtata

SEQ ID NO: 8430060 - DNA, 22 bp, Homo sapiens
gaaaggctcagattcccccagg

SEQ ID NO: 8430061 - DNA, 23 bp, Homo sapiens
gaaaggctctgggacccccaact

SEQ ID NO: 8430062 - DNA, 22 bp, Homo sapiens
gaaaggcttaaattgtaagggc

SEQ ID NO: 8430063 - DNA, 22 bp, Homo sapiens
gaaaggcttaaattgtaagggc

SEQ ID NO: 8430064 - DNA, 22 bp, Homo sapiens
gaaaggcttcttaagcttcact

SEQ ID NO: 8430065 - DNA, 22 bp, Homo sapiens
gaaaggcttgagacattgatga

SEQ ID NO: 8430066 - DNA, 22 bp, Homo sapiens
gaaaggctgcatctcgcctcag

SEQ ID NO: 8430067 - DNA, 19 bp, Homo sapiens
gaaaggctgctgctacctg

SEQ ID NO: 8430068 - DNA, 22 bp, Homo sapiens
gaaaggctgggatttagcgctg

SEQ ID NO: 8430069 - DNA, 22 bp, Homo sapiens
gaaaggcttggttttgaatata

SEQ ID NO: 8430070 - DNA, 22 bp, Homo sapiens
gaaaggcttgcttttgctcggt

SEQ ID NO: 8430071 - DNA, 22 bp, Homo sapiens
gaaaatacaaatagccttgaaa

SEQ ID NO: 8430072 - DNA, 18 bp, Homo sapiens
gaaaatactctgggctca

SEQ ID NO: 8430073 - DNA, 18 bp, Homo sapiens
gaaaatactctgggctca

SEQ ID NO: 8430074 - DNA, 22 bp, Homo sapiens
gaaaggcatcttcagtctctga

SEQ ID NO: 8430075 - DNA, 22 bp, Homo sapiens
gaaagttattgaaccttattta

SEQ ID NO: 8430076 - DNA, 22 bp, Homo sapiens
gaaagtttataggttatataat

SEQ ID NO: 8430077 - DNA, 22 bp, Homo sapiens
gaaagttgcaatcatggctttt

SEQ ID NO: 8430078 - DNA, 22 bp, Homo sapiens
gaaagtttataggttatataat

SEQ ID NO: 8430079 - DNA, 22 bp, Homo sapiens
gaaagtttctcacacatgcaga

SEQ ID NO: 8430080 - DNA, 22 bp, Homo sapiens
gaaagtttctcacacatgcaga

SEQ ID NO: 8430081 - DNA, 22 bp, Homo sapiens
gaaagttattcagcctctctga

SEQ ID NO: 8430082 - DNA, 22 bp, Homo sapiens
gaaagttatatcatgattttag

SEQ ID NO: 8430083 - DNA, 22 bp, Homo sapiens
gaaagttacagaaaccattagt

SEQ ID NO: 8430084 - DNA, 22 bp, Homo sapiens
gaaagtgcttttgagtgtgtgc

SEQ ID NO: 8430085 - DNA, 22 bp, Homo sapiens
gaaagtgctaggaagtgttaga

SEQ ID NO: 8430086 - DNA, 22 bp, Homo sapiens
gaaagtgctctctctatacaca

SEQ ID NO: 8430087 - DNA, 22 bp, Homo sapiens
gaaagtgcttagagtgtggtat

SEQ ID NO: 8430088 - DNA, 22 bp, Homo sapiens
gaaaggggcatgtagggatcac

SEQ ID NO: 8430089 - DNA, 22 bp, Homo sapiens
gaaagggtctttgatttccctc

SEQ ID NO: 8430090 - DNA, 22 bp, Homo sapiens
gaaaggtgccccataggcagga

SEQ ID NO: 8430091 - DNA, 22 bp, Homo sapiens
gaaagtgcctcagtcctcttat

SEQ ID NO: 8430092 - DNA, 18 bp, Homo sapiens
gaaagtgcggggcagggg

SEQ ID NO: 8430093 - DNA, 22 bp, Homo sapiens
gaaagtgccagaataggaggcc

SEQ ID NO: 8430094 - DNA, 22 bp, Homo sapiens
gaaagtgcatgtgcccaccatt

SEQ ID NO: 8430095 - DNA, 22 bp, Homo sapiens
gaaaggggcatgtagggatcac

SEQ ID NO: 8430096 - DNA, 22 bp, Homo sapiens
cttgggatgtaacctttgttcc

SEQ ID NO: 8430097 - DNA, 22 bp, Homo sapiens
cttgggagtagaggcaggagca

SEQ ID NO: 8430098 - DNA, 22 bp, Homo sapiens
cttgggccctccccttgtgaat

SEQ ID NO: 8430099 - DNA, 22 bp, Homo sapiens
cttgggctctaaatgccagtga

SEQ ID NO: 8430100 - DNA, 22 bp, Homo sapiens
cttggggctttgtgtgtaggat

SEQ ID NO: 8430101 - DNA, 22 bp, Homo sapiens
cttggggcagtgcttggcacat

SEQ ID NO: 8430102 - DNA, 22 bp, Homo sapiens
cttggctgtctataggaaagag

SEQ ID NO: 8430103 - DNA, 22 bp, Homo sapiens
cttggctgttgggcattgagaa

SEQ ID NO: 8430104 - DNA, 19 bp, Homo sapiens
cttggcttagcttcttagc

SEQ ID NO: 8430105 - DNA, 22 bp, Homo sapiens
cttggctgtcataaggtcctgg

SEQ ID NO: 8430106 - DNA, 22 bp, Homo sapiens
cttggctgcttttgtgcacatt

SEQ ID NO: 8430107 - DNA, 21 bp, Homo sapiens
cttggagttggttgaggatgc

SEQ ID NO: 8430108 - DNA, 22 bp, Homo sapiens
cttgaatgggccataagacggt

SEQ ID NO: 8430109 - DNA, 22 bp, Homo sapiens
cttgaatggtatgagagtaatt

SEQ ID NO: 8430110 - DNA, 22 bp, Homo sapiens
cttgaatgtcctgtggcaaagt

SEQ ID NO: 8430111 - DNA, 22 bp, Homo sapiens
cttgaatgtaaataatgtacag

SEQ ID NO: 8430112 - DNA, 23 bp, Homo sapiens
cttgaatgggatggaattcactg

SEQ ID NO: 8430113 - DNA, 22 bp, Homo sapiens
cttgaatgaaaccaactgatga

SEQ ID NO: 8430114 - DNA, 22 bp, Homo sapiens
ctttatgaacctgttcagcttg

SEQ ID NO: 8430115 - DNA, 22 bp, Homo sapiens
ctttatatattcccaggctgcc

SEQ ID NO: 8430116 - DNA, 22 bp, Homo sapiens
ctttatatccagatgtttggtg

SEQ ID NO: 8430117 - DNA, 22 bp, Homo sapiens
ctttatctgtgtcctcttgcct

SEQ ID NO: 8430118 - DNA, 22 bp, Homo sapiens
ctttgtatctaaatatcttgaa

SEQ ID NO: 8430119 - DNA, 22 bp, Homo sapiens
ctttggcagcctctgctattga

SEQ ID NO: 8430120 - DNA, 20 bp, Homo sapiens
ctttagaagaacccaagcat

SEQ ID NO: 8430121 - DNA, 22 bp, Homo sapiens
ctttagaagggtaacggaatta

SEQ ID NO: 8430122 - DNA, 22 bp, Homo sapiens
ctttagaagggtaacggaatta

SEQ ID NO: 8430123 - DNA, 20 bp, Homo sapiens
ctttagaagaacccaagcat

SEQ ID NO: 8430124 - DNA, 20 bp, Homo sapiens
ctttagaagaacccaagcat

SEQ ID NO: 8430125 - DNA, 22 bp, Homo sapiens
ctttagaaatctggatgtattt

SEQ ID NO: 8430126 - DNA, 19 bp, Homo sapiens
ctttagacacacctggaca

SEQ ID NO: 8430127 - DNA, 22 bp, Homo sapiens
ctttagaatttcatgtttggtc

SEQ ID NO: 8430128 - DNA, 22 bp, Homo sapiens
ctttagaatttcatgtttggtc

SEQ ID NO: 8430129 - DNA, 22 bp, Homo sapiens
ctttagaatttgatataatcaa

SEQ ID NO: 8430130 - DNA, 22 bp, Homo sapiens
ctttagaatttgatataatcaa

SEQ ID NO: 8430131 - DNA, 22 bp, Homo sapiens
ctttagaatttgatataatcaa

SEQ ID NO: 8430132 - DNA, 22 bp, Homo sapiens
cttctttcttttgatcacaggt

SEQ ID NO: 8430133 - DNA, 22 bp, Homo sapiens
cttctttcttttgatcacaggt

SEQ ID NO: 8430134 - DNA, 22 bp, Homo sapiens
cttctttgaaaaaggcagtcag

SEQ ID NO: 8430135 - DNA, 22 bp, Homo sapiens
cttctttccttcctccagtggc

SEQ ID NO: 8430136 - DNA, 22 bp, Homo sapiens
cttctttcccaggcatgtttta

SEQ ID NO: 8430137 - DNA, 22 bp, Homo sapiens
cttctttccttcctccagtggc

SEQ ID NO: 8430138 - DNA, 22 bp, Homo sapiens
cttctttcccaggcatgtttta

SEQ ID NO: 8430139 - DNA, 22 bp, Homo sapiens
cttctttagggatctcttgctg

SEQ ID NO: 8430140 - DNA, 22 bp, Homo sapiens
cttctttagggatctcttgctg

SEQ ID NO: 8430141 - DNA, 22 bp, Homo sapiens
cttctttactttctagaaataa

SEQ ID NO: 8430142 - DNA, 22 bp, Homo sapiens
cttcttgacttctgggtgccct

SEQ ID NO: 8430143 - DNA, 22 bp, Homo sapiens
cttctttcaagaatggattagg

SEQ ID NO: 8430144 - DNA, 22 bp, Homo sapiens
cttctttcaagaatggattagg

SEQ ID NO: 8430145 - DNA, 22 bp, Homo sapiens
cttgaaaataagaaagactttc

SEQ ID NO: 8430146 - DNA, 19 bp, Homo sapiens
cttgaaactactgttgaga

SEQ ID NO: 8430147 - DNA, 22 bp, Homo sapiens
cttgaaagaagggtcttttaat

SEQ ID NO: 8430148 - DNA, 22 bp, Homo sapiens
cttcttttcatggcttgggaag

SEQ ID NO: 8430149 - DNA, 22 bp, Homo sapiens
cttctctggctcctcagcgccc

SEQ ID NO: 8430150 - DNA, 22 bp, Homo sapiens
cttctctggctcctcagcgccc

SEQ ID NO: 8430151 - DNA, 22 bp, Homo sapiens
cttctctggctcctcagcgccc

SEQ ID NO: 8430152 - DNA, 22 bp, Homo sapiens
cttctctggcatagcaagcagg

SEQ ID NO: 8430153 - DNA, 22 bp, Homo sapiens
cttctctgcccataggaaatgc

SEQ ID NO: 8430154 - DNA, 17 bp, Homo sapiens
cttctctggcagaagat

SEQ ID NO: 8430155 - DNA, 22 bp, Homo sapiens
cttctctgcaccccacttttgc

SEQ ID NO: 8430156 - DNA, 22 bp, Homo sapiens
cttctctgcaccccacttttgc

SEQ ID NO: 8430157 - DNA, 23 bp, Homo sapiens
cttctctgagctaggaatgctct

SEQ ID NO: 8430158 - DNA, 22 bp, Homo sapiens
cttctctgacagtctgtttcac

SEQ ID NO: 8430159 - DNA, 22 bp, Homo sapiens
cttctctctgcataggcatggg

SEQ ID NO: 8430160 - DNA, 22 bp, Homo sapiens
cttctttactttctagaaataa

SEQ ID NO: 8430161 - DNA, 22 bp, Homo sapiens
cttcttcttttaataaatgtct

SEQ ID NO: 8430162 - DNA, 22 bp, Homo sapiens
cttctctggcagatgtgtgtcc

SEQ ID NO: 8430163 - DNA, 22 bp, Homo sapiens
cttctctgtcacagggttacgt

SEQ ID NO: 8430164 - DNA, 22 bp, Homo sapiens
cttctctgtgtagagattcaga

SEQ ID NO: 8430165 - DNA, 22 bp, Homo sapiens
cttctctgtgtagagattcaga

SEQ ID NO: 8430166 - DNA, 22 bp, Homo sapiens
ctggctggtcatcagcagtacg

SEQ ID NO: 8430167 - DNA, 22 bp, Homo sapiens
ctggctggtcatgtcatgagcc

SEQ ID NO: 8430168 - DNA, 22 bp, Homo sapiens
ctggctggtcctcggggacagc

SEQ ID NO: 8430169 - DNA, 22 bp, Homo sapiens
ctggctggtcatgtcatgagcc

SEQ ID NO: 8430170 - DNA, 22 bp, Homo sapiens
ctggctggggtccatcctctaa

SEQ ID NO: 8430171 - DNA, 22 bp, Homo sapiens
ctggctgggttccaggattcca

SEQ ID NO: 8430172 - DNA, 22 bp, Homo sapiens
ctggctgggttccaggattcca

SEQ ID NO: 8430173 - DNA, 22 bp, Homo sapiens
ctggctggtaatggaacgacag

SEQ ID NO: 8430174 - DNA, 22 bp, Homo sapiens
ctggctggtagaattgtgacct

SEQ ID NO: 8430175 - DNA, 22 bp, Homo sapiens
ctggctgggagctcgcctgcgg

SEQ ID NO: 8430176 - DNA, 22 bp, Homo sapiens
ctggctggaggtgagtcactga

SEQ ID NO: 8430177 - DNA, 22 bp, Homo sapiens
ctggctggaggtgagtcactga

SEQ ID NO: 8430178 - DNA, 22 bp, Homo sapiens
ctggctgggagctcgcctgcgg

SEQ ID NO: 8430179 - DNA, 22 bp, Homo sapiens
ctggctggagtgcaggtgagtg

SEQ ID NO: 8430180 - DNA, 22 bp, Homo sapiens
ctggctgggcagacagaatgct

SEQ ID NO: 8430181 - DNA, 22 bp, Homo sapiens
ctggctggggaagtcatttgat

SEQ ID NO: 8430182 - DNA, 22 bp, Homo sapiens
ctggctggggtaccagttgaac

SEQ ID NO: 8430183 - DNA, 22 bp, Homo sapiens
cttctcagttgcaagtgtcaga

SEQ ID NO: 8430184 - DNA, 22 bp, Homo sapiens
ctggctgtatgctggcctcaga

SEQ ID NO: 8430185 - DNA, 22 bp, Homo sapiens
ctggctggttgtctcaatccag

SEQ ID NO: 8430186 - DNA, 22 bp, Homo sapiens
ctggctggtttttaaagctagg

SEQ ID NO: 8430187 - DNA, 22 bp, Homo sapiens
ctggctgtcttggaggaaggag

SEQ ID NO: 8430188 - DNA, 22 bp, Homo sapiens
ctggctggttccctgctccagg

SEQ ID NO: 8430189 - DNA, 22 bp, Homo sapiens
ctggctggttccctgctccagg

SEQ ID NO: 8430190 - DNA, 22 bp, Homo sapiens
ctggctggttggggagaagaca

SEQ ID NO: 8430191 - DNA, 22 bp, Homo sapiens
ctggctggttccctgctccagg

SEQ ID NO: 8430192 - DNA, 22 bp, Homo sapiens
ctggctggtcctcggggacagc

SEQ ID NO: 8430193 - DNA, 22 bp, Homo sapiens
ctggctggtctgagcagtcgca

SEQ ID NO: 8430194 - DNA, 22 bp, Homo sapiens
ctggctggttactatttctggt

SEQ ID NO: 8430195 - DNA, 22 bp, Homo sapiens
ctggctggttactatttctggt

SEQ ID NO: 8430196 - DNA, 22 bp, Homo sapiens
ctggctggttactatttctggt

SEQ ID NO: 8430197 - DNA, 22 bp, Homo sapiens
gagtgcagtatgagaggctgct

SEQ ID NO: 8430198 - DNA, 22 bp, Homo sapiens
gagtgcagtatgagaggctgct

SEQ ID NO: 8430199 - DNA, 22 bp, Homo sapiens
gagtgcatggactactggcttg

SEQ ID NO: 8430200 - DNA, 22 bp, Homo sapiens
gagtgctgcttgggatagtgag

SEQ ID NO: 8430201 - DNA, 22 bp, Homo sapiens
gagtgctgctaatgcaagggtg

SEQ ID NO: 8430202 - DNA, 17 bp, Homo sapiens
gagtgctggtggagctc

SEQ ID NO: 8430203 - DNA, 22 bp, Homo sapiens
gagtgctggaggtgtgagtggg

SEQ ID NO: 8430204 - DNA, 22 bp, Homo sapiens
gagtgctggggtgcagagaggt

SEQ ID NO: 8430205 - DNA, 22 bp, Homo sapiens
gagtgctgaatgcgagaacaga

SEQ ID NO: 8430206 - DNA, 22 bp, Homo sapiens
gagtgctggggtgcagagaggt

SEQ ID NO: 8430207 - DNA, 22 bp, Homo sapiens
gagtggcatatgtgcctgtgaa

SEQ ID NO: 8430208 - DNA, 22 bp, Homo sapiens
gagtgggcaaaagaaagtaggc

SEQ ID NO: 8430209 - DNA, 22 bp, Homo sapiens
gagtggggctttaaaggctcag

SEQ ID NO: 8430210 - DNA, 22 bp, Homo sapiens
gagtggggctttaaaggctcag

SEQ ID NO: 8430211 - DNA, 21 bp, Homo sapiens
gagtgggacatgggagtggtt

SEQ ID NO: 8430212 - DNA, 21 bp, Homo sapiens
gagtgggacatgggagtggtt

SEQ ID NO: 8430213 - DNA, 21 bp, Homo sapiens
gagtgggacatgggagtggtt

SEQ ID NO: 8430214 - DNA, 22 bp, Homo sapiens
gagtggcagaactgggggtcct

SEQ ID NO: 8430215 - DNA, 22 bp, Homo sapiens
gagtggagcaaaagaggtagat

SEQ ID NO: 8430216 - DNA, 20 bp, Homo sapiens
gagtgctttggcttgctctc

SEQ ID NO: 8430217 - DNA, 22 bp, Homo sapiens
gagtgcttgcatatttattgtc

SEQ ID NO: 8430218 - DNA, 22 bp, Homo sapiens
gagtgctttgtcttgtaattct

SEQ ID NO: 8430219 - DNA, 22 bp, Homo sapiens
gagtgagggcagcaggggctgc

SEQ ID NO: 8430220 - DNA, 22 bp, Homo sapiens
gagtgagggcagcaggggctgc

SEQ ID NO: 8430221 - DNA, 22 bp, Homo sapiens
gagtgagggcagcaggggctgc

SEQ ID NO: 8430222 - DNA, 22 bp, Homo sapiens
gagtgaggctggaatcatggct

SEQ ID NO: 8430223 - DNA, 22 bp, Homo sapiens
gagtgagggccaacatccagct

SEQ ID NO: 8430224 - DNA, 22 bp, Homo sapiens
gagtgagtagctacagttttta

SEQ ID NO: 8430225 - DNA, 22 bp, Homo sapiens
gagtgagtagctacagttttta

SEQ ID NO: 8430226 - DNA, 22 bp, Homo sapiens
gagtgagttggaaaacagacac

SEQ ID NO: 8430227 - DNA, 22 bp, Homo sapiens
gagtgagttggaaaacagacac

SEQ ID NO: 8430228 - DNA, 22 bp, Homo sapiens
gagtctggtcattttctctccc

SEQ ID NO: 8430229 - DNA, 22 bp, Homo sapiens
gagtctggtgatggtcattgtc

SEQ ID NO: 8430230 - DNA, 22 bp, Homo sapiens
gagtctggccctgatgcatcat

SEQ ID NO: 8430231 - DNA, 22 bp, Homo sapiens
gagtctggccctgatgcatcat

SEQ ID NO: 8430232 - DNA, 22 bp, Homo sapiens
gagtctggactattctggtctt

SEQ ID NO: 8430233 - DNA, 22 bp, Homo sapiens
gagtctggaatgatgaagacct

SEQ ID NO: 8430234 - DNA, 22 bp, Homo sapiens
gagtctggactattctggtctt

SEQ ID NO: 8430235 - DNA, 22 bp, Homo sapiens
gagtctggaaactttgacaaaa

SEQ ID NO: 8430236 - DNA, 22 bp, Homo sapiens
gagtctctgggagggaaagaag

SEQ ID NO: 8430237 - DNA, 22 bp, Homo sapiens
gagtctttctgggcttgttctt

SEQ ID NO: 8430238 - DNA, 22 bp, Homo sapiens
gagtcttctgagttattggata

SEQ ID NO: 8430239 - DNA, 22 bp, Homo sapiens
gagtcttctgagttattggata

SEQ ID NO: 8430240 - DNA, 22 bp, Homo sapiens
gagtcttaggcaaaaataatgg

SEQ ID NO: 8430241 - DNA, 22 bp, Homo sapiens
gagtcttctacgctcacacaaa

SEQ ID NO: 8430242 - DNA, 22 bp, Homo sapiens
gagtctggtgatggtcattgtc

SEQ ID NO: 8430243 - DNA, 22 bp, Homo sapiens
gagtcttaggcaaaaataatgg

SEQ ID NO: 8430244 - DNA, 22 bp, Homo sapiens
gagtctttggtaaagtctgctg

SEQ ID NO: 8430245 - DNA, 22 bp, Homo sapiens
gagtctttgtatttacttccca

SEQ ID NO: 8430246 - DNA, 18 bp, Homo sapiens
gagtctttgttactgctg

SEQ ID NO: 8430247 - DNA, 22 bp, Homo sapiens
gagtccttgtcataattcagtg

SEQ ID NO: 8430248 - DNA, 22 bp, Homo sapiens
gagtccttgacacatagtaggt

SEQ ID NO: 8430249 - DNA, 22 bp, Homo sapiens
gagtccttccagcaggcattta

SEQ ID NO: 8430250 - DNA, 22 bp, Homo sapiens
gagtccttgacacatagtaggt

SEQ ID NO: 8430251 - DNA, 21 bp, Homo sapiens
gagtcctggctagggtggcag

SEQ ID NO: 8430252 - DNA, 22 bp, Homo sapiens
gagtcctggcgtccaatttcct

SEQ ID NO: 8430253 - DNA, 22 bp, Homo sapiens
gagtcctgctttcaattctttt

SEQ ID NO: 8430254 - DNA, 19 bp, Homo sapiens
gagtcctgtgctccttgtt

SEQ ID NO: 8430255 - DNA, 20 bp, Homo sapiens
gagtccttatgggctgaggt

SEQ ID NO: 8430256 - DNA, 22 bp, Homo sapiens
gagtgtcaaggctctctttggc

SEQ ID NO: 8430257 - DNA, 22 bp, Homo sapiens
gagtgtatggaaggaagagatt

SEQ ID NO: 8430258 - DNA, 22 bp, Homo sapiens
gagtgtcacttgatgcagggca

SEQ ID NO: 8430259 - DNA, 22 bp, Homo sapiens
gagtgggtgacagaaggaggta

SEQ ID NO: 8430260 - DNA, 22 bp, Homo sapiens
gagtggtaatgagcagattagg

SEQ ID NO: 8430261 - DNA, 22 bp, Homo sapiens
gagtgtcagtgcctggcttgtt

SEQ ID NO: 8430262 - DNA, 22 bp, Homo sapiens
gagtgtcagcagggcagagcac

SEQ ID NO: 8430263 - DNA, 22 bp, Homo sapiens
gagtgtcagtgcttggggctac

SEQ ID NO: 8430264 - DNA, 22 bp, Homo sapiens
gagtgggtccacagaggtgaca

SEQ ID NO: 8430265 - DNA, 22 bp, Homo sapiens
gagtgggtaaaggtgcttggct

SEQ ID NO: 8430266 - DNA, 22 bp, Homo sapiens
gagtggggtctgggcatcagtc

SEQ ID NO: 8430267 - DNA, 22 bp, Homo sapiens
gagtggggggtccgtctcagtg

SEQ ID NO: 8430268 - DNA, 22 bp, Homo sapiens
gagtggggggtccgtctcagtg

SEQ ID NO: 8430269 - DNA, 22 bp, Homo sapiens
gagtggggtctgggcatcagtc

SEQ ID NO: 8430270 - DNA, 22 bp, Homo sapiens
gagtggggggtccgtctcagtg

SEQ ID NO: 8430271 - DNA, 22 bp, Homo sapiens
gagtgtggatcccagaagcaga

SEQ ID NO: 8430272 - DNA, 22 bp, Homo sapiens
gagtgtgggggtgctgaggaca

SEQ ID NO: 8430273 - DNA, 22 bp, Homo sapiens
gagtgtgggtctcagctttaag

SEQ ID NO: 8430274 - DNA, 22 bp, Homo sapiens
gagtgtggtgaacaggagcacc

SEQ ID NO: 8430275 - DNA, 22 bp, Homo sapiens
gagtgtgtcggtcagcgtggcg

SEQ ID NO: 8430276 - DNA, 22 bp, Homo sapiens
gagtgttttactcaaagaaaga

SEQ ID NO: 8430277 - DNA, 22 bp, Homo sapiens
gagtgtgttctttatgctgtga

SEQ ID NO: 8430278 - DNA, 22 bp, Homo sapiens
gagttaaaggaaaataacttta

SEQ ID NO: 8430279 - DNA, 22 bp, Homo sapiens
gagttaaaagccctctcagcag

SEQ ID NO: 8430280 - DNA, 22 bp, Homo sapiens
gataaagggggaccaaatgact

SEQ ID NO: 8430281 - DNA, 22 bp, Homo sapiens
gataaattatcaggggtttaaa

SEQ ID NO: 8430282 - DNA, 22 bp, Homo sapiens
gataaacttgtggagttttggt

SEQ ID NO: 8430283 - DNA, 20 bp, Homo sapiens
gataaattgtctcttaagtg

SEQ ID NO: 8430284 - DNA, 22 bp, Homo sapiens
gataaattgcactttttcttac

SEQ ID NO: 8430285 - DNA, 22 bp, Homo sapiens
gataaactggaaccattgcctc

SEQ ID NO: 8430286 - DNA, 22 bp, Homo sapiens
gataaacattcttgcacatgtg

SEQ ID NO: 8430287 - DNA, 22 bp, Homo sapiens
gagttcttaggcaaacaactct

SEQ ID NO: 8430288 - DNA, 22 bp, Homo sapiens
gagttcttctatatagtatgag

SEQ ID NO: 8430289 - DNA, 22 bp, Homo sapiens
gagttgatcattatttggtttc

SEQ ID NO: 8430290 - DNA, 22 bp, Homo sapiens
gagttctcaagcaatcaaagag

SEQ ID NO: 8430291 - DNA, 22 bp, Homo sapiens
gagtttctccagtgctagttgt

SEQ ID NO: 8430292 - DNA, 22 bp, Homo sapiens
gagtttgatagagaggaaccgg

SEQ ID NO: 8430293 - DNA, 22 bp, Homo sapiens
gagtttgtaaactattcactaa

SEQ ID NO: 8430294 - DNA, 22 bp, Homo sapiens
gagttttaacctcagctctctg

SEQ ID NO: 8430295 - DNA, 22 bp, Homo sapiens
gatagataaaactatattttca

SEQ ID NO: 8430296 - DNA, 22 bp, Homo sapiens
gatagagtgttgcctctcaatt

SEQ ID NO: 8430297 - DNA, 22 bp, Homo sapiens
gatagaaaggtgttgaaatcca

SEQ ID NO: 8430298 - DNA, 22 bp, Homo sapiens
gatagaaagagtggttcttttt

SEQ ID NO: 8430299 - DNA, 22 bp, Homo sapiens
gatagaaagaatatagattcca

SEQ ID NO: 8430300 - DNA, 22 bp, Homo sapiens
gatagaaagagtggttcttttt

SEQ ID NO: 8430301 - DNA, 22 bp, Homo sapiens
gatagaaagaatatagattcca

SEQ ID NO: 8430302 - DNA, 22 bp, Homo sapiens
gataggaccaggtaacctctaa

SEQ ID NO: 8430303 - DNA, 19 bp, Homo sapiens
gataggcagccatgagccc

SEQ ID NO: 8430304 - DNA, 22 bp, Homo sapiens
gatagtcacctcccttaacttt

SEQ ID NO: 8430305 - DNA, 19 bp, Homo sapiens
gatataaagagatggtgaa

SEQ ID NO: 8430306 - DNA, 22 bp, Homo sapiens
gatataaattaatcaagtgcaa

SEQ ID NO: 8430307 - DNA, 22 bp, Homo sapiens
gatacactggccaagtggagga

SEQ ID NO: 8430308 - DNA, 22 bp, Homo sapiens
gatacactggagcttcctgaca

SEQ ID NO: 8430309 - DNA, 23 bp, Homo sapiens
gatacactccctgctgggcactg

SEQ ID NO: 8430310 - DNA, 22 bp, Homo sapiens
gatacagtatttaaagagcaac

SEQ ID NO: 8430311 - DNA, 22 bp, Homo sapiens
gatacagctctggccagatgtg

SEQ ID NO: 8430312 - DNA, 22 bp, Homo sapiens
gatacagtatttaaagagcaac

SEQ ID NO: 8430313 - DNA, 22 bp, Homo sapiens
gatacattccatttctacttaa

SEQ ID NO: 8430314 - DNA, 22 bp, Homo sapiens
gatacatttcaaggaggactgg

SEQ ID NO: 8430315 - DNA, 22 bp, Homo sapiens
gataatatctggtttattcacc

SEQ ID NO: 8430316 - DNA, 22 bp, Homo sapiens
gataactacacttaagacaacc

SEQ ID NO: 8430317 - DNA, 22 bp, Homo sapiens
gataacccccaagaaggtcttt

SEQ ID NO: 8430318 - DNA, 22 bp, Homo sapiens
gataagcagcagccgttatagg

SEQ ID NO: 8430319 - DNA, 22 bp, Homo sapiens
gataagcactatataagtattt

SEQ ID NO: 8430320 - DNA, 21 bp, Homo sapiens
gataaggcaggaggataagta

SEQ ID NO: 8430321 - DNA, 22 bp, Homo sapiens
gatacacacccttgataggact

SEQ ID NO: 8430322 - DNA, 20 bp, Homo sapiens
gatacacagcacagagggcc

SEQ ID NO: 8430323 - DNA, 22 bp, Homo sapiens
gatacacaagtggaaggagacg

SEQ ID NO: 8430324 - DNA, 22 bp, Homo sapiens
gatatttacattaagcacattg

SEQ ID NO: 8430325 - DNA, 22 bp, Homo sapiens
gatataggttcatagtgttaca

SEQ ID NO: 8430326 - DNA, 22 bp, Homo sapiens
gatatactgtctgtattacata

SEQ ID NO: 8430327 - DNA, 18 bp, Homo sapiens
gatatataggaggaaagt

SEQ ID NO: 8430328 - DNA, 22 bp, Homo sapiens
gatatttttaggtgatgcaggc

SEQ ID NO: 8430329 - DNA, 22 bp, Homo sapiens
gatattttgagaaatcctatga

SEQ ID NO: 8430330 - DNA, 22 bp, Homo sapiens
gatattttgagaaatcctatga

SEQ ID NO: 8430331 - DNA, 22 bp, Homo sapiens
gatcagagtggctagagccttg

SEQ ID NO: 8430332 - DNA, 22 bp, Homo sapiens
gatcaatactattaagatcata

SEQ ID NO: 8430333 - DNA, 22 bp, Homo sapiens
gatcaatggtgtaacttgtcct

SEQ ID NO: 8430334 - DNA, 22 bp, Homo sapiens
gatcacataatttggaaacagc

SEQ ID NO: 8430335 - DNA, 22 bp, Homo sapiens
gatcacatgaatggaatagaag

SEQ ID NO: 8430336 - DNA, 22 bp, Homo sapiens
gatcacatgaatggaatagaag

SEQ ID NO: 8430337 - DNA, 22 bp, Homo sapiens
gatcacatgagttatctaactt

SEQ ID NO: 8430338 - DNA, 22 bp, Homo sapiens
gatcaacaacttttgaatagct

SEQ ID NO: 8430339 - DNA, 22 bp, Homo sapiens
gatcaaaagctgggttctaaaa

SEQ ID NO: 8430340 - DNA, 22 bp, Homo sapiens
gatcaaaagctgggttctaaaa

SEQ ID NO: 8430341 - DNA, 22 bp, Homo sapiens
gatgaagtcattatccttttgg

SEQ ID NO: 8430342 - DNA, 22 bp, Homo sapiens
gatgaattctggcttggacaga

SEQ ID NO: 8430343 - DNA, 22 bp, Homo sapiens
gatgaattgttatggctacgag

SEQ ID NO: 8430344 - DNA, 22 bp, Homo sapiens
gatgaattgaaatcattgggca

SEQ ID NO: 8430345 - DNA, 22 bp, Homo sapiens
gatgagctgtgattaataagta

SEQ ID NO: 8430346 - DNA, 22 bp, Homo sapiens
gatgagcattgtttcatgtgtt

SEQ ID NO: 8430347 - DNA, 22 bp, Homo sapiens
gatgaggaaaccaaggctcagg

SEQ ID NO: 8430348 - DNA, 22 bp, Homo sapiens
gatgatgggttgatgtgaaggg

SEQ ID NO: 8430349 - DNA, 22 bp, Homo sapiens
gatgaggaatgctcagctcaat

SEQ ID NO: 8430350 - DNA, 20 bp, Homo sapiens
gatgagacccatgcatgaga

SEQ ID NO: 8430351 - DNA, 22 bp, Homo sapiens
gatgagaatgtttatcaaatgc

SEQ ID NO: 8430352 - DNA, 22 bp, Homo sapiens
gatgagacagaatagcccaagg

SEQ ID NO: 8430353 - DNA, 22 bp, Homo sapiens
gatgcacaggtgagcaggtgca

SEQ ID NO: 8430354 - DNA, 22 bp, Homo sapiens
gatgcaaagataaaacagacgc

SEQ ID NO: 8430355 - DNA, 22 bp, Homo sapiens
gatgcaaagataaaacagacgc

SEQ ID NO: 8430356 - DNA, 22 bp, Homo sapiens
gatgcaaagataaaacagacgc

SEQ ID NO: 8430357 - DNA, 22 bp, Homo sapiens
gatgcagcagccagcttctgaa

SEQ ID NO: 8430358 - DNA, 22 bp, Homo sapiens
gatgatttttgccagtgtgatg

SEQ ID NO: 8430359 - DNA, 22 bp, Homo sapiens
gatgcaaactgtgacatagagt

SEQ ID NO: 8430360 - DNA, 22 bp, Homo sapiens
gatgcaaagaggaccttcagta

SEQ ID NO: 8430361 - DNA, 22 bp, Homo sapiens
gatgcaaaccttacatggacct

SEQ ID NO: 8430362 - DNA, 22 bp, Homo sapiens
gatgcaaactgtgacatagagt

SEQ ID NO: 8430363 - DNA, 22 bp, Homo sapiens
gatgcaaactgtgacatagagt

SEQ ID NO: 8430364 - DNA, 22 bp, Homo sapiens
gatgatttaagtggccaaagta

SEQ ID NO: 8430365 - DNA, 22 bp, Homo sapiens
gatgattcctttgttcattgtg

SEQ ID NO: 8430366 - DNA, 22 bp, Homo sapiens
gatgattctgtgtttggaatgc

SEQ ID NO: 8430367 - DNA, 22 bp, Homo sapiens
gatgattttgatgcagtaaaga

SEQ ID NO: 8430368 - DNA, 22 bp, Homo sapiens
gatgaaatccagatcacaggtg

SEQ ID NO: 8430369 - DNA, 22 bp, Homo sapiens
gatcttttcagaatttatcagt

SEQ ID NO: 8430370 - DNA, 22 bp, Homo sapiens
gatcttttcaggtttctctagt

SEQ ID NO: 8430371 - DNA, 22 bp, Homo sapiens
gatcttttcagaatttatcagt

SEQ ID NO: 8430372 - DNA, 22 bp, Homo sapiens
gatctttgcaaactttgtcact

SEQ ID NO: 8430373 - DNA, 22 bp, Homo sapiens
gatctttgcaaactttgtcact

SEQ ID NO: 8430374 - DNA, 22 bp, Homo sapiens
gatcttttcagtcttggtagtt

SEQ ID NO: 8430375 - DNA, 22 bp, Homo sapiens
gatcttttcaggtttctctagt

SEQ ID NO: 8430376 - DNA, 22 bp, Homo sapiens
gatcttttcagtcttggtagtt

SEQ ID NO: 8430377 - DNA, 22 bp, Homo sapiens
gatgaaaaaagacgagcatata

SEQ ID NO: 8430378 - DNA, 22 bp, Homo sapiens
gatgaaaatcttgagatgtcga

SEQ ID NO: 8430379 - DNA, 22 bp, Homo sapiens
gatgaaaaattgctgtgtcata

SEQ ID NO: 8430380 - DNA, 22 bp, Homo sapiens
gatgaaaaaagacgagcatata

SEQ ID NO: 8430381 - DNA, 22 bp, Homo sapiens
gatgaaaaattgctgtgtcata

SEQ ID NO: 8430382 - DNA, 22 bp, Homo sapiens
gatctttatactgtaataatga

SEQ ID NO: 8430383 - DNA, 22 bp, Homo sapiens
gatctttagccaagacacacca

SEQ ID NO: 8430384 - DNA, 22 bp, Homo sapiens
gatcttgagcaagttgtgtaac

SEQ ID NO: 8430385 - DNA, 22 bp, Homo sapiens
gatctggtacaggcctgcagcc

SEQ ID NO: 8430386 - DNA, 22 bp, Homo sapiens
gatctggtttcatcatggactt

SEQ ID NO: 8430387 - DNA, 22 bp, Homo sapiens
gatccacagggccctggcccag

SEQ ID NO: 8430388 - DNA, 22 bp, Homo sapiens
gatccacaggaaccaaaacgca

SEQ ID NO: 8430389 - DNA, 22 bp, Homo sapiens
gatccacagctgcggtaggaga

SEQ ID NO: 8430390 - DNA, 22 bp, Homo sapiens
gatccacagcccgcttgggccc

SEQ ID NO: 8430391 - DNA, 22 bp, Homo sapiens
gatccctgccctcagcctggac

SEQ ID NO: 8430392 - DNA, 21 bp, Homo sapiens
gatccactgacctggggatcc

SEQ ID NO: 8430393 - DNA, 22 bp, Homo sapiens
gatccacagtttgatgatcata

SEQ ID NO: 8430394 - DNA, 22 bp, Homo sapiens
gatccagcttctacacagagct

SEQ ID NO: 8430395 - DNA, 22 bp, Homo sapiens
gatccactgtgtttgtgttgag

SEQ ID NO: 8430396 - DNA, 22 bp, Homo sapiens
gaggctgcccaactggagtgga

SEQ ID NO: 8430397 - DNA, 22 bp, Homo sapiens
gaggcctgctttggcactctgg

SEQ ID NO: 8430398 - DNA, 22 bp, Homo sapiens
gaggcctgcagcgtggtccctg

SEQ ID NO: 8430399 - DNA, 22 bp, Homo sapiens
gaggcctgcagcgtggtccctg

SEQ ID NO: 8430400 - DNA, 22 bp, Homo sapiens
gaggcctgaggctgcctggagc

SEQ ID NO: 8430401 - DNA, 22 bp, Homo sapiens
gaggcctgaggctgcctggagc

SEQ ID NO: 8430402 - DNA, 22 bp, Homo sapiens
gaggctgcccacacctgcgccg

SEQ ID NO: 8430403 - DNA, 22 bp, Homo sapiens
gaggctggaatattagaaatgt

SEQ ID NO: 8430404 - DNA, 22 bp, Homo sapiens
gaggctggaggtcaaagatgaa

SEQ ID NO: 8430405 - DNA, 22 bp, Homo sapiens
gaggctggagatattccaatct

SEQ ID NO: 8430406 - DNA, 22 bp, Homo sapiens
gaggctggacgtgcatttctac

SEQ ID NO: 8430407 - DNA, 22 bp, Homo sapiens
gaggctggaggtcaaagatgaa

SEQ ID NO: 8430408 - DNA, 22 bp, Homo sapiens
gaggctggcagaaaagcacagg

SEQ ID NO: 8430409 - DNA, 22 bp, Homo sapiens
gagggatgcagaaacagaggcc

SEQ ID NO: 8430410 - DNA, 22 bp, Homo sapiens
gagggatggtagttgacactga

SEQ ID NO: 8430411 - DNA, 22 bp, Homo sapiens
gaggctgggggctgccttcctc

SEQ ID NO: 8430412 - DNA, 22 bp, Homo sapiens
gaggctgggaagtccaatatca

SEQ ID NO: 8430413 - DNA, 22 bp, Homo sapiens
gaggctgggaagtccaagatca

SEQ ID NO: 8430414 - DNA, 16 bp, Homo sapiens
gaggctggcagatgtc

SEQ ID NO: 8430415 - DNA, 22 bp, Homo sapiens
gaggctgggaagtccaagacca

SEQ ID NO: 8430416 - DNA, 22 bp, Homo sapiens
gaggctgggaagtccaagacca

SEQ ID NO: 8430417 - DNA, 22 bp, Homo sapiens
gagggcagtagcctcgtaccct

SEQ ID NO: 8430418 - DNA, 22 bp, Homo sapiens
gagggcagtagcctcgtaccct

SEQ ID NO: 8430419 - DNA, 22 bp, Homo sapiens
gaggggcaatgagggaaagagt

SEQ ID NO: 8430420 - DNA, 22 bp, Homo sapiens
gaggggcacagcagctgttgca

SEQ ID NO: 8430421 - DNA, 22 bp, Homo sapiens
gaggggcaagaagttggcctct

SEQ ID NO: 8430422 - DNA, 22 bp, Homo sapiens
gaggggatgcagagaggcttat

SEQ ID NO: 8430423 - DNA, 22 bp, Homo sapiens
gaggggagtgtcctccgggccc

SEQ ID NO: 8430424 - DNA, 22 bp, Homo sapiens
gaggggagtgtcctccgggccc

SEQ ID NO: 8430425 - DNA, 22 bp, Homo sapiens
gaggggcacagtaaagggtccc

SEQ ID NO: 8430426 - DNA, 22 bp, Homo sapiens
gaggggcacagtaaagggtccc

SEQ ID NO: 8430427 - DNA, 22 bp, Homo sapiens
gaggggcacagtaaagggtccc

SEQ ID NO: 8430428 - DNA, 21 bp, Homo sapiens
gaggggcagctcttagcatta

SEQ ID NO: 8430429 - DNA, 22 bp, Homo sapiens
gaggggcagaggtagagaacaa

SEQ ID NO: 8430430 - DNA, 22 bp, Homo sapiens
gaggggcagaggtagagaacaa

SEQ ID NO: 8430431 - DNA, 22 bp, Homo sapiens
gaggggcagtgcacccgggccc

SEQ ID NO: 8430432 - DNA, 19 bp, Homo sapiens
gaggtgggtccccgcagcc

SEQ ID NO: 8430433 - DNA, 22 bp, Homo sapiens
gaggtgggtgtatcacaggtca

SEQ ID NO: 8430434 - DNA, 22 bp, Homo sapiens
gaggtggtggtggaggcatagc

SEQ ID NO: 8430435 - DNA, 22 bp, Homo sapiens
gagtcagaaactcactctatag

SEQ ID NO: 8430436 - DNA, 22 bp, Homo sapiens
gagtcagaaagtagtgtgccta

SEQ ID NO: 8430437 - DNA, 22 bp, Homo sapiens
gaggtgtcatgagggcctgctc

SEQ ID NO: 8430438 - DNA, 22 bp, Homo sapiens
gagtccagttgttcacagaggc

SEQ ID NO: 8430439 - DNA, 22 bp, Homo sapiens
gagtccagagattaagcacctc

SEQ ID NO: 8430440 - DNA, 22 bp, Homo sapiens
gagtcaggctagggtgacaggc

SEQ ID NO: 8430441 - DNA, 22 bp, Homo sapiens
gagtcaggctagaggtgagtct

SEQ ID NO: 8430442 - DNA, 22 bp, Homo sapiens
gagtcaggagtcctgtgtgaga

SEQ ID NO: 8430443 - DNA, 22 bp, Homo sapiens
gagtcaggcatgaaggtaatta

SEQ ID NO: 8430444 - DNA, 22 bp, Homo sapiens
gagtcagatgaagataaaaggg

SEQ ID NO: 8430445 - DNA, 22 bp, Homo sapiens
gagtcagaccgactgggctcat

SEQ ID NO: 8430446 - DNA, 22 bp, Homo sapiens
gagtcagattgcagacagggct

SEQ ID NO: 8430447 - DNA, 22 bp, Homo sapiens
gagtcagaattgtattttaaac

SEQ ID NO: 8430448 - DNA, 22 bp, Homo sapiens
gagtcagaatgtcctcctgcgg

SEQ ID NO: 8430449 - DNA, 22 bp, Homo sapiens
gagtcagacagggtcacccaga

SEQ ID NO: 8430450 - DNA, 22 bp, Homo sapiens
gagtcagaagaaactatttaca

SEQ ID NO: 8430451 - DNA, 22 bp, Homo sapiens
gaggtgggcggatcacaaggtc

SEQ ID NO: 8430452 - DNA, 22 bp, Homo sapiens
gaggtgggcggatcacaaggtc

SEQ ID NO: 8430453 - DNA, 22 bp, Homo sapiens
gaggtgggatgtgtgtgctact

SEQ ID NO: 8430454 - DNA, 22 bp, Homo sapiens
gaggtccatacagctattctac

SEQ ID NO: 8430455 - DNA, 22 bp, Homo sapiens
gaggtccagggtggggcctgag

SEQ ID NO: 8430456 - DNA, 22 bp, Homo sapiens
gaggtccagggtggggcctgag

SEQ ID NO: 8430457 - DNA, 22 bp, Homo sapiens
gaggtccagccaagcggcaagg

SEQ ID NO: 8430458 - DNA, 22 bp, Homo sapiens
gaggtccagagcaggttcagtg

SEQ ID NO: 8430459 - DNA, 22 bp, Homo sapiens
gaggtcaggcttgcagcagggt

SEQ ID NO: 8430460 - DNA, 22 bp, Homo sapiens
gaggtcaggcttgcagcagggt

SEQ ID NO: 8430461 - DNA, 22 bp, Homo sapiens
gaggtaacactgttcagtgggc

SEQ ID NO: 8430462 - DNA, 22 bp, Homo sapiens
gaggtaacactgttcagtgggc

SEQ ID NO: 8430463 - DNA, 22 bp, Homo sapiens
gaggtatcttagagagtgtaga

SEQ ID NO: 8430464 - DNA, 22 bp, Homo sapiens
gaggtatcttagagagtgtaga

SEQ ID NO: 8430465 - DNA, 22 bp, Homo sapiens
gaggggcctggcactgagctgg

SEQ ID NO: 8430466 - DNA, 22 bp, Homo sapiens
gaggggctctttaatagtaaca

SEQ ID NO: 8430467 - DNA, 22 bp, Homo sapiens
gagagtctaggaacctcatata

SEQ ID NO: 8430468 - DNA, 22 bp, Homo sapiens
gagagtctagtgcacctagttt

SEQ ID NO: 8430469 - DNA, 22 bp, Homo sapiens
gagagtggatggagctgcgaag

SEQ ID NO: 8430470 - DNA, 22 bp, Homo sapiens
gagataataatagtacctatct

SEQ ID NO: 8430471 - DNA, 22 bp, Homo sapiens
gagataaagctaccatgttgat

SEQ ID NO: 8430472 - DNA, 22 bp, Homo sapiens
gagagttcttgcctgggtatta

SEQ ID NO: 8430473 - DNA, 22 bp, Homo sapiens
gagatatgttggcagctggtat

SEQ ID NO: 8430474 - DNA, 22 bp, Homo sapiens
gagatccacttaatttttttgc

SEQ ID NO: 8430475 - DNA, 22 bp, Homo sapiens
gagatccagatttccattcctt

SEQ ID NO: 8430476 - DNA, 22 bp, Homo sapiens
gagctggcagtggtagacatgg

SEQ ID NO: 8430477 - DNA, 22 bp, Homo sapiens
gagctggcaatgacttgtgtat

SEQ ID NO: 8430478 - DNA, 22 bp, Homo sapiens
gagctggcacagaaggatctta

SEQ ID NO: 8430479 - DNA, 22 bp, Homo sapiens
gagctggcacagaaggatctta

SEQ ID NO: 8430480 - DNA, 22 bp, Homo sapiens
gagctggaggcagtgctgaggt

SEQ ID NO: 8430481 - DNA, 22 bp, Homo sapiens
gagctggaggaccaggactggg

SEQ ID NO: 8430482 - DNA, 22 bp, Homo sapiens
gagctggaggaccaggactggg

SEQ ID NO: 8430483 - DNA, 22 bp, Homo sapiens
gagctgcttgcccagaagcaga

SEQ ID NO: 8430484 - DNA, 22 bp, Homo sapiens
gagctggctgtggttgagtgca

SEQ ID NO: 8430485 - DNA, 22 bp, Homo sapiens
gagctggctccgccatgctgct

SEQ ID NO: 8430486 - DNA, 22 bp, Homo sapiens
gagctggctaatactgacttat

SEQ ID NO: 8430487 - DNA, 22 bp, Homo sapiens
gagctggctccgccatgctgct

SEQ ID NO: 8430488 - DNA, 22 bp, Homo sapiens
gagctggcctcaggcacaggag

SEQ ID NO: 8430489 - DNA, 22 bp, Homo sapiens
gagctggccgcagagagggcag

SEQ ID NO: 8430490 - DNA, 22 bp, Homo sapiens
gaggaaggtcccatcagaattt

SEQ ID NO: 8430491 - DNA, 22 bp, Homo sapiens
gaggaagagagctctgccttgt

SEQ ID NO: 8430492 - DNA, 22 bp, Homo sapiens
gagctgggacttggaatccaca

SEQ ID NO: 8430493 - DNA, 22 bp, Homo sapiens
gagctgggacttggaatccaca

SEQ ID NO: 8430494 - DNA, 22 bp, Homo sapiens
gagctgggagttatagcatgtt

SEQ ID NO: 8430495 - DNA, 22 bp, Homo sapiens
gagctgggagttatagcatgtt

SEQ ID NO: 8430496 - DNA, 22 bp, Homo sapiens
gaggacacaaagtggctgagat

SEQ ID NO: 8430497 - DNA, 22 bp, Homo sapiens
gaggaatgtcagcacaggcctc

SEQ ID NO: 8430498 - DNA, 22 bp, Homo sapiens
gaggaatgttattaaaggagct

SEQ ID NO: 8430499 - DNA, 21 bp, Homo sapiens
gaggaatggtttgcaaagcac

SEQ ID NO: 8430500 - DNA, 21 bp, Homo sapiens
gaggaatggtttgcaaagcac

SEQ ID NO: 8430501 - DNA, 22 bp, Homo sapiens
gaggaatgggtgtctcgtgatt

SEQ ID NO: 8430502 - DNA, 22 bp, Homo sapiens
gaggaatgggtgtctcgtgatt

SEQ ID NO: 8430503 - DNA, 22 bp, Homo sapiens
gaggaaggtcccatcagaattt

SEQ ID NO: 8430504 - DNA, 22 bp, Homo sapiens
gaggacagcttagggcttcctg

SEQ ID NO: 8430505 - DNA, 22 bp, Homo sapiens
gaggacagcttagggcttcctg

SEQ ID NO: 8430506 - DNA, 22 bp, Homo sapiens
gaggacacggccttttggaaaa

SEQ ID NO: 8430507 - DNA, 22 bp, Homo sapiens
gaggacacctcacagcctcaca

SEQ ID NO: 8430508 - DNA, 22 bp, Homo sapiens
gaggacagagccgcctggcaag

SEQ ID NO: 8430509 - DNA, 22 bp, Homo sapiens
gaggacagagccgcctggcaag

SEQ ID NO: 8430510 - DNA, 22 bp, Homo sapiens
gaggacagagccgcctggcaag

SEQ ID NO: 8430511 - DNA, 20 bp, Homo sapiens
gaggcctcagcctcagctcc

SEQ ID NO: 8430512 - DNA, 22 bp, Homo sapiens
gaggcccagtggagggccatgg

SEQ ID NO: 8430513 - DNA, 22 bp, Homo sapiens
gaggcccagtcctgcaagcacg

SEQ ID NO: 8430514 - DNA, 22 bp, Homo sapiens
gaggcctcaggcgtgggaaggg

SEQ ID NO: 8430515 - DNA, 22 bp, Homo sapiens
gaggcctcctctgagacatctg

SEQ ID NO: 8430516 - DNA, 22 bp, Homo sapiens
gaggcctcatgaggtgagcatt

SEQ ID NO: 8430517 - DNA, 22 bp, Homo sapiens
gaggcctcaggaatgtcgtgtg

SEQ ID NO: 8430518 - DNA, 22 bp, Homo sapiens
gaggcctcagcctgccctgaac

SEQ ID NO: 8430519 - DNA, 20 bp, Homo sapiens
gaggcctcagcctcagctcc

SEQ ID NO: 8430520 - DNA, 22 bp, Homo sapiens
gaggcctgaaaggggacctatg

SEQ ID NO: 8430521 - DNA, 18 bp, Homo sapiens
gaggcctgagaaccaggt

SEQ ID NO: 8430522 - DNA, 22 bp, Homo sapiens
gaggcagctgggatacaaggga

SEQ ID NO: 8430523 - DNA, 22 bp, Homo sapiens
gaggcagctgggatacaaggga

SEQ ID NO: 8430524 - DNA, 22 bp, Homo sapiens
gaggcagctgaaggagtgacag

SEQ ID NO: 8430525 - DNA, 22 bp, Homo sapiens
gaggcccagcattcagggcagg

SEQ ID NO: 8430526 - DNA, 22 bp, Homo sapiens
gaggcccagcattcagggcagg

SEQ ID NO: 8430527 - DNA, 22 bp, Homo sapiens
gaggcccaggtcaagcagccac

SEQ ID NO: 8430528 - DNA, 22 bp, Homo sapiens
gaggcccagggtacaggccgct

SEQ ID NO: 8430529 - DNA, 23 bp, Homo sapiens
gaggcagctcctgcagtgccctg

SEQ ID NO: 8430530 - DNA, 23 bp, Homo sapiens
gaggcagctcctgcagtgccctg

SEQ ID NO: 8430531 - DNA, 22 bp, Homo sapiens
gaggcagctgaagcttcaaaga

SEQ ID NO: 8430532 - DNA, 22 bp, Homo sapiens
gaggcagctcttctgaatgggg

SEQ ID NO: 8430533 - DNA, 18 bp, Homo sapiens
gaggcagctagcaatttt

SEQ ID NO: 8430534 - DNA, 22 bp, Homo sapiens
gaggagggagctggaagctctt

SEQ ID NO: 8430535 - DNA, 22 bp, Homo sapiens
gaggagggagctggaagctctt

SEQ ID NO: 8430536 - DNA, 22 bp, Homo sapiens
gaggagggagctggaagctctt

SEQ ID NO: 8430537 - DNA, 23 bp, Homo sapiens
gaggagggtctgacaagtgtagc

SEQ ID NO: 8430538 - DNA, 22 bp, Homo sapiens
gaggagggagaattaggcttaa

SEQ ID NO: 8430539 - DNA, 22 bp, Homo sapiens
gaggaggctgtttctctgcatt

SEQ ID NO: 8430540 - DNA, 22 bp, Homo sapiens
gaggaggctggcgccgcctgcc

SEQ ID NO: 8430541 - DNA, 22 bp, Homo sapiens
gaggaggcttccgggaggcacg

SEQ ID NO: 8430542 - DNA, 22 bp, Homo sapiens
gaggaggcttccgggaggcacg

SEQ ID NO: 8430543 - DNA, 19 bp, Homo sapiens
gaggaggcttcagctttct

SEQ ID NO: 8430544 - DNA, 22 bp, Homo sapiens
gaggagggttggccttaggtag

SEQ ID NO: 8430545 - DNA, 22 bp, Homo sapiens
gaggagggttggccttaggtag

SEQ ID NO: 8430546 - DNA, 22 bp, Homo sapiens
gaggagggttggccttaggtag

SEQ ID NO: 8430547 - DNA, 22 bp, Homo sapiens
gaggcagaggttgcagtgagct

SEQ ID NO: 8430548 - DNA, 22 bp, Homo sapiens
gaggcagagtcacaaagagtct

SEQ ID NO: 8430549 - DNA, 22 bp, Homo sapiens
gaggcagagtcacaaagagtct

SEQ ID NO: 8430550 - DNA, 22 bp, Homo sapiens
gaggcagagtgcaccccaggag

SEQ ID NO: 8430551 - DNA, 22 bp, Homo sapiens
gaggcagcaataaaaagaattt

SEQ ID NO: 8430552 - DNA, 22 bp, Homo sapiens
ggccttctgcctttcagcaatg

SEQ ID NO: 8430553 - DNA, 22 bp, Homo sapiens
ggccttgacagttaagagacct

SEQ ID NO: 8430554 - DNA, 22 bp, Homo sapiens
ggccttgagagccagtgcaggc

SEQ ID NO: 8430555 - DNA, 22 bp, Homo sapiens
ggccttgatcctccagagcact

SEQ ID NO: 8430556 - DNA, 22 bp, Homo sapiens
ggccttgagagccagtgcaggc

SEQ ID NO: 8430557 - DNA, 22 bp, Homo sapiens
ggccttgagcagggagaaacca

SEQ ID NO: 8430558 - DNA, 22 bp, Homo sapiens
ggccttgcggaacgctcaggcg

SEQ ID NO: 8430559 - DNA, 22 bp, Homo sapiens
ggccttgcctcaatagctccac

SEQ ID NO: 8430560 - DNA, 22 bp, Homo sapiens
ggccttgatcctccagagcact

SEQ ID NO: 8430561 - DNA, 22 bp, Homo sapiens
ggccttgatctctctaactgct

SEQ ID NO: 8430562 - DNA, 22 bp, Homo sapiens
ggccttgcagccacagaacaca

SEQ ID NO: 8430563 - DNA, 19 bp, Homo sapiens
ggccttgatgagtggggag

SEQ ID NO: 8430564 - DNA, 22 bp, Homo sapiens
ggccttgatgttcttgggagat

SEQ ID NO: 8430565 - DNA, 19 bp, Homo sapiens
ggccttgctctgtggcagc

SEQ ID NO: 8430566 - DNA, 22 bp, Homo sapiens
ggccttgctgcttccagaaggt

SEQ ID NO: 8430567 - DNA, 22 bp, Homo sapiens
ggccttcctgttgtgtccaccg

SEQ ID NO: 8430568 - DNA, 22 bp, Homo sapiens
ggccttccttcccagcctactg

SEQ ID NO: 8430569 - DNA, 21 bp, Homo sapiens
ggccttcccctgcagtctccg

SEQ ID NO: 8430570 - DNA, 22 bp, Homo sapiens
ggccttcctgctgctccgggcc

SEQ ID NO: 8430571 - DNA, 22 bp, Homo sapiens
ggccttcctgctgctccgggcc

SEQ ID NO: 8430572 - DNA, 22 bp, Homo sapiens
ggccttcctggcggctcagggt

SEQ ID NO: 8430573 - DNA, 22 bp, Homo sapiens
ggccttccatctgcctctgttt

SEQ ID NO: 8430574 - DNA, 22 bp, Homo sapiens
ggccttccatctgcctctgttt

SEQ ID NO: 8430575 - DNA, 22 bp, Homo sapiens
ggccttccattgctcttttcta

SEQ ID NO: 8430576 - DNA, 21 bp, Homo sapiens
ggccttcccctgcagtctccg

SEQ ID NO: 8430577 - DNA, 22 bp, Homo sapiens
ggccttcacgtgacctggcgtg

SEQ ID NO: 8430578 - DNA, 22 bp, Homo sapiens
ggccttagtgaggtcctgatgc

SEQ ID NO: 8430579 - DNA, 18 bp, Homo sapiens
ggccttagtatgtgcctt

SEQ ID NO: 8430580 - DNA, 22 bp, Homo sapiens
ggccttaggttccctgcctcca

SEQ ID NO: 8430581 - DNA, 20 bp, Homo sapiens
ggccttagggagggctgtaa

SEQ ID NO: 8430582 - DNA, 22 bp, Homo sapiens
ggccttaggctcaacaggcaga

SEQ ID NO: 8430583 - DNA, 22 bp, Homo sapiens
ggccttagagaccacctagtct

SEQ ID NO: 8430584 - DNA, 22 bp, Homo sapiens
ggccttagcggtcatagcaaag

SEQ ID NO: 8430585 - DNA, 22 bp, Homo sapiens
ggccttagctgtctttcctttg

SEQ ID NO: 8430586 - DNA, 22 bp, Homo sapiens
ggccctgcaaggtacccaggcc

SEQ ID NO: 8430587 - DNA, 22 bp, Homo sapiens
ggccctgatacaagtaaggtct

SEQ ID NO: 8430588 - DNA, 22 bp, Homo sapiens
ggccctgcatgagattaaggtt

SEQ ID NO: 8430589 - DNA, 22 bp, Homo sapiens
ggccctgcgattaggtggcagg

SEQ ID NO: 8430590 - DNA, 22 bp, Homo sapiens
ggccctgcaaggtacccaggcc

SEQ ID NO: 8430591 - DNA, 22 bp, Homo sapiens
ggccctgagtctagctgctctt

SEQ ID NO: 8430592 - DNA, 23 bp, Homo sapiens
ggcctgtgttttgtctgaagtac

SEQ ID NO: 8430593 - DNA, 22 bp, Homo sapiens
ggcctgggcccactgtcaagag

SEQ ID NO: 8430594 - DNA, 22 bp, Homo sapiens
ggccctgaagtgattgtgagtt

SEQ ID NO: 8430595 - DNA, 22 bp, Homo sapiens
ggccctcttttatccatcataa

SEQ ID NO: 8430596 - DNA, 22 bp, Homo sapiens
ggccctctgtggctgccatgga

SEQ ID NO: 8430597 - DNA, 22 bp, Homo sapiens
ggccctctgctcacttcctatt

SEQ ID NO: 8430598 - DNA, 22 bp, Homo sapiens
ggccctccctgagccaggtggg

SEQ ID NO: 8430599 - DNA, 22 bp, Homo sapiens
ggccctcccggtgatgaagagc

SEQ ID NO: 8430600 - DNA, 22 bp, Homo sapiens
ggctccaccctgcttccagaag

SEQ ID NO: 8430601 - DNA, 22 bp, Homo sapiens
ggctcctgcacctgtccctctg

SEQ ID NO: 8430602 - DNA, 22 bp, Homo sapiens
ggctcctggaaagccctcgctc

SEQ ID NO: 8430603 - DNA, 22 bp, Homo sapiens
ggctcctgcacctgtccctctg

SEQ ID NO: 8430604 - DNA, 23 bp, Homo sapiens
ggctcctgcttcatgtcccacct

SEQ ID NO: 8430605 - DNA, 22 bp, Homo sapiens
ggctcctgctgtcctttgaagc

SEQ ID NO: 8430606 - DNA, 22 bp, Homo sapiens
ggctcaggtttaaagtgcttta

SEQ ID NO: 8430607 - DNA, 22 bp, Homo sapiens
ggctcaggtttaaagtgcttta

SEQ ID NO: 8430608 - DNA, 22 bp, Homo sapiens
ggctcaggtttccttcccagct

SEQ ID NO: 8430609 - DNA, 22 bp, Homo sapiens
ggctcaggtttccttcccagct

SEQ ID NO: 8430610 - DNA, 20 bp, Homo sapiens
ggctcatcttgtctgctgac

SEQ ID NO: 8430611 - DNA, 22 bp, Homo sapiens
ggctcaggactgcagcgtagag

SEQ ID NO: 8430612 - DNA, 22 bp, Homo sapiens
ggctcaggactgcagcgtagag

SEQ ID NO: 8430613 - DNA, 22 bp, Homo sapiens
ggctcaggagaggggctaaaag

SEQ ID NO: 8430614 - DNA, 22 bp, Homo sapiens
ggctcaggagaggggctaaaag

SEQ ID NO: 8430615 - DNA, 22 bp, Homo sapiens
ggctcaggatgagccttctcat

SEQ ID NO: 8430616 - DNA, 22 bp, Homo sapiens
ggctcaggatgagccttctcat

SEQ ID NO: 8430617 - DNA, 22 bp, Homo sapiens
ggctcaggccagaccacgactc

SEQ ID NO: 8430618 - DNA, 22 bp, Homo sapiens
ggctcaggccagaccacgactc

SEQ ID NO: 8430619 - DNA, 22 bp, Homo sapiens
ggctcagcttggtgcgcagaaa

SEQ ID NO: 8430620 - DNA, 22 bp, Homo sapiens
ggctcagcttggtgcgcagaaa

SEQ ID NO: 8430621 - DNA, 22 bp, Homo sapiens
ggctcagcttggtgcgcagaaa

SEQ ID NO: 8430622 - DNA, 22 bp, Homo sapiens
ggctcaggactgcagcgtagag

SEQ ID NO: 8430623 - DNA, 22 bp, Homo sapiens
ggctcaggacctgggattgcca

SEQ ID NO: 8430624 - DNA, 22 bp, Homo sapiens
ggctcaggacctgggattgcca

SEQ ID NO: 8430625 - DNA, 22 bp, Homo sapiens
ggctcaggacctgggattgcca

SEQ ID NO: 8430626 - DNA, 22 bp, Homo sapiens
ggctcaggacacagtggtttag

SEQ ID NO: 8430627 - DNA, 22 bp, Homo sapiens
ggctcaggacacagtggtttag

SEQ ID NO: 8430628 - DNA, 22 bp, Homo sapiens
ggctcagcttatctgggcaggc

SEQ ID NO: 8430629 - DNA, 22 bp, Homo sapiens
ggccttggatccaagctgcggc

SEQ ID NO: 8430630 - DNA, 22 bp, Homo sapiens
ggccccagttcactcctggccg

SEQ ID NO: 8430631 - DNA, 22 bp, Homo sapiens
ggccccagttcactcctggccg

SEQ ID NO: 8430632 - DNA, 21 bp, Homo sapiens
ggccccgcagacccagcacgt

SEQ ID NO: 8430633 - DNA, 22 bp, Homo sapiens
ggcccctcagcatctgagtcag

SEQ ID NO: 8430634 - DNA, 19 bp, Homo sapiens
ggcccctctcacaggagtt

SEQ ID NO: 8430635 - DNA, 22 bp, Homo sapiens
ggcccctgcggactgcctagag

SEQ ID NO: 8430636 - DNA, 22 bp, Homo sapiens
ggccccagattctgggctgggt

SEQ ID NO: 8430637 - DNA, 22 bp, Homo sapiens
ggccccaaatgtcaatagtact

SEQ ID NO: 8430638 - DNA, 22 bp, Homo sapiens
ggcccagcgaggccacctacag

SEQ ID NO: 8430639 - DNA, 22 bp, Homo sapiens
ggcccagccttggggtttcttt

SEQ ID NO: 8430640 - DNA, 22 bp, Homo sapiens
ggcccagcctggcaacaatgac

SEQ ID NO: 8430641 - DNA, 22 bp, Homo sapiens
ggcccagcctcagacatgccct

SEQ ID NO: 8430642 - DNA, 22 bp, Homo sapiens
ggcccagcctcagacatgccct

SEQ ID NO: 8430643 - DNA, 17 bp, Homo sapiens
ggccatggtgcaaggtt

SEQ ID NO: 8430644 - DNA, 20 bp, Homo sapiens
ggccatgggttgcctgaggt

SEQ ID NO: 8430645 - DNA, 22 bp, Homo sapiens
ggcccacactgacagctgagct

SEQ ID NO: 8430646 - DNA, 22 bp, Homo sapiens
ggcccagccggcgagtctcgcg

SEQ ID NO: 8430647 - DNA, 22 bp, Homo sapiens
ggcccagaaaaaggcttagaat

SEQ ID NO: 8430648 - DNA, 22 bp, Homo sapiens
ggccagaagttggaaaagagcc

SEQ ID NO: 8430649 - DNA, 22 bp, Homo sapiens
ggccagacatatcgctcccaaa

SEQ ID NO: 8430650 - DNA, 22 bp, Homo sapiens
ggccagagaagtcagacccttg

SEQ ID NO: 8430651 - DNA, 22 bp, Homo sapiens
ggccagagaagtcagacccttg

SEQ ID NO: 8430652 - DNA, 22 bp, Homo sapiens
ggccagaagttggaaaagagcc

SEQ ID NO: 8430653 - DNA, 22 bp, Homo sapiens
ggcaggtgcttgtcgaaggcct

SEQ ID NO: 8430654 - DNA, 22 bp, Homo sapiens
ggcaggtgcttgtcgaaggcct

SEQ ID NO: 8430655 - DNA, 22 bp, Homo sapiens
ggcaggtgctgggagcatctca

SEQ ID NO: 8430656 - DNA, 22 bp, Homo sapiens
ggcaggtgctctgtgggcctgg

SEQ ID NO: 8430657 - DNA, 22 bp, Homo sapiens
ggcaggtgctctgtgggcctgg

SEQ ID NO: 8430658 - DNA, 22 bp, Homo sapiens
ggcaggtgctctgtgggcctgg

SEQ ID NO: 8430659 - DNA, 17 bp, Homo sapiens
ggccagaggcggggctg

SEQ ID NO: 8430660 - DNA, 22 bp, Homo sapiens
ggccagaggtggtacatagctt

SEQ ID NO: 8430661 - DNA, 22 bp, Homo sapiens
ggccagaggtgtcctcagttct

SEQ ID NO: 8430662 - DNA, 22 bp, Homo sapiens
ggccagaggtgtcctcagttct

SEQ ID NO: 8430663 - DNA, 18 bp, Homo sapiens
ggccagagggagggtccc

SEQ ID NO: 8430664 - DNA, 22 bp, Homo sapiens
ggccagaggccacagctgtgtc

SEQ ID NO: 8430665 - DNA, 22 bp, Homo sapiens
ggccagaggccacagctgtgtc

SEQ ID NO: 8430666 - DNA, 22 bp, Homo sapiens
ggccagaggacctctcatagcc

SEQ ID NO: 8430667 - DNA, 22 bp, Homo sapiens
ggccagaggccatcctcctgct

SEQ ID NO: 8430668 - DNA, 22 bp, Homo sapiens
ggccagaggccacagctgtgtc

SEQ ID NO: 8430669 - DNA, 22 bp, Homo sapiens
ggccagagaatatgccttacgt

SEQ ID NO: 8430670 - DNA, 22 bp, Homo sapiens
ggccagagaatatgccttacgt

SEQ ID NO: 8430671 - DNA, 22 bp, Homo sapiens
ggccagagagcagccaggattc

SEQ ID NO: 8430672 - DNA, 22 bp, Homo sapiens
ggccagagagcagccaggattc

SEQ ID NO: 8430673 - DNA, 22 bp, Homo sapiens
ggccagagagcagccaggattc

SEQ ID NO: 8430674 - DNA, 22 bp, Homo sapiens
ggccagagagccgctgttagga

SEQ ID NO: 8430675 - DNA, 22 bp, Homo sapiens
ggctcctggggaggtgagcttg

SEQ ID NO: 8430676 - DNA, 22 bp, Homo sapiens
ggctccttcaaagcacctggct

SEQ ID NO: 8430677 - DNA, 22 bp, Homo sapiens
ggctccttatctctcctatgcc

SEQ ID NO: 8430678 - DNA, 22 bp, Homo sapiens
ggctctcagggaaaggcctccc

SEQ ID NO: 8430679 - DNA, 22 bp, Homo sapiens
ggctccttcaagcctgtcactg

SEQ ID NO: 8430680 - DNA, 20 bp, Homo sapiens
ggctccttctttcatggccc

SEQ ID NO: 8430681 - DNA, 22 bp, Homo sapiens
ggctcctgggagatagaggtca

SEQ ID NO: 8430682 - DNA, 22 bp, Homo sapiens
ggctcctgggcagctgctccct

SEQ ID NO: 8430683 - DNA, 22 bp, Homo sapiens
ggctcctgggcagctgctccct

SEQ ID NO: 8430684 - DNA, 22 bp, Homo sapiens
ggctcctgggcagctgctccct

SEQ ID NO: 8430685 - DNA, 22 bp, Homo sapiens
ggctcctggaaagccctcgctc

SEQ ID NO: 8430686 - DNA, 22 bp, Homo sapiens
ggctcctggaaagccctcgctc

SEQ ID NO: 8430687 - DNA, 22 bp, Homo sapiens
ggctcctggaggcaccactggt

SEQ ID NO: 8430688 - DNA, 22 bp, Homo sapiens
ggctcctggaggcaccactggt

SEQ ID NO: 8430689 - DNA, 23 bp, Homo sapiens
ggctcctggattcaaatcctgcc

SEQ ID NO: 8430690 - DNA, 22 bp, Homo sapiens
ggctcctggcatctggtgggta

SEQ ID NO: 8430691 - DNA, 19 bp, Homo sapiens
ggctctcccttgagagagc

SEQ ID NO: 8430692 - DNA, 19 bp, Homo sapiens
ggctctcccttgagagagc

SEQ ID NO: 8430693 - DNA, 22 bp, Homo sapiens
ggctgatgagcttagctagaga

SEQ ID NO: 8430694 - DNA, 22 bp, Homo sapiens
ggctgcagagctggtgccctgg

SEQ ID NO: 8430695 - DNA, 22 bp, Homo sapiens
ggctgcagagctggtgccctgg

SEQ ID NO: 8430696 - DNA, 22 bp, Homo sapiens
ggctgcagagctggtgccctgg

SEQ ID NO: 8430697 - DNA, 22 bp, Homo sapiens
ggctgcagaggcccccagtggg

SEQ ID NO: 8430698 - DNA, 22 bp, Homo sapiens
ggctgcagaggcgatctgaggt

SEQ ID NO: 8430699 - DNA, 22 bp, Homo sapiens
ggctgcagagctgggtgggcct

SEQ ID NO: 8430700 - DNA, 22 bp, Homo sapiens
ggctgcagagctgggtgggcct

SEQ ID NO: 8430701 - DNA, 19 bp, Homo sapiens
ggctgcagagccccggcgc

SEQ ID NO: 8430702 - DNA, 22 bp, Homo sapiens
ggctgcaggatgcccagccgtg

SEQ ID NO: 8430703 - DNA, 22 bp, Homo sapiens
ggctgcaggaacgacggagggg

SEQ ID NO: 8430704 - DNA, 22 bp, Homo sapiens
ggctgcaggcagaggctgtctg

SEQ ID NO: 8430705 - DNA, 22 bp, Homo sapiens
ggctgcaggcagaggctgtctg

SEQ ID NO: 8430706 - DNA, 22 bp, Homo sapiens
ggctgcaggcagaggctgtctg

SEQ ID NO: 8430707 - DNA, 22 bp, Homo sapiens
ggctgccttcatagaccatggg

SEQ ID NO: 8430708 - DNA, 22 bp, Homo sapiens
ggctgccttcagactccagctt

SEQ ID NO: 8430709 - DNA, 22 bp, Homo sapiens
ggctgcctgttgagtatgtccc

SEQ ID NO: 8430710 - DNA, 21 bp, Homo sapiens
ggctgcctgggaagaagaaga

SEQ ID NO: 8430711 - DNA, 22 bp, Homo sapiens
ggctgcctgtgcccaggcacac

SEQ ID NO: 8430712 - DNA, 22 bp, Homo sapiens
ggctgcctgtgcccaggcacac

SEQ ID NO: 8430713 - DNA, 22 bp, Homo sapiens
ggctggctacattggaggaagg

SEQ ID NO: 8430714 - DNA, 22 bp, Homo sapiens
ggctggcgctctcccagcgctg

SEQ ID NO: 8430715 - DNA, 22 bp, Homo sapiens
ggctggcctcagggtcctcgct

SEQ ID NO: 8430716 - DNA, 22 bp, Homo sapiens
ggctgctcggcagctcctgagc

SEQ ID NO: 8430717 - DNA, 22 bp, Homo sapiens
ggctgctcggagcctcctgtga

SEQ ID NO: 8430718 - DNA, 22 bp, Homo sapiens
ggctgccttgaccctggctccg

SEQ ID NO: 8430719 - DNA, 19 bp, Homo sapiens
ggctgccttctgctcatct

SEQ ID NO: 8430720 - DNA, 19 bp, Homo sapiens
ggctgccttctgctcatct

SEQ ID NO: 8430721 - DNA, 22 bp, Homo sapiens
ggctgccttccctgagccccgg

SEQ ID NO: 8430722 - DNA, 22 bp, Homo sapiens
ggctgccttccctgagccccgg

SEQ ID NO: 8430723 - DNA, 22 bp, Homo sapiens
ggctgccttccctgagccccgg

SEQ ID NO: 8430724 - DNA, 22 bp, Homo sapiens
ggctgctctgccttccagctgg

SEQ ID NO: 8430725 - DNA, 22 bp, Homo sapiens
ggctgctctgccttccagctgg

SEQ ID NO: 8430726 - DNA, 22 bp, Homo sapiens
ggctgctctccatcccaggcct

SEQ ID NO: 8430727 - DNA, 22 bp, Homo sapiens
ggctgctcggagcctcctgtga

SEQ ID NO: 8430728 - DNA, 22 bp, Homo sapiens
ggctgctctgagagtgggtttt

SEQ ID NO: 8430729 - DNA, 22 bp, Homo sapiens
ggctgtggtggcatccctgagc

SEQ ID NO: 8430730 - DNA, 22 bp, Homo sapiens
ggctggcttgccaagctcaggg

SEQ ID NO: 8430731 - DNA, 22 bp, Homo sapiens
ggctggctgtgccctgtactct

SEQ ID NO: 8430732 - DNA, 22 bp, Homo sapiens
ggctggctggctggtagacaag

SEQ ID NO: 8430733 - DNA, 22 bp, Homo sapiens
ggctggctggctggtagacaag

SEQ ID NO: 8430734 - DNA, 22 bp, Homo sapiens
ggctggctggcttagcagagga

SEQ ID NO: 8430735 - DNA, 22 bp, Homo sapiens
ggctggctgataaagggttgag

SEQ ID NO: 8430736 - DNA, 22 bp, Homo sapiens
ggctggctcttaccgacagcgt

SEQ ID NO: 8430737 - DNA, 22 bp, Homo sapiens
ggctggctgcatgccccctcct

SEQ ID NO: 8430738 - DNA, 22 bp, Homo sapiens
ggctggctggatgaatggatta

SEQ ID NO: 8430739 - DNA, 22 bp, Homo sapiens
ggctggctatctgtggttgcct

SEQ ID NO: 8430740 - DNA, 22 bp, Homo sapiens
ggctggctatctgtggttgcct

SEQ ID NO: 8430741 - DNA, 22 bp, Homo sapiens
ggctggctcagggcttgagaga

SEQ ID NO: 8430742 - DNA, 22 bp, Homo sapiens
ggctggctccacctaggtagct

SEQ ID NO: 8430743 - DNA, 22 bp, Homo sapiens
ggctggctccacctaggtagct

SEQ ID NO: 8430744 - DNA, 22 bp, Homo sapiens
ggcttcatctcgttgacacctc

SEQ ID NO: 8430745 - DNA, 22 bp, Homo sapiens
ggcttcatggagttctacacca

SEQ ID NO: 8430746 - DNA, 22 bp, Homo sapiens
ggcttcccagtccctgctctca

SEQ ID NO: 8430747 - DNA, 22 bp, Homo sapiens
ggcttcccagcagagggcgcac

SEQ ID NO: 8430748 - DNA, 22 bp, Homo sapiens
ggcttcccaaggagccaggatg

SEQ ID NO: 8430749 - DNA, 17 bp, Homo sapiens
ggcttccaggtggctct

SEQ ID NO: 8430750 - DNA, 22 bp, Homo sapiens
ggcttccagctgggccttggag

SEQ ID NO: 8430751 - DNA, 22 bp, Homo sapiens
ggcttccctaaacctttccact

SEQ ID NO: 8430752 - DNA, 18 bp, Homo sapiens
ggcttccctactcacttc

SEQ ID NO: 8430753 - DNA, 22 bp, Homo sapiens
ggcttccctaaacctttccact

SEQ ID NO: 8430754 - DNA, 18 bp, Homo sapiens
ggcttccctactcacttc

SEQ ID NO: 8430755 - DNA, 22 bp, Homo sapiens
ggcttccctgcctcacttattc

SEQ ID NO: 8430756 - DNA, 22 bp, Homo sapiens
ggcttccctttccgagaggaga

SEQ ID NO: 8430757 - DNA, 22 bp, Homo sapiens
ggcttccctgtttgctgtgcct

SEQ ID NO: 8430758 - DNA, 22 bp, Homo sapiens
ggcttcccctccagtgctctgt

SEQ ID NO: 8430759 - DNA, 20 bp, Homo sapiens
ggcttccccgccatcttccg

SEQ ID NO: 8430760 - DNA, 22 bp, Homo sapiens
gggaaaggatttacagtttgat

SEQ ID NO: 8430761 - DNA, 22 bp, Homo sapiens
ggctttgtggggtgaagtaaag

SEQ ID NO: 8430762 - DNA, 22 bp, Homo sapiens
gggaaaggatcagtgggaggct

SEQ ID NO: 8430763 - DNA, 22 bp, Homo sapiens
ggcttctccaggtactgagcat

SEQ ID NO: 8430764 - DNA, 22 bp, Homo sapiens
ggctttgctttggctgtttcag

SEQ ID NO: 8430765 - DNA, 22 bp, Homo sapiens
ggcttcctttcactaccctcag

SEQ ID NO: 8430766 - DNA, 22 bp, Homo sapiens
ggcttctcagcacactgtccac

SEQ ID NO: 8430767 - DNA, 18 bp, Homo sapiens
ggcttctcactgacctca

SEQ ID NO: 8430768 - DNA, 22 bp, Homo sapiens
ggcttcctttcactaccctcag

SEQ ID NO: 8430769 - DNA, 22 bp, Homo sapiens
ggcttcctgggcatgtgttcta

SEQ ID NO: 8430770 - DNA, 22 bp, Homo sapiens
ggcttcctggggcctcctgcaa

SEQ ID NO: 8430771 - DNA, 22 bp, Homo sapiens
ggcttcctggagaaggtctgag

SEQ ID NO: 8430772 - DNA, 22 bp, Homo sapiens
ggcttcctccttcctgctgtca

SEQ ID NO: 8430773 - DNA, 22 bp, Homo sapiens
ggcttcctccttcctgctgtca

SEQ ID NO: 8430774 - DNA, 22 bp, Homo sapiens
ggcttcctaatactccctacac

SEQ ID NO: 8430775 - DNA, 22 bp, Homo sapiens
ggcttcctaatactccctacac

SEQ ID NO: 8430776 - DNA, 22 bp, Homo sapiens
gggaacagcttgggctctgcca

SEQ ID NO: 8430777 - DNA, 22 bp, Homo sapiens
gggaacagcatatctgaagggt

SEQ ID NO: 8430778 - DNA, 22 bp, Homo sapiens
gggaacagagtgccagactgac

SEQ ID NO: 8430779 - DNA, 22 bp, Homo sapiens
gggaacagagtgccagactgac

SEQ ID NO: 8430780 - DNA, 22 bp, Homo sapiens
gggaacagggcctgagctgggg

SEQ ID NO: 8430781 - DNA, 22 bp, Homo sapiens
gggaagagaccgtaccctggcc

SEQ ID NO: 8430782 - DNA, 22 bp, Homo sapiens
gggaagaagacatggtgaaggc

SEQ ID NO: 8430783 - DNA, 22 bp, Homo sapiens
gggaagaagacatggtgaaggc

SEQ ID NO: 8430784 - DNA, 18 bp, Homo sapiens
gggaagaggatctggccc

SEQ ID NO: 8430785 - DNA, 23 bp, Homo sapiens
gggaccaggcccttcctggtttg

SEQ ID NO: 8430786 - DNA, 22 bp, Homo sapiens
gggaagagatttccacatcatt

SEQ ID NO: 8430787 - DNA, 22 bp, Homo sapiens
ggggaccctcaggactgcgtct

SEQ ID NO: 8430788 - DNA, 19 bp, Homo sapiens
ggggagaactagagacagc

SEQ ID NO: 8430789 - DNA, 19 bp, Homo sapiens
ggggagaactagagacagc

SEQ ID NO: 8430790 - DNA, 22 bp, Homo sapiens
ggggactgaggcactgaaggtg

SEQ ID NO: 8430791 - DNA, 19 bp, Homo sapiens
ggggagaactagagacagc

SEQ ID NO: 8430792 - DNA, 22 bp, Homo sapiens
gggggctggaatatccatcaac

SEQ ID NO: 8430793 - DNA, 22 bp, Homo sapiens
gggggctgaggctgttctgagg

SEQ ID NO: 8430794 - DNA, 22 bp, Homo sapiens
gggggctggactttcccacaca

SEQ ID NO: 8430795 - DNA, 22 bp, Homo sapiens
gggggctgtcctgtgcattgta

SEQ ID NO: 8430796 - DNA, 22 bp, Homo sapiens
gggggctgtcctgtgcattgta

SEQ ID NO: 8430797 - DNA, 22 bp, Homo sapiens
gggggctgtcctgtgcattgta

SEQ ID NO: 8430798 - DNA, 22 bp, Homo sapiens
ggggggtgctgatcagtggagc

SEQ ID NO: 8430799 - DNA, 22 bp, Homo sapiens
ggggggcagctgtcctggccat

SEQ ID NO: 8430800 - DNA, 22 bp, Homo sapiens
ggggtactggctggagccccac

SEQ ID NO: 8430801 - DNA, 22 bp, Homo sapiens
gggggtggttctaagtcctata

SEQ ID NO: 8430802 - DNA, 20 bp, Homo sapiens
gggtccaggactctgaattt

SEQ ID NO: 8430803 - DNA, 22 bp, Homo sapiens
gggtccagctacatcagggtgg

SEQ ID NO: 8430804 - DNA, 22 bp, Homo sapiens
gggtccagggacgtttctgcag

SEQ ID NO: 8430805 - DNA, 22 bp, Homo sapiens
gggtccagggacgtttctgcag

SEQ ID NO: 8430806 - DNA, 22 bp, Homo sapiens
gggtccagggccagtggctgag

SEQ ID NO: 8430807 - DNA, 22 bp, Homo sapiens
gggtccaggcgtggcccagatg

SEQ ID NO: 8430808 - DNA, 22 bp, Homo sapiens
gggtccaggcactatgctaagt

SEQ ID NO: 8430809 - DNA, 22 bp, Homo sapiens
gggtccaggcggcatagttgta

SEQ ID NO: 8430810 - DNA, 22 bp, Homo sapiens
gggtctgagctgaggggaaatc

SEQ ID NO: 8430811 - DNA, 22 bp, Homo sapiens
gggtctggagatccgggtgaag

SEQ ID NO: 8430812 - DNA, 22 bp, Homo sapiens
gggtctggacggctgcaggaag

SEQ ID NO: 8430813 - DNA, 22 bp, Homo sapiens
gggtctctctcggctccacgcg

SEQ ID NO: 8430814 - DNA, 22 bp, Homo sapiens
gggtctctcctccccagctgtg

SEQ ID NO: 8430815 - DNA, 22 bp, Homo sapiens
gggtctctcatgcagttgctgt

SEQ ID NO: 8430816 - DNA, 22 bp, Homo sapiens
gggtctctcagaaggctgcaat

SEQ ID NO: 8430817 - DNA, 22 bp, Homo sapiens
gggtctcctaatggaggatgac

SEQ ID NO: 8430818 - DNA, 22 bp, Homo sapiens
gggtgagagtcaggcagagatt

SEQ ID NO: 8430819 - DNA, 20 bp, Homo sapiens
gggtgagatgtaggagaggg

SEQ ID NO: 8430820 - DNA, 22 bp, Homo sapiens
gggtctggcatgctgagatgga

SEQ ID NO: 8430821 - DNA, 22 bp, Homo sapiens
gggtctgggcaggcgcttcctc

SEQ ID NO: 8430822 - DNA, 22 bp, Homo sapiens
gggtcttctgatataggtccag

SEQ ID NO: 8430823 - DNA, 22 bp, Homo sapiens
gggtctggcatgctgagatgga

SEQ ID NO: 8430824 - DNA, 22 bp, Homo sapiens
gggtctggagggcagcccttct

SEQ ID NO: 8430825 - DNA, 17 bp, Homo sapiens
gggtgggcactgctggc

SEQ ID NO: 8430826 - DNA, 23 bp, Homo sapiens
gggtgggccaaattaggtagcct

SEQ ID NO: 8430827 - DNA, 22 bp, Homo sapiens
gggtgggcccagcccagagaag

SEQ ID NO: 8430828 - DNA, 22 bp, Homo sapiens
gggtgggcccagcccagagaag

SEQ ID NO: 8430829 - DNA, 22 bp, Homo sapiens
gggtgaggagctgccagtcatg

SEQ ID NO: 8430830 - DNA, 22 bp, Homo sapiens
gggtgggatgccgctgtctcca

SEQ ID NO: 8430831 - DNA, 22 bp, Homo sapiens
gggctctgggtcgtgtctccat

SEQ ID NO: 8430832 - DNA, 22 bp, Homo sapiens
gggctagcctcttccctgctcc

SEQ ID NO: 8430833 - DNA, 22 bp, Homo sapiens
gggctagcctcttccctgctcc

SEQ ID NO: 8430834 - DNA, 18 bp, Homo sapiens
gggctaggcaaggaccac

SEQ ID NO: 8430835 - DNA, 22 bp, Homo sapiens
gggctaggcttggccagcactg

SEQ ID NO: 8430836 - DNA, 22 bp, Homo sapiens
gggctctgtggatgtgagagct

SEQ ID NO: 8430837 - DNA, 22 bp, Homo sapiens
gggctgcttggaggaggcgctc

SEQ ID NO: 8430838 - DNA, 22 bp, Homo sapiens
gggctgcttgctggagacagac

SEQ ID NO: 8430839 - DNA, 22 bp, Homo sapiens
gggctgagacgatggggtcttc

SEQ ID NO: 8430840 - DNA, 22 bp, Homo sapiens
gggctgagagctggaatctgag

SEQ ID NO: 8430841 - DNA, 22 bp, Homo sapiens
gggctgagaattcagctttcct

SEQ ID NO: 8430842 - DNA, 22 bp, Homo sapiens
gggctgagaattcagctttcct

SEQ ID NO: 8430843 - DNA, 22 bp, Homo sapiens
gggctgagaagttgatcccaag

SEQ ID NO: 8430844 - DNA, 22 bp, Homo sapiens
gggctgagaattcagctttcct

SEQ ID NO: 8430845 - DNA, 22 bp, Homo sapiens
gggctctgtggttgtgctttgt

SEQ ID NO: 8430846 - DNA, 22 bp, Homo sapiens
gggctctgtgttctagctctcg

SEQ ID NO: 8430847 - DNA, 22 bp, Homo sapiens
gggctggagagtcccacgtggg

SEQ ID NO: 8430848 - DNA, 22 bp, Homo sapiens
gggctggaccgctcgcctccct

SEQ ID NO: 8430849 - DNA, 22 bp, Homo sapiens
gggctggaccgcgacccctgag

SEQ ID NO: 8430850 - DNA, 22 bp, Homo sapiens
gggctggcaggacctgggctga

SEQ ID NO: 8430851 - DNA, 22 bp, Homo sapiens
gggctggcaggacctgggctga

SEQ ID NO: 8430852 - DNA, 22 bp, Homo sapiens
gggctggatctcctgcaggcag

SEQ ID NO: 8430853 - DNA, 22 bp, Homo sapiens
ggggacagttaaagaccaagac

SEQ ID NO: 8430854 - DNA, 22 bp, Homo sapiens
ggggacagttaaagaccaagac

SEQ ID NO: 8430855 - DNA, 22 bp, Homo sapiens
ggggacagttaaagaccaagac

SEQ ID NO: 8430856 - DNA, 22 bp, Homo sapiens
ggggacagtcgatctagtgatt

SEQ ID NO: 8430857 - DNA, 22 bp, Homo sapiens
ggggacagtcgatctagtgatt

SEQ ID NO: 8430858 - DNA, 22 bp, Homo sapiens
ggggacagttaaagaccaagac

SEQ ID NO: 8430859 - DNA, 23 bp, Homo sapiens
ggggacagttcccactggggtct

SEQ ID NO: 8430860 - DNA, 23 bp, Homo sapiens
ggggacagagggcagcccgcatc

SEQ ID NO: 8430861 - DNA, 23 bp, Homo sapiens
ggggacagagggcagcccgcatc

SEQ ID NO: 8430862 - DNA, 23 bp, Homo sapiens
ggggacagagggcagcccgcatc

SEQ ID NO: 8430863 - DNA, 22 bp, Homo sapiens
ggggaagggagtccaagtgtta

SEQ ID NO: 8430864 - DNA, 16 bp, Homo sapiens
ggggaaggcaagaggg

SEQ ID NO: 8430865 - DNA, 22 bp, Homo sapiens
gggagggaaggaccttatgaat

SEQ ID NO: 8430866 - DNA, 22 bp, Homo sapiens
gggagggaaggaggcgccgtgt

SEQ ID NO: 8430867 - DNA, 22 bp, Homo sapiens
gggagggaaggaggcgccgtgt

SEQ ID NO: 8430868 - DNA, 22 bp, Homo sapiens
gggagggaaagcttgatctgtc

SEQ ID NO: 8430869 - DNA, 22 bp, Homo sapiens
gggagggaaagcttgatctgtc

SEQ ID NO: 8430870 - DNA, 22 bp, Homo sapiens
gggatgaggatcaatcagggag

SEQ ID NO: 8430871 - DNA, 21 bp, Homo sapiens
gggatctgaggcaagtctcct

SEQ ID NO: 8430872 - DNA, 22 bp, Homo sapiens
gggatctgacttgctggtgggt

SEQ ID NO: 8430873 - DNA, 22 bp, Homo sapiens
gggatctgatgcactgctgaaa

SEQ ID NO: 8430874 - DNA, 22 bp, Homo sapiens
gggatctgatgcactgctgaaa

SEQ ID NO: 8430875 - DNA, 20 bp, Homo sapiens
gggatgagagtcctagctct

SEQ ID NO: 8430876 - DNA, 22 bp, Homo sapiens
gggatctgagtaggcagaagct

SEQ ID NO: 8430877 - DNA, 22 bp, Homo sapiens
gggatctgagttgtcaggaagg

SEQ ID NO: 8430878 - DNA, 22 bp, Homo sapiens
gggatggggagctggaaagggg

SEQ ID NO: 8430879 - DNA, 22 bp, Homo sapiens
gggatggggagctggaaagggg

SEQ ID NO: 8430880 - DNA, 22 bp, Homo sapiens
gggatggggagctggaaagggg

SEQ ID NO: 8430881 - DNA, 22 bp, Homo sapiens
gggatggggagctggaaagggg

SEQ ID NO: 8430882 - DNA, 22 bp, Homo sapiens
gggatggggagctggaaagggg

SEQ ID NO: 8430883 - DNA, 22 bp, Homo sapiens
gggcagaggggcgcttccctct

SEQ ID NO: 8430884 - DNA, 22 bp, Homo sapiens
gggatggggagctggaaagggg

SEQ ID NO: 8430885 - DNA, 22 bp, Homo sapiens
gggatggatcttggctgaggct

SEQ ID NO: 8430886 - DNA, 22 bp, Homo sapiens
gggatggagggtagagcaagtg

SEQ ID NO: 8430887 - DNA, 22 bp, Homo sapiens
gggatggctgcctgcatcagga

SEQ ID NO: 8430888 - DNA, 22 bp, Homo sapiens
gggatggctcaaaggagtcagg

SEQ ID NO: 8430889 - DNA, 22 bp, Homo sapiens
gggaccaggtcagggctctgac

SEQ ID NO: 8430890 - DNA, 22 bp, Homo sapiens
gggaccagtgtctgtgagaaaa

SEQ ID NO: 8430891 - DNA, 22 bp, Homo sapiens
gggaagagatttccacatcatt

SEQ ID NO: 8430892 - DNA, 22 bp, Homo sapiens
gggaccagtgtctgtgagaaaa

SEQ ID NO: 8430893 - DNA, 22 bp, Homo sapiens
gggaccagtgtctgtgagaaaa

SEQ ID NO: 8430894 - DNA, 22 bp, Homo sapiens
gggacctgccaaggccacccag

SEQ ID NO: 8430895 - DNA, 22 bp, Homo sapiens
gggagaagaatgtgtcaattgt

SEQ ID NO: 8430896 - DNA, 22 bp, Homo sapiens
gggagaaatgtctggcctgctg

SEQ ID NO: 8430897 - DNA, 22 bp, Homo sapiens
gggacgagatcttggcagtgtg

SEQ ID NO: 8430898 - DNA, 22 bp, Homo sapiens
gggagaaggaggactgtgctgt

SEQ ID NO: 8430899 - DNA, 22 bp, Homo sapiens
gggagaaggagctagttcttga

SEQ ID NO: 8430900 - DNA, 22 bp, Homo sapiens
gggagaaggagctagttcttga

SEQ ID NO: 8430901 - DNA, 22 bp, Homo sapiens
gggagaaggagctagttcttga

SEQ ID NO: 8430902 - DNA, 20 bp, Homo sapiens
gggagaagggctgatgagag

SEQ ID NO: 8430903 - DNA, 20 bp, Homo sapiens
gggagaagggctgatgagag

SEQ ID NO: 8430904 - DNA, 22 bp, Homo sapiens
gggaggaggaatgttttgtgta

SEQ ID NO: 8430905 - DNA, 20 bp, Homo sapiens
gggaggccccagagtccagg

SEQ ID NO: 8430906 - DNA, 22 bp, Homo sapiens
gggaggctgccatccttcagga

SEQ ID NO: 8430907 - DNA, 22 bp, Homo sapiens
gggaggctggctctggccacag

SEQ ID NO: 8430908 - DNA, 22 bp, Homo sapiens
gggaggctctgctcagcccccg

SEQ ID NO: 8430909 - DNA, 20 bp, Homo sapiens
gggaggcgagggctgagcag

SEQ ID NO: 8430910 - DNA, 22 bp, Homo sapiens
gggaggctcagtggtgtcctct

SEQ ID NO: 8430911 - DNA, 22 bp, Homo sapiens
gggaggcgccgagggtagctaa

SEQ ID NO: 8430912 - DNA, 18 bp, Homo sapiens
gggaggccccagcaggag

SEQ ID NO: 8430913 - DNA, 20 bp, Homo sapiens
gggaggccccagagtccagg

SEQ ID NO: 8430914 - DNA, 22 bp, Homo sapiens
gggcggatcacctgaggtcagg

SEQ ID NO: 8430915 - DNA, 22 bp, Homo sapiens
gggcggatcacctgaggtcagg

SEQ ID NO: 8430916 - DNA, 22 bp, Homo sapiens
gggcggatcacctgaggtcagg

SEQ ID NO: 8430917 - DNA, 22 bp, Homo sapiens
gggcggatcatttgaggtcagg

SEQ ID NO: 8430918 - DNA, 22 bp, Homo sapiens
gggcggatcatttgaggtcagg

SEQ ID NO: 8430919 - DNA, 22 bp, Homo sapiens
gggcggatcacctgaggtcagg

SEQ ID NO: 8430920 - DNA, 22 bp, Homo sapiens
gggcggatcacctgaggtcagg

SEQ ID NO: 8430921 - DNA, 22 bp, Homo sapiens
gggcggatcacctgaggtcagg

SEQ ID NO: 8430922 - DNA, 22 bp, Homo sapiens
gggcggatcatttgaggtcagg

SEQ ID NO: 8430923 - DNA, 22 bp, Homo sapiens
gggcggatcatttgaggtcagg

SEQ ID NO: 8430924 - DNA, 22 bp, Homo sapiens
gggcggatcatttgaggtcagg

SEQ ID NO: 8430925 - DNA, 22 bp, Homo sapiens
gggcggatcatttgaggtcagg

SEQ ID NO: 8430926 - DNA, 22 bp, Homo sapiens
gggcggggggagctggaatgaa

SEQ ID NO: 8430927 - DNA, 22 bp, Homo sapiens
gggctactgagctggaactggg

SEQ ID NO: 8430928 - DNA, 22 bp, Homo sapiens
gggccatgagaggttcatcaac

SEQ ID NO: 8430929 - DNA, 22 bp, Homo sapiens
gggccatgagaggttcatcaac

SEQ ID NO: 8430930 - DNA, 22 bp, Homo sapiens
gggcccagcactggctgggatc

SEQ ID NO: 8430931 - DNA, 22 bp, Homo sapiens
gggcccagcactggctgggatc

SEQ ID NO: 8430932 - DNA, 23 bp, Homo sapiens
gggcccagcacaggacctggcag

SEQ ID NO: 8430933 - DNA, 19 bp, Homo sapiens
gggcccagcatggagggtt

SEQ ID NO: 8430934 - DNA, 19 bp, Homo sapiens
gggcccagcatggagggtt

SEQ ID NO: 8430935 - DNA, 22 bp, Homo sapiens
gggcccagccctctgctcactg

SEQ ID NO: 8430936 - DNA, 22 bp, Homo sapiens
gggcccagccctctgctcactg

SEQ ID NO: 8430937 - DNA, 22 bp, Homo sapiens
gggcccagcgtggttccatctg

SEQ ID NO: 8430938 - DNA, 22 bp, Homo sapiens
gggcctggtgcttctgactcct

SEQ ID NO: 8430939 - DNA, 22 bp, Homo sapiens
gggcctgtctcactccctggtt

SEQ ID NO: 8430940 - DNA, 22 bp, Homo sapiens
gggcagcagaattggacagaaa

SEQ ID NO: 8430941 - DNA, 20 bp, Homo sapiens
gggcagcctcgggagtgggt

SEQ ID NO: 8430942 - DNA, 18 bp, Homo sapiens
gggcagcacagcagcctc

SEQ ID NO: 8430943 - DNA, 22 bp, Homo sapiens
gggcagcaaatctgagtctggt

SEQ ID NO: 8430944 - DNA, 22 bp, Homo sapiens
gggccaggagtggagatatggg

SEQ ID NO: 8430945 - DNA, 22 bp, Homo sapiens
gggccaggagtggagatatggg

SEQ ID NO: 8430946 - DNA, 22 bp, Homo sapiens
gggccaggtatcgtctttagta

SEQ ID NO: 8430947 - DNA, 22 bp, Homo sapiens
gggccaggtatcgtctttagta

SEQ ID NO: 8430948 - DNA, 22 bp, Homo sapiens
gggccaggtggaccccagcctc

SEQ ID NO: 8430949 - DNA, 22 bp, Homo sapiens
gggccaggtggaccccagcctc

SEQ ID NO: 8430950 - DNA, 22 bp, Homo sapiens
gggccaggtggaccccagcctc

SEQ ID NO: 8430951 - DNA, 22 bp, Homo sapiens
gggccagtctgactctgctggt

SEQ ID NO: 8430952 - DNA, 22 bp, Homo sapiens
gggccaggtcggtgaatggtca

SEQ ID NO: 8430953 - DNA, 22 bp, Homo sapiens
gggcagctcctgtggaatccac

SEQ ID NO: 8430954 - DNA, 22 bp, Homo sapiens
gggcagctctcacagcagccaa

SEQ ID NO: 8430955 - DNA, 20 bp, Homo sapiens
gggcagcctcgggagtgggt

SEQ ID NO: 8430956 - DNA, 22 bp, Homo sapiens
gggcagctcagccaccatgcag

SEQ ID NO: 8430957 - DNA, 22 bp, Homo sapiens
gggcagctagccctctagccca

SEQ ID NO: 8430958 - DNA, 22 bp, Homo sapiens
gggcagctcagccaccatgcag

SEQ ID NO: 8430959 - DNA, 22 bp, Homo sapiens
gcttagtccccaagagagacca

SEQ ID NO: 8430960 - DNA, 22 bp, Homo sapiens
gcttaggagtttcaggctctca

SEQ ID NO: 8430961 - DNA, 22 bp, Homo sapiens
gcttaggaaaatggtggagttg

SEQ ID NO: 8430962 - DNA, 22 bp, Homo sapiens
gcttaggatgaatgctgtagaa

SEQ ID NO: 8430963 - DNA, 22 bp, Homo sapiens
gcttatcttgaaatccaccagc

SEQ ID NO: 8430964 - DNA, 22 bp, Homo sapiens
gcttagaagttcctataaaatg

SEQ ID NO: 8430965 - DNA, 22 bp, Homo sapiens
gcttacagataatgaggagact

SEQ ID NO: 8430966 - DNA, 22 bp, Homo sapiens
gcttagaagattgaccctggtt

SEQ ID NO: 8430967 - DNA, 22 bp, Homo sapiens
gcttagaagtacacatgccttt

SEQ ID NO: 8430968 - DNA, 22 bp, Homo sapiens
gcttagaacatgtggattgcaa

SEQ ID NO: 8430969 - DNA, 22 bp, Homo sapiens
gcttagaaagtgattgatacat

SEQ ID NO: 8430970 - DNA, 22 bp, Homo sapiens
gctgggctgcgtcggggaagcc

SEQ ID NO: 8430971 - DNA, 22 bp, Homo sapiens
gctgggctgcccaacctctgac

SEQ ID NO: 8430972 - DNA, 22 bp, Homo sapiens
gctgggctgcccaacctctgac

SEQ ID NO: 8430973 - DNA, 22 bp, Homo sapiens
gctgggctgagctagacttggc

SEQ ID NO: 8430974 - DNA, 22 bp, Homo sapiens
gctgggctgagctagacttggc

SEQ ID NO: 8430975 - DNA, 22 bp, Homo sapiens
gctgggctgagctagacttggc

SEQ ID NO: 8430976 - DNA, 22 bp, Homo sapiens
gctgggctgcgtcggggaagcc

SEQ ID NO: 8430977 - DNA, 22 bp, Homo sapiens
gcttaattctggctcagtttcc

SEQ ID NO: 8430978 - DNA, 22 bp, Homo sapiens
gctgggctgagctagacttggc

SEQ ID NO: 8430979 - DNA, 22 bp, Homo sapiens
gctgggctgagaagttaagcaa

SEQ ID NO: 8430980 - DNA, 22 bp, Homo sapiens
gctgggctcttatcacctgtac

SEQ ID NO: 8430981 - DNA, 22 bp, Homo sapiens
gctgggctctttacccctgtac

SEQ ID NO: 8430982 - DNA, 22 bp, Homo sapiens
gctgggctctgtcatgccttcc

SEQ ID NO: 8430983 - DNA, 22 bp, Homo sapiens
gctgggctctgtcatgccttcc

SEQ ID NO: 8430984 - DNA, 22 bp, Homo sapiens
gctgggctctgtcatgccttcc

SEQ ID NO: 8430985 - DNA, 22 bp, Homo sapiens
gctgggctcgttcccacacgcg

SEQ ID NO: 8430986 - DNA, 21 bp, Homo sapiens
gctgggctccagtctgccgct

SEQ ID NO: 8430987 - DNA, 22 bp, Homo sapiens
gctgggctcgttcccacacgcg

SEQ ID NO: 8430988 - DNA, 21 bp, Homo sapiens
gctgggctccagtctgccgct

SEQ ID NO: 8430989 - DNA, 21 bp, Homo sapiens
gctgggctccagtctgccgct

SEQ ID NO: 8430990 - DNA, 22 bp, Homo sapiens
gctgggcatgtgaccaacagaa

SEQ ID NO: 8430991 - DNA, 22 bp, Homo sapiens
gctgggccagagcagcagcact

SEQ ID NO: 8430992 - DNA, 22 bp, Homo sapiens
gctgggctcagacctagtgaac

SEQ ID NO: 8430993 - DNA, 22 bp, Homo sapiens
gctgggccagagcagcagcact

SEQ ID NO: 8430994 - DNA, 22 bp, Homo sapiens
gctgggccagagcagcagcact

SEQ ID NO: 8430995 - DNA, 22 bp, Homo sapiens
gctgggctccaggccagggtga

SEQ ID NO: 8430996 - DNA, 22 bp, Homo sapiens
gctgggctccaggccagggtga

SEQ ID NO: 8430997 - DNA, 22 bp, Homo sapiens
gctgggctcatttgtgtgtctg

SEQ ID NO: 8430998 - DNA, 22 bp, Homo sapiens
gctgggctccaccctcaactgt

SEQ ID NO: 8430999 - DNA, 22 bp, Homo sapiens
gcttctaacctgcttcctgtag

SEQ ID NO: 8431000 - DNA, 22 bp, Homo sapiens
gcttctgcgcctagcctcaggt

SEQ ID NO: 8431001 - DNA, 22 bp, Homo sapiens
gcttctgcagggtcctcgctgt

SEQ ID NO: 8431002 - DNA, 22 bp, Homo sapiens
gcttcctgtccctcagccatga

SEQ ID NO: 8431003 - DNA, 22 bp, Homo sapiens
gcttcctgtccaggccccacat

SEQ ID NO: 8431004 - DNA, 22 bp, Homo sapiens
gcttcctggagggagagagctg

SEQ ID NO: 8431005 - DNA, 22 bp, Homo sapiens
gcttcctgtaggcaggtccaag

SEQ ID NO: 8431006 - DNA, 22 bp, Homo sapiens
gcttcctgtaggcaggtccaag

SEQ ID NO: 8431007 - DNA, 22 bp, Homo sapiens
gcttcatttctctctgtagacc

SEQ ID NO: 8431008 - DNA, 22 bp, Homo sapiens
gcttcctggagggagagagctg

SEQ ID NO: 8431009 - DNA, 22 bp, Homo sapiens
gcttcctggagggagagagctg

SEQ ID NO: 8431010 - DNA, 22 bp, Homo sapiens
gcttcagggttatgcaagagtg

SEQ ID NO: 8431011 - DNA, 22 bp, Homo sapiens
gcttcaggctgaattcctccta

SEQ ID NO: 8431012 - DNA, 22 bp, Homo sapiens
gcttcagctttgtctccttggg

SEQ ID NO: 8431013 - DNA, 22 bp, Homo sapiens
gcttcaggaggtcggtctcctt

SEQ ID NO: 8431014 - DNA, 22 bp, Homo sapiens
gcttcatgggtgtgcaacctgt

SEQ ID NO: 8431015 - DNA, 22 bp, Homo sapiens
gcttcacagaatcaatagttgg

SEQ ID NO: 8431016 - DNA, 20 bp, Homo sapiens
ggaaaaatgcatgctcaaga

SEQ ID NO: 8431017 - DNA, 22 bp, Homo sapiens
ggaaaactgaggctctcagcag

SEQ ID NO: 8431018 - DNA, 22 bp, Homo sapiens
gcttctgctgttgaagccacca

SEQ ID NO: 8431019 - DNA, 22 bp, Homo sapiens
gcttctggaagctgcttctgcc

SEQ ID NO: 8431020 - DNA, 17 bp, Homo sapiens
gcttctggagcttctgt

SEQ ID NO: 8431021 - DNA, 22 bp, Homo sapiens
gcttctggaggagctgggctga

SEQ ID NO: 8431022 - DNA, 22 bp, Homo sapiens
ggaaacacatgatcagacatct

SEQ ID NO: 8431023 - DNA, 22 bp, Homo sapiens
ggaaacagcaaattatggcaat

SEQ ID NO: 8431024 - DNA, 22 bp, Homo sapiens
ggaaacatgcctgctggacagt

SEQ ID NO: 8431025 - DNA, 22 bp, Homo sapiens
ggaaagaaagtgtgaacaactt

SEQ ID NO: 8431026 - DNA, 22 bp, Homo sapiens
ggaaagagcccagcagtgcttg

SEQ ID NO: 8431027 - DNA, 23 bp, Homo sapiens
ggaaagagaggagttgtgcatag

SEQ ID NO: 8431028 - DNA, 22 bp, Homo sapiens
ggaaagaatcaagtgatcctgt

SEQ ID NO: 8431029 - DNA, 21 bp, Homo sapiens
ggaaagaaggcaaggctcagg

SEQ ID NO: 8431030 - DNA, 22 bp, Homo sapiens
ggaaagagaagttgggaggaat

SEQ ID NO: 8431031 - DNA, 22 bp, Homo sapiens
ggaaagaaagtgtgaacaactt

SEQ ID NO: 8431032 - DNA, 22 bp, Homo sapiens
ggaaagaaagtgtgaacaactt

SEQ ID NO: 8431033 - DNA, 22 bp, Homo sapiens
ggaaagaaagtgtgaacaactt

SEQ ID NO: 8431034 - DNA, 22 bp, Homo sapiens
ggaaagaaccctggatggctgg

SEQ ID NO: 8431035 - DNA, 22 bp, Homo sapiens
ggaaagaaccctggatggctgg

SEQ ID NO: 8431036 - DNA, 21 bp, Homo sapiens
ggaaagaaggcaaggctcagg

SEQ ID NO: 8431037 - DNA, 22 bp, Homo sapiens
ggaaagaggatagtgggtaggt

SEQ ID NO: 8431038 - DNA, 22 bp, Homo sapiens
ggaaagagggacccagcttggt

SEQ ID NO: 8431039 - DNA, 22 bp, Homo sapiens
ggaactgaatgtctcggtataa

SEQ ID NO: 8431040 - DNA, 22 bp, Homo sapiens
ggaaagctactggtgtcctctg

SEQ ID NO: 8431041 - DNA, 22 bp, Homo sapiens
ggaagaaagcacacaaacttga

SEQ ID NO: 8431042 - DNA, 22 bp, Homo sapiens
ggaagaaagcacacaaacttga

SEQ ID NO: 8431043 - DNA, 22 bp, Homo sapiens
ggaagaaagacatttattttga

SEQ ID NO: 8431044 - DNA, 22 bp, Homo sapiens
ggaagaaaatgggcaacaggtg

SEQ ID NO: 8431045 - DNA, 22 bp, Homo sapiens
ggaagaaaatgggcaacaggtg

SEQ ID NO: 8431046 - DNA, 22 bp, Homo sapiens
ggaagaaaatgggcaacaggtg

SEQ ID NO: 8431047 - DNA, 22 bp, Homo sapiens
ggaagaaagtagaaaaccgtgg

SEQ ID NO: 8431048 - DNA, 22 bp, Homo sapiens
ggaagaaaggtggacaacaggt

SEQ ID NO: 8431049 - DNA, 22 bp, Homo sapiens
ggaagaaaggtggacaacaggt

SEQ ID NO: 8431050 - DNA, 22 bp, Homo sapiens
ggaagaaaggtggacaacaggt

SEQ ID NO: 8431051 - DNA, 22 bp, Homo sapiens
ggaactgaatgtctcggtataa

SEQ ID NO: 8431052 - DNA, 22 bp, Homo sapiens
ggaactgagaagcagctatgcc

SEQ ID NO: 8431053 - DNA, 22 bp, Homo sapiens
ggaactgattaagtcatgagaa

SEQ ID NO: 8431054 - DNA, 22 bp, Homo sapiens
ggaactttttaacaagctgctg

SEQ ID NO: 8431055 - DNA, 21 bp, Homo sapiens
ggaactttcatgaatctagca

SEQ ID NO: 8431056 - DNA, 22 bp, Homo sapiens
ggaagaaaagcttccagcgcct

SEQ ID NO: 8431057 - DNA, 17 bp, Homo sapiens
ggaagaaaaggatcatc

SEQ ID NO: 8431058 - DNA, 17 bp, Homo sapiens
ggaagaaaaggatcatc

SEQ ID NO: 8431059 - DNA, 17 bp, Homo sapiens
ggaagaaaaggatcatc

SEQ ID NO: 8431060 - DNA, 22 bp, Homo sapiens
ggaagaaatctggttaagagat

SEQ ID NO: 8431061 - DNA, 22 bp, Homo sapiens
ggaagaaatgctcttctatgcg

SEQ ID NO: 8431062 - DNA, 22 bp, Homo sapiens
ggaagggtttggaaagccgaga

SEQ ID NO: 8431063 - DNA, 22 bp, Homo sapiens
ggaagggtttaagcaggagagt

SEQ ID NO: 8431064 - DNA, 22 bp, Homo sapiens
ggaaggggtgtcgcccatggat

SEQ ID NO: 8431065 - DNA, 22 bp, Homo sapiens
ggaaggggttaggggtccctga

SEQ ID NO: 8431066 - DNA, 22 bp, Homo sapiens
ggaaggtcgagctgcatctggc

SEQ ID NO: 8431067 - DNA, 22 bp, Homo sapiens
ggagaatgattctttgctcact

SEQ ID NO: 8431068 - DNA, 22 bp, Homo sapiens
ggagacacagagcaacaaaata

SEQ ID NO: 8431069 - DNA, 22 bp, Homo sapiens
ggagaatgatatatagctcagt

SEQ ID NO: 8431070 - DNA, 22 bp, Homo sapiens
ggagaaggtggctcagcaaagg

SEQ ID NO: 8431071 - DNA, 22 bp, Homo sapiens
ggagaaggtggctcagcaaagg

SEQ ID NO: 8431072 - DNA, 22 bp, Homo sapiens
ggagaaggtggctcagcaaagg

SEQ ID NO: 8431073 - DNA, 17 bp, Homo sapiens
ggagacagggtctttaa

SEQ ID NO: 8431074 - DNA, 22 bp, Homo sapiens
ggagacagcaggaagaaatatc

SEQ ID NO: 8431075 - DNA, 22 bp, Homo sapiens
ggagacacccacattgctgggt

SEQ ID NO: 8431076 - DNA, 22 bp, Homo sapiens
ggagacacatatacagaaagag

SEQ ID NO: 8431077 - DNA, 22 bp, Homo sapiens
ggagacacagagcaacaaaata

SEQ ID NO: 8431078 - DNA, 22 bp, Homo sapiens
ggagacacgggtgctgaggacc

SEQ ID NO: 8431079 - DNA, 22 bp, Homo sapiens
ggagaaggaagaaagctactat

SEQ ID NO: 8431080 - DNA, 22 bp, Homo sapiens
ggagaaggaatattggagtagg

SEQ ID NO: 8431081 - DNA, 22 bp, Homo sapiens
ggagaaggaagaaagctactat

SEQ ID NO: 8431082 - DNA, 22 bp, Homo sapiens
ggagaaggaatattggagtagg

SEQ ID NO: 8431083 - DNA, 22 bp, Homo sapiens
ggagaaggcacacccacctctg

SEQ ID NO: 8431084 - DNA, 21 bp, Homo sapiens
ggagaaggacaatgttgagta

SEQ ID NO: 8431085 - DNA, 21 bp, Homo sapiens
ggagaaggacaatgttgagta

SEQ ID NO: 8431086 - DNA, 21 bp, Homo sapiens
ggagaaggacaatgttgagta

SEQ ID NO: 8431087 - DNA, 22 bp, Homo sapiens
ggagaaggaagaaagctactat

SEQ ID NO: 8431088 - DNA, 22 bp, Homo sapiens
ggagaagccaggtgataagcaa

SEQ ID NO: 8431089 - DNA, 19 bp, Homo sapiens
ggagaagcatctagaaata

SEQ ID NO: 8431090 - DNA, 22 bp, Homo sapiens
ggaataggatttacctctgtaa

SEQ ID NO: 8431091 - DNA, 21 bp, Homo sapiens
ggaatagcttaaagtgagggg

SEQ ID NO: 8431092 - DNA, 22 bp, Homo sapiens
ggaagtggtagagccatgagtg

SEQ ID NO: 8431093 - DNA, 22 bp, Homo sapiens
ggagatcttgcttgaaggcatg

SEQ ID NO: 8431094 - DNA, 22 bp, Homo sapiens
ggagaggtgagaggtacaagtt

SEQ ID NO: 8431095 - DNA, 22 bp, Homo sapiens
ggagaggtgaatggctgctcta

SEQ ID NO: 8431096 - DNA, 23 bp, Homo sapiens
ggagaggggtgtgggcatcttta

SEQ ID NO: 8431097 - DNA, 23 bp, Homo sapiens
ggagaggggtgtgggcatcttta

SEQ ID NO: 8431098 - DNA, 22 bp, Homo sapiens
ggagaggggaacttgttgcttg

SEQ ID NO: 8431099 - DNA, 23 bp, Homo sapiens
ggagatgcttaagagtggttgag

SEQ ID NO: 8431100 - DNA, 22 bp, Homo sapiens
ggagcctggttactagagcctg

SEQ ID NO: 8431101 - DNA, 22 bp, Homo sapiens
ggagatgcgactcgcggggctg

SEQ ID NO: 8431102 - DNA, 22 bp, Homo sapiens
ggagatgacacaatttatttat

SEQ ID NO: 8431103 - DNA, 22 bp, Homo sapiens
ggagccttagacatctgatcct

SEQ ID NO: 8431104 - DNA, 22 bp, Homo sapiens
ggagccttactagaatgtgagc

SEQ ID NO: 8431105 - DNA, 22 bp, Homo sapiens
ggagcctgtggccgtcacgact

SEQ ID NO: 8431106 - DNA, 22 bp, Homo sapiens
ggaggacaggggctgcagcaca

SEQ ID NO: 8431107 - DNA, 22 bp, Homo sapiens
ggaggaagggcccaggctttat

SEQ ID NO: 8431108 - DNA, 22 bp, Homo sapiens
ggaggacaggggctgcagcaca

SEQ ID NO: 8431109 - DNA, 22 bp, Homo sapiens
ggaggaagcacacggcttgtat

SEQ ID NO: 8431110 - DNA, 22 bp, Homo sapiens
ggaggaagccctcggtgcccca

SEQ ID NO: 8431111 - DNA, 22 bp, Homo sapiens
ggagctgaaccccatcgtgctg

SEQ ID NO: 8431112 - DNA, 22 bp, Homo sapiens
ggagctcataacaaggtagcca

SEQ ID NO: 8431113 - DNA, 22 bp, Homo sapiens
ggagctcctggcagtgacagag

SEQ ID NO: 8431114 - DNA, 22 bp, Homo sapiens
ggagctcataacaaggtagcca

SEQ ID NO: 8431115 - DNA, 22 bp, Homo sapiens
ggagctcagtggggggactgtg

SEQ ID NO: 8431116 - DNA, 22 bp, Homo sapiens
ggagctcagtggggggactgtg

SEQ ID NO: 8431117 - DNA, 22 bp, Homo sapiens
ggagctcagaagtgagtgagtt

SEQ ID NO: 8431118 - DNA, 22 bp, Homo sapiens
ggagctcaccttggagtctctg

SEQ ID NO: 8431119 - DNA, 22 bp, Homo sapiens
ggagctcaccttggagtctctg

SEQ ID NO: 8431120 - DNA, 22 bp, Homo sapiens
ggagctgcacgctctgaagcct

SEQ ID NO: 8431121 - DNA, 22 bp, Homo sapiens
ggaggaaaggctccctccctct

SEQ ID NO: 8431122 - DNA, 22 bp, Homo sapiens
ggaggccagggacccagtcagc

SEQ ID NO: 8431123 - DNA, 22 bp, Homo sapiens
ggaggccagggacccagtcagc

SEQ ID NO: 8431124 - DNA, 22 bp, Homo sapiens
ggaggccagggacccagtcagc

SEQ ID NO: 8431125 - DNA, 22 bp, Homo sapiens
ggaggccagggtgggtggatcg

SEQ ID NO: 8431126 - DNA, 22 bp, Homo sapiens
ggaggccaggtgggagtcatct

SEQ ID NO: 8431127 - DNA, 22 bp, Homo sapiens
ggaggccaggtgggagtcatct

SEQ ID NO: 8431128 - DNA, 22 bp, Homo sapiens
ggaggccagcctgaggctgagg

SEQ ID NO: 8431129 - DNA, 22 bp, Homo sapiens
ggaggccatcagggagggcatt

SEQ ID NO: 8431130 - DNA, 22 bp, Homo sapiens
ggaggccatcagggagggcatt

SEQ ID NO: 8431131 - DNA, 22 bp, Homo sapiens
ggaggccatagtttgggagtca

SEQ ID NO: 8431132 - DNA, 22 bp, Homo sapiens
ggaggccatctggctggaggct

SEQ ID NO: 8431133 - DNA, 22 bp, Homo sapiens
ggaggccatgaggctctaggtg

SEQ ID NO: 8431134 - DNA, 22 bp, Homo sapiens
ggaggccatgaggctctaggtg

SEQ ID NO: 8431135 - DNA, 22 bp, Homo sapiens
ggaggccatctggctggaggct

SEQ ID NO: 8431136 - DNA, 22 bp, Homo sapiens
ggaggcagaatagagtgtgggt

SEQ ID NO: 8431137 - DNA, 22 bp, Homo sapiens
ggaggccagcctgaggctgagg

SEQ ID NO: 8431138 - DNA, 22 bp, Homo sapiens
ggaggccacctgacctgctgtt

SEQ ID NO: 8431139 - DNA, 22 bp, Homo sapiens
ggaggccaagtcactgacctgg

SEQ ID NO: 8431140 - DNA, 22 bp, Homo sapiens
ggaggccaccatggagtcactt

SEQ ID NO: 8431141 - DNA, 22 bp, Homo sapiens
ggcagacactcaaaagctggga

SEQ ID NO: 8431142 - DNA, 19 bp, Homo sapiens
ggcagacacagttgacatg

SEQ ID NO: 8431143 - DNA, 22 bp, Homo sapiens
ggcagagaatctggctgtttac

SEQ ID NO: 8431144 - DNA, 23 bp, Homo sapiens
ggcagagagcatggctggggccc

SEQ ID NO: 8431145 - DNA, 22 bp, Homo sapiens
ggcagagactgggttggcagag

SEQ ID NO: 8431146 - DNA, 22 bp, Homo sapiens
ggcagagacaccgaatgactct

SEQ ID NO: 8431147 - DNA, 22 bp, Homo sapiens
ggcagagcttgttccttctgtt

SEQ ID NO: 8431148 - DNA, 23 bp, Homo sapiens
ggcagagagcatggctggggccc

SEQ ID NO: 8431149 - DNA, 22 bp, Homo sapiens
ggcacagagctttgtcccagtt

SEQ ID NO: 8431150 - DNA, 22 bp, Homo sapiens
ggcacagagctttgtcccagtt

SEQ ID NO: 8431151 - DNA, 22 bp, Homo sapiens
ggcacagagctccagccttggc

SEQ ID NO: 8431152 - DNA, 22 bp, Homo sapiens
ggcacagagctccagccttggc

SEQ ID NO: 8431153 - DNA, 22 bp, Homo sapiens
ggcacagagcccagcttcctag

SEQ ID NO: 8431154 - DNA, 23 bp, Homo sapiens
ggcacagatgctgagcatgtgca

SEQ ID NO: 8431155 - DNA, 22 bp, Homo sapiens
ggcacagatagatcaagtgtct

SEQ ID NO: 8431156 - DNA, 22 bp, Homo sapiens
ggcacagagttggcagagctgc

SEQ ID NO: 8431157 - DNA, 22 bp, Homo sapiens
ggcacagagttggcagagctgc

SEQ ID NO: 8431158 - DNA, 22 bp, Homo sapiens
ggcacagcacagtggacccagg

SEQ ID NO: 8431159 - DNA, 22 bp, Homo sapiens
ggcacagcacagtggacccagg

SEQ ID NO: 8431160 - DNA, 22 bp, Homo sapiens
ggcacagcacagagcacatgta

SEQ ID NO: 8431161 - DNA, 22 bp, Homo sapiens
ggcacagcacagagcacatgta

SEQ ID NO: 8431162 - DNA, 23 bp, Homo sapiens
ggcacagatgctgagcatgtgca

SEQ ID NO: 8431163 - DNA, 22 bp, Homo sapiens
ggcacagcaagaagggaaatga

SEQ ID NO: 8431164 - DNA, 22 bp, Homo sapiens
ggcacagcactgtaggcctggg

SEQ ID NO: 8431165 - DNA, 22 bp, Homo sapiens
ggcacagcactgtaggcctggg

SEQ ID NO: 8431166 - DNA, 22 bp, Homo sapiens
ggcacagcactgtaggcctggg

SEQ ID NO: 8431167 - DNA, 22 bp, Homo sapiens
ggcacagcacagagcacatgta

SEQ ID NO: 8431168 - DNA, 22 bp, Homo sapiens
ggcacagcaccttttcacattg

SEQ ID NO: 8431169 - DNA, 23 bp, Homo sapiens
ggagtgtgaagacctgatatagc

SEQ ID NO: 8431170 - DNA, 22 bp, Homo sapiens
ggagtgtggagaggacatgggt

SEQ ID NO: 8431171 - DNA, 22 bp, Homo sapiens
ggcacagagcaggccactaatc

SEQ ID NO: 8431172 - DNA, 22 bp, Homo sapiens
ggcacagagcaggccactaatc

SEQ ID NO: 8431173 - DNA, 22 bp, Homo sapiens
ggcacagagaggccctggaagg

SEQ ID NO: 8431174 - DNA, 22 bp, Homo sapiens
ggcacacagatggagcactagc

SEQ ID NO: 8431175 - DNA, 22 bp, Homo sapiens
ggcacacagcttggcaggagat

SEQ ID NO: 8431176 - DNA, 22 bp, Homo sapiens
ggagtggcctctcctgtgcagg

SEQ ID NO: 8431177 - DNA, 22 bp, Homo sapiens
ggagtggcactctgaggcgggg

SEQ ID NO: 8431178 - DNA, 22 bp, Homo sapiens
ggagtggcagagagggtatact

SEQ ID NO: 8431179 - DNA, 22 bp, Homo sapiens
ggagtgggaacaatgacatggt

SEQ ID NO: 8431180 - DNA, 22 bp, Homo sapiens
ggagtgggaacaatgacatggt

SEQ ID NO: 8431181 - DNA, 22 bp, Homo sapiens
ggagtgggcagcactgccctgt

SEQ ID NO: 8431182 - DNA, 22 bp, Homo sapiens
ggcaggctccaagcatcctatg

SEQ ID NO: 8431183 - DNA, 22 bp, Homo sapiens
ggcaggctccagagccctctcc

SEQ ID NO: 8431184 - DNA, 22 bp, Homo sapiens
ggcaggctcagcagccaaggag

SEQ ID NO: 8431185 - DNA, 22 bp, Homo sapiens
ggcaggctcagcagccaaggag

SEQ ID NO: 8431186 - DNA, 22 bp, Homo sapiens
ggcaggctcagcagccaaggag

SEQ ID NO: 8431187 - DNA, 22 bp, Homo sapiens
ggcaggctcagcagccaaggag

SEQ ID NO: 8431188 - DNA, 22 bp, Homo sapiens
ggcaggctccaagcatcctatg

SEQ ID NO: 8431189 - DNA, 22 bp, Homo sapiens
ggcaggctgcttgggtcatgtc

SEQ ID NO: 8431190 - DNA, 22 bp, Homo sapiens
ggcaggctcttggccttatgag

SEQ ID NO: 8431191 - DNA, 22 bp, Homo sapiens
ggcaggctcttggccttatgag

SEQ ID NO: 8431192 - DNA, 22 bp, Homo sapiens
ggcaggcagcctccatccacag

SEQ ID NO: 8431193 - DNA, 22 bp, Homo sapiens
ggcaggcaggagcgtgcttggg

SEQ ID NO: 8431194 - DNA, 22 bp, Homo sapiens
ggcaggctagcactgatgtcct

SEQ ID NO: 8431195 - DNA, 22 bp, Homo sapiens
ggcaggctgggagtcatcagag

SEQ ID NO: 8431196 - DNA, 22 bp, Homo sapiens
ggcaggctgcttgggtcatgtc

SEQ ID NO: 8431197 - DNA, 22 bp, Homo sapiens
ggcaggctgcttgggtcatgtc

SEQ ID NO: 8431198 - DNA, 19 bp, Homo sapiens
ggcaggctggatagagagg

SEQ ID NO: 8431199 - DNA, 22 bp, Homo sapiens
ggcaggtgaggcatgtgcctgg

SEQ ID NO: 8431200 - DNA, 22 bp, Homo sapiens
ggcaggctgggtgtcatggagt

SEQ ID NO: 8431201 - DNA, 22 bp, Homo sapiens
ggcaggctgggagtcatcagag

SEQ ID NO: 8431202 - DNA, 22 bp, Homo sapiens
ggcaggctgggtgtcatggagt

SEQ ID NO: 8431203 - DNA, 22 bp, Homo sapiens
ggcaggctgggtgtcatggagt

SEQ ID NO: 8431204 - DNA, 20 bp, Homo sapiens
ggcaggtgctcgcttggtct

SEQ ID NO: 8431205 - DNA, 20 bp, Homo sapiens
ggcaggtgctcgcttggtct

SEQ ID NO: 8431206 - DNA, 22 bp, Homo sapiens
ggcaggtgctaagagaggtaaa

SEQ ID NO: 8431207 - DNA, 22 bp, Homo sapiens
ggcaggtgctaagagaggtaaa

SEQ ID NO: 8431208 - DNA, 22 bp, Homo sapiens
ggcaggtgcgcatgttgcatta

SEQ ID NO: 8431209 - DNA, 17 bp, Homo sapiens
ggcaggtgcggggccgc

SEQ ID NO: 8431210 - DNA, 17 bp, Homo sapiens
ggcaggtgcggggccgc

SEQ ID NO: 8431211 - DNA, 17 bp, Homo sapiens
ggcaggtgcggggccgc

SEQ ID NO: 8431212 - DNA, 22 bp, Homo sapiens
ggcagaggaagctggaagtggg

SEQ ID NO: 8431213 - DNA, 22 bp, Homo sapiens
ggcagaggaagctggaagtggg

SEQ ID NO: 8431214 - DNA, 22 bp, Homo sapiens
ggcagaggaagctggaagtggg

SEQ ID NO: 8431215 - DNA, 20 bp, Homo sapiens
ggcagctctagtcgaggccc

SEQ ID NO: 8431216 - DNA, 22 bp, Homo sapiens
ggcagctctgatgatgctctgg

SEQ ID NO: 8431217 - DNA, 23 bp, Homo sapiens
ggcagctctcatctgatgactga

SEQ ID NO: 8431218 - DNA, 23 bp, Homo sapiens
ggcagctctcatctgatgactga

SEQ ID NO: 8431219 - DNA, 22 bp, Homo sapiens
ggcagaggaagctggaagtggg

SEQ ID NO: 8431220 - DNA, 22 bp, Homo sapiens
ggcagctggcctcctcgcccac

SEQ ID NO: 8431221 - DNA, 22 bp, Homo sapiens
ggcagctggcctcctcgcccac

SEQ ID NO: 8431222 - DNA, 22 bp, Homo sapiens
ggcagctgctgcattacgttgt

SEQ ID NO: 8431223 - DNA, 17 bp, Homo sapiens
ggcagctgccacttttt

SEQ ID NO: 8431224 - DNA, 22 bp, Homo sapiens
ggcagctctgctccacatgagt

SEQ ID NO: 8431225 - DNA, 22 bp, Homo sapiens
ggcagctctgctccttggctcc

SEQ ID NO: 8431226 - DNA, 22 bp, Homo sapiens
ggcagctctgctaattgagcct

SEQ ID NO: 8431227 - DNA, 22 bp, Homo sapiens
ggcagctctgctaattgagcct

SEQ ID NO: 8431228 - DNA, 22 bp, Homo sapiens
ggcagctgggttggccagaaac

SEQ ID NO: 8431229 - DNA, 22 bp, Homo sapiens
ggcagctgggtcacaccgatct

SEQ ID NO: 8431230 - DNA, 22 bp, Homo sapiens
ggcagctggggcagtgccctgt

SEQ ID NO: 8431231 - DNA, 22 bp, Homo sapiens
ggcagctggttctttccattaa

SEQ ID NO: 8431232 - DNA, 22 bp, Homo sapiens
ggcagctggttctttccattaa

SEQ ID NO: 8431233 - DNA, 22 bp, Homo sapiens
ggcagctgtaagatgagtgaat

SEQ ID NO: 8431234 - DNA, 22 bp, Homo sapiens
ggcagctgtctctgagttagca

SEQ ID NO: 8431235 - DNA, 22 bp, Homo sapiens
ggcagctgtgaagtgcctcaca

SEQ ID NO: 8431236 - DNA, 22 bp, Homo sapiens
ggagggaaccttggctggattg

SEQ ID NO: 8431237 - DNA, 22 bp, Homo sapiens
ggagggaatgtctagcattctt

SEQ ID NO: 8431238 - DNA, 22 bp, Homo sapiens
ggagggaagtgagttctcagct

SEQ ID NO: 8431239 - DNA, 22 bp, Homo sapiens
ggagggaatgtctagcattctt

SEQ ID NO: 8431240 - DNA, 22 bp, Homo sapiens
ggagggcacaggaccagaaatc

SEQ ID NO: 8431241 - DNA, 21 bp, Homo sapiens
ggagggcagcccagactggct

SEQ ID NO: 8431242 - DNA, 21 bp, Homo sapiens
ggagggcagcccagactggct

SEQ ID NO: 8431243 - DNA, 22 bp, Homo sapiens
ggagggcatcaatcaggcctgg

SEQ ID NO: 8431244 - DNA, 22 bp, Homo sapiens
ggagggcatcaatcaggcctgg

SEQ ID NO: 8431245 - DNA, 22 bp, Homo sapiens
ggagggccatcttgggtgtgat

SEQ ID NO: 8431246 - DNA, 22 bp, Homo sapiens
ggagggccatcttgggtgtgat

SEQ ID NO: 8431247 - DNA, 22 bp, Homo sapiens
ggagggcccctccagtgggcag

SEQ ID NO: 8431248 - DNA, 22 bp, Homo sapiens
ggagggccctgggtgcagctct

SEQ ID NO: 8431249 - DNA, 22 bp, Homo sapiens
ggaggggaactaatcccgtgac

SEQ ID NO: 8431250 - DNA, 22 bp, Homo sapiens
ggaggctgagaagtccaagatc

SEQ ID NO: 8431251 - DNA, 22 bp, Homo sapiens
ggaggctgagaagtccaagatc

SEQ ID NO: 8431252 - DNA, 22 bp, Homo sapiens
ggaggctgagaggtcgcagtgg

SEQ ID NO: 8431253 - DNA, 22 bp, Homo sapiens
ggaggctgaggcccctcacagg

SEQ ID NO: 8431254 - DNA, 22 bp, Homo sapiens
ggaggctccatgagctcctgca

SEQ ID NO: 8431255 - DNA, 22 bp, Homo sapiens
ggaggccatgggcagaatcttt

SEQ ID NO: 8431256 - DNA, 22 bp, Homo sapiens
ggaggcctagaaaagtggttct

SEQ ID NO: 8431257 - DNA, 22 bp, Homo sapiens
ggaggcctcagtaccttgcttt

SEQ ID NO: 8431258 - DNA, 22 bp, Homo sapiens
ggaggcctggacttcctgatgg

SEQ ID NO: 8431259 - DNA, 20 bp, Homo sapiens
ggagggtggaagaaagcaag

SEQ ID NO: 8431260 - DNA, 22 bp, Homo sapiens
ggagggtggcagcgtcctgggc

SEQ ID NO: 8431261 - DNA, 22 bp, Homo sapiens
ggaggtggaggttgcagtgagc

SEQ ID NO: 8431262 - DNA, 22 bp, Homo sapiens
ggaggtgggagcctccagtggt

SEQ ID NO: 8431263 - DNA, 22 bp, Homo sapiens
ggaggtgggagcctccagtggt

SEQ ID NO: 8431264 - DNA, 22 bp, Homo sapiens
ggaggtgggagcctccagtggt

SEQ ID NO: 8431265 - DNA, 22 bp, Homo sapiens
ggaggtggcctgaaaatgtggc

SEQ ID NO: 8431266 - DNA, 22 bp, Homo sapiens
ggaggtggcctgaaaatgtggc

SEQ ID NO: 8431267 - DNA, 22 bp, Homo sapiens
ggagtagctgcattccgagcac

SEQ ID NO: 8431268 - DNA, 22 bp, Homo sapiens
ggagtaggccccgggagagagt

SEQ ID NO: 8431269 - DNA, 22 bp, Homo sapiens
ggaggtggtttgatttctatat

SEQ ID NO: 8431270 - DNA, 22 bp, Homo sapiens
ggaggtggtggcagtgacaatt

SEQ ID NO: 8431271 - DNA, 22 bp, Homo sapiens
ggaggtgggctaaggactctct

SEQ ID NO: 8431272 - DNA, 22 bp, Homo sapiens
ggaggtgggctaaggactctct

SEQ ID NO: 8431273 - DNA, 22 bp, Homo sapiens
ggaggggctgagcaactttcag

SEQ ID NO: 8431274 - DNA, 22 bp, Homo sapiens
ggagggggaaactttggctgcc

SEQ ID NO: 8431275 - DNA, 22 bp, Homo sapiens
ggagggggaaactttggctgcc

SEQ ID NO: 8431276 - DNA, 22 bp, Homo sapiens
ggagggggaattcagccccagc

SEQ ID NO: 8431277 - DNA, 22 bp, Homo sapiens
ggagggggaattcagccccagc

SEQ ID NO: 8431278 - DNA, 22 bp, Homo sapiens
ggagggggaattcagccccagc

SEQ ID NO: 8431279 - DNA, 22 bp, Homo sapiens
ggaggggagtctcccaaagccg

SEQ ID NO: 8431280 - DNA, 22 bp, Homo sapiens
ggaggggagtctcccaaagccg

SEQ ID NO: 8431281 - DNA, 22 bp, Homo sapiens
ggagggtgcattttaccctgtg

SEQ ID NO: 8431282 - DNA, 22 bp, Homo sapiens
ggagggggactgacactgattt

SEQ ID NO: 8431283 - DNA, 22 bp, Homo sapiens
ggagggggactgacactgattt

SEQ ID NO: 8431284 - DNA, 22 bp, Homo sapiens
gtgtgcaggtgtcagtgcagct

SEQ ID NO: 8431285 - DNA, 22 bp, Homo sapiens
gtgtgcaggggcttggtggagc

SEQ ID NO: 8431286 - DNA, 22 bp, Homo sapiens
gtgtgcagggatgagtgcaggt

SEQ ID NO: 8431287 - DNA, 22 bp, Homo sapiens
gtgtgcagaagacacaagacat

SEQ ID NO: 8431288 - DNA, 23 bp, Homo sapiens
gtgtgcaggattatttgcagaca

SEQ ID NO: 8431289 - DNA, 22 bp, Homo sapiens
gtgtgcagcagagacaggactc

SEQ ID NO: 8431290 - DNA, 22 bp, Homo sapiens
gtgtgcagaggcaggaggtgct

SEQ ID NO: 8431291 - DNA, 22 bp, Homo sapiens
gtgtgcagaacagggagtgggt

SEQ ID NO: 8431292 - DNA, 22 bp, Homo sapiens
gtgtggggccaggatcagggct

SEQ ID NO: 8431293 - DNA, 22 bp, Homo sapiens
gtgtggggaggagagagccctt

SEQ ID NO: 8431294 - DNA, 22 bp, Homo sapiens
gtgtgggaggaaggtgaacaga

SEQ ID NO: 8431295 - DNA, 22 bp, Homo sapiens
gtgtgcagtagagaaagagcag

SEQ ID NO: 8431296 - DNA, 22 bp, Homo sapiens
gtgtgcagtctgctaggcaggg

SEQ ID NO: 8431297 - DNA, 22 bp, Homo sapiens
gtgtgtcagagctcagagaagt

SEQ ID NO: 8431298 - DNA, 22 bp, Homo sapiens
gtgtggtcgaagttctcccgga

SEQ ID NO: 8431299 - DNA, 19 bp, Homo sapiens
gtgtcaggatgtgcagggg

SEQ ID NO: 8431300 - DNA, 22 bp, Homo sapiens
gtgtcattactgaaagattgaa

SEQ ID NO: 8431301 - DNA, 23 bp, Homo sapiens
gtgtcattactgtaattattgtg

SEQ ID NO: 8431302 - DNA, 22 bp, Homo sapiens
gtgtccagcgtggaatgagggt

SEQ ID NO: 8431303 - DNA, 22 bp, Homo sapiens
gtgtcccaaagattagaaatca

SEQ ID NO: 8431304 - DNA, 22 bp, Homo sapiens
gtgtcccaatgttcaggacggc

SEQ ID NO: 8431305 - DNA, 22 bp, Homo sapiens
gtgtcccaaagattagaaatca

SEQ ID NO: 8431306 - DNA, 22 bp, Homo sapiens
gtgtccattcactgcaacactt

SEQ ID NO: 8431307 - DNA, 22 bp, Homo sapiens
gtgtcctgggggacttcaggtt

SEQ ID NO: 8431308 - DNA, 22 bp, Homo sapiens
gtgtcctgcacagcaccttgca

SEQ ID NO: 8431309 - DNA, 22 bp, Homo sapiens
gtgtcctgcattggctctgccc

SEQ ID NO: 8431310 - DNA, 22 bp, Homo sapiens
gtgtcctgccaccctgggcttt

SEQ ID NO: 8431311 - DNA, 22 bp, Homo sapiens
gtgtcctgcattggctctgccc

SEQ ID NO: 8431312 - DNA, 22 bp, Homo sapiens
gtgtcctgccaccctgggcttt

SEQ ID NO: 8431313 - DNA, 22 bp, Homo sapiens
gtgtcctgccaccctgggcttt

SEQ ID NO: 8431314 - DNA, 18 bp, Homo sapiens
gtgtcctggctgcggcgc

SEQ ID NO: 8431315 - DNA, 18 bp, Homo sapiens
gtgtcctggctgcggcgc

SEQ ID NO: 8431316 - DNA, 18 bp, Homo sapiens
gtgtcctggctgcggcgc

SEQ ID NO: 8431317 - DNA, 22 bp, Homo sapiens
gtgtcccagcagcacattggct

SEQ ID NO: 8431318 - DNA, 22 bp, Homo sapiens
gtgtcccagccccacaggcctg

SEQ ID NO: 8431319 - DNA, 22 bp, Homo sapiens
gtgtcccagcagcacattggct

SEQ ID NO: 8431320 - DNA, 22 bp, Homo sapiens
gtgtcctcttattgctcttggc

SEQ ID NO: 8431321 - DNA, 22 bp, Homo sapiens
gtgtcctgagtgaggcctggcc

SEQ ID NO: 8431322 - DNA, 22 bp, Homo sapiens
gtgtcctgagtgaggcctggcc

SEQ ID NO: 8431323 - DNA, 22 bp, Homo sapiens
gtgtcctgatcaattgagctgg

SEQ ID NO: 8431324 - DNA, 22 bp, Homo sapiens
gttctctcagcgatagtgatgg

SEQ ID NO: 8431325 - DNA, 22 bp, Homo sapiens
gttctctgccggcacctacccg

SEQ ID NO: 8431326 - DNA, 22 bp, Homo sapiens
gttctctgagtcctggcaaaat

SEQ ID NO: 8431327 - DNA, 22 bp, Homo sapiens
gttctctgccacttaccagcta

SEQ ID NO: 8431328 - DNA, 22 bp, Homo sapiens
gttctctggagtccctgggccc

SEQ ID NO: 8431329 - DNA, 22 bp, Homo sapiens
gttctctggaaactatgattca

SEQ ID NO: 8431330 - DNA, 22 bp, Homo sapiens
gttctctgcgctcccggcccgg

SEQ ID NO: 8431331 - DNA, 22 bp, Homo sapiens
gttctattcattgctccacgag

SEQ ID NO: 8431332 - DNA, 21 bp, Homo sapiens
gttctattttgcaaacttctg

SEQ ID NO: 8431333 - DNA, 22 bp, Homo sapiens
gttctcagggataacttccccc

SEQ ID NO: 8431334 - DNA, 22 bp, Homo sapiens
gttctcagtggggagcagggtt

SEQ ID NO: 8431335 - DNA, 22 bp, Homo sapiens
gttctcatagtggaaaataggt

SEQ ID NO: 8431336 - DNA, 22 bp, Homo sapiens
gttctccctgtcccctgagctt

SEQ ID NO: 8431337 - DNA, 22 bp, Homo sapiens
gttctgcctgtggcttctgtgg

SEQ ID NO: 8431338 - DNA, 22 bp, Homo sapiens
gttctgagtcctcctttgaagg

SEQ ID NO: 8431339 - DNA, 22 bp, Homo sapiens
gttgtattcttcaatatcagag

SEQ ID NO: 8431340 - DNA, 22 bp, Homo sapiens
gttgtatttgcctgaatgcagt

SEQ ID NO: 8431341 - DNA, 22 bp, Homo sapiens
gttgttttaaaatactccagaa

SEQ ID NO: 8431342 - DNA, 22 bp, Homo sapiens
gttgttttataattgattgcaa

SEQ ID NO: 8431343 - DNA, 22 bp, Homo sapiens
gttgtttataaaaatatctagc

SEQ ID NO: 8431344 - DNA, 22 bp, Homo sapiens
gttgttctccctaacaattact

SEQ ID NO: 8431345 - DNA, 22 bp, Homo sapiens
gttgtgcaaccatcaccaccat

SEQ ID NO: 8431346 - DNA, 22 bp, Homo sapiens
gttgtgcagtcagactgcctgg

SEQ ID NO: 8431347 - DNA, 22 bp, Homo sapiens
gttgtgcagggcgaggacctga

SEQ ID NO: 8431348 - DNA, 22 bp, Homo sapiens
gttgtgcagaagtgcctcagta

SEQ ID NO: 8431349 - DNA, 22 bp, Homo sapiens
gttctactttctgtgtctttga

SEQ ID NO: 8431350 - DNA, 22 bp, Homo sapiens
gttctacagttcctattactta

SEQ ID NO: 8431351 - DNA, 22 bp, Homo sapiens
gttctattactccctgcttctt

SEQ ID NO: 8431352 - DNA, 21 bp, Homo sapiens
gttcaaatgggtagattcaca

SEQ ID NO: 8431353 - DNA, 22 bp, Homo sapiens
gttcaagaccagcctggccaac

SEQ ID NO: 8431354 - DNA, 22 bp, Homo sapiens
gtggggtagatctttctcagga

SEQ ID NO: 8431355 - DNA, 22 bp, Homo sapiens
gtgggggtggaaaggcaagttg

SEQ ID NO: 8431356 - DNA, 22 bp, Homo sapiens
gtgggggctggctcgtcctgtg

SEQ ID NO: 8431357 - DNA, 22 bp, Homo sapiens
gtgggggctggctcgtcctgtg

SEQ ID NO: 8431358 - DNA, 18 bp, Homo sapiens
gtggggtgttgtgaggat

SEQ ID NO: 8431359 - DNA, 18 bp, Homo sapiens
gtggggtgttgtgaggat

SEQ ID NO: 8431360 - DNA, 22 bp, Homo sapiens
gtggggtgcagcagtactgtgt

SEQ ID NO: 8431361 - DNA, 22 bp, Homo sapiens
gtggtcagcagcagtgggagtg

SEQ ID NO: 8431362 - DNA, 22 bp, Homo sapiens
gtggtcagcagcagtgggagtg

SEQ ID NO: 8431363 - DNA, 22 bp, Homo sapiens
gtggtcagagatgacagtgggt

SEQ ID NO: 8431364 - DNA, 22 bp, Homo sapiens
gtggtcagaatggagcccagga

SEQ ID NO: 8431365 - DNA, 22 bp, Homo sapiens
gtggtcagaaatctcagtggca

SEQ ID NO: 8431366 - DNA, 20 bp, Homo sapiens
gtggtattcagtaacagtga

SEQ ID NO: 8431367 - DNA, 22 bp, Homo sapiens
gtggtcaggcagtgggagagaa

SEQ ID NO: 8431368 - DNA, 22 bp, Homo sapiens
gtgggtggagactgggtgcaag

SEQ ID NO: 8431369 - DNA, 22 bp, Homo sapiens
gtgggtccctaaacacatccca

SEQ ID NO: 8431370 - DNA, 22 bp, Homo sapiens
gtgggtccgcttggttccggtg

SEQ ID NO: 8431371 - DNA, 17 bp, Homo sapiens
gtgtaactatgagccat

SEQ ID NO: 8431372 - DNA, 22 bp, Homo sapiens
gtgtaaagatgccaggaatctt

SEQ ID NO: 8431373 - DNA, 22 bp, Homo sapiens
gtgtaaaaacatactatttcta

SEQ ID NO: 8431374 - DNA, 22 bp, Homo sapiens
gtgtacaaaatgtctccatgga

SEQ ID NO: 8431375 - DNA, 17 bp, Homo sapiens
gtgtacaagcagaaggc

SEQ ID NO: 8431376 - DNA, 19 bp, Homo sapiens
gtgtacagctcagtgaatt

SEQ ID NO: 8431377 - DNA, 22 bp, Homo sapiens
gtgtacagatatctcacgttct

SEQ ID NO: 8431378 - DNA, 22 bp, Homo sapiens
gtgtacaggatgactgtactta

SEQ ID NO: 8431379 - DNA, 22 bp, Homo sapiens
gtgtcaacagccgaagataaat

SEQ ID NO: 8431380 - DNA, 22 bp, Homo sapiens
gtgtacaggatgactgtactta

SEQ ID NO: 8431381 - DNA, 22 bp, Homo sapiens
gtggtttaggggaaagaactgt

SEQ ID NO: 8431382 - DNA, 21 bp, Homo sapiens
gtggttctagagaaacagaat

SEQ ID NO: 8431383 - DNA, 21 bp, Homo sapiens
gtggttctagagaaacagaat

SEQ ID NO: 8431384 - DNA, 22 bp, Homo sapiens
gtggtgtttgagctgccaggga

SEQ ID NO: 8431385 - DNA, 22 bp, Homo sapiens
gtggtccatcatgcagagctcc

SEQ ID NO: 8431386 - DNA, 22 bp, Homo sapiens
gtggtcctgcacccgcttggcc

SEQ ID NO: 8431387 - DNA, 22 bp, Homo sapiens
gtggtcctcataattcagtgag

SEQ ID NO: 8431388 - DNA, 22 bp, Homo sapiens
gtggtcctggcaaccatggtga

SEQ ID NO: 8431389 - DNA, 22 bp, Homo sapiens
gtggtctggggtcaggcctgag

SEQ ID NO: 8431390 - DNA, 22 bp, Homo sapiens
gtgggctgcccttgaggtcagc

SEQ ID NO: 8431391 - DNA, 22 bp, Homo sapiens
gtgggctgcccttgaggtcagc

SEQ ID NO: 8431392 - DNA, 22 bp, Homo sapiens
gtgggcttgttttgatgagatc

SEQ ID NO: 8431393 - DNA, 22 bp, Homo sapiens
gtgggctcaggcctctgtgggg

SEQ ID NO: 8431394 - DNA, 22 bp, Homo sapiens
gtgggctcccctggcatgtcca

SEQ ID NO: 8431395 - DNA, 22 bp, Homo sapiens
gtgggcctcccctttacgagcc

SEQ ID NO: 8431396 - DNA, 22 bp, Homo sapiens
gtgggcctgatgctgccatgag

SEQ ID NO: 8431397 - DNA, 22 bp, Homo sapiens
gtggggaggcctaagcaagttg

SEQ ID NO: 8431398 - DNA, 22 bp, Homo sapiens
gtggggaggcctaagcaagttg

SEQ ID NO: 8431399 - DNA, 22 bp, Homo sapiens
gtggggctggaagatgggtact

SEQ ID NO: 8431400 - DNA, 22 bp, Homo sapiens
gtggggaggcattcttctccct

SEQ ID NO: 8431401 - DNA, 22 bp, Homo sapiens
gtggggaggcattcttctccct

SEQ ID NO: 8431402 - DNA, 22 bp, Homo sapiens
gtggggaaaggagtggggctca

SEQ ID NO: 8431403 - DNA, 22 bp, Homo sapiens
gtgggcttttgacagtgcctgg

SEQ ID NO: 8431404 - DNA, 22 bp, Homo sapiens
gtgggggctggaaatcttgcca

SEQ ID NO: 8431405 - DNA, 22 bp, Homo sapiens
gtgggggctggaaatcttgcca

SEQ ID NO: 8431406 - DNA, 22 bp, Homo sapiens
gtgggggcagtgggcttcgagc

SEQ ID NO: 8431407 - DNA, 22 bp, Homo sapiens
gtgggggcagtgggcttcgagc

SEQ ID NO: 8431408 - DNA, 22 bp, Homo sapiens
gtgggggcaggcagtgctagga

SEQ ID NO: 8431409 - DNA, 22 bp, Homo sapiens
gtgggggacccaggtgctgtcc

SEQ ID NO: 8431410 - DNA, 22 bp, Homo sapiens
gtgggcagagcaagggaactca

SEQ ID NO: 8431411 - DNA, 22 bp, Homo sapiens
gtgggcagcaccagggaagtgt

SEQ ID NO: 8431412 - DNA, 20 bp, Homo sapiens
gtgggcagcaggcatactgg

SEQ ID NO: 8431413 - DNA, 22 bp, Homo sapiens
taaatactttacaggatgtctc

SEQ ID NO: 8431414 - DNA, 22 bp, Homo sapiens
taaatactttacaggatgtctc

SEQ ID NO: 8431415 - DNA, 22 bp, Homo sapiens
taaaggcttttacaggagtgca

SEQ ID NO: 8431416 - DNA, 22 bp, Homo sapiens
taaaggctttattttccagtca

SEQ ID NO: 8431417 - DNA, 21 bp, Homo sapiens
taaaggctttagaatggcaaa

SEQ ID NO: 8431418 - DNA, 22 bp, Homo sapiens
taaaggctcgtattgttgtgtg

SEQ ID NO: 8431419 - DNA, 22 bp, Homo sapiens
taaaggcttcggagtgcacact

SEQ ID NO: 8431420 - DNA, 20 bp, Homo sapiens
taaaggctgtgaggtggccc

SEQ ID NO: 8431421 - DNA, 22 bp, Homo sapiens
taaaggcttctgcagggactga

SEQ ID NO: 8431422 - DNA, 22 bp, Homo sapiens
taaaggctcactggcttggggt

SEQ ID NO: 8431423 - DNA, 22 bp, Homo sapiens
taaaggctcagggaaccagatc

SEQ ID NO: 8431424 - DNA, 22 bp, Homo sapiens
taaaggcagttggagttgagga

SEQ ID NO: 8431425 - DNA, 22 bp, Homo sapiens
taaaggattttgtataatataa

SEQ ID NO: 8431426 - DNA, 22 bp, Homo sapiens
taaaggcaaatgtgtgtttgtg

SEQ ID NO: 8431427 - DNA, 22 bp, Homo sapiens
taaaggaagaattctctgtgat

SEQ ID NO: 8431428 - DNA, 22 bp, Homo sapiens
taaagctgcaggctcagaaaac

SEQ ID NO: 8431429 - DNA, 22 bp, Homo sapiens
taaagctgaaatgattatgaca

SEQ ID NO: 8431430 - DNA, 22 bp, Homo sapiens
taaagctgttcagtgcagaaag

SEQ ID NO: 8431431 - DNA, 22 bp, Homo sapiens
taaagctgttagagtagtaaga

SEQ ID NO: 8431432 - DNA, 22 bp, Homo sapiens
taaagctgttcagtgcagaaag

SEQ ID NO: 8431433 - DNA, 22 bp, Homo sapiens
taaagcttgtattgcaatattt

SEQ ID NO: 8431434 - DNA, 22 bp, Homo sapiens
taaaaccaggtcttgggattta

SEQ ID NO: 8431435 - DNA, 22 bp, Homo sapiens
taaaaccattcctgctttcatg

SEQ ID NO: 8431436 - DNA, 22 bp, Homo sapiens
taaaaccataaggctggaagga

SEQ ID NO: 8431437 - DNA, 22 bp, Homo sapiens
gtttaaataattaggggcctgt

SEQ ID NO: 8431438 - DNA, 22 bp, Homo sapiens
gttgtttttgttctctatagct

SEQ ID NO: 8431439 - DNA, 22 bp, Homo sapiens
gtttaagtttcagaagctaaga

SEQ ID NO: 8431440 - DNA, 22 bp, Homo sapiens
gtttaagagggtttcattccca

SEQ ID NO: 8431441 - DNA, 22 bp, Homo sapiens
gtttaataatgttgaattacta

SEQ ID NO: 8431442 - DNA, 22 bp, Homo sapiens
gtttaataatgttgaattacta

SEQ ID NO: 8431443 - DNA, 22 bp, Homo sapiens
gtttttctagaaatctcctcct

SEQ ID NO: 8431444 - DNA, 22 bp, Homo sapiens
gtttttctaagtagcgatattt

SEQ ID NO: 8431445 - DNA, 22 bp, Homo sapiens
taaaaaacattactctgtcctg

SEQ ID NO: 8431446 - DNA, 22 bp, Homo sapiens
gttttttcatgagtagttatct

SEQ ID NO: 8431447 - DNA, 22 bp, Homo sapiens
taaaacacataaactctctatt

SEQ ID NO: 8431448 - DNA, 22 bp, Homo sapiens
gttttttcatgagtagttatct

SEQ ID NO: 8431449 - DNA, 22 bp, Homo sapiens
gtttttctgtgagcggtaaagg

SEQ ID NO: 8431450 - DNA, 22 bp, Homo sapiens
gtttttctttgtgtgaagacaa

SEQ ID NO: 8431451 - DNA, 22 bp, Homo sapiens
gtttttctaggaccatgtgatt

SEQ ID NO: 8431452 - DNA, 22 bp, Homo sapiens
gtttttctagactgggagtttg

SEQ ID NO: 8431453 - DNA, 22 bp, Homo sapiens
gtttttctagactgggagtttg

SEQ ID NO: 8431454 - DNA, 22 bp, Homo sapiens
gtttttctagactgggagtttg

SEQ ID NO: 8431455 - DNA, 22 bp, Homo sapiens
gtttttctctgaaatagttgac

SEQ ID NO: 8431456 - DNA, 20 bp, Homo sapiens
gtttttctctcttgccacta

SEQ ID NO: 8431457 - DNA, 20 bp, Homo sapiens
gtttttctctcttgccacta

SEQ ID NO: 8431458 - DNA, 20 bp, Homo sapiens
gtttttcttgggcgagctat

SEQ ID NO: 8431459 - DNA, 22 bp, Homo sapiens
gtttttctgtgagcggtaaagg

SEQ ID NO: 8431460 - DNA, 22 bp, Homo sapiens
gtttttctctgaaatagttgac

SEQ ID NO: 8431461 - DNA, 22 bp, Homo sapiens
taaatgaagctcatgggccaca

SEQ ID NO: 8431462 - DNA, 22 bp, Homo sapiens
taaatgacattcttaagtcttg

SEQ ID NO: 8431463 - DNA, 22 bp, Homo sapiens
taacactgaaaatgatgcatgt

SEQ ID NO: 8431464 - DNA, 22 bp, Homo sapiens
taaatgagtaatatagctgttt

SEQ ID NO: 8431465 - DNA, 22 bp, Homo sapiens
taaatgagtaatatagctgttt

SEQ ID NO: 8431466 - DNA, 22 bp, Homo sapiens
taacactgatttgttctcaggg

SEQ ID NO: 8431467 - DNA, 22 bp, Homo sapiens
taacactgcttcattttggaga

SEQ ID NO: 8431468 - DNA, 22 bp, Homo sapiens
taacactgccatgctggagtca

SEQ ID NO: 8431469 - DNA, 22 bp, Homo sapiens
taacactggtatttcatttagt

SEQ ID NO: 8431470 - DNA, 22 bp, Homo sapiens
taacactggttatccctgtgca

SEQ ID NO: 8431471 - DNA, 22 bp, Homo sapiens
taacactggttatccctgtgca

SEQ ID NO: 8431472 - DNA, 22 bp, Homo sapiens
taacactggagagttggttgtg

SEQ ID NO: 8431473 - DNA, 22 bp, Homo sapiens
taacactggcttttgctgaggc

SEQ ID NO: 8431474 - DNA, 22 bp, Homo sapiens
taacactggcttttgctgaggc

SEQ ID NO: 8431475 - DNA, 22 bp, Homo sapiens
taaatgaaagggtttaatttat

SEQ ID NO: 8431476 - DNA, 22 bp, Homo sapiens
taaatgaagaaatggagattgt

SEQ ID NO: 8431477 - DNA, 22 bp, Homo sapiens
taaatgaagaaatggagattgt

SEQ ID NO: 8431478 - DNA, 22 bp, Homo sapiens
taaatcttgtggcaatgcttct

SEQ ID NO: 8431479 - DNA, 22 bp, Homo sapiens
taaatctttaggaagctcaaac

SEQ ID NO: 8431480 - DNA, 22 bp, Homo sapiens
taaatctttaggaagctcaaac

SEQ ID NO: 8431481 - DNA, 22 bp, Homo sapiens
taaatcttctacatcatcataa

SEQ ID NO: 8431482 - DNA, 21 bp, Homo sapiens
taaatctctgtattcttcagt

SEQ ID NO: 8431483 - DNA, 18 bp, Homo sapiens
taaatctctctttagtca

SEQ ID NO: 8431484 - DNA, 22 bp, Homo sapiens
taaatacttttactccactgat

SEQ ID NO: 8431485 - DNA, 22 bp, Homo sapiens
taaatacttttactccactgat

SEQ ID NO: 8431486 - DNA, 22 bp, Homo sapiens
taaatccagcttctaatttaga

SEQ ID NO: 8431487 - DNA, 22 bp, Homo sapiens
taacagagttgtacagttacgt

SEQ ID NO: 8431488 - DNA, 22 bp, Homo sapiens
taacagcactggcaggcactgt

SEQ ID NO: 8431489 - DNA, 22 bp, Homo sapiens
taacagagatagaaatgtaaag

SEQ ID NO: 8431490 - DNA, 22 bp, Homo sapiens
taacagaggtagaattcaaggt

SEQ ID NO: 8431491 - DNA, 22 bp, Homo sapiens
taacagagtaacaggtatgtaa

SEQ ID NO: 8431492 - DNA, 22 bp, Homo sapiens
taacagaatttgctaaactccg

SEQ ID NO: 8431493 - DNA, 22 bp, Homo sapiens
taacagaatttgctaaactccg

SEQ ID NO: 8431494 - DNA, 22 bp, Homo sapiens
taacagagtgaaaatcagcaca

SEQ ID NO: 8431495 - DNA, 22 bp, Homo sapiens
taacagcagggttacaggcatt

SEQ ID NO: 8431496 - DNA, 22 bp, Homo sapiens
taagaaatttagttatagaatg

SEQ ID NO: 8431497 - DNA, 22 bp, Homo sapiens
taacactgtaaacctagatgtt

SEQ ID NO: 8431498 - DNA, 22 bp, Homo sapiens
taacactgtgcccagagtccca

SEQ ID NO: 8431499 - DNA, 22 bp, Homo sapiens
taacactgtccaaagaattcca

SEQ ID NO: 8431500 - DNA, 22 bp, Homo sapiens
taacactgtggtgttctttgtc

SEQ ID NO: 8431501 - DNA, 22 bp, Homo sapiens
taacagaatagcagaaacagaa

SEQ ID NO: 8431502 - DNA, 22 bp, Homo sapiens
taacagaatcctgttattgcca

SEQ ID NO: 8431503 - DNA, 22 bp, Homo sapiens
taacagaatttgctaaactccg

SEQ ID NO: 8431504 - DNA, 22 bp, Homo sapiens
taacagaatagcagaaacagaa

SEQ ID NO: 8431505 - DNA, 22 bp, Homo sapiens
taacagaatagcagaaacagaa

SEQ ID NO: 8431506 - DNA, 22 bp, Homo sapiens
gtgacagagctgggatttgaag

SEQ ID NO: 8431507 - DNA, 22 bp, Homo sapiens
gtgacaggccactgcggctctg

SEQ ID NO: 8431508 - DNA, 22 bp, Homo sapiens
gtgaccagtgatgctgaggagt

SEQ ID NO: 8431509 - DNA, 22 bp, Homo sapiens
gtgacagggagtgatatagcag

SEQ ID NO: 8431510 - DNA, 22 bp, Homo sapiens
gtgacagtcaaagacatgactt

SEQ ID NO: 8431511 - DNA, 22 bp, Homo sapiens
gtgcctggaactgggtaggctg

SEQ ID NO: 8431512 - DNA, 22 bp, Homo sapiens
gtgcctggaactgggtaggctg

SEQ ID NO: 8431513 - DNA, 22 bp, Homo sapiens
gtgcctgctacctgacttgttt

SEQ ID NO: 8431514 - DNA, 22 bp, Homo sapiens
gtgcgggcctgggggtttctct

SEQ ID NO: 8431515 - DNA, 22 bp, Homo sapiens
gtgctacagactgagtacactt

SEQ ID NO: 8431516 - DNA, 22 bp, Homo sapiens
gtgctacagactgagtacactt

SEQ ID NO: 8431517 - DNA, 22 bp, Homo sapiens
gtgctacagactgagtacactt

SEQ ID NO: 8431518 - DNA, 20 bp, Homo sapiens
gtgcctggagaagaggctgt

SEQ ID NO: 8431519 - DNA, 20 bp, Homo sapiens
gtgcctggagaagaggctgt

SEQ ID NO: 8431520 - DNA, 20 bp, Homo sapiens
gtgcctggagaagaggctgt

SEQ ID NO: 8431521 - DNA, 20 bp, Homo sapiens
gtgcctggagaagaggctgt

SEQ ID NO: 8431522 - DNA, 22 bp, Homo sapiens
gtgcctggcacacagaaggcaa

SEQ ID NO: 8431523 - DNA, 22 bp, Homo sapiens
gtgcctggcacacagaaggcaa

SEQ ID NO: 8431524 - DNA, 22 bp, Homo sapiens
gtggaaggtgctagaacaagga

SEQ ID NO: 8431525 - DNA, 22 bp, Homo sapiens
gtggaaggaattaacagactag

SEQ ID NO: 8431526 - DNA, 22 bp, Homo sapiens
gtggaagggactgcctagagga

SEQ ID NO: 8431527 - DNA, 22 bp, Homo sapiens
gtggaaggtgaaggagcagcga

SEQ ID NO: 8431528 - DNA, 22 bp, Homo sapiens
gtggaacatgtccatatacatt

SEQ ID NO: 8431529 - DNA, 22 bp, Homo sapiens
gtgctttttcaatcagaaggga

SEQ ID NO: 8431530 - DNA, 22 bp, Homo sapiens
gtggaaattttaggatcatctt

SEQ ID NO: 8431531 - DNA, 22 bp, Homo sapiens
gtggcacaaggcttacacagca

SEQ ID NO: 8431532 - DNA, 22 bp, Homo sapiens
gtggattacaagacagttgaga

SEQ ID NO: 8431533 - DNA, 22 bp, Homo sapiens
gtggattacaagacagttgaga

SEQ ID NO: 8431534 - DNA, 22 bp, Homo sapiens
gtggatggctagttgagaaggg

SEQ ID NO: 8431535 - DNA, 22 bp, Homo sapiens
gtggatggattttgaggaatgg

SEQ ID NO: 8431536 - DNA, 22 bp, Homo sapiens
gtggatggccctgcacacaggt

SEQ ID NO: 8431537 - DNA, 22 bp, Homo sapiens
gtggatggccctgcacacaggt

SEQ ID NO: 8431538 - DNA, 22 bp, Homo sapiens
gtggatggagctggaagccatt

SEQ ID NO: 8431539 - DNA, 22 bp, Homo sapiens
gtggatggagcagtgacccagg

SEQ ID NO: 8431540 - DNA, 22 bp, Homo sapiens
gtggatggattgaggcagtggg

SEQ ID NO: 8431541 - DNA, 22 bp, Homo sapiens
gtggatggagctggaagccatt

SEQ ID NO: 8431542 - DNA, 22 bp, Homo sapiens
gtggcagagttgctgactagaa

SEQ ID NO: 8431543 - DNA, 22 bp, Homo sapiens
gtggcagattgctcaccatggt

SEQ ID NO: 8431544 - DNA, 22 bp, Homo sapiens
gtggcagattgctcaccatggt

SEQ ID NO: 8431545 - DNA, 22 bp, Homo sapiens
gtggaatttttacctatgaatg

SEQ ID NO: 8431546 - DNA, 22 bp, Homo sapiens
gtggaggaaaagaagttgggtg

SEQ ID NO: 8431547 - DNA, 22 bp, Homo sapiens
gtggagctggcccaagaagctg

SEQ ID NO: 8431548 - DNA, 22 bp, Homo sapiens
gtggagctggacccaggcctct

SEQ ID NO: 8431549 - DNA, 19 bp, Homo sapiens
gtggagctaagaaaaggaa

SEQ ID NO: 8431550 - DNA, 22 bp, Homo sapiens
gtggagggaatgaatcttctct

SEQ ID NO: 8431551 - DNA, 22 bp, Homo sapiens
gtggatgagataactgtagaag

SEQ ID NO: 8431552 - DNA, 22 bp, Homo sapiens
gtggatggacatgggcaagagg

SEQ ID NO: 8431553 - DNA, 20 bp, Homo sapiens
gtggatgatcagtgtagtgg

SEQ ID NO: 8431554 - DNA, 22 bp, Homo sapiens
gtggccagaaccaggagaatga

SEQ ID NO: 8431555 - DNA, 22 bp, Homo sapiens
gtggccagaggtcccatgtgtc

SEQ ID NO: 8431556 - DNA, 22 bp, Homo sapiens
gtggccagaatcttgaggcctt

SEQ ID NO: 8431557 - DNA, 22 bp, Homo sapiens
gtggccagcaagtgctgcctct

SEQ ID NO: 8431558 - DNA, 22 bp, Homo sapiens
gtggccagccagggtgctgatg

SEQ ID NO: 8431559 - DNA, 22 bp, Homo sapiens
gtggccagccagggtgctgatg

SEQ ID NO: 8431560 - DNA, 18 bp, Homo sapiens
gtggccagcctggtcttg

SEQ ID NO: 8431561 - DNA, 22 bp, Homo sapiens
gtggccctcagcagttgccaag

SEQ ID NO: 8431562 - DNA, 22 bp, Homo sapiens
gtggccctctgatagggtcagg

SEQ ID NO: 8431563 - DNA, 22 bp, Homo sapiens
gtggcccaggctggagtgcagt

SEQ ID NO: 8431564 - DNA, 22 bp, Homo sapiens
gtggcccaggcttggcgctggc

SEQ ID NO: 8431565 - DNA, 22 bp, Homo sapiens
gtggcccaggcaccctgatgac

SEQ ID NO: 8431566 - DNA, 22 bp, Homo sapiens
gtggcccatcacgtttcgcctt

SEQ ID NO: 8431567 - DNA, 22 bp, Homo sapiens
gtggcccaggttggagtgcagt

SEQ ID NO: 8431568 - DNA, 22 bp, Homo sapiens
gtggcccacttacgtcatgtgt

SEQ ID NO: 8431569 - DNA, 22 bp, Homo sapiens
gtggcccagccctacagaggac

SEQ ID NO: 8431570 - DNA, 22 bp, Homo sapiens
gtggcaggatcacggctcactg

SEQ ID NO: 8431571 - DNA, 22 bp, Homo sapiens
gtggcaggatcacggctcactg

SEQ ID NO: 8431572 - DNA, 22 bp, Homo sapiens
gtggcagggcaatgctccctct

SEQ ID NO: 8431573 - DNA, 22 bp, Homo sapiens
gtggcaggagagacacagccat

SEQ ID NO: 8431574 - DNA, 22 bp, Homo sapiens
gtggcaggagagacacagccat

SEQ ID NO: 8431575 - DNA, 22 bp, Homo sapiens
gtggcaggagtgggccttgaag

SEQ ID NO: 8431576 - DNA, 22 bp, Homo sapiens
gtggcaggagactggaagatgg

SEQ ID NO: 8431577 - DNA, 22 bp, Homo sapiens
gtggcagttctgtgtctcttgt

SEQ ID NO: 8431578 - DNA, 22 bp, Homo sapiens
gtggcagtgccgtttggttcag

SEQ ID NO: 8431579 - DNA, 22 bp, Homo sapiens
gtggcatttggaaagagcacta

SEQ ID NO: 8431580 - DNA, 22 bp, Homo sapiens
gtggcattaggccaggtgcata

SEQ ID NO: 8431581 - DNA, 22 bp, Homo sapiens
gtggcattctcggcaccatctg

SEQ ID NO: 8431582 - DNA, 22 bp, Homo sapiens
gtggcattgacatgtaaacagt

SEQ ID NO: 8431583 - DNA, 22 bp, Homo sapiens
gtggctggagtatgaggaaagg

SEQ ID NO: 8431584 - DNA, 22 bp, Homo sapiens
gtggctgggctccgagcggctt

SEQ ID NO: 8431585 - DNA, 22 bp, Homo sapiens
gtggctgggctccgagcggctt

SEQ ID NO: 8431586 - DNA, 22 bp, Homo sapiens
gtggctggtttcctgcatgcaa

SEQ ID NO: 8431587 - DNA, 22 bp, Homo sapiens
gtggctggtttcctgcatgcaa

SEQ ID NO: 8431588 - DNA, 22 bp, Homo sapiens
gtggctgtatagccaagtcaga

SEQ ID NO: 8431589 - DNA, 22 bp, Homo sapiens
gtggctgttcttgccccatgct

SEQ ID NO: 8431590 - DNA, 22 bp, Homo sapiens
gtggcttcacatggcatttggc

SEQ ID NO: 8431591 - DNA, 22 bp, Homo sapiens
gtggcttcaccccagttgtctc

SEQ ID NO: 8431592 - DNA, 22 bp, Homo sapiens
gtggcttcacatggcatttggc

SEQ ID NO: 8431593 - DNA, 22 bp, Homo sapiens
gtggcttcaccccagttgtctc

SEQ ID NO: 8431594 - DNA, 19 bp, Homo sapiens
gtggctgccgatcgcggct

SEQ ID NO: 8431595 - DNA, 22 bp, Homo sapiens
gtggctgctaagtctccttcct

SEQ ID NO: 8431596 - DNA, 22 bp, Homo sapiens
gtggctgctacagagctggagg

SEQ ID NO: 8431597 - DNA, 22 bp, Homo sapiens
gtggctgctacagagctggagg

SEQ ID NO: 8431598 - DNA, 22 bp, Homo sapiens
gtggctgctggtactctgggaa

SEQ ID NO: 8431599 - DNA, 22 bp, Homo sapiens
gtggctgctcgggctccggccc

SEQ ID NO: 8431600 - DNA, 22 bp, Homo sapiens
gtggctgctgtcctctctggtt

SEQ ID NO: 8431601 - DNA, 22 bp, Homo sapiens
gtggctgcatcggggtgaccag

SEQ ID NO: 8431602 - DNA, 22 bp, Homo sapiens
gtggctgcatcggggtgaccag

SEQ ID NO: 8431603 - DNA, 22 bp, Homo sapiens
gtggctgcagctctgaacggac

SEQ ID NO: 8431604 - DNA, 22 bp, Homo sapiens
gtggctgcagctctgaacggac

SEQ ID NO: 8431605 - DNA, 22 bp, Homo sapiens
gtggctgcagtagtgtagggtc

SEQ ID NO: 8431606 - DNA, 22 bp, Homo sapiens
gtggctgcagcccagcggcacg

SEQ ID NO: 8431607 - DNA, 22 bp, Homo sapiens
gtggctgcagcggctgtggaga

SEQ ID NO: 8431608 - DNA, 22 bp, Homo sapiens
gtggctgcagcggctgtggaga

SEQ ID NO: 8431609 - DNA, 22 bp, Homo sapiens
gtggctgcagagggcacagcat

SEQ ID NO: 8431610 - DNA, 22 bp, Homo sapiens
gtggctgcagcccagcggcacg

SEQ ID NO: 8431611 - DNA, 22 bp, Homo sapiens
gtggctgcagagggcacagcat

SEQ ID NO: 8431612 - DNA, 22 bp, Homo sapiens
gtggcttcatcaactgtgctta

SEQ ID NO: 8431613 - DNA, 22 bp, Homo sapiens
gtggcttcatcaactgtgctta

SEQ ID NO: 8431614 - DNA, 22 bp, Homo sapiens
gtggcttcatgaacactgatga

SEQ ID NO: 8431615 - DNA, 22 bp, Homo sapiens
gtggcttccaagactaagtcac

SEQ ID NO: 8431616 - DNA, 22 bp, Homo sapiens
gtggcttccatgtgcatctgac

SEQ ID NO: 8431617 - DNA, 22 bp, Homo sapiens
gtggcttccatgtgcatctgac

SEQ ID NO: 8431618 - DNA, 22 bp, Homo sapiens
gtgggagaaattagctctagtt

SEQ ID NO: 8431619 - DNA, 22 bp, Homo sapiens
gtgggagccctcagggaggtgc

SEQ ID NO: 8431620 - DNA, 22 bp, Homo sapiens
gtgggagtggagctcagcatgt

SEQ ID NO: 8431621 - DNA, 22 bp, Homo sapiens
gtgggagtggggaagcagagtg

SEQ ID NO: 8431622 - DNA, 23 bp, Homo sapiens
gtggcctccccggaatgcctcgc

SEQ ID NO: 8431623 - DNA, 22 bp, Homo sapiens
gtggcctctgttggctcctagg

SEQ ID NO: 8431624 - DNA, 20 bp, Homo sapiens
gtggcctctcacattctgag

SEQ ID NO: 8431625 - DNA, 22 bp, Homo sapiens
gtggcctctgtgctcctgccta

SEQ ID NO: 8431626 - DNA, 22 bp, Homo sapiens
gtggcctggatagactccatct

SEQ ID NO: 8431627 - DNA, 22 bp, Homo sapiens
gtggcctgccgtgtggtatggg

SEQ ID NO: 8431628 - DNA, 22 bp, Homo sapiens
gtggcctggctggcaccacctc

SEQ ID NO: 8431629 - DNA, 22 bp, Homo sapiens
gtggcctggcgagctggcgcgg

SEQ ID NO: 8431630 - DNA, 22 bp, Homo sapiens
gtggctctccattgacatggaa

SEQ ID NO: 8431631 - DNA, 21 bp, Homo sapiens
gtggctctgccaggactgaaa

SEQ ID NO: 8431632 - DNA, 22 bp, Homo sapiens
gtggctgcagagccagcaagct

SEQ ID NO: 8431633 - DNA, 22 bp, Homo sapiens
gtggctgcagagccagcaagct

SEQ ID NO: 8431634 - DNA, 17 bp, Homo sapiens
gtggctgcacacacatg

SEQ ID NO: 8431635 - DNA, 17 bp, Homo sapiens
gtggctgcacacacatg

SEQ ID NO: 8431636 - DNA, 22 bp, Homo sapiens
gtcagctgggcatctgcagatg

SEQ ID NO: 8431637 - DNA, 22 bp, Homo sapiens
gtcaggaaaacccgggttgact

SEQ ID NO: 8431638 - DNA, 22 bp, Homo sapiens
gtcaggaaaaattgataatttt

SEQ ID NO: 8431639 - DNA, 22 bp, Homo sapiens
gtcagaggggcagctgccaggc

SEQ ID NO: 8431640 - DNA, 18 bp, Homo sapiens
gtcagaggatggggaaat

SEQ ID NO: 8431641 - DNA, 22 bp, Homo sapiens
gtcagaggggacaagacacaga

SEQ ID NO: 8431642 - DNA, 22 bp, Homo sapiens
gtattacatttagtaattaggc

SEQ ID NO: 8431643 - DNA, 22 bp, Homo sapiens
gtccagggaaatagcgacaggg

SEQ ID NO: 8431644 - DNA, 22 bp, Homo sapiens
gtccagggaaatagcgacaggg

SEQ ID NO: 8431645 - DNA, 22 bp, Homo sapiens
gtccagggaaatagcgacaggg

SEQ ID NO: 8431646 - DNA, 22 bp, Homo sapiens
gtcaggattataatccccatgg

SEQ ID NO: 8431647 - DNA, 22 bp, Homo sapiens
gtcaggcagcctggagattcag

SEQ ID NO: 8431648 - DNA, 22 bp, Homo sapiens
gtcaggagagatcaggacagca

SEQ ID NO: 8431649 - DNA, 22 bp, Homo sapiens
gtcaggaagtggcattggagaa

SEQ ID NO: 8431650 - DNA, 22 bp, Homo sapiens
gtcaggaagtggcattggagaa

SEQ ID NO: 8431651 - DNA, 22 bp, Homo sapiens
gtcaggaagcaaggttgggcat

SEQ ID NO: 8431652 - DNA, 22 bp, Homo sapiens
gtcaggactctgacccgtcccg

SEQ ID NO: 8431653 - DNA, 22 bp, Homo sapiens
gtcaggacaggctctggactga

SEQ ID NO: 8431654 - DNA, 22 bp, Homo sapiens
gtccatctagaatttatttcta

SEQ ID NO: 8431655 - DNA, 22 bp, Homo sapiens
gtccatctgtaggagggacaca

SEQ ID NO: 8431656 - DNA, 22 bp, Homo sapiens
gtccatgcagtcacctccagct

SEQ ID NO: 8431657 - DNA, 19 bp, Homo sapiens
gtccatgcttagaggggcc

SEQ ID NO: 8431658 - DNA, 22 bp, Homo sapiens
gtccatgcttaaataccttaaa

SEQ ID NO: 8431659 - DNA, 22 bp, Homo sapiens
gtcccagggaagaaggcagcac

SEQ ID NO: 8431660 - DNA, 18 bp, Homo sapiens
gtccatggcctccaccca

SEQ ID NO: 8431661 - DNA, 22 bp, Homo sapiens
gtccatggttgctttcatgtaa

SEQ ID NO: 8431662 - DNA, 22 bp, Homo sapiens
gtccatggttgctttcatgtaa

SEQ ID NO: 8431663 - DNA, 18 bp, Homo sapiens
gtccatggcctccaccca

SEQ ID NO: 8431664 - DNA, 22 bp, Homo sapiens
gtccatggcagagcccttctgc

SEQ ID NO: 8431665 - DNA, 22 bp, Homo sapiens
gtccatggcatttccgtcacat

SEQ ID NO: 8431666 - DNA, 22 bp, Homo sapiens
gtccagtgtcttctacataaca

SEQ ID NO: 8431667 - DNA, 20 bp, Homo sapiens
gtccagtgggccttcatttc

SEQ ID NO: 8431668 - DNA, 22 bp, Homo sapiens
gtccagtggtcaattatctgga

SEQ ID NO: 8431669 - DNA, 19 bp, Homo sapiens
gtccagtgttttccagtca

SEQ ID NO: 8431670 - DNA, 22 bp, Homo sapiens
gtccagttgtatgtccagtgtc

SEQ ID NO: 8431671 - DNA, 22 bp, Homo sapiens
gtccagtttcagggtctgcgct

SEQ ID NO: 8431672 - DNA, 22 bp, Homo sapiens
gtccatacagtggcacacatct

SEQ ID NO: 8431673 - DNA, 22 bp, Homo sapiens
gtccatatgtcaggtgtgaatt

SEQ ID NO: 8431674 - DNA, 22 bp, Homo sapiens
gtccagtgacaagtagctggcc

SEQ ID NO: 8431675 - DNA, 22 bp, Homo sapiens
gtccaggtctggaccctgagcc

SEQ ID NO: 8431676 - DNA, 22 bp, Homo sapiens
gtccagtctctttccaagccca

SEQ ID NO: 8431677 - DNA, 22 bp, Homo sapiens
gtcccagggatgcagacatgag

SEQ ID NO: 8431678 - DNA, 22 bp, Homo sapiens
gtcccagggaggttcagggctt

SEQ ID NO: 8431679 - DNA, 22 bp, Homo sapiens
gtcccagggatgcagacatgag

SEQ ID NO: 8431680 - DNA, 22 bp, Homo sapiens
gtcccaggtgcccagtgggcag

SEQ ID NO: 8431681 - DNA, 22 bp, Homo sapiens
gtcccaggtgggctccacctct

SEQ ID NO: 8431682 - DNA, 22 bp, Homo sapiens
gtcctgtgtgacttcccaaatg

SEQ ID NO: 8431683 - DNA, 22 bp, Homo sapiens
gtcctgtgtcccagagaaagag

SEQ ID NO: 8431684 - DNA, 22 bp, Homo sapiens
gtcctgtgtaagccaggacaat

SEQ ID NO: 8431685 - DNA, 22 bp, Homo sapiens
gtcctgggtccccgcaggtcag

SEQ ID NO: 8431686 - DNA, 22 bp, Homo sapiens
gtcctgggtccccgcaggtcag

SEQ ID NO: 8431687 - DNA, 22 bp, Homo sapiens
gtcctgtgtgttgccggctgaa

SEQ ID NO: 8431688 - DNA, 22 bp, Homo sapiens
gtcctgtgtgagtgcaccacct

SEQ ID NO: 8431689 - DNA, 22 bp, Homo sapiens
gtcctgtgtgagtgcaccacct

SEQ ID NO: 8431690 - DNA, 22 bp, Homo sapiens
gtccttatttcacttaaacgta

SEQ ID NO: 8431691 - DNA, 22 bp, Homo sapiens
gtccttagttacttttcatgtc

SEQ ID NO: 8431692 - DNA, 22 bp, Homo sapiens
gtccttcctgcagggatggatg

SEQ ID NO: 8431693 - DNA, 22 bp, Homo sapiens
gtccttccccagccagctctgg

SEQ ID NO: 8431694 - DNA, 22 bp, Homo sapiens
gtccttccccagccagctctgg

SEQ ID NO: 8431695 - DNA, 22 bp, Homo sapiens
gtccttgcttgagacaggcagt

SEQ ID NO: 8431696 - DNA, 22 bp, Homo sapiens
gtccttcatttcctgatctcta

SEQ ID NO: 8431697 - DNA, 22 bp, Homo sapiens
gtccttcagctttatctgaaca

SEQ ID NO: 8431698 - DNA, 22 bp, Homo sapiens
gtccttcaagtaacctgggacc

SEQ ID NO: 8431699 - DNA, 22 bp, Homo sapiens
gtccttcaaggtccttggtgtg

SEQ ID NO: 8431700 - DNA, 22 bp, Homo sapiens
gtccttcagcacctccctcggc

SEQ ID NO: 8431701 - DNA, 21 bp, Homo sapiens
gtccttcagcaagttagtggc

SEQ ID NO: 8431702 - DNA, 22 bp, Homo sapiens
gtccttggcattctgagtcttg

SEQ ID NO: 8431703 - DNA, 22 bp, Homo sapiens
gtccttggaggtgtggaatctg

SEQ ID NO: 8431704 - DNA, 22 bp, Homo sapiens
gtccttggagtcaggcaaggct

SEQ ID NO: 8431705 - DNA, 22 bp, Homo sapiens
gtcctttcgagggtgagtgaaa

SEQ ID NO: 8431706 - DNA, 22 bp, Homo sapiens
gtccttggcttgaggcacctca

SEQ ID NO: 8431707 - DNA, 22 bp, Homo sapiens
gtcctttcttaaattcctgctt

SEQ ID NO: 8431708 - DNA, 22 bp, Homo sapiens
gtctgaggggtttcccaggaca

SEQ ID NO: 8431709 - DNA, 22 bp, Homo sapiens
gtctgagggacagagtcctggc

SEQ ID NO: 8431710 - DNA, 22 bp, Homo sapiens
gtctgagcaccctggcctgtca

SEQ ID NO: 8431711 - DNA, 20 bp, Homo sapiens
gtctgaggagcagtgggaaa

SEQ ID NO: 8431712 - DNA, 19 bp, Homo sapiens
gtctctggatttcaggtcc

SEQ ID NO: 8431713 - DNA, 22 bp, Homo sapiens
gtctgaaaatatgattttgcct

SEQ ID NO: 8431714 - DNA, 22 bp, Homo sapiens
gtctctgagctctgagctggct

SEQ ID NO: 8431715 - DNA, 22 bp, Homo sapiens
gtctggctcccactcttacaaa

SEQ ID NO: 8431716 - DNA, 22 bp, Homo sapiens
gtctggccatttgcccattgtg

SEQ ID NO: 8431717 - DNA, 22 bp, Homo sapiens
gtctggccatttgcccattgtg

SEQ ID NO: 8431718 - DNA, 22 bp, Homo sapiens
gtctggcatatgcaaagtgcat

SEQ ID NO: 8431719 - DNA, 22 bp, Homo sapiens
gtctggcattcttcctggagaa

SEQ ID NO: 8431720 - DNA, 22 bp, Homo sapiens
gtctggctcagtcctagctgta

SEQ ID NO: 8431721 - DNA, 20 bp, Homo sapiens
gtctgcagtaagagggaata

SEQ ID NO: 8431722 - DNA, 22 bp, Homo sapiens
gtctgcagacaacttagaagca

SEQ ID NO: 8431723 - DNA, 22 bp, Homo sapiens
gtctgcagagggaaggcttcag

SEQ ID NO: 8431724 - DNA, 22 bp, Homo sapiens
gtctgaggtcattagctctctt

SEQ ID NO: 8431725 - DNA, 22 bp, Homo sapiens
gtctgaggtcattagctctctt

SEQ ID NO: 8431726 - DNA, 22 bp, Homo sapiens
gtctgggctcccagggtcggcg

SEQ ID NO: 8431727 - DNA, 22 bp, Homo sapiens
gtctgggctcccagggtcggcg

SEQ ID NO: 8431728 - DNA, 22 bp, Homo sapiens
gtctgggcaggaatctgcattc

SEQ ID NO: 8431729 - DNA, 22 bp, Homo sapiens
gtctgggccaggcgagccgagg

SEQ ID NO: 8431730 - DNA, 22 bp, Homo sapiens
gtctgggctcctggcaggcagc

SEQ ID NO: 8431731 - DNA, 22 bp, Homo sapiens
gtctgggctcctggcaggcagc

SEQ ID NO: 8431732 - DNA, 22 bp, Homo sapiens
gtctgggcttcagagttagaga

SEQ ID NO: 8431733 - DNA, 22 bp, Homo sapiens
gtctgggcttagggacatggca

SEQ ID NO: 8431734 - DNA, 22 bp, Homo sapiens
gtctgggcttagggacatggca

SEQ ID NO: 8431735 - DNA, 22 bp, Homo sapiens
gtctggggaagtcagggcatca

SEQ ID NO: 8431736 - DNA, 22 bp, Homo sapiens
gtctgggcttcagagttagaga

SEQ ID NO: 8431737 - DNA, 17 bp, Homo sapiens
gtctgggctttagagac

SEQ ID NO: 8431738 - DNA, 17 bp, Homo sapiens
gtctgggctttagagac

SEQ ID NO: 8431739 - DNA, 22 bp, Homo sapiens
gtctgggcaagggagatggcgc

SEQ ID NO: 8431740 - DNA, 22 bp, Homo sapiens
gtctgggcacctggcctgggaa

SEQ ID NO: 8431741 - DNA, 22 bp, Homo sapiens
gtctgggcacctggcctgggaa

SEQ ID NO: 8431742 - DNA, 22 bp, Homo sapiens
gtctgggcacctggcctgggaa

SEQ ID NO: 8431743 - DNA, 22 bp, Homo sapiens
gtctgggccaggcgagccgagg

SEQ ID NO: 8431744 - DNA, 22 bp, Homo sapiens
gtctgggcatcagactgcgggc

SEQ ID NO: 8431745 - DNA, 22 bp, Homo sapiens
gtctgggcatcagactgcgggc

SEQ ID NO: 8431746 - DNA, 22 bp, Homo sapiens
gtctgggcatcagactgcgggc

SEQ ID NO: 8431747 - DNA, 22 bp, Homo sapiens
gtctgggcagcagcatttctta

SEQ ID NO: 8431748 - DNA, 22 bp, Homo sapiens
gtctgggcagcagcatttctta

SEQ ID NO: 8431749 - DNA, 22 bp, Homo sapiens
gtctgggcaggaatctgcattc

SEQ ID NO: 8431750 - DNA, 22 bp, Homo sapiens
gtctggctttgctcagatgctg

SEQ ID NO: 8431751 - DNA, 22 bp, Homo sapiens
gtctggctttatatttgctatt

SEQ ID NO: 8431752 - DNA, 22 bp, Homo sapiens
gtctgggacaggactggggaac

SEQ ID NO: 8431753 - DNA, 22 bp, Homo sapiens
gtctgggcaagggagatggcgc

SEQ ID NO: 8431754 - DNA, 22 bp, Homo sapiens
gtctgggattggggtaaagaag

SEQ ID NO: 8431755 - DNA, 22 bp, Homo sapiens
gtctgggagtttggtgctgccg

SEQ ID NO: 8431756 - DNA, 22 bp, Homo sapiens
gtatatcttcagaaattatagg

SEQ ID NO: 8431757 - DNA, 22 bp, Homo sapiens
gtatatcagacactcatatgta

SEQ ID NO: 8431758 - DNA, 22 bp, Homo sapiens
gtatatcaccccaagcagctga

SEQ ID NO: 8431759 - DNA, 22 bp, Homo sapiens
gtatatattggataaaccagag

SEQ ID NO: 8431760 - DNA, 22 bp, Homo sapiens
gtatagaaggatctggtgaatt

SEQ ID NO: 8431761 - DNA, 20 bp, Homo sapiens
gtatataaccatagtgacta

SEQ ID NO: 8431762 - DNA, 20 bp, Homo sapiens
gtatataaccatagtgacta

SEQ ID NO: 8431763 - DNA, 22 bp, Homo sapiens
gtatatatgtgtgaacatgtat

SEQ ID NO: 8431764 - DNA, 22 bp, Homo sapiens
gtatatatgtgtgaacatgtat

SEQ ID NO: 8431765 - DNA, 22 bp, Homo sapiens
gtatataaggtaaagcgattgt

SEQ ID NO: 8431766 - DNA, 22 bp, Homo sapiens
gtatatatcggcactattttaa

SEQ ID NO: 8431767 - DNA, 22 bp, Homo sapiens
gtatataaggtaaagcgattgt

SEQ ID NO: 8431768 - DNA, 22 bp, Homo sapiens
gtacatttaggattcattgaaa

SEQ ID NO: 8431769 - DNA, 22 bp, Homo sapiens
gtacatttaggattcattgaaa

SEQ ID NO: 8431770 - DNA, 22 bp, Homo sapiens
gtacatttactgatgaaaagta

SEQ ID NO: 8431771 - DNA, 22 bp, Homo sapiens
gtacatttactgatgaaaagta

SEQ ID NO: 8431772 - DNA, 22 bp, Homo sapiens
gtacatattacagacaaagctt

SEQ ID NO: 8431773 - DNA, 22 bp, Homo sapiens
gtacatgtcaaaaaatgcataa

SEQ ID NO: 8431774 - DNA, 22 bp, Homo sapiens
gtacatgtatgagatatgtgta

SEQ ID NO: 8431775 - DNA, 22 bp, Homo sapiens
gtacatgtgcacaacatgcatg

SEQ ID NO: 8431776 - DNA, 22 bp, Homo sapiens
gtacatgtgcacaatgtgcagg

SEQ ID NO: 8431777 - DNA, 22 bp, Homo sapiens
gtacagtgtgactttggagtga

SEQ ID NO: 8431778 - DNA, 22 bp, Homo sapiens
gtacataagaaattactacaga

SEQ ID NO: 8431779 - DNA, 21 bp, Homo sapiens
gtacagggatagtagtgtcaa

SEQ ID NO: 8431780 - DNA, 22 bp, Homo sapiens
gtacagggcccctcagcagggc

SEQ ID NO: 8431781 - DNA, 19 bp, Homo sapiens
gtacagtggtaagctatga

SEQ ID NO: 8431782 - DNA, 22 bp, Homo sapiens
gtaaaggctctgataagtactg

SEQ ID NO: 8431783 - DNA, 22 bp, Homo sapiens
gtaaagaaggcaacctggttat

SEQ ID NO: 8431784 - DNA, 22 bp, Homo sapiens
gtaaagaagtttttgaatgcat

SEQ ID NO: 8431785 - DNA, 22 bp, Homo sapiens
ggtgtcctcggattcagggcag

SEQ ID NO: 8431786 - DNA, 23 bp, Homo sapiens
gtaaaatacgcagtgcagtgtga

SEQ ID NO: 8431787 - DNA, 21 bp, Homo sapiens
ggtgtcctgagggataggtag

SEQ ID NO: 8431788 - DNA, 22 bp, Homo sapiens
gtaaacatgctgtgtactcagc

SEQ ID NO: 8431789 - DNA, 22 bp, Homo sapiens
gtacaggaaggagggagtttca

SEQ ID NO: 8431790 - DNA, 22 bp, Homo sapiens
gtacaggaccgcggccccctgg

SEQ ID NO: 8431791 - DNA, 22 bp, Homo sapiens
gtacaggccaccactgaatttt

SEQ ID NO: 8431792 - DNA, 22 bp, Homo sapiens
gtaaatataaatgctagctgcc

SEQ ID NO: 8431793 - DNA, 22 bp, Homo sapiens
gtaaataactggtaattggggt

SEQ ID NO: 8431794 - DNA, 23 bp, Homo sapiens
ggtggtggtgagtcacgggctca

SEQ ID NO: 8431795 - DNA, 22 bp, Homo sapiens
ggtgtagctctgtgtcccactg

SEQ ID NO: 8431796 - DNA, 22 bp, Homo sapiens
ggtgtagctctgtgtcccactg

SEQ ID NO: 8431797 - DNA, 22 bp, Homo sapiens
ggtgtcagatacataggaagta

SEQ ID NO: 8431798 - DNA, 20 bp, Homo sapiens
ggtgtcagggccatgcctgg

SEQ ID NO: 8431799 - DNA, 22 bp, Homo sapiens
ggtgtccactcagcccgtcctg

SEQ ID NO: 8431800 - DNA, 21 bp, Homo sapiens
ggtgtccagaggagtccccag

SEQ ID NO: 8431801 - DNA, 22 bp, Homo sapiens
ggtggcaggctggcattggcaa

SEQ ID NO: 8431802 - DNA, 22 bp, Homo sapiens
ggtggcaggctggcattggcaa

SEQ ID NO: 8431803 - DNA, 22 bp, Homo sapiens
ggtggcaggctggcattggcaa

SEQ ID NO: 8431804 - DNA, 22 bp, Homo sapiens
ggtggcaggccctgagcatccc

SEQ ID NO: 8431805 - DNA, 22 bp, Homo sapiens
ggtggcaggccctgagcatccc

SEQ ID NO: 8431806 - DNA, 22 bp, Homo sapiens
ggtggcagcatggtcccagtgt

SEQ ID NO: 8431807 - DNA, 22 bp, Homo sapiens
ggtggcagcgtctatctgacat

SEQ ID NO: 8431808 - DNA, 22 bp, Homo sapiens
ggtgcaggcggtggggcaagta

SEQ ID NO: 8431809 - DNA, 22 bp, Homo sapiens
ggtgcaggcggtggggcaagta

SEQ ID NO: 8431810 - DNA, 22 bp, Homo sapiens
ggtgcaggagcggggtgctcgg

SEQ ID NO: 8431811 - DNA, 22 bp, Homo sapiens
ggtggcagagaggaggtagttt

SEQ ID NO: 8431812 - DNA, 22 bp, Homo sapiens
ggtggcagaggtgcatcagccc

SEQ ID NO: 8431813 - DNA, 22 bp, Homo sapiens
ggtggcagcatggtcccagtgt

SEQ ID NO: 8431814 - DNA, 22 bp, Homo sapiens
gggtggggcccaggaaatctat

SEQ ID NO: 8431815 - DNA, 22 bp, Homo sapiens
ggtgagggtaaactaaaacatc

SEQ ID NO: 8431816 - DNA, 22 bp, Homo sapiens
ggtgagggtaaatataggcaaa

SEQ ID NO: 8431817 - DNA, 22 bp, Homo sapiens
ggtgagggtaaatataggcaaa

SEQ ID NO: 8431818 - DNA, 22 bp, Homo sapiens
ggtgagggtaaatataggcaaa

SEQ ID NO: 8431819 - DNA, 22 bp, Homo sapiens
ggtgagggtaaatataggcaaa

SEQ ID NO: 8431820 - DNA, 22 bp, Homo sapiens
ggtgaggggagagtgaaagaaa

SEQ ID NO: 8431821 - DNA, 22 bp, Homo sapiens
ggtgaggggagagtgaaagaaa

SEQ ID NO: 8431822 - DNA, 22 bp, Homo sapiens
ggtgaggggagagtgaaagaaa

SEQ ID NO: 8431823 - DNA, 22 bp, Homo sapiens
ggtgaggggagagtgaaagaaa

SEQ ID NO: 8431824 - DNA, 21 bp, Homo sapiens
tctgacttgatctattctccc

SEQ ID NO: 8431825 - DNA, 22 bp, Homo sapiens
tctgacttccttttctgatcca

SEQ ID NO: 8431826 - DNA, 22 bp, Homo sapiens
tctgaccctcagatcatgtcca

SEQ ID NO: 8431827 - DNA, 22 bp, Homo sapiens
tctgaccaggctcagccaaggc

SEQ ID NO: 8431828 - DNA, 22 bp, Homo sapiens
tctgacccgtggctctgcctcc

SEQ ID NO: 8431829 - DNA, 22 bp, Homo sapiens
tctgaattttgatgtgcattga

SEQ ID NO: 8431830 - DNA, 22 bp, Homo sapiens
tctgacaggtgttcttccaggc

SEQ ID NO: 8431831 - DNA, 22 bp, Homo sapiens
tctgacaggtcattttctatag

SEQ ID NO: 8431832 - DNA, 22 bp, Homo sapiens
tctgacattagattaattggaa

SEQ ID NO: 8431833 - DNA, 22 bp, Homo sapiens
tctgacatgagggctgtggaga

SEQ ID NO: 8431834 - DNA, 22 bp, Homo sapiens
tctgagaatggagctaaaaatc

SEQ ID NO: 8431835 - DNA, 17 bp, Homo sapiens
tctgagaatgctggagg

SEQ ID NO: 8431836 - DNA, 23 bp, Homo sapiens
tctgagaaggtttcagccagact

SEQ ID NO: 8431837 - DNA, 22 bp, Homo sapiens
tctgagaagcaccttctggaca

SEQ ID NO: 8431838 - DNA, 21 bp, Homo sapiens
tctgagaacttctgctgcagc

SEQ ID NO: 8431839 - DNA, 22 bp, Homo sapiens
tctgagaacatgctttgatcat

SEQ ID NO: 8431840 - DNA, 22 bp, Homo sapiens
tctgagaactccgggttagatc

SEQ ID NO: 8431841 - DNA, 17 bp, Homo sapiens
tctgagaacttgaagca

SEQ ID NO: 8431842 - DNA, 20 bp, Homo sapiens
tctgagaagcaaacaatgtt

SEQ ID NO: 8431843 - DNA, 22 bp, Homo sapiens
tctgagaaaataggaaacttga

SEQ ID NO: 8431844 - DNA, 22 bp, Homo sapiens
tctgacttttctcactgttgtg

SEQ ID NO: 8431845 - DNA, 17 bp, Homo sapiens
tctgagaaaggagaatc

SEQ ID NO: 8431846 - DNA, 22 bp, Homo sapiens
tctgagaaatttctttgtgatg

SEQ ID NO: 8431847 - DNA, 22 bp, Homo sapiens
tctgagaaatcagtggtgaata

SEQ ID NO: 8431848 - DNA, 22 bp, Homo sapiens
tctgagcttctgcatttccaac

SEQ ID NO: 8431849 - DNA, 22 bp, Homo sapiens
tctgagcttctgcatttccaac

SEQ ID NO: 8431850 - DNA, 22 bp, Homo sapiens
tctgagcttctgcatttccaac

SEQ ID NO: 8431851 - DNA, 22 bp, Homo sapiens
tctgagcttccctctgaggcag

SEQ ID NO: 8431852 - DNA, 22 bp, Homo sapiens
tctgagctgtgagttgcttagg

SEQ ID NO: 8431853 - DNA, 22 bp, Homo sapiens
tctgagctgtggccattcttcc

SEQ ID NO: 8431854 - DNA, 22 bp, Homo sapiens
tctgagctggagcccatcacct

SEQ ID NO: 8431855 - DNA, 22 bp, Homo sapiens
tctgagctgggcacagaaggcg

SEQ ID NO: 8431856 - DNA, 22 bp, Homo sapiens
tctgagctgggtcttgacagct

SEQ ID NO: 8431857 - DNA, 22 bp, Homo sapiens
tctgagctgctaggtatgcatt

SEQ ID NO: 8431858 - DNA, 22 bp, Homo sapiens
tctgagctgggcacagaaggcg

SEQ ID NO: 8431859 - DNA, 22 bp, Homo sapiens
tctgagctcaagtgacagttag

SEQ ID NO: 8431860 - DNA, 22 bp, Homo sapiens
tctgagctccatgcaggaggct

SEQ ID NO: 8431861 - DNA, 22 bp, Homo sapiens
tctgagctatgtaagacttgga

SEQ ID NO: 8431862 - DNA, 22 bp, Homo sapiens
tctgagctgcagagtggggtgg

SEQ ID NO: 8431863 - DNA, 22 bp, Homo sapiens
tctgagctgcagagtggggtgg

SEQ ID NO: 8431864 - DNA, 22 bp, Homo sapiens
tctgagctctatctgtgggaat

SEQ ID NO: 8431865 - DNA, 19 bp, Homo sapiens
tctgagctgatatgacatt

SEQ ID NO: 8431866 - DNA, 22 bp, Homo sapiens
tctgagctacgatgcctgtcac

SEQ ID NO: 8431867 - DNA, 22 bp, Homo sapiens
tctgagctacgatgcctgtcac

SEQ ID NO: 8431868 - DNA, 22 bp, Homo sapiens
tctgagcccctagaactgagcg

SEQ ID NO: 8431869 - DNA, 22 bp, Homo sapiens
tctgagctagaaagtatgccct

SEQ ID NO: 8431870 - DNA, 22 bp, Homo sapiens
tctgagctacgatgcctgtcac

SEQ ID NO: 8431871 - DNA, 22 bp, Homo sapiens
tctgagacaacttagccctcga

SEQ ID NO: 8431872 - DNA, 22 bp, Homo sapiens
tctgagacaggaagtggagggt

SEQ ID NO: 8431873 - DNA, 22 bp, Homo sapiens
tctgagacccatacaggcccac

SEQ ID NO: 8431874 - DNA, 20 bp, Homo sapiens
tctgagacctttccacaccc

SEQ ID NO: 8431875 - DNA, 20 bp, Homo sapiens
tctgagacttgtagtgtgga

SEQ ID NO: 8431876 - DNA, 21 bp, Homo sapiens
tctgagactgggttagaatgt

SEQ ID NO: 8431877 - DNA, 22 bp, Homo sapiens
tctgagactgcagtgagccgct

SEQ ID NO: 8431878 - DNA, 23 bp, Homo sapiens
tctgagagaacaatgcctcctat

SEQ ID NO: 8431879 - DNA, 22 bp, Homo sapiens
tctgagactttaacctggggcc

SEQ ID NO: 8431880 - DNA, 22 bp, Homo sapiens
tctgagagagcacctatccact

SEQ ID NO: 8431881 - DNA, 22 bp, Homo sapiens
tctgagcaccttatattcttga

SEQ ID NO: 8431882 - DNA, 22 bp, Homo sapiens
tctgagagatacaaggaggcaa

SEQ ID NO: 8431883 - DNA, 22 bp, Homo sapiens
tctgagatttgtatggtgagac

SEQ ID NO: 8431884 - DNA, 22 bp, Homo sapiens
tctgagccaatttctgtgtcca

SEQ ID NO: 8431885 - DNA, 22 bp, Homo sapiens
tctgagccacagatgtcctgtt

SEQ ID NO: 8431886 - DNA, 22 bp, Homo sapiens
tctgagcccctagaactgagcg

SEQ ID NO: 8431887 - DNA, 22 bp, Homo sapiens
tctgagcccagtgagtctcgca

SEQ ID NO: 8431888 - DNA, 22 bp, Homo sapiens
tctgagggacaattttgatggt

SEQ ID NO: 8431889 - DNA, 22 bp, Homo sapiens
tctgagggtgggagaaggagct

SEQ ID NO: 8431890 - DNA, 22 bp, Homo sapiens
tctgagggttactttattaggc

SEQ ID NO: 8431891 - DNA, 22 bp, Homo sapiens
tctgagggctgtactatgcacg

SEQ ID NO: 8431892 - DNA, 22 bp, Homo sapiens
tctgagggatttgtcccttatc

SEQ ID NO: 8431893 - DNA, 22 bp, Homo sapiens
tctgagggcttgaggggaagta

SEQ ID NO: 8431894 - DNA, 22 bp, Homo sapiens
tctgagggtaaggttaaggtag

SEQ ID NO: 8431895 - DNA, 22 bp, Homo sapiens
tctgagggggtgtttataagct

SEQ ID NO: 8431896 - DNA, 22 bp, Homo sapiens
tctgaggggctggaagggctgc

SEQ ID NO: 8431897 - DNA, 18 bp, Homo sapiens
tctgagggtgcgggagct

SEQ ID NO: 8431898 - DNA, 19 bp, Homo sapiens
tctgagggtccagatgcat

SEQ ID NO: 8431899 - DNA, 22 bp, Homo sapiens
tctgaggcctgaagcagcagag

SEQ ID NO: 8431900 - DNA, 22 bp, Homo sapiens
tctgaggccctgcaggcagtgt

SEQ ID NO: 8431901 - DNA, 22 bp, Homo sapiens
tctgaggccttgggacagaagt

SEQ ID NO: 8431902 - DNA, 22 bp, Homo sapiens
tctgagctgtaagtagacaagg

SEQ ID NO: 8431903 - DNA, 22 bp, Homo sapiens
tctgaggaaaagttcttgtcac

SEQ ID NO: 8431904 - DNA, 22 bp, Homo sapiens
tctgaggaagcagcaggaagtg

SEQ ID NO: 8431905 - DNA, 22 bp, Homo sapiens
tctgaggaaagagagtgggatg

SEQ ID NO: 8431906 - DNA, 22 bp, Homo sapiens
tctgagctttcttgtgctcaag

SEQ ID NO: 8431907 - DNA, 22 bp, Homo sapiens
tctgagcttctgcctgctgcaa

SEQ ID NO: 8431908 - DNA, 22 bp, Homo sapiens
tctgagctttagctgggatttt

SEQ ID NO: 8431909 - DNA, 22 bp, Homo sapiens
tctgaggaatcttgacacattt

SEQ ID NO: 8431910 - DNA, 22 bp, Homo sapiens
tctgaggaataagaaggaagtg

SEQ ID NO: 8431911 - DNA, 22 bp, Homo sapiens
tctgaggaattctgcagtgaga

SEQ ID NO: 8431912 - DNA, 22 bp, Homo sapiens
tctgcaaactggctcttactgc

SEQ ID NO: 8431913 - DNA, 22 bp, Homo sapiens
tctgcaagatcattaaagcaga

SEQ ID NO: 8431914 - DNA, 22 bp, Homo sapiens
tctgcaacattcctctccccac

SEQ ID NO: 8431915 - DNA, 23 bp, Homo sapiens
tctgcaagataatgaagatgata

SEQ ID NO: 8431916 - DNA, 22 bp, Homo sapiens
tctgatttactggaaaaaagga

SEQ ID NO: 8431917 - DNA, 22 bp, Homo sapiens
tctgattagagcattcttgagt

SEQ ID NO: 8431918 - DNA, 22 bp, Homo sapiens
tctgattagagcattcttgagt

SEQ ID NO: 8431919 - DNA, 21 bp, Homo sapiens
tctgatggtagatgagatgtg

SEQ ID NO: 8431920 - DNA, 21 bp, Homo sapiens
tctgatggtagatgagatgtg

SEQ ID NO: 8431921 - DNA, 22 bp, Homo sapiens
tctgaggttactgctttgtaga

SEQ ID NO: 8431922 - DNA, 22 bp, Homo sapiens
tctgagggttgtagagagggac

SEQ ID NO: 8431923 - DNA, 22 bp, Homo sapiens
tctgaggtgtagctgggcttca

SEQ ID NO: 8431924 - DNA, 22 bp, Homo sapiens
tctgccctcattgctgcctgga

SEQ ID NO: 8431925 - DNA, 22 bp, Homo sapiens
tctgccctcattgctgcctgga

SEQ ID NO: 8431926 - DNA, 21 bp, Homo sapiens
tctgccctccaggagctcata

SEQ ID NO: 8431927 - DNA, 21 bp, Homo sapiens
tctgccctccaggagctcata

SEQ ID NO: 8431928 - DNA, 22 bp, Homo sapiens
tctgccctcgaggagcttgtgt

SEQ ID NO: 8431929 - DNA, 22 bp, Homo sapiens
tctgccctcagggtaatgatca

SEQ ID NO: 8431930 - DNA, 18 bp, Homo sapiens
tctgccccagccgcactg

SEQ ID NO: 8431931 - DNA, 22 bp, Homo sapiens
tctgcccctgctgggcacagag

SEQ ID NO: 8431932 - DNA, 22 bp, Homo sapiens
tctgcccctgctgggcacagag

SEQ ID NO: 8431933 - DNA, 22 bp, Homo sapiens
tctgccctaattcagtgcttag

SEQ ID NO: 8431934 - DNA, 22 bp, Homo sapiens
tctgccctaattcagtgcttag

SEQ ID NO: 8431935 - DNA, 22 bp, Homo sapiens
tctgcccaggaggtcccatggg

SEQ ID NO: 8431936 - DNA, 22 bp, Homo sapiens
tctgcccaggaggtcccatggg

SEQ ID NO: 8431937 - DNA, 22 bp, Homo sapiens
tctgcccagccagacccaaggt

SEQ ID NO: 8431938 - DNA, 22 bp, Homo sapiens
tctgcccactgctctgctgccc

SEQ ID NO: 8431939 - DNA, 22 bp, Homo sapiens
tctgcccacagcctcctgtcca

SEQ ID NO: 8431940 - DNA, 22 bp, Homo sapiens
tctgcccacagtccaatagttg

SEQ ID NO: 8431941 - DNA, 22 bp, Homo sapiens
tctgccctggggtcagcctcca

SEQ ID NO: 8431942 - DNA, 22 bp, Homo sapiens
tctgccctgcagggagcagtaa

SEQ ID NO: 8431943 - DNA, 22 bp, Homo sapiens
tctgccctgccattcactggaa

SEQ ID NO: 8431944 - DNA, 22 bp, Homo sapiens
tctgccctgccattcactggaa

SEQ ID NO: 8431945 - DNA, 23 bp, Homo sapiens
tctgccctctgcctgtttttgta

SEQ ID NO: 8431946 - DNA, 18 bp, Homo sapiens
tctgccctgccattcact

SEQ ID NO: 8431947 - DNA, 21 bp, Homo sapiens
tctgcctgagactttgctggt

SEQ ID NO: 8431948 - DNA, 21 bp, Homo sapiens
tctgcctgagactttgctggt

SEQ ID NO: 8431949 - DNA, 22 bp, Homo sapiens
tctgcctgagcagagggaggcc

SEQ ID NO: 8431950 - DNA, 22 bp, Homo sapiens
tctgcccttggctctcttgttg

SEQ ID NO: 8431951 - DNA, 22 bp, Homo sapiens
tctgcctgaggactgacaccag

SEQ ID NO: 8431952 - DNA, 22 bp, Homo sapiens
tctgcctgagggagctgaggaa

SEQ ID NO: 8431953 - DNA, 22 bp, Homo sapiens
tctgcctgagggagctgaggaa

SEQ ID NO: 8431954 - DNA, 22 bp, Homo sapiens
tctgcctgagggagctgaggaa

SEQ ID NO: 8431955 - DNA, 22 bp, Homo sapiens
tctgcctgcagtgtggcagggc

SEQ ID NO: 8431956 - DNA, 20 bp, Homo sapiens
tctgctcagccctcagtggc

SEQ ID NO: 8431957 - DNA, 22 bp, Homo sapiens
tctgctcagggagggtcactac

SEQ ID NO: 8431958 - DNA, 22 bp, Homo sapiens
tctgctcacatggctccatgca

SEQ ID NO: 8431959 - DNA, 22 bp, Homo sapiens
tctgccttgatggcattgagaa

SEQ ID NO: 8431960 - DNA, 22 bp, Homo sapiens
tctgccttctatcttttgtctg

SEQ ID NO: 8431961 - DNA, 22 bp, Homo sapiens
tctgccttcgctgctccctgaa

SEQ ID NO: 8431962 - DNA, 22 bp, Homo sapiens
tctgccttcttttagtcatctt

SEQ ID NO: 8431963 - DNA, 22 bp, Homo sapiens
tctgcctgttgctagaatgtca

SEQ ID NO: 8431964 - DNA, 22 bp, Homo sapiens
tctgcctgttgctagaatgtca

SEQ ID NO: 8431965 - DNA, 20 bp, Homo sapiens
tctgccttatgaccttcgcc

SEQ ID NO: 8431966 - DNA, 22 bp, Homo sapiens
tctgccttagcaattgtcaagg

SEQ ID NO: 8431967 - DNA, 20 bp, Homo sapiens
tctgccttagggggagcctc

SEQ ID NO: 8431968 - DNA, 22 bp, Homo sapiens
tctgccttccccataatctgat

SEQ ID NO: 8431969 - DNA, 22 bp, Homo sapiens
tctgcctgtggtggaggaagtt

SEQ ID NO: 8431970 - DNA, 22 bp, Homo sapiens
tctgcctgtggtggaggaagtt

SEQ ID NO: 8431971 - DNA, 22 bp, Homo sapiens
tctgcctgtggatacatgctct

SEQ ID NO: 8431972 - DNA, 22 bp, Homo sapiens
tctgcctgggtgtggagcagag

SEQ ID NO: 8431973 - DNA, 22 bp, Homo sapiens
tctgcctggcctggagggcaca

SEQ ID NO: 8431974 - DNA, 22 bp, Homo sapiens
tctgcctggatgatggcagggc

SEQ ID NO: 8431975 - DNA, 22 bp, Homo sapiens
tctgcctggattccattctcca

SEQ ID NO: 8431976 - DNA, 22 bp, Homo sapiens
tctgcctgcggctgcaggtggc

SEQ ID NO: 8431977 - DNA, 22 bp, Homo sapiens
tctgcaggaggctggctgcagg

SEQ ID NO: 8431978 - DNA, 22 bp, Homo sapiens
tctgcaggaggctggctgcagg

SEQ ID NO: 8431979 - DNA, 22 bp, Homo sapiens
tctgcaggatcagagccagagg

SEQ ID NO: 8431980 - DNA, 22 bp, Homo sapiens
tctgcaggatcagagccagagg

SEQ ID NO: 8431981 - DNA, 22 bp, Homo sapiens
tctgcaggatcagagccagagg

SEQ ID NO: 8431982 - DNA, 22 bp, Homo sapiens
tctgcaggagcagggcgtggag

SEQ ID NO: 8431983 - DNA, 22 bp, Homo sapiens
tctgcaggagagtgccctagag

SEQ ID NO: 8431984 - DNA, 22 bp, Homo sapiens
tctgcaggaggctggctgcagg

SEQ ID NO: 8431985 - DNA, 22 bp, Homo sapiens
tctgcaggagcagggcgtggag

SEQ ID NO: 8431986 - DNA, 22 bp, Homo sapiens
tctgcaggctctagatgaggtt

SEQ ID NO: 8431987 - DNA, 22 bp, Homo sapiens
tctgcaggcctcgacaaggcca

SEQ ID NO: 8431988 - DNA, 22 bp, Homo sapiens
tctgcaggcatttttggttgtc

SEQ ID NO: 8431989 - DNA, 22 bp, Homo sapiens
tctgcaggatggatgctcagaa

SEQ ID NO: 8431990 - DNA, 22 bp, Homo sapiens
tctgcaggatggatgctcagaa

SEQ ID NO: 8431991 - DNA, 22 bp, Homo sapiens
tctgcaggatgcaaagtgtaca

SEQ ID NO: 8431992 - DNA, 22 bp, Homo sapiens
tctgcaggaaaaaagtgcctgg

SEQ ID NO: 8431993 - DNA, 18 bp, Homo sapiens
tctgcaggacctcagggc

SEQ ID NO: 8431994 - DNA, 18 bp, Homo sapiens
tctgcaggacctcagggc

SEQ ID NO: 8431995 - DNA, 22 bp, Homo sapiens
tctgcaggaaaaaagtgcctgg

SEQ ID NO: 8431996 - DNA, 22 bp, Homo sapiens
tctgcaggaaaaaagtgcctgg

SEQ ID NO: 8431997 - DNA, 22 bp, Homo sapiens
tctgcaggaagctggcggctga

SEQ ID NO: 8431998 - DNA, 22 bp, Homo sapiens
tctgcaggaagctggcggctga

SEQ ID NO: 8431999 - DNA, 22 bp, Homo sapiens
tctgcaggagagtgccctagag

SEQ ID NO: 8432000 - DNA, 22 bp, Homo sapiens
tctgcaggactgaggcctgttt

SEQ ID NO: 8432001 - DNA, 22 bp, Homo sapiens
tctgcaggactgaggcctgttt

SEQ ID NO: 8432002 - DNA, 22 bp, Homo sapiens
tctgcaggactgaggcctgttt

SEQ ID NO: 8432003 - DNA, 22 bp, Homo sapiens
tctgcagcccaaagtctcttag

SEQ ID NO: 8432004 - DNA, 22 bp, Homo sapiens
tctgcagatttatcagcagctg

SEQ ID NO: 8432005 - DNA, 22 bp, Homo sapiens
tctgcagaactttatgagcaaa

SEQ ID NO: 8432006 - DNA, 20 bp, Homo sapiens
tctgcacctccttccaatca

SEQ ID NO: 8432007 - DNA, 22 bp, Homo sapiens
tctgcacctctgaaattggtca

SEQ ID NO: 8432008 - DNA, 22 bp, Homo sapiens
tctgcacctttcttaaaaatcg

SEQ ID NO: 8432009 - DNA, 22 bp, Homo sapiens
tctgcacctcctgcttgctaga

SEQ ID NO: 8432010 - DNA, 21 bp, Homo sapiens
tctgcaccccagcctgagtga

SEQ ID NO: 8432011 - DNA, 22 bp, Homo sapiens
tctgcaccccgcagggtcaggt

SEQ ID NO: 8432012 - DNA, 22 bp, Homo sapiens
tctgcaccctgacctctgtttc

SEQ ID NO: 8432013 - DNA, 22 bp, Homo sapiens
tctgcacccttctgggttggaa

SEQ ID NO: 8432014 - DNA, 22 bp, Homo sapiens
tctgcaccctgtggtcctctag

SEQ ID NO: 8432015 - DNA, 22 bp, Homo sapiens
tctgcacccacgtaccttggct

SEQ ID NO: 8432016 - DNA, 22 bp, Homo sapiens
tctgcaccatcgtatgcttaat

SEQ ID NO: 8432017 - DNA, 22 bp, Homo sapiens
tctgcatctcttataaatgatg

SEQ ID NO: 8432018 - DNA, 22 bp, Homo sapiens
tctgcaggtgttggaagggtca

SEQ ID NO: 8432019 - DNA, 22 bp, Homo sapiens
tctgcaggtgttggaagggtca

SEQ ID NO: 8432020 - DNA, 22 bp, Homo sapiens
tctgcatattgttaatggaatg

SEQ ID NO: 8432021 - DNA, 22 bp, Homo sapiens
tctgcatattgttaatggaatg

SEQ ID NO: 8432022 - DNA, 22 bp, Homo sapiens
tctgcaggtgggcccctagaat

SEQ ID NO: 8432023 - DNA, 22 bp, Homo sapiens
tctgcaggtcacgctccagcct

SEQ ID NO: 8432024 - DNA, 22 bp, Homo sapiens
tctgcaggtagagctcaggaat

SEQ ID NO: 8432025 - DNA, 22 bp, Homo sapiens
tctgcaggtcacgctccagcct

SEQ ID NO: 8432026 - DNA, 22 bp, Homo sapiens
tctgcaggcttggagtggcagc

SEQ ID NO: 8432027 - DNA, 22 bp, Homo sapiens
tctgcaggcttggagtggcagc

SEQ ID NO: 8432028 - DNA, 22 bp, Homo sapiens
tctgcagggatgtgaggggtga

SEQ ID NO: 8432029 - DNA, 22 bp, Homo sapiens
tctgcaggctgtacaggaagca

SEQ ID NO: 8432030 - DNA, 22 bp, Homo sapiens
tctgcaggcttataggatgggt

SEQ ID NO: 8432031 - DNA, 22 bp, Homo sapiens
tctgcaggctgtacaggaagca

SEQ ID NO: 8432032 - DNA, 22 bp, Homo sapiens
tctgcaggctgtacaggaagca

SEQ ID NO: 8432033 - DNA, 22 bp, Homo sapiens
tctgcagggcccttggctcctg

SEQ ID NO: 8432034 - DNA, 22 bp, Homo sapiens
tctgcagggcccttggctcctg

SEQ ID NO: 8432035 - DNA, 17 bp, Homo sapiens
tctgcagggggccgtgt

SEQ ID NO: 8432036 - DNA, 22 bp, Homo sapiens
tctgcaggtaagcgttcttgga

SEQ ID NO: 8432037 - DNA, 22 bp, Homo sapiens
tctgcaggtaagcgttcttgga

SEQ ID NO: 8432038 - DNA, 22 bp, Homo sapiens
tctgcaggtagagctcaggaat

SEQ ID NO: 8432039 - DNA, 22 bp, Homo sapiens
tctgcaggtagagctcaggaat

SEQ ID NO: 8432040 - DNA, 22 bp, Homo sapiens
tctgcagggtcccagcctcagc

SEQ ID NO: 8432041 - DNA, 22 bp, Homo sapiens
tctgccaggccacacagggcac

SEQ ID NO: 8432042 - DNA, 22 bp, Homo sapiens
tctgccaggcttggtgctagat

SEQ ID NO: 8432043 - DNA, 16 bp, Homo sapiens
tctgccagggacaggc

SEQ ID NO: 8432044 - DNA, 16 bp, Homo sapiens
tctgccagggacaggc

SEQ ID NO: 8432045 - DNA, 22 bp, Homo sapiens
tctgccaggtggggagaggcca

SEQ ID NO: 8432046 - DNA, 22 bp, Homo sapiens
tctgccagtattcacggcccgt

SEQ ID NO: 8432047 - DNA, 22 bp, Homo sapiens
tctgccaggtggggagaggcca

SEQ ID NO: 8432048 - DNA, 22 bp, Homo sapiens
tctgccagtgccagagtacata

SEQ ID NO: 8432049 - DNA, 23 bp, Homo sapiens
tctgccagtgtgtgccaggagcc

SEQ ID NO: 8432050 - DNA, 23 bp, Homo sapiens
tctgccagtgtgtgccaggagcc

SEQ ID NO: 8432051 - DNA, 22 bp, Homo sapiens
tctgccagtttatagacaagcc

SEQ ID NO: 8432052 - DNA, 22 bp, Homo sapiens
tctgccatgctaacttcagtat

SEQ ID NO: 8432053 - DNA, 22 bp, Homo sapiens
tctgccatcttaattctctttt

SEQ ID NO: 8432054 - DNA, 22 bp, Homo sapiens
tctgcccaaggctgtcactaga

SEQ ID NO: 8432055 - DNA, 22 bp, Homo sapiens
tctggagaagcagtgagagtca

SEQ ID NO: 8432056 - DNA, 22 bp, Homo sapiens
tctggagaacttgcaagaggat

SEQ ID NO: 8432057 - DNA, 22 bp, Homo sapiens
tctggacttgaatcagagtaga

SEQ ID NO: 8432058 - DNA, 22 bp, Homo sapiens
tctggagaagcccagggagctg

SEQ ID NO: 8432059 - DNA, 22 bp, Homo sapiens
tctggagaagcccagggagctg

SEQ ID NO: 8432060 - DNA, 22 bp, Homo sapiens
tctggagaagcccagggagctg

SEQ ID NO: 8432061 - DNA, 22 bp, Homo sapiens
tctggagaagcccagggagctg

SEQ ID NO: 8432062 - DNA, 22 bp, Homo sapiens
tctggagaggggcctagaattt

SEQ ID NO: 8432063 - DNA, 22 bp, Homo sapiens
tctggagaggaggatgtggaca

SEQ ID NO: 8432064 - DNA, 22 bp, Homo sapiens
tctggaataggacaaaaccaaa

SEQ ID NO: 8432065 - DNA, 22 bp, Homo sapiens
tctggaataggtcctgagtatt

SEQ ID NO: 8432066 - DNA, 23 bp, Homo sapiens
tctggaatcctcccccttggttc

SEQ ID NO: 8432067 - DNA, 22 bp, Homo sapiens
tctgctgttcattcttttagct

SEQ ID NO: 8432068 - DNA, 22 bp, Homo sapiens
tctggaagacagtgagcccgct

SEQ ID NO: 8432069 - DNA, 22 bp, Homo sapiens
tctggaaggaacccttagagga

SEQ ID NO: 8432070 - DNA, 22 bp, Homo sapiens
tctggactaacagcagcctcag

SEQ ID NO: 8432071 - DNA, 22 bp, Homo sapiens
tctggaattttattgatcaaaa

SEQ ID NO: 8432072 - DNA, 22 bp, Homo sapiens
tctggaattttctagggcatca

SEQ ID NO: 8432073 - DNA, 23 bp, Homo sapiens
tctggaatggtactcactggagt

SEQ ID NO: 8432074 - DNA, 22 bp, Homo sapiens
tctggaattaaactcaggagac

SEQ ID NO: 8432075 - DNA, 22 bp, Homo sapiens
tctggaattctcaagtcctgga

SEQ ID NO: 8432076 - DNA, 22 bp, Homo sapiens
tctgctgtctatgcaagtcctt

SEQ ID NO: 8432077 - DNA, 22 bp, Homo sapiens
tctgctgtacttttggtctgtt

SEQ ID NO: 8432078 - DNA, 22 bp, Homo sapiens
tctgctgtcactcatttgcttc

SEQ ID NO: 8432079 - DNA, 22 bp, Homo sapiens
tctgctgtgtcccctgtgcggg

SEQ ID NO: 8432080 - DNA, 22 bp, Homo sapiens
tctgctgtgtccctggtctcct

SEQ ID NO: 8432081 - DNA, 22 bp, Homo sapiens
tctggaagaacggggcatgctg

SEQ ID NO: 8432082 - DNA, 22 bp, Homo sapiens
tctgctgttctcatgctgattt

SEQ ID NO: 8432083 - DNA, 22 bp, Homo sapiens
tctgctgtgttgaatgattggt

SEQ ID NO: 8432084 - DNA, 22 bp, Homo sapiens
tctgctgttgagcacaagtgaa

SEQ ID NO: 8432085 - DNA, 22 bp, Homo sapiens
tctgctgctgaccaacactgtg

SEQ ID NO: 8432086 - DNA, 22 bp, Homo sapiens
tctgctgctgcagctacactat

SEQ ID NO: 8432087 - DNA, 22 bp, Homo sapiens
tctgctggtgatgacctcataa

SEQ ID NO: 8432088 - DNA, 22 bp, Homo sapiens
tctgctggaaaaccagggaatt

SEQ ID NO: 8432089 - DNA, 22 bp, Homo sapiens
tctgctggtcaaggctgggtcc

SEQ ID NO: 8432090 - DNA, 23 bp, Homo sapiens
tctgctggtgacacggtcacatt

SEQ ID NO: 8432091 - DNA, 22 bp, Homo sapiens
tctgctggccttagcaggtcta

SEQ ID NO: 8432092 - DNA, 22 bp, Homo sapiens
tctgctgctacagactctctag

SEQ ID NO: 8432093 - DNA, 22 bp, Homo sapiens
tctgctgctgaccaacactgtg

SEQ ID NO: 8432094 - DNA, 22 bp, Homo sapiens
tctgctgccaccttgtggtgag

SEQ ID NO: 8432095 - DNA, 22 bp, Homo sapiens
tctgctgcacaaattcatctct

SEQ ID NO: 8432096 - DNA, 22 bp, Homo sapiens
tctgctctagttgcttcctgcc

SEQ ID NO: 8432097 - DNA, 22 bp, Homo sapiens
tctgctctgtactgcactggcc

SEQ ID NO: 8432098 - DNA, 22 bp, Homo sapiens
tctgctctgtggcttcagctaa

SEQ ID NO: 8432099 - DNA, 17 bp, Homo sapiens
tctgctctgccaatcca

SEQ ID NO: 8432100 - DNA, 22 bp, Homo sapiens
tctgctctgagagggccatcag

SEQ ID NO: 8432101 - DNA, 22 bp, Homo sapiens
tctggagggcccacatccacaa

SEQ ID NO: 8432102 - DNA, 18 bp, Homo sapiens
tctggagggaagctttga

SEQ ID NO: 8432103 - DNA, 22 bp, Homo sapiens
tctggaggggtttagagggaca

SEQ ID NO: 8432104 - DNA, 22 bp, Homo sapiens
tctggaggggtttagagggaca

SEQ ID NO: 8432105 - DNA, 22 bp, Homo sapiens
tctggagggggatgcctcatcc

SEQ ID NO: 8432106 - DNA, 22 bp, Homo sapiens
tctggagggggatgcctcatcc

SEQ ID NO: 8432107 - DNA, 22 bp, Homo sapiens
tctggaggctctgagggtgagt

SEQ ID NO: 8432108 - DNA, 21 bp, Homo sapiens
tctggagccctaagctgagaa

SEQ ID NO: 8432109 - DNA, 22 bp, Homo sapiens
tctggagccacaaacctcagct

SEQ ID NO: 8432110 - DNA, 22 bp, Homo sapiens
tctggagcaacagagcaggaca

SEQ ID NO: 8432111 - DNA, 17 bp, Homo sapiens
tctggatgtcatggaag

SEQ ID NO: 8432112 - DNA, 22 bp, Homo sapiens
tctggatctccctcatcctggg

SEQ ID NO: 8432113 - DNA, 22 bp, Homo sapiens
tctggatgatatgtgaacttga

SEQ ID NO: 8432114 - DNA, 23 bp, Homo sapiens
tctggatgccaccacatactaac

SEQ ID NO: 8432115 - DNA, 22 bp, Homo sapiens
tctggcccagcccctgaggtca

SEQ ID NO: 8432116 - DNA, 22 bp, Homo sapiens
tctggcccagcccctgatccca

SEQ ID NO: 8432117 - DNA, 22 bp, Homo sapiens
tctggccactaataggtctcac

SEQ ID NO: 8432118 - DNA, 22 bp, Homo sapiens
tctggccagtgaaatgcagaat

SEQ ID NO: 8432119 - DNA, 22 bp, Homo sapiens
tctggcagtttgagaaaggcta

SEQ ID NO: 8432120 - DNA, 22 bp, Homo sapiens
tctggcagttccttgttgatat

SEQ ID NO: 8432121 - DNA, 22 bp, Homo sapiens
tctggcagttgccgcttcagtc

SEQ ID NO: 8432122 - DNA, 22 bp, Homo sapiens
tctggcatcactcgcaagagca

SEQ ID NO: 8432123 - DNA, 22 bp, Homo sapiens
tctggcagtgatttctgtgatc

SEQ ID NO: 8432124 - DNA, 22 bp, Homo sapiens
tctggcagtggatgagggcagc

SEQ ID NO: 8432125 - DNA, 22 bp, Homo sapiens
tctggcagttgccgcttcagtc

SEQ ID NO: 8432126 - DNA, 22 bp, Homo sapiens
tctggcagttgccgcttcagtc

SEQ ID NO: 8432127 - DNA, 21 bp, Homo sapiens
tctggcagtggtctttcaaat

SEQ ID NO: 8432128 - DNA, 22 bp, Homo sapiens
tctggcagttccttgttgatat

SEQ ID NO: 8432129 - DNA, 22 bp, Homo sapiens
tctggcaaaggcaaccacagtt

SEQ ID NO: 8432130 - DNA, 22 bp, Homo sapiens
tctggcaccactgagtctgcag

SEQ ID NO: 8432131 - DNA, 22 bp, Homo sapiens
tctggcagagatatccatccca

SEQ ID NO: 8432132 - DNA, 22 bp, Homo sapiens
tctggcagaagtgctgtcagta

SEQ ID NO: 8432133 - DNA, 22 bp, Homo sapiens
tctggcagaaggcagaaattca

SEQ ID NO: 8432134 - DNA, 22 bp, Homo sapiens
tctggcagaagtgctgtcagta

SEQ ID NO: 8432135 - DNA, 22 bp, Homo sapiens
tctggcagaggaaggaggcctg

SEQ ID NO: 8432136 - DNA, 22 bp, Homo sapiens
tctggcagaggaaggaggcctg

SEQ ID NO: 8432137 - DNA, 22 bp, Homo sapiens
tctggcagagtcagtgcacaca

SEQ ID NO: 8432138 - DNA, 22 bp, Homo sapiens
tctggcagagtcagtgcacaca

SEQ ID NO: 8432139 - DNA, 20 bp, Homo sapiens
tctggcaggtgaacgagctg

SEQ ID NO: 8432140 - DNA, 20 bp, Homo sapiens
tctggcaggtgaacgagctg

SEQ ID NO: 8432141 - DNA, 22 bp, Homo sapiens
tctggcagtaataggggagaga

SEQ ID NO: 8432142 - DNA, 22 bp, Homo sapiens
tctggcagtgaagtcatgaggt

SEQ ID NO: 8432143 - DNA, 22 bp, Homo sapiens
tctggcaggttcccatgttatg

SEQ ID NO: 8432144 - DNA, 22 bp, Homo sapiens
tctggcagtgaagtcatgaggt

SEQ ID NO: 8432145 - DNA, 22 bp, Homo sapiens
tctggcagtgagcaacttgaca

SEQ ID NO: 8432146 - DNA, 22 bp, Homo sapiens
tctggcagtgagcaacttgaca

SEQ ID NO: 8432147 - DNA, 22 bp, Homo sapiens
tctggcagggtcagggcccagg

SEQ ID NO: 8432148 - DNA, 22 bp, Homo sapiens
tctggcagcaagataacaatgg

SEQ ID NO: 8432149 - DNA, 22 bp, Homo sapiens
tctggcagatcttcccacgttt

SEQ ID NO: 8432150 - DNA, 19 bp, Homo sapiens
tctggcaggtaattaggga

SEQ ID NO: 8432151 - DNA, 22 bp, Homo sapiens
tctggcaggtcaatcattcttt

SEQ ID NO: 8432152 - DNA, 22 bp, Homo sapiens
tctggcagagtgataggataag

SEQ ID NO: 8432153 - DNA, 22 bp, Homo sapiens
tctggcagggtgtgtatttaca

SEQ ID NO: 8432154 - DNA, 22 bp, Homo sapiens
tctgggagttagaatacatggg

SEQ ID NO: 8432155 - DNA, 22 bp, Homo sapiens
tctgggagttagaatacatggg

SEQ ID NO: 8432156 - DNA, 21 bp, Homo sapiens
tctgggagtgggaaaatggtc

SEQ ID NO: 8432157 - DNA, 22 bp, Homo sapiens
tctgggaggtgttttgagaact

SEQ ID NO: 8432158 - DNA, 22 bp, Homo sapiens
tctgggaggtggcagggtgcat

SEQ ID NO: 8432159 - DNA, 22 bp, Homo sapiens
tctgggaggtaaccatgctgat

SEQ ID NO: 8432160 - DNA, 22 bp, Homo sapiens
tctgggaggtaaccatgctgat

SEQ ID NO: 8432161 - DNA, 22 bp, Homo sapiens
tctgggaggggctgccattgct

SEQ ID NO: 8432162 - DNA, 22 bp, Homo sapiens
tctgggagggagcctcagaatc

SEQ ID NO: 8432163 - DNA, 22 bp, Homo sapiens
tctgggagagtcacaggcattg

SEQ ID NO: 8432164 - DNA, 22 bp, Homo sapiens
tctgggagagtagataaaggaa

SEQ ID NO: 8432165 - DNA, 22 bp, Homo sapiens
tctgggagagggaaagaagact

SEQ ID NO: 8432166 - DNA, 22 bp, Homo sapiens
tctgggagaagctgatgtgaag

SEQ ID NO: 8432167 - DNA, 22 bp, Homo sapiens
tctgggaagtcctctgtcatgc

SEQ ID NO: 8432168 - DNA, 22 bp, Homo sapiens
tctgggaatttattggcacttt

SEQ ID NO: 8432169 - DNA, 22 bp, Homo sapiens
tctgggaatgaataagacctgt

SEQ ID NO: 8432170 - DNA, 23 bp, Homo sapiens
tctgggccacttgtctgcacttc

SEQ ID NO: 8432171 - DNA, 22 bp, Homo sapiens
tctgggccagatctagggatct

SEQ ID NO: 8432172 - DNA, 22 bp, Homo sapiens
tctgggctcttagtgtaccctc

SEQ ID NO: 8432173 - DNA, 22 bp, Homo sapiens
tctgggccctaaaccagctcta

SEQ ID NO: 8432174 - DNA, 22 bp, Homo sapiens
tctgggctgctatgaggcagag

SEQ ID NO: 8432175 - DNA, 22 bp, Homo sapiens
tctgggctgctatgaggcagag

SEQ ID NO: 8432176 - DNA, 21 bp, Homo sapiens
tctgggctgctgctgcccatc

SEQ ID NO: 8432177 - DNA, 22 bp, Homo sapiens
tctgggctgctgtgcagtgacc

SEQ ID NO: 8432178 - DNA, 22 bp, Homo sapiens
tctgggctgaaatgaaggcctt

SEQ ID NO: 8432179 - DNA, 23 bp, Homo sapiens
tctgggctgagacttggaaggtc

SEQ ID NO: 8432180 - DNA, 23 bp, Homo sapiens
tctgggctgagctcgagtgtaga

SEQ ID NO: 8432181 - DNA, 22 bp, Homo sapiens
tctgggatagggccagaacatg

SEQ ID NO: 8432182 - DNA, 22 bp, Homo sapiens
tctgggatgcaaacagaatctg

SEQ ID NO: 8432183 - DNA, 22 bp, Homo sapiens
tctgggatttttgacactgaag

SEQ ID NO: 8432184 - DNA, 22 bp, Homo sapiens
tctgggattttatagacatgct

SEQ ID NO: 8432185 - DNA, 22 bp, Homo sapiens
tctgggatgagatcagagacac

SEQ ID NO: 8432186 - DNA, 22 bp, Homo sapiens
tctgggcacacaccatgcccac

SEQ ID NO: 8432187 - DNA, 23 bp, Homo sapiens
tctgggcaccttgttgacatgat

SEQ ID NO: 8432188 - DNA, 22 bp, Homo sapiens
tctgggcactgctgagcctgta

SEQ ID NO: 8432189 - DNA, 22 bp, Homo sapiens
tctgggcagcagcagctagtag

SEQ ID NO: 8432190 - DNA, 22 bp, Homo sapiens
tctgggcagccatgtgcctggc

SEQ ID NO: 8432191 - DNA, 20 bp, Homo sapiens
tctgggcagggcacatggaa

SEQ ID NO: 8432192 - DNA, 20 bp, Homo sapiens
tctgggcagggcacatggaa

SEQ ID NO: 8432193 - DNA, 22 bp, Homo sapiens
tctgggcagcctcaggccaggg

SEQ ID NO: 8432194 - DNA, 22 bp, Homo sapiens
tctgggcagccgccccatagga

SEQ ID NO: 8432195 - DNA, 22 bp, Homo sapiens
tctgggcagtacccctctccta

SEQ ID NO: 8432196 - DNA, 19 bp, Homo sapiens
tctgggcagggccagcacc

SEQ ID NO: 8432197 - DNA, 19 bp, Homo sapiens
tctgggcagggccagcacc

SEQ ID NO: 8432198 - DNA, 22 bp, Homo sapiens
tctggcccctggtctctggtgt

SEQ ID NO: 8432199 - DNA, 22 bp, Homo sapiens
tctggccctatggcatgtacct

SEQ ID NO: 8432200 - DNA, 22 bp, Homo sapiens
tctggccccgcatgcactttat

SEQ ID NO: 8432201 - DNA, 22 bp, Homo sapiens
tctggccccggtcttcacagct

SEQ ID NO: 8432202 - DNA, 22 bp, Homo sapiens
tctggctcccagcctgctctca

SEQ ID NO: 8432203 - DNA, 23 bp, Homo sapiens
tctggctccatccttggggatcc

SEQ ID NO: 8432204 - DNA, 22 bp, Homo sapiens
tctggctcctgagtccatgctc

SEQ ID NO: 8432205 - DNA, 22 bp, Homo sapiens
tctggctccgtgtccgctccca

SEQ ID NO: 8432206 - DNA, 22 bp, Homo sapiens
tctggctccactctgtgcatgc

SEQ ID NO: 8432207 - DNA, 22 bp, Homo sapiens
tctggctccactctgtgcatgc

SEQ ID NO: 8432208 - DNA, 22 bp, Homo sapiens
tctggctccactttcttcattt

SEQ ID NO: 8432209 - DNA, 20 bp, Homo sapiens
tctggctctttgctcctccc

SEQ ID NO: 8432210 - DNA, 22 bp, Homo sapiens
tctggctctgacactactgtta

SEQ ID NO: 8432211 - DNA, 22 bp, Homo sapiens
tctggctgaaaggggctgtgcc

SEQ ID NO: 8432212 - DNA, 22 bp, Homo sapiens
tctggctctttgggtgattgta

SEQ ID NO: 8432213 - DNA, 22 bp, Homo sapiens
tctggctgaaaggggctgtgcc

SEQ ID NO: 8432214 - DNA, 22 bp, Homo sapiens
tctggctgaattagccttgggt

SEQ ID NO: 8432215 - DNA, 22 bp, Homo sapiens
tctggctgaaattagaaggttc

SEQ ID NO: 8432216 - DNA, 22 bp, Homo sapiens
tctggctctataactcctagct

SEQ ID NO: 8432217 - DNA, 22 bp, Homo sapiens
tctggctctaactaggcatcag

SEQ ID NO: 8432218 - DNA, 22 bp, Homo sapiens
tctggctctccagtgctcttag

SEQ ID NO: 8432219 - DNA, 23 bp, Homo sapiens
tctggctctatgtgacagctctc

SEQ ID NO: 8432220 - DNA, 22 bp, Homo sapiens
tctggctctcaacaaatattta

SEQ ID NO: 8432221 - DNA, 22 bp, Homo sapiens
tctggctcctggctccactgcc

SEQ ID NO: 8432222 - DNA, 22 bp, Homo sapiens
tctggctcctggctccactgcc

SEQ ID NO: 8432223 - DNA, 22 bp, Homo sapiens
tctggctcggatttgtctagca

SEQ ID NO: 8432224 - DNA, 22 bp, Homo sapiens
tctggctcggatttgtctagca

SEQ ID NO: 8432225 - DNA, 22 bp, Homo sapiens
tctgggaaagtaaatgtaaagg

SEQ ID NO: 8432226 - DNA, 22 bp, Homo sapiens
tctgggaacgaaggctaatatg

SEQ ID NO: 8432227 - DNA, 22 bp, Homo sapiens
tctgggaacattttgagggcaa

SEQ ID NO: 8432228 - DNA, 22 bp, Homo sapiens
tctgggaagatgtttcaaaggt

SEQ ID NO: 8432229 - DNA, 22 bp, Homo sapiens
tctggctttcctggagcaagaa

SEQ ID NO: 8432230 - DNA, 22 bp, Homo sapiens
tctggctttcatttgtttaaag

SEQ ID NO: 8432231 - DNA, 22 bp, Homo sapiens
tctggctttctcagcatggcat

SEQ ID NO: 8432232 - DNA, 22 bp, Homo sapiens
tctggctgtgtatgagagtttt

SEQ ID NO: 8432233 - DNA, 22 bp, Homo sapiens
tctggctgtcattggaggcccc

SEQ ID NO: 8432234 - DNA, 22 bp, Homo sapiens
tctggctgtgtaaggtagcacc

SEQ ID NO: 8432235 - DNA, 22 bp, Homo sapiens
tctggctgggtgagagcttctc

SEQ ID NO: 8432236 - DNA, 22 bp, Homo sapiens
tctggctgggtgagagcttctc

SEQ ID NO: 8432237 - DNA, 22 bp, Homo sapiens
tctggctggcagtgatggtgtg

SEQ ID NO: 8432238 - DNA, 22 bp, Homo sapiens
tctggctggcagtgatggtgtg

SEQ ID NO: 8432239 - DNA, 22 bp, Homo sapiens
tctggctgctgcgtgagtgctt

SEQ ID NO: 8432240 - DNA, 22 bp, Homo sapiens
tctggctgattccctgggactg

SEQ ID NO: 8432241 - DNA, 22 bp, Homo sapiens
tcttctagtaggccaagaagct

SEQ ID NO: 8432242 - DNA, 22 bp, Homo sapiens
tcttcctgcttggtgtgtctgg

SEQ ID NO: 8432243 - DNA, 22 bp, Homo sapiens
tcttcctgcttggtgtgtctgg

SEQ ID NO: 8432244 - DNA, 22 bp, Homo sapiens
tcttcctggcattgatgctgca

SEQ ID NO: 8432245 - DNA, 22 bp, Homo sapiens
tcttcctgctttggtgaggctt

SEQ ID NO: 8432246 - DNA, 22 bp, Homo sapiens
tcttcctgtcaatgagaattaa

SEQ ID NO: 8432247 - DNA, 22 bp, Homo sapiens
tcttccttcgcccttgctgttt

SEQ ID NO: 8432248 - DNA, 22 bp, Homo sapiens
tcttccaggagggtgggcaaac

SEQ ID NO: 8432249 - DNA, 22 bp, Homo sapiens
tcttccagcttctggtggctgc

SEQ ID NO: 8432250 - DNA, 22 bp, Homo sapiens
tcttccaggacctggggctcca

SEQ ID NO: 8432251 - DNA, 22 bp, Homo sapiens
tcttccagcttctagaggatgc

SEQ ID NO: 8432252 - DNA, 22 bp, Homo sapiens
tcttctccagtgcttctgcaca

SEQ ID NO: 8432253 - DNA, 22 bp, Homo sapiens
tcttctccagtgcttctgcaca

SEQ ID NO: 8432254 - DNA, 22 bp, Homo sapiens
tcttctccataatcaacactct

SEQ ID NO: 8432255 - DNA, 22 bp, Homo sapiens
tcttctcccatcggccgcaggg

SEQ ID NO: 8432256 - DNA, 22 bp, Homo sapiens
tcttctcccatctccaggcagg

SEQ ID NO: 8432257 - DNA, 22 bp, Homo sapiens
tcttctcctttgccatgtgttt

SEQ ID NO: 8432258 - DNA, 22 bp, Homo sapiens
tcttctcctttgccatgtgttt

SEQ ID NO: 8432259 - DNA, 22 bp, Homo sapiens
tcttctctacaccagcagcccc

SEQ ID NO: 8432260 - DNA, 22 bp, Homo sapiens
tcttctctcatgtaggagggaa

SEQ ID NO: 8432261 - DNA, 22 bp, Homo sapiens
tcttctctacaccagcagcccc

SEQ ID NO: 8432262 - DNA, 22 bp, Homo sapiens
tcttctgtattgttaactcagg

SEQ ID NO: 8432263 - DNA, 22 bp, Homo sapiens
tcttctgtgagaattcaagcaa

SEQ ID NO: 8432264 - DNA, 22 bp, Homo sapiens
tcttctgtcctaagtcaaagca

SEQ ID NO: 8432265 - DNA, 22 bp, Homo sapiens
tcttctgtggctctcaccaccc

SEQ ID NO: 8432266 - DNA, 22 bp, Homo sapiens
tcttctgttaccacagcgatga

SEQ ID NO: 8432267 - DNA, 22 bp, Homo sapiens
tcttctgttaccacagcgatga

SEQ ID NO: 8432268 - DNA, 20 bp, Homo sapiens
tcttctgttgccttgttctg

SEQ ID NO: 8432269 - DNA, 20 bp, Homo sapiens
tcttctgttgccttgttctg

SEQ ID NO: 8432270 - DNA, 22 bp, Homo sapiens
tcttctttgaatcatagtgacc

SEQ ID NO: 8432271 - DNA, 22 bp, Homo sapiens
tcttcttcctcatttatacata

SEQ ID NO: 8432272 - DNA, 22 bp, Homo sapiens
tcttcttcctcatttatacata

SEQ ID NO: 8432273 - DNA, 22 bp, Homo sapiens
tcttctttttgtcccacagaat

SEQ ID NO: 8432274 - DNA, 21 bp, Homo sapiens
tcttgaaaagttagattctct

SEQ ID NO: 8432275 - DNA, 22 bp, Homo sapiens
tcttctttgaatcatagtgacc

SEQ ID NO: 8432276 - DNA, 22 bp, Homo sapiens
tcttctttttgtcccacagaat

SEQ ID NO: 8432277 - DNA, 22 bp, Homo sapiens
tcttcttttatttcaagggtgt

SEQ ID NO: 8432278 - DNA, 22 bp, Homo sapiens
tcttcaaagaattttagtaatt

SEQ ID NO: 8432279 - DNA, 22 bp, Homo sapiens
tcttcaaaaatacaggttttca

SEQ ID NO: 8432280 - DNA, 22 bp, Homo sapiens
tcttattttttaatgacagaga

SEQ ID NO: 8432281 - DNA, 22 bp, Homo sapiens
tcttatttagagaggactagag

SEQ ID NO: 8432282 - DNA, 22 bp, Homo sapiens
tcttatttgcaactggctcaga

SEQ ID NO: 8432283 - DNA, 22 bp, Homo sapiens
tcttattattgttgtaaaagca

SEQ ID NO: 8432284 - DNA, 22 bp, Homo sapiens
tcttcaaatacagtcatattga

SEQ ID NO: 8432285 - DNA, 20 bp, Homo sapiens
tcttcagatgcttttggagt

SEQ ID NO: 8432286 - DNA, 22 bp, Homo sapiens
tcttcagattgcactgagcaag

SEQ ID NO: 8432287 - DNA, 22 bp, Homo sapiens
tcttcacagatgcatatacttc

SEQ ID NO: 8432288 - DNA, 22 bp, Homo sapiens
tcttccagctccccacggtgtc

SEQ ID NO: 8432289 - DNA, 22 bp, Homo sapiens
tcttccagccaatagcgtcctt

SEQ ID NO: 8432290 - DNA, 22 bp, Homo sapiens
tcttccagcccttctaatggta

SEQ ID NO: 8432291 - DNA, 22 bp, Homo sapiens
tcttccagcaatgtgaaatcac

SEQ ID NO: 8432292 - DNA, 22 bp, Homo sapiens
tcttccagatacttcctgactt

SEQ ID NO: 8432293 - DNA, 22 bp, Homo sapiens
tcttccagagcctccatcccta

SEQ ID NO: 8432294 - DNA, 22 bp, Homo sapiens
tcttccagaatctcagagggct

SEQ ID NO: 8432295 - DNA, 18 bp, Homo sapiens
tcttcatctcctgagctg

SEQ ID NO: 8432296 - DNA, 22 bp, Homo sapiens
tcttcatgtatactcatggtac

SEQ ID NO: 8432297 - DNA, 22 bp, Homo sapiens
tcttcaggaagggaaatcatcc

SEQ ID NO: 8432298 - DNA, 22 bp, Homo sapiens
tcttcagtaggtcctcagaatc

SEQ ID NO: 8432299 - DNA, 22 bp, Homo sapiens
tctttattgctactggtttgtc

SEQ ID NO: 8432300 - DNA, 22 bp, Homo sapiens
tctttattgctactggtttgtc

SEQ ID NO: 8432301 - DNA, 22 bp, Homo sapiens
tctttcaatgagcattctttcc

SEQ ID NO: 8432302 - DNA, 22 bp, Homo sapiens
tctttcattctagtctgaggtt

SEQ ID NO: 8432303 - DNA, 19 bp, Homo sapiens
tctttcatttctagctctg

SEQ ID NO: 8432304 - DNA, 22 bp, Homo sapiens
tctttcaatgtgaaaccatgta

SEQ ID NO: 8432305 - DNA, 22 bp, Homo sapiens
tctttccaaggactctgtagca

SEQ ID NO: 8432306 - DNA, 22 bp, Homo sapiens
tctttccaaggactctgtagca

SEQ ID NO: 8432307 - DNA, 22 bp, Homo sapiens
tctttccacattctctgtttag

SEQ ID NO: 8432308 - DNA, 22 bp, Homo sapiens
tctttccacagcatgtccatgc

SEQ ID NO: 8432309 - DNA, 22 bp, Homo sapiens
tctttccagaggaatttttaga

SEQ ID NO: 8432310 - DNA, 22 bp, Homo sapiens
tctttccagaggaatttttaga

SEQ ID NO: 8432311 - DNA, 22 bp, Homo sapiens
tctttccatggccacacagtct

SEQ ID NO: 8432312 - DNA, 22 bp, Homo sapiens
tctttcccgccagagcatgagt

SEQ ID NO: 8432313 - DNA, 22 bp, Homo sapiens
tctttcccgccagagcatgagt

SEQ ID NO: 8432314 - DNA, 22 bp, Homo sapiens
tctttcccagtagctctcccag

SEQ ID NO: 8432315 - DNA, 22 bp, Homo sapiens
tctttcccctacatttggttaa

SEQ ID NO: 8432316 - DNA, 22 bp, Homo sapiens
tctttcccagtagctctcccag

SEQ ID NO: 8432317 - DNA, 20 bp, Homo sapiens
tctttagatttatcttatgt

SEQ ID NO: 8432318 - DNA, 20 bp, Homo sapiens
tctttagatttatcttatgt

SEQ ID NO: 8432319 - DNA, 19 bp, Homo sapiens
tctttagccagagctctgg

SEQ ID NO: 8432320 - DNA, 22 bp, Homo sapiens
tctttagtgacagttgtgcaag

SEQ ID NO: 8432321 - DNA, 22 bp, Homo sapiens
tctttagagctcagaaatacag

SEQ ID NO: 8432322 - DNA, 22 bp, Homo sapiens
tctttagagcctttcctcccga

SEQ ID NO: 8432323 - DNA, 22 bp, Homo sapiens
tctttagaaacttttcttcatg

SEQ ID NO: 8432324 - DNA, 22 bp, Homo sapiens
tctttagagcacgggaaaaaca

SEQ ID NO: 8432325 - DNA, 22 bp, Homo sapiens
tctttagatgtttagaggaaga

SEQ ID NO: 8432326 - DNA, 22 bp, Homo sapiens
tctttagagctcagaaatacag

SEQ ID NO: 8432327 - DNA, 22 bp, Homo sapiens
tctttagagttaacaataatga

SEQ ID NO: 8432328 - DNA, 22 bp, Homo sapiens
tctttagagttaacaataatga

SEQ ID NO: 8432329 - DNA, 22 bp, Homo sapiens
tctttataaaagtcattatgtc

SEQ ID NO: 8432330 - DNA, 21 bp, Homo sapiens
tctttatgacttgcccatttg

SEQ ID NO: 8432331 - DNA, 22 bp, Homo sapiens
tctttatacaaactgggaaaca

SEQ ID NO: 8432332 - DNA, 22 bp, Homo sapiens
tctttatacaaactgggaaaca

SEQ ID NO: 8432333 - DNA, 22 bp, Homo sapiens
tctttatcaagtctgttctttg

SEQ ID NO: 8432334 - DNA, 22 bp, Homo sapiens
tctttatctggctcagagacac

SEQ ID NO: 8432335 - DNA, 22 bp, Homo sapiens
tctttatcaggtgaagagggac

SEQ ID NO: 8432336 - DNA, 22 bp, Homo sapiens
tctttatgtttgaaagtacaat

SEQ ID NO: 8432337 - DNA, 21 bp, Homo sapiens
tctttctgaaatctcagtctg

SEQ ID NO: 8432338 - DNA, 21 bp, Homo sapiens
tctttctgaaatctcagtctg

SEQ ID NO: 8432339 - DNA, 22 bp, Homo sapiens
tctttctgaatatttgacctca

SEQ ID NO: 8432340 - DNA, 22 bp, Homo sapiens
tctttctgatgggaagggtcaa

SEQ ID NO: 8432341 - DNA, 22 bp, Homo sapiens
tctttctgcacttagtggggct

SEQ ID NO: 8432342 - DNA, 22 bp, Homo sapiens
tctttctgcagcacaggggcag

SEQ ID NO: 8432343 - DNA, 22 bp, Homo sapiens
tctttctggttatgtatagaga

SEQ ID NO: 8432344 - DNA, 22 bp, Homo sapiens
tctttctggtctcgccttattc

SEQ ID NO: 8432345 - DNA, 22 bp, Homo sapiens
tctttctgtaagctccatggaa

SEQ ID NO: 8432346 - DNA, 22 bp, Homo sapiens
tctttgaatcctttacatctga

SEQ ID NO: 8432347 - DNA, 22 bp, Homo sapiens
tctttgaagtatcttaaatggt

SEQ ID NO: 8432348 - DNA, 22 bp, Homo sapiens
tctttgatcagcctttcactga

SEQ ID NO: 8432349 - DNA, 22 bp, Homo sapiens
tctttgatgtggttaattatga

SEQ ID NO: 8432350 - DNA, 22 bp, Homo sapiens
tctttccctgtgttagcctgta

SEQ ID NO: 8432351 - DNA, 22 bp, Homo sapiens
tctttccctgtgttagcctgta

SEQ ID NO: 8432352 - DNA, 22 bp, Homo sapiens
tctttcccttagaacattaaca

SEQ ID NO: 8432353 - DNA, 22 bp, Homo sapiens
tctttccctgtgttagcctgta

SEQ ID NO: 8432354 - DNA, 17 bp, Homo sapiens
tctttccctgggagatg

SEQ ID NO: 8432355 - DNA, 22 bp, Homo sapiens
tctttcctagaggctgatgagt

SEQ ID NO: 8432356 - DNA, 22 bp, Homo sapiens
tctttacaatctaagcatagtt

SEQ ID NO: 8432357 - DNA, 22 bp, Homo sapiens
tctttaattgtggaagagcagc

SEQ ID NO: 8432358 - DNA, 22 bp, Homo sapiens
tctttaatgtgattgtaattat

SEQ ID NO: 8432359 - DNA, 22 bp, Homo sapiens
tctttaatcataaccaagatgg

SEQ ID NO: 8432360 - DNA, 22 bp, Homo sapiens
tctttacatcacaattgtatgg

SEQ ID NO: 8432361 - DNA, 22 bp, Homo sapiens
tctttacatagtgtggactact

SEQ ID NO: 8432362 - DNA, 22 bp, Homo sapiens
tctttacacaagacaagaataa

SEQ ID NO: 8432363 - DNA, 22 bp, Homo sapiens
tctttagaaacttttcttcatg

SEQ ID NO: 8432364 - DNA, 22 bp, Homo sapiens
tctttagacatccagtttctct

SEQ ID NO: 8432365 - DNA, 23 bp, Homo sapiens
tctttagaagaacatcagaaatg

SEQ ID NO: 8432366 - DNA, 22 bp, Homo sapiens
tctttacttgtgtattgtatat

SEQ ID NO: 8432367 - DNA, 22 bp, Homo sapiens
tctttacatcacaattgtatgg

SEQ ID NO: 8432368 - DNA, 22 bp, Homo sapiens
tcttggctttctcctagggatg

SEQ ID NO: 8432369 - DNA, 22 bp, Homo sapiens
tcttgggaggagcacctgcctg

SEQ ID NO: 8432370 - DNA, 22 bp, Homo sapiens
tcttgggattgccctgcagttc

SEQ ID NO: 8432371 - DNA, 20 bp, Homo sapiens
tcttggctgtgtgaggacac

SEQ ID NO: 8432372 - DNA, 22 bp, Homo sapiens
tcttggctcccttgtaggccct

SEQ ID NO: 8432373 - DNA, 20 bp, Homo sapiens
tcttggaaaaagttcagaat

SEQ ID NO: 8432374 - DNA, 19 bp, Homo sapiens
tcttgaggaaagtaaggca

SEQ ID NO: 8432375 - DNA, 22 bp, Homo sapiens
tcttgaggttattaagctgtta

SEQ ID NO: 8432376 - DNA, 22 bp, Homo sapiens
tcttgagagatatactactgaa

SEQ ID NO: 8432377 - DNA, 22 bp, Homo sapiens
tcttgacattgttgttagcagg

SEQ ID NO: 8432378 - DNA, 20 bp, Homo sapiens
tcttgagaacaatttctggc

SEQ ID NO: 8432379 - DNA, 22 bp, Homo sapiens
tcttgagaaataattaaacatg

SEQ ID NO: 8432380 - DNA, 22 bp, Homo sapiens
tcttgagaagcggctgtctcag

SEQ ID NO: 8432381 - DNA, 22 bp, Homo sapiens
tcttgaagtcttatggtttaaa

SEQ ID NO: 8432382 - DNA, 22 bp, Homo sapiens
tcttgaaaggagattggaggca

SEQ ID NO: 8432383 - DNA, 22 bp, Homo sapiens
tcttggcagtggaataccagga

SEQ ID NO: 8432384 - DNA, 22 bp, Homo sapiens
tcttggattttaatggatcaaa

SEQ ID NO: 8432385 - DNA, 22 bp, Homo sapiens
tcttggattttaatggatcaaa

SEQ ID NO: 8432386 - DNA, 18 bp, Homo sapiens
tcttggcagcatctggca

SEQ ID NO: 8432387 - DNA, 22 bp, Homo sapiens
tcttggctacttaggaggattc

SEQ ID NO: 8432388 - DNA, 22 bp, Homo sapiens
tcttggactcaaaattgcctta

SEQ ID NO: 8432389 - DNA, 22 bp, Homo sapiens
tcttggactcaaaattgcctta

SEQ ID NO: 8432390 - DNA, 18 bp, Homo sapiens
tcttggagtaatgatcaa

SEQ ID NO: 8432391 - DNA, 22 bp, Homo sapiens
tcttggaggagagtaagtacct

SEQ ID NO: 8432392 - DNA, 22 bp, Homo sapiens
tcttggagatagggtcttaatg

SEQ ID NO: 8432393 - DNA, 22 bp, Homo sapiens
tcttggagaatggcagagaagc

SEQ ID NO: 8432394 - DNA, 22 bp, Homo sapiens
tcttggagaatggcagagaagc

SEQ ID NO: 8432395 - DNA, 22 bp, Homo sapiens
tcttggagactcttgtatattt

SEQ ID NO: 8432396 - DNA, 22 bp, Homo sapiens
tcttagtcacagaggtgagaaa

SEQ ID NO: 8432397 - DNA, 22 bp, Homo sapiens
tcttataaaaggactcccattt

SEQ ID NO: 8432398 - DNA, 22 bp, Homo sapiens
tcttatatgcacatacattggg

SEQ ID NO: 8432399 - DNA, 22 bp, Homo sapiens
tcttatgaaaagcacttagaac

SEQ ID NO: 8432400 - DNA, 22 bp, Homo sapiens
tcttagaattgaagtcagaggg

SEQ ID NO: 8432401 - DNA, 22 bp, Homo sapiens
tcttaatgaaagtgaaatatca

SEQ ID NO: 8432402 - DNA, 22 bp, Homo sapiens
tcttaagtacctcctttatcac

SEQ ID NO: 8432403 - DNA, 22 bp, Homo sapiens
tcttaagaaagtgacaaatagg

SEQ ID NO: 8432404 - DNA, 22 bp, Homo sapiens
tcttaaatgactgataagagga

SEQ ID NO: 8432405 - DNA, 22 bp, Homo sapiens
tcttaaaccacaaaattcagag

SEQ ID NO: 8432406 - DNA, 22 bp, Homo sapiens
tcttaaactttgctgtaattct

SEQ ID NO: 8432407 - DNA, 22 bp, Homo sapiens
tcttaaaagtatgccaattgga

SEQ ID NO: 8432408 - DNA, 22 bp, Homo sapiens
tctgttttgtaccagatacagc

SEQ ID NO: 8432409 - DNA, 22 bp, Homo sapiens
tctgtttttgaggctatcttct

SEQ ID NO: 8432410 - DNA, 22 bp, Homo sapiens
tctgttttgtgtctctctggtg

SEQ ID NO: 8432411 - DNA, 22 bp, Homo sapiens
tctgtttattcaatttctatat

SEQ ID NO: 8432412 - DNA, 22 bp, Homo sapiens
tctgtttcttcttctgttatat

SEQ ID NO: 8432413 - DNA, 23 bp, Homo sapiens
tctgttttgcaacatgtgacaag

SEQ ID NO: 8432414 - DNA, 22 bp, Homo sapiens
tctgttttctctgtattttgac

SEQ ID NO: 8432415 - DNA, 22 bp, Homo sapiens
tctgttttagataagaaaggct

SEQ ID NO: 8432416 - DNA, 22 bp, Homo sapiens
tctgtgtgcccacctgacacct

SEQ ID NO: 8432417 - DNA, 20 bp, Homo sapiens
tctgtgtgccatcacctaac

SEQ ID NO: 8432418 - DNA, 20 bp, Homo sapiens
tctgtgtgccatcacctaac

SEQ ID NO: 8432419 - DNA, 22 bp, Homo sapiens
tctgtgtgaccataagccagct

SEQ ID NO: 8432420 - DNA, 22 bp, Homo sapiens
tctgtgtttaaaagatatgtcc

SEQ ID NO: 8432421 - DNA, 22 bp, Homo sapiens
tctgttaaaagtggaataatag

SEQ ID NO: 8432422 - DNA, 22 bp, Homo sapiens
tctgtgttttactccaattata

SEQ ID NO: 8432423 - DNA, 22 bp, Homo sapiens
tctgttgaccaagtcttcttcc

SEQ ID NO: 8432424 - DNA, 22 bp, Homo sapiens
tctgttgactcctagcagccat

SEQ ID NO: 8432425 - DNA, 18 bp, Homo sapiens
tctgttgagcagagaggc

SEQ ID NO: 8432426 - DNA, 22 bp, Homo sapiens
tctgttatatgttttttctaaa

SEQ ID NO: 8432427 - DNA, 22 bp, Homo sapiens
tctgtttagactcagttgaaac

SEQ ID NO: 8432428 - DNA, 22 bp, Homo sapiens
tctgtttagatgctttatctgt

SEQ ID NO: 8432429 - DNA, 22 bp, Homo sapiens
tctgtttaatgggaatgatact

SEQ ID NO: 8432430 - DNA, 22 bp, Homo sapiens
tctgtttagactcagttgaaac

SEQ ID NO: 8432431 - DNA, 22 bp, Homo sapiens
tctgtttatgcatatttaaaac

SEQ ID NO: 8432432 - DNA, 22 bp, Homo sapiens
tctgtttatgcatatttaaaac

SEQ ID NO: 8432433 - DNA, 22 bp, Homo sapiens
tctgtttatgcatatttaaaac

SEQ ID NO: 8432434 - DNA, 22 bp, Homo sapiens
tctgttggacattcatctgcag

SEQ ID NO: 8432435 - DNA, 22 bp, Homo sapiens
tctgttgcaatgtgcatggtga

SEQ ID NO: 8432436 - DNA, 22 bp, Homo sapiens
tctgtgctagcacgcagcaagg

SEQ ID NO: 8432437 - DNA, 22 bp, Homo sapiens
tctgtgctaggcagcctggccc

SEQ ID NO: 8432438 - DNA, 22 bp, Homo sapiens
tctgtgctagaggagttggcca

SEQ ID NO: 8432439 - DNA, 21 bp, Homo sapiens
tctgtgctgccgtcaacatcc

SEQ ID NO: 8432440 - DNA, 22 bp, Homo sapiens
tctgtgctgtctcagagaaagc

SEQ ID NO: 8432441 - DNA, 22 bp, Homo sapiens
tctgtgctggactgatttcata

SEQ ID NO: 8432442 - DNA, 22 bp, Homo sapiens
tctgtgctcatgcatgtgaatt

SEQ ID NO: 8432443 - DNA, 22 bp, Homo sapiens
tctgtgctgagctctgagatgt

SEQ ID NO: 8432444 - DNA, 22 bp, Homo sapiens
tctgtgctgcaggagtctgcat

SEQ ID NO: 8432445 - DNA, 22 bp, Homo sapiens
tctgtggattttagtgttcatg

SEQ ID NO: 8432446 - DNA, 22 bp, Homo sapiens
tctgtggagttgaggaaggttg

SEQ ID NO: 8432447 - DNA, 22 bp, Homo sapiens
tctgtggagtgacctgggcttt

SEQ ID NO: 8432448 - DNA, 22 bp, Homo sapiens
tctgtggagttagactggtatc

SEQ ID NO: 8432449 - DNA, 22 bp, Homo sapiens
tctgtggaagattccaggcgtt

SEQ ID NO: 8432450 - DNA, 22 bp, Homo sapiens
tctgtggaagattccaggcgtt

SEQ ID NO: 8432451 - DNA, 22 bp, Homo sapiens
tctgtgctttccctgccttctt

SEQ ID NO: 8432452 - DNA, 22 bp, Homo sapiens
tctgtgctgtctcagataagca

SEQ ID NO: 8432453 - DNA, 18 bp, Homo sapiens
tctgtggagagggcagtt

SEQ ID NO: 8432454 - DNA, 22 bp, Homo sapiens
tctgtggaccagggtataagga

SEQ ID NO: 8432455 - DNA, 22 bp, Homo sapiens
tctgtggcttcctatttcttgg

SEQ ID NO: 8432456 - DNA, 22 bp, Homo sapiens
tctgtgtatttgtgacctgtat

SEQ ID NO: 8432457 - DNA, 22 bp, Homo sapiens
tctgtgtctgcagaagttcagc

SEQ ID NO: 8432458 - DNA, 22 bp, Homo sapiens
tctgtgtctggttgggccagta

SEQ ID NO: 8432459 - DNA, 22 bp, Homo sapiens
tctgtgctaatgcttcacaata

SEQ ID NO: 8432460 - DNA, 22 bp, Homo sapiens
tctgtgctaatgcttcacaata

SEQ ID NO: 8432461 - DNA, 22 bp, Homo sapiens
tctgtgcctttaagaagctcat

SEQ ID NO: 8432462 - DNA, 23 bp, Homo sapiens
tctgtgccagtttccatgtctgt

SEQ ID NO: 8432463 - DNA, 22 bp, Homo sapiens
tctgtgcaggaagtcattatga

SEQ ID NO: 8432464 - DNA, 22 bp, Homo sapiens
tctgtgcagatgtagaccagtt

SEQ ID NO: 8432465 - DNA, 15 bp, Homo sapiens
tctgtgcagcaaggg

SEQ ID NO: 8432466 - DNA, 22 bp, Homo sapiens
tctgtgcagatgtagaccagtt

SEQ ID NO: 8432467 - DNA, 22 bp, Homo sapiens
tctgtgcagacatggggaagcc

SEQ ID NO: 8432468 - DNA, 22 bp, Homo sapiens
tctgtgcagaactcacagaagg

SEQ ID NO: 8432469 - DNA, 22 bp, Homo sapiens
tctgtgcagaactcacagaagg

SEQ ID NO: 8432470 - DNA, 22 bp, Homo sapiens
tctgtgcagaatcaaggagctt

SEQ ID NO: 8432471 - DNA, 22 bp, Homo sapiens
tctgtgcagaatcaaggagctt

SEQ ID NO: 8432472 - DNA, 22 bp, Homo sapiens
tctgtgcactgtgtcattaggt

SEQ ID NO: 8432473 - DNA, 22 bp, Homo sapiens
tctgtgcactaacattcctggt

SEQ ID NO: 8432474 - DNA, 22 bp, Homo sapiens
tctgtgcactaacattcctggt

SEQ ID NO: 8432475 - DNA, 22 bp, Homo sapiens
tctgtgcagtcagggctcagtc

SEQ ID NO: 8432476 - DNA, 22 bp, Homo sapiens
tctgtgcaggatttgaggaacc

SEQ ID NO: 8432477 - DNA, 22 bp, Homo sapiens
tctgtgcagggaccccaagagt

SEQ ID NO: 8432478 - DNA, 20 bp, Homo sapiens
tctgtgcagtggaggggcag

SEQ ID NO: 8432479 - DNA, 22 bp, Homo sapiens
tctgtgcagttcttgtcttgac

SEQ ID NO: 8432480 - DNA, 20 bp, Homo sapiens
tctgtgcagtggaggggcag

SEQ ID NO: 8432481 - DNA, 20 bp, Homo sapiens
tctgtgcagtttaggaaggc

SEQ ID NO: 8432482 - DNA, 22 bp, Homo sapiens
tctgtgcatccttaacgcctgc

SEQ ID NO: 8432483 - DNA, 20 bp, Homo sapiens
tctgtgcattgcctgctggt

SEQ ID NO: 8432484 - DNA, 20 bp, Homo sapiens
tctgtgcattgcctgctggt

SEQ ID NO: 8432485 - DNA, 22 bp, Homo sapiens
tctgtgcattgtaacaactaaa

SEQ ID NO: 8432486 - DNA, 22 bp, Homo sapiens
tctgtgcatttcaggacctgaa

SEQ ID NO: 8432487 - DNA, 22 bp, Homo sapiens
tctgtctttgagatctcagcct

SEQ ID NO: 8432488 - DNA, 22 bp, Homo sapiens
tctgtctttgtcaggaccagag

SEQ ID NO: 8432489 - DNA, 22 bp, Homo sapiens
tctgtctttgtcaggaccagag

SEQ ID NO: 8432490 - DNA, 22 bp, Homo sapiens
tctgtctttgtcaggaccagag

SEQ ID NO: 8432491 - DNA, 22 bp, Homo sapiens
tctgtctttagaggcctgtgct

SEQ ID NO: 8432492 - DNA, 22 bp, Homo sapiens
tctgtctgagtggtgttagagt

SEQ ID NO: 8432493 - DNA, 22 bp, Homo sapiens
tctgtctgagggagtgacattt

SEQ ID NO: 8432494 - DNA, 22 bp, Homo sapiens
tctgtctgaggagtttttgacc

SEQ ID NO: 8432495 - DNA, 22 bp, Homo sapiens
tctgtctgccttgtgagggcac

SEQ ID NO: 8432496 - DNA, 17 bp, Homo sapiens
tctgtgatagtgtagat

SEQ ID NO: 8432497 - DNA, 22 bp, Homo sapiens
tctgtgcaagaccaactttcaa

SEQ ID NO: 8432498 - DNA, 22 bp, Homo sapiens
tctgtgcaagtatttgacattt

SEQ ID NO: 8432499 - DNA, 22 bp, Homo sapiens
tctgtgcaatagtttgttttac

SEQ ID NO: 8432500 - DNA, 22 bp, Homo sapiens
tctgtgcaccttctaatgagta

SEQ ID NO: 8432501 - DNA, 22 bp, Homo sapiens
tctgtgcaccttctaatgagta

SEQ ID NO: 8432502 - DNA, 20 bp, Homo sapiens
tctgtgcacctgctacaagg

SEQ ID NO: 8432503 - DNA, 22 bp, Homo sapiens
tctgtgcaccagaatgatattt

SEQ ID NO: 8432504 - DNA, 22 bp, Homo sapiens
tctgtgcacaataggcattttt

SEQ ID NO: 8432505 - DNA, 22 bp, Homo sapiens
tctgtgaatgtgaccttatttg

SEQ ID NO: 8432506 - DNA, 22 bp, Homo sapiens
tctgggtatgacctatttttcc

SEQ ID NO: 8432507 - DNA, 22 bp, Homo sapiens
tctgggtacttgcaagattttc

SEQ ID NO: 8432508 - DNA, 22 bp, Homo sapiens
tctgggtcactgtgggagggca

SEQ ID NO: 8432509 - DNA, 22 bp, Homo sapiens
tctgggtcactgtgggagggca

SEQ ID NO: 8432510 - DNA, 22 bp, Homo sapiens
tctgggtcatgactcagcgtga

SEQ ID NO: 8432511 - DNA, 22 bp, Homo sapiens
tctgggtccccgaggaaggaga

SEQ ID NO: 8432512 - DNA, 22 bp, Homo sapiens
tctgggtcatgactcagcgtga

SEQ ID NO: 8432513 - DNA, 22 bp, Homo sapiens
tctgggtccccgaggaaggaga

SEQ ID NO: 8432514 - DNA, 22 bp, Homo sapiens
tctgggtccgggactgtggatg

SEQ ID NO: 8432515 - DNA, 22 bp, Homo sapiens
tctgggtctatgatctcacttc

SEQ ID NO: 8432516 - DNA, 22 bp, Homo sapiens
tctgggtctatgatctcacttc

SEQ ID NO: 8432517 - DNA, 22 bp, Homo sapiens
tctgggtccgggggtgaattga

SEQ ID NO: 8432518 - DNA, 22 bp, Homo sapiens
tctgggtccgggactgtggatg

SEQ ID NO: 8432519 - DNA, 22 bp, Homo sapiens
tctgggtctatcccatgccttt

SEQ ID NO: 8432520 - DNA, 22 bp, Homo sapiens
tctgggtctttacccatggaat

SEQ ID NO: 8432521 - DNA, 22 bp, Homo sapiens
tctgggtctggctgctggtgca

SEQ ID NO: 8432522 - DNA, 22 bp, Homo sapiens
tctgggtcttagttttcttgat

SEQ ID NO: 8432523 - DNA, 22 bp, Homo sapiens
tctgggtctcagagtgaccatg

SEQ ID NO: 8432524 - DNA, 22 bp, Homo sapiens
tctgggtctattcctactgtga

SEQ ID NO: 8432525 - DNA, 22 bp, Homo sapiens
tctgggggttaagtgaggacaa

SEQ ID NO: 8432526 - DNA, 22 bp, Homo sapiens
tctgggggttaagtgaggacaa

SEQ ID NO: 8432527 - DNA, 22 bp, Homo sapiens
tctggggtgtgacctgagcatg

SEQ ID NO: 8432528 - DNA, 22 bp, Homo sapiens
tctggggtgcagcctggacata

SEQ ID NO: 8432529 - DNA, 22 bp, Homo sapiens
tctgggtgtcactcctgcctgc

SEQ ID NO: 8432530 - DNA, 22 bp, Homo sapiens
tctgtaaaattagtataattgt

SEQ ID NO: 8432531 - DNA, 22 bp, Homo sapiens
tctgggtgccctttgctctgtt

SEQ ID NO: 8432532 - DNA, 22 bp, Homo sapiens
tctgggctttaagaactctgtt

SEQ ID NO: 8432533 - DNA, 22 bp, Homo sapiens
tctgggcttggttagggctgtt

SEQ ID NO: 8432534 - DNA, 22 bp, Homo sapiens
tctgggcttggttagggctgtt

SEQ ID NO: 8432535 - DNA, 22 bp, Homo sapiens
tctgggcttgggtagaaatcac

SEQ ID NO: 8432536 - DNA, 21 bp, Homo sapiens
tctgggctttcttataaggca

SEQ ID NO: 8432537 - DNA, 22 bp, Homo sapiens
tctgggctttgtaatgggaggt

SEQ ID NO: 8432538 - DNA, 22 bp, Homo sapiens
tctgggctttagtttgttatct

SEQ ID NO: 8432539 - DNA, 22 bp, Homo sapiens
tctgggctttacactgtgctta

SEQ ID NO: 8432540 - DNA, 22 bp, Homo sapiens
tctgggcttttccatgcctgtg

SEQ ID NO: 8432541 - DNA, 20 bp, Homo sapiens
tctggggatgaggtctagga

SEQ ID NO: 8432542 - DNA, 22 bp, Homo sapiens
tctgggggcgaccagggactgc

SEQ ID NO: 8432543 - DNA, 17 bp, Homo sapiens
tctgggcttcagtggtc

SEQ ID NO: 8432544 - DNA, 22 bp, Homo sapiens
tctgggctgtgccaaagctctt

SEQ ID NO: 8432545 - DNA, 22 bp, Homo sapiens
tctgggctgtgggaattcaaca

SEQ ID NO: 8432546 - DNA, 22 bp, Homo sapiens
tctgggctgtggttccactccg

SEQ ID NO: 8432547 - DNA, 20 bp, Homo sapiens
tctgggcttcccccagctcc

SEQ ID NO: 8432548 - DNA, 20 bp, Homo sapiens
tctgggcttcccccagctcc

SEQ ID NO: 8432549 - DNA, 18 bp, Homo sapiens
tctgggcttcccgaggct

SEQ ID NO: 8432550 - DNA, 22 bp, Homo sapiens
tctgggcttgcctggttgtgca

SEQ ID NO: 8432551 - DNA, 22 bp, Homo sapiens
tctgggcttggattggctctgc

SEQ ID NO: 8432552 - DNA, 22 bp, Homo sapiens
tctgggctggctttatgctgac

SEQ ID NO: 8432553 - DNA, 22 bp, Homo sapiens
tctgggctgcttcagccttcgc

SEQ ID NO: 8432554 - DNA, 23 bp, Homo sapiens
tctgggctgcttaaggatcaagg

SEQ ID NO: 8432555 - DNA, 22 bp, Homo sapiens
tctgggctgggagcgtgtggac

SEQ ID NO: 8432556 - DNA, 22 bp, Homo sapiens
tctgggctggctttatgctgac

SEQ ID NO: 8432557 - DNA, 22 bp, Homo sapiens
tctgggctgggcttaggaaccc

SEQ ID NO: 8432558 - DNA, 22 bp, Homo sapiens
tctgggctgggcttaggaaccc

SEQ ID NO: 8432559 - DNA, 22 bp, Homo sapiens
tctgggctgtctacaggttggc

SEQ ID NO: 8432560 - DNA, 15 bp, Homo sapiens
tctgggctgtgagca

SEQ ID NO: 8432561 - DNA, 22 bp, Homo sapiens
tctgggctgtctacaggttggc

SEQ ID NO: 8432562 - DNA, 22 bp, Homo sapiens
tctgggctgtctacaggttggc

SEQ ID NO: 8432563 - DNA, 22 bp, Homo sapiens
tctgggctggttgtgcttgctt

SEQ ID NO: 8432564 - DNA, 22 bp, Homo sapiens
tctgggctggtgctcatgaatt

SEQ ID NO: 8432565 - DNA, 22 bp, Homo sapiens
tctgtctctttgttctgtgagt

SEQ ID NO: 8432566 - DNA, 22 bp, Homo sapiens
tctgtctgactaccatgaggca

SEQ ID NO: 8432567 - DNA, 20 bp, Homo sapiens
tctgtcctttctgctaaggc

SEQ ID NO: 8432568 - DNA, 22 bp, Homo sapiens
tctgtcatctgtaacaggaggg

SEQ ID NO: 8432569 - DNA, 22 bp, Homo sapiens
tctgtcatctgttcagtgctca

SEQ ID NO: 8432570 - DNA, 22 bp, Homo sapiens
tctgtcatgtttccattacatg

SEQ ID NO: 8432571 - DNA, 22 bp, Homo sapiens
tctgtcatgtttccattacatg

SEQ ID NO: 8432572 - DNA, 19 bp, Homo sapiens
tctgtcatttcttctgtac

SEQ ID NO: 8432573 - DNA, 22 bp, Homo sapiens
tctgtcattgcaataaaatttc

SEQ ID NO: 8432574 - DNA, 22 bp, Homo sapiens
tctgtcattgcaataaaatttc

SEQ ID NO: 8432575 - DNA, 22 bp, Homo sapiens
tctgtcattagccttgactgta

SEQ ID NO: 8432576 - DNA, 22 bp, Homo sapiens
tctgtcattttgtatctacatg

SEQ ID NO: 8432577 - DNA, 22 bp, Homo sapiens
tctgtccattcagaatggccct

SEQ ID NO: 8432578 - DNA, 19 bp, Homo sapiens
tctgtaacactctagcctt

SEQ ID NO: 8432579 - DNA, 22 bp, Homo sapiens
tctgtaagtgttggttattcta

SEQ ID NO: 8432580 - DNA, 22 bp, Homo sapiens
tctgtaaatctactaagagctc

SEQ ID NO: 8432581 - DNA, 20 bp, Homo sapiens
tctgtaattatgccatcact

SEQ ID NO: 8432582 - DNA, 22 bp, Homo sapiens
tctgtacaacaaagggatgaga

SEQ ID NO: 8432583 - DNA, 22 bp, Homo sapiens
tctgtaaacacccgtaagcttt

SEQ ID NO: 8432584 - DNA, 22 bp, Homo sapiens
tctgtaaagtctgtgtaaagtc

SEQ ID NO: 8432585 - DNA, 22 bp, Homo sapiens
tctgtacaccaggggccattct

SEQ ID NO: 8432586 - DNA, 20 bp, Homo sapiens
tctgtacactcatcttctgc

SEQ ID NO: 8432587 - DNA, 22 bp, Homo sapiens
tctgtacatgagttgagaatca

SEQ ID NO: 8432588 - DNA, 22 bp, Homo sapiens
tctgtacagtaccagatagtaa

SEQ ID NO: 8432589 - DNA, 22 bp, Homo sapiens
tctgtattttaagatgctgttt

SEQ ID NO: 8432590 - DNA, 22 bp, Homo sapiens
tctgtatcgtaatcatgtctgg

SEQ ID NO: 8432591 - DNA, 22 bp, Homo sapiens
tctgtatatattaatgaaattc

SEQ ID NO: 8432592 - DNA, 22 bp, Homo sapiens
tctgtattctatggcagttggt

SEQ ID NO: 8432593 - DNA, 22 bp, Homo sapiens
tctgtagtctgtgccatagctg

SEQ ID NO: 8432594 - DNA, 20 bp, Homo sapiens
tctgtagtctatgaggctta

SEQ ID NO: 8432595 - DNA, 22 bp, Homo sapiens
tctgtagtctctgatatatctg

SEQ ID NO: 8432596 - DNA, 22 bp, Homo sapiens
tctgtagtctgtgccatagctg

SEQ ID NO: 8432597 - DNA, 22 bp, Homo sapiens
tctgtacctcacatgcaccatc

SEQ ID NO: 8432598 - DNA, 22 bp, Homo sapiens
tctgtagcatcttaaatgtagt

SEQ ID NO: 8432599 - DNA, 22 bp, Homo sapiens
tctgtaggacagagaaatgggg

SEQ ID NO: 8432600 - DNA, 20 bp, Homo sapiens
tctgtaggcaagttagcagg

SEQ ID NO: 8432601 - DNA, 22 bp, Homo sapiens
tctgtaggggccggcggagccc

SEQ ID NO: 8432602 - DNA, 22 bp, Homo sapiens
tctgtagggtagtagtggagat

SEQ ID NO: 8432603 - DNA, 22 bp, Homo sapiens
tctgtaggggccggcggagccc

SEQ ID NO: 8432604 - DNA, 23 bp, Homo sapiens
tctgtaggcagcatgccactctc

SEQ ID NO: 8432605 - DNA, 22 bp, Homo sapiens
tctgtaggcttacgcggcttct

SEQ ID NO: 8432606 - DNA, 22 bp, Homo sapiens
tctgtagcattcaccagccctg

SEQ ID NO: 8432607 - DNA, 22 bp, Homo sapiens
tctgtagcaagtgagaggcatt

SEQ ID NO: 8432608 - DNA, 22 bp, Homo sapiens
tctgtagtaggttgtagttctt

SEQ ID NO: 8432609 - DNA, 22 bp, Homo sapiens
tctgtaggttaaaagtagacaa

SEQ ID NO: 8432610 - DNA, 22 bp, Homo sapiens
tctataaagggccagatagtag

SEQ ID NO: 8432611 - DNA, 22 bp, Homo sapiens
tctataaaactcaagagcaatt

SEQ ID NO: 8432612 - DNA, 22 bp, Homo sapiens
tctagggaacctatcctatgat

SEQ ID NO: 8432613 - DNA, 22 bp, Homo sapiens
tctagggaggcaatagcaatgt

SEQ ID NO: 8432614 - DNA, 22 bp, Homo sapiens
tctagggagagttgttatgggt

SEQ ID NO: 8432615 - DNA, 22 bp, Homo sapiens
tctagggagctctagcagtggt

SEQ ID NO: 8432616 - DNA, 22 bp, Homo sapiens
tctatgttagagatacatccta

SEQ ID NO: 8432617 - DNA, 22 bp, Homo sapiens
tctattatggtacttatcatga

SEQ ID NO: 8432618 - DNA, 22 bp, Homo sapiens
tctatattttgaaaggtattta

SEQ ID NO: 8432619 - DNA, 22 bp, Homo sapiens
tctatctggccccttttatata

SEQ ID NO: 8432620 - DNA, 22 bp, Homo sapiens
tctatgaatcaattttaacatc

SEQ ID NO: 8432621 - DNA, 22 bp, Homo sapiens
tctatgaagttcagagatctat

SEQ ID NO: 8432622 - DNA, 22 bp, Homo sapiens
tctattttgtttccagctctac

SEQ ID NO: 8432623 - DNA, 22 bp, Homo sapiens
tctatttttatagttgaagtgc

SEQ ID NO: 8432624 - DNA, 22 bp, Homo sapiens
tctcaaagtagctcccacagat

SEQ ID NO: 8432625 - DNA, 23 bp, Homo sapiens
tctcaaatatgatctgggtcatc

SEQ ID NO: 8432626 - DNA, 22 bp, Homo sapiens
tctcaaataggccttggtcctg

SEQ ID NO: 8432627 - DNA, 22 bp, Homo sapiens
tctcaaatatttggagagagga

SEQ ID NO: 8432628 - DNA, 22 bp, Homo sapiens
tctcaaagtagctcccacagat

SEQ ID NO: 8432629 - DNA, 22 bp, Homo sapiens
tctcaaactacagtatggctgt

SEQ ID NO: 8432630 - DNA, 22 bp, Homo sapiens
tctcaaactaacaatgattata

SEQ ID NO: 8432631 - DNA, 22 bp, Homo sapiens
tctatttaccaaatgtagttcc

SEQ ID NO: 8432632 - DNA, 22 bp, Homo sapiens
tctatttgttctcaggatcatc

SEQ ID NO: 8432633 - DNA, 22 bp, Homo sapiens
tctattttatactcaaatcttc

SEQ ID NO: 8432634 - DNA, 22 bp, Homo sapiens
tctatttacagaaagcagaatt

SEQ ID NO: 8432635 - DNA, 22 bp, Homo sapiens
tctcaaatggcaaatgtgggtc

SEQ ID NO: 8432636 - DNA, 22 bp, Homo sapiens
tctcaaatggacaatattgtgg

SEQ ID NO: 8432637 - DNA, 23 bp, Homo sapiens
tctcaaatctttgcgttgtatct

SEQ ID NO: 8432638 - DNA, 22 bp, Homo sapiens
tctcaaatcaaactttgagctt

SEQ ID NO: 8432639 - DNA, 22 bp, Homo sapiens
tctcacaagctcaaggattagt

SEQ ID NO: 8432640 - DNA, 18 bp, Homo sapiens
tctcaatcgctgcagtct

SEQ ID NO: 8432641 - DNA, 22 bp, Homo sapiens
tctcaatcaaacatgtctgact

SEQ ID NO: 8432642 - DNA, 19 bp, Homo sapiens
tctcaattctccccactgc

SEQ ID NO: 8432643 - DNA, 22 bp, Homo sapiens
tctcacagccatttctccctct

SEQ ID NO: 8432644 - DNA, 23 bp, Homo sapiens
tctagaaaatgaaagaatgcagt

SEQ ID NO: 8432645 - DNA, 23 bp, Homo sapiens
tctagaaaatgaaagaatgcagt

SEQ ID NO: 8432646 - DNA, 22 bp, Homo sapiens
tctagaaaaccaatattacatg

SEQ ID NO: 8432647 - DNA, 22 bp, Homo sapiens
tctagaaacaggtttctagaaa

SEQ ID NO: 8432648 - DNA, 22 bp, Homo sapiens
tctagaatttgcgtaggttaga

SEQ ID NO: 8432649 - DNA, 22 bp, Homo sapiens
tctagaattttgccatatagct

SEQ ID NO: 8432650 - DNA, 22 bp, Homo sapiens
tctagacaatgcactgtaagga

SEQ ID NO: 8432651 - DNA, 22 bp, Homo sapiens
tctagaaaaacaaagtatctga

SEQ ID NO: 8432652 - DNA, 22 bp, Homo sapiens
tctactttataagtatataagt

SEQ ID NO: 8432653 - DNA, 22 bp, Homo sapiens
tctacctggagtccgttgttaa

SEQ ID NO: 8432654 - DNA, 22 bp, Homo sapiens
tctacgaagccaccatggagac

SEQ ID NO: 8432655 - DNA, 22 bp, Homo sapiens
tctaccctgcggtcttggggca

SEQ ID NO: 8432656 - DNA, 22 bp, Homo sapiens
tctagatttggggcatgaagtt

SEQ ID NO: 8432657 - DNA, 22 bp, Homo sapiens
tctagatgtactgctgaagagt

SEQ ID NO: 8432658 - DNA, 22 bp, Homo sapiens
tctagatctgcactgttggaca

SEQ ID NO: 8432659 - DNA, 22 bp, Homo sapiens
tctagagaagtttccttttgaa

SEQ ID NO: 8432660 - DNA, 22 bp, Homo sapiens
tctagagacaaaggaaggaggg

SEQ ID NO: 8432661 - DNA, 22 bp, Homo sapiens
tctagagactataatgtgtcct

SEQ ID NO: 8432662 - DNA, 22 bp, Homo sapiens
tctagagctttttcctcttgta

SEQ ID NO: 8432663 - DNA, 22 bp, Homo sapiens
tctagagatacattggtcattt

SEQ ID NO: 8432664 - DNA, 22 bp, Homo sapiens
tctagagattggacttcctaga

SEQ ID NO: 8432665 - DNA, 22 bp, Homo sapiens
tctagagctggagtagaatgtg

SEQ ID NO: 8432666 - DNA, 22 bp, Homo sapiens
tctagagctggagtagaatgtg

SEQ ID NO: 8432667 - DNA, 22 bp, Homo sapiens
tctagagccaaagtcttggggg

SEQ ID NO: 8432668 - DNA, 17 bp, Homo sapiens
tctagagcactttgaga

SEQ ID NO: 8432669 - DNA, 22 bp, Homo sapiens
tctaggaaagcctttcacaact

SEQ ID NO: 8432670 - DNA, 22 bp, Homo sapiens
tctaggaaattgttactatatt

SEQ ID NO: 8432671 - DNA, 22 bp, Homo sapiens
tctaggagtaatgagctagcac

SEQ ID NO: 8432672 - DNA, 22 bp, Homo sapiens
tctaggagcttaaaggaggcca

SEQ ID NO: 8432673 - DNA, 22 bp, Homo sapiens
tctaggaggcacacaagtagtt

SEQ ID NO: 8432674 - DNA, 17 bp, Homo sapiens
tctaggagagcagagct

SEQ ID NO: 8432675 - DNA, 22 bp, Homo sapiens
tctaggaatgttcttagggatt

SEQ ID NO: 8432676 - DNA, 22 bp, Homo sapiens
tctacaaataaattactatgta

SEQ ID NO: 8432677 - DNA, 22 bp, Homo sapiens
tctacaagtcaagtctatcaag

SEQ ID NO: 8432678 - DNA, 22 bp, Homo sapiens
tctacaagtcaagtctatcaag

SEQ ID NO: 8432679 - DNA, 22 bp, Homo sapiens
tctacattttctttatgtacat

SEQ ID NO: 8432680 - DNA, 22 bp, Homo sapiens
tctacagtgagtcattcaaaca

SEQ ID NO: 8432681 - DNA, 22 bp, Homo sapiens
tctacagctgctgcttctcatg

SEQ ID NO: 8432682 - DNA, 22 bp, Homo sapiens
tctacaaagaagaattaatgtc

SEQ ID NO: 8432683 - DNA, 22 bp, Homo sapiens
tctacaaagaagaattaatgtc

SEQ ID NO: 8432684 - DNA, 22 bp, Homo sapiens
tctaattttggcattttaacct

SEQ ID NO: 8432685 - DNA, 22 bp, Homo sapiens
tctaacttgtgagtatagatga

SEQ ID NO: 8432686 - DNA, 22 bp, Homo sapiens
tctaacttgtatgtatagtttt

SEQ ID NO: 8432687 - DNA, 22 bp, Homo sapiens
tctaacttgaactcatgactgt

SEQ ID NO: 8432688 - DNA, 22 bp, Homo sapiens
tctaacttagggaatactttag

SEQ ID NO: 8432689 - DNA, 22 bp, Homo sapiens
tctaaatgtcagtacagaatga

SEQ ID NO: 8432690 - DNA, 22 bp, Homo sapiens
tctaaatcccaacatgatatca

SEQ ID NO: 8432691 - DNA, 22 bp, Homo sapiens
tctaaattactttgggcagtat

SEQ ID NO: 8432692 - DNA, 22 bp, Homo sapiens
tccttagacaaagagtgggctt

SEQ ID NO: 8432693 - DNA, 22 bp, Homo sapiens
tccttacctcaagcttgtggtc

SEQ ID NO: 8432694 - DNA, 22 bp, Homo sapiens
tccttagacctggcaaatgggg

SEQ ID NO: 8432695 - DNA, 22 bp, Homo sapiens
tccttagagtggttgtgctatg

SEQ ID NO: 8432696 - DNA, 22 bp, Homo sapiens
tccttagcacccaccaaggact

SEQ ID NO: 8432697 - DNA, 22 bp, Homo sapiens
tccttagagatactgtcttgaa

SEQ ID NO: 8432698 - DNA, 22 bp, Homo sapiens
tccttaggcaatttgggagagt

SEQ ID NO: 8432699 - DNA, 22 bp, Homo sapiens
tccttcaagatgccacagcttt

SEQ ID NO: 8432700 - DNA, 22 bp, Homo sapiens
tccttcaactttttacttgccc

SEQ ID NO: 8432701 - DNA, 22 bp, Homo sapiens
tccttcaagtgcagtacctgag

SEQ ID NO: 8432702 - DNA, 22 bp, Homo sapiens
tccttcaaaagttgagagagcc

SEQ ID NO: 8432703 - DNA, 21 bp, Homo sapiens
tccttatatttgaatacttta

SEQ ID NO: 8432704 - DNA, 22 bp, Homo sapiens
tccttcaaagctcctagtgagc

SEQ ID NO: 8432705 - DNA, 22 bp, Homo sapiens
tccttatagttgtctttgaacc

SEQ ID NO: 8432706 - DNA, 22 bp, Homo sapiens
tccttcaagtgcagtacctgag

SEQ ID NO: 8432707 - DNA, 23 bp, Homo sapiens
tccttcaagttaggaagtgaaca

SEQ ID NO: 8432708 - DNA, 23 bp, Homo sapiens
tccttcaagttaggaagtgaaca

SEQ ID NO: 8432709 - DNA, 22 bp, Homo sapiens
tccttcaatcacccagtgggga

SEQ ID NO: 8432710 - DNA, 22 bp, Homo sapiens
tccttcaatcacccagtgggga

SEQ ID NO: 8432711 - DNA, 22 bp, Homo sapiens
tccttcagaacctgtgatggaa

SEQ ID NO: 8432712 - DNA, 22 bp, Homo sapiens
tccttcagggggccgcctgcac

SEQ ID NO: 8432713 - DNA, 22 bp, Homo sapiens
tccttgagattaattaatcacc

SEQ ID NO: 8432714 - DNA, 22 bp, Homo sapiens
tccttctttgacaagtggcaga

SEQ ID NO: 8432715 - DNA, 22 bp, Homo sapiens
tccttctttcacctcatagtca

SEQ ID NO: 8432716 - DNA, 22 bp, Homo sapiens
tccttggaagagcattcccagg

SEQ ID NO: 8432717 - DNA, 22 bp, Homo sapiens
tccttggaagagcattcccagg

SEQ ID NO: 8432718 - DNA, 22 bp, Homo sapiens
tccttggaacattgatccaaac

SEQ ID NO: 8432719 - DNA, 22 bp, Homo sapiens
tccttggaaatttcatcagaca

SEQ ID NO: 8432720 - DNA, 22 bp, Homo sapiens
tccttgcatatctgaaaatgtt

SEQ ID NO: 8432721 - DNA, 22 bp, Homo sapiens
tccttggagctctccaagggat

SEQ ID NO: 8432722 - DNA, 22 bp, Homo sapiens
tccttggaggtgttcatctgcc

SEQ ID NO: 8432723 - DNA, 22 bp, Homo sapiens
tccttggatctttcctatgatt

SEQ ID NO: 8432724 - DNA, 22 bp, Homo sapiens
tccttggagtcatgatggaggt

SEQ ID NO: 8432725 - DNA, 22 bp, Homo sapiens
tccttggcaagacacagcacag

SEQ ID NO: 8432726 - DNA, 17 bp, Homo sapiens
tccttggcaaccagttc

SEQ ID NO: 8432727 - DNA, 22 bp, Homo sapiens
tccttggcaagctgcaatggga

SEQ ID NO: 8432728 - DNA, 22 bp, Homo sapiens
tccttggcaagacacagcacag

SEQ ID NO: 8432729 - DNA, 22 bp, Homo sapiens
tccttggcacactcggatctga

SEQ ID NO: 8432730 - DNA, 22 bp, Homo sapiens
tccttggcagcagggagcatga

SEQ ID NO: 8432731 - DNA, 22 bp, Homo sapiens
tccttggcacactcggatctga

SEQ ID NO: 8432732 - DNA, 22 bp, Homo sapiens
tccttcctgctctaacattcag

SEQ ID NO: 8432733 - DNA, 19 bp, Homo sapiens
tccttcagtcagatctggg

SEQ ID NO: 8432734 - DNA, 23 bp, Homo sapiens
tccttcctttgagaggctccatc

SEQ ID NO: 8432735 - DNA, 22 bp, Homo sapiens
tccttcctggggtctctgctgc

SEQ ID NO: 8432736 - DNA, 22 bp, Homo sapiens
tcgttaaatgctaaaactgaca

SEQ ID NO: 8432737 - DNA, 20 bp, Homo sapiens
tcgtttatttgaaattgctc

SEQ ID NO: 8432738 - DNA, 23 bp, Homo sapiens
tcgttgaatagcaatagcacaac

SEQ ID NO: 8432739 - DNA, 21 bp, Homo sapiens
tcgtgcagcagctgaggcttg

SEQ ID NO: 8432740 - DNA, 21 bp, Homo sapiens
tcgtgcagcagctgaggcttg

SEQ ID NO: 8432741 - DNA, 21 bp, Homo sapiens
tcgtgcagcagctgaggcttg

SEQ ID NO: 8432742 - DNA, 22 bp, Homo sapiens
tcgtgcaaacctgacacagcca

SEQ ID NO: 8432743 - DNA, 22 bp, Homo sapiens
tcgtgcaaaggcccatgtgggt

SEQ ID NO: 8432744 - DNA, 22 bp, Homo sapiens
tcgtgatctgtccacctcggcc

SEQ ID NO: 8432745 - DNA, 22 bp, Homo sapiens
tcgcccagctcatctcccacaa

SEQ ID NO: 8432746 - DNA, 22 bp, Homo sapiens
tcgcaccattgcactccagcca

SEQ ID NO: 8432747 - DNA, 22 bp, Homo sapiens
tcgcaccattgcactccagcca

SEQ ID NO: 8432748 - DNA, 22 bp, Homo sapiens
tcgcccaggctggaagtgcagt

SEQ ID NO: 8432749 - DNA, 22 bp, Homo sapiens
tcgcccaggctggaagtgcagt

SEQ ID NO: 8432750 - DNA, 22 bp, Homo sapiens
tcgtctgtgaaattgggataag

SEQ ID NO: 8432751 - DNA, 22 bp, Homo sapiens
tcgtacagcagactgaagtcct

SEQ ID NO: 8432752 - DNA, 22 bp, Homo sapiens
tctaaagatttggattcatttg

SEQ ID NO: 8432753 - DNA, 22 bp, Homo sapiens
tctaaacattggtatggagcag

SEQ ID NO: 8432754 - DNA, 23 bp, Homo sapiens
tctaaaattcatcatttacgttc

SEQ ID NO: 8432755 - DNA, 22 bp, Homo sapiens
tctaaaaaagtctgttcacttg

SEQ ID NO: 8432756 - DNA, 22 bp, Homo sapiens
tctaaacagtttcactcttaat

SEQ ID NO: 8432757 - DNA, 22 bp, Homo sapiens
tctaaacacgtctctttgaata

SEQ ID NO: 8432758 - DNA, 22 bp, Homo sapiens
tctaaacactaagtcttgatgc

SEQ ID NO: 8432759 - DNA, 22 bp, Homo sapiens
tcctttctcccaggttagttgt

SEQ ID NO: 8432760 - DNA, 22 bp, Homo sapiens
tcctttctccagctggcattgt

SEQ ID NO: 8432761 - DNA, 22 bp, Homo sapiens
tcctttctatcttgggtatcta

SEQ ID NO: 8432762 - DNA, 22 bp, Homo sapiens
tcctttctccagctggcattgt

SEQ ID NO: 8432763 - DNA, 22 bp, Homo sapiens
tccttggcatgccgtcttctcc

SEQ ID NO: 8432764 - DNA, 22 bp, Homo sapiens
tccttggctagtactggccagc

SEQ ID NO: 8432765 - DNA, 22 bp, Homo sapiens
tccttggctttctggagcttct

SEQ ID NO: 8432766 - DNA, 22 bp, Homo sapiens
tccttgggaaacatcatgtaat

SEQ ID NO: 8432767 - DNA, 22 bp, Homo sapiens
tcctttctgggcctcagtgact

SEQ ID NO: 8432768 - DNA, 22 bp, Homo sapiens
tcctttctgtctttactctgga

SEQ ID NO: 8432769 - DNA, 22 bp, Homo sapiens
tcctttctgtctttactctgga

SEQ ID NO: 8432770 - DNA, 22 bp, Homo sapiens
tcctttctccgggggactgttg

SEQ ID NO: 8432771 - DNA, 22 bp, Homo sapiens
tcctttctccttccgacttcat

SEQ ID NO: 8432772 - DNA, 18 bp, Homo sapiens
tcctttctccctcatctt

SEQ ID NO: 8432773 - DNA, 19 bp, Homo sapiens
tcctttctgttcctgagat

SEQ ID NO: 8432774 - DNA, 19 bp, Homo sapiens
tcctttctgttcctgagat

SEQ ID NO: 8432775 - DNA, 22 bp, Homo sapiens
tcctttcttttctatgggccca

SEQ ID NO: 8432776 - DNA, 17 bp, Homo sapiens
tcctttctttacctgtt

SEQ ID NO: 8432777 - DNA, 17 bp, Homo sapiens
tcctttctttacctgtt

SEQ ID NO: 8432778 - DNA, 22 bp, Homo sapiens
tcgcaccattgcactccagcca

SEQ ID NO: 8432779 - DNA, 22 bp, Homo sapiens
tcgaggcagtgcgctggctgtt

SEQ ID NO: 8432780 - DNA, 22 bp, Homo sapiens
tcgagctgcacgcccccgagct

SEQ ID NO: 8432781 - DNA, 22 bp, Homo sapiens
tcgaaatactgtttccccttta

SEQ ID NO: 8432782 - DNA, 22 bp, Homo sapiens
tcctttgttaaggaggtttgtt

SEQ ID NO: 8432783 - DNA, 22 bp, Homo sapiens
tcctttgttgagataaattggg

SEQ ID NO: 8432784 - DNA, 23 bp, Homo sapiens
tcctttgtctttgcatagatggt

SEQ ID NO: 8432785 - DNA, 22 bp, Homo sapiens
tcctttggttgtagacaggaat

SEQ ID NO: 8432786 - DNA, 22 bp, Homo sapiens
tcctgtgagacttgtccattat

SEQ ID NO: 8432787 - DNA, 22 bp, Homo sapiens
tcctgtgacggagcgccagagg

SEQ ID NO: 8432788 - DNA, 22 bp, Homo sapiens
tcctgtgagcagcacagagaca

SEQ ID NO: 8432789 - DNA, 21 bp, Homo sapiens
tcctgtgaggacctgtcagtg

SEQ ID NO: 8432790 - DNA, 22 bp, Homo sapiens
tcctgtcttaatgatctcgtgc

SEQ ID NO: 8432791 - DNA, 22 bp, Homo sapiens
tcctgtgaagaatagcactcaa

SEQ ID NO: 8432792 - DNA, 23 bp, Homo sapiens
tcctgtgaagccatgtttgttgt

SEQ ID NO: 8432793 - DNA, 22 bp, Homo sapiens
tcctgtgaccagcttccatgct

SEQ ID NO: 8432794 - DNA, 22 bp, Homo sapiens
tcctgtgatggcttgcgatgtg

SEQ ID NO: 8432795 - DNA, 22 bp, Homo sapiens
tcctgtgagtagatagtattgt

SEQ ID NO: 8432796 - DNA, 22 bp, Homo sapiens
tcctgtgatattgtttgttata

SEQ ID NO: 8432797 - DNA, 22 bp, Homo sapiens
tcctgtggcttccacgacctaa

SEQ ID NO: 8432798 - DNA, 22 bp, Homo sapiens
tcctgtgggctctcggcctcca

SEQ ID NO: 8432799 - DNA, 22 bp, Homo sapiens
tccttaaatatttactgttaac

SEQ ID NO: 8432800 - DNA, 17 bp, Homo sapiens
tcctgtgggtgcagcag

SEQ ID NO: 8432801 - DNA, 22 bp, Homo sapiens
tcctgtggggaaaagcctatct

SEQ ID NO: 8432802 - DNA, 22 bp, Homo sapiens
tcctgtgctttggatgcttaga

SEQ ID NO: 8432803 - DNA, 22 bp, Homo sapiens
tcctgtgctgttaatagtgata

SEQ ID NO: 8432804 - DNA, 22 bp, Homo sapiens
tcctgtgctttggaggatgttc

SEQ ID NO: 8432805 - DNA, 22 bp, Homo sapiens
tcctggtgttactaaattgaaa

SEQ ID NO: 8432806 - DNA, 22 bp, Homo sapiens
tcctggtggctttccctgcctt

SEQ ID NO: 8432807 - DNA, 22 bp, Homo sapiens
tcctggtggtctgtgcttcttc

SEQ ID NO: 8432808 - DNA, 22 bp, Homo sapiens
tcctggtgtaatggtaagcatg

SEQ ID NO: 8432809 - DNA, 22 bp, Homo sapiens
tcctggtggtttgaaaactgaa

SEQ ID NO: 8432810 - DNA, 22 bp, Homo sapiens
tcctgtagctgtcactgggggc

SEQ ID NO: 8432811 - DNA, 21 bp, Homo sapiens
tcctgtaagcttgggtggctc

SEQ ID NO: 8432812 - DNA, 22 bp, Homo sapiens
tcctgtcctgaggctccaggcc

SEQ ID NO: 8432813 - DNA, 22 bp, Homo sapiens
tcctgtccacagccctgacctc

SEQ ID NO: 8432814 - DNA, 20 bp, Homo sapiens
tcctgtccgcgccttgcgtc

SEQ ID NO: 8432815 - DNA, 22 bp, Homo sapiens
tcctggggccagcactggtgga

SEQ ID NO: 8432816 - DNA, 22 bp, Homo sapiens
tcctggggccaggcacctctgg

SEQ ID NO: 8432817 - DNA, 22 bp, Homo sapiens
tcctggggctctgagcgagaca

SEQ ID NO: 8432818 - DNA, 19 bp, Homo sapiens
tcctggggatgtggtcacc

SEQ ID NO: 8432819 - DNA, 22 bp, Homo sapiens
tcctggggccagcactggtgga

SEQ ID NO: 8432820 - DNA, 22 bp, Homo sapiens
tcctggggctgcaaggcctgtc

SEQ ID NO: 8432821 - DNA, 22 bp, Homo sapiens
tcctggggctgcaaggcctgtc

SEQ ID NO: 8432822 - DNA, 20 bp, Homo sapiens
tcctggggtaagccatggtc

SEQ ID NO: 8432823 - DNA, 20 bp, Homo sapiens
tcctggggtaagccatggtc

SEQ ID NO: 8432824 - DNA, 22 bp, Homo sapiens
tcctgggtagcctgtccaagat

SEQ ID NO: 8432825 - DNA, 22 bp, Homo sapiens
tcctgggtagagacctgatgaa

SEQ ID NO: 8432826 - DNA, 22 bp, Homo sapiens
tcctggggttttggccgcagct

SEQ ID NO: 8432827 - DNA, 22 bp, Homo sapiens
tcctggggtgtgttttgctgct

SEQ ID NO: 8432828 - DNA, 22 bp, Homo sapiens
tcctggggtttagagggaagtg

SEQ ID NO: 8432829 - DNA, 22 bp, Homo sapiens
tcctggggtcctgactgcttcc

SEQ ID NO: 8432830 - DNA, 22 bp, Homo sapiens
tcctgggaccgagggaagagct

SEQ ID NO: 8432831 - DNA, 22 bp, Homo sapiens
tcctgggaccctgggtgcagag

SEQ ID NO: 8432832 - DNA, 22 bp, Homo sapiens
tcctgggaccctgggtgcagag

SEQ ID NO: 8432833 - DNA, 22 bp, Homo sapiens
tcctgggaccaggcacctactg

SEQ ID NO: 8432834 - DNA, 22 bp, Homo sapiens
tcctgggactctgcctcaggct

SEQ ID NO: 8432835 - DNA, 22 bp, Homo sapiens
tcctgggaccgagggaagagct
